United States Patent 10,329,575 (REGULATORY SEQUENCE FOR PLANTS) - sequence listing, part 10

SEQ ID NO: 11244 - DNA, 3000 bp, Unknown
  misc_feature (1)..( 3000): cDNA_ID_3039299_gDNA_ID_2214485_Annot_ID_183492 3000 nt of promoter + ATG
agtccttcgattttaactaaactctcaaaaatttccccatctgttaattgttattccatttaatccaacccaatttatcagggagggtcaggaactgctagcaatattatatttcaaaacattcagatggataatgttaagaatccgatcataatcgaccaagactactgcgacaagagcaaatgcactacagaggttcactgcaatctgatcaaatctatccaatactcatcatcattggtaacacatattcttggatctaatcatttagtatatattttcagaaatccgcggtccaagtgaagaacgtggtgtaccgggacataagtggcactagcgcatcggaaaacgcaataacgtttaactgcagcaagaactatccatgccaaggaattgtgcttgacagagtgaacattaaaggaggaaaagcaacttgcaccaatgctaatgtggttgataaaggagctgttctgcctcagtgcaactccacttagttacttagatcgcttagatctatcaaacacatacatatagatatataaatacagatagatcgattacaaaatatactaaatatacttgtggatatatatatacatggacaataaataacagatattgtctaactatgaattataggattatagtataggaatacatgtataaacaatgttcttgagatttgttgttttatttgtattcttacatactaaattgtttatctaaagttatatgaataaagggatacattctttataaggttatggaccttatggtattatttgttctgattaacgtgtgacattagaatgtcaggcccatttaagcccactttctgtttaagttaccaaaacaaacccaacaaggcctttagaaaccctaaaaatccttattgtagcagctggagcaatatatatcccaatttgccgcaactagggttttctcttcctcacgcaaagcaatacatcgcagtctcccactgattcagcagctctttgaactactcttcgacaatggccgaacgtggtggagaacgtggtgttgagcgtggtggagaacgtggtgatttcggacgaggattcggaggccgtggaggtcgtggagatcgtggagggcgtggacgtggaggccgtggtggtcgtcgtggagggcgtgccagtgaagaagagaaatgggttccagtgaccaagcttggtcgtctcgtggcggctggtcatatcaagcagatagagcagatctatcttcattcactcccggttaaggagtaccagatcattgatatgctcatcggtccaacattgaaggatgaggtaatgaaaatcatgccggttcagaaacaaaccagggctggtcaaaggactagattcaaggcctttgttgtcgttggagatggtaatggtcatgttgggttgggagtgaaatgctctaaggaagttgctacggccattagaggagcgattattctcgctaagctgtctgttgttccagtgaggagaggttactggggtaacaagattgggaagccacatacggttccttgtaaggtgactgggaagtgtggatctgtgacagtgaggatggttccagctcctagaggttctggtattgtggctgctagagttcctaagaaggttcttcaattcgctggaattgatgatgttttcacttcctccaggggatccaccaaaactcttggaaacttcgtcaaggtttgttcttttttactttcatgtagttacctatacacgagattcgtttccttttgattggtttctggtagtttctttgaaatcacaatttgattattcgaaatttgagcattttctgtcattttagtacagtagtagctatataagtagttccaggagtccatttggttaggaaaaattctgacttcacactgtatttgatgaaatatctctggaaatgttattggtgtattgatggaagagaaaaagtgtttctctttcgtctagtgattctctttagctgtaatgaatgatcgctttgtaggaaacctttaatgtagcaaatgaagaatagattcagtttggcatctcttgatacttgactgttttcacttgcttatgatgtgtttgttttcttgctaattcacgagttttgtaacttgaatacaatataccctcagttttttatccatgtatagtattcacttgtaccttagtttttttcacggatgaataattgttttcatgatgttgattaaattgcaggctacattcgattgccttcagaagacttacggattccttaccccagagttctggaaggagacaagattctctagatcaccataccaagagcacactgatttcctggcgtccaaggctctttcgaccagcaaacccgacccagtggttgaagaccaagcctaaacaatgcttccaccttgtgttctttttggattataatccttcatgagttaattttggttgaacctttggtagtatatgttgctggattgtgcaccttctgttttcatctcctcttccaaactactttatttttgcttatggatcttaatgttctagttttgcttttacttttgttgagaaaagttaatccagtggtgccaattttaattttcatcaatattctacctctacaagtttggtttatgatatagactttgtttgatataacatgttcaatagacgaaccattactgtgaagaacattcgatgacaggttctgattcttggaaagtaaagttaaagaatttcctgaaaatttccgaatgattcaaagtattgacttttttttaattggattgttctaacatagacaaaagagaaagactgagaatatagaagaagaaatcagtttgacatttcccacatatttgaaagctttcacggcttctgcgatatttcagctcatctaaatctgcagaatcctatttctttttttccttgagtttctctctctcgccggatataaaccctatttttggtcggaattgttgttcgaattcgaatg

SEQ ID NO: 11245 - DNA, 3000 bp, Unknown; identical to SEQ ID NO: 11239
  misc_feature (1)..( 3000): cDNA_ID_2702003_gDNA_ID_2214485_Annot_ID_133343 3000 nt of promoter + ATG

SEQ ID NO: 11246 - DNA, 3000 bp, Unknown
  misc_feature (1)..( 3000): cDNA_ID_2702007_gDNA_ID_2214485_Annot_ID_133345 3000 nt of promoter + ATG
aatcaaataatttattccgaaatacttttcttttttacaacattctatatgatattaactatgtataatgaatttggatagttttttttaatttgtgttaaaagatcttatacggtctattctacacctacataggttatatccaaatcaagtatgatttcacctatcttttcttgcaaatatttgcatcatttttttgttaatgtttatatataactaggtctaggttggtagctatttatggtacaacaaatccaataaatgtatgtaagtatatatatatatatatatatataagtttagatgcaatatatatttcaagacaaaaattagcgacgtttccaattgtataatgatgacctatttttttccatgtatattatattaaaatccaaaatattggtaatatattaattaaaatagctaaaaatagataaattttttttttttattgtttgcgaaggtctttaaaggtcggtactaccgaaaatccaatccgttggataatattaaattatattctccatcttatggatgaagaagtattgtttctgatcgatctctggttaacaaaggatttattaaaagagtcggttttggggcgtccatttcagtttaggaggattcgtggattccaactcaattcccgagaccagcaaaaagtaatggctcagttattgatccatgcctaaaagttcaaagtcttattgacactcgaacaaatttctggaagattgacttattaaatgagctttttgtcccagaagatgtttcactaataagtgctctgcacttgggtgcgtcaactacggaggatactcttggttggcactttacaaagtccagaaaatattcagttaaatctggatatcatacggcaaagctagaaactttggatgtaaatgtttcctttattgggccagacatcaaagctttaaaagctttcatttggaaagtgcagtgtccgcccaaattgcgtcattttttgtggcagactctagcgggttgtgtgccggttacagataatttacggaaaagaggtattaattgtgattcagggtgtgtctgatgtggtaacgtagaggaaacaattaatcatgtacttttccaatgtcaccctgcgcgacagatatgggccctttcacagattccttcggcggcaggaatatttccatatgcctctatttatgcgaatttggattatttattttggaggattatttcggattttgattctttttcatacccatggataatttggtatatttggaaggcaacgaatgaaaagatttttgacaatgtcgataaagatcccttaaaggtattatgtttcgcaaaaagtgaggcacagtcatggaagtcagctcaaattgagttgcatgttgaaaatcatgaaactcctaatttcggatctaggagtagagcgagggatatctatcctgatatcaatttcttgggatatcgttgttacgtggatgggtcatggaaaaaagacgattttttctctgggacaggatggtactgtacatcagcaattggagagacgccaacaatgggagcagcaaaccttagacgaagtctatccccactacatgccgaagtggaagctcttctatgggcgatgaagtgcatgattggcgccgacaatcaagatgttgtgtttctcacagactgttcggatctggtgaagatgatgtcttccccaaccgaatgaccggctttctcagtgtatttggaggaattgcagagtgacaagaaaaaattttcaagtttttttttatctttaatttctcgtagtgcaaatgtcaaagcggataatttggcgcgtaaagttcgtgtccaaccgcatcatatcacttatgtaaacaaaattcttcaggaatggctcttttgagctctaattaattttggatgacaaaaaaaaaaaaaaaatatttttacagttattaccataatttcgaaaaaacaatatgtattaaatttgggattaatgtggatttttggaattaaaagtgtggtaaagaaagaaaaagaaaaaggcaaaacaagattggtcgggaggaaattgaatcacgaccggatctaatttacttggccttaaaaattgacagactcttctttaaacgtcttttctcaaaactttgtctccctcctctatattcttcgtcttcgacctcgtcgtctggcagtaattcaatctctctctctctctctctactgtaataaatctaaggaaacaaaaaacgttacgaaagaaaaagcattaaaaagaaaagctttagagagaaaaaaaacacagctcacaacctcttttcaattattcaatttagctttttttctcttcttcttcttcatcttccctcgtcttctttgccagttcttcttcatctttcgtcgttttcttagtgccacccaaagatcttcgtgcaggttcgtacttctttctacctcgatcgattttgactaaatgtatggatcatctgatttccgatttgatcgtggttgttccttgctctgtttcatgatctgtgaatctgagtttctcgatctggctgcgtctttttcggaaaagtcgagaattttttcctgctgggtcttctgaatcacatttgatcaattcctggaaatcgcaaagttttgagtttttctaatttctaaaggttgatcgagccaaaatcctttacgtgtctgtgtctgactctctgtagacctttcctgtttcttgatcactagctagctttcgagattggatttaaaattttctagatgaatctcaaattataattacagaattgaccaatgctttgcttgagaaacagtccaagaagaaatgcttgagatccttcatctccaagtaaatgggaggatttggttgattatctgctcattttcttaactttgttccgtatttttttttttgactcaacaggttcattggcgtttgtagtacataaattttccctgacacacagaaaaagaggatttgactgttatacaatg

SEQ ID NO: 11247 - DNA, 3000 bp, Unknown
  misc_feature (1)..( 3000): cDNA_ID_2702013_gDNA_ID_2214485_Annot_ID_133347 3000 nt of promoter + ATG
aattatttgatttggagagattggtctcatcattcgctatttcagcatgacacgatgtcctttttagcatgtgaatttgcacgattcaactcctttttgaaggatatgcacttttcgtatattaaaagaatacactatagtatttcttcgtaataatatactctttaacatgaaaaacaacaatcatgaatgaaatacaataaccagataaatagagaacagccttcttttctacttttaggcttttggcagatgtcatggatggataatactccttttttctctactctcgttttcaactcaaaaaaaaagaaggaaaaaaaaaagttatgtcatgtatataatcgtattcgtaaatacatagaagaagaaatttcagaatcagctaccatcattccatcaatgctttgccaactagagtttgttcaaactcttacaaacttctctacttgactaatataattatgcatttaaaagttcaccgtaccgttttccatttatatctctcctttttgatagtctcattcgcatatgatacacttgacttgaaacctcccaaaaaaaaagggtacaaagtgtagcttctatatgaccgatggtacataacagactttcgactaccatgcacttaactaggatccaaatccctctcccgtagcctatttcacaatatatcagtgaatgtttttttaaggtgttcaaaacaaagttgctatacttgataaatcgatcattgttttattttgtgtgttgccaggtcaacttcacgtaaacaaacaataaatatcgaaaacagataaaagttattaacttgtactataccatcaagaaatgaataaaaattataattgaaggtcactccatcgtaaattaaggaaaacgtaaaaatgaataaagagagtgcaatgtccacaccgaatgaaatgaaagaaattatatgttttaaaatttcgagaaatatactatgtatggttgatatatatataatcggtatcaaaaatatatatattttttaagtaaactctataaagagatgataggagtttcgatcagatatttccgattgcatagaatgaacaggctcggtttattctttgagcagggccaaaactaatgtaattaagtaagattcaacctaaacaaattaaagttgaaatcgtaacttagcagtttcatctcttttttcttgactaacaagtttcgagctttcaattcagaatttatctaattctgaaattagtatttgtgccgtacgtattacgtagcatagatcatgtttgttttgaagttattcggacaacgaccaacgatatcgattagcaaccaacaatacatttcttcattcaaaatagtaagtcagacttattttgatctccaattcgaatatggaccgtaaaaaggaatatgaatttacaggaaacggttttaatgattgaacttgtgtgctttaggaattaggcatctatatattataacatcggtactaaaaggcctaaaaacatatcatgtgattcagtgagtgtctagttttttaaaaaaagtgtcaccttcatttataaatctcgaaagttagttatatgatcgcaaaacaatccacgaccccctcacctctatttctcacttcacgtggaacaaggtcccatgtcccattatttcttcttttctagttcataaagttcatcataatctatctgttccacacacacaaatatattgattgatttgtctactccaaattcgcaagaaaacgtgaataaatttgagaaatcacagaattatttgatattttgtaaattaactaattattgatatagaagaacaaattaatacaatggactaatgtcatagagcaatttttttttgctaaacttcaggatttaactcattcttcttcttgttcaagtggttgctgattctgaaatctcttcttcaataacttaggtcttggtttcataggcttcaagtacttagattgaaatctaaccatctctttcaaaacactaatcagcttcctctctatttcttcaccgtcaggttcaatagctcctaagcaccgtgccacagcctccgccgtagttacacatcctccgaatggttccttccttagcacaagctctgaatcgtagatggttcctccactcactgatgcgtctatttccgtatccaaacacactctaaccgctcctgcttctcttaacaccacctcgctagctttgaccatctccttcgcgtgtttccacgtcgcgtcgaatacgattagtctcagcggcgggggatttgagatctcacgatggtttaagaggtttagggatttgaattcggatatagtgacggcgggagaggaaggagaagaagggaagaggtagattgttggcggtgctgggagtgcggttcctccggcggtggagatgtgacggcggaggagacggcgggcggggattctggtgacgtttagtaaggatttggtaaggagaggagtggtgttgagcttgtggcgtgactcgtgtggatggtggaggatgatgatttctgtattcgtcggaattagatccgctggtaagacgtggcagagacaaatcgcatttgggcgatcgcagttgtcgcagatctgccggcgatgatgcgcgtcttgctcgtcctccatcgtcactgctctgtcacgcgagcattccaacattaatgggaaattagaaaaaataaaataatacgctgtcgtttttggtctattagaaacacggcatcgtttaaactaagtttctgaacgacggcgtttgacccattcacgaatacgaatacgattacgattgtattcactacgtcgtcgtttggtctgttcacgatacatcgtcgttgggcattaacttatttaactctctgtctcttctccggtcaccatttacccaattgtacacgaccactttttagttttgacgattagatgatcaacgttgctggaagtaggaaaattagataagagtactgatcaaatcctaagagaga

SEQ ID NO: 11248 - DNA, 3000 bp, Unknown
  misc_feature (1)..( 3000): cDNA_ID_3039313_gDNA_ID_2214485_Annot_ID_133348 3000 nt of promoter + ATG
atccggagctatttaactgatatgagttactcttcctctagagcaatgtaacagctttaatagacatgaagcttgaaaaacacaagaacttaaaggaggaatcccggttttactggcgagagattcaaagtggaacactcaaattcaaccgtaaagaggcagaggtacatggaacagcttctttttccttctatattttctcataaactaagaaaaccgcctcccgaatgcatgacccatgcatatatacttcctcgaatagttgtatcacttgtacgattaaatacaagttggtatgatggtgttgaaagtgactgatcgatgagagaatggggttgcaggtttctgcgttgaagcagcttcaaaagcaagagttgatagatttcttcgacgaatacattaaggttggagcagcacggaagaaatcgctgagcataagagtatacgggagccagcatttgaaggagatggcaagcgacaaagacgaagtcccatcaccgtctgttgagatcgaagacattgttggtttcagaaagtcccaacctcttcatgggtcgttcaggggatgcggacaacccaaactgtgagggctgaatgaaactcacttctttattatacaaagacaaaattgtttttcgtttgtcctttttctggttgtaataacaatatttaggtgaaccttaaattgttagaaaacagagtttgaatcatcaaagagaaaaacattgattactacgcatttcgctatatgaggctgtacctaagttaatcgctaagcaacccttgttcctcaattaataacataaatcacaaactctcaagcaccagctttgttttccatgcaatcgagttaaagcagagagaagcatagtaaaagataacaatccatttgatggatagagttgtccagaaatgcttgtgtttgtggtttatattcagacatggtgcatatacaaaggcggtactgtcttccaccccctccagatacttgttgttgctgcatgtgatcagttaaacgagatcatcagtgttttgtttcattttggttgttcgatctgaattcaatctttgctttacaggattgttggtgtagtgttcataacgctggagctctacttagttcactaagaaaacttgaggaacactcaagacgataaaactgaatcaagccgaatcctttgatatggaaaaactcgagcaaccttgatgaattccgaatcaaagctatgaatactaagaagagaagagatattctcttttaatggtatttcttattattaaaatctataactcccacgaagataagaggaaacacaagtccttatttgaaagcaaaatgaaaaagaaagagggctttaattagacttgttgaaactttggatcaggactccgtttaagaatataagaatacactgactaaaacacttagtcgtgaatggaaacgtaagagaaaagtaatcttcaatgtcagatataggagtaggaccaaggcttagatactaagcggggtgatctctatcgcggatctccttgacaatcttagatatgatgttcttgatggcgagcttgtgatcctcgctaaaagaagttggctgtggaacattactcattattacactcgcctccgaacccatcccctccaggtcaaccatctcagatctgctggctttcttgacggcgagacggtgatcctcgttaaacataagctgctgatcatgattcatgattatcttaccgctggccttccggtcaaccatctcagatctggtggcttccttggcgagagcgagacggtgatcctcctgcttccgcctgttttccataaacaaaagcagttgctccttattcatgacaatcttaccacccgccgtcttgtcgtccatcgagatcggattcgggtttcaagtagaagggaatccctagggctgtttcggttgcacacggactcaaccctaataataaagaatttagtatataccttttacgaatgggccccaaagaaaaacaaaacccactaatttttagctcctctccgaaagtgacattgatctattcagtttttggaactgttactgcgaataaatgataaacttgatttgtgttgtgtatatatcataatcagcccatttatgatccgctactattttgtcgtttttttttcttaaacctcaagcaaagtcttggagtttgatctttggggatcttgatggtgtttctccagcagcatcggaacgatacctctaggcttggaatttgaatcaatccaaagtgtttgattttgactttcttgaagatgatttcagagagatgataatgagatcatttcgccaagattttttttttgcttcttagggttatactagaggatcactaacgcaggctttgtggatctcgttggtccatttctattcactctatgcataaaagctgtgttgattttttgtttgatacgaacattttcgtattatatgatgtttataattagttatagtggaaattcgttagtagatcaaattctataataatttcatcctcgtatcctttttttatttttatttactatttgcctatttctatagtaagtaaatagtatttatttgtcgggtaaagtaaacgtattaaacatttccgtataagaaaatgcatttttaataatatttaaggctttgcttcatgcggtggctttgcgtgggtcctacagagaatacagcaagcaagaattactgtttagttgtctctttggttggtttggtgattaaagaagaaaagaacccaaagttttgcaattgcattgaccttacagctcacagagactctcagacttggctttcctatcaaagctcttttacatttgcattcaagcttaagcaacgtcaattccaactacaacaaccgcattactttcacttgcaaacaaaacacgaatccaaaacttccatttttgttcacaaatctcagcttcttctgattcaaaaagttttgagctttattgatccaatg

SEQ ID NO: 11249 - DNA, 3000 bp, Unknown; identical to SEQ ID NO: 11236
  misc_feature (1)..( 3000): cDNA_ID_1830751_gDNA_ID_2214485_Annot_ID_133350 3000 nt of promoter + ATG

SEQ ID NO: 11250 - DNA, 3000 bp, Unknown; identical to SEQ ID NO: 11235
  misc_feature (1)..( 3000): cDNA_ID_1808325_gDNA_ID_2214485_Annot_ID_133351 3000 nt of promoter + ATG

SEQ ID NO: 11251 - DNA, 3000 bp, Unknown; identical to SEQ ID NO: 11234
  misc_feature (1)..( 3000): cDNA_ID_2702019_gDNA_ID_2214485_Annot_ID_133353 3000 nt of promoter + ATG

SEQ ID NO: 11252 - DNA, 3000 bp, Unknown
  misc_feature (1)..( 3000): cDNA_ID_2702023_gDNA_ID_2214485_Annot_ID_133354 3000 nt of promoter + ATG
accctatttttggtcggaattgttgttcgaattcgaatggggactccggaatttccagatctggggaaacactgctccgtcgatgtttgcaagcaaatcgatttcttgcctttcacctgcgaccgttgcctacaggttcctttctccttctctccttctctccttctctctgtttatattcacatgcaaagactcgatttttatgttttcgcgaatggtgtttgactctgactgaatcctatatctctgggatcaacgataatcatgctgttacttattttctcgttggtttcgattttgtactttaggactaagaagaagattgaattgaagtctcgaatatcgaatttatcacttgaatccttttggttatcgttaggtgttaagttaactgacattttgagcttaattatcggtattttggtaaattccaatttcttcattcttgtctcagaaaaattctgctcgtaactaatgtgatgattcttgactgctttcttgattcaagagaacaatgattcgtgtctgctctcttggttcggttgtctgttctcatgtttctgctagatccattgactgttgacgatttgaattttgtttttgagttagcgctctggttttctctgaatctttagtgtcaaaatgtttccttggtttggaggaaaagtcttacattggaaatttttacaggtgttttgtttggatcatcgaagctatatgaaacatagttgtccaaaaggcgatagagaagatgtgactgtagttatctgcccactctgtgctaaaggagtccgattaaacccaaacgaagacccaaatataacatgggagaaacatgtcaataccgactgtgacccatcaaactacgaaaaagctacaaagaagaagaaatgtcccgttccaagatgcaaggagtacctaactttctccaacaccatcaagtgccgagattgcaatgtcgatcactgcttgaaacatcgttttggacctgatcacacttgccctggaccaagaaaactcccattcatgggtttcttgagtagtagtaccaccagaaaagaagctaagacaacaagacccaacaaagctcatccatcaacttcatcatcttcttcttcttcgagatggtctaatctcctatcttcagcagaagcaggaattagcaggctcggtaatgacattagccagaagctacagttttcgagcagcaaagataatggtatcgtggaggtgtgtccacagtgcggtgcgaaattctcttcggttacttctcttgtggaacatgtagagaaaacacatgagaggaacaagaagcagaatcatggcaatgtcacggtcgatgtctgccctagatgtagcagaggattccgcgatccagtagatcttgtgaaccatatcgaaagagatcaccgaggcacttcgaaagcataggaacatatgcgtttacaagccacacatcacaacataacttgtgaaaggtactcaaacatctttgtatttttcttttcatatttgtactggttttaaacaaccaaaaaaaatgtcacattctttgaaaagtcatggactcatgtccagaagtgtagccagaagtgtagtagactaatgttatcattatccttgggccttggcccttgggctttgggtgatatggttttttcaatgaacaatatgagaagaaattcaacggcgaccaatgtggttaagtccgttaaaaaataagggtaaaaccgtaaaaggttacaattggcgagttcgcgggaaattttaccctctttccgcggtaagaaaaaaaaaacagattgctgaccccacgtgaccgtcatgtgcagttaacgacgttaatgataagtggcagctaacttaacggtgcaataaaccttaaatcttaacgaattgaatgtttcagtactttttctcttaaattcaaaacgtggtcatgtcgaaagaattcgacttgatttcaccactagcatcctaatctaacatttagcctttataaaaaccaggttaaattgacttaagtgaagtgtgtatcagttctataagaaaagaaatcatagtcagggaattaaaaaattacatatctccaaataaaactttcttcttctagagtgtataatacacaattacacatcatgcacacacacaccgtgtgagtaagtaattaactaattatagaataatttaagagattatttgctttattagcagtgtatgagctggccaaaatgcaataactacctcagcaaatttcaacaaagcaggaaaaaaattaaaataatacgttatataatcaaagccgcttatattcgcatccgacggctgaggtttttatgtgaagaatgtttaagagtagttttaatatgaactaaaaataagaatgaagtagcaagcaacgaaacggcagaaggtggaacccgcgtcgtggccgttgaaacgtatctgaggaaggaaatattattatcagagctaaaagcttcgccggacgatccggcgactaaatcctactgagagaataatccggtctctcagagagagaaagggtttcgagttttctggtgtgtcgccgatcagttttcagttaccaactggcttatttgtgctttgatctgaggtaaattgatttttcttttgcagcattacgttgaaatcttctgatcaatctgggttttgttaaatcattgattcctcgggatgtgatgatttttttgggtaattcgttttcggcggaatttgactctggattatacaatgaattggtttcgttttgatcaacattacatcgtttttgaatttttttaaattttggatgtttcaggcgaaggtttgagttctaaggagtgtatcgtttaatcatcgagctctgttttccttctttcccgaggaagctctagggctttttcggtggatcaagagggagggagggaggattaacacgtaaataagatttaacaggaatttgcggaattttgattatatcagtgagtagaagaaatg

SEQ ID NO: 11253 - DNA, 3000 bp, Unknown; identical to SEQ ID NO: 11243
  misc_feature (1)..( 3000): cDNA_ID_2994722_gDNA_ID_2214485_Annot_ID_133355 3000 nt of promoter + ATG

SEQ ID NO: 11254 - DNA, 1893 bp, Unknown; identical to SEQ ID NO: 11242
  misc_feature (1)..( 1893): cDNA_ID_2702027_gDNA_ID_2214485_Annot_ID_133356 3000 nt of promoter + ATG

SEQ ID NO: 11255 - DNA, 2080 bp, Unknown
  misc_feature (1)..( 2080): cDNA_ID_3593271_gDNA_ID_2214486_Annot_ID_133357 3000 nt of promoter + ATG
tttgttaagtgatagaatagtctagaagactctagataatatggttcgagtattttaaaaaccaacattagcttccattggtgaatgtaaaaaatgtaaatgactagtgacatccaagagtaaaccatttggacgcatcaattttgaacgagagattggtggattaatgtctacatacacgtttactctcaagctatttatggttgtgttaaaggttcctatcttacttagcggctttgttttgggtataaatatattgattgaattttaacatttaagagtatcatcgtttagaaaatatttgtgacgaaaataattagactatggtcagattgattataactttacaaaacggtttctttttacttgtgtaatgacatttagctatagatcaatttagcgttcttaatttgtgttgggttagattttgaattggaaaacatttgacgtatatatgagttggatccagtttgtattttggttacattttcagttatatatgtgataagaagagttaatttagaaagttattttttactgtctgtatatatctctataaggaaaattttctaattaaatcatttctttgaaactcttatttgcatcaatcatatatgccatatattcacacatatattcgtgtcgaagatgttatataatatttctaagaaaaaatcattgaaaatgcgaaaatatttcataccgatatgaatattggtttgtgattataggtttataacaagatctcaccaacgttgcttcgttggagaactacagtattaaggtgacaaacttagtttcatgtcaattactcgttttcgttttgttttggtctcgtttcaatatattagttatatatggatgatgaaagaataaaattttgtattaatatgaattggtttttgactttacgtatatttcagtagaggaaaacttgcctaattcacaatttccttatgaatataaacttttttataactatgatatataataaacctataatctcaaatcaatattgatgtttgttcagaaatttctcgcggtttaactatcatcaatgttgatttgttaaagaataggcatagcaacatgttacctgaatcgaaattcatagcaaagatttatgtttgctaacgaatatcatatactattattgataataataaagttacatttaagcttttagaagctatatgcatatacttgcatacatcatcattatacgcatatgcttcactaattccacattttaaaacaaatttaaactttgtgattcaattcaagatgtaatgactttcaaatatgtaaaatggttccaacgcattactctttggttatcttagttaggactctcttaaagagagacacatcacacatgcaacaagttgtgtggcaccacacacaagaagatggtcatctttggtcggattcaacaacacaattttccaccttaaactcatccgatttcatcaaatcatagttcgttacactccttgattagtctagttttcaacgaacataaccattaaaaaaaaaaccataagcattctccaaaaaaccaaaaataccgtaatactatcaaaacaaaccatagttttgaccaaccttgcttcaatccccattttctcatcctacacaaaaccatttcaatcgattaaacactcaaacaaaaccttacagaattatctacacaatgaaaaaaacaaaatcaaaatccataaagtaaacaaaaagttatgataaaatcaatcaaagctaaaagcacaccaatacaatacacaaaagcacctatccacatccattaacctccgcatccttacattcgtaatcctaaattataaaccgtcgatagatttaaatccaacggttgaaattcaaacctgagttgatacaccgatccgagtactcatcattttaaccaatcagagaagagattacaaactctgtctcataaacacatctgactatataaacatcattcccatagttcttctccttctcctcatcacaaaattctccgacgcattacattttcttccgatcaatacagagagatcagtttctgagagagaagaagatg

SEQ ID NO: 11256 - DNA, 3000 bp, Unknown
  misc_feature (1)..( 3000): cDNA_ID_2706187_gDNA_ID_2214486_Annot_ID_133358 3000 nt of promoter + ATG
tggtagttgtaaaacttaggctaaaacattaatctctgctcttaactagtgttggtttggatttttgttagaaacaatgattggagcataagtttttatagaagaatgcttccaagttagttgcttttgtgctatatcttgagggcttatggttatacaacttatagctcttttatttgttttttgttctcacttttctgtcaaggtcttatgttagtgttcatactttgttttcttctttacaggtctataaaagacactactggttgaattagaatctgtaagagatattagtgtttttgttggccaatattttgttactgtgatgaaatgacaaataacgagctgattatgtcgggaaaccacgatatctcgtttaggcaggagcaatatatggaagctcgacagaacaatgaactttttactagtcatgattacaattttgctttggaaccattacaagagaccaacctgcagataggtgtttcccgtgagcaaaatgaggtttggaaccacggccaggaacatgcattggctctacaaaactcagggactcacagtgaagaaatacatgaaaagcaacttgtggaaggaaaagatgaggttgattctcaggaaaaccaaaatgaaagctatgaccatacttttgacctctcctttcctgataatgatgactcgggaacttcagagaatgataaacttgctttattagtttctcaggatctcaatgataatttacagttggcggtgggtcattgcatgaatagggatcccttacctggcctgaacataagcctttctcagcagctagagttggctcctcctatccttcaatgccggtctctgcaaacagctcctgagcacaatttgatcgttggtatggaattttctgatgtccttgcgtgtaggagagcactcagagatgcagcaattgccttacgctttgagatgcagactgttaaatctgacaaaactcgcttcactgctaagtgcaatagtgagggttgcccttggagaattcactgtgccaagcttcctggtctaccaacctttacaataaggactattcatgggagtcacacatgtggtggtatttcacaccttggtcaccatcaagcttcagttcagtgggttgctgatgctgtgacagaaaggctgaaagtaaatcctcattgcaaacccaaggagatactggagcaaattcatcaagttcatggaattacactaacatacaagcaagcatggaggggaaaagaacgtataatggctgctgttcgcgggtcatatgaagaagattatcgccttcttcctcgatattgtgatcaaattaggagaacaaatcctgggagcgttgctgtggttcatggaagcccagttgatgggagcttccaacaattcttcatttcttttcaagcatcaatctgtggttttctaaatgcttgtcgacctcttattggattggacaggactgttttgaagagcaaatatgtagggacattgctgcttgccactgggtttgatggagaaggtgcagtgtttcctttggctttcgctattattagtgaagaaaatgatagtagctggcagtggttcctctcagaattgcgtcagctgcttgaagttaattccgaaaacatgccaaagctgacaattttatctagtagagatcaatccattgtcgatggagtagatactaattttccaacggcgtttcatggcttgtgtgtccattgtctcacagaaagcgtccgtactcagttcaacaactccattcttgtgaaccttgtttgggaagcagcaaaatgtctgaccgactttgaatttgaaggaaaaatgggagagatagcccagatatccccagaagctgcctcgtggattcgtaacatccagcacagtcaatgggccacatactgctttgaaggaacaaggtttggacatctgactgcaaatgtttccgagtcacttaatagttgggttcaagatgcgtcaggtcttcctataatccaaatgttggagagtattcgtcgccaactaatgactctgttcaatgaacgccgtgaaacaagcatgcaatggtctggtatgctagttccatctgctgagagacatgtccttgaggctatagaagaatgtcgtttgtacccagttcacaaagcaaacgaagcacaattcgaggtcatgaccagtgaaggaaaatggatagtggatattagatgccgtacgtgttactgccgtggatgggagttatacggtttgccttgtagccacgcagttgcagccctcctcgcttgtagacagaacgtatacaggttcacagagagttacttcactgtagcaaattaccggcgaacttacgcagaaaccatacatccagttccagacaaaactgagtggaaaacaacagaacctgccggagaaagtggtgaggatggtgaagagattgttatcagaccacctagggatttaagacaaccaccacggccaaagaagaggagaagtcaaggagaggaccgtggacgtcaaaagcgggttgttcgatgtagccggtgtaatcaggctggccatttcagaacaacttgcacagctcctatatgaaaaacatatgacatctctctttagattctttacttcttctctgatctgaatttattatttcttatacttaggtttagaatattattttcaaagcctttctctgtaactcatttttccaatagatatccaatgacagattcttcttatgttatagccttaacgaatagattttataaaaccattgccaaaacactattatatcatacattggggatgagagtttggttattaaaacaaaatggtgagtcaaatcacacaaaaagcaaactaagaaacttccggagtaataggactcaaagctattttagtacaacacacgtggagaaagcagatacattgtctcgtaacagaaaacaaactcaagaatggacccaatcttagagttctaacaatcttaatctcatg

SEQ ID NO: 11257 - DNA, 3000 bp, Unknown
  misc_feature (1)..( 3000): cDNA_ID_2702082_gDNA_ID_2214486_Annot_ID_133360 3000 nt of promoter + ATG
gcatgttttataaatatcaaccttgtattggtgtcagctttcaatcgctctttacagaatccatgtataactagatctataatgcaaaatttgtttactttactcaggttagatgttatcgataggtgcttctcgaagagaacaatggaagaaattatatctgcacttgtaagtttttcattaatatataggatatgtcgacttccgttcctaagttggttgagtttacctttgacattgcactctgtgttggttaggagagagagaccactcaagaactagatgattggagcttaactacgattcgagctttgaagaagtcttcaccctcaagccttaaaatatctcttagatcggttagttcccaaaatgtgtcatatgcaataatgggacagagctgactatgtgtataaatttcagataagagaaggaagattgcaaggggtaggacactgtcttacccgcgagtatagaatggtgtgtcatgtgatgaagggagatttaagcaaagacttggtggaggttttgacagcttttctgattgtatcttcaacctgaaattttactttgtagacaagacaataattaaaaaatcatgttttacttatgcaggggtgcagagccatattgatagacaaagataggaatccaaaggtttaacaaatctctccatttagtatttgttgttatgtcatattgttgaaattatatatgttgtattgttggaattatagtgggagccaaggcgattggaggacatgaaggatagcatggtagatcagttctttgagagagtggaagaagaggagcgatgggaggatcttaagctttcaccaaggaacaacttgcatgctttaagaattgcagcaaagttgtgaagtagaaaaatgtgattggtcagacattaaaccaatgacctaaccaagattctgtgtcggaaccattcttctttttctttttttttttgttgttgtagaaaataagaatacacatgcttcttttactcctttcaaggagtttaatatctcatatttccactactttccctttatgtaattactttcgtgtatgtaggaacttatggttccaagttttttattgaaaataaaagaaaacaaaatcaaggctgaaattttttcctacggaaatattgtgttatatattgtaattgcacatgctttgattggaggttccattatgtgatattagagccttcattacatttttgatctaaaccactttatggtatccaaaccactcattcatcacagatttttatttttatccggtcgcgatttgtggtattaagaggaacacacattatggatgcaagattcggttccaattatggtgtgaatataagtataaattggaattagtctttcttgataaaaccaaagagaagaattgtagaccgaaaacaaaaggaaacaaagaaatgaaaaagttggtatttatgatgaactgtattaatacacagaaattaaattatatagtacaaatgtaacttgctagctaggttttttgtgtgcgaagaagattatcctcgatgacattcctcttattttatactagctcgagccttctaatatattgtgtttttggtgtcttttgtcctatgtttagcagtcgttttggttcatttgtcgtgttaaagtctatcttttgtgtcttttttattgtgttttgaatcttgtacatgttttaggtataggattgggtggtttcgaacgtgtttggatcaaaagcagggatcaaagctgaaactaggagcagagactggtggaccgatggatcggatagctgacggatggcataaactcagtcggatcgattagtcttctccaagaccgattggtctggttttctgactcgtttccttttatttttcagtattctacgacactcatttttaataaatatatattcttgaccgaaacaaacaaagtataattaagatttacaaccacttgacagaaaacaaaagtcataaataatgatttcttacaacaaaccaaaataaagtcacatataatataccaaataagaatctatctttttcaaccatactagcaaaagtcaatgttaaaagaaccataatagcgaaaccacctttctatttctcagtgtcacgcatcaatccaacggacaaaaaaggaagatgaatggaaaaaagggaaatatgagttataaagacaatttattcacgtacgacgtaatttttgtttgattgaaaatgtgcaagtgaaaagatgggtcgactataagataaaataaatactaaactaagagaaaataaaaaactatttgttttagaaaacaaaggaaaatcgatcacgacgaaagttagaaaggttaggcacatgtagtactgtcaatgttgtcatatcttattgatgcaagaataggaatgtgaaattaaaccaacgctctcttttaggacatgtatgagctgacaagtttcaacccctataaaaacgggtagattgtggaatgtgatttgatataagtagcaaaattagattcttacttttagagagctcaatgagatagattaaagttcattaaagctttatttagtgaaaaaatgatttgaagaaataccaaactatgatatactttttcattgaatgaattatgaaacgatgaaacaagagagttgcacaaagtgacaattcttcatgttactctattgatggttcattacatacatatctattaatctacttattacgaaaccctatttacatggatttttggacttttattaagttatgtgtgctttagcagtttcttatgtaagctttaatgctagtggatgagtgtgagacactcagattttcatacttgtgttttcataataagtattaaaattttcattcatttgtttacataaaaatgagatttatataaatcaacaacaaaataaataagaacttttaaactttattttagctacacaaaaaaaaaaaaaccaaaatattttcctatatatatatg

SEQ ID NO: 11258 - DNA, 3000 bp, Unknown
  misc_feature (1)..( 3000): cDNA_ID_2702050_gDNA_ID_2214486_Annot_ID_133362 3000 nt of promoter + ATG
gaaacatacgttgagattagaacaacaagggggatacatatgaagagatgatatagatatatatgttaatacccttcggatccagaacctgagagtgatgttaaagaatgcaacatcacttgagactgccaaggtgttcattgtgcgcttgaaggaagacaagtctcggttcatgactggttgtacacttgccatgagacgatggtaccatctcactgtttggaggaagacaagtctcggttgacatctttagatctagggtttgcagagggagggtttttctaactttttgatcttatctttgctttgggatggtaaatcggtatatgtggtttctagatatatcgaattaggttatacaaactattgattgactcgtgtaacgaaaaatagttgtacacacaacacatgtcaaaaaggttaataatatgccgactataaaataaaataaaaatataaaaacaacgatgcttgagctgaaaaccgtctataccaacccggaaaagtttaacccctaatcagtttattttggttatcagtagggattggcaaagaaaccaaaccttaccgaaccgaaataaatggtttggttagatccgtgagtttcgattcgattccgcttctgtagatttagttatggaacatgatggaccaaggagatcataggaagcttggggtttgtctgtagtattggttttatttataggatacttgcaaactaagaagagtgtcggtgtattcctactatagaagagtgcttccaagttagttacttttgtgctatatcttgaggactaatttgctcctctgtttgttatacttttttttttttttttggaaactactcgtgtgcgaactttttgttatgtttaagttttgaagtttgaacccttaggaactatttgtatcctcacttctggcaaggtcttattttattgtccaatgttcatgcattgttttcttgtttgcaggtctataaaagacagtacgagttgagtcagaatctggaacaattagtgtctgcattttcattgggatctagagctaagttcataattaaaacccaaaatattcaagaattcaaaaaaaataaaaataaaataagcaagaattctactatttgaactacaagatcaatcatcaaagttcatagatctctataaacattttaaaggacaagattgacggatttttcagatttctgaaattgatctggatttttgttttaatcatccggcctaacgaaccacaaaagaatattaaaaaataaatctcaaaactatagtattaaaaagatcgagtggcatatcgtcatacacggaacgtaacctttggcactatacacggactttcgcagtctttgttttctgtttgtcaactttcatttgagtcttcgtttatactttttcgaccatgttgctaatgtatgcttaagtcgtcattaaatattttggttcctctcatcttgacgtagaaattgtcattctttcacttatttgattctttcgctattactttaatcccacctgcaatttttcgagcaaggcacgattacatttttctttgttttcccatgtacgcacctaacctatgcaccaatatggcttctaatctatgtacacacctaacctacgtattaattgttttggaaaatggtgtcgtacatataatactactagttatacctgtaaatttttaggagtgaaatatatgattgatcacgtaacttagatgataacattgtacaaaaaacataacataaaaaactatgtgtttattatttattatgtattttacaataattgtagtccgtggatgttcgacgtatttatatatttatttaattaattaacatgtgtaaaaatttatgtccgaaagatataatctgaattttgagatgagaaatatatatgattctaaagcaaaatcgaagaggagttaatatgtagaaaatgatattatatatatatatataagattatgttaataaattaaacatagtgaaaatgatctgtatatttggagataaagttaacataaagaaaatggcaacttaacaaattgttttggagaataaccctaagaataacatattacagaaactttttttttatctattctgtaaaatttaaataaagattaaaatcggaatatttgaatattcattttaggtttgtgaaatttacttaatttatctttcttccattgtcatttacgtaatttttaatataattgtttttcatttacgtaagtcacattttcttttattattgcatccactctcgaaacttattaaagacactgtcgtattttaataattttattttagtttttttaatatttttattataaagaaagacacccaataaaatgtccaatgttgatgctctaccttgttaaaataaatttattaaagataattataactatttgccaccacgaaaaaactaaaaaattgcctccaaaaaagttaactccttccatgaccccactatcttttgtttaattttttttaaaagacccaacattactaatattttataaataaaggtataatttgtaaactaaaactacttaattttactaatttaaaaccctaaaaattttgattccaaattttccgttgttcttttattctcctccttggttttttatagacgagaactcattggtaaattattatttttttctttgttcctttgtaactgtttattttaatctttgctttttttatttagaaagtttaacagaaaatttatatattttaattgtaaaaatttctggttttttttgacaaatgacagttttatggacattttaatatattttaaaactgaaaaaaattgattatagtttttgcccccattgaataaattttctagacccaccattgcttggaaaggtcattagttagtaatattttatctaatttgcctctatatatatatatatgttatgtggtatctctagtcattgcaactcacaggcaaagagaaaatg

SEQ ID NO: 11259 - DNA, 3000 bp, Unknown
  misc_feature (1)..( 3000): cDNA_ID_2702070_gDNA_ID_2214486_Annot_ID_133365 3000 nt of promoter + ATG
cttgttatatactagaacctgtttcaagacacatggaagagcatgggctagagtttcttcaatttgctttccggtggtataattgtcttctgattcgtgaggttaaacatcactttgaactcctacgaatatatgccagtatgccatggtttcttaaatccggtttagtcgcagtttttaattgtgaaactgacaaacctttgaacttttctagatcccattcaatctcatcaatcgactatgggacacttatcttgctgaaggagatgcgttgccagacttcctggtgtatatatatgctagctttctcttgacggtaagcaaacactgaatcgaatataacttgcgttggtcttgaaaatgttttcttctataaaccacgagaatcaaatacaagttgtttctgtaaacaatgcagtggtctgatgagctgaagaagctagattttcaagaaatggtaatgttcctgcaacaccttccgacacataactggtcagaccaagagctcgaaatggttttgtcaagagcttacatgtggcatagtatgttcaataattccccaaaccatttggctagctgaaatgacttttcctccatggtgcttgctgctgtttttccctttgttatattatcttcttcttcttgttgtctaaatcagctttcgttttgttttgggttatggtaaatgctaacattcttgtcttgttaattgttattagtttatgtatggtttcacttgttgaatctgtcaccagtttgtgtgtttgtaatatttgtagctttcactaatttggctctctcaatatttttttttttttgggaattcatgaaatttggggagacatagagagctctgaaatggataactcttgaatgtattatccatgccaatccagctcaacccgatccgacccgactcttttgggcgagtaataataggttcttttgtttatgtgttagatagataaaacaatattaatgattaattaacctcaaaattcaaaacacagaatgtggacataagcaacgttgtcaacaaatctactactaaagatgatgtcttttgtcttggattcctaagcataataatatatattttaaagtcaacatcaatcaaaaaatttggtcgattatttgcatcttttattattaactttgggtggtatgattatttttgataaggaatattatttctagtaaattattagttatgtaacgttatagaagcttgagcagtaatgtcactaatatagcaaattttccattcaagtaaaagaaaaatatcgacagattataatgaatatgatgatgatgatgatgatgatgatgagtcatcactttttttaagcccatgcctaattacggtaaaatgaaaaaggtgttttaaggaaataagaaaaaaaaaacacagtgaaggaagggttaagagagaaaggtaaagtaacaagtctctcgagtttcctttttgctttcccttttgtgtggttcatctctcagtcttcttcttctgctataacgctcttctccatcaccgtataatcgagtttcgattgtctccgacgaagagaagctgacacttctggtttcgtcaatttctactgggataaagctctctactacctttttgctcagagaaaatggtttgattttcgaggatgataaaggcttcaggtagcttcacttgttccttgttcttatagatatcgctttctcgtattagtgcttgaaaagtgttgcaaccagttctaattcgagaaatttacatgaatgtttaatcgtagcctctgcgttttcatttgagcttagtaattgtttttgggagaatttgtgagtgtttgagaattgggtattgactctgatttctgggtaaaacagaaattttgaactttttgttggatccgaataaattaggatcttgaatacaaaaaaagcaaatggttgttagatgccaaaaatatttggtggaagaacacaaagatttaatagattctttttttatgtgggggttggattctttactagttggaataatacttaaaaagacccaaatgttcgttggattcaatgataagaggtatagagtgatgtggttggcaagaaaatagagctcttttataacaaagaacatttcactaaactatctaacttcctttttctgcatctaccatacttgtaaatgtccattagcctcattctctcgaatgggttcattggaaaggttactaactacttttgggtttgttcttttcttctgaaggttgttgtagaggtgtttttgccagccttggtgctggtcatggattttatctgactatcgtatgtgcctttgatgaaactaaataatgccccggggagagttagctatgggctctttagagactgtttgttggcttaagggtaagtttagttttcttgcatgttgagtttgaattctaatttgtatggtggatacaaatgagttgaagcctatgtttttttgcggctaacgagaatcatgagagtagtttcacgctctgtttttgggtttccatagttcactgcaatgatgaattatgtttatagacttgttggaatgagtttaatagttttatgttagcaatgttttccccaagcaacagcattacacattcaggtttcgctcataagaaaagttcttgtttcttggagagacattcttctaactaaattccaactctgtgatcgcaataacgtggtttcataaatgatttcctggaatacgaaaatatataaagctgtttgttgatgtgttactttcttctcttatcaggctgcttggtttatcgcttcttgttatttattatctggttatcaagcttccaagatgtagctgcgcatgataagcttaatgagcatagtagcagatccacaacctctgaattggcaaatccacctggtattggagtatctggtcccattcaagtatcaccgtccgtaatccccaaatatgcatcccctgctctaccttggacaccaccaatg

SEQ ID NO: 11260 - DNA, 2080 bp, Unknown; identical to SEQ ID NO: 11255
  misc_feature (1)..( 2080): cDNA_ID_3593271_gDNA_ID_2214486_Annot_ID_183500 3000 nt of promoter + ATG

SEQ ID NO: 11261 - DNA, 3000 bp, Unknown
  misc_feature (1)..( 3000): cDNA_ID_2702066_gDNA_ID_2214486_Annot_ID_133367 3000 nt of promoter + ATG
tattagatcattttttggcgattaaaacgaccaaagacatgtaattcttgtctattaagttaccatcctaacccttttttagatatttatatactctctgggatgaaagtagtgtaccttagctactgatttaggagaatattctccctttagctttggatcaacacactcctctactgtatcttcactaagtttcggtgtagcctgaataatacacagttataagatatgagattaaaacacagtatgatacatatatattgagatggaaaaagagtagctaaaacatacccaagttacaagactttgttggcctcgcggcattgtatggtcaactggtttcctccctgtcaagagctctagaagtacaaccccaaaaccatatacatcactcttatgtgtcaactctccagtcatagcatatctacaaatggcaagtcacatttagctagctcgtacatacttttataacgatgcaacaaaatttaaaagtttacaaactatggaggattactctggagagtaatagccaaagctgcccaaaactcttgtagattgtaaacgagcagcattatcaggagattgatttgaaagattaaaatcagcaatttttgcttgatagtcgtcaaaaagaagtatattgctagatcttatgtctctatgtattacttgaggctgaaccttctcatgaaggtattctaaacctctagctgcctcaacggctatcttcacccttgttatccagtcaagtgttggacctggtagtgcatcttgaactcccttcctacctgtaataacatcacatgacacaatcatggagaaaacaatcctaggccgagaacctcttagttatttaaaacagaaaaaagttttaaaataagaagggcggagaaactcattataccatgcagaatatcgtgcaatgatcccattgttgcaaactcataagcaagaacacgaaggttttcatcaacacaataaccgaccagttgaatgagattctcatgctttagtcttgaaaccatggaaacctaaggagaaagaagcaagagaatgtaaatacaagtttccttaagacaaaggaagggaaaagagattgaaacaagatctataacctggcttaaaaactcggtgtttgtttcatcttcaggtgcaagatcgagtttcttcaaagcaactgcttttccatcatttagagttgcatagtatacccttccataagatccctcaccaatcagagaatttggtccaaaattgtcagtctgttcattaacctcatccactgacaaggaaggaactataatgggaagaatctccttaggctttgcaagatcttgtggtttttgattcttttgatttgctacatatgtgatgacaagaaaaaaaaacattttcttattagaaacgtacaaaagcattcatcaaatgtttcacgtccctgctttaaaatagtcaactcattttaagtggttaaatatgatactttatacaaagcctgaaagctgaagcctatatttatgaaggaaacaataccactcgaatccattattttcccaaaaaatcatcaaatcaaaatcatacatagacagaaaaatcagtaagttaagtgatctcttgaaacttactgttctcatttgaagaatctgaaactccttttttacccgcacaacatatccacttgcgcattcttgttatattcttcaaatatggattttccaaaacttttacctcctgaaaccattcaaaagtattgaaaatagatgcataaaatatacaattttctatcaactcgtgatcacactacagaattctaacaacaaatctagaccaaacccacagtaagtaggacaaagttttaagaaatgaagttgtcattgtcattgcagcgacatcactttgaatataattggtgaaataacgttacagtttcactaggcactacttaggcaggaatgaaagattatatactagcaagatcacatagactaaaaaactaaaatcgttacctaaatgataaatctattcgagtttacgctaaagttttatgtataaaagaaacatatatataatcagaatcactccgaacgaagatcctcttcaaatgggcacatcaaattttttttaaaaattataaagttaagaaagcaaaacctacccccaattttctagttatctacataagtaattaaattgtgagaaccatatatataacctaaatttctagaaaataagtttttaataaatctagaaattattattacacctaactattatatagtataattatattttcacatttaaagttaggtctgattcttaaaatttatagatttactcaaagtatagtgttttaaattttattatttagtgtcattcttatgagttgtattctctcacaattgtcaacacaaatcggaaaaggaaaacaataataagtaagattttacaatggtgttttgttgaagtacaaagaatatcaaatattctatcccaagcaaaaagatttgaaaacaataaataataatcaatatgtaatccgtagataatatcaacttatcatttcatcttcagattttttttctcttttttttttgttacattaaatcaaatacagttttgttatttaaattaacagagtacttatttttgacaaactttcaaaaactcttgattttaattttaattttctaataacactagtttagtacatttgtttggccaaaacattagttcggtattacacgttttttatgccacaagtcatgttagtcaaatataatgtgcttcaataggactttcaaattttgaatattcctatttattaaattcatttctaatatctgtatttagctttccaccaagacaaaaaatcactgtagcgtgattagcacttagctcacaacgagagaacaggcaaaaggaaagaatgagagattctatcgattcataaaggaaaattgtacctctccaattctctgcttccgtcatcgtagatccatg

SEQ ID NO: 11262 - DNA, 3000 bp, Unknown
  misc_feature (1)..( 3000): cDNA_ID_2717198_gDNA_ID_2214486_Annot_ID_183519 3000 nt of promoter + ATG
aggttagtgtaacagtcgaatacttcattcaccaaatttcttagtaaatcttaaaacaactctactgttaaaacagaaaattttccaaattgaataagtaaacgaataatcaaaattttcatttacaatttaaattaagattttttttttttgtagaatatatgaaaatacatgagctagctatttgtagttgtgaggaatttgagatttttgaagtttggctgactcattcaacaactaagtaacattatatcgggtcgcattcaacagctaagtaagaccggccgggtaacttacttaacttcagtagtcgacactttgattattttaactaaagtaacttcgttgttgaatgggtaagtcaaacttccaaataaaagtcatcgtatgtttggaaaagtaaaagtcatcatatattctaaaaacataatatattaaaatcatattattatacggatacacgttttaggtcttttacaaaagaaaaccatctacatggcaaataatataattcaaagatgaatttggatcaaacacattttgaatcaaaagtgttaatttggtttgttaatagacaaataagtcatataaccagcatgtaggacaggggttctcctagtattttacgttaaagggatattatgtgtttataaatgacacatatatatagtagttgtcacatttttttttctttgtgaattaataaccacgtgatgaattctattcatgagaatttctcagctacaaatgaatgacttaaaaatgtggctgcaacaatttaagaagatagattcattgcataaggagctatgtgagaaaaatcattaatagggaatcagtgaggacaagataattggttgcacgcacttttacatagaaaagtcctggaagaaaaatcaaatgtttgacagaaataaaagattatttggggaaatgttttatgaattgtgttggatcaggtccgtcatgccttattaattttttcggtggaaccaaaaaatcatacgatgccttcctgttctacacgaggactggacaacacatgtcaatacacatctaaactataaaagaaaattttgacaaaatatatataatatactgtatatgaaaggcaaaacatagttatctatataatattttttcaacccagtaggtcaaaatgtatttagatcaatttgatattcgtttatttaataatttttatctattaaattttttgataggtctattcaaacaaaatttgattttaaatccgttttcaaaaacttttacaccgaatatttttatatttaaaatataaatatttctaaaatttggttaaaatttaaaactatgaatatacttgtttgatttttaaatattttaaatcatattgtaattttaaatattttaaaaacagacatatattactccgattaacaaaaaatatgtgggtttaatatcatatatataaagtaaaaaatttagacaattattcaaaatcatatcataattaatattaacattaataaaagaaataagttttttaacgggacaaatttgacagaatattacttaataacaattgtaaattataaaatataaatagtttagaaaaaaatacaatttgcaaacttttatatatactaacttaaaaaaaaaatcgtttcacggtgtatcgcgggataaaatctagtttatccagtaaaatattgttagaattgcaaaaaaaaagttttttccaaattatttgcttctattatctttatgaaataatataaaaaatagtgaaacatttaagaatctgaaattagctttaattacaaaaactaacccttgttttcaaaaatttgaaaaaatacttttagtaagtaataagacaatacacatttgataaaatttgagaaatgcaattactaaatagacaatttttctgaaacgttatatattttagaataaaacaagcttattttaacggtaatatatgttaagatgtacacaagtcatggatatacatcgattttactttgaatccttctaagttcatcatcactagtcttacgaataaacttctatacatcactagatatacatacgacatggatatatatatcaatattacgtatgcactcaaaacttctatatacccttaatacgtcacggcaatgtatgtaattctttcgaggtttgaaaaaaaaaaaaaaactttattttattctttctcacttcaaacgtttgatgaatcacgtcgttctttttatatatatataagaaaacgtcgatcttaagacttatgtacgaattatataacaaacttttgcaggatttactgagttaaagtagtttacactatatttacaaagattgttgtgacttctctgatatcaaattaaattaaagttataagtaactttttatgaaagagaataaaagcttacaacaagaaagtagctagcaaaactaattaaatttggctaataatagtttattattcatatcaatagttatttttcaactcttctttaacttgtataactattgatatttattagtataattattattcaatatttgaattctagttcttaaaaagaaagattacgtttaattccaaaaaataaatttaggatattacttttcttagtacacaaaatagaatcaaaaatataactactatcataggtcggctaaaatgatgttcgtggtcatagttaatggaagtgtttttttttggatatactatactgtgtatttttatgaagaaaaatcaatatataataacgacttaaaagaaaaaaaaacaagatatatttccaaaactaaccatataggatcggattattacttttcaaagtacacaaacaacgaataaaattgacgtcctgcactattgacagaaaacgatgggttccaaaactgtcgctaataaactcttccaattaaccctataaatagcatgcagaatatgagttaaaaatcaccaatcaaacactttcttacatgagcaatattcaagaaatg

SEQ ID NO: 11263 - DNA, 3000 bp, Unknown
  misc_feature (1)..( 3000): cDNA_ID_2702058_gDNA_ID_2214486_Annot_ID_183516 3000 nt of promoter + ATG
ctcttagtattttatgaaagtaatatttatttcaataagagttaaaccgcatttaaaaagtaaagtttatggaaaacacgaatgtaaatgtagaacagttttttattggtcaaacttgaatagtaaaacaacaaaaatcaaaatatagtcaaatcaataatctttgaattttgctaagggattgaccgactttcgtactgcttgttctttcgtctgccgatgtgtcgagttagcttagctaccctaagacatttatattttctcttgtttatattggtatgatacattcagatctaatgataaaattgtaccaacaatactgtttttagttacattcttttttaagaaaacatgagagaaatacatcaacaaattttgacaaatgacttctcaaaataatacataagagatatatgatgtgtttatagtgacatatatagtagcatatacaaattgttttgtaaatttatatccacgtcttgaaattatattcatgagaattagtcagtttttaaaatatttattgttctaccagcagccttgcgaaggtatttgctgcacatgcacaaatgacattaaaatgtcttcgcaataaatgatttgacaagattaattcgttccatcagcagctttatgagaaaaatcatggaatcaaatcaacgatgaaattataatggtttggttacatgcattagcctatactatacatgattggtttaataatctaattcatatgttttctaaatttcgaaatatctttttttttttttgaagtaatcagacaatataacccttaaaaaagaagtaataaaacaatataaccttaatcaaaatttgagaatatacagaaattatttagtatatacatataattacatactaaatggatacatgctaagtttaattacaacttatgactcaaagtcaaactttgatgatacccttattatacggcacggcaatctcaaattttcgtggtttgacaaagtaacgatagtatgactttcaaaaataaaataaaaaagtctctttgtttgatcattcggtaaatatttttatcttattttcaacgtttgatgaataacgtcgctagaagaatatagtaattatatttttgcaggatttgttgaataacataattaacactgcatttgcaaatattattgtgacatctttcatctaattgatatcaaattattttattatgaaagcgactgaaagttacatgaacgtagcaaaaataaatttggcttagatattttggaatacatattgtgtcatcatccgaatcattttgacaaaaaataactcttctatatgttttatctatttatgatattttggtaatttccaggtaaaagatattctaaaaacacgagttagttttggaacataattttggaatattttctgtaacttcctcgaaatttcaaaatacaactacaatacagatgacattaattgcaaattatagtaacagaacataactaacttataaactaaactgtagtgataattaaatataataagaatatcaaattcattcatctcttctatatgttttatctatttatgatattttggtaattttcagtacaaaattatttctaaaaacacgagttagtttttgtctttacgaaacataagtttggaatattttatgaaatttcgtcaaaatgtcaaagtacgactacaatacacatgacattaattgcatcgtcgttaactatagtaacagaaaataactaacttataaattaaactgtagtgataattaaaaataatgtatacaaaattccattaatctccaatttccgttttattttttatcaaatggtcaaatttatacaatcttagtgtattactattttctaggtaaacaaaagtacaatccaattcaatattactacattatcaaatgcggcaaaactgaatctgataaaaaatgatgatttttattcataactacaaagggtggttaattattcacaaaccttgtttatgttatactagattttaacccgcggtataccgcgggtacaatttattttttaaattaatatatataaaagtttgtaaattgtatatagttataaaatgtttttattttatagtttacaattgttattaagtaacgtcctgccaaacccgtcccgccaacccgtcctctaaaaaaaactcatttattttattaatgttgatcttatttatgatatgtttatgaattattgtctaaatattttgtaattttgtagtaattaaatgctatcaaagatctctacggtttgatgattataatcatgtagaaaagcaatatcaaaaatgataattttgtagtaattaaataatattaaatattttggaagttttattttagtaattaatcgtgtagttaaggtagagagattttgggaagattgttaaatgtcaaatatttaattagaagattttctttctaattatcaaaaataattattaaatgccagtggcagccgctgtaaataaatcccaactccaggatttatttcacaaagtggctgcaaaaatgtatatatagatatcaattagtaagacttaagaatttaatattctaatacgagttgttaaatagaaagattacgtctctaattccaaaaactatagttattatattatttttctaagtaaacaaaaataaatatcaaaattataactgctatcatgtgagatcatatagaactgtttaaacatgaataacaaaaagaccaaagtgcaaagactagttgtcaaaaaagactggactagatatagttgccaagactaaataattataggattattacttttcaacgtatacaaagatgcaatcacactacataattatatttagctaaataggggctacattcatgcaagttgacaaaaacgatgagttccagtaaaccctataaatagcatgcagaagatgagttaaaaatcacaaatcaaacactttcatacatgagcaatattcaagaaatg

SEQ ID NO: 11264 - DNA, 3000 bp, Unknown
  misc_feature (1)..( 3000): cDNA_ID_2702038_gDNA_ID_2214486_Annot_ID_183515 3000 nt of promoter + ATG
aaacaccgagtttttaagccaggttatagatcttgtttcaatctcttttcccttcctttgtcttaaggaaacttgtatttacattctcttgcttctttctccttaggtttccatggtttcaagactaaagcatgagaatctcattcaactggtcggttattgtgttgatgaaaaccttcgtgttcttgcttatgagtttgcaacaatgggatcattgcacgatattctgcatggtataatgagtttctccgcccttcttattttaaaacttttttctgttttaaataactaagaggttctcggcctaggattgttttctccatgattgtgtcatgtgatgttattacaggtaggaagggagttcaagatgcactaccaggtccaacacttgactggataacaagggtgaagatagccgttgaggcagctagaggtttagaataccttcatgagaaggttcagcctcaagtaatacatagagacataagatctagcaatatacttctttttgacgactatcaagcaaaaattgctgattttaatctttcaaatcaatctcctgataatgctgctcgtttacaatctacaagagttttgggcagctttggctattactctccagagtaatcctccatagtttgtaaacttttaaattttgttgcatcgttataaaagtatgtacgagctagctaaatgtgacttgccatttgtagatatgctatgactggagagttgacacataagagtgatgtatatggttttggggttgtacttctagagctcttgacagggaggaaaccagttgaccatacaatgccgcgaggccaacaaagtcttgtaacttgggtatgttttagctactctttttccatctcaatatatatgtatcatactgtgttttaatctcatatcttataactgtgtattattcaggctacaccgaaacttagtgaagatacagtagaggagtgtgttgatccaaagctaaagggagaatattctcctaaatcagtagctaaggtacactactttcatcccagagagtatataaatatctaaaaaagggttaggatggtaacttaatagacaagaattacatgtctttggtcgttttaatcgccaaaaaatgatctaatatttatgtaatttggtaacgcagctagcagcggtggcagcattgtgtgtgcaatatgaatctaattgtagaccaaaaatgagtacagttgtgaaagctttgcaacaacttcttatagcgacaggctcaataccgcaattctaaattcgtgcgcttttaaaatactatcttatattgtttttggacaacagagttagaatcttcattcatacaaaagagacattttactttgatttggaatatatatatatatatatatatatattaaaactactaagtcttgtgcatgattaggtatataatcattgatggataaataagagatgaggttacatattcaggcttcaaattttttatatttggtgatcaaaatttaaaaaaaaattaggtgagtttggtctttttaaagctaaaaaatattgaaacacaacaaagcaaaaaaatgagtgattgatttcaattataaggtgaaaatagaaagaaaataatacaaaaatattacttttaaaaacattattaatttaagaagaaaaagggcaaatgagaaaagtggactttccttttaggctgttttaataatcgtcttccccgcggtttgcccatctgtctccgtcttcatcatcaagcaaaaaaaaaactcatctttctccactctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctggttcatctacagagttaataatcattaagcgaagaagatccctagaaagattgatcagagaaagtctcagctgaagcacgtttttggaaaacccagatttgacgggtatatatctaatattttctttcaatttggatcaattctcttgattttctacctttatagagcttattgattcgtttccctttgacccaattttgctttctttatttagatttcaaatttcttactcgatttcgttttgtgccccatttgaggatcttcgttgtagacgcgattctcagtggttctgagtgttaattcgagtagaatctcttctgggtaacgtttctcatttgaaattcacagtaaagttttgatctttcattcttttcgtttttttcaatatccagtttatccatagtagttgactattgccaaccttatctgacggcagaattttgtccctttctgatttgtaattttgcagttcgactaatggaatgtggagttgttgattgagaattgcattttttattatgattagagaattaccaactcattgttccaaaagcttgtgcttatcatcattgctatcttgatgcaaatctgaatccagtttctggttttgactttactttgaagcttttttttttcagttatgtgaaaatgttgctgtgatttgttagatggtttcaatatgcctaaacaaatttgtacttgctagttacaatatttgaatcatgtctaggggacagttgctttacttgtttgcattttggaggtagtgatctgaagcattaacttaaattgaagtagcaggttgtgacattgtaacattagatgttaagtaatgccgctgccatggcagtgactatttcatttgttaaaattttgttctacttactttggcattgacatgtagtgtaacgagctaatagaggattgttacttttttctgcatctataatcagttgctttgaatggtttcaggtactaagaagctgtggaggatctatatttgaaagaagagaacaagg

SEQ ID NO: 11265 - DNA, 3000 bp, Unknown; identical to SEQ ID NO: 11261
  misc_feature (1)..( 3000): cDNA_ID_2702066_gDNA_ID_2214486_Annot_ID_183512 3000 nt of promoter + ATG

SEQ ID NO: 11266 - DNA, 3000 bp, Unknown
  misc_feature (1)..( 3000): cDNA_ID_3039345_gDNA_ID_2214486_Annot_ID_183510 3000 nt of promoter + ATG
gcccttcctagtgattttcttgtcagaatatctagatggcggtgtagacagttggtcaatggatgatctatctgctgaaaaagtctcagatgtagaagcggattgctactggtgcttaacaaagctccttgacggtatgcaagatcattacacgtttgctcaacctggaatccagagacttgtgtttaagctgaaggaactggtcaggcgtatcgatggtaggttcttgctagcttgttcctgttaattggatgtgtctttggtgattgtttgagcttatgacatgcacgtcctctccttacagaatcatgttaattatattgagtccgattttcaacttgtttaccatgaagtccttaatttacatcttctgcattttaaggaaatttgaagtttgtgtctttaacaatggttgtgtacttgtgttaagtttggttttaatgtagtcacgcttttgcttatatacgacattttgatgagttgatgtcataaagtgataagaacaagggatgctaatcaacttgtcatgatgattgatgctattgtactgcatttcttagtgcattaattcataattaaccaaccacctattttccattttaggcctgattattgttttataatatagagttaacattgtcacatcttcatctgccttgttatatactagaacctgtttcaagacacatggaagagcatgggctagagtttcttcaatttgctttccggtggtataattgtcttctgattcgtgaggttaaacatcactttgaactcctacgaatatatgccagtatgccatggtttcttaaatccggtttagtcgcagtttttaattgtgaaactgacaaacctttgaacttttctagatcccattcaatctcatcaatcgactatgggacacttatcttgctgaaggagatgcgttgccagacttcctggtgtatatatatgctagctttctcttgacggtaagcaaacactgaatcgaatataacttgcgttggtcttgaaaatgttttcttctataaaccacgagaatcaaatacaagttgtttctgtaaacaatgcagtggtctgatgagctgaagaagctagattttcaagaaatggtaatgttcctgcaacaccttccgacacataactggtcagaccaagagctcgaaatggttttgtcaagagcttacatgtggcatagtatgttcaataattccccaaaccatttggctagctgaaatgacttttcctccatggtgcttgctgctgtttttccctttgttatattatcttcttcttcttgttgtctaaatcagctttcgttttgttttgggttatggtaaatgctaacattcttgtcttgttaattgttattagtttatgtatggtttcacttgttgaatctgtcaccagtttgtgtgtttgtaatatttgtagctttcactaatttggctctctcaatatttttttttttttgggaattcatgaaatttggggagacatagagagctctgaaatggataactcttgaatgtattatccatgccaatccagctcaacccgatccgacccgactcttttgggcgagtaataataggttcttttgtttatgtgttagatagataaaacaatattaatgattaattaacctcaaaattcaaaacacagaatgtggacataagcaacgttgtcaacaaatctactactaaagatgatgtcttttgtcttggattcctaagcataataatatatattttaaagtcaacatcaatcaaaaaatttggtcgattatttgcatcttttattattaactttgggtggtatgattatttttgataaggaatattatttctagtaaattattagttatgtaacgttatagaagcttgagcagtaatgtcactaatatagcaaattttccattcaagtaaaagaaaaatatcgacagattataatgaatatgatgatgatgatgatgatgatgatgagtcatcactttttttaagcccatgcctaattacggtaaaatgaaaaaggtgttttaaggaaataagaaaaaaaaaacacagtgaaggaagggttaagagagaaaggtaaagtaacaagtctctcgagtttcctttttgctttcccttttgtgtggttcatctctcagtcttcttcttctgctataacgctcttctccatcaccgtataatcgagtttcgattgtctccgacgaagagaagctgacacttctggtttcgtcaatttctactgggataaagctctctactacctttttgctcagagaaaatggtttgattttcgaggatgataaaggcttcaggtagcttcacttgttccttgttcttatagatatcgctttctcgtattagtgcttgaaaagtgttgcaaccagttctaattcgagaaatttacatgaatgtttaatcgtagcctctgcgttttcatttgagcttagtaattgtttttgggagaatttgtgagtgtttgagaattgggtattgactctgatttctgggtaaaacagaaattttgaactttttgttggatccgaataaattaggatcttgaatacaaaaaaagcaaatggttgttagatgccaaaaatatttggtggaagaacacaaagatttaatagattctttttttatgtgggggttggattctttactagttggaataatacttaaaaagacccaaatgttcgttggattcaatgataagaggtatagagtgatgtggttggcaagaaaatagagctcttttataacaaagaacatttcactaaactatctaacttcctttttctgcatctaccatacttgtaaatgtccattagcctcattctctcgaatgggttcattggaaaggttactaactacttttgggtttgttcttttcttctgaaggttgttgtagaggtgtttttgccagccttggtgctggtcatggattttatctgactatcgtatgtgcctttgatgaaactaaataatg

SEQ ID NO: 11267 - DNA, 3000 bp, Unknown
  misc_feature (1)..( 3000): cDNA_ID_1026667_gDNA_ID_2214486_Annot_ID_183509 3000 nt of promoter + ATG
ttcgctcataagaaaagttcttgtttcttggagagacattcttctaactaaattccaactctgtgatcgcaataacgtggtttcataaatgatttcctggaatacgaaaatatataaagctgtttgttgatgtgttactttcttctcttatcaggctgcttggtttatcgcttcttgttatttattatctggttatcaagcttccaagatgtagctgcgcatgataagcttaatgagcatagtagcagatccacaacctctgaattggcaaatccacctggtattggagtatctggtcccattcaagtatcaccgtccgtaatccccaaatatgcatcccctgctctaccttggacaccaccaatgtaccctacttttcctgatacatatgagcccaagttaactggcaaatgtcctacagactttcaagcaatttcaagtgttatcgataccgcagcttctgattgttcccaaccattcgctgcacttgttgggaacgtgatatgttgtccgcagtttgttagcttacttcatatattccaaggacagcacaacgtgaagtcgaataagttggttctgcctgatgcagttgctacagattgtttttcagatatcgttagcatcctggtcagcagaagagccaacatgacaatacctgcactttgctctgtaacatcgtcaaatctaactggaggttcctgtccagtaacagatgtcacaacgttcgagaaagttgttaacagtagcaaattactggatgcctgtcgcacagttgatcctctgaaggagtgttgtaggccaatttgccaacctgcaattatggaagctgcgctaattatttcgggacaccaaatgacagttggtgataagatccctttagcaggatcaaataacgtcaacgcaattaacgactgcaaaaatgtggtgttttcatatctttccaggaagcttcccgcagacaaagcaaacgctgcatttagaattttatcgtcctgcaaagttaacaaaggtacttagctgtatcatattatctctcgcatcaatctcccttggatagtcttggaaattattctgactgtacatttgtgtaacagcttgcccgttggaatttaaggagccaacggaagtgatcaaggcttgccgtaatgtggctgctccaagcccttcctgctgtagctcgttgaatgcatacatttctgggatacagaaccaaatgctaataacaaacaagcaggccatagtctgtgcaacagtcatcggttctatgttaaggaaaggtggtgttatgacaaatatctatgagctttgtgatgtcgatctcaaagatttcagtgtccaaggtaagttttgttttagactccttaataactgtatcatcatttcctctaccgtttattgaatatcttcctgacattagctctctttttctgtttctgggtatgccttggacgataagcagcatatggaatgcaacaaggtttgcatcaattcatctcatattccaaagttgtttgatatgtgttgttgtctcgccagaataagttaaaaagtgttaatgatcttttttgggtaacaatgtgattataggttgtcttctgagaagctatcctgcagacttgatatttgataacacatcaggctacagctttacatgtgatttgacagacaacattgctgctccatggccatcttcatcgtcaatgtcttctttgtctctatgtgctcctggtaatcacttctctctctacctgttctcttcttactcattgttggagcttccagaaaactaaaaagtttaaattgcaaaaaaagttttgctttatcttattcaattttattttaaatatgcagagatgtcattacctgccttgccaacatcccagactattaaaaatcacggtaagcctagtttcgttgcaatgtaatctctagtctcatgaacagaactcaaagacttgcattttcaactcgtaattgcagggttttgcaatggtggggttggagcgttgcgtctcattgttttggtatttcttctgtatgttgttgttgtgagacattaaaaagaggtttaggagggttttgtttttggtagtcagtgaggactttggataaaacaatggtaagctcaattttctcttgtgtagatgtatgacaatagggcaagtgttatgtagtagtaatatcttctcaatcttcatgtatagtggcatctctgcttctgtttgttaatgcgtttggttttattcattttcgcctgaagatcaatgaccgaagcttgttggcctctgagagacccttgacaaaacaaaaccaatgaaccttctaaagcctgtagttctatttttcagatatctgatgagactcacaaaccttaaattcaaaattaaactatgaagaagaaacctaaaaaaatggaatcaagcatagttatttaattaagtataattttgagaaatttcagtatatgtcactattgaaaatatcgtaactcataaaaaaaaaatagcaattgaagattttgatatcaaacaaattgggtaaatttttttttgggtattccttcaaattatgaatgatctcaaattagtgtatttttttacaatttatttcttgttattgttttttggagtcagtgaatgtttttgagtttttgagtttttgagtaaagtagagttaaaatcgtaaatatgcatatacttataggatagaaccatcgttcttcttcactctatctgcttcttcgtttcatctccgactctctccgtcctccgcgtttctctttatactcctacacaaggttatatctctcttcatctcctatcgattttactctcgatgcaatgactgttctgtacgaattccccgcgaattcctcctgtggagtttcaaattctggaactcgaagaaatcaagtatttaccaaaaactttcgtaattaattcattttgaatctcatattagagcaagaaggcgccacagaaccaacagctatagataatg

SEQ ID NO: 11268 - DNA, 3000 bp, Unknown; identical to SEQ ID NO: 11258
  misc_feature (1)..( 3000): cDNA_ID_2702050_gDNA_ID_2214486_Annot_ID_183506 3000 nt of promoter + ATG

SEQ ID NO: 11269 - DNA, 3000 bp, Unknown; identical to SEQ ID NO: 11256
  misc_feature (1)..( 3000): cDNA_ID_2706187_gDNA_ID_2214486_Annot_ID_183501 3000 nt of promoter + ATG

SEQ ID NO: 11270 - DNA, 3000 bp, Unknown; identical to SEQ ID NO: 11264
  misc_feature (1)..( 3000): cDNA_ID_2702038_gDNA_ID_2214486_Annot_ID_133369 3000 nt of promoter + ATG

SEQ ID NO: 11271 - DNA, 3000 bp, Unknown; identical to SEQ ID NO: 11263
  misc_feature (1)..( 3000): cDNA_ID_2702058_gDNA_ID_2214486_Annot_ID_133370 3000 nt of promoter + ATG

SEQ ID NO: 11272 - DNA, 3000 bp, Unknown; identical to SEQ ID NO: 11262
  misc_feature (1)..( 3000): cDNA_ID_2717198_gDNA_ID_2214486_Annot_ID_133372 3000 nt of promoter + ATG

SEQ ID NO: 11273 - DNA, 3000 bp, Unknown
  misc_feature (1)..( 3000): cDNA_ID_1807750_gDNA_ID_2214487_Annot_ID_133376 3000 nt of promoter + ATG
aataaagtcaaattaacagttgtcaacctcttggatttttcattctcaaatgtctttgcgttttgtttttatggagtttcttttcatatttttttaaagttgatgataaaaatataaccatcttattatcttaagtctaaaacaacactttgacttcatcaattatctttggtcacatatttgccaattagagccttacgaacattttggaccaattgttatgtgaaatattattgggacactttggaccactttttacatactgtaatcatcgaaaataatcatcaaaatttatactttttaatctcccaactttaaccttatagatagaaaatgatatatttattgcgtttttgtttatatcttgaagtggttagtatttctagctaaagaaattggagatgaaatttgtaagttattcctcatagtgaattgttttgtatatgtagtcgactaaaatcttgagcgatatgatagaaaagaaacaaattatgtataacaatatatatactcttatttccttttacaaatactagtttttgatatattttttacagtgataaaaatgatttaatatattactatattctttaaaatatactactactcagagcatctccatcagtaaaagtaaggaaagtttttcaaaaaaaatatatatatatatatattttaatcaaaacagaaatattaattattatttaatacttgaactaataatacgatgacagctgtccaatttagatgagaatagtttctcaaagtttctcctgcgagaaattcaattctccttctctcttactttttctttcttctctcttacttttttttttttaattattattttttttattaggtatctcattgaaatactcccaatggagatgctctcattgattaagtatgcaaagacctacactcaaaaccaatgtcaaccagctttcgagatcttcccatttactgtgattattcagtagaattaggtacaaaccacagttgtggtggctggctcgagctgctgaatccacataaatttgatcttaactattgggacatttaataatctcatctttaaaagattcattaattttgtttcttgtctgtggtagatggatcaaaaaggagtgtatggtaggtgcaatatcgattttggaaacttcggaccccctcaggccctcggccgaagtcaaatgattctgctaaccattgcttttttgctcatcattatagaccaaccacttcgagaaaccatttgataagaagtataataatcactaatatccaaatacgtcaactaactcatatcaagataaatactatcttttatgaaaaagccaaaaatatttcaaattcatgtacttcattattttgtaataaaatgatactaataatttcatttggatttgtgttatgtttttttaaagtgattatatatatagctactacataaacaaccatacatattgttgtttcactttatagctaattagctatgttatcaatagaagttaaacagtgaaaatgacataatacatagctaattaacacacacaaaatttagaaacatccgcttggactacaacatcccacttttaatttaattagaatcttacttaatgatatgatcataggagtgtttgtggtttagaaaaatggtataatttgaaaaattaaaagatagttgaacggtaagggatagtgatttaaaaatatttattgattggtaagaattttaacaaatttaaatagtttagttgatatatagtcaatctcaattagtaattcatagacagtcatcaaaaccatcataattcttaacacatttatcaatcggtggtggcttgaaagttcaaacttcaaactatcaaatcataactttaaagtttaaacatacacagatggttaagctgtcatagttgatatttaaaggaaaaataccataaaccaaagtggtttaagttttccatcttctaattaatttttcactactttccaacttcttctttttttttgttcaaactacttttcaacttctaaatttagaggagtatatacgagtcacgaaaatgcagatgggtgttatataattatgacatcttataaggaaagtaaaaatattccataataattacaaactcttcgtatcttcaaaaagacgatatacaacgtgatgaaaaaagagagtagaatctgacaaatcttatgtatatttttttaacattaaactgttggtgtaacatttggatttaacaattactgattactagtacaaataaaataaaaataaaaatgcggattacagcctaatatttccagtctctccacgagtcacgacgctgtaatgatgtcccttttaaagtctttacttcttcctcactacagagacacagagcaagcaaaaaccctttaatcattcattcagtcaccaaatctcttgttctgtttttctgtctctctgcttcagtgttcttcgcggcctttaccagtttttcagttctttgacgagcttctttcattggtcctgaactcaggtttttgtatctatcttttgtttcttcgttgaaaactagaacttctttttgctgtgtttcaatggttgtagattggatctggagaatagacaatttagtggttgtggttaatgtcatttcttttagtaaagtttgaacctttttcgattttcatagcattgggtttgttttcactcaagtatttatggtttgctctctaattgaatacacttttcaattgggtacttgattttgttgattttgcttgtgttttgagtcgttgagtacaaagaaccaatccaataatcattagcttgtattcacattcaatttttgtatattaaacaaaagagtttctgtggagtagttgatccttaaacattagctgttttttttattaaccagagtattttggcttcaaatctcagggttagagcagcatttgcatatatacaaggtgttttggtgacaattgatagactctaagatg

SEQ ID NO: 11274 - DNA, 3000 bp, Unknown
  misc_feature (1)..( 3000): cDNA_ID_2702132_gDNA_ID_2214487_Annot_ID_133379 3000 nt of promoter + ATG
attggttgctgaatgttcatcgaaaaatcatacaggatggattgatcgaaaaactaaagatattgaaaggctttgttggtaagcttaggttccctttttcttatctttgagcatttttctgtatgaagattttgtggtttatgttaatatatgcagaagcaagagtagaagcggatcctaagaataagaaagctgcagggattatgctgttgagtctatctccctttctcatggtgacattttcggctatatttgattcacattcttggagtcacatcattgtgttgatcacactcataatttcttcttcttcaaccgttgtctactttgtttactcggtataatccctctagaaaacccaagtaaacccttttggtttcgctttgttatctaaatgacaatttgtggaactctgcagtatcttgatacggctaaccaagagaagagcttagatcacgcgaggtttgagctcatgtcagaagttcataagcacttaaagaggttttcaccgaaacaccttataaaagatggagaactaagcaaagagagcttgaaaaggttttattctctctatatttttgaagcaataatagtttcatttcagccttcttacgtcgtaaatcattgcttaaatcgatagtttgttcaagaaaactgataagaacaaagatgggaagatacaaatatctgaactaaaagacttaaccatagagctttccaactttgggagaatgagatatgacatcaatgagcttgctaaagcttttcttgaggattttgatggagacaacgacggcgaattagaagagaatgaattcgaggaagggattgcgagacttctcaaacaatacaaattcaacgttgaggatcaaagagagaatcagactgtaagtctatgcacatttcaagagaaatgccatttttggatatttctctagctagtttaaaaacaggctttggttttgaaatatggtaatgtgttgcaggaggaaaatggagttcttaagctggaaattaaaccgaagaaaacacttgttactaagttgctatctatggaaacattaatagctacgactgaagtcatcgtagggatcctaattgtactctttcttgcaaaaccatttatgctgaacatccagctcttatccatctcagctggaattccttctttctacatcgtgttcgcgatgatccctttcgctagaaacttaaagaacactctatctacacgcttctgtcgtggcaaagacaagaaaagagtctcgtccaatactttctccgaggtcagtttaacaatcacaattcattaacttgactaacacgttaagaactcaaagtttatgggcattttcattggtttccacagatctacaaagatattacaatgaacaatctcttgggaatgtcggtaatattggcaattgtgtatacaaggggcttgacttggaaatactcggtagaaactcttattatggtgatcgttggcctcataatcggcttaccaatctatataagatcgacttacccgttctggatgtgtgtcttggcctttgctatgtacttcttttctcttctccttatctatatccgtttaaattttctagacaagaactaaggttacacacctttaggtgagacttggagtgaaattatatcattgttatatagaaacttatcatatgttattcgttcgttttggaaagtatttatattcattgttttaagaacacgtggttttcgcatatttcactcggaaaattcaatcgtattggcccatatcactgaccatcccctgcaaacatttatatattatatatgtacccacaatgtaagttgatccggcagcagtatcttttttttttctttgatgtgatcctgcagcatatcgtttgtacgatttatttttttgaatgtaagttaatgcaacttgcactctaagcttagataagtccaaaaatattagaacttgaaggaagtgcacaatagtatttaaatttaggtccgatggggtcaaaatagttcagctccgattttcatagtttcgatgaataaaaaaaagtcacattgtgttttccgatacaaattgtaaaatactccagctatcctcgtgtataacaactgttcatgctccacgtaaaacttatttatattaaagtaaccccccaaccacacagtagaggaggtaacatacctaataatccccaaatactctcgaaattccacaatattgatttaacgcaatgttggaaaaattagcaaatcagatgttttgataagtttgtgataaaaaaaaaaggtcgatagaccagaagaaataaagaattatgaaaacaaagctgcttggatgttatagcttttaaaaggtgttagtaaaatctgatgatttaaaaatacttaactcatgtgatcttggccattggtgcatggaaaagaatcaaaagttgaaccaaaatgtaaatttgcagctaaatatatgcaaattcgaattcaaatagtgacacaatggtcacactaacataaaacactagatatcattttattgattttcaagtgatatatactttcattcttaaatataaaatatgattttatttgcccatttcggccaacagtccatcatctttctttggcagagtggcatgtatttccatgctagtttgtaaattacaatgaacaaataaaataaaaaatgtattgttaatttgactctacaaaaaacatgatatgaatttgttctgaaaacaataatttatataagtacctaattggggtaagtattaaaatattaacatggtgcttgtagatctcagttatatgagcagggaaactttagtaagaatagttgcaatatctaaaagcaatctcgctcttctcttctcttctcttctcttctcttctcttctctcctcttcaacctcaatcacttaacaaaaccctcagtagaaaacttccactaagtttttagtcatcgttggttttcacaataaagcagctcacatg

SEQ ID NO: 11275 - DNA, 3000 bp, Unknown
  misc_feature (1)..( 3000): cDNA_ID_2702124_gDNA_ID_2214487_Annot_ID_133381 3000 nt of promoter + ATG
attatgctatagtgcgctggcatgcctgagaaagataatacaaatttccaattttggtaaaattttgacctcaacgaagcagtcgtgaaagaagaggcgaatggtggctggagctgagatggggacttctttgaaccgctgagaagtgacggaaccgacgagagtttcaagctgaggacatttcttggagtagtaatcggcggagagctctctgtggggccgtggtgccggaggcttagaggttgtgggttgtaccggagaaatcaaaatggttgatgtgaggaagaggaaaaagaatattgaggataacgaaagagatatgacatgcatggtggggttgtgacttgtgagatactgtgagtctggaccaacttataaatagtttacagttttttgtacggttcaaaataatgacaacaaaacaacctaagtcaaatctcatatcagtgacaaacaagttgattttgttataacacaaaatacttttgtgagacaaaaaacaaagagtgacaggaaatttgtgaaacatgggttaagatctcatttttttctgtgtattttagtctaaaatgtggaagcaatcatggcttatattaactttatagatctactgccgacaataaaaaaaaaatctttatagaatctttcgagtagaatgcgtaataatgtgttcctgtgactattacacattttctaaaaggatcaataataatgtgttcatgtaatttgccatgttaaacataactgtggtagaacaaaaatatatatatgtaaatactaaacagtactaggtgaagtccattgaacattggtttagtttagaagtcaggtcgagtaatccggaaattttagactctggaccagcccattattattggttcagaaaaagcgaaattactaaaatccggtttggaccgtcgaaccaagttacccacgaaatctcgagccggcttcgtttccggttagggttctaaatctgagatttccagagaactgtgcatatcttcatagtttctttgaatttcaccgtattcataccataaaaatgagaagaatcgtcggttcaatttcgagtcttgctaaagataagctctcttcatcttcttattcttcgtctagacaaattttcactgcgcgttcatcttcttggcaacgagatgcatcaagtaagctctcagaagcttctttacctggaaaccacataaaatgggcttcgcttggttcagtcagaaattcgagattcgcatctggttttacaccattgcagcaaaaacctttggattcaatcatggatttggccagagccaagactaaatcccctgaagaactcacttcgatctgggacgatgtaatctcaaaatttctctttttatgtgaaattttctgtctttcaattgcatttcgttggatcttactacattttcaatttgtcagtatcatttgggacgaggtcatattgggttaacgatgaaagctcagctttatcgattgttggagcaacgagcctccgagtggtaataacatcattaagccttgttcttgtttgattataatcctttgatcttttttttctttttctaattgatgttgcaaattgcagccgatactttgtcattccattgtggagaggaaatggttacataacaatgtttgctcaaggttctaactttaatcctccattatatatacatctttcatttccttgtgagaaatttatatgaaatggttacataacaatgcttgctccagatttgtggtagcttttaagttcagttaaattagtgagattcattagcaatggatcttcttttacttgcacttattttgtcagaacaaaaattagcgaactactgatcgcaagaatagtttatctgaaagttcagttaacttagtgagattagcagtggaaatgtttaacttagtcaggaaagaaattaacaaactactaatctcaagaacagttcatttacctggtgtgttgatatgtgaggctagatgtaccatttaattcatgttgagcttcattacaacagttatgtaactcggctgaagagttcattatgatcttatataaatggtcagttttattgtggcagttgaagcgcctcacatgatttttactggtctcgaagactacaaagcaagaggaactcaagcggctccttacctgactacaaccttctacactgagctttcagagacaaaagacttggtctttatccgaggcgatgttgtgttcacaagcaaactcactgacgaggaggctaaatggatcatggagacagctcaatcgttttatttgaacgactctcgctacaagctgcttgagcggttcaataaacatactcatgactttgagttcaaggatgtgttacaagctctggatatgcctcttctgtgattatcaggagaaaaaacttttctggcttttgagttcttgagacaacaacaccttgtattagaattttttttgtatggtaataagactatttcatgaccaaactaggtttggttggatacttactgtgttttgcttttataaataaacaattttgagtaaagtagtcattaatttcctttccaaatcgataactgatgtcaaggtgaagaattcgaacaggtattttcctccaaaaacaaacatcgggggtgaaattttgaagaaacgtcaagttcagtggcatttctaaagtttcatatacatgaaccggcgtcgttttataagatttttgtcaaggacaatagattaagctcacggtcttcttcttcaagctaaggaaggtcgtgagaaaagaaaaacacttctcaatctttctacagtcttcttcttccaaaagaacaccatgtacgctctttatcttctttctcccgcctttttcctgtgttacagagatgtgattacatgtgtatatagcttctcttttcctctattgaactatctgaatatattactcatctgcttcgattttttctcgctcttcttcagcttccttcgtaatg

SEQ ID NO: 11276 - DNA, 3000 bp, Unknown
  misc_feature (1)..( 3000): cDNA_ID_2702113_gDNA_ID_2214487_Annot_ID_133385 3000 nt of promoter + ATG
ggatgtgaattacaggtatgaagcttgatctctatttgaattcccgcagctagcttatggaatcccattcttgtccacaaatatcgcagctaaagcatcattatttgcgggaagaagtatcgctttctatacataaatcttggctgtcgcttcactggccatcttcttggtttaaacaattaatggcaagattgaggtggcaaatttgttcgcaaactaacaagttatgactttaatttgtaggatgggactataatacgcggacagaacgaaatttctcacccgaccactgggactacgcagacagttgacaaggtgttctatttgaatatcttacattggtgttttttgatgatcacgagaactaagtttactatatacttgtatcaattaaaaatgtcaattttgccatatgtagaatttattttcttacattgtctttctatgtttctagtagagacattgttctacttccgctctcccatcgaagataaagagagtgttttacatgtcaagtgaaggcaataatctgcttcatgaggttaactactctgcttttatatatacagaatgtcctagatatcttcaatgttatctctaatgattctgattccctttaagaaactctatcgttttagttctctacttcatttctttgttttgcacggtgtatttgacattgcaaatgtttggtgttatgtccattaaacaggtcttcccaccagttaacccaactgtcctagagcagttgagaagcgtggactgtatcgtttacgcaatgggatccctgttcacttccatttgcccatcactggttagcacccgcaataaatatgttgtgcaaaaatggtggattactaaatttgtgataactgttatagacaagtctttctgttcatcaggttttgcttggtgttggggagattatctcttccaggtcatgtcgtaaggtatgctgaagcttgtcaaaaatactaatgatggtaaaaatcaatctgatttcttctctctgtcacaggtacttcttttgaacggtagccaagaccgagaaacaagcaggttcaccgcttcctgctttgtgactgctatcgctgacgctctcaacagaactcatggagatactaatattcggctcaagaatcccgtgagtggttcttcacaatccacactctttcgatgtcttctttatcagacatatatcgatatccaagaacatcatttttgtgtgcagcctggatattacatcaacactctcttggtcccgaaagatggagaaatagcagtagatctcaaacaattgtctgaacaagggatatatgatgttgtcagtatctctttccttcacttgtttccaagtttatgtgcacaacaaacactcactgttacctccactctattgcagagagtcgtggagagtgttggtgacccgaagcacggtatcttgttcaacccgagctcactgataaacacactggccggtttggtggagtaaatagtgattctttaggccagagctagtttcttcttctacgcaattgggaccatgatttttttgttactgtttagtttgatcctttagtgaattgatatgaaaggttatgaatggtcaatgatcatattcttagctaaggaaagacaaacgcctctctttctctcggagttgtatcatatgttttttcttacacgttttacatataactactgtacagatgaatacagttcactttccaatgaaaccaaatgatgacatttctacataactatgtgtgcttttcattcccaaacaagcaaaggcatctttgtttctcactgtgtattaacatgtgtgcttttactaaaaagatgtattaaagcaaagcaaatgatgccagcaacaaacagagcgtgccctgagattggtagggccctaagcccatacaactttgttggccctttcagttaagtttagaaaagaatcacttgttcaataaccaatgttaattgttgaaagatgaatttaaccgaagatttctttacaagtttttgacacagtgatcataattttataatgctcacaagtagcagtacgtgactcttgtaagtcaagtagagagacataaatataccaaaatattaaacttgtatgatgacaatgacgcatccatttgagcccatgcttcattgctcctccattcagtgattgggcagacatataatatgtattgttttagacactttgtttctagtcattcgttgcggaaatgacaaacaaatcaactttttaacagaatttattacaaaaatatgtaaagtacacgccaaaagaaaaaagtgtactactttcataatttaacataaactatgctatttttgactaaaccttaagtgtttacatactacgaggatcctaaccaaaaaggaattcataaagtgtgatctctgaataataaaaagaaaactataaatatatggggtaaatagcttacttggtgagatttcttgaaataaaattggaccaagatcatgaattcgtgtttcgacgggttatagaactttaaattattacataaccaaccaaaaactgaaaaaggttactttagttattacaacaaaacaatcgacgatcaagtaaccccaaacgtggtgtatatcattaaattcttgattaaccactagacaagaggttttcgattttgatttcagtataattgcatatattgaacccaaagaagcaaaccacaaacgaaacaaattgcatataagaaagttcaggaaaaaaaatagtgaagttttttcttccaaatatcacggcgcaagtaatgcaaagtattaacatcaccccaaatggattcaagtcaagttgcattttcttacatacaattggatttcatggttcaatcctaaatctataaatactattccttctattctcacttcatcaccacattacaagtcaacaccattaatcataagcccatattaaaaacataattatttcctctattttccaaaacctaaatg

SEQ ID NO: 11277 - DNA, 3000 bp, Unknown
  misc_feature (1)..( 3000): cDNA_ID_1711228_gDNA_ID_2214487_Annot_ID_183550 3000 nt of promoter + ATG
ccggaggaatgatcagatgggttttgaagataagaaacaaagattgagtttttgtgggttatgttgcttgaggtgggtgagagattatggcagcttaaccgccgaaacgagagagagagggaaaatttggagattacaaaaaggtttttcgttgtaaaaagagaaaagagagactcggagacattgctaacaccgcaagccattccctttttcaatgtcatcattttaactaaaagtgctaagagaaaattacgaaaaagggcttggagcaaaaagaaaggtacccataacctacccatatggagcgaatcatgatccaaattagtcatttgttacttacataatttcccgaaaataaactttagtttttataagaatttgttagtgctaaacataaattatttaaaaagaactataaacatttttagtcatgtgtataacccctacttgtaatactatatttgtatgcttaagtcatctaatgagaacttactctgcttaatcttctactactagctactaaaacaaaaaacttctactacttgtaatattatatcatatacattttgcacaaatatggagtataaaactagaagttaaagtttggatcattgaatgagcatttgaagacttctattataaaatagaaatgcgttacagtttagatagcgttaaagtttgaatcattgaatgagaatttggtcgtttgcgaggaaatagacttgttgagttggctacatatttattggagaacaaaactcccataaatgaggcatcaatacatacgtaacacttgtactcaaactctatagctgtgatttgtttttgtttttgacaccaactatatatgaatgatgatggtacaattcaaagattttcataatgaatctagtaaagcggaagtgtatgtattgccgtaatggtgtgcctctcgcatccttgatctatacaatcaagtttgatgttacaagagttgcataatatcttccatctacacacgctgcgtagtgtgtgcgcgtgtgggtgaatgtattcatacatctatatcttacactacttgaggacttgcacacatgcatgtggatgtgtgacttactccatcctcgtttaggcatatatacacaataataaatcatgcacaagcattttagatctgtgcttctagagttttggatctggctcccattaaccaaagcaatttatcaactcgaattcttttgtcgtttttcttgatactaacatataaatacattttatttataaactacagttcagacatatggatcgaagatccacagtactactccagtactccatacaagctaatacacagtattagaagtaatcaattcttatggtccttggtaggtatagtattattaaataagtgatgcgattagatcaatgcatgacttttagctggtcgtctatttatggatgctacctaaacataaatttaatcacatgtcatttattatttattattactcctaaattgttctgtccattaaatattttataagttgttacttgctactcctatcaaccattaatggtaatctttgacgcagattctatgagctatactattgcattgttttccatcatatattatcaatcacaagtaactcttcacaaaaaatggcggtcaataaagtgacacttacaaaactcaatggtttaaataaaaactacaacattgctgaaaaatatacataaattttaaacacgaaattggttaacaaaacaaaattggcggtcatctcatgtttttttttatatcatagtaaatctcgaaatgtgctttgattaaagatcagaccatcgaatggtgcactagcattctcatataatttgacatataaaatagtataagtaacaatatactaatatagtagtagtatattaatcatttgcataaatataaaacaagaattggtccaatgacccatcgatggcatcaatgccttgttcttggatgaaacgtggcatatacagtacggtgtcggattaagacatgataccataattagatatcgtatttttcgaaaacgtcaatatgttgttagttgattttatgagaggcaggtttttccaataagataatctttcttttatttaatcagaatccaactcattgactttgcaattgctgataatttattcacgatagaagagtattgatctgaagcaattacatagtgataaatctagtagtcattctaaattattaagatataaaatcaccaaactggaaattgcttcttctttttcttgttaacatcaaattggaaatagctataagagaagagtatagctaggaggacccatcacccatccatgatcaggctttaaatataatttcgatcccttcatgctgatggaccacactcttcccatggttttggataatattctagttatagtccatatcacattttacaccaaaaaacaattcttaagatttcaaaaaccattttacatttgagcccatgattattatatgtaaacaaaggttcagaatcatgcaagttaagatcaagtaatatcaccaagctctacgtttattcaacacaacattggaccttaagaaatctttatgatcttgtaaggtgaattatggattcatactaattaactaaaagagagtttgtatacgcgctaagttatcaaatttagagaacacaaacaacaaatgaacaaacacatttgtttggaaatctctaggcccaaaccaaacccattgaaagcccataagctcaacatcactgatctatttcttagtattgggctaatatagtcatatgtcaccaaagtccaaacaaagaaaaatcttcaagccgacaacccgatttccataaccggatagaccggattgtgggtaaggagtttatgcgggttgacccgatttcacaagcgtatctgtcttgtttaatttcgttactcgtcgtcgtcccttaactcgagaaaaattagggttacggattccgattagcaagc

SEQ ID NO: 11278 - DNA, 3000 bp, Unknown
  misc_feature (1)..( 3000): cDNA_ID_3039403_gDNA_ID_2214487_Annot_ID_183548 3000 nt of promoter + ATG
aatttttctcgagttaagggacgacgacgagtaacgaaattaaacaagacagatacgcttgtgaaatcgggtcaacccgcataaactccttacccacaatccggtctatccggttatggaaatcgggttgtcggcttgaagatttttctttgtttggactttggtgacatatgactatattagcccaatactaagaaatagatcagtgatgttgagcttatgggctttcaatgggtttggtttgggcctagagatttccaaacaaatgtgtttgttcatttgttgtttgtgttctctaaatttgataacttagcgcgtatacaaactctcttttagttaattagtatgaatccataattcaccttacaagatcataaagatttcttaaggtccaatgttgtgttgaataaacgtagagcttggtgatattacttgatcttaacttgcatgattctgaacctttgtttacatataataatcatgggctcaaatgtaaaatggtttttgaaatcttaagaattgttttttggtgtaaaatgtgatatggactataactagaatattatccaaaaccatgggaagagtgtggtccatcagcatgaagggatcgaaattatatttaaagcctgatcatggatgggtgatgggtcctcctagctatactcttctcttatagctatttccaatttgatgttaacaagaaaaagaagaagcaatttccagtttggtgattttatatcttaataatttagaatgactactagatttatcactatgtaattgcttcagatcaatactcttctatcgtgaataaattatcagcaattgcaaagtcaatgagttggattctgattaaataaaagaaagattatcttattggaaaaacctgcctctcataaaatcaactaacaacatattgacgttttcgaaaaatacgatatctaattatggtatcatgtcttaatccgacaccgtactgtatatgccacgtttcatccaagaacaaggcattgatgccatcgatgggtcattggaccaattcttgttttatatttatgcaaatgattaatatactactactatattagtatattgttacttatactattttatatgtcaaattatatgagaatgctagtgcaccattcgatggtctgatctttaatcaaagcacatttcgagatttactatgatataaaaaaaaacatgagatgaccgccaattttgttttgttaaccaatttcgtgtttaaaatttatgtatatttttcagcaatgttgtagtttttatttaaaccattgagttttgtaagtgtcactttattgaccgccattttttgtgaagagttacttgtgattgataatatatgatggaaaacaatgcaatagtatagctcatagaatctgcgtcaaagattaccattaatggttgataggagtagcaagtaacaacttataaaatatttaatggacagaacaatttaggagtaataataaataataaatgacatgtgattaaatttatgtttaggtagcatccataaatagacgaccagctaaaagtcatgcattgatctaatcgcatcacttatttaataatactatacctaccaaggaccataagaattgattacttctaatactgtgtattagcttgtatggagtactggagtagtactgtggatcttcgatccatatgtctgaactgtagtttataaataaaatgtatttatatgttagtatcaagaaaaacgacaaaagaattcgagttgataaattgctttggttaatgggagccagatccaaaactctagaagcacagatctaaaatgcttgtgcatgatttattattgtgtatatatgcctaaacgaggatggagtaagtcacacatccacatgcatgtgtgcaagtcctcaagtagtgtaagatatagatgtatgaatacattcacccacacgcgcacacactacgcagcgtgtgtagatggaagatattatgcaactcttgtaacatcaaacttgattgtatagatcaaggatgcgagaggcacaccattacggcaatacatacacttccgctttactagattcattatgaaaatctttgaattgtaccatcatcattcatatatagttggtgtcaaaaacaaaaacaaatcacagctatagagtttgagtacaagtgttacgtatgtattgatgcctcatttatgggagttttgttctccaataaatatgtagccaactcaacaagtctatttcctcgcaaacgaccaaattctcattcaatgattcaaactttaacgctatctaaactgtaacgcatttctattttataatagaagtcttcaaatgctcattcaatgatccaaactttaacttctagttttatactccatatttgtgcaaaatgtatatgatataatattacaagtagtagaagttttttgttttagtagctagtagtagaagattaagcagagtaagttctcattagatgacttaagcatacaaatatagtattacaagtaggggttatacacatgactaaaaatgtttatagttctttttaaataatttatgtttagcactaacaaattcttataaaaactaaagtttattttcgggaaattatgtaagtaacaaatgactaatttggatcatgattcgctccatatgggtaggttatgggtacctttctttttgctccaagccctttttcgtaattttctcttagcacttttagttaaaatgatgacattgaaaaagggaatggcttgcggtgttagcaatgtctccgagtctctcttttctctttttacaacgaaaaacctttttgtaatctccaaattttccctctctctctcgtttcggcggttaagctgccataatctctcacccacctcaagcaacataacccacaaaaactcaatctttgtttcttatcttcaaaacccatctgatcattcctccggaatctttctcaagaacagagcaaatg

SEQ ID NO: 11279 - DNA, 3000 bp, Unknown; identical to SEQ ID NO: 11276
  misc_feature (1)..( 3000): cDNA_ID_2702113_gDNA_ID_2214487_Annot_ID_183540 3000 nt of promoter + ATG

SEQ ID NO: 11280 - DNA, 3000 bp, Unknown
  misc_feature (1)..( 3000): cDNA_ID_3409184_gDNA_ID_2214487_Annot_ID_183539 3000 nt of promoter + ATG
ttttttttagaatcaattatgaaaatgccatttttttggatgacatttgtggatttttgcccttttttgaatagtttgtggattttgccatttttcaagttaccaaaataagatttaacatgcgttttattcattatgtttgggtttagttggttatggttgtttttagagtttagtattttgtgtaaactacgtatttttatcaaaaaaagtccgaaatccatatgtttttaaatcttagaaaatggcatatccgtaagattttagtaaaaatggcaatttcaaaagatctctataaaaaatggaaaaatcaataataatccttctttttgtcatgattggaccggaatgttaataatccaaaaagaaagaaagataggcttaatgagtatatgacaacaacaacaacggccattagttaccgtggtcggagttcaaaatttggtaagtagagttccgagttcgattcctctaacgactgcaccatagaggtgatagagtcatcactttcttctgatatagcttcgttctttttttcttttttgcctttttttttgtaatatatacttttcgagtattgaactgttgttgttttagaaatcggtgaaaagctcggtatgtgattttacaaggatttcatgaatagtttttagtctttttttttataaagctttatatagtttttgtctttacattttaatttcaattttctttttttttgcaaatgataattatatattaaactgtcatgtttttcacatgcagaaaagttactaaaaaaaatatatattattgtaaaatccgtcaaactatttagtttcgtatatatatataccatacgaccatcataatgttctttcgactaagtcaaaattcactatttaaatcaaaatttattacattttggtcatttgtgtttgattgctttaagtcgttaagttgcaggatctaatcttttttttttttttgtcaactttttggttccactgcaattgcaggatataatcattatatttattttcggtcagatcagaatcaaattatttataatgtaataaaaataaaaataattgtgaaataacatccttcttacatgtgaatactcctgtgaaaatattcctaaatatatccctcactattctaaaaacactaatcaacaaaacacaatcaattgatgactacaagtctaaaatagcatcaattacctgtcaatagtgctgtccatatgttataaaaatatttttgttcttcaaaattatatacacacttgatttgaaatatataatttaaatgaacaaatggcgtagaagcatgtgaaaattgattggaaatgatttaagatgtccctcgtgacaagtatagcaatagaatgtcccactaacaccattgattcatccacgggagccccacgaaaacacacctaaaatgataatgtggatgacttgagagatacttttttgcttgcaatagttattaccagaattaatatgacatcaaattgtggcaataatcagcactatataaagtatatatcaaaataagttcttattttccttcttatcatgatctctatcatttggtaggtggttaacagctcgattgtaaacgttacatgtcaaataagctgcatattcccaagaagggccatttttttttccagtcttttaaatatgagaaataatgcatttttgaatattttctctaaattgtttctagattactatttttgttatattatatgttgttttctgattggttacaacttataaatatttgccatttttcatttcacaaaaccatcacaaacagaagagacacaagtacacgtgctttgtgggaatttttttattccttactcttcaagcaaaatcacatttgactcttacatcttcttgagttttcgtacgttatacactcatttggttcatgatcaacaccagtcatgtcttagtcattctgttgaaaaatgtttcgaacacatacccgctcaaaaaaattctatacacagtatgtagaatatcagtcataaattcattacgaaacacttcaggaaaaaaaatgaatttgatcaaaaccaattaaaaagccaaaaaaaagaatactccaatttccaaatgttttaccaaatgaactacttcttgtagtactatgaactagtacaacgactgcttcaacagttttattttcattcttcgccttctaggaatatcgctttttgtttctcttcatctttttataaaatttattaagaatacatcaacaatttctttgtaatctttgccttagagactacaattaattgttactttgtcgttaatttatgattatttagcaacaattttgtcaaaaaataacaacgaagttaccaagggtgtgcaatatatcacaaattgttcggtttgttatagcaataaattttctgtcactaattccctcgttaccggatgcattttagtgatgcagttgtgaacttttgatccatttttagttaaaaaatctctgaaatttggtatgtttgagtgaaggaataaatcctttcattttggtcaaaaccattttgtggaaagtgaaaaggcacgattgcatcaaaaaatagaatttcaacttcggaaatgtattacgagaaccagaaatctaccaaaatagatggtcaagatgattgtccaaaagtatagaaatcatgcagatttagaagatcatcatacagtattttactttagaaatttttacattaaatttatctataaagattaatttattttttatttctatttaggacatttaatttacatgtcctaaacaattgttatttaggaaccgtaaatggacagcctaaatattcttggatttcctaatgaatgatatttttaacaaaaattgaacccatataaggccaagaagctcttcacactactttacctatgtatatataaactcgaatccatcacaaagcctattcaagttaagagaaaagaaaaaaaaaaccgttcttggaagatg

SEQ ID NO: 11281 - DNA, 3000 bp, Unknown; identical to SEQ ID NO: 11275
  misc_feature (1)..( 3000): cDNA_ID_1030987_gDNA_ID_2214487_Annot_ID_183536 3000 nt of promoter + ATG

SEQ ID NO: 11282 - DNA, 3000 bp, Unknown
  misc_feature (1)..( 3000): cDNA_ID_3039422_gDNA_ID_2214487_Annot_ID_183535 3000 nt of promoter + ATG
tgtttgacatgttctgtggcagcagtgtatgttcatccttgtacaaactccatcctgttgacaaaaagctttaatatatgtaccacagtctgcattgtttctcttgagtgatgttaatttcccttcaactccagtatattctgtggtccttggtttgaatgcaaggaaatgcataaaattgttaaaatgatagtattaccataatgagttatacaaacttgatagtgtctgctctgattaccatgtaaacactcaatcttagatttttctgtatcccatatggtgagtataatagtttgaagtatcaggttggacagccaaatttatatgagattatccatgtactgtgtggtattactcctgataataaatattgtttttcccagttttcagatacggaccatattgacaggttgatatcatgcctgcaactggctcttcccttttttgcggtatgaactcagaataagtgctgctagtagctggatagagtccattttataaacttgactggttgtcttactaactttccgttcctctgaacagagaggtgctccaagcagcaggtttcttatctatttgaacaaacatatcatacctgtttttgacaaggtatcgtgaatttcattgctttgttatttcacacttgtgtttcgtatcagcacatgatccctgattccttgtgtgctcttttaggcatctgttatctactctcttagacataattaagaatagcttatgtcactaatggtatgaagtaaaattctaatttattgcaacgtttatttaatccatatttgtaggtatatttgcttgtttctcttttgccttcttgcatgtaaatatccgtatctctacaaaaagggagctttcttggccaccatattaattccaattttttttcttaactagctcccagaagagaggaaacttgatttgctcaaagcacttgctgatatttctccatacacaactgctcaggaagcaaggcagctgcttccttcaatcgttgagcttttaaaggtacctcctttaagtgccagcatgtcatgagtcctttgagaaatagtttgtggacatccttgcttatattgtggatatcctactgcatccttacacttatgaatgcaaaagctttacatgtggtcttatgaagattgttacattctttgtttttagatatacatgcctgctagaaagactggagaggaaatgaacttcacatacgtcgagtgtttgttgtatgcgtttcatcaccttgcccacaaggttgccaacgacttcttattttgtgatttatcccgttctcttttttttcttccttgttttacttatctgattatgttatatatataggttccaaatgctacaaacagcttgtgtgggtacaagattgtgaccggccagccatcagacagattgggggaggacttctcagagttgaacaaagactttactgagaggtattattaattctttcacatgacatccgagtttttgcacgttgaaactttagtagaccgtcatttagagtagaaattttttggtaatgattaagtagaggtaggagggttctagttatgtgttttatgatatcttaaagtttttgttttgtgattcgccaaccattggtgcagattaaccattgttgaggatctaactaaggcaacgatgaagaaattaactcagggaatgactgagcacaacaaagccatgtcggctgctaagacagatgaagagaaagcgagtattgtaagtacattaacctgtgctattttctatttttcctagtgctatttgctttcagtactaatgctcctatgtgaattttttatttcagaaaacaaagaggcagaatactacaactggacttaggacctgtaataacatattggcgatgacaaaggtgaacattccaacatcttgtttttccccctttttgtcctttctttggtcgaagcatatagttatgatgatataaactaaacttggagttaattttgatatgaaacagccattgcatgcaaaagtgccaccttttatcggagacactaatctcaacctgtcttggaaagaagccacaaagccgttagcctcaacaacaacaacaattgggtttgtgcaaagtttactcaatccacaatctttctgttgtcttatatctatttgtaatttgttgtacctttgcaataatatacagaggaaagcggcctgctaatagcaacaatggaagtggtaacaatgttgcagcaaagaagggacgtgggtcgggtactatgcaaaaccagcttgtgaacaaggcctttgaggggatatcatcctatggagctggtagaggcggaaaccgaggttggggaagacgtggaggtggtcgaggaagaggacaaggaagaggtcactggtaataacaagtttccagtagaggattccatgactgtgtttctgtttctgtgtctgtctgtcagtacaagttttgattttggtacttagtagagtttggagacttctcttctcatatcagaatagatcatctgtgtttttctctgttcactaaagatatttcgagcattagaaaaaaagatatttcgagcatttatgaccttagttatacaatctttctagtctatagctacataacatgagaggtccattgcatgtctccttcatcccaagattacttccatggcacgctttagagttagcaatgactctccattagggtgtctcttaatcacaaacacactgtcttgtccaaatgaatggtcaaagctcttagttacgtataaagattacaaggggatatgtttttaaaaacgtaccattcatcatcttaataatttgttcatacgctttatcaaaacataatcctatcagtcttcatcgtactacaattaaccttaaagcctctatgtttactgtatatttaagatcttgtgcgattgtatacagaggaaaattatccgatcaaatccctattagatcttcgatcttacttccatg

SEQ ID NO: 11283 - DNA, 3000 bp, Unknown; identical to SEQ ID NO: 11274
  misc_feature (1)..( 3000): cDNA_ID_3039426_gDNA_ID_2214487_Annot_ID_183534 3000 nt of promoter + ATG

SEQ ID NO: 11284 - DNA, 3000 bp, Unknown
  misc_feature (1)..( 3000): cDNA_ID_3039430_gDNA_ID_2214487_Annot_ID_183533 3000 nt of promoter + ATG
gtttctagttcaactttcttagacggaagactagaacacactagttgtcttcgcaagtatatggtcatattgagttttgaatatcaatcaagtttgttattaaacaatgtttggcgttaattaataatgcattcttcatcatcatccatatactataatgtcgaaaagtgcaatgatggtcacctccttactttacatactacaagaaaagagactaattcttacggtacgtagaatactattatatacatatagtcaaatcttcaaaagtctatgcaaaagtaatattagttgttgatcctaggaggtggcttataagactactcttgcggggagttaatctctttaaagtcaagacaaaagcttacactccttttgaccaaaaaaaaaaaaaaagcttacactccttcgtgatttacggttgaagttcgagatccaaacttaaaggaccaataggaagcttatgtaccgggcggagtctccaaaacacgaagtagcaactcacacatgtgtcaggcgtgtaaacttgtcttgtagtttaggttcttgtttaaaagagatcgatggagggaagtgggaatacacttgtcatttggaaataagggaaaagagaaagtttgtattttgttagcgagaatgagctaaaactataatctttgagaagatttggtaaaacctctcaagagatgtggttttctctctaagtttaaaacttattaaatcgccttaacattcattctattttatgtttttcatatttactttcttctgttgcttgatatttctgttttgttcttgttcttgatatcaaaatctaaatgcatttttgattccgcttaaagttcgagtattttagagttcatcaatctgtacaattaaatttgtaaggcgtagctatcatgttctatacttctattactactaaagatttgagattaatttagatattttatgtaaaatttgacattaaaagatacacttaattattttatgaaacagaaaacaatcataaaatgacacttaattagttaatttgatttgagaggaagaataaactatacctacttataaatactttttttgcttacaaagtatacaatgttcattctctggatgatatctaattctcttgttttttcattttcatcacattaaattcagtcaggttttgatttcctagattagttaaatattgtagaattcaacctcatgactgttccttgttttctctttctcttgctagtctacaataactgtctctcttttattctttttcattttaagaatgaacagcttaatatcatatgttcagtattacctgattggttggccgattgttttatgacataacactatgtaatgagttatacacttatacttatatttaccatgcaatgggttactttactttgtacagttgacaacgtaacaaaagaatccattaacagttgaaaacatacatttcataaacccatttctcaacggatattgtcgaatcactattacagttgatcttataacgtgcgaaacaacacctagatttctgatgattcgttactcaatttaataatgctaaatttcgtaatatttaacctcaattaattttgtagcacagcgttcgaacgctgtctttgaaaacatagggagagcagtgtaatcagtaatgttctctataatcgaatcacaaaatcaatgtcaatagtatactatatgattatagatttctgaaaatattgggcacgtgatttgcgttggatcatcgtagggtatgggccatttacaagtaggaggtcaatttataaattatttgatacagatgacgcaaggatatacatgatgcatcatcattattgtattgtttacatattcaagaacaacaggaaaactaaaatttaacacacaaagataatttttattatgattctcgttttctttatataatagacgcagggattttgtatgggaactatgtgccaatataatgatataatctcatttctgaatagagaacacataacattaaacccaaaaatatctatatgagatgtgatgcatataggttgttttgaaaatttgtttccctagcccctagctagtaaggaaatacataatttagttaaaagttataaacattctaacagaaataaaagagtaaaagacaagaaacttattgactaatatttcacaagtgggttacatattttggctttggcccgcttttgttacgggaccatccatgatccatccatacaagtttcaatttctaaaataatgaatatcccccaaattttccgattaatcataacgttttctgattctcgccagcttcttgaaatagaaaattaaattttctacttataaaattttcataaaggcccctactcttaatataaattaacaaactaacaatttttctaagggtccctactttggctaaattgtagaaattgcattttatgtgtaacgtagatgattcagttttccttatttgtttggtcgatgatgaaatctctttaacattgatctcgaaaaaagaaagagaagacaactttcatttagtaaaattgttgaactgaaaaataaaagagataaatctacaaatatttaataactatggggttatgaaataattatggacttttcatgaaagcgaaacttattaaaaatgatctataaaaaaatattgttggtggaggagaatcacaatatttttccgagagaaaatcacggaaaccgatgtagattctctatctccaggttgttcactttctcattcatataaagaacaagaaagatagagatagagagatctaaagaaagctaaaaacatggagttttttttgaattttctttaaattcccacgacttttctcactacgcaagaagagcctatttcttctcagatcttacctttccttcaatctctcccatttgaatcatcattttgtttctcaaaaacaaaaaaacaaaaaaaatactttttctctgcacttgagaaca

SEQ ID NO: 11285 - DNA, 3000 bp, Unknown; identical to SEQ ID NO: 11273
  misc_feature (1)..( 3000): cDNA_ID_3039434_gDNA_ID_2214487_Annot_ID_183531 3000 nt of promoter + ATG

SEQ ID NO: 11286 - DNA, 3000 bp, Unknown
  misc_feature (1)..( 3000): cDNA_ID_2702109_gDNA_ID_2214487_Annot_ID_133386 3000 nt of promoter + ATG
gaaataaccaaaagtttactaatttcttttatacaatttacaaatctataaatttttcattgttatcacttaaaaattaaaatggataatatacaggcagttgtatgatatcaaaagtatatcggaagtcctagtcttatgtgttattttagaaattaggaaacgaaaaaaagttataaaacctcgttaaaacccaactcgttttttcctgcgctcattgttcctctatctctccaattcctccgaagcaaatcttcttaactaaaacttcctctcgcacgtggtttcgttttcattcgtaagttttcttttagcgattgtgcaattttcgagacattcaatcgtcgttctcgatcgttctaattagggtttccgcgactctttttaggccgcttaaacaatattaaggagattccttttattgactaaaattaagagttagataactgaattttggttttgaaacccttccctgttttcatacggtaccaggtcaggttaaattaaagattatgggaggcgtagaaggtaaccagtggtttgataagtttatggacgaagtcggattggtatttaccaaggttgacgaatcgatacagaaggtaagtactcttgttcttctggtttgatctttatttgatgtttatgccctaaaattcaagagtttatggttctgtctatgttgtgtggctaaaagactaaacctatgttcttttatcatcatcatcatcatcatcatcaacgcaaagtatatgctacgaattgatgtagataatgtattttagttattagtgtatttagtagttaaaacagaattaaggtttccaaggttcttttagatttttttttttcttaaacgatgaagagtataaaaaaaagttttgcataagatctgaaaatagaaagaccaagagatcatagaaagacagcttcagttccatcagatattttattagatttatggaaacctaattgatcacggtctaatccttttgaaaaccagaactattcatgatagttagatctttccataaaacaggcttcgattgtcaaaacttaccgtttacatgacaacttttctttgatttggtttttcttttctatattttcagagtattgaactctggacagagttaaccaaagacatatttgacgaccagcctaaccaagacttgaccggacagccagataatggtggatctggtgatgaacattcctctcaatatcctgtctctgaggtcaaagaaagaccgattcaacactggtatatgtgcctttctgacgtaaaagaaaaaccgcttcaacactggtctatgtgcattgctgaggtcaaagaaaaaccgagccaacactgggctatgcgtggtatgtgttttatatatagtatatattacattatagttattgtaaataccattaaattaaagtagctagaacatcagcacttttttggtttcttgactgacaagtatcatattgattttcttggcagcttcaaaattcccagagagtttcactcaagcacaaggtggtgatgattgttatgaaaattatggtgatggtgctgatggtattgatgatgatgattatgatgaagagaatagtgtaagtttgaagcacttttcccattttcatatcaaagctcattaactagaataagtaaatcaccatggattttgtataacggaattttggtaaatttaattagttgctactttgtttattgtctctgactgaatctttctgatataggaatcgagtttgaagtggaactgtgactatcagctgttaaagagtggctacttgtctttcgatgaagaagaagaagaggataatgacgatgaagaagatgttgacattttctccgaagatagtgatgattcatggaatgaggattttgatgatgaagatgaagaagcggatactacagtttttaaatattccgaaaacatgtcggagcttgatttgggatcagcgacgaattatacccctagttcctacgatcatcgtaatgaaaaagatagtgtaagtttttgtgtagcagtttttttcacatttttatacctatgctcatacaaaaactaggaaaatgatcatctatgaaatgttgttattttaatcagttgctgatttggttattgtatttgtgattagggttcaagtttgacgtggaaaggtggttatcagcagttatataatgttgacacgtcttccgacgaagaagatgaagaatcatgcgatgaggaggatgatgaagctggggaatatcactctgaagaagcgatggagatgtcgcgcgagcagagaatgagcgagctaaggaaagtgcttcatgacgatgaagatgacgtatcacaaggatttgtgaatgtgaggcgagagacaattgcgaagaatacggaatttggtgaggtcgagacccttttaccagatggtgattgggtttatgtgaagagtgcttagggctctgatcttttggcaaaaaatgtgtgtgatttgatcgagtttatactttacatcggctttaatgatatttatttgtgtagttttttgagtgtttcattcgtttttcacaaggcttatgtcactctattaacttggggtttaataccaaatagtgtactttttcttatcattattgtttgtcttctttgccattcgatcatgtgatcttttagattatcttaaggtacctttccagtggaatcatcgacatttggtctatacatgtattttgagctcaaacactaatgcaaaaccacaatcccaccaaaatcgatttaacactagttttggtttattggaccaaaccaagtagaaaaccaacaaaaccaccagtaccgtgattattttcttttctaacgcgtaataaatatcttttatggctttattatgcactctcattgcgaaaaaagaaaaatccaaaggcttggaaaatcgacaaaaacgaaaagggtagtggtgagatgtttcatcattctctgtttcagttcggtaatg

SEQ ID NO: 11287 - DNA, 3000 bp, Unknown; identical to SEQ ID NO: 11277
  misc_feature (1)..( 3000): cDNA_ID_1711228_gDNA_ID_2214487_Annot_ID_133393 3000 nt of promoter + ATG

SEQ ID NO: 11288 - DNA, 527 bp, Unknown
  misc_feature (1)..( 527): cDNA_ID_2717243_gDNA_ID_2214488_Annot_ID_133394 3000 nt of promoter + ATG
attaatttgtgctacttttctcttgaaatgttaatcgttattacagcctttttgaaaaaagttgagtaggtattgtaatagtatactttccacgtatgattgagaaaactcaaggtgaggcagagaggagccggtggggatctctcatactctctctttgtttacagagatccaattatcatatcgagccatgaactgattctgattcgatttggcaataattaacatttatcgtctttaaacgattaaataatataaattacattttaaatgaaaaggaccatgcatccaccaaggtgatactgactgcctaattataaatgtcatatcaaaatttattactatatggtttaacaaaaattcttatctgaattttttttctttttcttatctgaatgctttcattctaattaaagattttaatatatgaatattcgcacgtggatatttgtataagatatgcattaatctccgaggctatgtatagttcagaatttgaagtgaagtttaggagaggaagagagatg

SEQ ID NO: 11289 - DNA, 3000 bp, Unknown
  misc_feature (1)..( 3000): cDNA_ID_2702164_gDNA_ID_2214488_Annot_ID_133395 3000 nt of promoter + ATG
atctagagtaatataaaaaggatatgatcaatccactcttggcttgattttgaaattggaaatccaccaaacttaacaattaaattgtacggcttttaagatatgtattctgtcttgcctaacaattaacatattaaagaagaacaagattaactacttagattcactttttaaaatgtgccgaaaacaccttatatttaaacacgatatttatgcctttatttttgattaccatctcgttccaggggaaggtccaaggatgtatatccggggtaagggcttttgctcaagttgtggctccatttgtatatagtccattgacaggtaagtgaacacagtatcactaagtgaccaatgaacaccattcattaataactatcattaataaaacgttattcatcactaataagttttatagcgttcattggtcaatatcgagaaaataaagttttatttcctttaacaaatatttattttggtttgatatagctctatttctctccgaaaatgcaccattctatttccctggattcagcattctatgcatcgccatctctttggtattctttacatctacaaccatatcatcagttatcacaattatatgtttattattaataatgcatgacataatgacattgctttacatgcacagatgatcggattccttcagagtcttctgataaaagatcatccttctttgcccttagtgaacataacaatcaacaacccttcaaaagcggaagcttgacaagaaatatatcaagaagcaaatgtaactgtaatattgtacaaatttgcttcaaattaaaagttcatttaaaacgaatacatagctagaagctgtaaaaataacttagttttcttacaaagattgtcattgcaaatgaataaaatcacttgtatagtagttgttggcaactaagtacaaccggtcacatcaacatacatcaactaagtaaccaaacaaatataaccgtaaaaacaaacaaccgtaaatattttagagaagagatgcgataaaaagacaaccgtagaaaaataaacgaaaatatttcaacaaaagaattagatgaaaagacacaactgaaaaattaaccgtaaatattttaacaaaatgttgcattgacacaaccgttcataaatgcaaaaaggattgggataaaaagacaaagctttttatatttcaatgaaaagatgtaataaaaaagacaaaacaaaaaaaaacgtaaatattttagtaagaaattgcgataaaaagacacatccgttcgtaagtaaaaagacattacgataaaaagacacaaccgtaataaaaaaacaataaatatattaacaaaaaattgcaacaaaaaaacacaaccgtttagaaatgcaaatgacattacgataaaaagatgcaagtttcggggagaattcgcaaaacttcatgaaaatacgcgataaaaagatataacaaaaaagatcgtaaatatttcaacgaaaatttttcgttaaaaagatacaaccatttagaagtgcttacgaaagaaacgacacaaccgtaaatattgcaacaaaaagttgcgagattaaaagaaacaaccttataatctctttgatcatatgaatggaaaactaaatctttgcacacaaaaaaattcaggattttcatattattttcatgggatttttgtttaaatgggcacatttcagccaaaaaaataatgagagggtacattcttgtgggcttataagaatgagtacttatttggctaagaaaagacaatcttgtcaatactctttcttctttctttttttttttttttttttcttttttttccaaatgcttcatagatctttttctcccttattaattcaatagatccaattaaataggtttgtatataaataaatctatatcctaagggaataatgcttagggaacccaaagatttcaagacgcagattaaattaattttacatttgatcgataaatatattggtcggtggattttgattcggactgaaacttgtcaccagtttaggagtcgaggaaagagatgaaggcagtgtcactggtttttgattagcaaagactgaagatggaaggcgttaacggcggaaatgaggatcgacggtaggatatgttttcgatttgatagaacgatgtctaataatcgctaagtaattcaaaaacagatgttcgatggtgtatgtgtcatgttgtgatcagtttacgaattacgattagggtgaattgagagacaaatcggaactggagattgagggtgaattgtagagacaaattagacggttaaatgcgaataataaaaaagataaaaacgtcaatactgtgagaaaaatacctaattgcagtagcacatgattttgtgcctatttctacaacggcatacacttttgaagtgctttatttgtaactgatccttattttcatgcatgtgagtgatatcaagttgtactttgttgttttgaaatgcctagaaatgacaaaagcgtgtgggaatggacataatcgtttttacaaaattgtgggaatggacatgatccttatttatggtttgtacgcgacggataaatttttatttaattacgtaatcgtctggatttatatatctttaatgcagattgaaatatggcagtaccaaattttttgcatagtcttaacttcaaatcgatcgtagttattacaaaatgtcacataattcgtaatgtgtaattaaaaggtactccctacacaagagatggtgactaatgatcgagtcggccagaaaataccaaaaaagtcctcaaaagtctgatgtgatctcccatgcttcaaccgaatttttggaataaagaatagattggaaaaatatctgccacattgtagtattttcaagtaagctttctttgtttgttcaataatcaaaagcaaaaacaaaaacaaaactctcaacactttttgtgtttattttctgttattttgaatcgaagtcggcaagcataggctaaaaggtg

SEQ ID NO: 11290 - DNA, 3000 bp, Unknown
  misc_feature (1)..( 3000): cDNA_ID_2717235_gDNA_ID_2214488_Annot_ID_133397 3000 nt of promoter + ATG
cgaaccaaatctaactgaacaaaccgaaataaaccgttaccgttttgtctgatatcaatattttaatgtccatgaaaaatggatctaaaaattcggactttttaaagatgagattcggacacaacccgagatcgccacaatttccgcaatttacttgatcaggaaagagagactccgttgatggctaccaccaccgtcgtatgcggcggaggaggagatgttgagggttgcgatggcgagagaagcctggatctgttaccggcggctctcttggagactattatgacgaaactcgatgttgcgtctctctgctcgttggcttctacttgcaaaacacttaagagctgtgtcactcgtgttctcaccttcactcccaacttccacatcttcgtaagtctccacatttctttaagggtttgatttggatttcgatttcaaactgaaactgtataaaaagttttagtctttttggatttcagaatgtttcattgtcaatggaaactgttagaccattgttgtttccgaatcaacaactttctagtctcaagcttgattgtggaaggcttggtaattcagctattgatatattggtacgtccttctttgagggagatttctcttcacaattgtcgggatttcagcggagatctcatctccgaaattggtaggaaatgcaaggatttgaggtatgtgtgtgatgatgcatctgctataatatgaggaatctttctgttgctgtgtctgacggattggtaaacttcaggctcctatgtttgggttcagtagcagagaaagttggtcgaagtattagccgttgtgctttggaggatttacttaatggttgctcccatttagaggtttgaatccttaatagattctcttttgatcttattatctagtgttgattgtctgtgtaatggaatcatgccatatgtgttgtatttggcaggtcttagcactcatgtttgacctctcattgtatctgcgtcctggtgatggtcgcatttttggattggtatctgatagattgactcatctggagctaggacacatcacgtcaaggatgatgactcagctactcacatcaactgaaatctcggggcaagacagcaaccgagttactacatctactgtgctacaaaatgtccagcggttgcgcctctcagtggattgtattactgatgctgtggttaaggcgatatcgaaatctcttccatctttgatagatttggacataagagacgcgcctcttgaggatccaagacaagtatcagacctcacggattttgggcttcatgagatcaatcagaatggtaagctgaagcacctgtctctaatccgtagccaggagtttcaccctacttacttccggcgagttagtgatcaaggaatgctttttcttgctgacaaatgcttgggaatggaaaccatttgtcttggtggcttttgtcgggtaacagatgctggtttcaagactattcttcactcttgcgctagcctctccaagtttagtatatatcatggacctaaattgacggatcttgtcttccatgacatcttagcaactactctttcgcttagtcatgttagcttaagaaggtgccatcttcttactgaccacgcaattcaaaagctggcatcaagtctcaagctggagaatcttgacctcagagggtgcagaaacctgagggatgaaaccttgacagctgtatctcatctgccaaaactgaaggttttacttcttgatggcgctgatattagcgacacagggctttcgtacctaaaagagggagttttggactccctagtttctttatctgtcagagggtgcagaaatttaaccgataagttcatgtctaccttatttgacggatcctcaaaactggcgttgcgggaactcgacttgtctaatcttcctaatctaacggatgctgccatttttgctctagcaaaatctggagccccaatcacaaaactgcaactaagagaatgtagactcataggtgatgcctcagtcatggctcttgcatccacccgggtttacgaagacgaatgtcctggaagtagcctgtgcttgttggatctttacgactgtggtggcatcacgcaactctcattcaaatggctaaagaaaccgtttttcccgaggcttaaatggttagggatcacaggaagtgtaaacagagatatcgtagatgctttggcaaggagacgaccacatttgcaggtctcttgccgtggagaagagcttggaaatgatggggaagacgactgggactctgcagacatacaccaacacatagaagcacaagaagatgagcttgaacagtggattcttggagacgaaggtgatgttgaaatggaggatgcagaagacgagagtgaagaagacgcaagtgaagaagactgataattctgaagctatttgggtaaataccaattctcgtcatctttacttgaggttttaattcttttgatgttctttttttctttcttagttcttatggttattgttgttattagtgttgtgttgttgttgttggtgatgttgttgttctaatcatctcttgtttctttaactctggtcttgattatttgaataaaggatatctagagattgtgttgtgtgtgtttttgtaataattagagtttgataaaagaaaataaaatatttaaggtgaaatagttttggattttaattatcatttttggttcaatttaatatgaattttatttgctatactataaagatttgaatctcttataccagtattgatcatagtaagttaaaaaaacattatcgtaaataatataatagttgtaatttgtttataatctcatgccattatgtacacgtaacgtttattcctaattaacgtaagcttttgtaccatgcatcacaacaatcggcgaagtttttgtttcttttttctaaaaaatcgtaattttgttaagcaaatttttcttcttagatttaataataacaattaattttcaaatg

SEQ ID NO: 11291 - DNA, 3000 bp, Unknown
  misc_feature (1)..( 3000): cDNA_ID_2717227_gDNA_ID_2214488_Annot_ID_133399 3000 nt of promoter + ATG
cgttacgtgtacataatggcatgagattataaacaaattacaactattatattatttacgataatgtttttttaacttactatgatcaatactggtataagagattcaaatctttatagtatagcaaataaaattcatattaaattgaaccaaaaatgataattaaaatccaaaactatttcaccttaaatattttattttcttttatcaaactctaattattacaaaaacacacacaacacaatctctagatatcctttattcaaataatcaagaccagagttaaagaaacaagagatgattagaacaacaacatcaccaacaacaacaacacaacactaataacaacaataaccataagaactaagaaagaaaaaaagaacatcaaaagaattaaaacctcaagtaaagatgacgagaattggtatttacccaaatagcttcagaattatcagtcttcttcacttgcgtcttcttcactctcgtcttctgcatcctccatttcaacatcaccttcgtctccaagaatccactgttcaagctcatcttcttgtgcttctatgtgttggtgtatgtctgcagagtcccagtcgtcttccccatcatttccaagctcttctccacggcaagagacctgcaaatgtggtcgtctccttgccaaagcatctacgatatctctgtttacacttcctgtgatccctaaccatttaagcctcgggaaaaacggtttctttagccatttgaatgagagttgcgtgatgccaccacagtcgtaaagatccaacaagcacaggctacttccaggacattcgtcttcgtaaacccgggtggatgcaagagccatgactgaggcatcacctatgagtctacattctcttagttgcagttttgtgattggggctccagattttgctagagcaaaaatggcagcatccgttagattaggaagattagacaagtcgagttcccgcaacgccagttttgaggatccgtcaaataaggtagacatgaacttatcggttaaatttctgcaccctctgacagataaagaaactagggagtccaaaactccctcttttaggtacgaaagccctgtgtcgctaatatcagcgccatcaagaagtaaaaccttcagttttggcagatgagatacagctgtcaaggtttcatccctcaggtttctgcaccctctgaggtcaagattctccagcttgagacttgatgccagcttttgaattgcgtggtcagtaagaagatggcaccttcttaagctaacatgactaagcgaaagagtagttgctaagatgtcatggaagacaagatccgtcaatttaggtccatgatatatactaaacttggagaggctagcgcaagagtgaagaatagtcttgaaaccagcatctgttacccgacaaaagccaccaagacaaatggtttccattcccaagcatttgtcagcaagaaaaagcattccttgatcactaactcgccggaagtaagtagggtgaaactcctggctacggattagagacaggtgcttcagcttaccattctgattgatctcatgaagcccaaaatccgtgaggtctgatacttgtcttggatcctcaagaggcgcgtctcttatgtccaaatctatcaaagatggaagagatttcgatatcgccttaaccacagcatcagtaatacaatccactgagaggcgcaaccgctggacattttgtagcacagtagatgtagtaactcggttgctgtcttgccccgagatttcagttgatgtgagtagctgagtcatcatccttgacgtgatgtgtcctagctccagatgagtcaatctatcagataccaatccaaaaatgcgaccatcaccaggacgcagatacaatgagaggtcaaacatgagtgctaagacctgccaaatacaacacatatggcatgattccattacacagacaatcaacactagataataagatcaaaagagaatctattaaggattcaaacctctaaatgggagcaaccattaagtaaatcctccaaagcacaacggctaatacttcgaccaactttctctgctactgaacccaaacataggagcctgaagtttaccaatccgtcagacacagcaacagaaagattcctcatattatagcagatgcatcatcacacacatacctcaaatccttgcatttcctaccaatttcggagatgagatctccgctgaaatcccgacaattgtgaagagaaatctccctcaaagaaggacgtaccaatatatcaatagctgaattaccaagccttccacaatcaagcttgagactagaaagttgttgattcggaaacaacaatggtctaacagtttccattgacaatgaaacattctgaaatccaaaaagactaaaactttttatacagtttcagtttgaaatcgaaatccaaatcaaacccttaaagaaatgtggagacttacgaagatgtggaagttgggagtgaaggtgagaacacgagtgacacagctcttaagtgttttgcaagtagaagccaacgagcagagagacgcaacatcgagtttcgtcataatagtctccaagagagccgccggtaacagatccaggcttctctcgccatcgcaaccctcaacatctcctcctccgccgcatacgacggtggtggtagccatcaacggagtctctctttcctgatcaagtaaattgcggaaattgtggcgatctcgggttgtgtccgaatctcatctttaaaaagtccgaatttttagatccatttttcatggacattaaaatattgatatcagacaaaacggtaacggtttatttcggtttgttcagttagatttggttcggttatagttaaatttgattcggtttgataaaattatggctcggctcggtattagattcgggtcgggtcgggtcaaatctcaccgtcgataactgttatcgagttttcatttctgaagttcaaagctattcaatttcatca

SEQ ID NO: 11292 - DNA, 3000 bp, Unknown
  misc_feature (1)..( 3000): cDNA_ID_2702160_gDNA_ID_2214488_Annot_ID_133400 3000 nt of promoter + ATG
attgtcaaggtttgggataacatatatgtatctcgtaagatgacccttctcaaaccgttgagttcttcaagaaactactttcctcagcatttacctcgtattttcgatatgtctaagtttacggttcgtgaattgtgtcgggaagtcaagctctatcatcctgattactactgtgtccctggacacacagctttagagttggagttggggaaaactgttgtcaagtacctaaatgatgacaaattcgtgttgcttacaattcttgaatatggaaagttagctgtgtttaggtcttgggatcgagaatggactgtgatcaatgattacataccttctcgttgtcaagatttgattatgttcgatggacgtttctttgctatcgactacaatgggaggactgtagttgttgactactcttctttcaaattgacattggccgctaatcctttgattggcggcggtgacaagaagtttctgattgaatcttgtggtgaaatgtttctggtggatatagagttttgcctgaatgaaaaaccggaattcacagggggtttctattcgtattttaatgagaccacggtcagttacaaatttaaattctttaaattagtggaaagagagaagagatgggttgaggttgaggatcttggggataagatgtttttccttggtgatgactccaccttttccgcttcaactgctgatattatacctcgctgcgtgggaactggaagcttcgtgttcttctacacgcatgaggaatccttggtggtgatggatgatcgaaacttgggagtgtttgatttcaggagtgggaaaacagagctggtaaacaaactccctgaatatgccaagttgttttggcctccacctccatggattactacttctcatgaggtcagtggtttccaatctctcaaccacccgaatagagtgtatttacatttgcatcttactacttcttttttaccgcttgtctcactaacttatgctcaaatatcttttgtctcagagtgttgaaaattatactggagaaacatcatcacaatcccaatcttgagtttaagaccttggagatgacacttcaacttgaatgacaatgtttatatgtatttttccaactcttgttttttcctaaacaatttgtatattcatctttcaaaagttttcttatgtctaaaccgaagtccgctatacaaagattttgaggaaaactggaaaagtgattttgtgttaaaatcgaattagttacgagaaataagtcccaactaaaacaagaactttatttcgatgaagcctgctttactttaagatggtgttgattggtgaaaaactgtaaagattggctatgcaaatgaagttgtaactgtgaatttaatcacttgaattcacaagttctcagtgaaacagagaagagtgcattaaaattttgtatgatatgacacaaccagtgaaatacagtcaccttgcagtaaaaaaaagctttatcatgtatgtggtgattttttttttaataaccaatcactttaatggttaaaaagttcattttacaatttacaagtttggttataaagtgtatattagatgcttcttattttgggaagtttcgttaatattgctgtgttctgtttactgaataatgttcggcatttgaagacaaaaaaactaaaagaaagtagctttttctgaagtttccgagaaattttcatatgtttgtcatatatattcttcctagccccactagtcgaactcacttgtttttattggtgaattgtttggtcttttggtaacaaagaaaacgatttaaaatctataaattttatatctacatatatctactttacatttattgaaaatacaagaaatattagagtttttttttcttagttgtaccatgaaattgaggtttgagtcgtgttgagttctttaaatggaggtgctccaaattaagaaaatatatattgggagtctctcacttagaaagtagtatgggaaaacatatctattattgaactgcagaatgttgattcaatgattaaagattccaacattaaaaccaccttaaagaaaaataagaagccggtgagataacaacacaaactattggtactacaagatttggctaaaataaaaaacacgttagtacataaccttataaaactaatgtaagaggctaagagttcatgcttttcttttagattacacataatatttaaaagctaaaatgaaatcattttaaagcctgaataattgtttttgtccattcatattattgataaaaaatgatgttacattttatttaattatatatatccacatcagtttttttcttagttttgactacaacaaaaaaaatagttaattttatagaaattttttaaaatatttgttttatgttttaggttgtgtccaacaaagacaaataacttcaagtctttggaggagacttcccaagtcaatctgagattaaacaaaatggtggaagtcccacaatcaaaaaagttatattcatttttcacactaaaatatgatcaaactaattaattacaaaaaaaaaagaagaagaaaaaaagtggagtaaacagaagaaccaagctctggtccaatcctcatatgaccatttctaattctcttaagataaaaccgtgtgggttccatccactttgatcaagacctttcttcttctttcaagtaaacatcacaaacctttaagaaatatgaaagaaaataaaacacattataaaaaatctcacaagacttcaaatttcaatatgttaaatcattcatgcctccacatacagtatttttatttttctctcttgacttagtcttctccatcaaagtattgccccacaaagaaaatctttcacaacatattcggtcctagttgtatataaatgtgtattgattcacctaagtgataaccaccaacaactttttcacttacacagctttaaaaagaaccaaacctttataagtgttttttagacattgggagag

SEQ ID NO: 11293 - DNA, 3000 bp, Unknown
  misc_feature (1)..( 3000): cDNA_ID_2717212_gDNA_ID_2214488_Annot_ID_183573 3000 nt of promoter + ATG
tatttgacaaaacgatgttaaggttgtatcacaagattaacatctcaaaataacaaaaagtggtaaaccaaatagtggtttgaaatcacaaaaagggataggcaaaaagttgtgtgaaataacaatgacactataatggatgaagatgaagtcaccttttaagtgtttgatgtgtaagtgttttgaaaaacaaacaactatcatagtttcatataaaattttaagtgcatttaaagattaaattatgcaatttaacccaaaaataaacaaattctcaaacaatatcaaatctacatttttcaaatgagattcaacatagatatggtcaaactttcaaaacttagaataatcttcaactattatgattataaaagtttaacctctataagaacataatataataataaattcatgcaacgcgtgagtattttttagttcatttaatcacactaataacatgtacaacatactaccatcaacaaaagattgtgtcgtactaaaaaataaaaattataacaccaaggaaagtaaaaaaaaaaaaaaaactaattgacttatattaatggatgaaaacccctaaaccattcacctacttatctcattcgttgttcgcctagttaacaaatttgatattgttcaatcaattacatctgagatatcttaaagagaaaatggtttattagcttgtttagtccattacatgcaaaagtatctaaaactcctgaaagtgaagacgacatcaacaacaactatgtcaaacccatataaagaagaattgtaacctcctagtgtttctcctgatcgataataccaacaacatataatgtcttacaaacaaccttactattagagttcgtacttctacgtacaaccatataatcatcaattttatgctcataaaagcattggttgtggcttttgggactttgaaaccttggacatgccacaacattttgatctcgcaagtctatttaacacagtaaatggagcagtaaagaagctgaaccactcttattcgattagaaaatttcatgctattaggatgccacaaagcattttgaaagcaaatatttgccaaatataactatatttttcaaataagctagatttctagtctttgaacaaaggatgcacaaaacgacatttgttgtgaaatagagggagtaataatttttttttttagctcctttagattcaatgaatcatatggttcgtagagaaattaaagttgaggttttgaagtgaaaatgataaaactttaaatagttaggtgatataaacaaaaaaactaaagcatggttcaactatagtttgatttttcaacctcaaagcttagacagtggtaggagaaaagtgtatcatttcacgaactctcacaaatatatctcctaaccgaatatttaaactgatttcagaattacatacatataaagtaaaagtagcaaatagataaaagagttttaaatagagatattcttttccgtacaacatgattccaaccttaaaataattatgtattctagaatctactagccacataatggacattcatataaaaataagattattaatattaataatttttatattttttttgctgcaacttttttggagggtggataaagtccattcaagtacaaatggtacccgtccattaaagcaaatttgttcattaaaaatcttttggattgggttacgtaaaatgcgactatattgccctagttcttttcatatttggttaagatttaaaactgtaaatctccattcatctttgtttgattttttcaactgttttaaatcatcctataatatataaagttatgaaaaactcaatctttttctccctatattgtgattcaaaattaaaaaaacggacatatattacccaattaatggaaatgatgtgtgttcaatgtcccacatcgactaaaatattcagataatgatttagaataatattatatatatgattaaaataaattcaaattcgaatgtataggaaagcttaccttaacaagcatccaaatttaaaattttgtatatgatttaattcagtctttagttttattgtttagttttaccgagaatattaaaattttctaatatcaataaaaggttttataacattataaacatttgaacaaataaaaataaaataaataacatgggacaaattgtattgtggtatacagttatatggtgagatgaatttttgaatcaacattaataaaatttagaatatcatcaatctgccgctttattatttttaatactaccaatattagaaatatctaaacaacctaattaagataagattgtatataccaaaaatttctctgtgatatacagttacttaataacaatcgtatattataaaatataaatttcttagaaaattttacaatttgcaaacttatgtatataataaatagtcatcaatttttaaactactatttttagaaaacaaatcatgagatgtgttatattacagaacaaagttatatgatggacgggtttgaatcaatatttataaattttttgaaatcattaatatgttgtttcaatacgggttaaattctcagtttattaacaattgttatgtggacttgtgatatatttttacttaataacgattataaactaaaatagaaatattttataactaaatataatttataaaattttatatatacaaattttaaaatataaattgtcttgcagtttacagctaattaaaatttagttgtgatattatatccaattatccatataactacacttttttctccacaattagggcgtgacaaatggcaacacttcaatcaaggaacagaacacaatgtgaaaccagactgttctcatttattttccagcaagtcaaaaagtcaaactcaaaaagtcctctctcggtcaactttcttcttggtccccatcttcacaaatcacaactctttttatttccaaagaccaaaaacctgagaacacaccggcgacctgaaa

SEQ ID NO: 11294 - DNA, 3000 bp, Unknown
  misc_feature (1)..( 3000): cDNA_ID_3039466_gDNA_ID_2214488_Annot_ID_183566 3000 nt of promoter + ATG
gtcttcaccttcacgtttacaattgcatataattttatttaaataatatgttatatcggggacaagttcatatcgaatgagtgatcgaattagatagggaacaaatttagatcgaatggtagacaagataatatgttataactggatttttttattattttacaatataagaaaaaatgaataattcaaatcggtgaagacaataatgctcaactaatctgtagaccaaaatagatggtgaaaagtctaaataaaatttgaaatccttaaatgataacaattttgtggataagatgtgggattcatgataattttgaaagatgatgaaatcggagacaatatatagatacaacaaagaatttatgagaatttatgatgaataaattgggagacaaatttaattgaaagttacatgtagataatttgtgcaggttgtcaggggaagtgggtgagagaccaaaacgtttcgttttgtcttcggaaatataatgatgtatggttaaaacatacggatttcgaagaaatagagattaaatagagaaaaaatggtgaggacagtactgacatttcagatcgaaatgtggtatgatgtgtaagagaggaatgattgtgataaattgcataaagaattgagaataaatagtaaagtttataattttccctatattttctccgtttcaaaaaaagtatcattttaatttttttatcatcaaaataacttaattaaaatctaagttcaattatataaaccatacgtgcgttaacttgtttacatcggctgactcattcatccacaaacatggaaaagtcttgctctttcctaaatttgttaatgactatcataaacggtatcctaaaaactggggcggatcaaaaatatttattagctggggtatatatatattgttgggtttgggtcatattctgcatctttttggacagttgaatttcgtttcttataaaacttcgtttaattggaataaccgtgcgaaaagtaaaagtaaggatgaaagactcgtcgctagagattaaacatattgtaaaaaaaaaaaaaagacacatacatattgtccatttgaagcagcgagatattttgcaaatatgtacaatcgttatcttttattaattaattattattattttagaatattttaagttgtaagaatttaagtttttattataaataaccgttttaggctcttattgtattggattgtttttattaataaattaaagaacttttgataagctttgaaaaaaatattctcaaacgaagtttttaaagtctctgttcattggaatctattgatctccgataacactaaaattccgagttacgattatcctgcttgaaatccattgatactcaaatttactttcatattctatccttaaaagcttccgctaaatcaattggtatcagagcaaaaactacgtcagtgataggatacaaaagtaatattgacgtagcggaagtctaacagatatgttttattacaaacagatttgcatgtctaaatgtttgtcttttataaatatattttctactactaaaagttttttatatgcatcattattagtttgatttgtcttttaaaaaatattatataaacaaatttaaaatattttctttgagtcttagtttatttttagaaaattatgaaattatatattcataattatatttttttaaaatttatatttaaatatatattctctagtatcttgactaaataaaaaaatgaaaatttagttttcgttatatatttaaaatttggaattaatataaaatcaatcattatacattatatcgattaaatctgaaaaatttaattgtaattgttgtttcatatttgttaaattaaataatcaaattattattagtattaatattaattgataaaataataaatatttttattttaatttccttaatttgctaaagtttatgcaattactagctactttattaatggtttctcgattttttgtcttagataatgcctatatatatgaggtctctgtattatttttagagtatttataataaatgattatagatttgaaaagaatgtacaaactaaccttgagtcacagtatcttgtcggaaacatgttggagaacacgtgtaattacgtaaatgtcctttgtaacatgttatttttccgaaatacatgcgataacataatatcctctttttatcttgttattttctcttattacatagtatttgtaaaaaccacatagtattttttgtaaaaaacattctattcagtttaatatctcattttatcatgatattttgtagtaatacaagttttttattaagatcacacgtgatttctttaaaaatatattcttattttttagtaatacatggtttttattaaaatcacatataatttttgttttttaagattctgttcatgtaaaagaatttcataataatgttttttcttaaaaattcataacgttttttgaaatagcatatttttaaactaaatattacatgtgaaattttaatgttacatgctattttgaaaaattacacggatgtgtttcgtttactgttcatcttacaacaaatgaagggtagctttgttatttcctttcttccgacaacgtgggtccatggttattttgtaacaaaaaactttctctctactagtttcttaatttgtatgttttatttggttatctactaatattacccttatttttatatgcaagtatatattaatttatacataaaaaaaatagtatatgtcaatgtatacatgtttactaagtccaatcaaccattatttactttgcttcttcgtcttttccgatttttgtcaaaggtgctttcgttctcctttgatgtcaacttctaatatctagagaaaattcaatttaccaattgagattcaacttcctcttctctgcaggaaaaaaaaaaaaaaacttcctcttctttacctaaaggccaaaatcattatcggtggcacaaaggcgatg

SEQ ID NO: 11295 - DNA, 3000 bp, Unknown; identical to SEQ ID NO: 11292
  misc_feature (1)..( 3000): cDNA_ID_2702160_gDNA_ID_2214488_Annot_ID_183564 3000 nt of promoter + ATG

SEQ ID NO: 11296 - DNA, 3000 bp, Unknown
  misc_feature (1)..( 3000): cDNA_ID_3039473_gDNA_ID_2214488_Annot_ID_183563 3000 nt of promoter + ATG
gaatgatgttcgtcggagattccaactcatgttatctccaaaacaatttgcgacacttacggtaagaacaaatttactttgtaaattcatctttggttatcacagtaaatcaatcttttgaaattctagaatttctgaacttgaatttgacgatgacagagctgtaccattaattagtcgtcacactaatccaaattgcttaaccggtaccaaattatttaaccgaagtccggtattcggcgatgcggtctagtgtgttcggatgagtcataacgaatggataatgagtgatggtggataaggatttacggcaaagaaaaacagaggcaaattcgttaccagtttaaaaatggcggctttgatccagaccatccatggtggtaaacccaacttgtaaactctcttgtgttcttattgattctttcgatttcgctatctagtggtttaaaagttttccccttttttctgattactgttgtatagacaagaaactagaattgttgaaaacgaattccggtttaggttcttattgggtaaggtagaatccctaattgcacagtttctctcttaagttcacatctcgtgttaaagtacaattttttattcagtttctcagtgtagcattagtttctctaattgattggaattgaattgggcattttggcattaaacgtatgtaatttagcaattggttctcagtttctgattcaattcatcgatatgggttgatttcttggtctgtacttggttattcatattgagcactatacaatgcaggtgtggttgttaccagaaccttgactcttgtttatccttctacctttacgtccagacacaaagctctgaaccagatgacaagtagcagtaacagcggcttgcgacggttcctgttcactccgcctcagcggctaagccaaggtatctgttactggggagcagagctaagcaacaatgtgtcatggacttacaaaacgaaaatggttgttcgatccaaggccggagcagtgcctctgatgaagcatggcgaccggtttctctcctctctctcgtctccagccttagctggtgatccgtcagcgataaaccgacacattaagaagtttgtggctgcttcacccaaatcagttgctctcaatgtcctctctcatctcctctctgatcaaacttcccatcctcatctctccttctttgctctgtctgtgagtctttgcttttttttcctgtttctctcaataaaatattgatgaaggtaaatgactttatattggttgttgttttcttctccagttgtattcggaaattactgaagcgtcgtggtttgattggaatcctaaactcattgctgaacttattgctttgctcaataaacaagaaagatttgatgaatcagaaacgctactttctactgcggtttcgagactgaagtcaaatgaaagagactttactctcttcctctgcaatttggttgaatcaaattctaaacaagggtctatacaaggtttcagtgaagcatcttttcgtttgagagagataatccaaagatcatcatcagtttatgtcaaaactcaagcttacaagtctatggtttctggattatgtaacatggaccagcctcatgatgcggaaagagttatcgaggagatgagaatggaaaaaataaagccgggattgtttgaatataagtctgttctatacggctatggaagattaggattgtttgacgatatgaacagagtagtacacagaatgggaacagaaggtcacaaaatcgacacagtttgttcaaatatggttctctcttcctatggagctcatgatgcattgccccaaatgggttcttggttacagaagttgaagggttttaatgttcctttctccataaggacgtataactcggtcttgaattcttgtcctaccatcatatcaatgttgaaagacttggatagctgtccggtttctctttctgaactgcgtacttttctgaatgaggacgaagcacttctggtccatgaattgactcagtcatcagttttagatgaagcaattgagtggaacgcggtagagggtaagttggatttacatggtatgcacttgagctcatcgtatttgatattgctgcaatggatggatgagaccagacttagatttagcgaagaaaagtgtgtaattcctgcagagattgtagttgtttctggatctggaaagcatagcaatgtaagaggagagtcaccggtgaaagcgctggttaaaaagataatggtgcgtactggaagcccgatgagaattgaccggaagaatgttggtagttttattgccaagggaaaaactgttaaagaatggctctgcaaatgaagatttataactgtatattttgatcacaatttgcttaagattgatcaggaataagttttgcttggaatccaaatcaactcttggtgtcaaattttccaccagaactaatcaggtgagtcgaaattttctctttacactcttaaaattacctgcgtggtagtaaaattctgaatagctggttttagaataagagaaatctgaacaaaaatcatttcagttttcaagtatgtatgttaaaccctagagctctgtgaaattttaacaatagtttgtttgtttctgtttctggtgtatctttagctatattccatgaagtttctagtcttgaataatgtgtatagtttatttcaagcaatggctctggagctttagtttgtttaaaagtgcatctgctctagtcctttgatttggatagcaaataagtgaaagttcttgtccctataaggtttcttcagattaatggtattgatttctcttttgtcttcttaagatttttattcaagagagaatcttggatgtctgcttttctcattcaaaaatttgtcttcaaaaagtgatttttcatgcttgaccttgtccacctttgaactctattaaagtcaaccgatcaaatttgaagaaaaaaaaaagcttttcgtttcacccatg

SEQ ID NO: 11297 - DNA, 3000 bp, Unknown; identical to SEQ ID NO: 11291
  misc_feature (1)..( 3000): cDNA_ID_3039477_gDNA_ID_2214488_Annot_ID_183562 3000 nt of promoter + ATG

SEQ ID NO: 11298 - DNA, 3000 bp, Unknown; identical to SEQ ID NO: 11290
  misc_feature (1)..( 3000): cDNA_ID_3039481_gDNA_ID_2214488_Annot_ID_183560 3000 nt of promoter + ATG

SEQ ID NO: 11299 - DNA, 3000 bp, Unknown; identical to SEQ ID NO: 11289
  misc_feature (1)..( 3000): cDNA_ID_3039489_gDNA_ID_2214488_Annot_ID_183558 3000 nt of promoter + ATG

SEQ ID NO: 11300 - DNA, 3000 bp, Unknown
  misc_feature (1)..( 3000): cDNA_ID_2717223_gDNA_ID_2214488_Annot_ID_133401 3000 nt of promoter + ATG
ttctcctttgatgtcaacttctaatatctagagaaaattcaatttaccaattgagattcaacttcctcttctctgcaggaaaaaaaaaaaaaaacttcctcttctttacctaaaggccaaaatcattatcggtggcacaaaggcgatgacatacatggtgtacataagcttccacaaaggtgaagatagaatccggtactccttcctcagccacttatctgcctctcttcgccggaaaggtctgatctcttcatcgtcgtttgtccatcattcttccaatgagattaagatagagaaaacaaaattcaaggcttttttggtggttatctcttggaagtacgtgttatccgcagaatgcctcgatgagcttgcagagattgctgatcaaaatgtggtggtccccgtgttttactgcataactcaatcggacgttaagcatcagtgccgattggacattttgagagatacgtttccattggaggattactcagccgagagggtatcccggtggatatatgctctgaacaaaacgaccaaatcatataaattaaggtaacagtataaagattgcagacgctcaatttgttttgctaacttagagataccatcataccataccatgcagtcttccataacggatattttttaaaaagaaatatgaatttatgaacggatcatgttatttatactagttgtgtgtgctagatcactataaaaacaggtctataaatcagttgtgaaatccaatcaccagtgtttgatggttggatttctacagtcttattttgtttttgtaaagaccaagttctttccaatcgtgctttgccttttttgtttttactaaagttaaagcctaggaaaaagaccggtatgacttaaattttctactgcctaatacttttttttgctacaagtgctgtagattctgtttttttgtttttctctcctctaactttgtatactgcatccactagttcatgtctgtcaatttaataaattttaggtaatgaccatcctaatgcaaatgataattaatttgaaaatttatttataagttaaaagattatgtgtagggtaaaagaataacatggcataggcttgatgtatacaacatacccaatttatttgataattaagttaagagtttgtcctattattagttgacctcttctttaatataatcatataggattaggtctagaccccaaacccttgttgcaataagacttgaaaactctaattaatatggcatatgcttgacttggggattcggttcggttcattcatttatgtttgtttttctttggttttagagtttagcatctatgtagaaaccgaaacaattttggttcgattctagtgttttttgttcttaagtttaggacctatttacatatttttagtatttttgatattttgccgagtattttttggtatttcagatatttaatttggttattcgataaataaatagctagaatgtttggatcaataatcacatgttgggcaacaaaaatattttagttaggtttagatttagaatttaggaaccaattaagtgtataataattttggttcggttcttttttgttcggtttttatgtttcgagtattttgccaaggcctaggcttgacgtatacaacatactgtatgtctgtatctaatctttatattattaaaaaagaagtacatttgtacttttttccaaaatcgttcacttaataaattaccattaaaattatatgtcgaaagtgtttaattggaatgagaaatgataaatttggaattaaaacaattgaaagtgtcttatttcctttcattaatttagaaatatttcaaacctaacatcttgtttaatcatattttctaggacatttgaatcaatagatagtaataaataaaatactagatttttgtaaatgttgtgattcaaattttttaaaacaaacataatttacccaatcaatgaagaaacaaaagtgtgaattgaacgttccacatcggttaaatatattgtgtggtggttcaaagaaaattttataaaagaaattaaaaagattcgaaatctaatgagtagaaagcttgatttaatagatatccaaatgtctataatttttagttgctttaattagttttctttgaatcatataatttctcaaaaaaaaataatatcataagaatgttttttatataaagaaatctttgattttgttaagatttacatcataaacatatatatagaaagaaaccgaaatgtagtcaattgtttactaattacaagtttgaaagaacattttattgaacaaatagtaaagaaaaaagttaatcagaaacaataaataagaactttagaaaaatatataaatttgcactggttcataagttaaccaaattacaatataattaactattaatttgttgttcaaaaaaaaaaatttaactattaattaaaaacttttgtaatttagtgtaaaataacataagtaatatcttcaatatataaagatgtttctaataaattaaatatactcattcgatttgagaataatattttcaaaagagaaattatatagattcttataaatatataaattatatattttatgaaagttttgtaaaagtaaaagtaaatatgggttaatttgcaaacttttataaataaaaggtggtaattcaaaaataaaaatcgaatctattaatatttatttttagaggaaaacatagagaaataaattgaaattaaaacaacttatttataaagttcctctatgtagaagcaaaaatacatataagcctgcatattttagtttttttatcacattgacatcgtgcatggcatcttaacataatatgagtcgatgtaatggaattttgttcaagtagaaattggtcgttgtccctcattattatacacatgtttaagtttaattaagacacatatgttatcaccggaatgtctaactatataattgtgttggtctcaactctcaaggaggatg

SEQ ID NO: 11301 - DNA, 3000 bp, Unknown
  misc_feature (1)..( 3000): cDNA_ID_2717219_gDNA_ID_2214488_Annot_ID_133402 3000 nt of promoter + ATG
gaaaactaaattttcatttttttatttagtcaagatactagagaatatatatttaaatataaattttaaaaaaatataattatgaatatataatttcataattttctaaaaataaactaagactcaaagaaaatattttaaatttgtttatataatattttttaaaagacaaatcaaactaataatgatgcatataaaaaacttttagtagtagaaaatatatttataaaagacaaacatttagacatgcaaatctgtttgtaataaaacatatctgttagacttccgctacgtcaatattacttttgtatcctatcactgacgtagtttttgctctgataccaattgatttagcggaagcttttaaggatagaatatgaaagtaaatttgagtatcaatggatttcaagcaggataatcgtaactcggaattttagtgttatcggagatcaatagattccaatgaacagagactttaaaaacttcgtttgagaatatttttttcaaagcttatcaaaagttctttaatttattaataaaaacaatccaatacaataagagcctaaaacggttatttataataaaaacttaaattcttacaacttaaaatattctaaaataataataattaattaataaaagataacgattgtacatatttgcaaaatatctcgctgcttcaaatggacaatatgtatgtgtcttttttttttttttacaatatgtttaatctctagcgacgagtctttcatccttacttttacttttcgcacggttattccaattaaacgaagttttataagaaacgaaattcaactgtccaaaaagatgcagaatatgacccaaacccaacaatatatatataccccagctaataaatatttttgatccgccccagtttttaggataccgtttatgatagtcattaacaaatttaggaaagagcaagacttttccatgtttgtggatgaatgagtcagccgatgtaaacaagttaacgcacgtatggtttatataattgaacttagattttaattaagttattttgatgataaaaaaattaaaatgatactttttttgaaacggagaaaatatagggaaaattataaactttactatttattctcaattctttatgcaatttatcacaatcattcctctcttacacatcataccacatttcgatctgaaatgtcagtactgtcctcaccattttttctctatttaatctctatttcttcgaaatccgtatgttttaaccatacatcattatatttccgaagacaaaacgaaacgttttggtctctcacccacttcccctgacaacctgcacaaattatctacatgtaactttcaattaaatttgtctcccaatttattcatcataaattctcataaattctttgttgtatctatatattgtctccgatttcatcatctttcaaaattatcatgaatcccacatcttatccacaaaattgttatcatttaaggatttcaaattttatttagacttttcaccatctattttggtctacagattagttgagcattattgtcttcaccgatttgaattattcattttttcttatattgtaaaataataaaaaaatccagttataacatattatcttgtctaccattcgatctaaatttgttccctatctaattcgatcactcattcgatatgaacttgtccccgatataacatattatttaaataaaattatatgcaattgtaaacgtgaaggtgaagacaataacgttcaactaatctgtggaccaaaatagatggcaaaaaatcttaataaaattcaaaatctttaaatgagaacaattgatggacaagatgtgggattcacaataatggagcaagatgatgaaatcgaggataagacatagacgcaacagagaatttctattctgggacaagatctggagacaaaaacaaaagtctgtcaccaattgtcttttatctgatacattagtctatcaccatcaagggcaatttcgtccacaaatgtgcatgtgacaatgaaatgtggtagattttgtaagaggaggaaactttttgtggtaaagattgtaagaaaactccaaaaaagtggtagattttacaagattctcgaatatatatatatgctcacgcatacatttaaagagtcacaaaaacaatttagttgttattataaaaatattatcctctattttgttattgttacttaaagagtcataaatagaattgacgttattttctaattttgagcttcataagtagtggtgatagttagtttgtttcaaagattttcttggcagaatggttgagttcttgttttcaagtttgaatctgtatttataagggaggtcggtttcatgtcgaggaagatcataaaccaatggtccaaagattgcattaaagataaattaaaaaaaaaaaagagagaaaaaggggaaaactaagaagttgtgaccttctctttcttatgctcgaagagacaattagtttcctgacataattgtataagcaagtggggcatgctctacggaaggttgacgcagttctcttcttacttgtgatttcttttgctcttaatttaaaatgaaggtctatgttgaaatggtccatatgttattatattatacatgactttttaagttgaataagtttacaaattgatttgcatcgtctatcaaaaaaagattccaatcatgaaagaaagtcccactttgagaagatattccatggaggcctcacggcaacctcaagtgttcatcaacttccggggaagtgaactacggtatacctttgtctactatctcaggacggccttggtaaaaaacgggatcaacgtttttacagacaacatggagccgaaaggccgtaaccagaaaattttattcaagagaatcgaagagtcgaagatcgcactggcgattttctcctcaaggtatacggagtcaagttggtgtctggaagagctggtaaagatgaaagaatgc

SEQ ID NO: 11302 - DNA, 3000 bp, Unknown; identical to SEQ ID NO: 11293
  misc_feature (1)..( 3000): cDNA_ID_2717212_gDNA_ID_2214488_Annot_ID_133407 3000 nt of promoter + ATG

SEQ ID NO: 11303 - DNA, 3000 bp, Unknown
  misc_feature (1)..( 3000): cDNA_ID_2717204_gDNA_ID_2214488_Annot_ID_133409 3000 nt of promoter + ATG
aacctgaaattttggatcttttgagttgaaagtttgtgactttagtagttttattggatatatctaaatgggtttggattggatgatggtttagatgaaataaacgaaaaaatttgattgaaaagtctttgacttttagtagtttcattggacaaaccaaatctaattaggtttgagtttttattactaattggtgattggctttgaagaaaagttatgaactttgaactttattttgcagcttgtagctcttctgtgaggaaggactcgttggatgctcctctgcttctgtctaacaactcatacgtcttcactgcaaacaattgcgtcaagtgtacttgtgacgctttgaagaattggacgttaagtgattgataatctcgttgtgtttgtcccataggataagcttgttcttttttcttctttttctagattctgatggttttggttttgtatcttgtgatcagtttaagctgtcaatcatcatctgagattaagccttcgaactggcaaacctgcccaccattttcacaatgtgatggagctttgcttaacgcctcttgcagacaacctcgtgattgcgtctatgctggttactccaaccaaaccatcttcaccacagcttccccagcttgtccaggtttgtttgatccaagtttctgcgcatttggttatagtgtagtgtaattaagtgacttaataacctggttactctctgatatgaacagattctgctggtcctgataactatgcatcaacgctcagctcaagcttcaatttcgtgattgtgttgattcagtgtgctctgctttgtctctgccttctctagtaatgttttgttgtgtgtttatgagtgtgtatctaagtacagttcggattaaaataaagacattgtttcacctgaagcatcacgtccttgtaccatttttatattggaaacatttcagcttttgacacattttgttaccaactaaacaatacaaaactttgacatgaagttaaacataattttcattattcaaaaaataatgctctgaggcagttttcactttgcactttgcatattacatgaacaaaaagaagaaaaacaaaacaaaaaaccatatgttatttttctcgaaatctgaaatcccaattcgagttatctcgaaagaatgtgggaactagaagtattttccagtaagcgtgaatcataccgacgtgtgactgatgctttacacaagcgaagttggaattgtcaagtcaatccaaatttgcaatgacagcgtcaacgacctcttgagtggtactgtttccaccaagatcttcagtccgacaattcccttcagcgataacacgcttcacagcggtttcaagcctgtcagcaaaagaagggaactgaaggtgtctaagcatcatggctgatgacagcaacaaagccacagggtttgcattcttttgctcttccgttgtatccttccccacgtttcccgctgatgcaccttgctcaaagaccgcatactccgccccaacatttcctacagaaaatttcatagcataagcaagagaatctacttctctatagtgcttgtacattagatcaaggtaaaatgaattttattattacctccaggcatgactccagtacctccagcaataccagcagcagtgtttgccactagattaccatagagattaggcgtcacctgcaaagcagatacaagtaaataaaccaaaatagaaggaagctagcccaagcatcaacaagtgctgaaaaacatttaccatgacatcgaattgctctggtctagccacaagttgcatacaacaattatcaacaatgatttcattgtaagcaatgcttggatacttcttagcaacctcttgacaagactccaagaacaaaccatcagccaatttcatgatattagccttgtgcactgctgtaactttcttcctgttgttcaagtaggcatactcaaacgcatactttgcaatacgctctgaacagaactttgtaatcacctaccaaaacattagcatcagagacatctttgatataacatgaacatctccaactttcacatctactaccaaatcactatgaatcaaatcacatttgtaaccaaaacaatcaacaaaaactgagaaattgcaccttaaggctctcaacaacaccaggaacaacttcatgttcaagacctgcatattcaccttcagtgttctctctaatcacaacaatatcaacattctcatgacgagaagctaaaccaggcaaattgaaacagttgaccaaagaagcaaagagatcaagctcctttctcagattaacattgagagagctcacaccaccaccgacgggagtcttaagaccacctttcaaacaaactttgttcttcttaatcgattccaacaatccttcaggtaaactcttcatatctccatgaacttcgaacggttcgaagtaaaccggagcgtgcatcgcttccatcacttgttgaaccgcgtttgttaccaacggaccaactccgtctccggggattaacgtcactggtcttggttttccgtcaccgggtctgggcatgtaagtcacggatcgggtctggattttggaaccggaagcgatgctacgaagattcttcagtagagaaaacgattggcgagacatcttcttctgcaattttgatcggaatcagattcttctgaaaatgatcgtcagaggaagaagatgaagaagagttgcgactttttggaacgaagaaagaacaagaaaagcgtttacttttagtctataacttttattgtttacataatagccccaaatgtttaaccgttattaatgtttagcccgtttataatttgaattgtacattaagaccaaattgggtaaaaccatgttctgttattaacataatagtcctcgatttcttaacattatacgttttagtccgtatgtaatttagtattttgcttataagaccaatttggaaaaattgaatttttgagttctgtagtagttct

SEQ ID NO: 11304 - DNA, 2490 bp, Unknown
  misc_feature (1)..( 2490): cDNA_ID_1807075_gDNA_ID_2214489_Annot_ID_133410 3000 nt of promoter + ATG
tacatctacaaccataacaagcacacaacaataatataatagcattaccaataaatcaagtggttatgtatgtatttaacaacaataagtggagtaaatgaaaatcaaacaaggagatgggcagctggatttccaagacaagattgaaattcttggttgcttgtgtatgaatgtaaagtagacatgcttattatgttattattatgtatcagtattgccttgagttaaccatatatttacgttcttaaaccagaaagaaaaaaacagattattattattattatttgagcattgtcattatgagagacatggtttatttcccaagacaaatcacaaacctccatgtgagtttccaccactattgtgtctctgtcctaaaacaaaatgtgtatcgcattaaattagttttcgcccctttttgttatttttagaatacaaattaccaacttgcttattcaatcttagaggtgatgactagctaaagaagggacaccactaacgtgccacttgtgtagagatattcaattgtatattatatagtatgcaatatgaattttgttttgttttttatataatttatattttttccgccaatattattttatttatatgaagtcttaacttattaaacgtttgcacaaaaaagaaaaaataaacttcttattacgtctcatacacagggttcggaccttattagtggcatttgcgcagagttactattatcgatcacttaaaaacatatataggaaaagtatatcggtaatggagctctagatgtagaaatttcgtaatgaaattatgaaatctcaattaagatgaacatggcatggcatacctagcctagttgtatcgatgttatgtttggatttatatgcttatggcagaaagtaacaaatacagaaatacaataatgctactacatggttataatatatggtctcttttgttaagacaacgaccaacacaactacaccacaagataatcatcgattagtacattattaaatcttaactattattgctaaaatctagggatagttgaaatataaaactatacgatgcactattacatacattctccattaatcatttggtaatgatgaagtgctccaattatatactacctttctttattttgttatgttccttaacatctctattactaaagattttcggagattatgaaatattgtgaggcatatatgatatattcatacaaattactctacacgtttttgaaaattgataggtttaaacatgattgtaccagggaagacatggtcaaacagaaagctattagctttgatgagggacctcttaacaaaaaatttgttggtagagccaaaatgattgaactgacaaattttcatagagtttggtgaattgaataactccatatgaccaattctgttttgtaagacaacgaaaattatgtttttcgaatatctttgtgttatcgtacagaggagcgagtcaccagaaagcacaaacacaacgattttgtatcaattacatcgatacgcaatacaaatatttggaatatgtcatacatatgtattgggcctttatctcatgtctcatcaaacctcgtatctatcataaacttacgattcacagacccacttactacttattctggcccattaaagttcttctttttttgtcggttctagcccattaaagttcagcaacccttattattcattttttagtctttctatttctaattattcaattttatccaaataatgaatgaataaagttaaacaccgacactgttatatatatatatatatataacaatacaccgccacgtgagaactacgaatgggaatttcgcattacatgtttcgttaacaatataaactggaggaaaaaaacacatcgaaaggaaaaaaattcaatgtaagaaaaagtgagggaaaggcaaatcaaagacgtgttctacactaaaaggaaaagtatgaggaaaaactaacaataaattaaacaaaatttggtattttattacgtaatagtagtattaattaattaaaagaattgacattgacctaacaaaaattcttaaaacaaaaagaaagaaaaatttgtttgaacaataatggaatgactttgtttgtttggagaacaagctaagctgacgtgtctaataactcaacacgtcagctaacagacatatataaacaagtgtatatagagttaacgttatccaatcatagacgaaaagaaaaaggttcctttttttgactttgtatccgtagatcatcttcttcttcttcttccagagttttatccttatccgttccatcaaattctctctctgtaagttttctgttgatttctctgttacatactctgttttgatttctctagatttagaattcatttttttcccgaaaagacgcggaatttcgatttgggtgttgaaaacaaaattagggttttgtgtctcaatttctttgattgtgtatattctcagaagcaaagatg

SEQ ID NO: 11305 - DNA, 3000 bp, Unknown
  misc_feature (1)..( 3000): cDNA_ID_3039566_gDNA_ID_2214489_Annot_ID_133413 3000 nt of promoter + ATG
caccaatttccatttcatctttatatcaatgtccaaagacagtataccactaagtgtccccatgctaatcacatcattatcgataatcactattagactcttaataattatttacgttatcagcttactgtataattgagactatcacaagaaaagtgtaaagtgacaaaaagtaacaagattagaaaatggtaaatgaaagggaacaatatctacaaagaaaataaaagcttgaaaatcctaagaactatttccataattgtcttcaattgcggcaatgacggccccatggaaatacccgagaacttgaccccgatgcgatccgggtcttgacccgttcgaaatctgaatacagacaaggaatagtgatacctccttcgtggcaaaatccgtactctttttcggcttctcgaagcagctcaccgaacaaaggatggttaaagtaaacgatgggtaccaaaactctatgacagtcgccgtctttttgacccacgtagatagctaagtgtccccttggaaccgggtcggctttcttatgatcaacgggtatgtatgcggatcttctcgtagacctgcgtctgaaactttgcttgagacgttggccccaacttttgagtttggctaatggtctcatcagcatgcaagcttgctgggtcgagtgtatccggttgtatcctgaacgttggatccgggttttgcgaaagatccatcttgagactcgtctcccgattctaaaccctatgatcttcctcatcttcttatagctaactttaaaaaacagtttttgtcacaaaactacactttttgagagatctgagaggaaatagagattaagagagtgagacgagacatggactaacgagtcaaataaagagtgattcatttgaacgagaataaataaatatatcaatcttttttacattttcttgattttctctataagaaagaaaaaaaaaaagacaatttctagggaaaacacaaattcgaaaatgatgtgaacggacaaagaagaaatgctttcgatgtatataaagtataaacgttaaagaagaagagatcaagagaagaatgagtgaaagacaagaggtctttaaaggagtttatatggagtctaaataaatgaacggttagatgaagactaaggtctatgaccgttggattagattaaaactgccatatttctcttgcttggcagatagtccaaacccgaagaatctacattaaatatgacacgtcccattaacctttagcctacatttatcattatcactgaaacgttttgatgggttatcaatcacaaattcacaatacgaaaaaaaacagtagtgtcaaactattatggtattttagcgtgtaattcgttacgcagatattattatctatggttgattttgaatctgaaaatatgatctatcgaagaaaggcctgaaattattttattatctgaatatgttttgtcggagcttacatgcttagcatgtttgaacttcgaagatgaagacaactatgccaccacacgtgtgctggccaagtgggacaaagttttgaacctattcggtaacactcacacgagatcaaatccccaccatctcattttataatgtcgtttatttatttgttagtgatcatctactgttttttaataaggttagtgccctagtgatcatctacttgtctgtgattttgtaaaaaatatatatagaattaaaattatattacgagaacaaaatgtgtacggtgtgtcctctagttgcgttacttgtgtacgttgatgatggttgatatatatacatattcatatcaggacaaaaaagcttttaaaaagaccaataaagatagatctagttttgagtaattggaggattcactaagctttttggagctaaaatggtgaatttcccacgaatcaaatctgagaagagaagctttctatattttgagttactttacacaattacacgttcatttgtaaattaagatcgtgtttgtgctgcatccaaaaaattcttggaattttaaagtaatgaaatataactaaacaaaatgaccactaaaaaataaaataaaaagcacatgagagatgagtgattatactctgataaattagctaacaaaattatgtatatataaaaaaggttttatgcagtgtaaattgtacttacacacttaatcaaagcaaaacaaaaatattaaaccgacaataatacgtaaaccaaaaaaccaatattccttaaaatcaatttgtgtttccaaccgacaagttctttgtatatatggttaatcatattttgttgtagtccgtatcctagctaaaagacgtttaaacgttcataatggatatgacccacccagctggtgaagatattcgtttttcgtgatcatatatatatgtttctttttgcccatccctgtttctattaacccaagttaaattagctatatatgagcaaaaactatgagttgaagttaagcacaatttccgaatcacaaaaaaaaaacaaattgatttggacctttcgataataggaatcagaaagaagtttgttccaaacacttctcttatataaatcccaactcatcagcttcgtgtttccgtacagtgcgtacatatacgaacgtgtcactcggcttttaacgtcaacttaatcgagagcccaattcaggcttactataagccttaataagcccaatattaaaagtccctgattattgtgagcccaatattaaaagtccatgactatggtgagcccaataataaaagtccatgactatggtgagcccaataataaaagtccttgattaaaaggcccatcaccagtggagcgaagaagcggaggagggaagagggatgcgatcctctcgtcatcgctggttccatcagtttcagtgagaatcagatcgtcgttgtactgagagctccggcattggttcacggcggagctggagagttatctaagaacggagaggttactgatctgaattgttgaagatcggaaaatg

SEQ ID NO: 11306 - DNA, 3000 bp, Unknown
  misc_feature (1)..( 3000): cDNA_ID_2717251_gDNA_ID_2214489_Annot_ID_133415 3000 nt of promoter + ATG
tagttttttcctgaatatgaaatttctatggataatccatgagaagactgattaacttccagagtcaaatcatatcgttttatcgatcgttacttcatcttcaaagcttttattcaaaaacaattaatttcgttacctataaaataaggaacgtgttaatactattttgtggccgtgcttaaaaagtcaacttagaccaaatgataatgttggtaatctactcatggattgagacctctctacggcttctggtagtttttgaaacctcgtttcttccgtcgacgttacgtgtaacgcagtcttgctttgaacgaggacgtttcaaaaacccatagctagaatatgatacttataccaattaagtaaacattcaaacaaagtctaatctctttacaacacaattcttttttggattttgattttaaccataaaccaaaaagagagagtctgattaagtgagcacaaaagtgaaaattttacattattgtgtaagagatttttttttttaaaagaaaaaatattcttgggcatgctattgaggaccgcccaataatgaccacaacaatctgtgatgttttatatttagctcgcataaaaactgtctttgtagtctcgaccaagcggtcgtacatgtgtttagtatttatttattataatagtaaaaaatgtattaaaaataaacatgaactaattaacctataaaatgtaactgaaaattattaaaaaccatattgatttcctttgactacttctttttatgccaataacttcacatatgatcactttaaaaccataacactcaccaatctttttgtttatctaaagttaaggcggattgtttagctctatactatagattatgatttttcgaagttacttttattaaaaacaaatctccaaattgggtgatgtgtaattgtttttaaaaaaaaacttgccaatctatttcaaactgaaatcaatatatgatcatccacaatttgtgtagtggatcctattcaaaattaacacgttcttaaattggtccgaccgatccaatcccaagttcgatcttatgataaggttttgttgagataaatgagtaggaaagtctatcatctcaaaacgtctttaaaatattacaatatataaaaatgtaacaaaacatataataataaatcatggaatcaaaccaattatctactcattactaattttgttcacaaactccaaattctctaagtgtcacggtattaggtaggttcgtattggattattataagtaactagattagaaaaatataagaaaaataaaatcaatatgatctgactatgacgatgatgccgcctttctcattactggtttttaattcgtactcgtgacagtgtgtgttttttctcttacttgatagtattacgttaattagttatgagttctcaattcaaacgttggcggggtacatttctagtattagaaacatatatagctttgcattgcatgtaaccaattcttcaacctcttaataatcagattctggacgggataagatcatttgtatcttttgcgtttaaatattagatgatctacctaccatcgtcttacgtattctcgatttttttattttaaaagagaccaaacatatatataataataaaatggtttggatctattatctatatatgtttccttaacaacttaattagtttaaggcttaagcacagttgacaaacatctaaaattttgtccaccagcccggagatttcatagttccattctacccaccaaaacaagagccctttcaatatatatagggctattcaaacatgaactttaaccccacaaatttttttatctattattattgaaagaaataactatgattcgttagatatcatgattctataattagttggacgatactaatgatattttttcgtaattagataaataggtaattttgtgtggatagttcatttggtgaacaaagttctcttgcatacaaacttttcactgggaaaaacagtgtatattttatcaaagtattatcaactataattggttccagatctctaaagattattataagatcaaaaaccttttctgtagtttttgtgtatgaaaaaaagattaatagtttagctagaaaacctttaggaaatcatcttttatgtagtcaatctgattatgtacacaagaagtcaataaactacccaaaaaaaaaagttcaccaatttcaaaatacttctatagttatatttcacctagaaatagcatcatgaaccaattatcaaaataagaataaacagaatctttattaaaaaaaagtaccccggccctttatactgtcttttgtgcaaattgatgatggtcgtatacagtgtgcgctacggcaaggagacgattatattgattaaaaaaacttctgcatacagtattgcgaagttaacgtcgacgtttgatatgtctttgtggatagcgattacatgtttaagtcaattgagtttaagtcccatagacgcgtttatgccagtaagattattaaatttgagaaagaaaaaatataaagggtagactagttacgatttatgcgtattcgtaaacctattattttcttgctatcacatttaatctgtgtccaatactttgtaccaagattagattgtagactgatttttttctggttattactgaatatcacactaaaatttgtttcgtggtcaaatcaaagcgtattagtatacacgtcaaaaagatagcacaaacaagaaaattaaaattcaaaattgagaatatatgacggcatgatcgttaccaatccattggttggtataaacatatatacttttcttttttgcttcaactacaatgaaattacatattaatatatttgattattaatttaaattaaaaaacataagtccccacatctatataaacacatcgattcaagactcaaatctcatcaatcaaaatcttcaaacacaaacttctcgtttctcaaaacatttggtcttatgatg

SEQ ID NO: 11307 - DNA, 3000 bp, Unknown
  misc_feature (1)..( 3000): cDNA_ID_1830995_gDNA_ID_2214489_Annot_ID_133418 3000 nt of promoter + ATG
cctcactatgcaagtatcctttgttactttagaatttcgtgagatggtatgttgttgtcttgttagtctattccagtgtaaacgtccttaacctcaaaatcaggaaacaaagcagttggagtgatgaaagcaggtcagactttcacaatcgagccaatgatcaacgcaggtgagttcaatgttaaatgtccttaacctgcattcgttaaatgttttaaatttgttactccatacttgagttatctatttacaaccataagggcattgtcatgataggggggtggagggatcgaacatggcctgatggatggactgcagttaccgcagatggaaaacgcagcgctcagtttgagcataccctattggtaacggagactggtgttgaggttttaacagcgaggcttccttcatcgcctgacgtatatccttggcttaccaagtgattaagtgtttggttcctttttggttgtgattcgtaaacttgggaataatagtgtcatctttttgccattatagaccatttgatgttgttaccttgttgtctttgtttatgtaattttattattactatctgaaactgaatcttaaagacagagtcatactgtttcaaacctatttttatcaccatgagaacttttttgctaaaaacgtctgaaactgaaatactgacaacaaacgaaataaaaaaagttttgaggtcgcttggctaggatatatcacaagagacttgctagttgctactgtcatcgaataacgatcgacctaaagatgttgagacgaagaagatattaattccatttttttttaacaatagatgatacatataggcttgcttataacaaagagaaaataaaagttgcacaacaaagtgggaagaagcattaagagagttcctgagatccttcactcaaggaccttcacaccagaaacataaactcggctttgaatgacactgccaccaatccaaaacccaggcataaccataagaccaactcttgggttctcttctttttcatccacaactatgttcttcacaacactttccatgtatgaatcagagaactcactaccctttttcacttggaagatctttgcagctggatcaaaagagtaagcaagcctatgcaagatccatatcgactttatggaatgttaacaatccacagaacaaacatatcaaacaaagcgactgtgacattttctttggaatgcaaagccttaagtggtacctttcctgtataatgtaactgcggcttgctatggctatccacagatgtctttggataaagttttggaagacgaggttgttgaagatacaggggaatcacaagtctttaacttgcttaatccagaatttgtagactttgatacttgtttagatcctatcacaaacgaacttccaacttccggtgactgaaaaaaagatgcaagtacaaaactttatcaaataataacatagctagcaacatgtatactatttgagtttttttagagtttctaagccaatcagaaggctctatttcgtacccactcgcagaaagagcgcgttgagcgagtgagagcgattctgtgggtaaacccctttccaattcatgactttttttatcgacgcacatctctccaaattctctatcgcgtgactcttttagtttttttccacaaaaccaaatgaaaccgaaccgaaatcagttttaatttcaaaaccaatgcaaaccaaaccgaatcagcaaatagtgtgaagcaacaattctggacagaaattttctcaacatcccaacaacgggaaaaagagaaaacaccacaactcaaaatcacaaaaaaaatatccaagaaaatcacaaaagcctttgacccttaaattgcactacaactcaaaaatcacagtaaactttcaaattgcaaaaatctcagaatcaaagccaaagaagattcctgaagatttctacttccatggcatccaatagatgaagaagaacatgaaaaacgaccgaaagagcttagctttactagttttagtaaaatttctcggcaacaaagtgacacataaaaaaagataccaaaaagaattgtagattccataagaacaaggacgatttgcaataattaaggtttatacagattagacttaccagttgaaatctgaaagcatgaatctcgttgtgagctcttcgtgtttgcctcgtccttttattatctttcttattttctcttctttgtgtgatttcaactcaccaacttttatattttactctgctgcttcgagatcaacgcattaaaagtaatggggtacatttagaatatttagattttaaggggttgaagttgtaattttgaagaagtggaagatcaataaaaaataatagaagaacagagacgacgaaacctgccggagaactgaggagagaaaaaaatccgtcgaaaatgggaatttgaattcgtcttctgttgatcatcgcttcacttctgcttccaggtcttcatcggaaccaatctcactttcactctctaatttctaatttgaaaatcgatcttatcaattgtgtgtgtgtgttttgttgcagagcttttactcagaagaagcttgatgatctcaaatctctctttgtttccctcgcttccaagtctcacagcaatgaccaatacgtctcgtaccctgttttccaggttttgacaaaaaaaaaaattgtgttctgttctcatctggtttttgtggttgatagttttgaattaagccttacacgatgtgtgtcggaatagtgtccaaatctcttgtttttctcaaactcgcaaaaactcaccaaaggaaactcaacaatttcactcgggagtgttgttcttcacttgtgttttttttgttggtatcaacgtgactgaaaagcatgggccatagaatgcgatgctatacagtatgtagagggagtaagactggcccgtgaatgcacataatgggccttaaactggcccatcaatgctttactctcctctctagctagcgaggag

SEQ ID NO: 11308 - DNA, 3000 bp, Unknown
  misc_feature (1)..( 3000): cDNA_ID_3039512_gDNA_ID_2214489_Annot_ID_183611 3000 nt of promoter + ATG
atactgtagatgattacataatatcaatacttttatatttatatgtattggtctttatatattgttttctactatacgaaatgtcaggtttgaatcattgttgagtaagatacatattgtattggtcactacaccaatccacaaacaatttatggtatataaaacattttcgataacaaaatagatagcattactgaatacactgaccaccacatataaaactcgacactattgatcaatttagatgaagaaaacgagaaacaatctccagtgttttatttaggccaaacaaatatctaagagtaaaaagaagcccaaatctctaattttttggtgtaatataaacaacaagacaattaaatggaatggcctcttttcttcttccagctatgtccgaaaaagaacacatggccccaatccaacccaactcacttcttataaacaacacacatttcaaaaatataaaggcaaaattaactctagtcaaatactctaacctaaccatgatcaaaatttaaccgtggttaacaatcatccttctcttttaacttcatctctcttctcactcagtcttctccacttcctctgctccacactgacacttgaaaaaactcaaaaccgtctcatcatggcggcgtcacagacattctcactcctcgccttcactttctccctcctcgcctttgcttccaccgtgagtagccacaacatcactcaaatcctcgctgattctccagattactcttccttcaacagctacctttctcagacgaagctcgccgacgagatcaacagccgcacgacgattacagttctcgtccttaacaatggcgcaatgtctgctctcgccggaaaacatccactctccgttattaaaagcgctttaagcctcctcgtcctcctcgattactacgatccacaaaaactccacaagatctccaaaggcacaactctctccaccacactttaccaaaccaccggaaacgctcccggaaacctaggattcgtcaacatcaccgatcttaaaggaggcaaagtcggatttggctccgccgcttcaggttccaaactcgattcatcttacaccaaatccgttaaacaaatcccttacaacatctcaatcctcgagattgatgctccgatcatcgctcccggagttttaaccgctcctgctccttccgcctccttgtcaaacatcaccggattactcgaaaaagccggttgcaaaacctttgctaatttgcttgtctcaagtggagtactcaagacttacgaatccgccgttgaaaaaggcttgacggtttttgcaccgtccgatgaagcttttaaagctgaaggtgtaccagatctgacgaagctcacacaagctgaggtagtctcgctcttagagtatcacgccctcgctgagtataaacctaaaggctcattgaagactaacaagaacaatatctccacgttagccactaacggcgccggaaaattcgatctaacgacctctacctccggcgacgaagttattctccacaccggcgttgctccgtcgagactcgcggacactgtgctcgacgcgactccggttgtgatattcactgtggataatgtccttctccctgctgagctattcggaaaatctaaatctccatctccggcaccggcgcctgagccagttaccgcaccgacaccatctccagcggatgcaccttcacccaccgcagcttcaccaccggcacctccgacggacgagtcaccggaaagtgctccttcagactcgccaacaggttcagcgaacagtaagtcagctaacgcagcggttggcgtgagcacaccgtcgttgttcaccgcattggtcacgatcgccgccatagccgtctccgtgtctctctgctcttaaaacctttcgtaattacgcaggctgccactccctttgtttatttttaatttaattatcttttcaatttttatttttgtggttatgtgttgttgagtttgaaaacatgggattagtgagtgaggttttatttaaatcgtttgttaatcacattttcattattgctttcagtgttgatctgatagtatcttgttgagatctttggctttcacttatttaacttcttttccatttttggataaagtgctttttcttctaataattttggtaccgacaaataatgcatcaaactagaagtttactgtttacctttatcagttgatggtaattaaaattcttaaaaactccttaaaattttaaattattatcgctacttggaactactttataactttcttttgtccaagaactactttatgattataacatcaaatattaaggcttagaatttcatgttttctctcgtgtagtgaatttgattcaaagatgctttaatatttttttgaagaaattttagctggtaattcctgggcccaatttcttattatttgaactcaaactttgttttgaaagcaaattgattccttatttatcttcgccggctaaatgctaagttttcccgcgaagcaacgaacaaagcaacattcccacttttagcctttaacttgctttatttattattattaaaacgatgagaataatttaaatttgtagattatattaaacgatgccgttttctcacatgtgcaaaacaaattaaacaaatgaatgggtctacattgtcgagggttgggagaggtggcccatttatatttattaagagagcgaaaagcccgatctctttcatctcttgacaccgacacttctttaaacaatggaaacgtttttttttatcccgagaacacaaaccctatcgttcttaactctagaaaacaacactcagttcttatctccattcaacgaacgacggagcgtttaaacatcagtcttcctcgagaagctttaccaacagagaggttcacacagcacaaaaccccttcactcactggcgtatttgacagttagggtttcaaaatccccgccatatttcttctataatcggagtgttaatg

SEQ ID NO: 11309 - DNA, 3000 bp, Unknown
  misc_feature (1)..( 3000): cDNA_ID_3039525_gDNA_ID_2214489_Annot_ID_183605 3000 nt of promoter + ATG
tactatacttttggcttctagtggtgtcgaatgtattaattataataccatgcatgttctaggcatagattaagggatattattaggattgtgtgattaatatataattaatatgaatgagagaaaataaaacgcgtgaatgagatggaatggaatagaaagcgtaggcgtggcacatgatcatgcaactatcttaattttgtgtctccacaaagctaccgtttttctcgggactttgctttgttgatgttgcgaactctcttcctttttcttttctttttttatataattgatttaactttttggatcggccattcactgataaattttatcattataattaatttgctaatgcaaggaaattccgttatcgattgatgtttattgttcgcagttcaagattgcttttcaatcaccagtatgaatttgtcatctgagcgatgtagcaaacaaacattaggtgagtttgatcttatagacgtatttaccatttgaaaatgatactatataagtgttctaattattaatgttaaatacttatttccatttcttccatagagatatatgtgtgtattgttaattttgtatgattaattagttaagagttcaacttccaacaaccacaaaaaaaacaaaaataaacaaaaagtaacaaatgaagaaaaaacaaaaaaaaaactctaatcaattatgtgatttgatagttttcgttttcccccctgtatagcaaaaaaagaagcagagagggaaagaatttgttttttgttgtaatccgttaaatacttatccgaaacagtatttgaatattccatcaattttgtaagaatctggatcaaaatgtggtattacgtttagttttttttaaaacatatttaacgtttgtgtaattgatatcgtgacttcaccaacttttagagaagcatgagagagatccaaaattccacgtttaaaaataaaagcaaaaataattaatttgttttagagtatagtatatttcttatggacattggtgatttgagacttcgatatttatatattctattaattatagaaaacacatctcgatgactatacaacagtaacaatacaatagtgttagggggggatcaatgatccctacgttcctaagtctagatcgtagatggctattctaaaactcacaatttttatatcgattacagctacccccaaaaaaaaaaaaaaaaacgactacagctataatatattacaaacattactactttattagtgaatgcgcgtgatgcatgacatttaaatgaattctaaataattttcttttgggtttggttcacaattcacatcacgcttctatggtccatatatttttttcctaaaatgccatttaaaagaaacaaaacagtattaattaaaagaaattaatacaagattgttaatggcttatttgccaaaaaataatataaggattattaatgacctcataatacagacaaattaagttccgagtagcctttgttttacggatgatgattattttacaaaatgaatacttattgttttatgttttctacatgtacaattaaaaagagtttaatgttgtactgatataatattgttttccagttgaaattcagtaactattctagttgataaattttatgatgaacacaaaatttgaattcatatataaaaaaatacttatacattgtagaacgtaaccaactaagttggacgttaggtgtttggtattcgtcacataatatattaaaatttgaaactctcagcaaagctacaagtctcttataaaaatgtcattttttggataaagtagtaaatgtagttttacaaaagggatggtgtcctactggtaatatatacagtataaggggagaaaacaaactgttatcaaagatggatgcagtcaaacttccagcttatattttcggttaactgaaagttctaagtccgattcatctagttctgtctctaaaagtgtgttgccagtagtgctttcgtgtcttttctcaactttacatgattgtaacacttcatagcttcctcctccttaccttgctcgaaccaatactctacgaatgcgctactaattcataatgcaaaaggaaggaattggaatcggaatcggattcagatccatggaaggtaaacacgttctcagaccattccacgactccctaaaccagcttgcccatcatgcggatctcaaatgaaatctgtgcacaccaaatctccgtttttccttagtatacgtcttccaccaaactgtcactctcctttctccgccagggtttgccaccgaaacaagataattacaagacagtccttcaagtcccccaaccttggtactccacgcccacggcctagaatcatcactgcaaagtagtttgagtttcccattggaaaccgttgcttggaagtctttgcaatctatgagtaccatgcaaacattcggacacaagttaagcttgtccatcagaagattgtcataaacttttccactaattaggatgccacaatcatgaaaaactaattcaccaactataaaattgttggtcggtaattgagttttcagttaaaggttgtaagtttgtgttgtttcactcaagaggcacaagtagaaagagacacaagtatgaagtgacagaactaattgagttgttgtgtctatttgttttctatataaacaccttgtatcgtcatgtaaagattaacaagtttcagtttcaataaaacaaagttttgttcttgtcttcttcacaagagaagagatatgtctctcttactctgtttttcttctttctctcaataaaccaacatggtatcagagccgatggttgtccttggttgtctctacaaaaataagatgtgttctgctgcgaaaagaaaaagagagatggagacaacaaatctatggtgagatgaagaggaagaagaagagggaagaagaagaaataagaggtggtaactacagagagtaccatcagttttcacaaacacattcac

SEQ ID NO: 11310 - DNA, 3000 bp, Unknown
  misc_feature (1)..( 3000): cDNA_ID_3039528_gDNA_ID_2214489_Annot_ID_183604 3000 nt of promoter + ATG
tgacgatacaaggtgtttatatagaaaacaaatagacacaacaactcaattagttctgtcacttcatacttgtgtctctttctacttgtgcctcttgagtgaaacaacacaaacttacaacctttaactgaaaactcaattaccgaccaacaattttatagttggtgaattagtttttcatgattgtggcatcctaattagtggaaaagtttatgacaatcttctgatggacaagcttaacttgtgtccgaatgtttgcatggtactcatagattgcaaagacttccaagcaacggtttccaatgggaaactcaaactactttgcagtgatgattctaggccgtgggcgtggagtaccaaggttgggggacttgaaggactgtcttgtaattatcttgtttcggtggcaaaccctggcggagaaaggagagtgacagtttggtggaagacgtatactaaggaaaaacggagatttggtgtgcacagatttcatttgagatccgcatgatgggcaagctggtttagggagtcgtggaatggtctgagaacgtgtttaccttccatggatctgaatccgattccgattccaattccttccttttgcattatgaattagtagcgcattcgtagagtattggttcgagcaaggtaaggaggaggaagctatgaagtgttacaatcatgtaaagttgagaaaagacacgaaagcactactggcaacacacttttagagacagaactagatgaatcggacttagaactttcagttaaccgaaaatataagctggaagtttgactgcatccatctttgataacagtttgttttctccccttatactgtatatattaccagtaggacaccatcccttttgtaaaactacatttactactttatccaaaaaatgacatttttataagagacttgtagctttgctgagagtttcaaattttaatatattatgtgacgaataccaaacacctaacgtccaacttagttggttacgttctacaatgtataagtatttttttatatatgaattcaaattttgtgttcatcataaaatttatcaactagaatagttactgaatttcaactggaaaacaatattatatcagtacaacattaaactctttttaattgtacatgtagaaaacataaaacaataagtattcattttgtaaaataatcatcatccgtaaaacaaaggctactcggaacttaatttgtctgtattatgaggtcattaataatccttatattattttttggcaaataagccattaacaatcttgtattaatttcttttaattaatactgttttgtttcttttaaatggcattttaggaaaaaaatatatggaccatagaagcgtgatgtgaattgtgaaccaaacccaaaagaaaattatttagaattcatttaaatgtcatgcatcacgcgcattcactaataaagtagtaatgtttgtaatatattatagctgtagtcgtttttttttttttttttgggggtagctgtaatcgatataaaaattgtgagttttagaatagccatctacgatctagacttaggaacgtagggatcattgatccccccctaacactattgtattgttactgttgtatagtcatcgagatgtgttttctataattaatagaatatataaatatcgaagtctcaaatcaccaatgtccataagaaatatactatactctaaaacaaattaattatttttgcttttatttttaaacgtggaattttggatctctctcatgcttctctaaaagttggtgaagtcacgatatcaattacacaaacgttaaatatgttttaaaaaaaactaaacgtaataccacattttgatccagattcttacaaaattgatggaatattcaaatactgtttcggataagtatttaacggattacaacaaaaaacaaattctttccctctctgcttctttttttgctatacaggggggaaaacgaaaactatcaaatcacataattgattagagttttttttttgttttttcttcatttgttactttttgtttatttttgttttttttgtggttgttggaagttgaactcttaactaattaatcatacaaaattaacaatacacacatatatctctatggaagaaatggaaataagtatttaacattaataattagaacacttatatagtatcattttcaaatggtaaatacgtctataagatcaaactcacctaatgtttgtttgctacatcgctcagatgacaaattcatactggtgattgaaaagcaatcttgaactgcgaacaataaacatcaatcgataacggaatttccttgcattagcaaattaattataatgataaaatttatcagtgaatggccgatccaaaaagttaaatcaattatataaaaaaagaaaagaaaaaggaagagagttcgcaacatcaacaaagcaaagtcccgagaaaaacggtagctttgtggagacacaaaattaagatagttgcatgatcatgtgccacgcctacgctttctattccattccatctcattcacgcgttttattttctctcattcatattaattatatattaatcacacaatcctaataatatcccttaatctatgcctagaacatgcatggtattataattaatacattcgacaccactagaagccaaaagtatagtagtaaaaaaaagaagaagaagctggtttgtacgtaagaatgaaaataacggaatccaataacaatgtttgtaataaacggacaaagaatgtgaattattcacataaatgatctgtaaaatgtgagcatttgattataacggatataataaaacaaaaattgtaataaagagagaagagggcaaaacggggaacatgtcacgcggataggtgtgagagagtaaatgacgtaggttccgttatttaagaacccttctagagaggttcccacacaccagaagagagagaaagagacagagagaaaatg

SEQ ID NO: 11311 - DNA, 3000 bp, Unknown
  misc_feature (1)..( 3000): cDNA_ID_3039532_gDNA_ID_2214489_Annot_ID_183603 3000 nt of promoter + ATG
ttgagttcggtgggaagaatgggttagaggttgtgacgctcgttattcctctcgtcgtcggaccttttatatcttcgtcgttgccttcctccgtcttcatatctctcgccatgctctttggtacttaattctcatatctaataagttttttattttatttttctccatgattaaactaaagctgaaaattaataattttaaaaacttaaccactttgattacgtatacgttatatataggtattaatttttaaaactaaccaaaccttttatttctcaaataaagtaaagtaaattcatagtactagcctactagctagcttgtactctagtagtagttaaatggtttatggttggttcaccaagtatcttgggagatcatagctcgaattttctcaaaaaaaaaatttttgaacaaatgctcgaattttctcatttatacttttgttttaaatgaaaaaaatattctgctcaggcttagtagatttatgtttggacatagtggctattgaaaatgttagaattcgaaccaaaatatgtatattttatacgaaaaaacagaactaaaatcctaattactatacgtaactaataaaactcttttcttttgcttataacctacgtgcgtggaatttttgagttatttagaacgaattttgtgtgtgttaaactcgtgtaaacatgtgctaataatattcacaaatagtgttttgagtaataatcactattcactatagtaatattacgtttttttatgaaggaaattacaaggagaagtatttgtttgatacttacaatatggtgcatattgatgatgtggcaagggcgatgatatttctattagaaaagccagttgcaaaaggtagatatatttgttcgtcggtggagatgaagatcgatgaggtctttgagtttttgtctacgaaatttcctcagtttcagctaccttcaatagagtatgtcattttttactagtataattaatttcacgtgtaaatattctattgtttttttccaagagtttttattatgttctttttttgtgtgggtacgtaaagtttgaataaatataaagtagagaagaggatgggtctttcatcgaagaagctgaaaagtgccgggttcgaattcaagtatggagccgaggaaatattcagtggagctataaggagctgtcaagcaaggggatttctttaaattcttatgggatttttgtgttaaaatttgtatatgaattgaaaatatgttttttctttattggccatttccgttttgtaacatgttctagttacttgttgacgaaaaaaaaagaaagtgttttgattcagatttacaaagaaggtttgcttaaaaaaaaaggtttgccaaaaaaggaagagaaggttttagaaaaatgaaaagaataacgcccaccgtggggctcgaacccacgaccacaaggttaagagccttgcgctctaccaactgagctagacgggctttttgatttaactttcaatctactagatattctccacatatattttacatgtactttcagtattttaaaattcgcgaatcaaaacaagatttgaagtgaaatgtttagaaaagtgggtttatgcaaaacaattaatcatgtgctacatcaggcccttatgataaaaactaaataaatttccacctcgaacgaatatcatacattggaaaataatatagcatggttctgttttctgaacataagattcaaatagtattcaaatcaaaacaactagctgctactctcttactttttggtcttcaagtccaaaatccttaactaggcccagtaagcttgtccgtcatgacatgacaattttaacgtattgaaaaagaacgcttgcttacttctatcagcagcataattaactggatcaaaagagtaagcaagcctatgcaagatccatatcgactttatggaatgttaacaatccacagaacaaacatatcaaacaaagtgactgtgacattttctttggaatgcaaagccttaagtggtacctttcctgtataatgtaactgcggcttgctatggttatccacagatgtctttggataaagttttggaagacgaggttgttgaagatacaggggaatcacaagtctttaacttgcttaatccagaatttgtagactttgatacttgtttagatcctatcacaaacgaacttccaacttccggtgactgaaaaaaagatgcaagtacaaaactttatcaaataataacatagctagcaacatgtatactatttgagtttttttagagtttctaagccaatcagaaggctctatttcgtacccactcgcagaaagagcgcgttgagcgagtgagagcgattctgtgggtaaacccctttccaattcatgactttttttatcgacgcacatctctccaaattctccatcgcgtgactcttttagtttttttccacaaaactaaatgaaaccgaaccgaaatcagttttaatttcaaaaccaatgcaaaccaaaccgaatcagcaaatagtgtaaagcaacaattctggacagaaattttatcaacatctcaacaacgggaaaaagagaaaacaccacaactcaaaatcacaaatcatagaaaaatatccaaaaaaaatcacagtaacctttgattaaactttcaaattgcaaaaatctcagaatcaaagccaagaagaatcttgaataacaatctactgcttcaattaaacatgaaaaacattagaaaaagcttagttttactagttttagtaaaatttctcggcaacaaaatcaaaacagagatgaacacataaaaaaaaaactaaaacagaactgcatattcgataagaacaaagactatttgcaataattaaggtttatacatattagactcaccggttgaaatctaaaagcatgaagagctagctcttcgtgtttgcctccctttattatctttcttattttctcaactttgtgtgatttcaactcacaactaaaagtaatg

SEQ ID NO: 11312 - DNA, 3000 bp, Unknown
  misc_feature (1)..( 3000): cDNA_ID_2717255_gDNA_ID_2214489_Annot_ID_183602 3000 nt of promoter + ATG
acaagtgactctccttttccatgtcactaaatatttcaagagcttccatgtgatacttgttttgaacataaccagccatcatagaattatatgccacaacatctctatgaggcatttggtcaaacagagtcttagcgtgatgaacaaaacctaactttgcatacccatcaatcatggtagcccaagtaactacatctcttctcggcatcacatcgaataaacccttagcatcttcgattcttccgtgttttacatatccatctatcattgagttccacgaaatcaagtccttctcaggcatatcagcaaacagtttagacgctatgtcaactccatctgatgtctgagcataaccacttatcatagagttccaagatatcaaattcttcatctccataggcatcaaatcgaacaattcacgcgcggatacaatcaatccacatttgacatacccatcaatcatggaattataagaaacagagtctctcttcggcattctatcaaacatctggcgtgataaacctaaacaaccacatttcagatacaagccaatcaaacaattctgtagaaacaaatccgaccaaagtccagtttttttcaaaaacccatgaatctgcattcctccttttacaaaacctaacctcgaacacgctttaagaacaagtgacagtgagaatttgtccacggaaaccccattctcgagcatcaaacagagcaagagcagagcttgtctcggatcctttccatgagagtgagacttgatcacggcgttccataaaaatggatcctccacctctccaaatgaaaacgaacatacgtgatactcgtggaagacacaacgcgcgaaatcggcgagatacggacgtcgagaagaggcaaaagccagaacaatcctcgtagtgagatttgagtttttgatgattcccgtcttaatcaatcgcccgtggatttggttcacgtcatctgaagttttgcagcttccaaggacatgaatggtggatgaaatcgaacactccatggttgacttgaagacaagcatcagttattacgttcttctgttggagatgaaccggattgggtttattatcatcgttttaacggctatgtggaagtcgctgagcggatgagttaaacgccgtcgtttttgtatctgcctataaaagggctcttaaattaaggcccaataataaatattataagcccaatctcaatatctgtccaaagattttccaaacagcagtgaaactgaaacatttacccaaaacaaaatggaattaactattaagtcagactaacgttcgaatttaggcttatacagttatacttcaacacaaactagtagatcttaaattttaagttgattacattatgaccaacatgatctataggaaataatatatgtatagaaaagagaaaaactgatagtgataaataggatattgataagcaagtagttgataagcattgacttcctccataagtcatagtcaggatggagtggtacgacatatcgtacatttttctcatttatcaaattggttatagttatatattttatataattttaatgtatagttgccatttaaatatcgtgcgtctttaatataaaacgaaagcgctaatttgtcgtttactcaatcgttaatctaattaaatcatgtcaacgttagcttaagagtactttggtaggtatttggttcttctactatttcagcggccatggtacaggcatgtctcggcctaccaatgggtgttatttccttacacatttttgggctacactcatgcacaaatacatctctattgtatgcagttcgagtaaatttatctgtttagttattttttcgtgtaatctgatcaataaacaggttataagatgagaaatcaaatatatttgttaataaaaattttatacgaatattttacataaataatcggctaagttacttttactattttaaaagtctatgtgtgtgtctgattggcgaatataaacgagttattaaaaataaaggtaggaatgttgtacttttggttcatttaaaaaaaaaaaaatcattttcgctctatcttgaattttgattttaaactacgaaatgtatataaagatacatttttagtttttttaataaagatataaagatatattttcattgattaaactactaatatatacatccaacattcttatattatatatacttatatatgtaatttatagatattttgtcgcatatctgttagctttatatgttacgtgcagaataaacaaaactaggcggcgttaaattatgtttgtataggcttggtgtttcttatataacctttgattatagattcgttggttggcactatgaaagcgagtgtcaaagaaaaaagatagtatatgaatcgcgtcattaagttgaaataacaaaggctttaatcaaaagattgaaaatttagaaaagaaaaggaaaaaatcaaagattgaagctgaccatctcatgtaattattcaagttgtctcactaagtccacaatgtcagcaatcaaaaattatcctttgatctactacaggtatttttcacacgctagctacccttctgacgaaactgaaataagtaacaaaataaaaacattcaactgctatctattataacaaaaccaaatgattcaaatatgtaattcatgtctagataaattttactgtgtatatttatggatattggtttgcataggttgtgaaaagagcgtgggctaacgcaaatcgacgacataaattctcgaatttttattaggatggaattataaattagattttattgattgtaacaaagtgttttttataaaaaagaagatggtgaggctaaataaggagtaataaatggaagcaatgagaccaattgacacgttgttattagtgtaagcaaatgtcaacgcttcgtttgtccatttataaaacctaactacttcttcttcttcttcttcccaaatcatcaaactccatttcactttcact

SEQ ID NO: 11313 - DNA, 3000 bp, Unknown
  misc_feature (1)..( 3000): cDNA_ID_2717263_gDNA_ID_2214489_Annot_ID_183600 3000 nt of promoter + ATG
tgtaattttttctctaagaaatgtgatacatttgatgtataatattttatactaaatcgtattgattgaggtggaacattatggtctatcattagaaaccaatgaatcgagtgacgaactatacggaaatggcatacagttgtcaactatatgaagagttgaaattatttacacaataatcaaatacttatcttattttcatatgatgcttgacacaagcatataagtttttcacaaaagaatttgattaacaattattgttcttcacaaatttttgtatatttgtaatcatgagcttatatactgtcttctgttttctatcatggacactacttcgttttgtcttcccgtgttaggtgagacagaagaatttatttttttatatatttgaattctctgaatttgaaatatgatcttttcagctggtggaattttttgaagtggcgagcttatcattttctgaatatgacaaaaaaaagtcttatttactgtagttataaatagtttaactaattaacacaaatgcgaatcgaaaatttgatatatgtgacgacgaaacaactaaactagtacagtataatcatataattaaagatttgatgcatttgaaaatgtacgcgtttgatagcatatcataattaatttgcacgcctatatgacatatagcgtttggaccaattttagatgtaataaatcaaagaacacatcgaacacacataagttcgattttcaacgtctaaatttacgagaagcaaaacaaaattatgtataataataaaaagactaatattaccactcacaattagacacgatatatagcaaaacaagatacatagttttgctcaaaaacaaaacatggatgataatcagtaaaatgcggtgcctaccaagtaccaacatacaattataatgattattgataaatttttgaagtttttgtaacaatatacgaaacatcgtactcatgcattcaaacaaaaatgggacaggctgggttagataacgtgtgagggatggatttctctagagacgaagccaaatataaggcgtgactttaaatgatatcacactactgtttcatcttataacaaatcaaaagagatgaactagtgatgtaattctataaaatttaccacttagatgtactgtgtatcggctaattaattggtcataaactattactttcaaatgagttctacgtactattactatagtttaaaagtaaagtaaaatcatattcaatcaacttaggaactcaaattaatattgtctaattaacacaatgtcatcatcatatagagatttgactgcactaattaagttatcatggacactttctttctgaaaattctcattttctcactcaaataataatttcattctataaatagataatgaaatacacacacatctatcatccaccaaaaatatcatccaccactacccacgaagtaagaaaattacagagaaaacggaatatcttttaagtagaccttagccttttgctttattctcttgctttatgtctttcttgtttctgtaaattcacatgttacacttagaggagagcgaggtgttggtccattttaccttttgctatgatcagatatagaagatagcaaaaacattaactcaagacaagttcacatgtttgtaaaattttacgtaaatttgtttattaattgtgttagaaaaatgttcacatgttgctactattgacttgcctccatcatcttctttgtcccatttgatgtactcttagccccatgcctcttggatgccttttttaccttttaatttgttcttatataatataaaatattagctacccttttttttgttattcatggaacaattatttgcatcaaatatagtaatttaatggaataatatcaagaagatcccatttatctttgtaccttattctccatgtgaacatataaagcttgttatcaggttatttgtacatgtaatatctaagggtgtttactgatgatgatcggataaactcgaggtttgatttagtcaaatatagttcttttctaactaaaatcccaacctcacaattttgatgtttttcagtaaatatggtcattaataagttatgaattcgctaattaatagaaatttataagaaaacatatatccaacatttatggatatatgaaaagttaaaaacaaatgatataaaaagtacaattttatagctggtgcactgaaaaagaaacaacttttcttaccattaaatccagggagaatggtatcattttcaattttgaaaaaaagctaagattcgcctaactattattgttttcctctgaaaagactttaaaagtaatctttaccgtataaagtacagaaaatgaaatgaactcgtggacttcaatgttttcaattttcatgagtcttttgttttccttcaatttccaaataaacttatatatatatactaatcaatcaaaaacaatccactcaaaatgtgaaactatacatgtagaatacttgatgtaacatgaacaaacaatcaaaatattgtagttaaaaaaatttactgttgattttgatcagtaatatgtgtaattaaaaagtgataaaaagtcaagtggtttaaaattatcataagagtaacatatggactatggttcaaatactttcattgcaataacaattatgtatagttagctactatatgaatgtcttaatacattgcaataacttacattggagattagtctatatacatttatatattaaaaaattagagttgtgatctatatagttctctatgttatcattttacattttcatagttgaactaactttttattattattatgttcacgatatctatacttttgtggtttaagcttttcttagtattaacaatcaagaactactattttataaatacaatggacaagattttttcttcaaaaccacaagagagagtcattttcattttcttcctcatctctctctctctcttctctccaaccaaac

SEQ ID NO: 11314 - DNA, 3000 bp, Unknown
  misc_feature (1)..( 3000): cDNA_ID_3039536_gDNA_ID_2214489_Annot_ID_183598 3000 nt of promoter + ATG
tctgtctcacctaacacgggaagacaaaacgaagtagtgtccatgatagaaaacagaagacagtatataagctcatgattacaaatatacaaaaatttgtgaagaacaataattgttaatcaaattcttttgtgaaaaacttatatgcttgtgtcaagcatcatatgaaaataagataagtatttgattattgtgtaaataatttcaactcttcatatagttgacaactgtatgccatttccgtatagttcgtcactcgattcattggtttctaatgatagaccataatgttccacctcaatcaatacgatttagtataaaatattatacatcaaatgtatcacatttcttagagaaaaaattacaaggtcttttcatgtgctttatttatttatattgaattgactaggaaacagtataagaaaaaaatgatatgaaatgtctgcatcacagaaaccgagttttgttggagaccacaagaaaccaagcaagtcgaagacaaagattgaagtataaagttttaaaagcatacactaattaactagtgctattatattcattctatgcctaaaagtaaatgttgcaaacatatcacgtgaccaagacaaatgtgcactttaaattaattaacaataatctcatcgacaatacatatctttacaagttttctcttttgttttcacggttctcactcttatattcttgcgtttctctatatatttttttttttggataccatgtttgtaccattcttttccttgaaattcggtcattatgatacaatcaaagaataataatacattaaagatttaaaggtactgataactgcagcttaaaagactaaatccaactttaagcatatgcataattacaacttttcagacgaaacctgcaaaggaaaagatctttcattgctcttaatattcctttcgtatagttgggccttgaacgctttttttttttttttaacatggaggggtttggggccttgggctttagggccttaaattatttaagaaccataaaacgctttttattaacagttgatttatttctgcacttctcatgtctttgggcaaaggaaacaacataatcttgaaagttttcataaattgtcatatgtgcaattgaaaacactgagacaacattacataatcaaggttcagaagaatcctcacaatcattgtcataggatcctgtcaatcttcgcatgatgttgaattatatgaatcagaaaggtatggattgccgatcaggccaagactcgatcttctggaagtaatcgacaggcaatacaccatcaatgccttcagtcaaaatcactttgttgtctgatatgtagaacgcaatcccatctgggtgcaccaataaagtggaattttaatattgaatctttcaagggcatatcactattttttcagacaagttattaagttctcataccttcaagagctttcttgatgtcgaggaagatgataacatttacatttcttctcatgccttagccaaattatgtcgatatggaaaatcagataaatatgcatatgaaataatgtctgaccaacaacaataggattaatcaaatattaccactaatcacttcaccatctgttggtaatccacaagagaagtgaacatgcattctattcatacgctttaagcccgatgctaagatggattccaaattcttcctataagttccatgtacacacactgccattacagaaattcaaatgaactcgagtaacacataacaataacataattttacaagtatgtgtcctagtagtacctggagcttcttctggtgacagtattggtttaagtaacttctctgactcaaccgtctgcgcacaaagacataagctaaagctattgatcaaaactaggagaacaaaaatccaatcatagtgctactgtgtctcaacgaagaagaaaacagccaaatgctaaggattcattgttcaagttctattaccgtgatcgaatggccttggttagcgcgaatcaagagctctccattctcatcgatgagactaaaccgttgcttattgtcccttctcacagcctgcaagttaacgaaaaccatacacaaactcatctcaaaaacgtctccaatcgaaaatgctcgttgacaaaaacaagtgaaaaaaatgaaactaacctctctaatttcatcaatcgtgtgtgactttaactgaatatttgcagaagttttcaaattcaggttaagtaaatcttcaactttaacaaaaccatcacctctcatgttcaatctcagctcagtagccatatgtcgcaatattctcgtcctgattatcaatccattatagattcaaaattcaagctaattctctaacatctagaatccagtattgatcgattacacttacaagagtcgtccaagtgcatcgattctatcctttccgcctccaccgtcgccacgaccctgaggtctccgtcgatcgttatctctctcatatcctcctcctctaccaccgctaaatccatcaaaatcaaacaccaaaccttacatgaaaaaacgagggaaaatcaaaagggattttgacttttcgaataatttgaaaaattagaattcaccttcgactggactgagcgaaggaagagacattagattttctagaagaattgggatttgaagcatccatgaaagcagaagaaacaggagacgatttcgagaagaagacagagctgctcaaagtcagaggaagaggaagtcgatgacgacagagacgcagcaacattatgtattcgccaacttaggaatcgatatacattatgtactgggcctttctattataaagcccactcagataagtgaatgacgagacggcatgatattcgatgacagttcaaataaacgtcacgtagtttgggttcttcccggtttagtttttttcaggcggtcagtagtcagtcctcctccgcggattcgtttgatcggcgattgcgttgaaggttgaaaatacgatattaatg

SEQ ID NO: 11315 - DNA, 3000 bp, Unknown
  misc_feature (1)..( 3000): cDNA_ID_3039543_gDNA_ID_2214489_Annot_ID_183595 3000 nt of promoter + ATG
ggttgggagaaggcacttcctgtaagtagaactttctggtaatctataacgttttatcagtattcttcatatataaggctcttattttaggcaacttaaaattttcatttagacatatacaccagactctccgggtgatgccaccagaaacctgtctcagcaatgtcttaacgcacttgcgaaagctgtgcctggttttcttggtgggagtgctgaccttgcatcttccaacatgacaatgcttaaagcattcggcaacttccaaaaagccacacctgaagaaagaaaccttagatttggtgtcagggaacatggtatgggagctatctgcaacggcattgcccttcacagccccggttttatcccttactgcgcaactttctttgtgtttactgactatatgagagctgcaatgagaatctcggctttgtctgaagctggtgttatatacgttatgacccatgactccattggtcttggagaagatggaccaacccaccaacccatcgaacacttatccagtttccgtgccatgcccaatattatgatgttccgtccagctgatgggaacgaaacagccggtgcatacaaaatcgctgtcacaaaacgtaagacaccttctgtcttagccttatctagacaaaagctgcctcaacttccaggaacatctattgagagcgtcgagaaaggtggatacaccatttctgacaactcaaccggtaacaaacccgatgtgatcttgatcggaactggatcagagctagagattgctgctcaagctgcagagaagttaagggaacaaggcaaaagtgtgagagttgtttcctttgtatgttgggagcttttcgacgagcaatcagatgcatacaaggaaagtgttttgccatctgatgtatcagctagagttagtatcgaagctggatcgacttttggatggggaaagatcgtcggaggaaaagggaaatcgattggaattgatacgtttggagcaagtgcaccagcaggaaagctttataaagagtttggtatcaccattgaagctatggttgaagcagccaagtcacttatttaaaaaagtatcttacaggtactaccgaggtttgcatttgaagtaagagacattccataagcattatcttctttgtccaaataaaaatatactccttccaatctttttataaatgatgtttaaagctttcattttggtttttaaataaatgatgttttaaattttcaatgcaaaattatttttattggttgattaaataaatgatgttttaggcttttatttatatttttattgttttcttgtaattaacatagttttgatctttgtaaacaacaactctattgtacttttattcttgattagttgattttatttcgcaaagacatgtaatccttacatgttaattgcaatcgtctcaactagtcttacatctactttgtagtctaattggttgacacaaaaggaatttacggaattctgtctagaatctttccatttttgcttacaaatatggcacaaccggaaattcccttacttatttatggaaaaacaaaagtgtcatgtgttatatatattggtccctttttatgtttgtagggctatcactaccaatccacaatggaagattcacaaccgtgtacatcacgtaacctagatcatgccgaaaactccacagcaagcattcctcttaaactcatcttcgaaatactatcgaggctttcgacgaaatttatcatcagattccgatccgtgtcgatgctgtgacgctctatcatcgatagtaaagatttcgtcgacgcctttctgaatcctcttttttcaatgaagactctttttttagtccgctttatggaataatacttatgttttaacgtaatgaatctttatatctatttgtatttttcagttacacttttgtttggacgttttgttttcaaagaacttctcaagttttcttttccttttttcttcttgtagtttgccttgctcgttggtgaatacactacattaattgagggcacttgcgattatgatgttctcccgcgtgaaagagcattgacctctcttttattcaaaacatcacataacagagagtctgtgaggtttgggacatcgcattctcaaatctcaatataagtggttttggtcgaatgctagaaaagggtgacttgtatgttgtgtcgccgctagtgttcgtacatacagtttatgatctaacgtatctataacatattattaatagatattattttgttttaattttgcacattgtttataaattaagtgcaaaaatttttagctccaagagatcgcctttgctaatcaataaaattgaacgcatttaataaaattgtaagagcaaactcgcactgatacgtagaataaatttgttgcttttgccttcacgacaccattacctatagttaatactccaaaagaaatagcagattcaacatacaacgtgcaagaccaaaaaacaaatgactcgtaatctccagagaatcataattcataacatgggagattgtccacaaaaaacataaattccctttcatgtctttttgttagaaaacccatttcttaaggcccaacaaaaaacataatcccctttcatgtctttttgttagaaaccccatttatctttcttgaggcccaatttgaaaacccacattttctttcacctaacccaccaaagcctttgcacatgttgacgtgaacaccaaactaacacgtgtcatactgccagtggttatgataaatgctcataccataccagagtcatagagtttttggttggtgaaagatttgacggatgccttcttctcatttctcaccaactccctccaaacccaacaaaagtgtttatattagcaaagccgccaaagtgtaaacgaaagtttataaatttcatttctgtgatcttacgtaattggaggaagatcaaaattttcaatccccattcttcgattgcttcaattgaagtttctccg

SEQ ID NO: 11316 - DNA, 3000 bp, Unknown
  misc_feature (1)..( 3000): cDNA_ID_2706252_gDNA_ID_2214489_Annot_ID_183594 3000 nt of promoter + ATG
tcaagaagatgtggagaagaccaatcgattgtcacagagtctgttctgctaaggagttttcaaatggatttgaagaaaaatggcaggcttcattgttttaaggttgttggtctcaaatccatttgtatctttgcccattttgggctttaaatgaaaagttgttcgacgaaaaaaaaagggaaaaaaattaaaaaaacgtaaaaaaagttgcaaatatggatcgaactcacgacattagtaaaatttagatgtcgttgaaccactagactactgagaattatacgatttttaatccaatagtttttaaatattgattcaacgatagggagttaaaagactttcatcgttatatatgtggcgccaacaatgatttcatttgggcggcgtaaatcgccggcgattgaagaaacttcactcgcgacttcagtcatggaggcatggaggttaccgttatcgccttcgattagaggaaaactgatatcggccggttatacttgtctgtcttcgattgcttccgtctcttcttctgatctcgctcgaggtaaatttctgctttaccctaatcttagaagattagaatctgttgctcgtttttctctgattagcacagacagtacacctcaattgattagtccttgggttgataattagggttctatttagtctcttgtttaaggcttatttctggaataattctatatatgtgtgtgtgtgtgttttgagtcatctttgatatcgttggtgtgtgagtagatgcaaatatcacagaggaggaagcatttgagattttgaagctggctaatcaaagttgttgcaatggaagccgttcactcataaatggtaacttgatgaactcctccttggagctatgttggtggtttttctccttcttaaatggttcactcaaggattctctttatgaaattttgtgactaaacaaaggagcaaagaacgcttgggatatgcttcacgaggaggagtctttgccgcgtattactacatcttgctctgatcttgataacattttgggcggtggaattagctgtagggatgttacagagattggtatgtcatctccattatcattctttctctggtccaatttgagatcattaagtgatttagtggtttgcttattttctcaaaggtggggtaccagggattggcaagactcagattgggtaaatccgcttcactgctttcctctactttctcatcatcatcagagtgtttcctcttctgttaacttcgatctggtttcaggatccagctctctgtgaatgttcagattccacgtgagtgtggtggtcttggagggaaagctatatatatcggtatgtttcttttagtagtgatgactaatgccttggttgatcacttacttggttgttaatgctttttgtatgctacagatacagaaggtagcttcatggtggagcgtgctttacagatagcagaagcttgtgtagaggacatggaagaatacacaggatacatgcataaacattttcaagcaaatcaagtacaaatgaaaccagaagatatcttagagaacatattctacttccgtgtctgcagttacaccgagcaaatcgcattggtcaatcatcttgaaaagttcatctctgaaaacaaagatgtaggtataataattttgaagttccatcccgttgatttgctgctacaagtgtatattgtgacataattcggcggctcactaagactctctttaatctttcatggttgcaggttaaagttgtaatcgtagacagtatcacctttcatttccgtcaggactatgatgacttagcccagaggacacgagtgctcagcgaaatggctttaaagttcatgaagcttgccaaaaagttctcacttgcggtaagaagaaatgatctaattcacaatacaatccttgactagcttaagtggaggttcctaatcaactcttatgatccaatctcaggtcgtgttactaaaccaggtgaccacaaagtttagtgaaggctcgtttcaactagcgcttgctttaggtgagccaaactcaaatctaccatctcagtttgctattatcatcatcatcattcatttgttatgatacttaaatggtcaacttgtgctgttttcaggcgatagctggtctcattcgtgcaccaaccgagtcattctgtattggaatggtgatgagcgttacgcatatatcgataagtccccttcacttccttcagcttcggcttcatacactgtaaccagtagaggtctaagaaactcatcctcgagtagcaagcgagtcaagatgatgtaatgacacaccacgacacagtcacaaggacatgagtaagctttctccggtttagttttggttcagttcttgattccattaaactgcatgagtttttttcggcccaattgtttcataaagcccaaatgggcaaatattcggtacaaaagaaggtcataagaaggcccactaattgcaaacataacaagaaaaaatgagcaaaataaagacacgtgctatgcaacgtgggatgttgagagaaaaaaaggtttcgtcagctacgccgtcaccgactgggtcaataccggagttggtgaattggtgactaaaatgtatttcctaaatctaaagcaattttgcccccaaaaaaaaaaaaaatctaaagtaattaggttcttcaccaacccttgtcataaccatggcttttgcttaacacaccaaccatgccgcattgtcaatctattttttacttaaattaaattattattttaataattagcgtaaaaagcaatgattagttgaaaattaaacaaaagaattagattcgaaaaattgttaaagccatagagcatcacagccgtcaagattgtgtcctttctgaatccaacggtcagatcgagatctcattggtttattaatagcaacagtctcctaaaataggtttgcagagaagctttctcttctattttctctctctcagttaaccagagagagcatca

SEQ ID NO: 11317 - DNA, 3000 bp, Unknown
  misc_feature (1)..( 3000): cDNA_ID_3039547_gDNA_ID_2214489_Annot_ID_183593 3000 nt of promoter + ATG
agttttgtctgagaaagcctttcacttttaaaaatttctatcctttatatgattcgttaagtttcacctgttctgatctcggaattggcaacattaaggcagaattgcttgtccaatatggaggcgtcgctcctaaacaggctgaagaagcacactcccgagttatcgataaggtaatatagactattcatcgttacaaagcattgcatgactcgataactctcaagtatctagattcagtctttgttcacaattggtccagattcttcattttgccctgagatgtgcatatttttaggccggtggggtttaatgctaacggcacacaaaaatgttgattcatcggttgcaggttgtgcaagacgcgcttgataaagccaatttgaccgagaaggatctctctgctgttgctgttaccattggacctggtttgagcctctgtctacgtggtaagttggagaaataagaatccactcattgtactttggaatgatgagtgttgttagagtacttagacacaagtgtttattttgagttatacagttggtgtgcgcaaggctagaagagttgctggtaacttcagtctcccaatcgttggggtgcatcacatggaggctcatgctctcgttgctaggtattgcttaatctgctcgcgttatggttttgttcccattttttgagatttgtgactggctcatcagcgtctgatttgtctatgtagattagtggaacaagaattaagcttccctttcatggcattgcttatatcaggtattgcaaaatcagttaagtttaatgtaagtgagaaactatcatcttagtgaagttattcttaagcaaaatcagtttcaccgtagggattaggtttctatctaaactgaaacgccccttttctttttttctatttaggagggcacaatcttctagttcttgcgcataagcttggtcagtacacacaacttgggactacagtagatgatgctataggtgaggcatttgacaagacagctaaatggctcggcctcgatatgcacaggagtggtggaccagctgttgaagaacttgctctggagggtgatgcaaagtctgttaagtttaatgtaagtgacaaactagttgctggttggttagatatcttttttcatgttctactcaatgttcacatcatttctgtgatattgtttaccatgtttatcaggttccaatgaaatatcataaagattgcaacttttcttatgctggtttgaagacacaagtgaggctagccattgaagccaaagaaatgtaaaatagtgagatcttataatcagcttcggaaattgtttatcagcgttgtgtcacatatgctgaagctttgtgttacaaaaatattggtcgtttgctggatgtgcagtgatgctaaatgtcccgtctcttctgcaacaaacgaagacagaagaaaccgtgctgatattgccgcttctttccaggtacaaatttatctccggttttaatgttctagtgaaatgctgatttctaaacattttcagtttgtatgaaccagcgagtagctgtcttgcatctggaagaaaaatgtgagcgagcaatagactgggcattagaactagagccttctattaaacatatggtgaggtttagaacaagaaaaagaaacctctgttttgcttgacaaatgcttctagactaatattgactaagcttcaggtaatctctggtggtgttgcttcaaacaagtatgtacgactccgacttaataacattgtcgaaaacaaaaacctgaaacttgtttgccctcctcctagcctctgcacagacaatggtaaatagagtttgaaattctcctactgatcaaattagagacacagagaatagaaactaacaagtattcattagtctcaccaggagtaatggtggcttggactggtctcgagcattttcgtgtaggaagatatgatccacctccacctgcaactgaacctgaggattatgtggtactttttcttaacaaaactcggtacttgtaaagattctattgtttgaaaaactgataacttggagattgatgttttgttggttatgaatttagtatgatcttcgaccgaggtggcctcttggcgaggagtatgcgaaaggaagaagcgaagctcgttctatgagaactgcacggatccatccgtcacttacttcaatcattagagcagattctcttcaacaacaaacacaaacgtagcaagaagattgtctcctgtaacttaaaaccagatatccaaatccttgtattcttttcactgaggaacaaacgcttttccggttaatttaatttcgttcaatcattggtcccggttaacctaaaccgtgtctggttcattatactttttagtttattcctagttccaacattaaatggcgccaacattgaggagaaaaaaagaagcttgcagagatcaatttttctctaaagattcagtggccgtgaggaattctttcagcttcaacatatgctctaatcttctcaggcagggagtaatgatgcctttgctcgtccatggaaagtcatgggacgtcttttatcgataaatcggttgtggagcggagtgttctgtagcttcgaggcggtcagagatggatttccggtcaagaagatgtggagaagaccaatcgattgtcacagagtctgttctgctaaggagttttcaaatggatttgaagaaaaatggcaggcttcattgttttaaggttgttggtctcaaatccatttgtatctttgcccattttgggctttaaatgaaaagttgttcgacgaaaaaaaaagggaaaaaaattaaaaaaacgtaaaaaaagttgcaaatatggatcgaactcacgacattagtaaaatttagatgtcgttgaaccactagactactgagaattatacgatttttaatccaatagtttttaaatattgattcaacgatagggagttaaaagactttcatcgttatatatgtggcgccaaca

SEQ ID NO: 11318 - DNA, 3000 bp, Unknown; identical to SEQ ID NO: 11307
  misc_feature (1)..( 3000): cDNA_ID_3039555_gDNA_ID_2214489_Annot_ID_183590 3000 nt of promoter + ATG

SEQ ID NO: 11319 - DNA, 3000 bp, Unknown; identical to SEQ ID NO: 11306
  misc_feature (1)..( 3000): cDNA_ID_2717251_gDNA_ID_2214489_Annot_ID_183586 3000 nt of promoter + ATG

SEQ ID NO: 11320 - DNA, 3000 bp, Unknown
  misc_feature (1)..( 3000): cDNA_ID_3039566_gDNA_ID_2214489_Annot_ID_183583 3000 nt of promoter + ATG
tcatcagcatgcaagcttgctgggtcgagtgtatccggttgtatcctgaacgttggatccgggttttgcgaaagatccatcttgagactcgtctcccgattctaaaccctatgatcttcctcatcttcttatagctaactttaaaaaacagtttttgtcacaaaactacactttttgagagatctgagaggaaatagagattaagagagtgagacgagacatggactaacgagtcaaataaagagtgattcatttgaacgagaataaataaatatatcaatcttttttacattttcttgattttctctataagaaagaaaaaaaaaaagacaatttctagggaaaacacaaattcgaaaatgatgtgaacggacaaagaagaaatgctttcgatgtatataaagtataaacgttaaagaagaagagatcaagagaagaatgagtgaaagacaagaggtctttaaaggagtttatatggagtctaaataaatgaacggttagatgaagactaaggtctatgaccgttggattagattaaaactgccatatttctcttgcttggcagatagtccaaacccgaagaatctacattaaatatgacacgtcccattaacctttagcctacatttatcattatcactgaaacgttttgatgggttatcaatcacaaattcacaatacgaaaaaaaacagtagtgtcaaactattatggtattttagcgtgtaattcgttacgcagatattattatctatggttgattttgaatctgaaaatatgatctatcgaagaaaggcctgaaattattttattatctgaatatgttttgtcggagcttacatgcttagcatgtttgaacttcgaagatgaagacaactatgccaccacacgtgtgctggccaagtgggacaaagttttgaacctattcggtaacactcacacgagatcaaatccccaccatctcattttataatgtcgtttatttatttgttagtgatcatctactgttttttaataaggttagtgccctagtgatcatctacttgtctgtgattttgtaaaaaatatatatagaattaaaattatattacgagaacaaaatgtgtacggtgtgtcctctagttgcgttacttgtgtacgttgatgatggttgatatatatacatattcatatcaggacaaaaaagcttttaaaaagaccaataaagatagatctagttttgagtaattggaggattcactaagctttttggagctaaaatggtgaatttcccacgaatcaaatctgagaagagaagctttctatattttgagttactttacacaattacacgttcatttgtaaattaagatcgtgtttgtgctgcatccaaaaaattcttggaattttaaagtaatgaaatataactaaacaaaatgaccactaaaaaataaaataaaaagcacatgagagatgagtgattatactctgataaattagctaacaaaattatgtatatataaaaaaggttttatgcagtgtaaattgtacttacacacttaatcaaagcaaaacaaaaatattaaaccgacaataatacgtaaaccaaaaaaccaatattccttaaaatcaatttgtgtttccaaccgacaagttctttgtatatatggttaatcatattttgttgtagtccgtatcctagctaaaagacgtttaaacgttcataatggatatgacccacccagctggtgaagatattcgtttttcgtgatcatatatatatgtttctttttgcccatccctgtttctattaacccaagttaaattagctatatatgagcaaaaactatgagttgaagttaagcacaatttccgaatcacaaaaaaaaaacaaattgatttggacctttcgataataggaatcagaaagaagtttgttccaaacacttctcttatataaatcccaactcatcagcttcgtgtttccgtacagtgcgtacatatacgaacgtgtcactcggcttttaacgtcaacttaatcgagagcccaattcaggcttactataagccttaataagcccaatattaaaagtccctgattattgtgagcccaatattaaaagtccatgactatggtgagcccaataataaaagtccatgactatggtgagcccaataataaaagtccttgattaaaaggcccatcaccagtggagcgaagaagcggaggagggaagagggatgcgatcctctcgtcatcgctggttccatcagtttcagtgagaatcagatcgtcgttgtactgagagctccggcattggttcacggcggagctggagagttatctaagaacggagaggttactgatctgaattgttgaagatcggaaaatgacagaatcgagtctggatctgcaggaatctggttgggaagaacttaggcgggaagctcgtaaaattgaaggagatctagacgttaagctctcttcttacgctaagctaggcgccaggtttactcaaggcggttcgttcttcttcctttccgcttgatcatgctatctgtgtctttctttgttatttccattgctttgaatgttgctgttatgtctactatctgaatgtgggggttagtagtctgtaatgtgatatagatctaggaatcaatgttggatatgatctcttcaccgaattgaatttgatcgccattgtttgctcagtctatgttatgcttccccaatgcttaattcatgtgtggtgtttggtagagtaaagttaaaattggtaatgtttctctcagattcctgtcaaaattatttttctgtgaatgactaaggtaagaagaatttttgtgtgttaagcttactgttttgcattagctttcagtttttaagaattgcattgttgtatgtatcagatactgatcttgttatgaattatgagaaagtattgaaatgtgttttggtttcagggtatgttgacactgggtctccaaccgttggatcggggagatcatggaagtctatg

SEQ ID NO: 11321 - DNA, 2490 bp, Unknown; identical to SEQ ID NO: 11304
  misc_feature (1)..( 2490): cDNA_ID_1807075_gDNA_ID_2214489_Annot_ID_183580 3000 nt of promoter + ATG

SEQ ID NO: 11322 - DNA, 3000 bp, Unknown; identical to SEQ ID NO: 11317
  misc_feature (1)..( 3000): cDNA_ID_2717275_gDNA_ID_2214489_Annot_ID_133421 3000 nt of promoter + ATG

SEQ ID NO: 11323 - DNA, 3000 bp, Unknown; identical to SEQ ID NO: 11316
  misc_feature (1)..( 3000): cDNA_ID_2706252_gDNA_ID_2214489_Annot_ID_133422 3000 nt of promoter + ATG

SEQ ID NO: 11324 - DNA, 3000 bp, Unknown; identical to SEQ ID NO: 11315
  misc_feature (1)..( 3000): cDNA_ID_3039543_gDNA_ID_2214489_Annot_ID_133423 3000 nt of promoter + ATG

SEQ ID NO: 11325 - DNA, 3000 bp, Unknown; identical to SEQ ID NO: 11313
  misc_feature (1)..( 3000): cDNA_ID_2717263_gDNA_ID_2214489_Annot_ID_133427 3000 nt of promoter + ATG

SEQ ID NO: 11326 - DNA, 3000 bp, Unknown; identical to SEQ ID NO: 11312
  misc_feature (1)..( 3000): cDNA_ID_2717255_gDNA_ID_2214489_Annot_ID_133429 3000 nt of promoter + ATG

SEQ ID NO: 11327 - DNA, 3000 bp, Unknown
  misc_feature (1)..( 3000): cDNA_ID_2706256_gDNA_ID_2214489_Annot_ID_133430 3000 nt of promoter + ATG
ttgttgacgaaaaaaaaagaaagtgttttgattcagatttacaaagaaggtttgcttaaaaaaaaaggtttgccaaaaaaggaagagaaggttttagaaaaatgaaaagaataacgcccaccgtggggctcgaacccacgaccacaaggttaagagccttgcgctctaccaactgagctagacgggctttttgatttaactttcaatctactagatattctccacatatattttacatgtactttcagtattttaaaattcgcgaatcaaaacaagatttgaagtgaaatgtttagaaaagtgggtttatgcaaaacaattaatcatgtgctacatcaggcccttatgataaaaactaaataaatttccacctcgaacgaatatcatacattggaaaataatatagcatggttctgttttctgaacataagattcaaatagtattcaaatcaaaacaactagctgctactctcttactttttggtcttcaagtccaaaatccttaactaggcccagtaagcttgtccgtcatgacatgacaattttaacgtattgaaaaagaacgcttgcttacttctatcagcagcataattaactggatcaaaagagtaagcaagcctatgcaagatccatatcgactttatggaatgttaacaatccacagaacaaacatatcaaacaaagtgactgtgacattttctttggaatgcaaagccttaagtggtacctttcctgtataatgtaactgcggcttgctatggttatccacagatgtctttggataaagttttggaagacgaggttgttgaagatacaggggaatcacaagtctttaacttgcttaatccagaatttgtagactttgatacttgtttagatcctatcacaaacgaacttccaacttccggtgactgaaaaaaagatgcaagtacaaaactttatcaaataataacatagctagcaacatgtatactatttgagtttttttagagtttctaagccaatcagaaggctctatttcgtacccactcgcagaaagagcgcgttgagcgagtgagagcgattctgtgggtaaacccctttccaattcatgactttttttatcgacgcacatctctccaaattctccatcgcgtgactcttttagtttttttccacaaaactaaatgaaaccgaaccgaaatcagttttaatttcaaaaccaatgcaaaccaaaccgaatcagcaaatagtgtaaagcaacaattctggacagaaattttatcaacatctcaacaacgggaaaaagagaaaacaccacaactcaaaatcacaaatcatagaaaaatatccaaaaaaaatcacagtaacctttgattaaactttcaaattgcaaaaatctcagaatcaaagccaagaagaatcttgaataacaatctactgcttcaattaaacatgaaaaacattagaaaaagcttagttttactagttttagtaaaatttctcggcaacaaaatcaaaacagagatgaacacataaaaaaaaaactaaaacagaactgcatattcgataagaacaaagactatttgcaataattaaggtttatacatattagactcaccggttgaaatctaaaagcatgaagagctagctcttcgtgtttgcctccctttattatctttcttattttctcaactttgtgtgatttcaactcacaactaaaagtaatggggtacattaagaatatttagattttaaggggttgaagttgtaattttgaagaagtggaagatcaatagaaaataatagaagaacagagacgacgaaacctgccggggaactgaggagagaaaaaaccccggcgaaaaagggaaattcgaattcgtcttctgttgatcatcgcttcacttctgcttccaggtcttcatcggaaccaatctcactttcactctctaatttctaaattgaaaatcgatcttatcaattgtgtgtttgtgttttgttgcagagcttttactcagaagaagctcgatgatctcaaatctctctttgtttccctcgcttccaagtctcacagcaatgaccaatacgtctcgtaccctgttttccaggttttgaccaaaaaaaaaaattgtgttctgttctcatctggtttttgtggttgataattttgaattaagccttacacgatgtgtcggatttcgattttcacaggagtattttggtctgagtggttctttaggagaaaggatctttgatatggttactcaacacaggaaagatgataaaatgacttttgaagatcttgttattgctaaaatgacttttgaagatcttgttattgctaaggtacacacttaagtcttttcatcctcttaatcattggtttcttcttctgagcttttgaagatcttaaaatgcagagttcaattttgtaatctccatatgaaaagtgattgtagttataaatgtagaaccagtctcacgttgaatagaatccttcctcaggttaagtcactgatttttctgaaaagtctattcctttttgttaaaaccctggtttcaatgcttgccattggaatttttgtggtaaaataaagaaaattcgcaaggatgaagaatgatgaagaagcttctaggttatggtaacatgacacgtgtatcaatctcagacgtccttttttgttataattgaggttatataaaatcagagtgatgttattttgtcttttgaattaagagtactctgcctctggaatttctgggttcttctcggattctctcaaaggtactctcttttcttagctcttgttcgaactcttcgattatcttatagaacgataggttatatactctatttgaaaatcatctattagagatagagatttggtgaagtttgtattcaatttaggttcttcatagagatttttgcttgatgagtatagagaagagtttctgagatcatgatactatagtttatgcaaaaagattgcagaggtaaaaagaggaattaggaaaatg

SEQ ID NO: 11328 - DNA, 3000 bp, Unknown
  misc_feature (1)..( 3000): cDNA_ID_3039528_gDNA_ID_2214489_Annot_ID_133431 3000 nt of promoter + ATG
ttgcttcttggctcatcatgcgtctccttcaacgtggctactccgttcgggccacggttcgaaccaactcaggttcgagttaattaacttcactttctctttacttatacactttgaatcatcatcactgattaagcaaatgccaataaaattattgttgtcatatatggctgattggtccgttttaacataaagtacataaatagaaagatagattatagttttttttttatatatagagagagataacatttaaagttgatttttggatcgacaattaaaaatatatatatttttatggatgtgaaaaatttattgtacttggctggaattatctgtcagtttgtaggatcttgaagcttcatagctatgtaaatatgtcatgtttccatgcatcttctatagaaagtcaaccatatattttatgatcaataactaataagtaatcacggaccataagatataaatgaagttaataattcataagtttgtttattttatgcatattacagaagggaataagaaagatataagctacctaaccgagctaccatttgcatcggagaggcttcaaatattcaccgccgatctcaacgaaccggagagcttcaaaccggcaatcgaaggatgcaaagccgtattccacgtggcacatcctatggacccaaacagcaacgaaacagaagagaccgttacgaaacgtactgtgcaaggtctcatggggatactaaagtcgtgtttggacgctaaaaccgtgaaacgttttttctacacgtcaagcgccgtgactgttttctatagcggtggaaacggcggtggaggaggcgaagtagacgagagcgtttggagcgacgtcgaggtgtttaggaatcaaaaggagaagagggtgagtagctcttacgtcgtgtcgaaaatggcggcggagacggcggcgcttgagttcggtgggaagaatgggttagaggttgtgacgctcgttattcctctcgtcgtcggaccttttatatcttcgtcgttgccttcctccgtcttcatatctctcgccatgctctttggtacttaattctcatatctaataagttttttattttatttttctccatgattaaactaaagctgaaaattaataattttaaaaacttaaccactttgattacgtatacgttatatataggtattaatttttaaaactaaccaaaccttttatttctcaaataaagtaaagtaaattcatagtactagcctactagctagcttgtactctagtagtagttaaatggtttatggttggttcaccaagtatcttgggagatcatagctcgaattttctcaaaaaaaaaatttttgaacaaatgctcgaattttctcatttatacttttgttttaaatgaaaaaaatattctgctcaggcttagtagatttatgtttggacatagtggctattgaaaatgttagaattcgaaccaaaatatgtatattttatacgaaaaaacagaactaaaatcctaattactatacgtaactaataaaactcttttcttttgcttataacctacgtgcgtggaatttttgagttatttagaacgaattttgtgtgtgttaaactcgtgtaaacatgtgctaataatattcacaaatagtgttttgagtaataatcactattcactatagtaatattacgtttttttatgaaggaaattacaaggagaagtatttgtttgatacttacaatatggtgcatattgatgatgtggcaagggcgatgatatttctattagaaaagccagttgcaaaaggtagatatatttgttcgtcggtggagatgaagatcgatgaggtctttgagtttttgtctacgaaatttcctcagtttcagctaccttcaatagagtatgtcattttttactagtataattaatttcacgtgtaaatattctattgtttttttccaagagtttttattatgttctttttttgtgtgggtacgtaaagtttgaataaatataaagtagagaagaggatgggtctttcatcgaagaagctgaaaagtgccgggttcgaattcaagtatggagccgaggaaatattcagtggagctataaggagctgtcaagcaaggggatttctttaaattcttatgggatttttgtgttaaaatttgtatatgaattgaaaatatgttttttctttattggccatttccgttttgtaacatgttctagttacttgttgacgaaaaaaaaagaaagtgttttgattcagatttacaaagaaggtttgcttaaaaaaaaaggtttgccaaaaaaggaagagaaggttttagaaaaatgaaaagaataacgcccaccgtggggctcgaacccacgaccacaaggttaagagccttgcgctctaccaactgagctagacgggctttttgatttaactttcaatctactagatattctccacatatattttacatgtactttcagtattttaaaattcgcgaatcaaaacaagatttgaagtgaaatgtttagaaaagtgggtttatgcaaaacaattaatcatgtgctacatcaggcccttatgataaaaactaaataaatttccacctcgaacgaatatcatacattggaaaataatatagcatggttctgttttctgaacataagattcaaatagtattcaaatcaaaacaactagctgctactctcttactttttggtcttcaagtccaaaatccttaactaggcccagtaagcttgtccgtcatgacatgacaattttaacgtattgaaaaagaacgcttgcttacttctatcagcagcataattaactggatcaaaagagtaagcaagcctatgcaagatccatatcgactttatggaatgttaacaatccacagaacaaacatatcaaacaaagtgactgtgacattttctttggaatgcaaagccttaagtggtacctttcctgtataatgtaactgcggcttgctatggttatccacagatg

SEQ ID NO: 11329 - DNA, 3000 bp, Unknown; identical to SEQ ID NO: 11310
  misc_feature (1)..( 3000): cDNA_ID_1807433_gDNA_ID_2214489_Annot_ID_133432 3000 nt of promoter + ATG

SEQ ID NO: 11330 - DNA, 3000 bp, Unknown
  misc_feature (1)..( 3000): cDNA_ID_1831917_gDNA_ID_2214490_Annot_ID_133442 3000 nt of promoter + ATG
ttagattattaagcttatattgaagggttttatatttctttcttgcgtacatttctctttcgttttctctaatgatttaagttagattagagaggtcaataacgtatgcagttaaccttttccatttcccgttattgtggaaacctcagtttgactacatactccgaccactttttagtgatatttaacacaaaaagaacttttgaaaaactaatttatcggtgtgactttttttgttcgcttgtgcatttttttccaacactggtccataagtttaccatgtaacatatattagtatttagagttagtatatttctacaaatatgtgcacagctagctagcattacttggacccttaaaggtgacatgtattggatataggaaatcaggacccctttagcaaaaaaaaaaaaaagaaaaaaaaaagaaaatcaggaccatcttaaaactatttgttcctctctatataatggtttataatcataattaagatttaaagtacaaattatagttattaaaaaggttagttctcacagataataacagaaaatattttaagttaccaattttagcacataatatctaaagtttttaaaatactatgaatttaatatcaaaaatcttatataagtatttgatggacgctttacgcgataataatagaatcatgatttcaaattgtgattaattttttacgtaattcggtgaagataagtaattcttgtataaatttcactaatgttaattttaaaagtttatggaagatatgatataattgttcataaaacttgttataatgctattataagatatttttcttaaaaagacaagtaaattactttgttcgtcgaacacaaactaacttacgcttgatcaagctgtattctacaaaagttatacattattaatttatcattacaaaaattggaaaaaggttactttaacaattcaaaaatatatcgaaatccaaaaagatttatcaactccttttaaatttcacgttttacgtgaatcatgtgatataatcatatgcatacaaatgtcatctgagagatttcagccgacttttgaacaaggaccaaaacagcctacgccatgcggagaccacgaaaatagatattttattataaataaatggatttttttggacgtaatgaaacgagaagtggatcagaagattaattacataatcttttctatttataaatttaaactatttctttctaattcattaacaattttgatacatcaggacaatggtaacttatgttactataagacaatggtaatatctcaatagaagtttttttttgtaaaatcgcaatatatacatgaattaataatgacatatgatggtcatttggacataatataaaaatataaatatttggcaaaataaataagtaaatgaaggggagaggaatgtgtgagtgtgtgtgggtgtggatgcctttatgcctcctacatctcaacattgagcaaaattgcggctgcccaacaaccacccaaaagagaattagtcaaaattattaaaatcaatgcatgtcctaatctctctcacccaactctcaccttcatttcaactcccatgcatctttttggtcaattaatttattaatattataaatatattttttcaatgaattttgaaaagactgtgttgcatattaaaataatgcgttgtactattaagagtcaaattagaaaatgtacttttaactccaaattaatttacaacatcttagattatgttattttttttttttcaagtcttcacgtacgtggtgtggtttggagtaacgcgaagttggtccaaaagcagagagactctttatattaaaactagaaaactattaagaagacgcaatagtattatgcacgttcacatttcttggtattcttttacattttgttgtttctctggtcataaactaaattgactaattagccatcaatcattttttcttcagtgtttttttcaacaatggacttttgttataaaactatctgtttagtggttgttgctcgattttatccaattctgtcacagaactgagaaataacattaaagtaaataatcttctatactgaaccggtaagatataaaaatttatcaattttatccaattaacatcgaagtcccacgacgtatggtgtgaacagtataagataaaattaaatacttttagaggtagtcgtacgtgagtacgtgtataagacaacacagctgataactccccaatttccgaccaatgcattgtacagtattatgtattcattcgtgtgtgtacttttccccataaaataaacgatttagatttaactatataagaatagaaagactagagaaaaaataagagaagaataagaccaatgcaatgtatcatgagttgtccatttatttccccatccaaaattcacgtatattctttacacacaaaaaaaaataaaaaaaattcagttacattagtttatgtaatttttttaataaatactgtatattattaagaaaaagcttttaaaacgagagagctaaatcattgtaaaacgttttagttttggataccaatgtgttagtaaaaagcccaccaagcccaatagattttatttttgccaaaaaaaaaatcaaagaagaacgaagccttccttctccgccgtaacctccgccagtgaaaccctaaactcctctttccgatatttcactgttcatcaatcgctctgcgtcactcttcctagcaagctcctttaattttcctctcaatccaatcgtgattttgcatacccatcaggtttcaggttagtacgtagtcttaggagaaattaggtaatcagatcgatatcgctatttgttcatacctagattagtcagaatctgtaatcgaaattcgattaggatggtgtagttcaacgaattcatagatacagaatcacttcttcgtagttatggaaagctctttgtttaaaacctcttccgatttttgtatcagaaaaactgaaata

SEQ ID NO: 11331 - DNA, 3000 bp, Unknown
  misc_feature (1)..( 3000): cDNA_ID_2706219_gDNA_ID_2214490_Annot_ID_133443 3000 nt of promoter + ATG
tgcttttggaaaaagagaaggctcagattcaagccccacctataaagataccatatagttagcaccccacattcacacccattaattccacattgtatccaactaatacacccacataaaatttaatatcaataatcattacctacgggattggtattttgtatatggtttgccatttgaaaaagacacttacagaatttggtaactatgatataacttcaaacgaatattgatatcattaatcaatggttgacaaaaaaaaaaagattatgattaaataatagtcatacaaaactgcatgcgttttaaaatctttctataaatgcattcacatttcagctcaacaaccttaaaaaatttatgtctaaagattgatgattctaaagaaaccatcatttctagttttgtacatagatttacttagaaccaatgaacttaaaaaagatggctagttatatcaaaattacgttcacaactaattacaattaatctttaatagtattacataggagttacattttgaataaactcatgggaatattttttttctccatgaacattgtcagagacaagatttgtcttaagagttagaactacaggatttgatcgatactatatatatttctaaggacactaaaattcgtcttaagcgattccaaaaacaagaaaatgagaaaggaaagtaaaaaaaaaagggacgagacactgcatgtgttttggaccgtttggttagagtgataaaagataaatctgtcccaaacatagatcccctcaatccacgcgcagtctcacctgatccgtattcaccaattcaccctcgtctcgaaagccttatttccgtctatgaaggttatttccgtctattttccgacaactatctctgttgcttataatctttgttttcctttgttcttttgctcggagaattttcaacttcattatagttagtgaagatttttatacattattagcagtgtttaatcttcccaaaattctaatataaaattatcgtcgcagcttttatttactttacagacaaataaagtatcactcacgaagcccaccatgattagagcgtcgaggtccaacattgttttcttaatcaaactatactattcttattgctgaaattaagacaaatattatactatgaattaatacaattttttttttatgactcgcaaaacactgtgtccactaatcattgctttcaagcacataatgtaaactgttcctatataattattggcataaaaagagagcagacaaattagtggaattggagagacaagattaattaaacaagtgatcttatcttttcaagaaactcaattcattgccatatgtgtcattgtatcaatacacttctccctaaatgattcgtttgataaaaatttataactttatcaccaagtctatattcattttaaaacccatgcaactctcatcataatgaattctagagtgatgagtgtacgtatttgtaatactcttcttacattctctattgcacttacaccactcattatttttctttctgtttcacttgttgttcaagttgcatttagatttcaaagaacacatgttcaaatgaagacaaaatcttgagtataggaaaaacaaaaggcaaagaaaaaagaaaagaaaagtgatgggaaatgggtagaaaaataacaaaaaaagctaatcaatattatgcgctggtgggtcaaaaaagtgttatttcacaaatccacaaggctttgattctttgtctctttctttcactattcattttttctatattttattacacaacaaaaggaatagtttcttcatcttctctctcacaacaacaacaacaacaaaatatgtatttcatttttgttttaaatgtgatcaactattgtttgatactactataccccttgtggccttgtccatctaataaatttatcagcatacgtctaatcaaagattgtggaatcaagctaacaaaatgaataaagacatcgatcttaacgacataaaagataaacggaatctctcaaagaaaaaacctttgatctaaaagcataaacaagaagaagaaacgtctcaaacaaattttgtaaattgtaggttaaacaaggaacacatgtaggtcctactttaattactggaccctacatactctgggccccactctctatttgccattttttgttttttaattttagctttctccgttaccgtcagtagtcgcagcagcaggagctagatagcgcccacacacacacataaagcaaaagcctttgagctctctcaccattcccaaatcccaaagactctctcatttgagggttttttgtgtttatcttcctaatctctgctccaattcgattttcacagagaaagtttcttccttttggaacatttttccggtgttgaaatctctctctgtatcggctacattgtaccggaaaaacctctcgatctcgggaatctcgccgataatcctctctttgttaccggttagtgacgatttcgaaatctctttcctttgtcgttttctatttgggatttctcgattgattctgttgaatgataaagtttaataatccctatgaatgttttctttaatcactccagaaagtgaactcctgttttctcgacaaggtttctgcaaaatctcagatcgaacaatggataataatcttaggacacacacatagagacaaacacaaaccacacactcgtgttcttattctttgtcttgaaaaccataagtaagaattagtcctgtggcttattcccaaatcacgtgttactgttgttgttgttgttgttgtgtttatatatatatatatatttgccgacaagatttctaaatatggtcccgaaattgttagtgggttttgttagtatctttctagtgagcttgtgttaattgaggttggagattgatttagtttacgttatttgcttttgtagggaaagagagatttgtgtttggtgttaaaaatcgcatgaatgctggaa

SEQ ID NO: 11332 - DNA, 3000 bp, Unknown
  misc_feature (1)..( 3000): cDNA_ID_1442899_gDNA_ID_2214490_Annot_ID_133446 3000 nt of promoter + ATG
acatcatcatcatcatcttgtttgcaactataataattcatattttagttaaatatatagccttggttattgtagtcaaatcaaatccgaaccggaatcaatttcggtttggttttggttcaatgttcatgctaagaaaacagagcaaaacactatgttgcagcctgctggtgaattctgttataagtttataaccaacagaaggctaaagaatcattgaaagatccatgcaaacaaatctaaacacaaagtttgttattgcaatgtgtacgtctctcatggactgtaatgcgagtaaatgctcaaaattggagctcaatatcatgaagggatatacttacttcttcttgccttctttccttttagaccacaaaaacaattcatatttttcccaaagcaaaagaacagtggttacttttagaacatgttaaaacaaataaataatggagatgtaaattgttttcataatatgatttgtctaacatgtaagaactttcagagtttcaatcaagtctctaggcttgtggaaactagatttgttcgtctacaaagaaaccttatcatgtacacaacaagcaacacgattgctacagctcaaaacagacaaaaacagtaaacgattcagctataaacacatatttttatcttcacttgaatattagtgcaccaatagagccttctgcttcattctcgtctctaataatcatttctcctcaaaatcgacatcaatgatttgggacttaggtggctttttagagtttcccttgctattattattgttgttgttgttgttgccatcttttgagaagaaatcgccttgtggttgccacactatgttcccacatccctcacatctgatgatttggttcttgtaccctataaactgcctcttacatgctgggcattctccctgtgcagacccaaacgtgttataacaaagctttgaaacacattttgtttcataaaccaaattgaagaatgcagagaaagaacagagttttattagctataccttgatgacaaagttgttggcgactgcaccaatgagaagagggccagcaattggaagaacccaagtggcgattattataactcggaacagccatccagagagagcaaaccaaaggaagaaaatagtctggaaacgaaaatcaaagcatatccaacattagaattctaaactcagccagtaagattcactcaaaaccatcaaaggtactcaatgaaccccatgggatgatattacatagatacaggatcacattcacaagaagactcacagcaaaacttccaccaagcggtgtattcaagaatgcactgaattgcttcctgtactgtaatgtaaaacaacaaggaaaaataaaattcatcaatggccaaaatcacagaacatataactctacaaaaccaaccagttactttccacttatacatgagaatgattcaatatatcacagtgtatacataactaagaagtagcttcttcgatcgaaatagtgaaatgaagtattattaccttagggaaatttctactgaaatcggcagagacagtcctaacacgaggagtaatcccaaactcacgatcaatctcacgagcacggtcagcggctgagctagcagcggagctaaagcggcgagaaacagcgtattggcgatcaattcgctcagcggttttcttagcctcaaaaacgaattgctcgaatccatcgttagcgcttctccacgcgtctctccatgctttacctgacttaacgttatcagccaaacggtcaaagtcgccgcgttggaaagctttcacctgtaagaaagaagaggcggcgcgtgggtgtggataaggtgtggtgatggtgaatctaggtgatgtggaaggccacatagaaaccggacaagggaggataaatcccaattctctgtgaactccaaggaaggagaaaccacaagtcttagaagatgaattgagaaaatagaattatcagctcgaagatcctgggctcgtttgagaaaattgttctttttgattggttaaacttgtaaggctataaagagacaaattgaaaacctaaatcacttaaccggttaacaagacattaaaccggaaataaattaaataaaaccaaattacatatcatgttggtttcttctcttgcaacagatgggttccatgcttctatgtgtgtcttttgtatattttacatatttgatttctaagatttttaatgactaaactcattcagtaatctgatacaaaaccatgaacatgaaaattatcgattgacaataaaagttttatctaaaactcttcaaataacaatatatatgcaattaaaagttttcttatatgaaaacaaaattaaatggacttgcatatttatttacaacttttttacatattatatgaaaggatcgagatactatataatataataaggaatccaaaattgaatatttgggccgtaattaccgcattaatgggcagacaaaacataacaactaatgggccggaatcaatgttaggttatgggcctcaaattagaaatttatgttaacgtttcataaaccctaagagatttcttagaagtagtcatcttcttctctttagacctttttttctgcaggggggctctaaagcaaaacccttttcctgaaatcgccgtcgcaaattagaagaatcacctacaggtttgccgcttaatctcaaagtcctaatcccatctcgttcgtttggtgttctctttgttatgattttttcatatttgttgaaatctagactaatttttgagtagtataattgaatatctgttcattgaaaccgtgtaattagagaaaaattgaaactttgtcttctgcttcttagctcttactataagtaagcgactttatttctgggaaagtatcctctttttttgtttgtttgttgtcaattttgtggtctgagtttcagttttacatgtcttaactttgcaacagtcttttgtagggttttcaagacgaggcaatatg

SEQ ID NO: 11333 - DNA, 3000 bp, Unknown; identical to SEQ ID NO: 11331
  misc_feature (1)..( 3000): cDNA_ID_2706219_gDNA_ID_2214490_Annot_ID_183631 3000 nt of promoter + ATG

SEQ ID NO: 11334 - DNA, 3000 bp, Unknown; identical to SEQ ID NO: 11332
  misc_feature (1)..( 3000): cDNA_ID_1442899_gDNA_ID_2214490_Annot_ID_183634 3000 nt of promoter + ATG

SEQ ID NO: 11335 - DNA, 3000 bp, Unknown
  misc_feature (1)..( 3000): cDNA_ID_3039588_gDNA_ID_2214490_Annot_ID_183638 3000 nt of promoter + ATG
atttgtcgtttgatgataagaatcgagaatctatctctgtagctggtggtgttgaagctttggtatgcttccagtttgtttagtatgattacactgttcctctgcatatataaggggaattgatcacttttgttgattattttaggtggcgctcgcacagtcttgttcaaatgcatcgacaggtcttcaagaaagagctgctggtgcactttggggattatcggtgtcagaagcaaacaggtgctaaatacatctgaatctaagtttaatgcgttctgtttatagattgtcacgtgatatgtttaagatcaatgcagaagcaacataaggacagaccatcttgctttaacatatcacacatgctgatactttttattttgcttgcaccaagttgaggcttttgttacagagaagttttaaaggagtttcttaccaatttattgttactgtcactttccttgataataatcctaccattgctctttttgatctccatcagcgttgcgattggacgtgaaggtggggttccacctctaattgcacttgcacggtctgaagccgaggtaagaactttgagcatagccaagccatcttggataatctgatataaaatttcctcaatgtgctggtttttttcccaggatgtacatgaaactgcagcaggagctctatggaatcttgcttttaatcctggtaatgcactccgcattgttgaggaaggaggagttccagctcttgttcacttgtgttcgtcttctgtctcaaaaatggctcgattcatggctgcattggctttggcatacatgtttgatggaaggtatattaatatataacttagttaataaacatcccaaattcaatccgactctcacggttttcgatctgaattatcgatctgcaacaggatggatgaatatgctctgatgataggaacttcttcatcagagagcacatcgaaaaacattagcttagatggggcaagaaacatggctcttaaacacattgaagcttttgtcctaagttttatagatcctcacatatttgaatctcctgttgtttcatctacccctactatgctagcacaagtcacagagagagctcgcatacaagaagctggccatttgagatgcaggttaaatcttttcgcctctatctatctctatcagcggtgtcttgtgtttgattgaaaactgatttgaaatttttaaatgtattgttttctttgcagtggtgctgaaattggaagatttgtaacaatgttgcgcaatcctgattcaacactcaaagcatgtgctgcgtttgcgcttcttcaggtatgtaaaaatgtgaaaacaaacattgtgtcgtgttctctgttggttacaacaactgatgcatatatcttatctttttgtgcttgctctaattcagtttacaataccgggtggtcgacatgcaatgcatcacgtaagccttatgcagaacggaggagaatcgagattccttcgttctgcagctgcttctgcaaaaacgcctcgtgaagctaagatctttacgaaaattctcctacgcaatctcgagcatcaccaggcggaatcttccatttaagcctcttagagaaaatgatagttaaaagtcccgtttacttagaaatacgtctgtatctcaaatacgcaagaagccaaagccatactgcaaaaccacaaactctcaagatgctttatcagaccaagaatgtcctctctgtgtgattacatgagactattgtgttcttctttatcgtgttttgagaattttcctgtaataacaggtccaaaggattcgaaggtgctgtttcttctatctcctatcttgttcatcgttcctttttggctctgatcatttcttgtgccaagatctattgacgatattaccctccgctctgttattcccttagataaatcatatgtgttgtaaattaggcccaatgacatgctcatgaaaatggaaaactaaacagagcttctgtcacttgacgtttcaggttttcaaaagagaaacattaatacagagcggagggtaattttgtgtcgattcatatttttcacagagcaaaaagtttccttcagcaagaatcaattcatatcagaaatacagataataatgagaaaacaccatttttgaagaagccgatacataaagttgaataaatcaattcgatttcatttgtcaagaaccggaactggacccatatcaaaccggttttattgatcttcctttgtctttccgagagcatggggagtgcagaaaatgatgacatggacatagagtgagcaaaggagataatatctactacatagcaatgtgtaggatgacttacatttagggtcaagatgaggaagatttcaagccagagagatggcttaaggatggcgtgttccaaccttaagaaatacatttctaataaaacctgagatgttttctttctttgactatgtatgtaggctggtccaagaatctgtcttggcaaagatttcgcataccggcaaatgaagacacttattcacttctttcgcttcaaaatggctgatgagaagactactgtatgttactagagaatgcttactcttcgtgtccaaggaggacaaacacctctaaaaaacttttttttcatatcaaataatatatggaagtataatcaattaaaaaaaacacatttttcccccatatcttctgttttgtctttatataatttgattacgtggtacaaaagaaagttgaggccctaattcatattgtgcgactttttcacccacaattactacatgagaaaacatcaaaacgacaaaatcggttacactcaacgttaaccttcgaggtaaaagagagggttcagaatgtttcgttggatgcgtgtaaaatccgtcttgacttttcgtgattgttgaatcgtctatatatgacttcttagcgggaagattgaaaaaatcagacaacaagacgaaacaacttccaagccaaaaaaaaaaaagtgaatcaatg

SEQ ID NO: 11336 - DNA, 3000 bp, Unknown
  misc_feature (1)..( 3000): cDNA_ID_2706215_gDNA_ID_2214490_Annot_ID_183640 3000 nt of promoter + ATG
aaattgttagatacgtcgatacaatcatgtggtacgtgaaaatatcataattattttgtaatgattaaattggctcagcaagcaataacattgatggatggactaaacagtagaactatggttgaatgattttcttttctttttgacgtcattgatagtgagtgatttatacgaataaaaatatgccgatgagcaacagatttcagttgttagttgttaccgtgtcaaaaaaaaatgttgagcaaagatcaaaatttatatatattttttttgctaataacagaatataaattgatactttacattaatatatgtataattataaatgcacatggttatggacacacacgtgggaccaaattgtgtatcttctttttaaaaatgtagatgtatcaaaattattgaactcttgaattaagtaagtatgataaggatttatattcatgcatgattacctcagaaactctcgttgttggtacaacatgggctttggttgctttggccggttttcaccggatcctgttcgtagctgtctcttaccgaactgatatctttaaattaattccctcgccatacagttataacaaaactcaaaccatattgtaaatatactcatatccacaatttaactcatatttacgtgtattaatatattgagttttttgttttgctaaagatcttatcgagtatcttctaacgttctcttctttaaattctctcaacgatttaaaaaaaaaaaaaaaaaaatcacagcgatttttacaggaaaaattacgcgagagtgagcgcgtggaattgttaggaaccatcgagtcggaggaggagagaagtatccaatgattaaagagaagtgaatgtctggtcgtggaggaacaaaaattacgccgcacgagtgtggtcactggggaccatgttctgccacgttggcaacttcccacgtgaaccccttcccatttcccacgtgaccaccacttcttctatttcctttgaatctcttgctttacttcttctacactctctcccacaccattcacacgcttcattccagaatttcacattcttaaatatgcaatgtactgaaacatcaatacatcatcagctcttaaacatatttcaaccaatcgtgaaaacaaatgaattaatttgtacgaatttcacggagaacgaagatgtagtaacgatatattttctttttcatattagttacacttcatgtagttttatcatgaaacattcatacaaaaatatagcatagccatgtaacaaagcagaatcatacatacatacgttttctagacaaaaagacaaataaaaaaaacacttgtctgattttccttaaaacattcaagaatgccaggagaattggggaaaaatagattacagtataagcttagaaacaactgtatataattaatgaacatgggttatgaattgtaacttgcaacaaactttacattaatatgcatgatacggctcatatatcataaacccatgctaacttagttcaaaccccttattcatttatcaataaatacatactttgtagctttgagcaaaaaagcttacaagaaaatttaggaatataataatttgtttgtataactattgttttcagagtactatactatcaatcaagtcaactaaccaattaggctccaaaataaaatcaattttctaaacgtaatttaccaagaaaagtttataagaaaggtcaaagcaagttataagagtcaatgaaaagaccgcattgattgaagatacataagaagtcaatatatagtcattaagaataaatttgaaagtaattaatttgttttgaaaaagcgtcgggcgttatttaactttaaaattaattaacaaacgagacctgtcttgtcttgtctgtaactctcaaagaaactgaagtagtaataatgatggcattatcaacaactttgaaaacaatagaaaggaaacataaaccaaaaattattgtttcaatgacaggaagtagccgtaaactctaccatccactaatgttttccaaatgtccgtttgctatttgatttagccataaaattcaatggaaaaacttgaatattgcttttattagttgaccaaaagaattactcgaaggatagtttttggaaaagggaataataaattaattgaagactaattagatgcatgttgggttcacggggtaactctagagtcttaaaaccccatgcagtattaggctctgtgttatcaaagacgacatcgttttctgactaccatacccattttgagcccaacgccattctattcagttccacgcgttcttactcacgtttgttctacacgagcgacgctactttaccatatacatctgtcttttcttgttaaaataccatctcatggttttaagaaataaaaagagtattcaaacaaagatctttgttatactactattattgtttagtagatctacaaagcgtgtgcattacttcccaaaataatttaataatgggttttataagctaatcaagttcgaaatatgaattttcgagaataaaaaatgattgattagttaagcatcatttttaaaacgttgtaccataaccaaatacagtacttattactgtcaaagacaaaaaaataactgagattttaggtattaaaatgttaacgtttgttattgacttttaggacgaaaatgaacaaaaattcatttgtcaaacgtattgaaaaaattaaacgcattggagttgaatgacttttttttttttttttttttaaagagagaggagcaggtaacagtatatatcatcattgaaattacaagggtctttctgacacaagtcatcattgaaaccccaagcaccccacataaccccttctctctattaattgtctacatatcaacttctgtgtatatatatattagtcgtgtctttaaccccattatcactacatcgattttctcgagaaagtctttcaaaatccagaaaagaaaagttctttctgttgaggacaatg

SEQ ID NO: 11337 - DNA, 3000 bp, Unknown
  misc_feature (1)..( 3000): cDNA_ID_2717289_gDNA_ID_2214490_Annot_ID_183639 3000 nt of promoter + ATG
gtaatttttatctaacttataaattcagttaattacattttcgttatttgtcacttcttattgcatggacgtttgtaattggcttctctctaaaagactaaaattggtttttttttttttttttttaattatcggattgggcagaagcaaaagctggctctagcaaaacagttgaatctaagggcaagacaagttgaagtgtggtttcagaaccgtagggcaaggtaaagaaattatctttattttctaggggtattataggaaatttggtttcacagaaccttagtaattgctatgatggggatataattgtccttttatgacccaaaagcgatttcagttccctgtcctaaaagaaaatcctaataagatctctgcctctgtactgtcacatggagtttcttactttttactacagccttaaagacacatgcatgcgtatgcgtacaaataaaatctacttttgtccttttttgtttcttatcagttttaaacttttatttctgttcacttcactaattaaggtgattttgatttattatttgtacgtacattaggacgaagctgaaacaaacggaggttgattgtgagtatttaaagagatgttgcgataatctgaccgaggagaatcgacggctgcagaaagaagtgtcggagctgagggcgttgaagttgtctccacatctctacatgcacatgactcctcctactactctcaccatgtgcccttcttgcgaacgtgtctcctcctctgccgccactgtgaccgctgctccttccactactactactcctacggtggtggggcggccaagtccacagcgattaactccttggactgctatttctctccagcaaaaatcaggtcgctagggaaggagtatcttcggtagttttagcttagaataaagatatgagtatgaaagtttcaaagattagcttctatctattgaaaatgaaaacaaagattagtctcaattcaaagggttcaatttgaggctctaattctgaatttgttttaacctgtaaaaggattaccctttttagaattcagttttgtgagtatatttgattgtttattacctctaaaatcatgagagagatcttctaggggttgtacgtaataaaacattaatgggcttagataaagattaaccaacaaaaaatcatggtgggctttttgccggcattactctgttatgcatagatgttctttctcctcctttgttgggttataaaaccgagagacttcgaaacccaccgatggtattgggatccatatttccaaactgtctgtctgaggatgtggatatttgggtgatgttgaaactctcaagtcattttatatgaggaattttcaaacatcagttttaatgaaacaaagaatgttccaattggaacataaatatcataacaaatgaaattatcaataaatagaagtaataaagaatcgtaatacctaatcaatcaaattattggttgggtccaaatgagcgtctcgtcaagttactcgagcctcctctttttttcttttctttctgccttctttggtttactcgtcaaagtctcatctcactaaaaataagtttcatctaaacttctctaaagtattttctatgggggtgaaaacgttaaactgaaagtgtagtgaagaagttgataaaaaaggaaaggagttgtacaaagggatgcagattcctatattcaacatggtcgacatatatctcctttctttctaatttcagtactttcaaaagagtaacttttaagtttttattaaagaccagtctcttaatgttcaattcaaccaaaataatataaacttataattgtatatatatgaaaatcaaactgttttcatgagtttgtgcctaattgaatagatttcaactaaacctcaataccagatttaaatgcacaatattataacaattgttcagtgtaacatttttttttcctaaagcatgaaaaagaagaaacaaacaacaatggctgaattttggatcataacgtttttatggttgagataaatgaaattctcctgacaacattttactatttaatggagtaacaacaaagagaaacaatatggaaataccaatctgtattaaagttaacactaacaaaagaaaaaatcaatagtcttaaaatgtaattgcggtaaaatatattgaaacattgtaataatgtataatggtattcaaatcaataaaaatgcagaaaatcaaattgtaattaaaaggtaaaaaagataaaaaaaaaagggaggtgaattaattctgctgcctctctctctatcatattcgtatatatgagctgtgttttcatcacacgaagccctcttctctcttgtctcttctcctctaagccccgacctggaattttccaattccttcatcatcatcttctctctctatctctttgtgccgcacgaataaaggaagagagagtttaacggaattactttgagactttgagagaggtcttttggtttcttatacagttttcgggtttggcttcaattctctccgaccatcactctctcttctttatcctctcttcactttcaaattcccattgaccttcttctcatcattgtgagtttaatgtcaatacaaatctattgacgaagaaaggtcagagattttgcttctctattcgagggtttttgcgttcgttgagctctttgaattcggttttaatctaatcgtatcgtgtaatgtgttgttgattcgatatggttactaggttttgaaaagactctgagccttccaagtatctaaattgcttaaaatcgggggacgaaaggtttggttgtgtttgtttgctattgaagatctctgtgtcttcgtttgattatgcccttttaaggaatttgtgatcagcgttttaaaggttgagactttagagatatataaagcctgaagtttcgatttttatttcggtaagctgcaagaggatttgttgctgttttagaggattatctgatcaaaggtaatg

SEQ ID NO: 11338 - DNA, 3000 bp, Unknown
  misc_feature (1)..( 3000): cDNA_ID_3039583_gDNA_ID_2214490_Annot_ID_183642 3000 nt of promoter + ATG
aagagctgatgatgtattgatgtttcagtacattgcatatttaagaatgtgaaattctggaatgaagcgtgtgaatggtgtgggagagagtgtagaagaagtaaagcaagagattcaaaggaaatagaagaagtggtggtcacgtgggaaatgggaaggggttcacgtgggaagttgccaacgtggcagaacatggtccccagtgaccacactcgtgcggcgtaatttttgttcctccacgaccagacattcacttctctttaatcattggatacttctctcctcctccgactcgatggttcctaacaattccacgcgctcactctcgcgtaatttttcctgtaaaaatcgctgtgatttttttttttttttttttaaatcgttgagagaatttaaagaagagaacgttagaagatactcgataagatctttagcaaaacaaaaaactcaatatattaatacacgtaaatatgagttaaattgtggatatgagtatatttacaatatggtttgagttttgttataactgtatggcgagggaattaatttaaagatatcagttcggtaagagacagctacgaacaggatccggtgaaaaccggccaaagcaaccaaagcccatgttgtaccaacaacgagagtttctgaggtaatcatgcatgaatataaatccttatcatacttacttaattcaagagttcaataattttgatacatctacatttttaaaaagaagatacacaatttggtcccacgtgtgtgtccataaccatgtgcatttataattatacatatattaatgtaaagtatcaatttatattctgttattagcaaaaaaaatatatataaattttgatctttgctcaacatttttttttgacacggtaacaactaacaactgaaatctgttgctcatcggcatatttttattcgtataaatcactcactatcaatgacgtcaaaaagaaaagaaaatcattcaaccatagttctactgtttagtccatccatcaatgttattgcttgctgagccaatttaatcattacaaaataattatgatattttcacgtaccacatgattgtatcgacgtatctaacaatttactcgaaatcattacacatgtccacgtgggaagcccgtcacttattttggtccgttccaagatttgattgattcttataatttattatttgctatccgtgcaatctgtattaataataacatatgctacgttttgaacactaaaacatagggatacgctggaaaggtgtgtaagatattagaatttcagaataacagctgttcacatgcatgcagaaattatatttataaacagagatcataaaggcatacataatctaagtagcatttataagaactaaggtgatcgatcgaacactgaattgaattatatcagaatgaacttgccgccttatcggtgcttttttaaaaagtcgacgaaatatctagtgaattgatccgatagaaaaaagatgtctttagatcaaatcgttcgacaaattttttctttcaaatatataaatcctagacaaaatatatctcaaaacgtctggactctggatagttcaactagctagttaccaaattaaaatcttttgaaataagactttactatggtataagttttaaatggtgacggtcacaagatgaatcgtatatgaaactataacacaattgaatgctgttttgttttttgttattgacagttttcggattcgcaacttgtaaccatctgaaccctaatattaatcatagttaaggactgaaaacaacagcatcgagcgtatttccgttgaacaatctttacgaaatccaaaataaataaataaagttaaaaagcagaaagtttcaagattcaaaaaaaaagttagcgaggagacatagcgagtgagagccacgtgactaagatgtgtaaagaatggagtgaggagaaaaaaaaaacagacaaaggacttaaaattaaattagatacgccagcgtttcacgtgggaagtcacgtgattgagtatccacgtgtcaatcccacaagtgaaataatagacgggttcccattgtcctaccttcgcaccacccccgcgcgtgtctctttgcctctctctcaccggacaccaatcatttgatgcgacacgagcttcttctacgtaattacatttataccccttagcctcctctcatgatgttatgatcacacagcctcgatccaatgcgttttggattgtgtgtgggtgtccagctgttatccatgtgaattgcacgtgatctcgctttgtttgagaaattagatttcattgcactaaaattggtagagagacaattagaacttgagtgatggataattcgtcttttcttaagacgatatctatttaactatattagacttatgaacaaaactaaaaatttcatttgaaatgtactatcgctcaagatctcaaggccttcatattgttctttttttttttaatcaaaattttaagtaatatcaattataagtggtttttagattatagatttttggttttggtctttggattttacacaaaagaagaaataaaataaatggaaaaatatataaaataaataaattcaaatggtaattctaaaaactagtaaatatggtttttggattttgggaaagaattgacaaaatctctttaaatctagattctctaatttttaggaaatcatttttattataatcttgaatgagtaacaaattgtttttttccaaaatcaaaaactaaaaaccatttcagaatctacaaacaataaaaaagtcttaatatttgcatataagtcaaactggtggtatctgggttaaacttaacaaaatgtgttgggcctaaataagctcaattaaaacgggccttttctcaagtacaccggtcaaaatcaaattttatccacaaggagtcgcttttggcttatccactgaaacaaagagactcgttggattcgtgaagccgaaaaaaaaaaaaaa

SEQ ID NO: 11339 - DNA, 3000 bp, Unknown
  misc_feature (1)..( 3000): cDNA_ID_3039596_gDNA_ID_2214490_Annot_ID_183636 3000 nt of promoter + ATG
cctccatgaggtattgaaggaaggcactgatgtgtgtttgatagaccagattgcatcagttcatcactgtcccaaaactattgtgcttggatttagcaagggtggagttgtgatgaaccagctcatgagtgagatcagttccttggataccaactttgcgaaaacttcatctgcaatggtagaagaatctaccagccagcatgaaaagattcagatcattccagcctccaaagaaagcttcctcaacagcatttctgaagttcattatatagatgtaggactgaactcttctggtgcctacattactgatcacaatgtcgtgcagagaatctcccaacgccttgcacgaggtgcagactcgctacgcattgtcattcatggaactcctaggcagtggtgtgatgagctgcgaggctggattcgcaaggaaaaagatgagttggttcgtttgctcaaagctgaaactgagaattccggtgggaaactacaggtctgtgaaaggttctatttttctgatagacttgctgatttgcaaatgcactttgagataattgatgctatggatgtctcctaaccattcgcatgataaaagacacataataatacattgcaaaatgatagcaacttaaagccgttttatcagtacaaaaaccaaaacttttttttttttaaagacttccaaaaacaaatggtaagagaaactaaagaagacttgttctttaagatgacaccagcatcagagtaagtgagaggcttttagacggatcatattgttaccacagaatcactcttccatggcttcgttttgaacagacttcttttcggaaacatcaactttgatcttctgtgccccgggagcctggaccatatgaatgttctgatcaagttctttcatatcgtcattgagtttcttctgcttgtttggcttcaacctaagtcccatacaaaaaacaaaaacaatcataatcaaaaacagagtctagttttaaaatcatacaagcagtgttatcaaggatttgcaggagactagaagaagaagaagaaggaatgtatacctattttcgatatgtttggcttcccttgcggttctgatcttagcaatcttcttaatggccatgagtgtattctctgtaacgttcctgtcgtatctctcaggtctgtttctcttcttctcaaactcaaatgttgtatccttttagggtaaagtaaacaaagaaagacaagcaggagggtcagcatcaactagacaaccccaaggaaacaaagaaaaacttttgctcaaatgaacacgtaccttagtcatgtccttcccgtgtgcagctctgaatgctttagtccatttcactttacgtgggtttctcttcatcttgaagttcttgtgacacttcgacctacagaaccggaatatctgcaaaggagaagataccatgcttgtaagtgaattacaataacgcataagaaacaaagctaatcgataacaagacatacaaacaataaggtgttttgattaacatttatgctcaaatttttatcagaacatttgtaaacctcttatatactaaactcctagctaaagacacataaacatattgtaagaatatacaaaatggtcatttttttagctaaagactcacacaaataacgacatatatcaaaaattgttcatttaagctagagaatacgagcaaggagacattcacatatatagaatctaagagtactatgtaatataaaactcaagcaaactatttactgtgaattaaagcaggttgataaagatttatgccaaattaattaccttggcatcgttacggacaaattgaataccatgaccaggatatattgtggaagagcaaaaccaacacttctccaatctcatattgcctcgtcttgaaaaccctacaaaagactgttgcaaagttaagacatgtaaaactgaaactcagaccacaaaattgacaacaaacaaacaaaaaaagaggatactttcccagaaataaagtcgcttacttatagtaagagctaagaagcagaagacaaagtttcaatttttctctaattacacggtttcaatgaacagatattcaattatactactcaaaaattagtctagatttcaacaaatatgaaaaaatcataacaaagagaacaccaaacgaacgagatgggattaggactttgagattaagcggcaaacctgtaggtgattcttctaatttgcgacggcgatttcaggaaaagggttttgctttagagcccccctgcagaaaaaaaggtctaaagagaagaagatgactacttctaagaaatctcttagggtttatgaaacgttaacataaatttctaatttgaggcccataacctaacattgattccggcccattagttgttatgttttgtctgcccattaatgcggtaattacggcccaaatattcaattttggattccttattatattatatagtatctcgatcctttcatataatatgtaaaaaagttgtaaataaatatgcaagtccatttaattttgttttcatataagaaaacttttaattgcatatatattgttatttgaagagttttagataaaacttttattgtcaatcgataattttcatgttcatggttttgtatcagattactgaatgagtttagtcattaaaaatcttagaaatcaaatatgtaaaatatacaaaagacacacatagaagcatggaacccatctgttgcaagagaagaaaccaacatgatatgtaatttggttttatttaatttatttccggtttaatgtcttgttaaccggttaagtgatttaggttttcaatttgtctctttatagccttacaagtttaaccaatcaaaaagaacaattttctcaaacgagcccaggatcttcgagctgataattctattttctcaattcatcttctaagacttgtggtttctccttccttggagttcacagagaattgggatttatcctcccttgtccggtttct

SEQ ID NO: 11340 - DNA, 3000 bp, Unknown
  misc_feature (1)..( 3000): cDNA_ID_3039601_gDNA_ID_2214490_Annot_ID_183632 3000 nt of promoter + ATG
gttgaaattccccgagtcaccagcaactagctatgcaggcagggacttgatacaggctttactggtgaaagatccaaagaacaggttagggacaaagagaggagcaacggagataaagcagcatccattctttgaaggtgtgaattgggcattgataaggtgtagcactccacctgaagtaccgagacagatggagaccgaaccgccaccaaagtatggaccgattgatccggttgggtttggtagtaatagcaaaaggatgatgggaccaccagcagtatcagcagcagcagcagacacgaaatctggtggtaaatttctagactttgagtttttctaaagcttccaagatttggttccgtagtagccatttttagtcttttatctatgtcgttatatattgtaaccacgcctctagctttaatagatcaagagtgagggtttaattcttatagtaacttaggtcttgtttggtttttgtatcggagattaaaatcttcttccatggaaccaaaacttttgtaaggacatggaaagccccaagtcgaaattatttaagataatctcctttggtactagtactgctaggtttctcggaatcctttttctacacatagcaactaatagatcgtaatgtcaatgtcaatgtcactgccatttttgggtacatctatactatatgaacatttttgtggtcccaaacggtactataatctaaaaccaatcaacgatccaaaatgttatctttcttttttgtatattctaatcccaaaactgaactgattttggcattcgtgtgttttgtttcgtttaaaagagtcggcataactattgcttgatagtctatagtctataccaagaagaaccccatccatgtgcttcagacaaagaagagagaaatgatgacttgtcagatcctaactcttatctctcagggaatccgatgaaaacggaccccatagacttttacataaattctaccgaccagtttcatgccaaaaagagacaattcgaggccaggtcctagattgtaatcatcaccttatatcacttatacatatgattaacgaacaagcatgagattagtctttattcatttcattagaacatgtagctgggaactacatgaacaaaaaatccccacatttcataacaaaaaagaaaagccaagtcctagggaatagggatcatataggtaaaacgataaaaggttatactatgatacacttttttcatttatacgttaattaatgactggattagtgttttctctataatcttctcagctatagtatttaactaattaaacaaggaatagtttctacagtgattttctttaaataaagacttatgttgaaagaaatcaaaatagtaaaccatagttgaaacaaaacatccattttaataacacatttcgtctttttaatgtccaaagcagccatcagccatgtggattaattggtgctttatgataagactccaaatcgttgcgtaggacgttggtcttattattactccacttgatttttgattaagccgactttaacgggcttttccacaaggcatcacctacttgtgccttggcccattatcaaaaaacctagtagaatattctcacgtcatctttcccacgtatatgtgcacgacgtttttgttattttgtacgtaaacaagaggactggcgtttttatattccgataattaaaatactgaatataattatttaaacgatttgcatttgtctgtgtagagatgttgttgcaacgaaaggaacgattagagagaataaaacgaaagtcgcaattaagaaaacgtgtctttgacagtcacagtgggtcgacttaacctttcgacgtcagacttaacaatattttattacattcagcacgtgaaaattgcgttgtttccgattagttttatttttttaatgggagttgcttattaatgttttaaatttggagggatttatactttattcctgaaaaaacataaacgaagaatgaatctaatcttttgtttattggtgagtaactaactacctatattcaatttcataccggaaaattttgtattatgtactaatatactttgttagactcgtcgttaacgactaaacgaatcttgtaattttccatagctttcttgacttccactgttgtattgcgcgtttcaagtgttttcaataacttatatttgctcttctctctctctctctctctctcttttttgttgttgttgttgttcactttgatgaatcttgacaaagtttacaaagttgactctatttaagcaaccaatggcaaaagatgatcgagtgaaaacctattatgtgtatatagcactaaacattatttgattaacatccaaagatatatatgagtttatacagtttcttagtttttaaatcggtggattcttttttaacaaaaaaggtttaagatcttgtagattgatttttgttcgtcaaaaaactttattatagatggatttttggtgagtacagataggccacaaaaagtgaatttaactaatttcttaatcagttatttaaaatcgtcaagtatatatggattatcattttataatgatttgggttacaaaatatcaaagaacagccaacaacaaaaaaagaaatcgaagaacaagatcatctatagaaaaaaagacaaatattactgaaaaagaaagaccaaagaccaaaagtccaaacaaaaataaataactaatatttttgtcgctgttctattttaagaacgaggcaaaaaaagaacagaaaaaaagaagaaaacgaatcttctaagaacgtaacaactatcatcaaatcaaaacctcaaagaaccttccatggactttctctcattccatacctttataaactcatacacaactacttatctcttcacttcattagtctccaagaagaaaacatctctcactctctaaaatacacactctcatcaaaaaccttctcttcggttcagaagcattcaagaatccatt

SEQ ID NO: 11341 - DNA, 3000 bp, Unknown; identical to SEQ ID NO: 11330
  misc_feature (1)..( 3000): cDNA_ID_1831917_gDNA_ID_2214490_Annot_ID_183630 3000 nt of promoter + ATG

SEQ ID NO: 11342 - DNA, 3000 bp, Unknown
  misc_feature (1)..( 3000): cDNA_ID_2706211_gDNA_ID_2214490_Annot_ID_133449 3000 nt of promoter + ATG
agaatcgagaatctatctctgtagctggtggtgttgaagctttggtatgcttccagtttgtttagtatgattacactgttcctctgcatatataaggggaattgatcacttttgttgattattttaggtggcgctcgcacagtcttgttcaaatgcatcgacaggtcttcaagaaagagctgctggtgcactttggggattatcggtgtcagaagcaaacaggtgctaaatacatctgaatctaagtttaatgcgttctgtttatagattgtcacgtgatatgtttaagatcaatgcagaagcaacataaggacagaccatcttgctttaacatatcacacatgctgatactttttattttgcttgcaccaagttgaggcttttgttacagagaagttttaaaggagtttcttaccaatttattgttactgtcactttccttgataataatcctaccattgctctttttgatctccatcagcgttgcgattggacgtgaaggtggggttccacctctaattgcacttgcacggtctgaagccgaggtaagaactttgagcatagccaagccatcttggataatctgatataaaatttcctcaatgtgctggtttttttcccaggatgtacatgaaactgcagcaggagctctatggaatcttgcttttaatcctggtaatgcactccgcattgttgaggaaggaggagttccagctcttgttcacttgtgttcgtcttctgtctcaaaaatggctcgattcatggctgcattggctttggcatacatgtttgatggaaggtatattaatatataacttagttaataaacatcccaaattcaatccgactctcacggttttcgatctgaattatcgatctgcaacaggatggatgaatatgctctgatgataggaacttcttcatcagagagcacatcgaaaaacattagcttagatggggcaagaaacatggctcttaaacacattgaagcttttgtcctaagttttatagatcctcacatatttgaatctcctgttgtttcatctacccctactatgctagcacaagtcacagagagagctcgcatacaagaagctggccatttgagatgcaggttaaatcttttcgcctctatctatctctatcagcggtgtcttgtgtttgattgaaaactgatttgaaatttttaaatgtattgttttctttgcagtggtgctgaaattggaagatttgtaacaatgttgcgcaatcctgattcaacactcaaagcatgtgctgcgtttgcgcttcttcaggtatgtaaaaatgtgaaaacaaacattgtgtcgtgttctctgttggttacaacaactgatgcatatatcttatctttttgtgcttgctctaattcagtttacaataccgggtggtcgacatgcaatgcatcacgtaagccttatgcagaacggaggagaatcgagattccttcgttctgcagctgcttctgcaaaaacgcctcgtgaagctaagatctttacgaaaattctcctacgcaatctcgagcatcaccaggcggaatcttccatttaagcctcttagagaaaatgatagttaaaagtcccgtttacttagaaatacgtctgtatctcaaatacgcaagaagccaaagccatactgcaaaaccacaaactctcaagatgctttatcagaccaagaatgtcctctctgtgtgattacatgagactattgtgttcttctttatcgtgttttgagaattttcctgtaataacaggtccaaaggattcgaaggtgctgtttcttctatctcctatcttgttcatcgttcctttttggctctgatcatttcttgtgccaagatctattgacgatattaccctccgctctgttattcccttagataaatcatatgtgttgtaaattaggcccaatgacatgctcatgaaaatggaaaactaaacagagcttctgtcacttgacgtttcaggttttcaaaagagaaacattaatacagagcggagggtaattttgtgtcgattcatatttttcacagagcaaaaagtttccttcagcaagaatcaattcatatcagaaatacagataataatgagaaaacaccatttttgaagaagccgatacataaagttgaataaatcaattcgatttcatttgtcaagaaccggaactggacccatatcaaaccggttttattgatcttcctttgtctttccgagagcatggggagtgcagaaaatgatgacatggacatagagtgagcaaaggagataatatctactacatagcaatgtgtaggatgacttacatttagggtcaagatgaggaagatttcaagccagagagatggcttaaggatggcgtgttccaaccttaagaaatacatttctaataaaacctgagatgttttctttctttgactatgtatgtaggctggtccaagaatctgtcttggcaaagatttcgcataccggcaaatgaagacacttattcacttctttcgcttcaaaatggctgatgagaagactactgtatgttactagagaatgcttactcttcgtgtccaaggaggacaaacacctctaaaaaacttttttttcatatcaaataatatatggaagtataatcaattaaaaaaaacacatttttcccccatatcttctgttttgtctttatataatttgattacgtggtacaaaagaaagttgaggccctaattcatattgtgcgactttttcacccacaattactacatgagaaaacatcaaaacgacaaaatcggttacactcaacgttaaccttcgaggtaaaagagagggttcagaatgtttcgttggatgcgtgtaaaatccgtcttgacttttcgtgattgttgaatcgtctatatatgacttcttagcgggaagattgaaaaaatcagacaacaagacgaaacaacttccaagccaaaaaaaaaaaagtgaatcaatggagattttgacgagcatg

SEQ ID NO: 11343 - DNA, 3000 bp, Unknown; identical to SEQ ID NO: 11337
  misc_feature (1)..( 3000): cDNA_ID_2717289_gDNA_ID_2214490_Annot_ID_133450 3000 nt of promoter + ATG

SEQ ID NO: 11344 - DNA, 3000 bp, Unknown; identical to SEQ ID NO: 11336
  misc_feature (1)..( 3000): cDNA_ID_2706215_gDNA_ID_2214490_Annot_ID_133451 3000 nt of promoter + ATG

SEQ ID NO: 11345 - DNA, 3000 bp, Unknown
  misc_feature (1)..( 3000): cDNA_ID_2707710_gDNA_ID_2214491_Annot_ID_133456 3000 nt of promoter + ATG
ttgaaggggagattgttgggtacaaaccaacgtcccacatctgaagtttagaaaataagtttctaatatataagccaagtccaactccaactagtaagagatcttttgggaaggatcccaataacaaatccttgcaggtttgagcatgtagacccaaagaaaacaatatcatagtaaatgggagttgaaatgggcttgggaagcccaatagtttgcggattgcactggatgcagtctctcatgaagtcattgggatcgacttgtttcaatctcgcttagcttcctttgtgttgtatcttgcatttatccctagtttatcttcttttgaaatattgttaggcatttcttgccttgttaccttatattttccctttatttggattgtatttgctcctcttttgactgagtctgagacttaatttgaatgaaaattatggaccaaacaaaacacacaaaatctactaagataagtgaggtgaattagccaagagataaatccatagatattggcatgttttatgtatatatatatatatgtctgattacatatatggaagaacaaatattacttaggggattttggaaaaatgtattttgatacaaacttatcttacagtataaccgtttatatgttcaaatatttataatattataaacgttttcttaattttaaatatatgaattataatgtttataactctttaaaaccttagaaatggagatggtacatatcctaaaaatctttacatcaatcgaattttcagacaatcatggcctttatggcctttcatttgaaaaaacttgtttatatgtatttgaactatattatgtgggaatgtttattaacaaaccattgtgagtttatatcaacaatttattttgtaaaagtaaatatataaaatgtgtttattaatgtaaaacttaatacattgacaaaagagtaaaagttaataaaatctaagcaaacgcaaaatatcaaatctaagagccttttaaatttctttcaatcatatttatattaaaacaaaataactttataaaaattatttctccgtatatcgccagttttaatctagttattaatcaattaatccatcaaattaaatgagtttatgggttgacccatcaaataagttgagtcaacccataaactcatttactaattttttggtattctacctatctagaatatgtaaaattaaaatcatgtttattctgcattttatatgaacgagctccaaataagtgtaatttatatttcatgataataataaattttaaaacatttacatcatattcagattcaaaagaaagtattctaaatccaccaacagtaacaaaaaaattatgcgattataaattttcattcaatagattcattgaagaacataagatatattattatagttaagacatacatgattaacacaatttatgctctcttaagggctaggaggctttcctatggggctccatttatactctaatttaggaatttctttaccatgtgtgaagtaaataccatcttctctagcttcccaaatattctttttaccgtagtgagctatcagaccgccacttttatatgccctaaaatttgcataaaacttgtaagtaggaccacgtccctgccataactcacaatcaaatttagttttcaaaacactatcatgaaaacgaaattcgtagatttgtactccaggtctcaaatagtggtagcctaggtcgtcgtcttttgatgtacaatgaatcttgagaacgtttttcacaccaagagaatttttaaaaactacagaatttttttctctgaacttcgcattactcgatcctgcacataacacaataataataaaagaaaacgaaaaacaattcattgtttcttagatttacttgttcttttgttttaggggctatatatatataagataaaagatgtttagaaaaaaaaagaagaagaagataaaagatgatattttggtgctattttgggaaaactcattcaacgttcaacttttacgaggtgtatgtttcttaaattgacttgaattctaattgagacaaaaaaactgaaaaagagatatgtttcttaaattgacttgaattctaattcagacaaaaaaagagatatgtttcttaaattatgtttcttaattgacaggttgtacagttgattcttcagttagaatttcttccattaattggcaaattattgtttttgtggacgataagatttattgtaaagacctgatggctttttaatgatgttttacattataaggattattgtggcaaggcaatcatacaagatttgtgactcatcaagctcgggtgacaatgatagtataagaaaaggaagggttaaagacgtaatcttgaaaaatctgattcgtccaaactgcttaatagagccccttctaaataacaaggtcacgcgaaacaagagatacctaaatcagctgatgattctgatgctacaagaaggttttcaatgtcaatgaggccctgtttgtttcatcatttccattcagatgatcgacttacatgattcatttaaatcatacatttgaatgatgtttgtttcattatttgcaatttaatctacatgatgcatttaaatggatctttatttgtttgatcattttgtagttcatccacattctcgtttagataaaaatgttcatgctttcattttgacaaataacaattattcaacatcattacccattatcaatactaaacatattggcgggaaaatatgattttatgattttgctgagaatacacgattttacggttttggcgataaaatacgattttgcgatgttggcgggaaaacatgagtttggggttttggcgagaaaacatgattttacggatttgcgaaaacatgatttatggttttggcgggaaaacatgattttacgattttgacgggaaaaacatgattttgcggttttggtgggaaaaacatgattttgcggttttggcgggaaaaccatg

SEQ ID NO: 11346 - DNA, 3000 bp, Unknown
  misc_feature (1)..( 3000): cDNA_ID_3039621_gDNA_ID_2214491_Annot_ID_183675 3000 nt of promoter + ATG
agttattccgctatttatcatacatattagtcaagcctaataatgttttcctccgccttttcaatacttaaccaaaatttccgccaaaattcgtcaataatggtgaaaccgtaaataagtagtgtatttttgggtgtggtttaaactttaaacaaataacgtaatatcatgtaaaaccgcttgttatcataagtgatatttttaacataagcataaaattccactatttttcaaaagaattatacaataaataatctaacttatttacaattttgcaatctatttttttttaaatggtaagagttaaactatttagtgcatatgtacccttttttcattgtagaaaaaatgaaacagtaaaagatttatgcaaatggtagctgaacaatatttagcttactagtgcccattgtaccgacaaattcagcagcaaggaatataaagatattttggttgaaccaaagcaagaagtaccgtaaaagagagtactttggtggataaacaaaccaaagaatgagaaaaacattattatttattggtttgttaatcaaaagtatggttaaatgagaatcaaatacccaagaatctgataacttaacccatcaacaaaagcagaagctgattctggttctgcacaaagacagagagatgtgcacttacaaaggtaatccttgccgcgtcccctaagttctcagaagcttcttaagtttactaggctccattacgacaattaggtgaagaaatagaagaaactaacaatggtccataaaaagggtataacaatagcttagcaagtcttctaggttggttctttcttaggaactactggagattggtgtcttcaaatctctacacaatgtccacattgttcttattgagtagattttgcactggatttaaagtcatgaaaatggttcatccttaactcaagtcgatagaagtgacacaagaccgtcacaagatgtgaacataggaggaatgtagaatcatttgtcctcaaactaacaaaacttttaacagaaacattcattacagaataaagaaactagatgaattgttgtgctatatagtcacaactctagcatgatagtcaactagattagaacgaaaaccataaccaaaagcttcaagatttcaatccatgctatcacatatccatcacatgagaaccggacaagtgaatgccaatgccaaatattataagaaaatctaacaaagctataatctgaaatatcctcataagcctcatgagtcaatgatataacagagacataaattgttcgaaaagccacaagtaggaacgtataacctgagcatagaagtgcatacaaagcaattttcaatcgccttttatcacatgaaagcatgcaattctgagctgctgaaaagggaaacaaaagataacctggtaaaagccaatgacaaacaatatgatgattattttagtaaaaactggactagtgaatgccaatgacaaactataggacgattagtataagaaaagcattctgttagaaatattaacaggtgcagagagctctcagttctttcacttcgtattaacacagcaaaaacttccactgccaatgagaaaagcaaaaacgtgccataagatttcaggtgtgtgtcaagcagcttttggttttcatttcacaatgaccaatgcatacactttcataacgaattcaactccatttataaatcttgttttccaacagcatagatcaaaggctaacatcaaattattgaaaacaaggaaaccaaagccaacaaagttataatctgaaacatcctcatagcctcatgaggctgtcatatgactttgaaaagacacaagcaggaacgtataacctgagtataataaaactgcatacaaagcaatttccaattgcaatttatcacagggaaagtatgcaactcagagatgttgaaaagggggaaaacaaatgatcacctgataaaagcagcgtccttagacaacattgaaaagaagaactagtaagatggcttataagcccaatgcgtagaagagaccactcaccctcaagatccagcttataagcaatcttaccattccttctcttcaatgtaaaagattcattaaaccaactgcaaacatctccttcctaaccatcatgaactcactcatcaacactctactactccactttattgcttgcacataacaatcaccatagcttaaactaactttccacattaaacctctagaactaaaaatgctcaatttcaatactcaataaccagaaaagttacaaacttaacaaaccaaatcagatgtagtttcacctatcatcaaatgaaaaacagagacagagaatttgggtttctactctaacaactagaattctcgataacaagaaaagttacaaactttacaaaccaaaccagatatagtatcacctatcatcaaattcaacacatttttagatagttactctcacactcgtaatcattgtacataatcgaaaaagagattagaaacaaaaatactcgaattcaaacttaagcagtcacagtaacttcgtgcaggagcttaccggagatgaattcatcataaaccggcgacggtagcggcggagcaaagcaaaaatgcgatgattcatggaataggtctcaaaagtcacgagaggatcacgtgagatatcttgaaaagaatcggacggctaagaataaagcagactaattctcttatctatctctaaccgttaaataaaaactaaagttttaaccttttaacctgggactagggttttcagatttcactactcttgtcgtgtaagacttgagcaactatataatctcaacttttctcaatcactatccgctgcggtctcgccgtgctgcccacaacaatctccgacttcgtcttcctcatctatcatcgtcgtcgtcaaccttatttatctcttaatttatcattaaaaccaaaaaaccaaaaaaaaagccttagctttcgtttcttcaatcccagcaaaaaaa

SEQ ID NO: 11347 - DNA, 3000 bp, Unknown
  misc_feature (1)..( 3000): cDNA_ID_3039638_gDNA_ID_2214491_Annot_ID_183672 3000 nt of promoter + ATG
cctaatcggtattataatcatagtgatttattatttgtacaatagattagggtccatattttatcattaactttatacaatcatttttacttttgtcgtttatacgatatattcaataacttaactttgccactaattcaacgtcacaggtatgacatgtactttcatctttgttatataaatgacaaaagcgaagttcttttgtctttttttctttgtaggattgccaaacaatcatatatgcaattatttgtacatattgttttccaattaatatataattctctaatcttattaagttagctttgttttatcaattataatatgtttcttattgtaattttcttcttaatttaatcggcattacaatttgtctcaaatcaagtccaattttatgtaatgattgatctaaagaagcatgtatttgattataggtttataatttaaaaccaattagcaataagtggattgatccatatcttttatataccatttaaaattatgttttatatactcattcgatctgtgttcaatatgtcaagaagatcgttcttgatcaattatattcatccttcaacttaaaagagtattttcaagttagcatttatatattctctctttctatttttctctttctgtaaattagtaattttctactatgaggttacaagttaatatgattagtaatgtagtaaatcatatattacaaagtatacttagcaataatattattttcattatactattttcaaaaagataattgtaattatatcattgaaattttaacgacacacgcataatgtgcgttagatatcaaatttgtataaataattaatcgtgtgtctgattttttttaactttggtggactagctagctgtgaactagttggcacatgaacatggtgccaattacgacaattcatacattttttttggaagaataaagcaaaacagcaaaccatataaatcaataagagaccaccaatatggtttacattgttgatattcacatcctttgtatgaaaccattatattttcatgtgcactcgtggttctataaattagaattatacctatttagaaagtttcaaggacagtcgttggttttaaatatatataaaaaatcttcatttatgaatattgagtcatggaatttatgaggtgatgtgaattgtttatcttttagttttatttttattattctgaaaagtcatttccaagtgtgaacggagcatcaatttttttgataacgttttgcgatgaaaaaaactatatttcttctttttttttttaaatgaaatgagctcaaaatagatttatcgcatggaatttttttaatttttaagtcatatgaaatatataatttaagtttgatagatcaagaaatgggtccatcagagaatcaaagctccactcggatcagaccgattcaaacgtatggttctaattagttgtttttataaaactccttgaaggtaaatcatatagatatataaaaagtattagttcatatgagaaaaagtgaaccaaaaaaaaaaattgtataccctaggttataataggtagaggagtttgtaaacaccaatcaactaaactaacccaaagtcaaaatgaaactaacgcaaagtcaaaatgataattataagtacttcacttattgtctgataatataaatgcgcctgtcgcaatttaaatggtgaagtctacgacattcacaggttatcccctattaggttatatcatattcattaataatttaatatcccaagttcccaaccttcacaaatggatcttcttggtcataagattaataattctagatcaaatctaatgttaaatatagaattctacgatgtgttgcaaacttcgagtgtaacttttttcagaaatctcaacatattgttgatttgattgactatatccagatagaggataagtattcaaagaaaaaacgtaatatctccttttcaagctttattttatactagttgacttagacttagaaaactagcatagtcaacaaacgttttgtcataaatcggatagacaacattaatgtaaaaagacttggtaaacaggtaaataaagacgtcttaaatgtacatataacctgtcgtttctttttggggaggttttaaatgatacatagttatactgaaacggaagataaatatgattcatcgattaatctgtcatatctaaaatattgtaactattgacttacatagatatagagagacaactccaattacagtattccattcgttcaagccttgcagaaatggaactattataagatgatggttaaattagtgggccttttaataagctcatcttatctctgataacccatgacttatgacctttaacctacaagaccaaaacttgtcagaccaaaaaaaacaaaaagcccaaaacttgtaagatgctaaaagtatattactttgggccaaaccagctatttgaggccggattagcttttgtaggtttcgaaaatgtagtctttataaagagctaatcaacatccggacacaattaatcaaaacttcgtactgattcgtatatgttgggatgcagagtctggactcctggactcaggtgcttgtttattttgggccgaaccagctattcgaggccggatatggagttcacgtttcaaacattgtttaactattattgttcgggtgagaattatgagttgttaaggacggttgatcttgtttaatttcaggtgctcgagataactggagaggttagtattagagtagatacgatatatgtaaatcctagatttactagatacgttcttatcttctatgagcaactctccttgtataaatactctcttcgactattggaataaacacacttttacattatatttcattgtatcagagcaaaagctcttttgacctaaatttttttccaccgcagccttcgttgttctgtttcttattctacttctattttctcctattactatacctctactatacgatg

SEQ ID NO: 11348 - DNA, 3000 bp, Unknown
  misc_feature (1)..( 3000): cDNA_ID_2706277_gDNA_ID_2214491_Annot_ID_183671 3000 nt of promoter + ATG
tatgtttaagaataatctatgatcaaaatatagatgaagaggaaatgatatatatagcgaaggaactttcggtgatagggcaaaagaaacacgtttctgggaggaataaatggtttcgtcagctttcgtctttgactttgagtgtctcttcagtcaagtcaagttttgtgtgtactttgtttttcattctcaagtctctctcctcgattaaattaaaatcgtggtcacatctacgaatctaactgtgtgaatgtctcgtcgtgatctggttaactaaaggttgaatatttttaccctaataaaggttcttttttccaagcttctacactaacttttctttttaattaaaaacaaaattgaactagtttatgatttcatttgtgtatattattttacgtatagaccatgtcaccatgctatttttgttatatatcatcgtatcagtgtttgttatttgttatggttattgtggaccattggccaaacatatatgcattgtttcaatcatgttgaaggtctaatctacaataacactctcttggataatttttcacacaaaaaataaaatgtagaaaaagatgatcacatgagtactgattatggttttaacttttttttttttggtatcaatgttaagtatttataccattttcgaagttatgacagaagttacacggaatacatgtagcggaaaaataaatctacagaaagcacagacaaaaacaaacagtaatagtggttaacgttaactaaaagcggaaacaagagaaaaaacaccgattccgagaagctaaactcagaaatttgcgtgatttccacaactcgaagataccaaagagttggagtcccatcgtagttgccacgagcaaactttagcagaagcccgtccacaaaacctcttaataaagcgcctacagcttctccgcaaactaacgcaaaaacgcaaagacaacagaggactaaaacacaaatccgacggttacagggataaccaaagaaactaccttcagtcaccattcctatcaaaacaataggaaccatctcccacggataaatgatgcctcgaagaccaacgcgccgcctctattcttcccttaagactccactccgacatgacgcataacatcactgttgtctaagtacaaaacaacaacaacaaaagacaccacaagctccaacttcgagcaaaaacgatgaagaatcgaggaggctttacgaagagcagaaaaaacaaaactaaggcgatgcaccacctgatttctagatcggagaagaatcccgtcgctaggaggtccaacgaacccaaacgtctcatcaagagccacaaccaccgcagaaaggagaaacccaccacgcaccaccaactagagacgatgggcaatcgaaatctgaaacaaaacgatggagcacgagaggaggagaaacatcaaagacaacaaagagggaggaggaggagccctccccgttcgccggcaaggagtgccgcaaacggagaggcggaggaggcagatcgccgacattatgatttaaacttaatttgtaacaagaaattactctaaaatgatatcggcatagatattgtattagacttcatttttaacaaatatggttgtacaacaaccaacctaaaccatgattagtgaagaagaagcaataaaagtagagtaaataaagcccaaagaattaatgaacaaaaataacaaagaggatgttgacgaaaagtcaactccactaagctggcgacgacaaaaacttctgcgatttaagttaaatttgttgggtcctacttcgaaaccagatcatacggctgacgacgaaagtttgactcgatcctctctcttctttttcgtccgttatgactcttatcatcacacctatcttgatttgtctctccataaaaataaaaaataaaacattttctttttcattcatcttaacaacatgtattttatcaagtttaattacaatagtgtcgacgaaaagaacaagaaaaatgccgacaaaaaaaaaaatactagaacaagaaaaattagaataatgtcgaaaagcgattaagttagtggtttagccgtttgttcatcttctagcctaatagtttggacatctctttctttagtggagtaaaaaatgagtctaatgtactaattaaaccagaatagagataatttcatcctaatacaaattactagattatatacgaagtagtaatacttcatttgttctaaaaacttttttgaaaaaaataaagttttttcgatgaaatgtataattggttaatcagagtaaaaatatgtacaaaagtgtttaactgtgtctaaacggatgactagcagtttaataaggagttttggacagctttaatcactatagttgtaagaaaacaagatgtgagtttgtaagttctctcacaaagtttttttccaaagctctttcaaaaacattgaattgtaggcattacaaatgttttggtgcttaaatgaattgtatcaaaaattgttggtgttacaaattgttacaacaactcatctaataaagacttgattcttctatctcgacaaaagattagagtttgccaaagctcatgggatagtggtgtatagtaaaataaaataaaatgtattgagttctcttggtttttaagtaaagaacatgtatgcaaatatgctcgtaaacgttttaaaaatagtgatgatcaagacttatcactaccgttgcaacaaacacgtgaaggttgaatcctctaattttgtacaaactttgacttttcgaatctaacaaaaaaagaaaaagttgactcttaacaacaaaaattgaatagtaaaaaagactatttatgaacataggaaaagtctaaaccgtgacacattagtcagtcacctaccatacaaattacatcactttaaataccaaattttttattcatttttgttctcttatttactttagtcctctcgaatcccataaagtccacaactctctccttgtagagagagagatttt

SEQ ID NO: 11349 - DNA, 3000 bp, Unknown
  misc_feature (1)..( 3000): cDNA_ID_3039646_gDNA_ID_2214491_Annot_ID_183668 3000 nt of promoter + ATG
taacttatgaaaccattttctcagtttatcatgataattgatcctctatttaaaaccctaaagtttatattttgtttgttcaaacacagtcggtactcaaaatagatgaaacataaatttgattttatttctaaaccacttggaaaaacatatactattattcttctcatgcaaaggaccccattataaaactaacatggcttttactattggattcactgtagtgattaagggtgtatcaccaactgttttgaatttttgtcaacttaattagttattaattaagaagtgggtaaagctaacataccaaccttttactacacaattatcttaaaaaatccttaaatttataagaatagaagaaagctaaaacgaataaggaaaaagaacagcaatcgagtgaaatgatgaacatattcaactcccaccattttgtttatatggatgagttccaaaattttggggcatacattctctaacagtattgagatatttcaataatagtatttgcataatgaaaagtaatattgatcatttcagaagattatatgctctttttatttaactattacgagatacatggttttattttgtaacatgttatttttaccaaataaaatttgttaattgttttactcatatcattaagctattttcaatggaatctaatatattggacgtgtgacattatcttatattttctgtaattatttagcatgttaaatattgatttttagtatattcatgtatggtaataacaaacaattatattgaaagagtcgtatactcgtatgtatgactgtttatatcgtaatcgtatatactgcaagttaaattcaacaactgtaattactaattagataaaatcaaatatctgtcgggcgtaacatgcgacccaacaaacgtcatgtgaatattttaattcttctattagtttgttaacctaatcgtgattgggtattcatataaatacacattttcatataaatacactttgtatatggtaagttatcattttatacaaaaaaccaaagaatgttttcttctctattatatcatcatatcccataattatgggaacccaaaaaaaaaaaaaattggaccctccattataaatataaactattgtcatataaattttagacataactgattttgtcataaagaaattgaaaggagaatctccgtgacggttggatatagcaataataacaactcttaataatcatagcaacaagcaaataaaagcagcacatggaagccatttgcgcaaggataattcttgtaagaacacattacctaaaagctaataataatgagaaaaacagcagaaatattcgaaaccatattaaaaaagaatgaaacatttcttaaataaacctaaactagattcgattttgcatgtttgatccacttgatgtatgaacaaaagaaacataaaacagtaagcaaaagtcaaggatctaatgtaaagtcataaggaaaaaaactaaatttaaacaagttgtaactgcagatcatgttatgtcttttaactagtaaatcctacgaccaattagattagagcaaccaattcttttatgattttgatttttgagagccaatttttatttgtattgaaaataatagttatatttttcactcctataaatttattttctactaatgaaattgttgtttataaaagtattctgtgtgtaatagtctataaaaaatatagtacaattttacacatttttaaaagttaatatttttgatattttgtatagtaaatacaaaaaataccaccacacaatacattgatgattcgaagtttcgaaccaccattttcattgaatcagctctaatattaaaaaaaaatgatttttttgataaaatatataaagaatgttagttttgttaaaccaatatatcataaatacgatagtatatatttttgtattttattgagcttgtaatcagtacatggatgcgaatccgagtgacgttgatattggtacaaactacaaagtatagtagtctaagtatatgtccatatatatataataaatctgttatattcaatgattaatgaaacctggaaactggaagtgcaaaaatgcattgattactttaatcgaaaagaaaaacaaaatgcattgattatagtatttataaaactgcagattttgcagagagcaggaaacagagaggtttggttttgcgttgcgtgagctgtttcctctttaactctctcttcttctacctcttgaccctctctctctctctctggtgatgcggtttcttccttggaagccatgaaaacacaatcagcttcaccgttcttcttcgtctccttcttcttcttcttcttcttcttctcttctctgtttcttctctcctctgctttaaactctgatggagttctcttactgagtttcaaatactctgttcttcttgatcctctctctttattacaatcatggaactacgaccacgacaatccttgttcatggcgaggtgtgttgtgtaataacgattcaagagttgttactttatctctcccaaactctaacctcgttggttcgattccttccgatctgggtttcctccaaaacctccaaagtcttaatctttccaataattcactcaatgggtcattaccggttgagtttttcgccgccgataagctccggtttcttgatttatcaaataacttgatctccggcgagatccctgtatcaatcggaggtttacacaacctccagacgttaaatctctccgataacatcttcaccgggaaactaccagctaacttagcgtctcttggaagcttaacggaggtttctctgaagaacaactacttctccggcgagtttcccggcggcggatggagatcggttcagtatctagacatttcttcaaatctaatcaacggttcactcccacctgatttctccggcgacaatctccgatacctgaatgtctcgtataaccaaatctccggagagattcctccga

SEQ ID NO: 11350 - DNA, 3000 bp, Unknown
  misc_feature (1)..( 3000): cDNA_ID_2717309_gDNA_ID_2214491_Annot_ID_183658 3000 nt of promoter + ATG
ccgagtatgagggatgtgatttgggatcttgagtatgttcttcagctacagatgatgacgaatcgtcgagaggctcatgaagaagatagtacggcgattaattccggtggttcgttggttgctccgaggttgatggtgagtgattcgtttagtacgaactcgatatttcagaatggtgatgaatcgaagaacagatttggatttacagattcatcggagactcgagttttttcgcagttgaagatctctgatgcaagatgatgaaatctttcgcaattgtgtgtaaaattataattttttcgaaatgtgaagtttctagcagtatctggttcaatttcaaaatttaatatccggttatttccggttaatagataatcacagtccgtctatagggtatttcgaaggctaaacactattttggtgttaaaattacatcatttttaacgattttgatgtcgttgatgaacaagtccaaattacgagcgagggatccaccaggcgccatcgccgatctcgtcgcttgcttcaactccgccgctctcctcctcatatccgcagcgtcggtaccctttgtcacggcgtcaatgcatctctccacctcagcaaccttaagctctccatcgacgacatcgttcttcatccgtactccgattccaaacacatcaacaagcaatctcgcgtcaagcggctgatcaaaccaagtcggatacgccaccatcggaacaccactcaccaccgtctcgatcgtcgagttccatccacaatgagtgacaaaacaagagatcgccatatggcatagtatcttctcttgttgaccccattcaataacaactccttgaccttcttcaaccatatcttccaaaacgtcaacgttttcggccttctcctttggccgtatcacccatagaaatggaactcctctgttttttaatgctgtcgctatggtctcgacttgattctctgatgatttgagtatgcttccgaaagatatgtaaaaactgaagacctaacttgtttgtcaagccactccatacaataatcatcagctttccacatatctaggcttttcccatctaagattttgtcctcatcagctcccaaaagaaatggagaaacaagaggaccaattgggataataggttttaaatcaaacatcgattcaattataaccgattcgagttcataaaatgaattagccaaaacccatttaacatctttcaagcattcgacgaattccgccattagtgtattgaagatagcaccgtgagaaggtaacatcaatgtcgggagatctcggacttctaaaaacggtaagcctggtaactccactttttgattaggatcttcgagatcggggaaagagtttgtcttcatgtagtaacggtaataaactgagaaacctgcacaagcttcaatccagaggattgcacaaggaatgttatgagcagctgcaacagctggaacccatggagtaaaaggcacagagatgatgcaatcaaatctctttccttcgattattttcgaaaagttattggctccgacttttctcaatgactctgtgagaggttcgtggtctcttggatcgtctttaggcagaccatcagagaagaacacaagatccaccaggctatggggttcatcggtggatgagaggaggtcacgggctgattcaatggtggcgagagtgaagtgtaggttggttcgtgcgagatgtttggcgaatttgagcattggatttaggtgaccttggaacggtaatgctaccattagaacgtgtgtttcttgaccctcaatacttcccattttttttgtatagacttttagtagtaataattctttttaatagtaatttagaggtattagacttgaatttcgtataaaaattatgagttttaatcttagtggtatatataacaattgttcttcaacaatattaagtgagatttttgtaatatatcattatgatttgctaacccaatatataatggtcaacagatttaaaattatgattttctatattcttgtaaaattgttgtggcaagaaatcatgttcttaccaatttctagcataattatgtcaacagccagctgcaaagttatcttattaactaaaattttatataatacagaagtgtgaacttgtttcaaattagttaaaaagagtgtatattgagtacaattttctaatgatatttaataaaaaaacattgtgttaaaattttaagagattttgtcatgtgattattattattccttatatatatattatcctttatatattaattgagaaacattcttaataaaaacttactcttatatgttattaatgaaaatgtcatgctgacatgttgtgttcgtagagatttgtaatctatttcattcattgtctaacatttactagaatattaacagattttctattagtattatttatacatatctcacacaaataataaaaataaaaaagagatcacatttaaattgataacatatgcaattaaggaatgcactttgttgtttttcaatcaatttacgggtaaaactaactctgatactaaaaatctctgcttcaataaaataataaaatatagtacatgttttttgttacgaaacaagtttcggattctgaatagtgatgatacaataaatttgtagttaactacaatgtatttatttaatcattattttaccccgcacattttgacctctcattttttttgtgttgcctattttcctaacttagctgaattcttgaactcaaagatcttgaatagctctatgctacttgtgctggccaatctgaatttattaataatgtttgatatatattacacgtgtttaattgcatgggacgtgaatatatctttagtaacgggtgggataaactccatgacaataccaaaatttgaactctcgcgcttacgttataaactaagctataacttctaaccccccatgcatgtttcaattcaacacatttacaaattcttagatctaaat

SEQ ID NO: 11351 - DNA, 3000 bp, Unknown
  misc_feature (1)..( 3000): cDNA_ID_1831091_gDNA_ID_2214491_Annot_ID_183653 3000 nt of promoter + ATG
cttcgaccgaattaacgcaaaccttgaaccattcatcatttccctatgaatgtaatcaaaacagcaatggagttaattttgtactatttattaaaaagttatggaacatacttgaattgcttaagattctaaagaaaatatctgtcggattatagtggccattctttcttttcttttatttttgcaataattagtggccatgccttttccatgcttgatattgaaagttgattcacaactcgtaaaatatatctctccgaacgcagcttcgtctttgaattttgaaatagtttcttctaatcaacaaaacaaaaaaacttttatagataatttggttttagttttacataataccatttaacatcgagtaatgagctcaattagacaaagataatatactgtattatttagaccaagaaaattagtaacgaatttctaacctattcaagtaaaataacagacaagtgggaggaaataactatttcaattaacgtatgcaatactaaggaatagtggtatttaattattaaaaagaagaagaaagaatagtgatatggacatactagaaaattgttgaaatggtccaagtgttcccctaaatgtctaatcaaagataaggcatgacccgtgcgaccagtcacttcctcaatttgttttctttctctcattaggtcatattcatatgcataccgtctttttatcaattacatattcaataattattgttttaggtcgtatattctctttttctattagtattatgtataccagtaatcttatttagtctttattttaaggcttacatgtcaactgatcgccatgactgaatattatcttcggatacctccaagatatcaaataatataatatttgaataatattaatatcataattctgatttttttgtatataaagcaaaaggatacaaatgtatatgcttttcatattttcatctatgtgatgtatattattgatttttcttaccaagataccaccgtattaatttttatatcttattatttattactggtatcgtaagaccaatctctttaacacatcgccaaaaaaaatgtataagagctacattatcagttggcttggattttccttttttctgccttcatcactttgcgcgttaattccttctataatcgtcctcaaatatttttaaattgctatgtgctgaatattttaaattttcataaactttaaagcaacctaataattttctatttctttcaatatatttattgtttttcctatttaccaatttaaataaaatataattttaatacataatatacattaaaaattgaacctcttgctctttcagaagaaaaaaaacaaaaagcaaaaaccctagaattaaatagtactgtcaagttggagtgggtacaggcacgatcgagcaaaacgaaatgtcccatgcatgcctttaattgctttagagttagttcttccaaatcaagaattagttttagttatcaataaataggagtacccactagtagtcgtaccacgacctttcaattcataggacaaacgtcttaccccctgcattattatgcgatatatatgtgaatcatacatcatacatggtgcctaaagaaaatgtgaatcatacatatgaatcttaattattccatacatttaaattatgaaatgcataaaaatgttttcgaaaatgattttataaacatatacgcagaatctcaaagttgctaattgtatactattgctttggtttggttgttaggctaacgtcccatgatccttcggaaagataaatatgcatgacccggagtgatggagcatctaaaattttatggaagctttgctcttaaaaagattaagctgtaattgtataagtatatatagttttaaccaacttgtggttatttttgtagtcgtcgaaatatttattatgggattggaagatcatggtggattgatatgtgtgtcttttctatatatttttaatatttaggtcccattaaatcagtttgtgatttcagaatcctaacatacccttttgagattacttttcctatttatctcgaacataacctcattctaaaactacaacactctattgggacaattctatttggatcaaatttgtgctatagtcatgaatttattactcaaaattaactaaaaagaaatgaacgacacatattttaaatgttttctaggtttaatatcaacttcagatgtggaatattccaaacatgttcgagtttttctattgcaatttcaataataattgatcattgtggacgttttaaatcactagaacattttggcctctcacatgtttcatgattagtctttattttatatacagaattccggattatgagagaaaaaaacacatacttttattaataattacaaatttaaattgaaaatttatttttatgttattacatccaatgaactaatgtcaatgcatggaaagaattacttaggctccgggaacaacaacatgatcccttcacacacatactctaattcaactaaccaagtcttcttaattctgataagtcaaattgaaaatgtcattaccactgattaaaaaggaatcaaaagaaaaaaagcttttagtattgagtattgaccgtcgctatcggtgacaggcagagtcacaagccaaataaaagggaaccgcgtggtacgtacgggctgacgcctagctgctacggtcatgacaataaattgcccaatcaaagtaacatgccaacgtggcgcagacatatcagtcccacatgtctgcccaaaactagccaaagattacgtgaccgcggtccctcttgtcccctgtctcggtctaacgataacaaaccgagcccacttttatgtcgacgtggaatttggctgacgttggttttctccttcttgccactataaatacaaccccatactcgtcgagtttcaatatctcctcatcatcaaacacaaagtctaatattatcacttacaaataccattttaatcatg

SEQ ID NO: 11352 - DNA, 3000 bp, Unknown
  misc_feature (1)..( 3000): cDNA_ID_2707699_gDNA_ID_2214491_Annot_ID_133457 3000 nt of promoter + ATG
ttgttttttcaaaattaaaaagtgtttttcagaggggccatattaaacatgttttggttcgtgcgtggatacatgctttttcatagcttttgattccgatttttgaaacacaaagcgaacctcagacgaagtttctatataatctaattctacatacatggttacacatatcatgttatgttttttgtcaaattattttaaagttaaactgagtctgaattgatgtatatacatcttcacggatgattcgacaatgtgatgtttcctatgtccattatactccatatacatcgtacatacatcttcacggataaatatcaaatttatttgcttcttcaagcaagcgtatatgttttttcatacttccaaaagtgttcttgttttttagtaaatggagttttacgtttttagagattcatatttcttctgcgctgaaaagtgaaacataagataggataatatcttcgcgcagcctgggaaatgtagattgctctttgaaagttgtgccatctgtttttcttttggtcgtctgccattcattctaaataaagcccattacatatacatgtatttattcaaaaaaaaaaatactcaaaatggtccgtaaaaatagagaaaaaaatacgaacaactatgtcaactaaatatttcgagagaaaaaattatgttgttatcattttccaaaaaaaaataacccggaaacatcaacaaataaaatgagcagacttctttaaaatgagatgataaacacgtaataatcttttagaatttgtttttttgaatttaatgcaaaattatattcaaaagaaaaaaatactgtttggtacatagaaatgcatacttttttatggaaatcaagtaaagattatctatccttgactttttaatttttatctttgatttctacttgttgtttaatatagtgaacctatataaaagtttgcgttgtttagaattctgatgaattggtaaagataacaaactacacgggcatgttcacctcttttcacaatgcattttgatgagcatgcaaacattaactatacatatctatatatacatttttgcagccattttgtgaaataaatcttgtagttgaaacttatttacaatggttgccactggattttaatatttgtttttgataattagaaaaaaaaatttcgaattaaatatttgatatttaacaatttccctaaaatctctctacattaactacacgattggttactaaaataaaactttcaaaatatttaatatcatttaattactacaaaattatcattattgatattgtttttctgcatgactattacaattcaattataatcatcaaaccgtagagatatttgatagcatttaattactagataattttaaaaataaatgattcataaacatatgataaataagatcaacattaataaaataaaacgggacgggttggcggaacgggtttggcaggacgttacttaataacaattcttaactagaaaataaaaatattttatagatagttacatagatagttacaaattgtaaacttttatatatactaattttaaagtataaattgtctccgcggtataccgcgggtgaaaatctagtatatacatattttaataagatatcttttattatcatttaatgaaaacattaaatatgtacttgttttttgtttctcttataattcaggtactttgaacaattaaatagataatttagcacaaaaggtatactatatccatataacattatatttgtaatctatgtgccatccatttctaaactttgtaactttaacatagttgttgacaatagaagttgcactaaaagattgttttttataattatgtgtaaagaataatttacaaaaaattggtgaaaggatggatatcttttgcaaatttaccaagaaaaaaaaaagaagagaatatcggaggtgagagacgtgtatccacgagccaaccatgtttaatatcaggcttggttcccactattgcatgacatggcatcatccccatggttctttcgatctcgccaggtcatcaacctaagtggaccatttatttcgcatgatacacaccacctgtttatttctttatttgcttttttattccctatacatgctttttgattttgatatatactgttcgaggaaacaatactcctaaatagtatagaaatattttaagaagacagaaatataaataattatattaaaaatcttaacattagttacaatatattaataaattcaacaaacagtttatatatagtttattcatgtttgaagcaaaacaaagtttaaaaacaaatattttcgcatgttactttatcacaaaaaatgatctaattatactaaaaatgataaatttatcgaatctatttaatattttgaaaaggattctatttacactatacatatctatggactacgatagacatttttatttttaacacacgaggccacaaacgaaggtatacgtgatgcatgaacactgtgaagtgtgaagcttcctatataatctacatgttgatgaacgctcgataaaattataaacctaattattagtccaaagaaattctacaaaaattctctatttaaaaaaaaaaagatagtgaaaaaatgtgtccgtaagtaaataagcgaattaaatgtaaaatctgtcccagaaaaacaaacaaaactaaactagaaaagagaaatttgaatttacttttccaaattccatttacacatcaaaattttatttatttgtttatgagtgattatccgaattacctccaccaaataaaaccctatcttatttccccctaaattattagaaaaatataaagtgattaagattcttttgaaagtttgtgtttatactttatcttgtactaagagaaacagaacttccctataaaaagcaaaagcaagtaagaataacgtgttaaactaaaacctcgaaaacaacaaaacccgaaactgaaacagagaatccaaaaaaaatg

SEQ ID NO: 11353 - DNA, 3000 bp, Unknown; identical to SEQ ID NO: 11351
  misc_feature (1)..( 3000): cDNA_ID_1831091_gDNA_ID_2214491_Annot_ID_133459 3000 nt of promoter + ATG

SEQ ID NO: 11354 - DNA, 3000 bp, Unknown
  misc_feature (1)..( 3000): cDNA_ID_2717309_gDNA_ID_2214491_Annot_ID_133464 3000 nt of promoter + ATG
atggaaattgctgagaaatgtttgaaagagtatggagatgagagaccgagtatgagggatgtgatttgggatcttgagtatgttcttcagctacagatgatgacgaatcgtcgagaggctcatgaagaagatagtacggcgattaattccggtggttcgttggttgctccgaggttgatggtgagtgattcgtttagtacgaactcgatatttcagaatggtgatgaatcgaagaacagatttggatttacagattcatcggagactcgagttttttcgcagttgaagatctctgatgcaagatgatgaaatctttcgcaattgtgtgtaaaattataattttttcgaaatgtgaagtttctagcagtatctggttcaatttcaaaatttaatatccggttatttccggttaatagataatcacagtccgtctatagggtatttcgaaggctaaacactattttggtgttaaaattacatcatttttaacgattttgatgtcgttgatgaacaagtccaaattacgagcgagggatccaccaggcgccatcgccgatctcgtcgcttgcttcaactccgccgctctcctcctcatatccgcagcgtcggtaccctttgtcacggcgtcaatgcatctctccacctcagcaaccttaagctctccatcgacgacatcgttcttcatccgtactccgattccaaacacatcaacaagcaatctcgcgtcaagcggctgatcaaaccaagtcggatacgccaccatcggaacaccactcaccaccgtctcgatcgtcgagttccatccacaatgagtgacaaaacaagagatcgccatatggcatagtatcttctcttgttgaccccattcaataacaactccttgaccttcttcaaccatatcttccaaaacgtcaacgttttcggccttctcctttggccgtatcacccatagaaatggaactcctctgttttttaatgctgtcgctatggtctcgacttgattctctgatgatttgagtatgcttccgaaagatatgtaaaaactgaagacctaacttgtttgtcaagccactccatacaataatcatcagctttccacatatctaggcttttcccatctaagattttgtcctcatcagctcccaaaagaaatggagaaacaagaggaccaattgggataataggttttaaatcaaacatcgattcaattataaccgattcgagttcataaaatgaattagccaaaacccatttaacatctttcaagcattcgacgaattccgccattagtgtattgaagatagcaccgtgagaaggtaacatcaatgtcgggagatctcggacttctaaaaacggtaagcctggtaactccactttttgattaggatcttcgagatcggggaaagagtttgtcttcatgtagtaacggtaataaactgagaaacctgcacaagcttcaatccagaggattgcacaaggaatgttatgagcagctgcaacagctggaacccatggagtaaaaggcacagagatgatgcaatcaaatctctttccttcgattattttcgaaaagttattggctccgacttttctcaatgactctgtgagaggttcgtggtctcttggatcgtctttaggcagaccatcagagaagaacacaagatccaccaggctatggggttcatcggtggatgagaggaggtcacgggctgattcaatggtggcgagagtgaagtgtaggttggttcgtgcgagatgtttggcgaatttgagcattggatttaggtgaccttggaacggtaatgctaccattagaacgtgtgtttcttgaccctcaatacttcccattttttttgtatagacttttagtagtaataattctttttaatagtaatttagaggtattagacttgaatttcgtataaaaattatgagttttaatcttagtggtatatataacaattgttcttcaacaatattaagtgagatttttgtaatatatcattatgatttgctaacccaatatataatggtcaacagatttaaaattatgattttctatattcttgtaaaattgttgtggcaagaaatcatgttcttaccaatttctagcataattatgtcaacagccagctgcaaagttatcttattaactaaaattttatataatacagaagtgtgaacttgtttcaaattagttaaaaagagtgtatattgagtacaattttctaatgatatttaataaaaaaacattgtgttaaaattttaagagattttgtcatgtgattattattattccttatatatatattatcctttatatattaattgagaaacattcttaataaaaacttactcttatatgttattaatgaaaatgtcatgctgacatgttgtgttcgtagagatttgtaatctatttcattcattgtctaacatttactagaatattaacagattttctattagtattatttatacatatctcacacaaataataaaaataaaaaagagatcacatttaaattgataacatatgcaattaaggaatgcactttgttgtttttcaatcaatttacgggtaaaactaactctgatactaaaaatctctgcttcaataaaataataaaatatagtacatgttttttgttacgaaacaagtttcggattctgaatagtgatgatacaataaatttgtagttaactacaatgtatttatttaatcattattttaccccgcacattttgacctctcattttttttgtgttgcctattttcctaacttagctgaattcttgaactcaaagatcttgaatagctctatgctacttgtgctggccaatctgaatttattaataatgtttgatatatattacacgtgtttaattgcatgggacgtgaatatatctttagtaacgggtgggataaactccatgacaataccaaaatttgaactctcgcgcttacgttataaactaagctataacttctaacccccc

SEQ ID NO: 11355 - DNA, 3000 bp, Unknown
  misc_feature (1)..( 3000): cDNA_ID_2717305_gDNA_ID_2214491_Annot_ID_133465 3000 nt of promoter + ATG
cttctaacaaggtggattatgctttttcaatccaccttgattacttctaacaaggtggattatgcttctaactaggtggattactgctaacaaggtggattacttccaacaaggtggattatgcttctaacaaggtgaattatgcttctggattatgctttttcaatcattttacttatttacgcaagttagacaaggatcatcattgattttttgtcgacgtcggagtcttatattcttttttttttgtgtggtcaaaaagattaggcagcgatcatctttttttttttaattaatgaattgattagaactttgggttctttttttcagtaccgttttgatctcacctcttcgttgtttatcggtattcttcgtgaataacgatattatcaacaaccttcgttgaacggccattctttggaatcaacggtttttgagttaagaacccactatttggttccaaagaatggtttgtgagttatcgttaaaattttaatctcttaatcattttttgtttttaaactccaatttaagaacccgctatttggttcgattaaaaaaattagtgaatcagataaaaattataattggagttttttcatatattttaaaaaattgaatcattcttttacattgttctcctaaaattacagggaatcttttttctttaatgtaaaattaccgagaatctttttttcttttaatgtagaatcatccggcagagaatctttgttgccacgttccctatgagttatcttagcttatgagagtgttagagacaaatgtttcatgagatgccatatggaagaattcatgcacatgcaataaatgcattgtttaaccaaaaaaaagaaagaaagaacaaagcattgttgcatgggttcgtttacataatggaattctataaagaagaagcaaacaaagctatcaactaattcattacaaatagagacatatcattaaaaggtgtatgctccatatgatacttgtcttttaatctcttataagcttagccataggggatactatgttggcttggtttctccgtactatcactctagaaatgaatgaatgcctttatttaacggcaaccaacacattatacacaagcaaacaatatctgacagagaagatgtatgtgatggtacaagtagagaaattactccatagaaaaatttgaaccttggttagactaaggagatgtgttaagtagatatataacgatttgaaatttgtgtatttaaatacagataataattcactgtaagaaaactaacagaaatcattaaggtataattcatagttatttaaaaacttatttataatggtgaaaagaaatacttaaaccaaattaactcagcaaaagataaggacatataaaacaaacatatatatatttaattttatgagaaatcttttgtttttgtacgattacaaaatatatagtgattttgtttggtattataatatgttgtaaacacaacgctaaactcagatcaacttctgtgtttattgcaaattttaagaactactagattttaacccgcgatataccgcggaaacaacttattttttaaattagtatataaaaaagtttgcaaattaaatctatttatttttattttatagtttacaattgttattaagtaacgtcctaccaaacccgtctcgccaaatccgtcccgtaaaaaaaaccgcggtacactacaaatttaaatatataattaaaataaatattttacgggattgcaattgtattttggtttgtcaaaacaaatatttgtttaaaatagttgccaaaatctagttcaaattttggagaaaaaagatttattggatagataaagaatgtatttaggtgggttttgctcattttaagggattgcaattatatttttgtttgtcaaacattttttgttttaaatagttgctgaatatatttggaatatttttagtttgttaatcaatttattgctggaaaaaaatcaataattaaaagttaatggcagccattgttaatgtatatatagatagttggtgtttgttatgaataattagaacaaatttttttatagaaaaaaataatttaaaagaaacttattgttttcattataatcccgagatgtcaaaaccaaattttgttggcattaaaatattttaaattaagatattgttatataaatatcatgcaacagcccaaaattttagtatataaattatatattatattttaaatatttattgatttatattatacaaataaagtatcatttatgttattcataaatttagagatatagatttatggtttatactatataaaatgaatatatgtttatattatctaatatccacttaaaaattacagtacattcattataattaaatcttatattgaagctatactatttgaatgaaatatttaattttgaataataagactagtttatgaaattcataatgtctggaaagaaagataattataagagtcaaggtgtttggaaagaagggtagtaatagtattagttaaaatgtttgaaaataagaatagtagaaaaataaattaatttcaaatacaagtaaaaaccgtggatttgacatataagtataaataatttttctttaaataagattcggttttcaaatttagtgcggattttcattctcttgtaattatacacttgtttgtaattagttaatttaagatttaaaagaaaatcatatgcacattaaccaagttacttaatcagcgttcccacttcctaccaaaaaaaaaagagttactaatcagcgccacacacatgtaacgtaattaagatatattaatcctaacacggtatgaacaatttgacagataaggtctaaagcaaaaacaaacctgtggtcacatgctctaagtcgttcatgaatctttgatcatgtatgtctataaataccttcgattctatcgacattttagccaaacttttgacgtgatccactagcaacaaagtttatacc

SEQ ID NO: 11356 - DNA, 3000 bp, Unknown
  misc_feature (1)..( 3000): cDNA_ID_2706296_gDNA_ID_2214491_Annot_ID_133472 3000 nt of promoter + ATG
taatttcaatttatatacatgcaaattacaaaatataatagtttttgggggataattatcttcttgcgcctttttattaaattaatatgctcatatagcagttcttacaattaatataactagggttttaaatttcaatatcgagttgacaaaatgaattgtttacaagtttttttcttttcaatatgcattgttcatcacgtattcgtagtgatgcaaaaacaaactataaattataattgcactagtgagattagcaagaagtgttataaattagaataaacggaactatcaaactgtgttatgtacaccatttatttttgttaaagaatatgtgtagtagttagaaaactgatcaaattaaactgaaaattcacattacggagatcaagttacattgtctattgatgaaaaaaacaaaataaatccaaatggcactaaaagttgtagaaattgaaagaagaaaatagatttttgtctaggaataaaagtcaaaatgggaaagacaaaaaaaagagaggcaaataagcagtgatggagctaaagcaacgctttactcttttaattatgaattatttgatttgacctccactcgcctggctttttttggttgttctttatagaaaagtaaaataacacaattagcacataacatgagttatcgagaaaccaattctctttgtggtgttttagttaatttctataacttatgaaaccattttctcagtttatcatgataattgatcctctatttaaaaccctaaagtttatattttgtttgttcaaacacagtcggtactcaaaatagatgaaacataaatttgattttatttctaaaccacttggaaaaacatatactattattcttctcatgcaaaggaccccattataaaactaacatggcttttactattggattcactgtagtgattaagggtgtatcaccaactgttttgaatttttgtcaacttaattagttattaattaagaagtgggtaaagctaacataccaaccttttactacacaattatcttaaaaaatccttaaatttataagaatagaagaaagctaaaacgaataaggaaaaagaacagcaatcgagtgaaatgatgaacatattcaactcccaccattttgtttatatggatgagttccaaaattttggggcatacattctctaacagtattgagatatttcaataatagtatttgcataatgaaaagtaatattgatcatttcagaagattatatgctctttttatttaactattacgagatacatggttttattttgtaacatgttatttttaccaaataaaatttgttaattgttttactcatatcattaagctattttcaatggaatctaatatattggacgtgtgacattatcttatattttctgtaattatttagcatgttaaatattgatttttagtatattcatgtatggtaataacaaacaattatattgaaagagtcgtatactcgtatgtatgactgtttatatcgtaatcgtatatactgcaagttaaattcaacaactgtaattactaattagataaaatcaaatatctgtcgggcgtaacatgcgacccaacaaacgtcatgtgaatattttaattcttctattagtttgttaacctaatcgtgattgggtattcatataaatacacattttcatataaatacactttgtatatggtaagttatcattttatacaaaaaaccaaagaatgttttcttctctattatatcatcatatcccataattatgggaacccaaaaaaaaaaaaaattggaccctccattataaatataaactattgtcatataaattttagacataactgattttgtcataaagaaattgaaaggagaatctccgtgacggttggatatagcaataataacaactcttaataatcatagcaacaagcaaataaaagcagcacatggaagccatttgcgcaaggataattcttgtaagaacacattacctaaaagctaataataatgagaaaaacagcagaaatattcgaaaccatattaaaaaagaatgaaacatttcttaaataaacctaaactagattcgattttgcatgtttgatccacttgatgtatgaacaaaagaaacataaaacagtaagcaaaagtcaaggatctaatgtaaagtcataaggaaaaaaactaaatttaaacaagttgtaactgcagatcatgttatgtcttttaactagtaaatcctacgaccaattagattagagcaaccaattcttttatgattttgatttttgagagccaatttttatttgtattgaaaataatagttatatttttcactcctataaatttattttctactaatgaaattgttgtttataaaagtattctgtgtgtaatagtctataaaaaatatagtacaattttacacatttttaaaagttaatatttttgatattttgtatagtaaatacaaaaaataccaccacacaatacattgatgattcgaagtttcgaaccaccattttcattgaatcagctctaatattaaaaaaaaatgatttttttgataaaatatataaagaatgttagttttgttaaaccaatatatcataaatacgatagtatatatttttgtattttattgagcttgtaatcagtacatggatgcgaatccgagtgacgttgatattggtacaaactacaaagtatagtagtctaagtatatgtccatatatatataataaatctgttatattcaatgattaatgaaacctggaaactggaagtgcaaaaatgcattgattactttaatcgaaaagaaaaacaaaatgcattgattatagtatttataaaactgcagattttgcagagagcaggaaacagagaggtttggttttgcgttgcgtgagctgtttcctctttaactctctcttcttctacctcttgaccctctctctctctctctggtgatgcggtttcttccttggaagcc

SEQ ID NO: 11357 - DNA, 3000 bp, Unknown; identical to SEQ ID NO: 11348
  misc_feature (1)..( 3000): cDNA_ID_2706277_gDNA_ID_2214491_Annot_ID_133474 3000 nt of promoter + ATG

SEQ ID NO: 11358 - DNA, 3000 bp, Unknown; identical to SEQ ID NO: 11346
  misc_feature (1)..( 3000): cDNA_ID_3039621_gDNA_ID_2214491_Annot_ID_133477 3000 nt of promoter + ATG

SEQ ID NO: 11359 - DNA, 3000 bp, Unknown
  misc_feature (1)..( 3000): cDNA_ID_2992127_gDNA_ID_2214492_Annot_ID_133478 3000 nt of promoter + ATG
aaggctatttaaaagaaagggtaatgagcaaaataagggagactacaatctttttgtatgtggggaggatctttaattttagttaacctgagaatttgtgatagcgaatcatgctactaagattgtattttaatttctttgcaaatattttgtttaagctatttgtatcatcaaagcatactactagtaccccctatcttaaagtgttgctatgaaaaatctgatttttaaaaaaaaaatataattttaagaatttaaatagcttcttattcgatatatataatactaatattacaacgatgattcaaatttaagtttattactttttgataaatgataaattataatcttagtctaaaaatgtgttttgggggaaaagggtacttttttgaacaacaaaaaaagtataattcgtctttcaccaaacacaaatagtgatctagtgacatttaccgctgacaaaatcattcaaatcacaattatttatactatgcatcatttattcatcatatattttggaataattaatatgggttatgtaaataaaataaaaatattttactttataatacatctaaatataacaagtaatcattatttttaaattggtgaaaaaggcatgttattcatatgataaattttaattggagaagaaaggaatgcaatgagtttagaataagcataacgaatgaaatgaaattatagtagatcacagatgccagataaacaccaatccgtaatgtgaattaaaatactagctataactattaccaagatctatgtttattcctttcaatttgattatatcgattataatcattgggatctctaaatgaacctaattgatgtttataattatacagataagttagttgttttgattctttaaagttttgggggatttaagttttaacattcataaaacgttagtattatatgcttaccaatctaaagtattagatgaattattttaataatctgaagtattatagccatgtgatgctaatgtcttgttgatcttaaaaagacatgaactaaaactctatatagatagtgccaaaattccttgatcgcgctatgtacattagtacggtctcaaatttcctggcatgtataaggcatagagatttactcacacaattataagaaacactaaattttcttttattcaaaatcatattatgtacatagattcatagaaagcttctaatcaagatccatacaaaattacaaagggagacacaaacctcccatataccttgccggttttattatattgacatatatatagactatataatgctataacataacataacaacatactatacgaacatataatatatatgtgcaaattaacatgttaatttgaacaagtcgcggcacacttggtcgtacagtcaaatgaacatcctccactgcggctggtgcttttataaccatccttgttaacgttggttgatttgtagcactcctcgggacatgtcagcttcttaccgctacaagctccttgcgccgagcatgtatgtgcacctccagcattcatcatatctccgaatgatcctccagcacctccagcacctccagaggaccccgaaaacccggaaaatccatgatgaaacccggatttggaaccaaacatctcgctgattccactatcccagagttgacgactagcttgagatgctgagacgaagatgattaccagaagaaaaggtaaaaggattgattttgtaaacattttgttgttgtttgttgttgtttgttgttgttgttgttgttgttgttattgttttgtgtgtagattggttgttgtgagattgaataggatgatgtttcaatatatgcatatatataacatactctgactacatatgtgaccagtgatttttgttaagctatttaaagaaagaggcaatgagaaaatttaggtagactacaattatttgagaaagctctctaattttagattaattgtagaggactagctagataattggtcggagtagttttatgcaactaagaaattgtgtaaaatttcttgcaagcgtgtccgtaatattatgcacattggccgacgtacataggttttgggagggtcacttgtacacatgatttttttttaaaaattaaaagtaattttataaggtttgctaataatgcccctattgatgtattaattttatgtcccactaggtgactaatgtggcttagcatttgttgcatatatatgtcaggaattaaggatctaatttttttttcaagaacacgaaattaaagtagaaaaaataatgtgcacacaagatatatagtggttttactcaaaaagagttacgtccactttcttctgctgcagatttcactaatatcgaaaaaattcggaggatacaagttctctcaatctctaactctacctctatacttcgatgatataacataggtgactactacaattatataaatgaaaaacttaggacaaacatacatatgccaatattacccaaatatctttaccagcacgtttactagacatcatacgttcatatagaataaaacaatatctgtcatttgtggtcgaaacacacaacaaagaaaaaaaacaatattaatgacaatagtgaaatatcatagtattacagtatattttgatattcaaatatttaatttacattagttacaaatacaatcgttttcttttcttatataaaaaaaaaaatataaaagaaaaaaaaaatgcaatcgtaaatttgataaattcaatttccatgattcataggcccaaatttggtaaattcaatttccatgatttccttgattaaatgggcctcgttaataatcgattgggccaaacttcttaatattttttaagtcacgtggaatgtcacgtgctaatcatcttcttcatagaaaccaaaaacctaatctgcaagatctaaaccaaaaaaaaaaaacttcagaaaatttgaaatcctcagaattgcagagcaaagaacaaccatg

SEQ ID NO: 11360 - DNA, 3000 bp, Unknown
  misc_feature (1)..( 3000): cDNA_ID_3039734_gDNA_ID_2214492_Annot_ID_133480 3000 nt of promoter + ATG
atcgattattaacgaggcccatttaatcaaggaaatcatggaaattgaatttaccaaatttgggcctatgaatcatggaaattgaatttatcaaatttacgattgcattttttttttcttttatatttttttttttatataagaaaagaaaacgattgtatttgtaactaatgtaaattaaatatttgaatatcaaaatatactgtaatactatgatatttcactattgtcattaatattgttttttttctttgttgtgtgtttcgaccacaaatgacagatattgttttattctatatgaacgtatgatgtctagtaaacgtgctggtaaagatatttgggtaatattggcatatgtatgtttgtcctaagtttttcatttatataattgtagtagtcacctatgttatatcatcgaagtatagaggtagagttagagattgagagaacttgtatcctccgaattttttcgatattagtgaaatctgcagcagaagaaagtggacgtaactctttttgagtaaaaccactatatatcttgtgtgcacattattttttctactttaatttcgtgttcttgaaaaaaaaattagatccttaattcctgacatatatatgcaacaaatgctaagccacattagtcacctagtgggacataaaattaatacatcaataggggcattattagcaaaccttataaaattacttttaatttttaaaaaaaaatcatgtgtacaagtgaccctcccaaaacctatgtacgtcggccaatgtgcataatattacggacacgcttgcaagaaattttacacaatttcttagttgcataaaactactccgaccaattatctagctagtcctctacaattaatctaaaattagagagctttctcaaataattgtagtctacctaaattttctcattgcctctttctttaaatagcttaacaaaaatcactggtcacatatgtagtcagagtatgttatatatatgcatatattgaaacatcatcctattcaatctcacaacaaccaatctacacacaaaacaataacaacaacaacaacaacaacaacaaacaacaacaaacaacaacaaaatgtttacaaaatcaatccttttaccttttcttctggtaatcatcttcgtctcagcatctcaagctagtcgtcaactctgggatagtggaatcagcgagatgtttggttccaaatccgggtttcatcatggattttccgggttttcggggtcctctggaggtgctggaggtgctggaggatcattcggagatatgatgaatgctggaggtgcacatacatgctcggcgcaaggagcttgtagcggtaagaagctgacatgtcccgaggagtgctacaaatcaaccaacgttaacaaggatggttataaaagcaccagccgcagtggaggatgttcatttgactgtacgaccaagtgtgccgcgacttgttcaaattaacatgttaatttgcacatatatattatatgttcgtatagtatgttgttatgttatgttatagcattatatagtctatatatatgtcaatataataaaaccggcaaggtatatgggaggtttgtgtctccctttgtaattttgtatggatcttgattagaagctttctatgaatctatgtacataatatgattttgaataaaagaaaatttagtgtttcttataattgtgtgagtaaatctctatgccttatacatgccaggaaatttgagaccgtactaatgtacatagcgcgatcaaggaattttggcactatctatatagagttttagttcatgtctttttaagatcaacaagacattagcatcacatggctataatacttcagattattaaaataattcatctaatactttagattggtaagcatataatactaacgttttatgaatgttaaaacttaaatcccccaaaactttaaagaatcaaaacaactaacttatctgtataattataaacatcaattaggttcatttagagatcccaatgattataatcgatataatcaaattgaaaggaataaacatagatcttggtaatagttatagctagtattttaattcacattacggattggtgtttatctggcatctgtgatctactataatttcatttcattcgttatgcttattctaaactcattgcattcctttcttctccaattaaaatttatcatatgaataacatgcctttttcaccaatttaaaaataatgattacttgttatatttagatgtattataaagtaaaatatttttattttatttacataacccatattaattattccaaaatatatgatgaataaatgatgcatagtataaataattgtgatttgaatgattttgtcagcggtaaatgtcactagatcactatttgtgtttggtgaaagacgaattatactttttttgttgttcaaaaaagtacccttttcccccaaaacacatttttagactaagattataatttatcatttatcaaaaagtaataaacttaaatttgaatcatcgttgtaatattagtattatatatatcgaataagaagctatttaaattcttaaaattatattttttttttaaaaatcagatttttcatagcaacactttaagatagggggtactagtagtatgctttgatgatacaaatagcttaaacaaaatatttgcaaagaaattaaaatacaatcttagtagcatgattcgctatcacaaattctcaggttaactaaaattaaagatcctccccacatacaaaaagattgtagtctcccttattttgctcattaccctttcttttaaatagccttttaatattcttcatagaatcaatttcaaatctaaacttaaactctggcctctcttatatgacaactttaatgaataagatcttacttcttttcttcaataaatatttcctctgttcaatttcttgttttattttatttttgaagaatatggttgaaaga

SEQ ID NO: 11361 - DNA, 3000 bp, Unknown
  misc_feature (1)..( 3000): cDNA_ID_2717353_gDNA_ID_2214492_Annot_ID_133484 3000 nt of promoter + ATG
tgctttcgataacattttccatttcaattcagcttccagttccttgatcgcattaattagaagtagagggattagccatacagaaattttcctcgattcattacagattttaaaatttaatttgttatttaccgttttaatttgtattactgtagattctagacatcaggctaaatatgctttgcacacacttttcagttttaacatattacaggcttaagaaacaaaagaaatgcactttaagtaaaattatttttaggaaatgcaaacaaaaagaaaattaatgcaaaaagtcttactttcggatgatattttgaagaactaaaatcaaagtgaagcaattaatgaacctgaaattatcaaagtgattaagtgaagttattaacacaactcacacatgtgcatgacgatgcggtttttttcctcttaaacttggaatttaaattaacgagatccaattatttgactcaaactgtttctcattggctaacaatgtgactcaaaagctagttgatgtttttgaaaaaaaatcatagtagagccgtcgagcagttttttttgttcctggacaaaacactttttttttaaccataaaaattattgttaataaaatcgaccaatgtctttcgcttttctggtttgtccaagaaaaaaaaaaagtcttttgcttttcctatagccataaataaaaaaggccacagtcaaataatcttaatttgcgctatttgttattttcttattctttttatattatatcaaatacggtatgattagtagataaacgcgtttattaaatagcctaaatagtttttcacaacttatcatgaacgctaaaattcaacaggatgcacagtttcgatccatatacatcgtggttttattttaagtacacgtagttttcatatatggtagaaaaaaataatatttatgtgataacatgaaaaataatgcaatcctgattcgatttaagtgttggttaattagtcaatacagacggttttaacaatttacagcaatcaaaaagaaatctttttcatcttctttgcacttcatcatttacaaaaatatgaaagcaaacctaaaaataactcagaattcatcttctagctaatttttacatccttaatttagctaaatctaatgcatcttctaacctctaattgtatatataaagtagcccatctttcttcaattttacaacaaacaaaaagaaaaagaagaagtactatcagctatatatctcaacaaataaagaaatatgaaggcatgggtgatatgtttgctagtgatttgcgcggcagtgattgcggaaccagtggagagtcggaattacatagaatatggtgcgattaacaagtgcgctggtcctaatcctcctccgggatgcaatcctcccggggccgaacagaagaaccctaatcccgttaacgaatatagccgtggctgcagcaaaattcatcggtgcaggcgtgactgaacccgaagtgacgttcatcatttaaactgattcctcatctctacgaactctgtacgtatttgctttacatgcatatacatacactcgtatatgcaaggtgttttatgtgtatcaaattaattaatagtttattaatcctcagatcattgtattaaaaatatcaaatatatactaactgtgttaaattatataaagtgttcatcaatctcctttacatctaattttttttatcggctttgatcttatactaactataactaggattctgatttataatactataaactggaaaatttgtaagaaaacaactagacgcaaaaggactagcaatataattaagcagaaaaaaaaaatttggttactagctaacctaacctgtaagatgattagtggaacatttaaaaagtgcatggcatgactcgaccaacgaaaacaatgaagttgaaagccatttatgcaatatcctaaaacagtcagaaacttggtctatatctcttgcatatgcatggataatactttataattataaccgtttttattaaaacattgaaaactggatttatgcggtaacttttttccttcttattttaacatttaattattcctcaagttttatttacctttgttcgcatattcttcttttttatataatcaaatatagtatttatttatatatattttcctcaattcattacagattttctcaagttaggcagatctacttgaagagagtaagaatacaaaagtgtttaggaagaattgtaataaactctcatgaaaatagttataagagatacattatgttatataaagatgagatttcctaatctacgataaacttaaatgtaaataatatatttaaagataatgttaaactttctaaacttcaattattaacgtttattaataatcttttagatacttatagaataattatcttgatcttgtcatttcaaccgtcaatctcggtcgatttccggttttcaataccagttctctatattctaataatgtgtttgaacaataaaacaaataacaaagtacaaactacacctcattttagaagtcatcgcaataattaacatgttgaatgcgtcgactttgcataacaatctttttttttctgttcaatgtgatcatattattcagttaaataaaataaaatcaaacaccacaagattcttcacgaaaccaaatatacgtatctggctcttattcagagactttgatatttgtctgttaaaatgacttctaatattcttattacaactcacgtacaagttgacaattgaagattttgccgaacataaaaaaaaaactacttacttacaagttgacacttaatgatctttcagaaaatctaagaattaccatccctgtttaatttattcattatctattctgtctctagtcttgaaatagaattttacttctgtctgtttctgtctatatatgtttatatataggctcttatctgttcttgaacgttaacaatttcagtttctggtcattaatttactaaa

SEQ ID NO: 11362 - DNA, 3000 bp, Unknown
  misc_feature (1)..( 3000): cDNA_ID_2706333_gDNA_ID_2214492_Annot_ID_133486 3000 nt of promoter + ATG
accaatgaaatttatataaaagccaaaagctctccttcagaacgaaaagtcgaaaaccattataatgtgactaaatctcacatctgtatcctctccataactaagagttcaagaagaaaaaagcgtagagattactggttatgtttttatcttagtctcagagagttcgcctgagagttaccggtccatttaataagaaaagctttagtttagtcatcttcatcttcatactccagttcatcagaactacctcctcccatcactgatacgtaaatgacgacagctagaaactgagcagctagaaagaaccttgctcttttcttaaattttttctcctcttcggtcttttctacctttggtttgctctttggcttcgaacctgaacaaaagatgaaattcacttccttcacaggcttaaacatatccaatgaatgttgcatatatgacagatatataatatgatgaaatatatatgatatggacgttgaaggttagatgtgtcttactctttcttggaaatgaggaagggaatgagtgaagtggaggtgaaggagatgaagaagaggcttcaaggaactctgacttaagtttctcagcatatcgcacaagattactatgttccagaagtttgcaccgaagcactgatgtaacctgatcatgcaccattaagaaaactacttcatctaaatagttctaaggctaaattcaacctgataaacccataactgagaaatatattggtgaaatttaaagctgctcactggtaacgcttggattataaaaagtatgtgcgagagtaagaaagcatccaaactcgatggcctgtgggaagagaataatataaacattgtcaatcttttacaaaaaggcttaagggaaagaatccagttccggaatgtgattgcaatacctgtcttcaaagagaaacttctgctcacctaacctagtcgacaaagcttcatatgcctcacttgctctcttgtatatctgttcacatttaagactatgaactttaataactagttcaaatgctcacaaatataaaccacaggtcttctaaagtaacaacaaaacttaaacaaacccgacctgtttttctctttgctctgcgttctctttggtgattcctaaacggttctttgccaagtatgtctgcttataaaacaggaccttgctgatcacccaaggaagatctgaatagtagattttcgatgtagatatcccctcggtaccaacccatatctcataggtaagcgcttcttctagccaagacacaataagagccttcaaagataaataatccgaaagagactgtagctgagagtccagattaacaatcccatctttcttcagtttttcaattactcctccatcttcattgttatatgcaacatatgtatcactttcaaagtacggcagttcatctatattaaaaacaaatgattaacattgtcaatacacaagcttataaatattgaatgcacaaatttgtaaatccgtgaacaaaggattacgaagtgtctagagatattatcaaacataacatagaaattctgaagatattgttaatatacaaactcaatagctaaatcaaacaactaatttcttctgaacaagtatgaaacatcatcattctcttcgaattaacaattacgataacgaggaattcaaccaaagctataacaagaaattatgatgaacacttcctatccagaaaaattcaccaatgcatatatacacctcaaaattgaattactattgcctaaaaaccctatctaaactctgattaacctaagagcaggatcttaatagtacgaattcgaatccagaactcaaaattatcttgtctaggattcgaatctcaattcaagctaatagaattaacaatgttcacttccaacagatacacatcacgcaaccaaaaccttaatctaacaacaaccaaaatacgaagcgaggaatcaaaacagaagcaaacctgaatcagggaaggttgaattgaacgcaagttcaaaaggtagctgggctaatttcaggtatatataagcaggaagacaattagggcaagctgttgggagatcgaaggaaggcttccttgccaccaaagtataaacattcgtctcttgatcgccttccattatagtgactcgtatgtgtgagagctctggtcaaaagaagaagaagtactcaagtaagttcgatcgtcgatagagagagatggggcgagaagagaagatccagtcgagtccgggtctgggttaaggtttagtcggtcgggtttaaaactagggtttattaatacgataactcattttgggctttaaaaggcccacaaattacccattaagacaaaactactggaggaggagactcggagaaagtggaattgttttctcctttttgttagtttgtaaaaactaaaattactgtgtaacagtgtaaaatacatcatccacattttttttcttcaagatgactttataaaaataaactcaacttaaattcagaagatataatcaaaactggcgatgtgggcttttgaatttaatgctatgaagttagtattttggatttaccatttctttttagagtttatgatatatacttaaggatttagtttagaatttatactttggaatatacttgcataaaaaagtataacacattccctaatagtgatatgaattttatgttatatgttcttacctcgttttttttcattttttcgtggaaatatatattcatccacaatgtgaacaaaatagagaagaagggtaatacgcgtgatcatatacaaccaacaaaactaaaccttattctcacttccactaattaagctgcttcgaaggaaacaaactaaaccacgagaaaaacatttttgaattttgactaacagcaagaaaaattcgttgaatccatatgattctgtgtactatataaacattactttagcacgaacttcaaaaagagaagagaaaaagaaagggggtttgtgttatg

SEQ ID NO: 11363 - DNA, 3000 bp, Unknown
  misc_feature (1)..( 3000): cDNA_ID_2686029_gDNA_ID_2214492_Annot_ID_133487 3000 nt of promoter + ATG
ttgctagtaaagcctaaaaagatatcattctgcttccaaataccttgcattaatttagaattagtattgctaaattgtaacaacatgccatcatatttccatcattgagttttgttatggatttggcaaacaacccaatctaagtcaaattcattgcatgcaagatcatactaaatgttgtactggagaaagcacgatattctatagcatttttttttgtttaaatgttaattccattgtagtaagaacaataatatatagtttagaatctgttattacaattcaataatcactacaatataagtagaattcaaatgaaagtgcataaatatttgtatacgtcatgtatataaaaaacatataaggcctagatatcttcataaaagtgtttcttgaaggcctccatgtgagccacctgtagacacgtcgcgagaatcaccgagccatcttcgttttgatccggcaagatcagcgagtcgccgtcaaagtcatgcgtgcctggtcccgtgtagaactctttgccccatccgaaatcaaggccgtacattggcaaagttaaccagctcaccactccaagatttgggtttccgtagaatggaccttccgtgcttcccaaggcatgtagatcttgaaacttcttcagatctttttggttcttaagatactctatcccaatcatcacgtattcgtttgttacattctttatggctttactgattaaactcgccgcgaaacccaattcattcgatatcagttcacctatatgcataacaaaattatcgaaacagactttgcattgtagaatcagtacgtactaacctacatttacgtggatgaaaagcaaccaagaaaagtttcatatatccaagttcttcagataattttaattgttcagcaatagtagaaattaatgataatccatcagtttcataaaagagtcgttttgacggtcttttgacacgaattctaagataaacaaattacaatattttgtaatatttttgaattgaaaaaaattaataaataaataatatatataattggaatataaaagtaatgaacaaaatcataatttttgtttagaggactaaattaaattttgaagaagtgtattcaaattcacaaaacaaacaaaatttctatggatagtaatagaaaagaaagaaaaaacacgtacctgaggtgcttgctgcgaccacgtcaagagtagcattgccgaagtagccgcgtggcagaggtggctccatccgactacgagtatctatacagattcctagagccgttggttgctccggagagtggccacgtgctttacacgcgcacctccacacgtgtccggtgacggtctcgtaccttgtaaaccctttcgccgggtcagagtgtttgcttccgttggctttacttcgtagcttctgcagctgagatgtgctcagtggtagcatcaccacaatcgttttcttctttctctcttctacattgtccgtttctccgatcaaaaacggtggctgatcaaactctttgtggtcgaactttgggggcgacacaaacggtgggagcggttcaccagcccagaggattttccggtctagaaatggaacggtttctaacggttcaccgcgcgcgagtcttccccattccgatattaagtgaagcgcgctttggccatctacgatcgcgtgggaaacgttgacgctaaggcttattccaccgcatttgaatttggttacctgagctaaaaatagaggaatcgtttcgatagggtttttatagtttacttgcggcataagattctcgaattccggcgtaggagagaagtctttgaaatccgaaagcttcccctcagattccgcttcaatgaattccactccctcggcgttacaattgagctcgaaccgtccccgagggagccatctgagacggccagccatagggtaaaaatggactagcacacggctcaacgaggtttttaggatttcgactacattgccttggaaagattcagatggcttgtcgtaaaagtaaagggtgggaatgtgagtaattgtaccaacttgatcccactcggctaagggaaacctaccgctccacgttggttcggccggtactatagtgtaagattttctaaaagttatgggagccataacacaaaccccctttctttttctcttctctttttgaagttcgtgctaaagtaatgtttatatagtacacagaatcatatggattcaacgaatttttcttgctgttagtcaaaattcaaaaatgtttttctcgtggtttagtttgtttccttcgaagcagcttaattagtggaagtgagaataaggtttagttttgttggttgtatatgatcacgcgtattacccttcttctctattttgttcacattgtggatgaatatatatttccacgaaaaaatgaaaaaaaacgaggtaagaacatataacataaaattcatatcactattagggaatgtgttatacttttttatgcaagtatattccaaagtataaattctaaactaaatccttaagtatatatcataaactctaaaaagaaatggtaaatccaaaatactaacttcatagcattaaattcaaaagcccacatcgccagttttgattatatcttctgaatttaagttgagtttatttttataaagtcatcttgaagaaaaaaaatgtggatgatgtattttacactgttacacagtaattttagtttttacaaactaacaaaaaggagaaaacaattccactttctccgagtctcctcctccagtagttttgtcttaatgggtaatttgtgggccttttaaagcccaaaatgagttatcgtattaataaaccctagttttaaacccgaccgactaaaccttaacccagacccggactcgactggatcttctcttctcgccccatctctctctatcgacgatcgaacttacttgagtacttcttcttcttttgaccagagctctcacacatacgagtcactata

SEQ ID NO: 11364 - DNA, 3000 bp, Unknown
  misc_feature (1)..( 3000): cDNA_ID_2706329_gDNA_ID_2214492_Annot_ID_133488 3000 nt of promoter + ATG
agtggcgtgggaagcaatttgtaaaccgaaacaggagggaggccttggactgcgatctttgaaagaagcaaatgatgtctgttgtctgaagctgatttggcgaatattatcccatggagactcactgtgggtaaagtggatagaaacgaatctcttgaaaaataactctttctggataataaaaagctccacaacgatgggatcatggatgtggaagaagcttctaaagtaccgagaagtggcaaaaacttttagtaagattgaagtacacaatggtcaacgcacatcgttttggtatgatgactggtcttgtatgggcagaataatgaacttcatcggagataaaggtattattgacctgggcattaaaagagataagttagtggctgaggtttgggacacacatcgcagccgaaggcacataacagactatttaaatcaagtagaaaacgtcatagctacatcaaaggcgaaccgcaaggagaaagcagatgatgtggtttggcgaggaagaaatgacatttataaaccacagttctctacacgagatacttggaacaatattcgaaccactgcgaccaaggttacatggtacaaaggagtatggttttatcaagcgactccaaaattttctttctgtgtttggcttgcagctttggatcgcctctctacgggagatcgaatggctaattggaaaggggtttcttcaggatcatgtgtcttctgcaatcatcccacaaaatctcgtgatcacctcttttttaactgcccctattcttctgaagtctggacagtcacagcaaagaacattctaacgacgcgtttcacaacggattggcacctcctccttaacacggtttctagtttacagcaaaatcgagttgaaaactttcttgtgcgttatgcctttcaagcttcggtttactcaatctggagcgaacgcaacagaagacgacatgggaacactctgcattcagcaactcggctaattggttggatcgacaaacaagtgagaaacattctttcatcaattcgaataaagggagatagacactacgatgcgggactccaaatgtggtttgatacaagagcctaatcacttctagtttctaaattttcatttcaattctaaactttcagcttcatttcaaacaagttgcacatgttgtaaaaaaagataatttttcttttgaatataatttaacattatattaaaaaaaaataaaaaaaattcaatcattctaaatgtaataaattacagtttcaagaaactacgttacgggctaagtctgcaatttaactttacgacaattatgtccattgtgctagatatgactgtaaatgcttggcccaataaaatagattgcggagaaattctagttctcaatattaatggcagttttgtggttacgtgaaattcccagggacaaaaaaaagaagaagtacgtatcaggtatcgaggcattttcatgatatcttttacaaatgtgggtccagatcctgccttttactttacaggccggtcctttctttttgttgcttttcctaaattcgtccaacgtattttcccactggcgacgcttattaagttactaaattgcccatgcttaactactcatatagattctccgaattgattccattttacacaaaacaatccaccatgcaaatgtaatttatataactcgacaaaaatatagattagtaaaactaaaaaaaaaacttatgtaatttagaagttaccaagtaaatcactatcggtaatatgatatactccctttatttatttttgtttgattttctagaaaaaattattattctaaaaaattgattttttagattttcaatgcaattcttattaattataattgataaattgtaaattttaataaaaattattaaatactattagtttagagttattaaaaattgtaaatcacaaagtataatacatttaaaatcaatatttaatatgttttcttaatatttgtatattttctagaaaaagaaaagaaaacagagagtataatttagttgtttacactatttgcatcgttatgtcattatattaatattcatgttattataagattgaaattaatatcagtataacaattgaggtatgaaaataaatgtaatgtaaacatcaatagactatgccatatataaactcataaacataaaacttagtacagaaaaaagacaagaaatattcagagtggcaaaatcgaaaataaacatgaaaagcgaggatagaaacaaaataagcttcgtgtcccgtctttctcttagccaatatatattcttcgtagctttattaaaatttagtttagctctaccattcactttatttattaattaatcatctcttttaatttcgatcaatacacacgattttagttctatcaaatgtttttttttggttttgttttatgtagcctctgtcttcttcttcttcaacttcttgattgcgagtgagtcttgacttctttctttcattctctctccttcaaaatccgacagtaattttgaccgttgttttctccaacgtctctctctctctctactgtgtatccctcacgctcctccagtctcttttcttttgactcattattaggttttttcttcttcttctttgtcttctctctctctttcttcaataacttcttttctggctttgctctttactttccttttgacattttcacaacaccaaatccaagattttacaccatttctcatctgggtttctgttatttctgagtacaatctcaccctttaatagaaaacaagcaaaatctcttcaagggttttaaggactaaagagctttgtcttgtatattaagcaaagaatcttcttattgtctttttctcagttaatgcgagttcagacatagttattatgtctttgttttgttctgttctcagttgtttcatagcttttgtatgagtgtcttgagctctggatttgagcttaggaaagaagagtagagagaaatg

SEQ ID NO: 11365 - DNA, 3000 bp, Unknown
  misc_feature (1)..( 3000): cDNA_ID_2706321_gDNA_ID_2214492_Annot_ID_133490 3000 nt of promoter + ATG
tattaaaactaattataaatgtattaatttttgtaatttatatttttctttaattataaattaacgatattcaattaattgttctaaattttaaaattcattaataataactaataaatagtgcatagaaaacaaaaaaaaaatcaatcattttgaaacaatagtttttctaaaaaatcaataaatgatcaaaataataaaaatgcaatgaacgcgacaaagcaaagtttgaataaaagcaattaatgaacctttactcaagagtacattaactggaaatatttgatgaaacaattaataaagttttacatcggtttggaaagccgcaccatccaaaatttgagatgaaagaaaaaaattacccaaactatggattttatagtttttgcgatcaagataccacaaacttaccgatcgggtatgccatgaaaaagcttaaagctaacattcaagatgtccttgaaacctataacgatgattattttgttataggtttaattacctacgacaatttgaaacttttttcccattctgactattgtactctaataaatgatgcaatcaaaatcttccatgcacagagaagagttggtaattgttgcaattgtaaaaacaaaaacccataaaatctcaagaacctcatgtcacacagataatgccacattgcttacttaaaaaatttgctttcttgtttttcttttttttttttttgccaagaaaccaatgtttttcttttctctttttttttttttgagcaaaaccaaaaaaccaatgtatatttgtactttaccaataataaaatctcaaaaacttgaagataagtttgatcaaggccgacccatgggtaaaaagcccaacaagcgaatgctttaggcaacaacgtttataaatgtttttagcagcctcactaaccatcaagagttttgctttatttgttatcatattctttttcgcagtatacactataaagatgcggtcatattatctatattttttgtaacgatttggctgggactgtttgtggaccacgacgtctatttttggttgatggatttctacaatatacgatactgaaaagagtaaaaatcatttattttattataaaaataatgtctccaactttctcttgtaataggttatggcttgtattcactgattcttaatgcattctagtataactttatgtcatttatttatttaatttagtggtttatcatttaagccgcatacgtctttactctatctctttctcctagagtataactataagttatactatgcaaacatgtgagattttattagaaagtataaaagatataggtagatattaagagataagctacgaaagtagacgacattggtgcgttgcgttaaaagaatttgtagttaattatttagaatgataaactaagaaaatcgtactaaaaacaataataaagaaaacaatgagatgaggaatcacacatggattccattttcgtgacattccacttttgggggtttccactaaattttttataactttgatttcgtgtctcttcctcacgagataaaatccccctttgaccatttgtttcgtccaatcaacttaaaacctagcaagaactattaatcataatataattattcagattcttagatatgctatatactaatgtgcctaaactcgtgacgtatcggaccagttttagtcccgccctactttcaaactaataatgttttgtaatctcaatacttttccttcaaaacaattttaagaaaactgccgtatttgttatgagctaattataatcgagcatcctaccttgaattaacttggtttcaagactaattaagatcgacttttccaaaataaagtcatgcataaaaattgatttaaatattatacatacgagttatgacaatttgtatataaaaaaatttgctggacgtttgagtaaaacgtttcataaaatataggaactgaatcttgaagataggaaccggaaacaaataactaaaaagatagcctacgagatttacgtggtaaaaaaataacttaaaaccccataaaaccttaatcaaagaaaaaatggtttaataaaggtttcaaaaatttagtaatggttctaaaatcatttggtaccccccttattaaactttcaacaaccttatacacctactagatttgtggtatttttaataattttgaatttttgtggtagttttggaaaacatgatttaataatttgaagcttttcgaattactctataatttttaatagagatcgatcattatccctaaatatatttataaaaaatctgataattactaaaatgttaaagaaaactaaccaatcatcttgcatctaacattcttacttatctgcctatataagcaacaactcccatttcttgacttctctatgttcctaacacttctctcaacctttatctgatcgcaccaaaccagttttttcgcatcggcttcttccttttgctactagctctcctctcttctccggtatttttgtctctcttcttaattcacacagatttcatgataagtgatgatctataacaagacgctaactcttctcttgcatttctcgtgttttcattttcttgttacgccaaatttatcccttcaaaatcatttttttatgcgtatagaatccaaataataagtaaaagctgattcgtcttcttccacttaacacaagtaagcaatgagagggtgaagatttttctttaggaaaaaaaagagagtgaagatattttttggcttgatctcaacattattttttcttaaaagtaaacattttcaataagaaaatacaagacccataccgaaagtttcttcttaaaaaaaaaaaaaaggttttgaactgtttcatgataatgataactaaaaaagtttttgctttcttgttttttttcctccgcaaaacagtcttaaagtataaccaaaaagcctataaatcaatataatttgttgttttgatttacgttttacagaaa

SEQ ID NO: 11366 - DNA, 3000 bp, Unknown
  misc_feature (1)..( 3000): cDNA_ID_2706305_gDNA_ID_2214492_Annot_ID_133496 3000 nt of promoter + ATG
ctaaaagaaaaattaaagagataggaagaaaacaaaaaaaaaaaagaatagaaaagtgttaaaaaaagaagaagatgtggaataatccgttagaagaatggatgtacaataaaatcgatccatacactaatcatgtatcatgtctcatcgaattatttggcaggtttgggacatttcatcgattttgcaaatagccatgcacaaaacagaagagggtcacatattcacatattcgtcaatgttttgtgacaaaaaaagggtcacaaattagagtcccgaaactgcaggttttcttctagaattgatcctcaaaatgaagtaagaaactacttcatatgatttctcggttacatttgtatttaccaatctctttaaatatcactttgtactttccatatttttggtaatacattggtagctttcaagttttaggttattggtaatttgtaagaaaaaatcttttacttaccatattttaggactttgaaatatacaagtttgagggtgatgatatcttggctaaatcactgaatcataaatttcatggttttaggtttctagatcttacaaaaagtgtcattttgaaatgtataacacatattgagatatatttatgatataaaatatatttacattagatatattaccaactaaatggtgaagaattaaacttcagactttttgagttttgaataaagagtaattaaattggaaattaagtttgcgacattctaattaaaacattttaaaaaaaataaaaaatctagaacaacatatttgtgatacagaaaaagaaaaaaagaaaaaaacgattttcatatatttaccctaaacatcaaatattaaactatttcaaacatatgattgagtagagtccctttagcagtataattgtatatcaatttttcataatgcttttgtaatgaagacgcctttctgatttgtaaaaggaactcttttctctggcgatcaaacatcataattgagttaaataacattggccctctaattatgaatttagatataacttttcaccagtgttaagactataaccaatttaagtcagcaatatatcatacttactcattaatgttccattgtcaactttctcttaattttctgtcaataatctttcatatttagggttttatttgcttagataaaaagtttaaaaaaaattgaaataaataatgcagcattgatcagataactaactattcactgaattgttattaatatatcatcatttatttttgtcacatattacatcagagatactatcaatccatataaacgactccaaatataactttcacgatgtgccacttttccggaatactcgaatttgtactatgccacaatatacagttttatacctaccatacaaaactacgataaaggctttgtatttacagtaacgatctctttacagtactaagaaattttcattaaattttagatttattacaatgcaagctaatacattatctggaaatcgaattttgaccatgagatcaaaggcgttaccattaccatttacatttctagaactctctagctagaaaggaaaaaataaataggattttgatatttctcggcatttaacacaaaacattgattttcatatctactttttgaggggtattaacgtcattacaaaacgaactgacagcaaatccggcgcgcgaatggtcactctcctccctccccaccttcggacaatcggacatttacgtaaatccgcaccacaccaaattttattgttggatttttgtaaaacacttttttaacattttaccattacacgaaaacattactacagtataaaactaattaaaaatttacatacgtaatcttcggttcgttgtctccttagcatttatagtataaagtttataaaaataattaaaaccctaaataacgacattttcttcttcatttctctaccaacaaacacacactcactgaaattacagtaacaagttttttattttttaacttcactttcgtactttttttttgttttctctctttggatactttgctagatctctattctacgaacaaacccagaaacaaaaatgtttctctttaatcactcaattagagagatctgaataaacttgttctcttgtttttcttcttcttcttcttcaaatgtgactaaatttataatctttcggttttgattcaatcgtacattcaccatttcgtctctcacagaaagctaactttttttttttgtgtgtgttctctgttccgtctcgtgaagcaaatgtaagttcgtacaacattattggctttttggatttactctattgaaactgctactggttctttctttctaaaaggatctttctttttgggttttatttgatgtttgattctttgcttggatgatttgtgaaagtgggttattcttacttagtcttgatactttttctttgattttggtgattttcattttggtttaagagagtagaagattctttcttctttgtttgtctcattaattgaagagcaatagtggttataatgtacttactggtttgctttttatataaatggtataagatggagctgaactttctttacttgattgttgtgtttagtcaaatttctctggagtaagttcttggtcttcaagctgtgatttgagtttcaagttcttttctttggtgttggttggattttggttactgctcttatgtgtttggttcttgttctttgtttttggtggttcttgtgtacttggccttggagatgattcttgcgtttctctatacactagtttgattatgcgttgtctgcattttgtgggaaagcttgatccttttagaccaaaagtaactatgtccttgttagctctgagaagtgtgtatgagattagatgatctatctggtctgagggagctaatgcattcatttgattttgatgctgcagttgaatctacagcaagaaattaaagttggagcttcactttgagtgaaaccaaaatg

SEQ ID NO: 11367 - DNA, 3000 bp, Unknown; identical to SEQ ID NO: 11365
  misc_feature (1)..( 3000): cDNA_ID_2706321_gDNA_ID_2214492_Annot_ID_183710 3000 nt of promoter + ATG

SEQ ID NO: 11368 - DNA, 3000 bp, Unknown
  misc_feature (1)..( 3000): cDNA_ID_3039720_gDNA_ID_2214492_Annot_ID_183709 3000 nt of promoter + ATG
tttcttagtttatcattctaaataattaactacaaattcttttaacgcaacgcaccaatgtcgtctactttcgtagcttatctcttaatatctacctatatcttttatactttctaataaaatctcacatgtttgcatagtataacttatagttatactctaggagaaagagatagagtaaagacgtatgcggcttaaatgataaaccactaaattaaataaataaatgacataaagttatactagaatgcattaagaatcagtgaatacaagccataacctattacaagagaaagttggagacattatttttataataaaataaatgatttttactcttttcagtatcgtatattgtagaaatccatcaaccaaaaatagacgtcgtggtccacaaacagtcccagccaaatcgttacaaaaaatatagataatatgaccgcatctttatagtgtatactgcgaaaaagaatatgataacaaataaagcaaaactcttgatggttagtgaggctgctaaaaacatttataaacgttgttgcctaaagcattcgcttgttgggctttttacccatgggtcggccttgatcaaacttatcttcaagtttttgagattttattattggtaaagtacaaatatacattggttttttggttttgctcaaaaaaaaaaaaagagaaaagaaaaacattggtttcttggcaaaaaaaaaaaaaagaaaaacaagaaagcaaattttttaagtaagcaatgtggcattatctgtgtgacatgaggttcttgagattttatgggtttttgtttttacaattgcaacaattaccaactcttctctgtgcatggaagattttgattgcatcatttattagagtacaatagtcagaatgggaaaaaagtttcaaattgtcgtaggtaattaaacctataacaaaataatcatcgttataggtttcaaggacatcttgaatgttagctttaagctttttcatggcatacccgatcggtaagtttgtggtatcttgatcgcaaaaactataaaatccatagtttgggtaatttttttctttcatctcaaattttggatggtgcggctttccaaaccgatgtaaaactttattaattgtttcatcaaatatttccagttaatgtactcttgagtaaaggttcattaattgcttttattcaaactttgctttgtcgcgttcattgcatttttattattttgatcatttattgattttttagaaaaactattgtttcaaaatgattgattttttttttgttttctatgcactatttattagttattattaatgaattttaaaatttagaacaattaattgaatatcgttaatttataattaaagaaaaatataaattacaaaaattaatacatttataattagttttaatatattttcttaatctgtgtgttttttctacaaaatcaattaaaaagaaacataaaaagtatataataaatttttaatttaacacaacttctagtttattattcacaatgagcaaattcttatttcctgtaatacttagataacaaagagtttataaacaacttgacaacggataataggactactaagatgatagttatttctaaaaatcttttggaaaaggcaaacaaaattagccaacactatagatattgtgagaaattacatagtgcgggtgaacaatagaatacgcaaacgtatactacatgtacatgggcaagaacattactacattagattgaatatgaatagaaattgtcataataaggaaacctctttttgtgtatcgaaaagtggtcgtacttatattcgttctaccacctaatcacattaaaattatagttcctgaatctttggaacttttaagaattgtaacttactattttcagttttcttcacccttttctcattatagtaaacatttcatttttagacttcgacatcaacaagaatttatctctctttcaatcatttctaatggatattctttataaaactctttgatacatgtacattagtggaagttttattctaagattagtttttagttattaaagaaatcattttcaccatgggatttatttcatagttgattttagtagaattgttaaatgcaagcatctaaccgatagatttcttaaagcctaagtgggctggaatctcttgatcggtctaaacttttaaatttattgtataaaatgatacacgaatatgaagtaaaatattgttcgatatgttatcgtgatgcattagaaattaaaaaagaaaatgatataggacacctattgtttgcccatatataatatttttgagaaaagttgctataagtgattatgaaagtgcaatgcaagaactaaattaccaatgaggaccatgaggtggtcaagcttaattgtatacttaactcgttaatattatcataatcatatctttacaaaagaaaaccatatcgttttatcaagaatatttataacatatttctcaccttcgagtaatatgatagaattgatgcaaagtaataaagtaacaaccatatctatatacacgtacacctagaaaaaatccaatacgtgcatcataatattgacctttggaatttaaaaaatggggacaaagacaagagacgagtgttttatcatgatatgtacacagtgaaaaacacaatgaggatatatgatatcatgaattcatgatagtggacattcgatcaacaactaacatgagctcaaactatatactgaatccgatccaaaccgacttgggtttgctatttttgtatatctgtttttacagataagaaaaaaaaacttgcattcaatcacataccatgaaccagaaacatgtaaatattgaacaaaaggcctagtacgtagttggtttaagcttttaaattagtcaaacatgtggtgtggctttgtcattgaaaaactcaatgattaaaagagaaaataaggcgatctagggttctttgcgtttctagcaagtatg

SEQ ID NO: 11369 - DNA, 3000 bp, Unknown; identical to SEQ ID NO: 11364
  misc_feature (1)..( 3000): cDNA_ID_3039724_gDNA_ID_2214492_Annot_ID_183708 3000 nt of promoter + ATG

SEQ ID NO: 11370 - DNA, 3000 bp, Unknown; identical to SEQ ID NO: 11363
  misc_feature (1)..( 3000): cDNA_ID_2686029_gDNA_ID_2214492_Annot_ID_183707 3000 nt of promoter + ATG

SEQ ID NO: 11371 - DNA, 3000 bp, Unknown; identical to SEQ ID NO: 11362
  misc_feature (1)..( 3000): cDNA_ID_2706333_gDNA_ID_2214492_Annot_ID_183706 3000 nt of promoter + ATG

SEQ ID NO: 11372 - DNA, 3000 bp, Unknown; identical to SEQ ID NO: 11361
  misc_feature (1)..( 3000): cDNA_ID_2717353_gDNA_ID_2214492_Annot_ID_183704 3000 nt of promoter + ATG

SEQ ID NO: 11373 - DNA, 3000 bp, Unknown
  misc_feature (1)..( 3000): cDNA_ID_3039734_gDNA_ID_2214492_Annot_ID_183699 3000 nt of promoter + ATG
aagtttggcccaatcgattattaacgaggcccatttaatcaaggaaatcatggaaattgaatttaccaaatttgggcctatgaatcatggaaattgaatttatcaaatttacgattgcattttttttttcttttatatttttttttttatataagaaaagaaaacgattgtatttgtaactaatgtaaattaaatatttgaatatcaaaatatactgtaatactatgatatttcactattgtcattaatattgttttttttctttgttgtgtgtttcgaccacaaatgacagatattgttttattctatatgaacgtatgatgtctagtaaacgtgctggtaaagatatttgggtaatattggcatatgtatgtttgtcctaagtttttcatttatataattgtagtagtcacctatgttatatcatcgaagtatagaggtagagttagagattgagagaacttgtatcctccgaattttttcgatattagtgaaatctgcagcagaagaaagtggacgtaactctttttgagtaaaaccactatatatcttgtgtgcacattattttttctactttaatttcgtgttcttgaaaaaaaaattagatccttaattcctgacatatatatgcaacaaatgctaagccacattagtcacctagtgggacataaaattaatacatcaataggggcattattagcaaaccttataaaattacttttaatttttaaaaaaaaatcatgtgtacaagtgaccctcccaaaacctatgtacgtcggccaatgtgcataatattacggacacgcttgcaagaaattttacacaatttcttagttgcataaaactactccgaccaattatctagctagtcctctacaattaatctaaaattagagagctttctcaaataattgtagtctacctaaattttctcattgcctctttctttaaatagcttaacaaaaatcactggtcacatatgtagtcagagtatgttatatatatgcatatattgaaacatcatcctattcaatctcacaacaaccaatctacacacaaaacaataacaacaacaacaacaacaacaacaaacaacaacaaacaacaacaaaatgtttacaaaatcaatccttttaccttttcttctggtaatcatcttcgtctcagcatctcaagctagtcgtcaactctgggatagtggaatcagcgagatgtttggttccaaatccgggtttcatcatggattttccgggttttcggggtcctctggaggtgctggaggtgctggaggatcattcggagatatgatgaatgctggaggtgcacatacatgctcggcgcaaggagcttgtagcggtaagaagctgacatgtcccgaggagtgctacaaatcaaccaacgttaacaaggatggttataaaagcaccagccgcagtggaggatgttcatttgactgtacgaccaagtgtgccgcgacttgttcaaattaacatgttaatttgcacatatatattatatgttcgtatagtatgttgttatgttatgttatagcattatatagtctatatatatgtcaatataataaaaccggcaaggtatatgggaggtttgtgtctccctttgtaattttgtatggatcttgattagaagctttctatgaatctatgtacataatatgattttgaataaaagaaaatttagtgtttcttataattgtgtgagtaaatctctatgccttatacatgccaggaaatttgagaccgtactaatgtacatagcgcgatcaaggaattttggcactatctatatagagttttagttcatgtctttttaagatcaacaagacattagcatcacatggctataatacttcagattattaaaataattcatctaatactttagattggtaagcatataatactaacgttttatgaatgttaaaacttaaatcccccaaaactttaaagaatcaaaacaactaacttatctgtataattataaacatcaattaggttcatttagagatcccaatgattataatcgatataatcaaattgaaaggaataaacatagatcttggtaatagttatagctagtattttaattcacattacggattggtgtttatctggcatctgtgatctactataatttcatttcattcgttatgcttattctaaactcattgcattcctttcttctccaattaaaatttatcatatgaataacatgcctttttcaccaatttaaaaataatgattacttgttatatttagatgtattataaagtaaaatatttttattttatttacataacccatattaattattccaaaatatatgatgaataaatgatgcatagtataaataattgtgatttgaatgattttgtcagcggtaaatgtcactagatcactatttgtgtttggtgaaagacgaattatactttttttgttgttcaaaaaagtacccttttcccccaaaacacatttttagactaagattataatttatcatttatcaaaaagtaataaacttaaatttgaatcatcgttgtaatattagtattatatatatcgaataagaagctatttaaattcttaaaattatattttttttttaaaaatcagatttttcatagcaacactttaagatagggggtactagtagtatgctttgatgatacaaatagcttaaacaaaatatttgcaaagaaattaaaatacaatcttagtagcatgattcgctatcacaaattctcaggttaactaaaattaaagatcctccccacatacaaaaagattgtagtctcccttattttgctcattaccctttcttttaaatagccttttaatattcttcatagaatcaatttcaaatctaaacttaaactctggcctctcttatatgacaactttaatgaataagatcttacttcttttcttcaataaatatttcctctgttcaatttcttgttttattttatttttgaagaat

SEQ ID NO: 11374 - DNA, 3000 bp, Unknown; identical to SEQ ID NO: 11359
  misc_feature (1)..( 3000): cDNA_ID_2992127_gDNA_ID_2214492_Annot_ID_183697 3000 nt of promoter + ATG

SEQ ID NO: 11375 - DNA, 3000 bp, Unknown
  misc_feature (1)..( 3000): cDNA_ID_2717337_gDNA_ID_2214492_Annot_ID_133498 3000 nt of promoter + ATG
aagtcttaatatcgttttttaaaaaaatttgaaattacatttacaaatcgaaaagtgttaaaaaaaacttaaagataccaatttgacctaacttttttttttttttggacctaacttttaaattagagaattggagacaatgagaaatcgctgtcgaacatacattgtcgcaaaactccgccgtcattgttccccgaatccctgacagtgaacttcattgttcaagcgaggtgagtttcctatttttcttcttctcctttcaattaaaatttcagggtttatgatctctagggtttaggttttattttcttaaactaaaccctaaattctttttcttcttctttttcttgtaatttccagatgcactgcgaacgctagaggaggtgcgatatcgaagaggaagcgttatacaggatcatgggaccaaaatatatcgtatagattcggttcttgttcttctataccttatgagagtagaagtttttctcttcaagagaaaaaaaaaaaaaagaaaaaaaaaaaagaagagtagaaatttctctgtgtttttttttaccaacaagacacaaatgaaactggtccaaaaggagtgtgtataatctctgtggagacataactaatacgttgatgaatttcaagaatacttggattatatagattaaccctgactcccttagatagagatcgaaatcgggtggtgatttctgagaccatacaagttctgatcagattactactaagtaaatcttaattattagactgtttttaatggatttttctgctctaatgataacgtaatgagattttttttttttttttgtatgtttggcttgcagacccgggtaatgagaagtttggtaagagcaaaaggcactaatctcacgtaagaaaacacttttttcatcaaccatgtatataatcatgtcggtttacataaaccgtatcgtctattcaagaatttagttttgtataattataatatttttttcagactacttttcaattaagcatctttttcttggatttttttttcacaaagggagagctttaactttttgcattaacttatatattttaaattatacatgcatgcataccgacttatataaatcatatggtcaatatgagacttttgatttatattatttgtcaactaagcatcttttcagatgaggttcatgcacctttgttagaattatcggaccagaagatcacatcaacgtttaccaaatcaacaaaaaaatccaatccgtccaaaaaatttggaaactgtttgaaagattcgaaatgttggagcaaggatactcagttccaatctctgagcagaatctgatatgactcatctactcataagactttgcgagatagaccggtacaaaaccgtttccaagggttcataatatatggattaatgtgagttattgtggacgttgtggttgtagaagccgcggtagtcgtggaaacactaattagttatctcctgtaagctatttttattttttttcctcacttcctcttcctcgcagctatgtataattttggttggttatctccaaaactttttatggtcaaacaattttgagaaagtaatttggaaagaaaaaaggtttaagaatatctttttatcgtcaagtcctcctccaaattacttccttaaaactgtttgaccataaaaagtcatagcaaggtattagttattctaatttaaattaaacgcctttttatcaacaacaaaaaaaagaagaagatttgatatgttgaaaagtattagggacgcttattagggcagtattcctagttattgcattttctttcggtcattcgaccttaggatcatacctcaatctgtatgactgtattcgccatgtgaattccaatattacatagtgaccaaatttgatatccaactaaaagtcgatctttgatctaaacgaaatgacaactatttggttagtgattgcaggttggaaagatttaccttctagacctgtcttacgaagctagtattctaaagtaatcttcataaaccgaattcagaaacaaaaaaagaaaaggagtccaaaattgtatgatcatacattaatatcagaatagtctcttttgttaaataaatatctgaagaatatatatctctttgattattttgtggatggcaatgaaactaagaatatatattcattgacttagaagtcgacaaaaaaaaataaaaaaattattgacttaattactagttgaccaatatatatattattaaaagaacatattgtatcgttgaaagcggatcatcgggttttaaaagaaaaacacatcgttgaaacttgaaagtgatgactaataaaaagatctaaacgtgtccggtcacctaccaatgtggttttgcaaattattgtcaagtaccttgactatattaaataaaaaaattcaccgtaacacattgatattcaactgattcctaaaaaaatatacaaactattgggagttgtgagattttttatatcagtgttggtctctttacatttgtgatgtggtgttatagcatatatagtaataaactcaaaaggaaattagatgtgttttgaccatttattaaaatgaaccttttcttgtcaaacatttgaaaaatactagtttttttttttggcaacgttgtaaataatagttaaaaatagattttaagtctcgtttttttatgcatatagtttcattcgctttattagactcaaatatacttttaattaaattttgcagagaattaaaggtaatcatttgccaaggaaaaaccatgcaaatatgcaataagtagaaataatgttaatgagagtaagcgttgacatatattacgtcctggtccgaacattcttaaagttgcgtaacactaataaccttagaagatggttggttgactatcaacatcttattgaccaaatgtttttttttttttaattataaaacagttgctcattgctctagcccagagaaagcagctcaattaagtaaatg

SEQ ID NO: 11376 - DNA, 3000 bp, Unknown
  misc_feature (1)..( 3000): cDNA_ID_2706397_gDNA_ID_2214493_Annot_ID_133501 3000 nt of promoter + ATG
tgtgatgggcctgttttagtggtagaaagcatgtgatgggttttgaagagattagttttgagagagattcaaattgtcttgatccaaattccaagcgatatacaaacttcgagagaattgtactcctaattagtcagatgcaattgttgagatagatagacaatgtgtactcagttataatttttataaaatgtttgtcttgagattttttttttgtaaaggataggaacatttcctttttaaacgggaatccaaattagggaacaaggaagtaagagccacgttttagaacttctaagtgaaaagacaacaaaacacagctcatgtttgttcctggattggactcattcataaacgttactttcatttctgttatattttatgtaacacatacacatatatgaaactataaaataaaacaaaatgaggtaatgagagaacggttaatgtaaaactgtatcggacaacgacttccttaggttggaggaatagtagaaggaagtcctcttcacgttcaccgcattgattgatagtgtttctctttttggtgaaaatatcaaaatatagttgtgtttttgacctttcaactgaaacgttggctcctcaagacaaagattccaccaactgttttatcaatttatcacgactccactctctaacctacatatccaaaaaaaattacatctttcgtaaatttgttcaatttcttgtcatttgcattgttgaaacatatatataggtattagattaaaaattgttgacattgtggatatctatttagccgtctttatgaaaacaacccgaaacgactaggttggcttttgttccacctaagaccatggtactacgtctaaattcaatggatttaaatataaataatattttctatatattagatggcgtttatcatgttatttgttttgttaaactcgttttatcatattatttagcattatcttgatatatatttggaagatctaataaggcgtttatcaaaatttgatttcatttcttttcaattgaaattgatggtttgtaataagaaacatttaacttgatagattttctttgtacatgtatgatctgtataatttattgatgatcatctatataaatatgatgtgcattttgtgtatggtgatatcatgcatagtatatacatcgtaacctaagatttggagcctagtatatactacacgaatatggtttgtactttatactttgcaactatatagcccatcactacaagtctacaaaattgttgaccaaaacaatcgttagcacttgtaattttgaattacagtgttgaaatcaagtaaacacctaatttcaaaatataaccgttcaagtcaactaacacgacccctcctcttatttatcacatgtacacttggacaatacattgatgttgattataaagatttaaaagaaagtttggtaagttgcaactatccatttaatcaacataaaggttcctttttgctatcataaaaacaattatttaaagtctcttttttctgaacctaccaagttagattccatggataagaaatgtagaagtaataatagaatgaatacatatgcatgttctacaaatctaattcctttatcaataattgttctactttcaatccaaaatacaatactatctttggtatctagcattttgtctatgtttaccaaccattctcagatttatatatgtaaataaaatagcatgaagaaaaaaaataatgcaataagtaactcatttggtaaataaattattattttttctgtctaactagagattgaatatgttgttctcaaatttgttatcagaaaataccttcaatatgaatatatattcacttacgtacactgttttttatcagaccaaatgtaaatggatggctcctttttaaacggctatctaaattggtggcgctataaaaaaattggtgggattaattaaagatttactatcataaccaaagaaaaaggacatgatcccaccagagcaaaatcaatacaattttttcgaatgaaagagatgtgttatgaagataattagttagataaacacggaaactaatattcttggcttaaagatttataaaatggtcgttaaagaatcataattacattccatcaaaacaattagctccgacggcgcgtgaatttcaaacgaaaagagagagcgcgtagtcactttccagcaaacaagaggcggaccagactgtgtcgaatttatatttaaacgttttttcttctctttaacgatgatgatggcgtgaaagaaagagagagagagattaaagaaatgatgatgagtcaagcgagctgtttttgggaagagagactaaagaatcagaagactaaaggtgtcgtctcctttctctctcttttctacttctgcattttcttctatcttcaatcttttgcagaagaaataaaactctgaagactaaagactcttctctgttttttttcttcctacttctgcctctctctgtttctggggttggcttaaaaacttgtaagaagaagttttatagaatctattcttcttgcattctcatgaattttgttgtctccatttttcaatggtaatttcttgttgcatgaattagataattcttgcatctgtaaactataatcttacatgttatattaattgctagcttttcatgtgtttgaaaaaatttcaaggtttagtgtcaccatttcttttttttttgtttgtttccgtgttcttgcatctttttctaattcgttgattccttaccgttgaagcaaaaattaatctgaaattaagtttaagattagtgcaagttccattttgggattttgtttacagtaatttcttgaactgtttcttttaattataaaagatatataaaaaaagaattaaatagatgcagtcacgagaatgcagagtttcaggttgatgattataagaagacatgtttgtttaattgttctttgttctttttgtaaacagacaagatcctgacaatg

SEQ ID NO: 11377 - DNA, 3000 bp, Unknown
  misc_feature (1)..( 3000): cDNA_ID_2706393_gDNA_ID_2214493_Annot_ID_133503 3000 nt of promoter + ATG
agtcgaaatacccactggtgtcacagatgtcagcgtgctgtccgccttcacggccaagagcctgtatgcttttattgcggaggtggatttgttgaagaacttgatatggctcaagccagcccctttgatatgtttagatcccacaggggtgttgtagaacgtgatcagacttttgatctcatggatgctttctctgtgtttatgaggaaccgcttagctgaaaggagccacgacagagaaatcagaggaagaaccatcagttcaggtcctgaaaactttcctggtctggcccctttgttgatctttggtggtcaagtcccttatagactaactggcgacaatgcagtcgaagccctcttcaatggcggctcccctggcattggcatcacacgtggtaacaccggcgactacttcttcggtcccggccttgaagaattgttcgagcagctttcagctggcactactcgccgaggcccaccacccgcaccgagatcagcaatagacgcattgccaactatcaagatcgcgcagaggcatcttaggtcatcggactcgaattgtcccgtgtgcaaagacgaattcgaactgggatcagaagcgaaacagatgccgtgtaaccacatctatcattctgactgcattgtcccgtggctggttcagcacaactcttgcccggtctgtcgccaagagctaccatcagctagcggaccttcaagcagtcaaaacagaaccacccctaccagaaactacagaagcagtagtagtagtagtagtagtaacagtcgtgagaacgggaatgaaagaaggaatcctttctcttccttctggccattccgttcgtcaggttcaagctcaagctccactcaaaaccgtggaggcacaagaaactcggatacaagcgatgagaaccataactaccatcaacagcaacatcaacaatcatatatgggttacagtggctggccttttgattactaaaagtctaaaagtgagctaaaacaaatctttggtctcactttggtctctttacttaaatatgcttgtgattctgcatatgccttgtgcttcactctctatctctctcactctcttttatcaacataaataatggagaactgtatttgttactgtagattttctttctctgttaaaaacgagttcatcattttctatatgctttgttaaatatgtcattttagttgggtttttgaaaatggttgaaatagatttttgagttgatcgataaataaataaatgaaaacgtctggacactcttgagcgatctatcagtatctcgtgatcttcttcaatactaataaaaaaagggaaaagaaagagaagagagtcgtgctcataaattaacggtgcagagcgattgaacaaaaacaaaaatatcttccagaaaaagccatttttgattgcgtataatgaatacacgaaattaaaatcattacttgccatatatagtacactatttctcagcttcactcactctcgagactcgtgtatgttgatttacggtttgttcaagcaaaggtgatcatcaattcccaattttttttacgtcactattttcgattcactccaatggcttgcgtgttgctgatttcttgattttgtggttcttgagttagtctccatctgataagtaagtaaattatgtgattgtgatctgggttttgctaaagttttgatttttattattgttgtttagagaatgatgaatctaggatctctttcgttgagtacgagcaagtcgagtaagccaatggttagcatcagcttttggataccgtatttcactcactggggagagagcctgctggtctgtggctcggctcctggacttggttccgggaatgtgaaaaaaggtttgctgctaaagccatcccagcaagatgatcagctcatctggagtggctctgtctcggttccacctgggtttagctctgactattgttactatgtggtggatgactcgaagagtgtgttaaggtcggagtttgggatgaaacgaaaacttgtggtgcctgagacattgaccggtggagagtctgttcatcttcgtgatctctggcaggtttgagttctttgtccttttcgagtgtattatacaaattttgtaatctgattttgtagtgttgtgattgatgttctgttcctttaattttagagtggggatcaagctcttccatttagaagtgcatttaaagatgtcatcttccaccacagtttcgatgtgaaagtagaaaaacctctaggggtctttatgaataagtcagatcaagatggtattcatttttttatctaatcctatcacaccattgtctctgagattctctagtttgtgattgatctctttgctaactgttgtggccttatgactttaccatgtaaacagattcagttgttgtccaattcaaaatctgttgtccagacattggagagggaacatctgtaagcctttctctatgatctttggttttctttcttttcatgtttgagcctgatgtggtgttgtggccatcattcttacccttgattatgacatgtacaggtgtatgttctaggcaccccagaaaagttggggaattggaaagttgaaaatggacttagactcaactatgtcgatgattccatatgggaagcagattgcttgatccctaaagcagactttcctatcaaatatcctttctttttactttcttccagactaattagttgaacatagttgacacttcacttctcatatgctttctgcatgttgggttcttaacgattctttcacatatagatactgtaaagttcagaaggaagatagcatagggtttgaatctggtggtaatcgggagctgtctcttcactccatcggtagtaaacaggaatacattgtcatgtcagatggcttgtttcgagtaagtaacagagacaagctatgaactagctctaatgtgacagaatcaatgttgtcttactattatttaattttacttgtaggca

SEQ ID NO: 11378 - DNA, 3000 bp, Unknown
  misc_feature (1)..( 3000): cDNA_ID_3039766_gDNA_ID_2214493_Annot_ID_133505 3000 nt of promoter + ATG
cttcgatgatgagtcatttgcttcaccattttgtttggacacctcctcaagggactaaaccggaggagattgacatgtctgaaaaccctggactcgttacttacatgcgtacccctgtgcaagcggttgcaacgcctcggttgccttcggatctgtacaaacgcgtgccttacgatatgtaaatgtcactctgatctaccttttgttgctgctgctcatgctcttgttgttgtttgtagacatgtttcttgtggtttatcatcgaaaaacttttgatgagatttgttgtatcaattctctcaaggagaagtaaagaagccatcttctttgtcattgggtttacgatctttcaatcagtgcaatgttgtaacttgaaacataagaataaacaggaaacaaacatacaaagatatttgcaggacataagaacaagtttcttgattacattaactttttaggtttcgcatatagcaaagtattttacacacatataattaattactctcagagcatttgtaatcattaacttgaacaagtgaaattcaagaagatgattccttgaactcctgcaactgtttgaagttcatccatggcttcacccacactttggcttcaaaattcttagtctgatcaccttcttttgcttctagggttaagtggtacatcgttcctgcaactacctgctcccttgctttgacaatcttcttgaactcaagaattttgttctgtacttacccggaaaaaacaaaaactaatcagataaagatatattcataggttattataatcagatcgaaaacagaggatttaaaaacctgttgtttgttatgttcttgaatggcaaatcgagcgagactctcgatctctccactgttctgatttcctcggagatcatgaacgcctcctagcatcatcgtcttctctgtgcttttctcttctgatctgcaaatcgctaattgaattgttccacagagaagaagagtaacgatccagaacgtctttgattccatctttaatagacaaacttatgcttcttcaaatttcagattcgtaggttttggccatgtcggtatcttttacgttacttggcgattaaggtatgaaagtgacaagtcaaggaacaaatgacacgtgtcttcacctgagaggctgtgcgtttcgttctctctgaaaggtcaaagagataagaaaaacaaaaagcggcacgctgtgtgtggtttatattaatttgagagcgttccaaacacatgaaaacggtatgcattctacgaggttactgttgaaactgcgaaattggggaattcgtcgtcgtcatcacgctcgatcggttctctgttcgtcgtttgtttttccggtggagaaaaatggtgatggaaattgtgaaaccaaacacatgcattagaggatgttgcaccagtgaatcgatccctcttcatctcccttcttcttccttcactcttctctccccaatcgctaaaggtactgtttcttctcttccccagttccccctctccctctcactcccgcaatcttcattcgtttgaattcgatttgtctggagaaattttcaggatcagagagtgttgtttatgaagcgattctcgatggccgaagagtagcagcgaagaagcctatcttgtctacttccgatgaccttgacaagttccacaggaatttgcagctctcatggtctctctttcattttccatttccattttaaatttcgtaccattttcaaaatgttgtttttttcttactttgctgtggattggtgaagcaatctcaatcatcctggtgtggctaagttactagcagcacatgcgaagcctccaaattacatgtttttctttgacttctacgagtctgggactttagctgagaagttacacgtcgaggagtggtctccgagtattgatcaagtgttactgatcacgcttcacttgggtatgtgactctacttgtctcaaaggaaccttcttttttgccattcgtgtgtgactctgacgatttcttcttcttgtcataaacttttcaatggttactaatttgaatatctgattctatctgtttcgtttttttcagcaaaggcattgcaatatcttcacaacaacgggattgttcatagggatgtgaaaccagcaaatgttcttgtaattctcttcttccattctctagattctctatcttgttatgtgcttatttcatataggataggtacttcttctgtttctttatgaaatttgtgtgtgatgcttaagtgagcttttgttgttgcagcttgacgagaagtttttcccatatctggctgactttggtttagctgaatacaagaagaatttgcgcgaagttaatctgcagaattggagatcgtctgggaagccaactggtggattccacaaaaagaatatggtcggaacacttatttacatggcccctgaaatactgaggaaagacatgtatactgagaaagcagatatttatagctttgggattttgatcaagtaagaattatctttgagtagaaattgtaaagttttttcttcgtattttcttacattcaacttttctttagatcttatatttcgtttggagtatatttagctttcttcctaaaagatccctgtggttatgaattttttttccatcttacattgcagtgagcttttaactggagttgttccatatactgatcgtcgtgcagaagctcaggttaaaattttctttcctcatttcgcattttgacattattatctctgggagaagcctttatatacgatatactgtattttcatatattcaggctcctgaattgcattcatttgccgttcaatgatattgctatatcttggcaagcccaattcttacgatttctgtgataaatatatatgattttatggacatatagcagtttatatgaatgcattcttgttcttttcattcatgacacatagtgtttccctttgcatatcttgatggcaggctcacactgttttagagatg

SEQ ID NO: 11379 - DNA, 3000 bp, Unknown
  misc_feature (1)..( 3000): cDNA_ID_3434303_gDNA_ID_2214493_Annot_ID_133507 3000 nt of promoter + ATG
aagggtgaccggcgcggcataaaattgccctggagtcaccaacattcgcaacgaaaagcttattctctactaggagagaggctatagcagtacaaccaggatgccagtctttctgactcaccctttttgactgacgatgggaatccagttcttgtctgaaagctaaatctgtcctaacaaatgcttgtgacaatgcctcgccagcgctgaaaatgaaacatgccaatgggtttttcgaacaaaccatgctgagaatatgaaaagattgaactgagcattaaccttgtggaacataagctttgaactagtcctggcaaaacttgagcagaaaattcagcagctgcagcgcctgcatgtcattcaagatgctattttatatcctatttgatggatagctaaagaatttggagtaaaaagagagagggcacaagtaagaatttggagtttaatgcgtcctggataaaattggcagttggtatacctctatgaccatcgaagatggcaaataagtggatgctttcctcattacacatgtgcggtatgatgaagtgtgtatcttccatggattctcttcttccacatgttgcaaaagacccacaagaaattactgggacatatcttgaaggttcatctgttgaactagaccataatttcacatcaaagacagtggaaacagacgatttcttggataaacactccccttgactaaaccaattaacggtgtccctgtaatctcctgaatttttaatgatgtccgccccatccgtatcactctgggaattagaagttttctcaaggagatgaccttgctgttttcctctcacttgttcccaaattgattctagttccaaaaccacattgtccgaagaaggtcgtttagacggatcagattcccagcagttttgtatcagagatagcaaactctttggaaggtgcaatccaatttcagcaagagctggtcgcagaccagaagacacaatggcaactgtaagttgctgttctgtgtaattcatctctaaaacagtgtgagcctgccatcaagatatgcaaagggaaacactatgtgtcatgaatgaaaagaacaagaatgcattcatataaactgctatatgtccataaaatcatatatatttatcacagaaatcgtaagaattgggcttgccaagatatagcaatatcattgaacggcaaatgaatgcaattcaggagcctgaatatatgaaaatacagtatatcgtatataaaggcttctcccagagataataatgtcaaaatgcgaaatgaggaaagaaaattttaacctgagcttctgcacgacgatcagtatatggaacaactccagttaaaagctcactgcaatgtaagatggaaaaaaaattcataaccacagggatcttttaggaagaaagctaaatatactccaaacgaaatataagatctaaagaaaagttgaatgtaagaaaatacgaagaaaaaactttacaatttctactcaaagataattcttacttgatcaaaatcccaaagctataaatatctgctttctcagtatacatgtctttcctcagtatttcaggggccatgtaaataagtgttccgaccatattctttttgtggaatccaccagttggcttcccagacgatctccaattctgcagattaacttcgcgcaaattcttcttgtattcagctaaaccaaagtcagccagatatgggaaaaacttctcgtcaagctgcaacaacaaaagctcacttaagcatcacacacaaatttcataaagaaacagaagaagtacctatcctatatgaaataagcacataacaagatagagaatctagagaatggaagaagagaattacaagaacatttgctggtttcacatccctatgaacaatcccgttgttgtgaagatattgcaatgcctttgctgaaaaaaacgaaacagatagaatcagatattcaaattagtaaccattgaaaagtttatgacaagaagaagaaatcgtcagagtcacacacgaatggcaaaaaagaaggttcctttgagacaagtagagtcacatacccaagtgaagcgtgatcagtaacacttgatcaatactcggagaccactcctcgacgtgtaacttctcagctaaagtcccagactcgtagaagtcaaagaaaaacatgtaatttggaggcttcgcatgtgctgctagtaacttagccacaccaggatgattgagattgcttcaccaatccacagcaaagtaagaaaaaaacaacattttgaaaatggtacgaaatttaaaatggaaatggaaaatgaaagagagaccatgagagctgcaaattcctgtggaacttgtcaaggtcatcggaagtagacaagataggcttcttcgctgctactcttcggccatcgagaatcgcttcataaacaacactctctgatcctgaaaatttctccagacaaatcgaattcaaacgaatgaagattgcgggagtgagagggagagggggaactggggaagagaagaaacagtacctttagcgattggggagagaagagtgaaggaagaagaagggagatgaagagggatcgattcactggtgcaacatcctctaatgcatgtgtttggtttcacaatttccatcaccatttttctccaccggaaaaacaaacgacgaacagagaaccgatcgagcgtgatgacgacgacgaattccccaatttcgcagtttcaacagtaacctcgtagaatgcataccgttttcatgtgtttggaacgctctcaaattaatataaaccacacacagcgtgccgctttttgtttttcttatctctttgacctttcagagagaacgaaacgcacagcctctcaggtgaagacacgtgtcatttgttccttgacttgtcactttcataccttaatcgccaagtaacgtaaaagataccgacatggccaaaacctacgaatctgaaatttgaagaagcataagtttgtctattaaag

SEQ ID NO: 11380 - DNA, 3000 bp, Unknown
  misc_feature (1)..( 3000): cDNA_ID_2706385_gDNA_ID_2214493_Annot_ID_133508 3000 nt of promoter + ATG
cgaaaatcgacgaagctgatgaggaggatgttgaaaccggaaaggctacgtcggagaaggagtcgtcagttccggaagtggtggtggtagttttttgtagtgaaaatgtgcatagcgtttcacgacctaactagatgggttttcaattttttttttactttttgttagaagcaaaattggggagaagagtaacttctttttttgatacttgtaagtttgaattccttttcccgtgcttcaaaagttttatattttatttatagttttgatttcttattgtaactaagggattcgattttgatcgttgactagctatacaatcccgtgtaatcactacatttggtattggtacgcatctgttacataccatttttacggcggttttagtgaactatattataaaaaaaaatcgtaagtttttttgtgtgtgtgttaacaatgtactcactactcactgttccatatttttgatgtacgtatatcgaaaacattctgccaacaaatgcaaacataacaaaagtcaaaaacaataacataaccgggaattaaaccaaaatgtaattgctttttattagtgtcaggccttctgcttaaaaatattctcggcccagagcccattaacacctatctcaattcatattgaagaaaatgactatattacttgacaaaaactttagtcagaaaaatatggaatctctttcggtactgctaagtgctaaccttaaatagtatagaattcttagttcattctcaaaaacatagctatatgtagattataaaagttcgatattatttcctgcaaaagatgttataatgttacaacttacaagaaaatgatgtatatgtagattttataaactggtaccgtaattcataaaagatggtggtgggtatgtatcagtaacggaacttacatatgcgtgtgtattactatgtctatatggtgtattcctttgtgtggaacaatgcacgtcagagttgtttattttcttatagaatttaaggaatcaattattggatttctcaaggtgaaagtggacttctttgcacgcaaggtctagttgccgacttgccgttgcatgtaacatgattgttgaaataaagtgaattgagagaagtttggccagacattttaaatttaacccaaaaaaagtagggcctaacacaaaatataacctctctttgttcaaaggaaataacacctacgtcttataattgaaccaaacattgaatcattgaactcacctataataattataataacacgaattcacaagacacctaaaagaaaaagttcacaaaaacaaataaaaatttacctctcaccaaacacactcacctacccgtctggtcccactgaccccaacatacaacaccgactctctcccacaccaatttttttttttggcgttttaaaacaaataaactatctatttttttttcttaccaactgattaattcgtgaataatctattatcttcttcttttttttgtgacggatgattagtgcgtggggaaatcaaaatttacaaaatttgggatgattccgatttttgccattcgattaattttggttaaaagatatactattcattcaccaagttttcagatgagtctaaaagataatatcatttcactagtcacttaaaaaaagggttaaaagaacatcaataatatcactggtttccttaggtgacccaaaaaaagaagaaaaagtcactagtttctttttggaaattttactgggcatatagacgaagttgtaatgagtgagtttaaatttatctatggcacgcagctacgtctggtcggactataccaagttaccaactctctctacttcatgtgattgccaataaaaggtgacgtctctctctctctcaccaaccccaaaccactttccccactcgctctcaaaacgcttgccacccaaatctatggcttacggggacatgtattaacatatatcactgagtgaaaagaagggtttattaccgttggaccagtgatcaaacgtgttttataaaaatttggaattgaaaacatgatttgacatttttaatgatggcagcagacgaaaccaacaacactaagtttaacgttcgtggagtatacttttctattttcgaagaagacatataactaagctgattgttattcttcatagatttcttttcactgcgaataaaagtttgtgaacatgtcaccgtttgaacactcaacaatcataagcgttttacctttgtggggtggagaagatgacaatgagaaagtcgtcgtacatataatttaagaaaatactattctgactctggaacgtgtaaataattatctaaacagattgcgaatgttctctactttttttttgtttacattaaaaatgcaaattttataacattttacatcgcgtaaatattcctgttttatctataattaatgaaagctactgaaaaaaaacatccaggtcaggtacatgtatttcacctcaacttagtaaataaccagtaaaatccaaagtaattaccttttctctggaaattttcctcagtagtttataccagtcaaattaaaacctcaaatctgaatgttgaaaatttgatatccaagaaattttctcattggaataaaagttcaatctgaaaatagatatttctctacctctgtttttttttttctccaccaactttcccctacttatcactatcaataatcgacattatccatcttttttattgtcttgaactttgcaatttaattgcatactagtttcttgttttacataaaagaagtttggtggtagcaaatatatatgtctgaaattgattatttaaaaacaaaaaaagataaatcggttcaccaaccccctccctaatataaatcaaagtctccaccacatatatctagaagaattctacaagtgaattcgatttacacttttttttgtccttttttattaataaatcactgacccgaaaataaaaatagaagcaaaacttcatg

SEQ ID NO: 11381 - DNA, 3000 bp, Unknown
  misc_feature (1)..( 3000): cDNA_ID_2706381_gDNA_ID_2214493_Annot_ID_133509 3000 nt of promoter + ATG
cgcccatcatccgggtttgattcctggccattaagaaattaacatgcgtacttgctctagtgtctcagaccattagttccagcggatttttatgtggaggtttaaaaatccctaatcgcgggtttaggcccagtaagataataagattactgtgtggtctggatatttagttataaaaaaaaaaaaaaaaaaaaaaatgtggagacagacgtccgacaccgtgcatggttcagctcgtcacattgattctatagtttggtaaaaatatatgaatcatattgaaaactcaaagttatttaattagagttacgaatgatttttacgtgacaaatcaaaagtcagatacatatgccagattttgtcagaaggattttgtgtaagcatataattcccaatcgcagagacgtaaaatattcgattcgttaactaaatcgtaaggagttgacacttgtctccgacagcggccagagtcgatttacgtggaatccacacatccgcacttgcatgacacaaactgcaccttttcatctgtttttttttttttttaatttgaaagttttacacccaatggtgctaattttagtagccacatacataactataatattaaaatgtgcaagagatcattacataattggaacgaaattttgatcatgaaacatatggtttacactaatacacgaatagaaatcctattatgatgagttcatgcatgatacagtggttggtatacttcactataaatttatatgatcttgaactcgaatataacatagaatgatcatatatatatatatatatatatatatatatgaagacattccaatattgttactattgttaaataatcaacatcatatcatttgtacaacactagtcagttggttcaatcataatacttctaaagtacttatgtttttatacatgcagacgagtgagcgtgagacatttcctctatttggataagtatattgaattattaattattaacataatggatagtttaaatttcaaaaaaataacaaaaaaaataatgatggatagactagaacctccaattaaaacaatgcaaatcaagatgttgaaccgatcgaaccatcaaactttttcggattgcataataaaataattcgtctttgttctcattctcaccgtgcatatacatatcaacaaagtcatgcgacctaatataatacagttgaatctatctaatttttttaaaaaaaattaagatacgaattccacacaaaccttctccaactaagtaaagtagccactattgtcacttaaagtgacattaatgcatattctataaaagataatggatgcccaactaaacataagtgaagtatttgggatatataataaaacaaaagaatccaatgagttatgctatgtggttagcttttgttcacgaatttatatattgtataatatatgaggtttacatttcggataagcaattctaggcagatcgatgatatgtacgcaaacatgtatagatgtattcaagaattgagtatataattgcttatccgaaatgtaaacaacaggtatgaacatatataattaagtgcccaaaacagaacatatattcaagattttcttgtactaataatattcttttttttggtaaggtgttctaataatattctgattagattaacttttaaccatatataactcataattattttgttacgtaactctaaaaatatctggggttttatttctttgtgaagagatcgataacagacaagacatgtaacacatattttgtccaccttaaatttctaaacatgaaatgtagttttgagatattggccggtcccaatgtacgtaggattgaacccaattgattattgctgccacgtggaactcaatctgtccacttatgcttcttcattgatttaacctcttattaaagatcgatgatttatgaccatgaatgtagtaattaggatagaggtggacatacgtcagattccacacgtatataaccccatattagcattacaatgagttaatctttttgcagaggtcggtcgatttgtcaaatttctactatacattaaccaaaagatattctactatatattaaataaagcaattagcttatgatggtgatgagtcatgagaccacatatatcgaaaaccacggtagactaacaatcgcaacaatttttctgtggctttcaagtttcttttaatcttttaacaatacgctaatccgatccggctaattttagttcagtttggattttgtgattttatagacaagtccacagtttaaaaaaaaaaaaaaccatgtttaaagccaattgcatgaataaaataatttacatgcatgttagaattacgttttagtgtccatatgtacttattagtttttttgttttttttgcaactacaacatatactaatgttgttgttttttgtgcaactaaaacatatactactataaacatgtaaattttgattgttaagaaatgaggtgatgttaattaatcacttgttccacactgatcacacttttaacctcgacttttagtagccacaagttttatttaaaatcctaatatgattggtttcacgaagtcatataaacagaatatatatatgtagaatgttttatccacttactttagagataatgaattcatgacacccaattcttatgccgaatcaaaccggaataattaacgctaacgtcaccgaaaaaaaataaaataaaaataacaaaaatacaaaggaagaaatcagagaacactgaacatatccgaataatatgctatatatacaaagaacctctcaccacttggttctcaggaaaaagcacattctccaagtgtttctctcctctcttttcctaactcagttttcttatatacataacactaatttgacaatttttttgtcctcgaggatcctaaaataactccaaaactttgattggtttttcttgctctaaaacaaaaacaaaaacaaaatattaagatg

SEQ ID NO: 11382 - DNA, 3000 bp, Unknown
  misc_feature (1)..( 3000): cDNA_ID_2706369_gDNA_ID_2214493_Annot_ID_183740 3000 nt of promoter + ATG
agaaacgttgcggtcgaccagaaggttaaagtggaagaagctgctacgacgacgacgtctattaccaagaggaagaaagagatcgatgaggatttgactgacgagtctaggaacagtaagtacaggagatcgggagaggatgctgacgctagtgctgttaccggtgaagaagatgagaaaaagagagctagactcatgagaaaccgtgaaagtgctcagctttctaggcagaggaagaagcattacgtcgaggagcttgaagaaaaggttaggaatatgcattctacgattacggatttgaacggtaagatatcgtatttcatggctgagaatgctactctaaggcagcaattgggtggcaatggaatgtgcccgccgcatcttccaccacctccgatgggaatgtatccacctatggctccaatgccttatccatggatgccttgtcctccttatatggtgaagcaacaaggatctcaagtgcctttgattcctattcctaggttgaaaccacagaacacccttggaacatccaaggctaagaagtccgagagtaagaagagtgaagctaagaccaagaaggtggctagtattagttttctgggtcttctgttttgtctatttttgtttggtgcattagctccaattgtgaacgttaattatggaggaattagtggtgctttttatgggaactatagatctaattatattactgaccagatttacagtcagcatagggatagagttttggatacatctcgtagtggtgctggtactggggtttctaatagtaatgggatgcatcgtgggagagattctgatcgaggagctaggaaaaatatatctgcaacagagagttctgtcactcctggaaatggtagtgagcctctagttgcatcactctttgttccgaggaatgacaagcttgtgaagatagatgggaatttgattatcaattctatattggcgagtgagaaagccgtggcttcgagaaaggcttctgaatcaaaggagaggaaagctgacttgatgatctctaaagattatacccctgcactgcctctacctgacgtgggaaggacagaggaattggctaagcatctctatagatctaaggctgaaaaacagaaagctctatcctctggctctgctgatactctgaaagaccaagtcaaaacaaaagcagccaacggtgaaatgcagcaatggttccgtgaaggtgttgcaggtaatcatgggtttttgatcttactttctgttcccttgacttggttatgtaggcaggcattgtaggtatactagtccttatcatatcttgatattagacacaagaacattttaatgaggcttaacttaccttcagcaaatctctggtcatgagtagatgtattgtataatctggattagatactaaacactaataaggaacatgtgaaattgttactcatattgtatatttttcttcatctttctcggcagaagctgtaagcgcagtagtagcgtttatatctttcttgttcactaaataataacaccttttttgtttgttaaatgactatattgtaggtcccatgtttagttcagggatgtgcactgaagtgtttcagtttgatgtatcctcaacctctggagccatcattcctgcagctaccaacgtctctgctgaacacggtaagaacaccacagacacacacaagcaacagaacagaagaatccttcgtggtcttcccattccactcccaggatcagattttaacctcacgaaagagcaccaaagaaacagcagtagcaaagaaatcaagcctgcttcatcaatggttgtatctgtgcttgttgatcccagagaaggaggtgatggagatatagatgggatgattgggggaccaaaatcactgtctcgagtttttgtagtcgtgcttctggacagtgcaaagtatgtaacatactcctgtgtcctacctcgatcaggagctcctcatcttgtgaccacttgaagacatatgaggattgaaacatatatcagcaggtcttctctcatataggctttgtatgtaaaagaataaatacctgctctctggtatcacgtaatatccttagctaataccgttgtccggtttttgtttccagatgtagaatccgaatgctgtaactttttttttttaccttttataaactcatagccttagaaagttttatcaaacctctcatatacattgcaaaagtcgatgaccaaaaaatgtcattctacaatagaagctgaaatccaagtagacaaaagtgatcagttagttgattccatggtttgagccaagggggcatcggtgatagcaggagaatatgagcacacaagtgacagaagaagaagtctttacctgaaggtcgacggagagagaattggattagcatgaaccctcagattcatgaacctgagctcacttttaaaatttctttatttcattgtcagaaaaagagagctaataatattattatttaaatgtaacaagtaggcctataacacgtgaacttccctctttgcaaaaaaaaaatcatcaaaaacttttacctctcattggtttcttctttatcacactgttacgcttggattctcatttcttcaagttcataacgctcggatcaatcaggaagacgaacttgaactttctttttttcatcattacccaaagctatgaggctcacaccaccaatagctccgccgtcatgaatccttctcttccaggtactgtgccgtctcgggataacaaactttctatttattctcttctgatcggatctatctatcgatgaagattgatttcactactttagtaacatttcatctgatcgatctgtgttgtgttatcgaggaatcaatctcattttgtagattcaattttctggatagattttgtatctcttttccatagctctagtccaaatctagtctccactgatatctgagttttgttgaccaggtcaacacaagtcagagctccaaaaatg

SEQ ID NO: 11383 - DNA, 3000 bp, Unknown
  misc_feature (1)..( 3000): cDNA_ID_1383322_gDNA_ID_2214493_Annot_ID_183739 3000 nt of promoter + ATG
tatcaaaagattgtgaaacttctacactaccagttctgaatgcattcctgcttgaagagaaccctcctgcggcagccaagctcgatttagaaggctcaatgagaatagaagtagagtctccatccaccaatccgttctcttgagcagattgaatgtgagcacttgataatgtaccattgatgtcaagcacctccaccaaaatctgtttttaaacgacagacacaaaatcagtgggaaagttaacgagtcagtaagaacaccagaaaagataaaagtcagagagctataaaaccttaagcttaggctaactaaacaatcggactgaagcataaaaaatttatattcaaatagctaataactttgaaagcaaaaagaagaagaagaagaagtgaactcacatcctgatccatttgtaggttagcatcgtccagtgtcttatctaagtcattcatcaaagaatacttttggtggccgtagtaatcccaaatgcgtacctacatgatagaaaatgctcatgtaagaaagagaaagggaaagaaaagaataccaaaagtattattgaaacgggctgtttaataacataggaatatcagatctttacatgctctgagtcgaggtcaaaaatttcacaggctcttcgatggagctctctgatagtttcctgcacaacaaagtttgatagttcaatgaagtagcagactaaacgagttcagattttcaagtaatgaacaaagaaaaaaaaagaacagaaaagaggataacctttttgctaattcttatggcactatggtcactttttggcatcagaagtagctgaagacgtaaagggtaaacctctacagccaattctgtttgagagagacctgagctaatgactctccgtgccagagttggaccacccccgtaccttataaaacagaagcaatagtccataagaaccatataatcagtttaagtgaaaaaagccaaactatagtgtagtaaataagaaaaccaagagattgcgttattagtttcatattatgcattacaaatcaacataggagagaaagcaactaaataacatcaggtgcatacaagatgaacttggtagagctacacatctgacttaaccttagcattatccatttgaggaatgttagataaacatgacccaacataccaaagataaccaaggaaaatcaaaagcactagaatagggataaaaataagtctagcccacataagatgaagagacgtaaaatttaatatcagttcaattcttctacacttaaaactcaccatgaacgcaattggttccacacttcttgagggagcaaaacataatcacgaccttcctgaagtgtttcaataatctcactggtattactcgggtcctccagcgaagaatcatagatcaaatcagagttatcaatcctagaaggcttctttagagtgcttgaaccaggagagtcgcaatgctctgacagtgaagacccatcatttgtgttacatggttggtcttgattcacatactcaatccattcttgccaccatctggacagaaaagagagagaatgttctcagcagaagtaccataagagaaaattcaaactttatcacaatggttgtaatctaatacaatacccataaacatgagtcaataaaagacagttctttggaaaaggttatgaaatgctcaaactaatctcatcaactactacagataacccaatccctaatcgtaactctaaccctaaccaagtccgaaaccaaggcaaccaaacaagacgaacagatagatataactcttgggaatttgataaattcaagctacaagtgaccatagggagcaaaaatcaaagctttataaacctctgagtgatgagataaaatgtatcgccttctttactattagcctcagcagcaatagcaatgtctctgatgaaaactcgctcttcctcgggagacagatccgtgctgctactgctgcttcccatcgatacctccgccatatctcgaaaattaggagaaattcgtttcagctaaagtcagctttcgcgaattctagctatgaagagaagaatctaaagctgagacaacgccgaacaaccgtgcttcgccgtacgactccggcgagagtaaagcaaggcggtggatatgataaaccctaacggcttttttgggggagacaaagtagagtgagccgctcgctaacaaaaagtcggaacctcttttttttctctctgaaacagatccttgctggcttcgctccttagatagtcatttcgaaataggtccccaaaaaaatccaccaccatttataaatttaagaaaaaaaacaatttttgttgaccaacattttttttttttgctcttgcactaattgaaaaggttgatttaaaaagatatcttaaaattgttagatttttttttttttgtaacttttattttctcaaattgttagatatgaaactttaaacaatggttggaaagaaacattttactaataatgaaaaatttattaatgcgtaaattgatgttttgagattaatatataaataacatgttgataagaggcctggtcaatttactcaacgtggaaactccatctctcttcttctggaaccaataaataaaataaaagtaagctctttctcgtgaatctctgagttaatgcgctaaactaatctctccgttgagctcaggtaaagagttgtttctattcacatgtatctgattatttcttcttgggtttaaagtttactcttttatctcgttttcgctgattcgtcttgttctctcttccgatcctttttttgtctctgcttcttgctctgttcgttcatttacttatcttctccatctcactacctttttgatttagctgctgttgtagtaattgtatatatgttcattttgatgcaattcaaggtacagatgtgtttcttggtgtcaattttcaggctctgtggtaaataaagtcctgttcttgatattggtggtttcatcagaattagg

SEQ ID NO: 11384 - DNA, 3000 bp, Unknown; identical to SEQ ID NO: 11381
  misc_feature (1)..( 3000): cDNA_ID_2706381_gDNA_ID_2214493_Annot_ID_183735 3000 nt of promoter + ATG

SEQ ID NO: 11385 - DNA, 3000 bp, Unknown; identical to SEQ ID NO: 11380
  misc_feature (1)..( 3000): cDNA_ID_2706385_gDNA_ID_2214493_Annot_ID_183734 3000 nt of

SEQ ID NO: 11386 - DNA, 3000 bp, Unknown; identical to SEQ ID NO: 11379
  misc_feature (1)..( 3000): cDNA_ID_3434303_gDNA_ID_2214493_Annot_ID_183733 3000 nt of promoter + ATG

SEQ ID NO: 11387 - DNA, 3000 bp, Unknown
  misc_feature (1)..( 3000): cDNA_ID_3039766_gDNA_ID_2214493_Annot_ID_183732 3000 nt of promoter + ATG
gtgaagatgaagtcaccgccatggttgaatccgtcttcagagactgtaaccttcctggtacgtcttcgttgtttaggtcaaactttttcgatgaaagagaggaacattatctgccattaaagaagttttaagtttatccatataaaatacgactttgtagtaaaatgctctgattaaggaaagttcgatttatacaaaatcggaaagatttttcttttttactcaaaatcgtaatttatgttctttggaaagaacgaaatttatgccagatttgtctttttatacaaaattacgcaagccacacgttgcctttactaattatcgtcagaaatgatgaaatctatgcttaatgtcgtcaaattagttttatttaagtacatgaataattttcgacttttatttaaatctttctatggtaacaataaatgtttttggttgagtaggtattaagtaaatgacttttttaaaataataattagttgttatttaatagtactactatagtagcatataagtgatattttttattaagaaaatttatttcgaaatagtataatttgatagtgttatattttcaaaaattataaggtccataattatttacctagttcaataaaagtttatgttcattagtacaaaaaccctaattgtttttcttaacactgaatttggttatttatcttttcagaaaacagagcaaaaggtttacaactgaggaagtacttaggagcggttgcgttcaacaacataacgcggctagcctttgggaagcgttttatgaacgctgaaggtgttgtggacgagcaagggcttgagttcaaggccatagtatccaacggtctgaagctaggtgcttcactgtcaatagctgaacacatcccgtggctcaggtggatgtttccggctgatgagaaggcgtttgctgagcacggggctcgtcgtgaccgcctcactcgagctatcatggaggagcatactttggcccgtcaaaagtctagtggagcgaaacagcatttcgttgatgcgttgctaacgttgaaggatcagtatgatcttagtgaggatactatcattggtcttctatgggtgagttttagtgcttttatgaaatcagttgacctaatttgtgtagatttcttgtttctcacgtttggtaaatggtgtgtgcaggatatgatcacggcagggatggacacgacagcgataacagcggaatgggcgatggcggaaatgatcaagaatccaagagtgcaacaaaaagtgcaagaagagttcgacagagtggttggacttgaccggatcttaaccgaggcagatttctcccgcttaccttacttgcaatgcgtggtgaaagagtcattcaggctgcatcctccaacgcctctaatgctacctcaccgaagcaacgcagatgtcaagatcggaggctatgatattcccaaaggatcaaacgttcatgtgaatgtgtgggctgtggctagagacccggctgtatggaaaaatccatttgagtttagaccagagagattcttggaagaagatgttgacatgaagggtcatgattttaggctgcttccgtttggagctggaagacgggtttgtcccggtgcacaacttggtatcaatttggtaacttcgatgatgagtcatttgcttcaccattttgtttggacacctcctcaagggactaaaccggaggagattgacatgtctgaaaaccctggactcgttacttacatgcgtacccctgtgcaagcggttgcaacgcctcggttgccttcggatctgtacaaacgcgtgccttacgatatgtaaatgtcactctgatctaccttttgttgctgctgctcatgctcttgttgttgtttgtagacatgtttcttgtggtttatcatcgaaaaacttttgatgagatttgttgtatcaattctctcaaggagaagtaaagaagccatcttctttgtcattgggtttacgatctttcaatcagtgcaatgttgtaacttgaaacataagaataaacaggaaacaaacatacaaagatatttgcaggacataagaacaagtttcttgattacattaactttttaggtttcgcatatagcaaagtattttacacacatataattaattactctcagagcatttgtaatcattaacttgaacaagtgaaattcaagaagatgattccttgaactcctgcaactgtttgaagttcatccatggcttcacccacactttggcttcaaaattcttagtctgatcaccttcttttgcttctagggttaagtggtacatcgttcctgcaactacctgctcccttgctttgacaatcttcttgaactcaagaattttgttctgtacttacccggaaaaaacaaaaactaatcagataaagatatattcataggttattataatcagatcgaaaacagaggatttaaaaacctgttgtttgttatgttcttgaatggcaaatcgagcgagactctcgatctctccactgttctgatttcctcggagatcatgaacgcctcctagcatcatcgtcttctctgtgcttttctcttctgatctgcaaatcgctaattgaattgttccacagagaagaagagtaacgatccagaacgtctttgattccatctttaatagacaaacttatgcttcttcaaatttcagattcgtaggttttggccatgtcggtatcttttacgttacttggcgattaaggtatgaaagtgacaagtcaaggaacaaatgacacgtgtcttcacctgagaggctgtgcgtttcgttctctctgaaaggtcaaagagataagaaaaacaaaaagcggcacgctgtgtgtggtttatattaatttgagagcgttccaaacacatgaaaacggtatgcattctacgaggttactgttgaaactgcgaaattggggaattcgtcgtcgtcatcacgctcgatcggttctctgttcgtcgtttgtttttccggtggagaaaaatg

SEQ ID NO: 11388 - DNA, 3000 bp, Unknown
  misc_feature (1)..( 3000): cDNA_ID_3039770_gDNA_ID_2214493_Annot_ID_183730 3000 nt of promoter + ATG
aatctcttcaaaacccatcacatgctttctaccactaaaacaggcccatcacatgctttctacctctaaaacaggcccatcggatatgttcctatattttttgtccgataaagttataagaagcgcaaggcccataatatttttagttattaaaaaaattagcagacgtagggttgacttaaaaaagactcttattacattagtcgacaagtaaaaaacacgtggcatatattgtgcgttcgtagagactgtaataaagacggagagattcttctagagtcagttcttcttcttcatcctcttcttccccccaaatcctctctcgctagggtttctcattccgatccataattctagatgtcgaggtattcttttgattgagctccgcttttaaccaaaccatcttagattttgttttcatgattggatcactgaattgaaattcttctcttctgtctttagatttcttctcaggtaattttgctctgctttgtgaagcgttttcattgatcggattttagcttctcgtatttaaattgatacttgtgtgcatctgaaattcgtttggattaagccattccgaattttgagttacttgtgagttgtgagttgttacattaccctctcatttattttcccactccataaattggtttcagttagaaattgtagtagctacaaggtgattgattgcatcattatttgaaccttcgttggtttgtgttggcttatataagcaagttccgtcaaaagattaaaactttgggttcagtctctgtgtgtttattagcagctagactttgtattgcctgaaaattcatgattgagggatatgctttatgtactattataagttctgagtttgtagaaacaatattttgtgttttggggaaaacaccacaataactttctattaatgtattagaaaaagaaagttggaacctatgttttagaaaattttttctctatatattgaagtatgacctataattgaatcttctgatgtgcactaaactgaggcaagcgggatttcctggagtctttggtttgcttacttggaaaaaactgtagataactgattactaacttatacccacttttgcaggtttttaactgagacctgtcaaataagctaaagcttcttctaagagcttcaaggaaagcattgcattgttgtggtcttgtttgtgtccacagaaggaaagaagagtgagaagctcaggatgtcaagcagtcgaaatacccactggtgtcacagatgtcagcgtgctgtccgccttcacggccaagagcctgtatgcttttattgcggaggtggatttgttgaagaacttgatatggctcaagccagcccctttgatatgtttagatcccacaggggtgttgtagaacgtgatcagacttttgatctcatggatgctttctctgtgtttatgaggaaccgcttagctgaaaggagccacgacagagaaatcagaggaagaaccatcagttcaggtcctgaaaactttcctggtctggcccctttgttgatctttggtggtcaagtcccttatagactaactggcgacaatgcagtcgaagccctcttcaatggcggctcccctggcattggcatcacacgtggtaacaccggcgactacttcttcggtcccggccttgaagaattgttcgagcagctttcagctggcactactcgccgaggcccaccacccgcaccgagatcagcaatagacgcattgccaactatcaagatcgcgcagaggcatcttaggtcatcggactcgaattgtcccgtgtgcaaagacgaattcgaactgggatcagaagcgaaacagatgccgtgtaaccacatctatcattctgactgcattgtcccgtggctggttcagcacaactcttgcccggtctgtcgccaagagctaccatcagctagcggaccttcaagcagtcaaaacagaaccacccctaccagaaactacagaagcagtagtagtagtagtagtagtaacagtcgtgagaacgggaatgaaagaaggaatcctttctcttccttctggccattccgttcgtcaggttcaagctcaagctccactcaaaaccgtggaggcacaagaaactcggatacaagcgatgagaaccataactaccatcaacagcaacatcaacaatcatatatgggttacagtggctggccttttgattactaaaagtctaaaagtgagctaaaacaaatctttggtctcactttggtctctttacttaaatatgcttgtgattctgcatatgccttgtgcttcactctctatctctctcactctcttttatcaacataaataatggagaactgtatttgttactgtagattttctttctctgttaaaaacgagttcatcattttctatatgctttgttaaatatgtcattttagttgggtttttgaaaatggttgaaatagatttttgagttgatcgataaataaataaatgaaaacgtctggacactcttgagcgatctatcagtatctcgtgatcttcttcaatactaataaaaaaagggaaaagaaagagaagagagtcgtgctcataaattaacggtgcagagcgattgaacaaaaacaaaaatatcttccagaaaaagccatttttgattgcgtataatgaatacacgaaattaaaatcattacttgccatatatagtacactatttctcagcttcactcactctcgagactcgtgtatgttgatttacggtttgttcaagcaaaggtgatcatcaattcccaattttttttacgtcactattttcgattcactccaatggcttgcgtgttgctgatttcttgattttgtggttcttgagttagtctccatctgataagtaagtaaattatgtgattgtgatctgggttttgctaaagttttgatttttattattgttgtttagagaatgatgaatctaggatctctttcgttgagtacgagcaagtcgagtaagcca

SEQ ID NO: 11389 - DNA, 3000 bp, Unknown; identical to SEQ ID NO: 11376
  misc_feature (1)..( 3000): cDNA_ID_3039778_gDNA_ID_2214493_Annot_ID_183728 3000 nt of promoter + ATG

SEQ ID NO: 11390 - DNA, 3000 bp, Unknown
  misc_feature (1)..( 3000): cDNA_ID_2706397_gDNA_ID_2214493_Annot_ID_183727 3000 nt of promoter + ATG
acattgtgttttttgtttgctggaatatttaaggcaaagttaaacgatgtgacttctttggaaggacatgttatgctaaagaaacttagggatgctttagaaaccatgagaggtcgtatggatggaagaaacagagaagcagtggaaaaagctatctccatggttagcttttcttactgcagaatcactttctttacggttttacgcctttacaatgacttgtatgattgtatcaactgtgaagggtgtgaataaaactatgcagtgttttgtgtcttgcaggttgaggcactagccgttaagttaactcaaaatgaaggtgaactaattcatgataagtttgaagtgaagaaactggcaagcttcctcaagaaggtcttataagtttccttttcatgtttaatacattataattttgttagacatttgtagacagtcaagctaaggctgattcattgtgtttcctcaggcttcagacgacgcgaagaagttagtaaaccaagaaaagtcgtttgcttgtgctgaaatagagagtgcacgggctcttgtgatgaaacttggaggtgcatttgaagaacaggagctttgttctaaagcttctagagatcagggaccggtatgtatcattttgagttcagttttccttttcatatgttatgctctgacttatgacataggagtaggattctgaatcaaacttatgttccattttcacagaatgtggagaaattggttgaggaggttcaggaggctagacgaattagacggttgcataaaccaaccatggtccaactccatttctgtgctctacataaattttccattataagactttctatctctttcattagtcatctttttgacaatggaatccaaaatgttcaaacaaaacttctgattttgatggtttataatctaggtgatcggtatgcaacatgagcttcgtgatttaaagagtcaaatccaagagaagtctgcatattccgttaaacttcaaagagaggtaggttttgtgtcttgtttacttcttgttattctttcatcaacaaactgtcttgactctaaaaattgcaaatatccatatagatagcaataattaagaaagctgaggggtccaagtcatgtccgtatgttctggatggtgcacaaagtcttggctcgtgcctaagaatccgtgcctcctcagacagtggtatagatatttccaaatgctcaatccattggtaccgtgcagcatctgagtctagtcgaagagaagctatatctggtaattcgcattctctctttccctgatcatttggcaaatcttattatgttctcaaaataacttataggacatgagcttttagcttgagcactgagcagttcacatttttccaatcttaggtgccaaccggtcagtatatgctccagaaccatttgatgtcgggcgagtgatacaagcagacattgtttcaaatggccagaagttcaccgttacaaccgatggtccaattaatactggttggtgttacaagagtttgctattattatgtactttctgcaaagtccaaatacagattataatggagatatgataaacaaaatggctaactgaatcacaatttctacagctgctggcttgcagtcacgcgttgaatcactcctgcgcaaatctaacagtgaattcaccgtatgtttacaactttccttttccccttggaagagaattttgcataaaacagttgttatttcttgctctaacaaaactagaaatgttgaaattcttcgcaggtggttatatcacagatgaatggacaagaccatgcatcacgatcccatgtatttactgttggaaaggcgaggataaagctgtcccgaggatggatcacaaaggctagagaaatatattcaacctccatgcaggtaatctagagcctatgattgccacttaattcactctctgtctcttcctttagctttatttgaagttttctttttcttcaagtttaaatggtttggtaacatttcagctctgtggagtgagaggcaatgctaacgttcctgcaaaggcattgttctggcaacttagaaagggtctaactttcttactaactttcgagtcagagcaagaacgtaatgcagccatagtactcgcacgaacatatgcatatgattgtaatgtgagtaaaagtaaccagaaaaagatccattttctttttctgatccttctatcttctcttgttttgcattgcccttttaatatgcagttactccattatatagttttggtgtaattaagcaaccattttgaatcaatttcgcatcctgcaggtcactctagttggtccagatgattgaggtagtgaaaggagtagttttgtgatatcgactgttatgtatttcagtgtttgtgtgtggttgaaagaagaagaagaagaagaaacacaagtgttgctgcatagttttagacagaaaacacattttgtgtttttttttggcatgatcactggtttgaggtggttggcattttttctgatttgattttatttgtttgtttgtttgatttgtttggaccattattggctaattaggattattttttggattgtgaaaaattgtaatcaagatttgttggtatctaataacagaacagtgtttcaatcaatattacattctactcttcaatcttaattaatgtaataaaatgaaaatttcttttaaataaaaataataataatgaatggccaatttcatatatttaattttgcactatccaagggtgcaaaattatccaaatgttaaagaaacttgaatatttttgggacatcacagatatgtagatactttaagttaagcttattatgacaaattaatactttaacatatagagaaatagatggaacattatctacctttatagttgtccgaatttcttgttcctcttttatttttcacactctttcagtccatcgtccgaccgagattttgtcttctcgtgagttcaaatccaaatccatg

SEQ ID NO: 11391 - DNA, 3000 bp, Unknown
  misc_feature (1)..( 3000): cDNA_ID_2706377_gDNA_ID_2214493_Annot_ID_133510 3000 nt of promoter + ATG
ggctcaaagcataaatcgatgtgtcattattatctgcaaatccgagctttggccaactgcttataacagaatgaaccaaaccaattataaattgtggtttagcatgtgattatgtaaatagaaatatgaaaaatcttttctatataaaaatgtaactattctcataaaatctatttaaaaataaaaaaacgaattttattttgtttttcctattttttcgtcgagaaaaacttcataaataacgaggcctatattggcccaacaatattatataacatgctaacaaaataaataacagcccacgtaaaagagataagaaggcccatcgtggcccaaccgtaatatatatatatatatatatatatatattcttatcaacaaactgtaatgcgttgctcttccaactgcacaaattcgaaacccctaatatcgtcgatttccgtattcaaaatccaaaagcacacaagaataagagacccctttgctcttttggttgtaattttggttttgaatagaattgagctgaagagttaaaagagatgaagagaagaaggaaggatctgaaacaagcggcggagtcagagcaggaggaatgtcagagcattgcccaggtcgtctctctcggagattccgatcaaattcaggtataaatacgccaattcgtagcgattattttctttggcttaaagtttgaattttgacttgtggttttcatgttataagtttaaaccgttcttatttgctactatttttggtctagccgccacccaacaagaaagaagaagaagatatatgtgaatacttactgcagaattttgatcttgatcatgtgatggaaattcttatgagatttcctttaacctccctgacgaggttcaagtgcgtctctaagcagtggtcatccctcatttctagtcgatatttttgcaaccttttatatactacggtcacacgacaacaaccacgcctatacatgtgtttaaaggatgacggcgggcaccgtgtactgctatctatatcatcaccgtctcgaggcaacacttctttcgtggtggtcgagcaagatttgagcatcccagggatgggaggcttcttcttgaacgttgttcgtggcttgatgtgtttctctcgcagaaaaaaggcgcgtatctataaccccagcaccaaacaactcttgaccttacccgccataaagtccgacattgtagctcaacaaggtcaaacgaagcatcatccccggtattacatcggacacgaccctgttagtgatcaatacaaactagtctgcacggttgcgatatcctcgctattgccacgtttgggtaatctgaagtcagagcactgggtcttcgcactagaagctggaggttcgtggaaaaaggttgttccactggaaaattatcgtcatcatgccccttccacggaaggacggtctaccagtggatcagtagtgcgttatatggcctggcctgataattataattgtgtggttgtgagtttcgacattaggtctgaacagttgactatcatcccagtacctagggagatccaccttgacgaggttgtgcctgcagttacgatgatggcggatcttatagagtatggtgggaagatagcaattttctatcatacaaaccttaaagacgagggttccgcggatttatgggttttggaagacactgggaagagtgaatggtcgaaaaagactctggttctgcagccttgtcaaaggcatttagtcgaagacattgaattgatcgtaaaaggtacaactcaagacggcaaggtgatcttggcaccggtggagatgcattctcgattctacattctgtattacaacttgcaaagcaatgacttgagaaaggttgaaatcaaaggagtaccagactcttggtttgataaagaatgctatttcgacttgaattctatggataagagtgagagcttcatctacttggaaacttgaccaagacggcaagacgtttgatttccttttttttttttttttttttttctgtttgttgtttaagaatacaaccgagttaaatgatatttctagttacttgaataaattttatcttcatgctcttgattttattggtctcctgcttaaatgcttttttcaagcagtagcatattgaggatagaatcttttttgtagaagtttggattttggaattagcagattatttttaacgttatctccattctctttcattatcagcacgatgtgttcagtcagttgtttggtattgataatgatctccatacttcaaaactcattttgttaaaataatgaatgaagaaacttttttccatcaagcaaaacacaaaagagaagcagacgttgtttttggacttcatccattttcttaacccaatctctccctgtagttgctatagtttcttctgtcttctcagcttgtatttgaaatgggtacatcacgtctgctgattcgaatttagccttgatagttaatgcttatcttggtttcatgaatggctgttgtaaaagggactgctttcatttttcaccatcttttgttgagacgagagacaacaagatgatgtcagttctaacaaacaagcatgtgccaacaattaatcacttatacacactaatgttgtaaaactcatcaaggctcatagcataaatcgatgtgtcattattatctgcaaatccgagcatagaatgaaccaaaccaattaaggatagtggtaaattagcacgtgaaccaagcggttagcttgtgaattgtgattatgtaaatattaatttattacttccttaattttcctttttattttccttttccttttctaccatttattatgttacctttgtctttggtcataaagataaagactacacaaagtaggtctctcttccgactgcgcaacttcaaagccctaatatcgatttcttttgtttggtcgtaactttagtattaaagtttggatttttttgaattaaatttgagctgaagagttaaaaagatg

SEQ ID NO: 11392 - DNA, 3000 bp, Unknown
  misc_feature (1)..( 3000): cDNA_ID_1831217_gDNA_ID_2214493_Annot_ID_133512 3000 nt of promoter + ATG
atcatgaaacccgagtccttacaagaattaccatctccagaattttttccagttctcagtgacagtcacttctacctatgtgtgcaggttagacccaatctacaaattactaaactacaaagttaagcttcttactgtgttcttactgttataatcatggtgcaggtgaaggacacagggtgtggaattcacacacaagacattcctttgctctttaccaaatttgtacagcctcggaccggaactcagaggaaccattccggtggaggactcgggctagctctctgtaaacggtaacaacccaaaagtatatataagttataagcagatggtgttacaaatagctaaaaggcaagtttctgttgatggatgtctctggttaggtttgtcgggctaatgggaggatacatgtggatagaaagtgaaggcctagagaaaggctgcacagcttcgttcatcatcaggcttggtatctgcaacggtccaagcagtagcagtggttcaatggcgctacatcttgcagctaaatcacaaaccagaccgtggaactggtgatacattacgttggaaagacttgtattgaggtgagactttttaactacacagcagcaagagaaagaagaaaatacatgaccggacggtgtgatctaacttattggattttgttggatgtaatatgtaaaataaaaatcctatatacggggagaggtaccttatctgttctcactatattttattgaacattactttagagaatatgttttggaattcactactaaataaacgatataaatcttcacgaaaagagcaacattttgtggttgtggcagattcacaaattcttttttatatatgataaattaccttagaaagttttacttactcatcaaacttctcaaatacattgcaaaagtcgatgaaaagaaaaatgtcttctacaaaataaacaaggaagctcaatgagacaaagtgatcagttagctgattccatggtttgagccaagggggcattggtgatagccatcttcatgtcaagaggatatgaaccactgctttgttctcgaatctctctgtattcttggcaaatggcacacaagtgacagaagaagtgtgttacaaaatccccacatggagcctcctgaatcaaagaatgttaaatcagtcagaagcgccacatacatacctaatggtattatccacatatgtgtcgtttgagaaattctaacctgtaaattgtacttggctcttaatgatttgcggtacccgcaagcataacatgacacaaagcatcccggtagaccgagcaatgcgccattagttgcaaagcagcaaatggtattgaccaaagcccaggagatgcaatgggttaagcagggtcctgcaaatgttccagaccccagaagctctgcgtttttgccaaagatataacaaggacagaacaaacctacacaacctgtgcatacgaaacaaaccacagtaagttgtaatgttcatttcaaaccattgtctaaatgatcttcagcataaacaagaaaacagaatcaagtcctagagaagtaacacaaggaagctcaaaacataagcaatctaagtttcttcctagcctattcaagaaatgcacttggttattcttctaaaccaaaaaaaactctgcaagaactatcaaccagaaccacacttatctttatgaacatatctgaacacactaacacatggcaatttcacaggtcaatgcaaagaggcacctttaacaaatttgattcgtgtagtaaaatgaagaaggtttggatgacagagagtagtagcatacagctctgcatatcgtcgaagcaagcgcatataccagatgaccattgtctcggatcatcttttgtgctttcagaaacagcaatttccagatttggagtagtggtctctacttcagtatcagcatctgactgtgttaatggaatataagatggtggcacgtaatgacccttcttctctttcatcctaattctgatgaaaccaccaatatcaagaacaggactttatttaccacagagcctgaaaattgacaccaagaaacacatctgtaccttgaattgcatcaaaatgaacatatatacaattactacaacagcagctaaatcaaaaaggtagtgagatggagaagataagtaaatgaacgaacagagcaagaagcagagacaaaaaaaggatcggaagagagaacaagacgaatcagcgaaaacgagataaaagagtaaactttaaacccaagaagaaataatcagatacatgtgaatagaaacaactctttacctgagctcaacggagagattagtttagcgcattaactcagagattcacgagaaagagcttacttttattttatttattggttccagaagaagagagatggagtttccacgttgagtaaattgaccaggcctcttatcaacatgttatttatatattaatctcaaaacatcaatttacgcattaataaatttttcattattagtaaaatgtttctttccaaccattgtttaaagtttcatatctaacaatttgagaaaataaaagttacaaaaaaaaaaaaatctaacaattttaagatatctttttaaatcaaccttttcaattagtgcaagagcaaaaaaaaaaaatgttggtcaacaaaaattgttttttttcttaaatttataaatggtggtggatttttttggggacctatttcgaaatgactatctaaggagcgaagccagcaaggatctgtttcagagagaaaaaaaagaggttccgactttttgttagcgagcggctcactctactttgtctcccccaaaaaagccgttagggtttatcatatccaccgccttgctttactctcgccggagtcgtacggcgaagcacggttgttcggcgttgtctcagctttagattcttctcttcatagctagaattcgcgaaagctgactttagctgaaacgaatttctcctaattttcgagatatg

SEQ ID NO: 11393 - DNA, 3000 bp, Unknown; identical to SEQ ID NO: 11382
  misc_feature (1)..( 3000): cDNA_ID_2706369_gDNA_ID_2214493_Annot_ID_133513 3000 nt of promoter + ATG

SEQ ID NO: 11394 - DNA, 921 bp, Unknown
  misc_feature (1)..( 921): cDNA_ID_1833057_gDNA_ID_2214494_Annot_ID_133517 3000 nt of promoter + ATG
aagctttgcagaagagagagatagagtgagtgagagggagtgattttgtttctctctcttgaagggtaaaacggtcataaaatgtagaagaagaaggagaagaagaacatgttaatggcagtggtgaataaaggaggtcgctttcgttgcccaatacttacgagtctttgtctctctgtggcttgtttcacagatgacccatatcaataaatccatcttatgggtacttttgtaattatgtatttttatatgattttagtgtaatttttttgtttgcttaacatgttcttcttcatcttcttacttcaattactaatttaaattcaggagtttacaaaaagtttggttcagttttctcttctttaattattagtatagttgttgtgtttttgtcaacgttttttagtatagtgaacgtgtgatttctaagtgtttttgtttattactaaatttagaaatatgcatgccaatgatttttggtttagcatcaacacaaaacttaataaaatatgattggttttaggatgttaaccggtttggttggctccggtcggtttgtcacaaaattaatattttgaagctttgagaacgaagtggactaaaactaaaagggtcacaggcccaacaaaagaaggaagaacttaaaaaataataattccttttcattttaacttctctttttttttttgttaaatcatttatttgtttcaataaaaatacacataatattatcttttctcaaaaagtactatatagttagaaaactacatatttattttaacccaaattattatttttccattccttacacactgtacgttacactttttattatcatttgctgtacaacgttaatatttttaaccatttctgcaattgtttacctctttttcatccgcaaatttctaattaaattatatg

SEQ ID NO: 11395 - DNA, 3000 bp, Unknown
  misc_feature (1)..( 3000): cDNA_ID_2706468_gDNA_ID_2214494_Annot_ID_133518 3000 nt of promoter + ATG
aaattctcaaaagcttgactcttgtttccgtagaaaatcgaattcagatgcgtgtagctttatagttagcttaaattttgcaaaagttggaaattttacttcaagatccaatgaaattgctccattgatcaatgaagctgttgctaaaggcaagaactttgatactgggtgaggacaagaaccttgtagatactgtttttctttaaaacatttgtgtctaaactacatgttttgttaggacaagagttggattagatgttggtcatcttcttaaatctgcattagctggaggaatctcatgtgctttctctgcttttttgatgcatccagtggatactgtcaaggtataatggtaatttcatttcaggttcttcttttgtgtttatgagattgttctgattacttacatttgtcttggatcattaagacacaagttcaagcatcaactacattgtcgtttctcgaaatattgtcaaagattccagagattggtgctcgaggtttatacaaaggctcgattccggctgttgttggtcaatttgctaggtttcatctcttatgctttgccttgtggttattggttataagcattatcatgatttcatctcttgtttaaacatttttcagtcatggtttacgaacaagtatatatgaagcaagtaaacttgcgttaccgctcgttgctcctactcttcttgatattcaagttagtaattgtaaaaagctcattgccaactttattgctacataatgtttcgttctttgaatttttttgcttcttgattattttaggttcagtcaatcgcgtcttttattggtacggtattggggacaacgttgcgaataccgtgtgaagtgttgaaacaacggttacaagccaaccagtttgataacatagtggaagctacagtttcgacttggcatcaagaagggctcaaaggactctttcgtgggaccggtgttacccttctacgtgaggttcccttctacgttgctggcatgggactttacaaccaatcaaagaaggtaatcatgatagaacagaacaatgacatgtctttgtgtaattaataagacgtggttgcgattgagtttcacaggtggtggagagacaattaggaagagagttggagccgtgggaagccatcgcggttggagccttgtccggtggtttcactgcagttttaacaacgccattcgatgtgattaaaacaagaatgatgacggctccacaaggcgtggaattgtcgatgttgatggctgcttattcaattctcacacatgagggtcctcttgctttctacaaaggagctgttccaaggtttttctggactgctcctctcggagccttgaacttagctggctatgaacttcttcaaaaggctatgatcacacctctgaatcaatcagtgcatagtgagtaagattggaaaactagaccaacattttgtgttataataatttatttcatgtttatgtattctaaatcttgagaaaaaaaaatatattctacaaaaataacataatttacttctttttttttttctcaagtgtagtattgtattaaacgtaacccgatcatacacgggctacactaaaagccccacgaaaagtttacagaaatatttgaggcccaacaagagcctatcggataaccgcatactgcataagaaaatttgtttgtactccacctaagcccacgtgtcagcaactggatacaaccacgacacatgctggatgagtaatcgaaagatttccgacatcaaccttcgccgttgagcatcgatttcggtgagaagattatcgccgaaatataatcggtcgttgaatcctttgtttgtcaccgttgctaagctaatcgaaactccaaaaagaaactaacagctttaaggcaatcataatatgcttcgaaagattcttctttccttatgtctctggaaagatttctgcaaaccaaaagctcaaaagaaacaagtcggagaaatccattctttaagtgacacaacacctaaaacatcatcaccaactcagatctaatgagattattgaaacaaaaaaacttaacaaacccaaaactggccgaagacaccgtaaacaagacggcaaatcgccagacataagccagccaacactactttagaagctagtcgatgctggacaggagccggataaaccggacggcgaggatagaacatgcatatgagatcacgatcggactttaccaaaaaaacaaactctctctctcaaaagtttttgagagagaagagagaaagttttcgtcaaggttaatatctcctttaataatttaattatggaaacactttgctcggatttatttttaacataatttacttaacatcatgtattctaaaaaactaatcagctcacccgaatcgattgactattacaaaatactgcttaatatagacaaatatttgatcataaaaataattaaaaagattataattaataaaatattattgatctcatatataaatggcatcgatacatttgcaaatatttatttttcctttgaattaaaaaaaaatatcaaaggccgaataaaaaacatcattcggcaagttcatcgatccacgaaaaaaaagaaacgatgaggcttaatggggattcgggtccgggtcaggatgaacccggttcgagcgggtttcacggcggaatcagacgattcccgttagcagctcagccggagattatgagagctgctgagaaagacgatcaatacgcttctttcatccacgaagcttgccgcgatgccttccgacaccttttcggtacaatttttccgacaccaaaccaaacaacaacaactgtctactttaattgcttcatcgttattgtccaattaataactaatttttatcactcttaggtacaagaatcgctcttgcttaccagaaggaggtaatatacactaaattatatttgtctgagtttccatgagatttttgattatttgtttttattgtttttggatagatg

SEQ ID NO: 11396 - DNA, 3000 bp, Unknown
  misc_feature (1)..( 3000): cDNA_ID_2717386_gDNA_ID_2214494_Annot_ID_133519 3000 nt of promoter + ATG
agtgtcatatgaagaattgaaaacatatttccataagccaattggatttaatcaagcagagaccgatgttgtagttggagcagggttatcgaactcaacacacatttttagcagtggcacttcagcgtcatcaccatattcatcaacaagggatatgacaatcttggacttatccttctaattagtttaaagaaagaaaaaaaaaaccgtcaggcaaaccaagtaaatatactattgtggtttttagattgttcggttttaaaatacatttatcaaagtgaaaccgtttgtccaaaaattaaaataaaaaatacttacatgagggagtgactgcaaaccaggaactttggaaagagttaacacaaatttttcgccaggttcaatagagcatggatcctcacccatcacatcactgaggtcgtaatttattatagtgctattcacattttcatatttatacaacacatgtatagttgctctatagatgatgtagcctgtaaacacaaatatattttcttacaagataagatattggaaactataaatgaaaacaattaaaagaatagaaaatattacgtactatcatcacttgtaaagccggatatggtaatggttggctcgtcgtaaggcccaacagggtatggagagatctccacacgtgtgacgttcgtaataccgtaattgtagtcaataggtgcatctttagtcgcaccgatttagagcatgttaacaattgtagaagttatcagtaagtcatggcaggtaaaaaaaaaacttggatctacatcctaatttcttacaaaaataaatcctaaatttctttatttggaaatttggtatgtcaaatgatagggtcataggggtaagtgtttctttatttatttatttgtaggattaacaaaagataaatctattttaaatttcgatcagatttcaaattgtttgatctatctttgaatattggaggaactctggacctgcaatattttagttataatactcagttcttgacttatacaccacggctctcgaaaaccacactgaaggaaaaaaaaaagaaaaaagtcttcggtgaatacttcacaattattgggttattttatagatgggagtactttcatagtttcattgatctgttctttctatataaacgttttcacagtagcaaaatactctatttctgttttatggaattgacgactaatgtgagttccggttcaagatttatttggtaaaacaaaaaacagagataggagcaaaccacaatctatgaaattcaggcatattcttttcattgaattgacttatcaagtaacaagaattgatgttctatataacaatataagacttaacaaaaacgatacttacttttgcagttttcaaaattgtatgcgccggcgccaaaagcagataagaaatagagtgatgataggagaagcagaacaggttgggcgtgagatatcgccatgggttatatcttcgaaagataaaaaagattaatgcctgttttgttttgacaaacaagtctgtaatacgtatgcttaaattcattcatgcctagtattttatatagtctatataatataatattctgcttaactagtggatgattcatccctatataataatcttccacgttatacttattcctatatgatataatcctaatttatacgtgagaatcttaaaaaaatgagtgttgcctgaaatctcaatatttcaaatattaccaccttttatatacaaggacgtgaattcttttagataaaaaaaaatcccaaagatggagttgtttgactgcgaccatgtctgttggttcggcgtgatttccaaaacacaactgttattagcatcatacaaaatttaaaaccgatcacaaaccgaaaaaacaaaaatgtatgcatagatatacattgcgcttaaaccatatactggggaactaaatggtcaacgttaacgcaacatggcatacaaatcttatttttgagataagatgaaatagtaataaaataaaataaaccatacccgaaccacatggtcgaagctaaacacaacctggcaaatactttcattattagaggtttttgtttccccactttgagatgcaccaccggttaaataggtgaatctttaatttcttcgacatgaactcacacatgcctgtgaattgaagaatttggtcatagttggcaataccaatgacattttatttatattttggttaaaaatacaaatgacatctaaagtcatattctaaaatctcgcttttaacgaagcatataaatatatctggatattactttgattcggtccactaattaagcaaaatattttaatctaatagactataaaaatagtaggcatgaataacatgttttatgatatatatatatatgattttgtgtttttttggatttgtggttttaggactttaggattttaagatgttttttttttttaatatctagatattttttaatttgttactgaaattttttcttggttttattataatatgttttttagatttttattacttataaatttttcttttatttttatctagatatcaatataaccaattaaaccaataaattttatggttgtggatttgagtatataaattcaacttatataaatacatgggttgggtcaaactcgtctattaaaatctcaaatccatgtgggtttgggtaaggttactcattttgacatctttggttaaaatagttacctctagttttgtttcagtcccacatctcaatttgttttaacacagtcatttcgtcgaacacctcatatgcgttgttgttgtatactaaattactaatactttaaacaaagactaacaaaaatggcttaattcgataatcaaaaccactatttggatcaaacgttgactaatctcacttaaatcactcttctgttttcctctaatgacggatgaagaacagagttagttttcaaggtttatccacagatccactgaaatcaacaatg

SEQ ID NO: 11397 - DNA, 3000 bp, Unknown
  misc_feature (1)..( 3000): cDNA_ID_2706401_gDNA_ID_2214494_Annot_ID_133523 3000 nt of promoter + ATG
cttgcatcggctgttgcagccgaagcagctgtggtagctgcacatgctgccgcggaggttatacgtctcacgaccccatcaacacctcaaattgaggaatcaaaggaggaaactgccgcaatcaagatccaaaatgcgtatagatgttacacggtatacaaaaaaatcacttttttttttttggacaaaatacaaaaaaaatcactaattcctcttattatgaaagacttagtctaatattttgaaatttcataggcgagacgcactcttcgtgcgctgcgaggaatggctagactcaaaagtttgctgcaaggaaaatacgtcaaaagacaaatgaatgcgatgcttagctcaatgcaaactcttacacgtttacaaacacagattcaagagaggaggaatcggttatctgcagagaacaaaactcgtcacaggctgatccaacagaagggtcaccagaaagaaaaccatcagaatttggtaaatctcgttacattttttgttgaatgaatgtaaaatttattcaaccatgtttacaatatatgcaaccgttcatctaaaaatatgacaaaatttaaaaagagtcatcccattgttatgtggtaaaatctccctacattttaccacactgggtgaaccaaaattctgaactggagcatattttgttgtaggttaccgcgggaaattttgattccagcaataaatcaaaggaacagatcgtggcaaggtcggtgaatcgaaaagaagcttcagtaagacgagaaagggcattggcgtatgcttacagtcatcaggtaaatataaattaaagacaacatcattgtgaacttagtcatagttgtttatatattgatgttggaaaataaaacagcaaacatggagaaactcttcaaaacttccacatcagactttgatggacacaaacacaacagattggggttggagttggcttgagaggtggatggcttctcgtccgtgggatgctgaatccattgacgatcaagtttccgttaaaagttctcttaaacgcgaaaactcgatcaagagttctcctgccagatctaaaacacaaaagtcagctagccaaagttctattcaatggcctgtaaacaatgatacaaagagtagaaagatcgaggttactaatcgcaggcacagtatcggtggtggatcatctgaaaacgctaaagatgatgaaagcgttggtagctcatcctcgcgcagaaattcgttggataatacacaaactgtgaaatccaaggttagtgtggaaacaacaagcaacgtgagtaatgcacaaactgtgaaacccaaggctaatgtgggagcaaaaagaaacttggataacacgaaaactttgaaatccaagtctagtgtgggaacaacaggaaacttggccaacacggaagctgtgaaatctaaggttaatgtcggaacaacaagtatgccaaagaaggaggttgttgctgataagaagaaacctccacagatggtattgccaaagaagaggctttcatcttctacttctcttgggaaaacaaagaaattgtcggattcggataaagcaacaactggtgttgcaaatggagagaagaagagaagaaatggtggtagcagttaacctaaagtaatagccttatctagaccaagatattgctttggtggcggtttgatagatttagcatctcaaatgtgagatttgttttctatcaacgcaaatagaaaagagaaagaaaaaacaaaaaaacaaagagtgtattttgaagaccttattttgattgttttctttgggtgagtacaaatgatgtatgtctgtttcggtttggtgtttatctggtggattatttgtttacattttttaaaaatttaaaccatttatttcgcgttaatgtttgaaaatagtcgttgaaatcgattcaaaatgacatatgcaatggttacaaaaagtaaacgagagtctacgtgaactggagctggtttgtgacaaagtttgttatcaatttaagagtttgttaaaaccaaaaaaaaaaaacaagacattgtatcgggattgtaaaaatttggattgtggagctctcaatgaatatgtacaattgagtctattgctggattacgttctggccgagacatatcaatcaatcagacaggttgctatgaattagtaaacttcatgtagtggatcattcttcctctttctctgtaatttgtccgtaataacatcatcaaactcaagtttctcaaagttaattttaattcaattaataacttcgaatatcacacatatatgattcatgccgttaatatttttcttagcatggtcttactgaaaataaaatttaaatattactatgaaaaattatataaatcacaaaactagtttggttttcttttgtgtagaaaagattatcggaaataatttcatgtttatttatttatttttacatcaaaattttaaaatagaaacacaattttccattaaaaaaattcataagattccaatgagcttccaaagtaatttttttggaagcctatatagtcttagattttgataatatttatgaaaaaaaagctaattctgaagtacactgaaacaaataacaaatacatgacgcttccatttttatttttttctaacatgaagcttccttacacgtagaaagttaagtacatcgaaacaaataccaaagacctgagaaagtggatagaagtcttattattaagaacaataattgataagaacaaagcatcttattatttaacaaatgcaaatagagtaaatagaagtcgtgagacttcgtgacgtcatcacttcttcgtcatctccttgacacttcgtgacgtccttgtcttctcgataaaggtgcctaagaaatggaaagagtggttttgtgttcttactttacatttttgcacacagaaaaatgctagcggtttccttttttatctatataaatggtttctttctttcttcattttgaacacaaaagaagaataaccatg

SEQ ID NO: 11398 - DNA, 3000 bp, Unknown
  misc_feature (1)..( 3000): cDNA_ID_2706457_gDNA_ID_2214494_Annot_ID_133524 3000 nt of promoter + ATG
agtaatggacccttaatgagactaggggaaagtacaccggcaaaagcagagcaggtgagcagatttgaggaagagacgtgggaagaagatgcaattgacaactcaaatcctaagggtacaaggaaagaagccgttgaggtgatcctttatttcggtgttattgacattcttcaagactatgatatcaccaaaaaactagagcacgcctacaagtcactccacgcagatcccgcgtccatttcagctgttgatcctaagctttattcccgaagatttagagactttataaacaaaatattcattgaagacaaatgagaatgaatttaagtaacgtgcaacacctacacaagttcaaagaaaaagaattttacggtacatcagaatctcaggcatgggtttggcatttaattttttgggttttgaatgtcaaatttttaaacccttgaggcccctacacacgatgagatcgcacggcaccccgcaatgttgctcgaatccaggatgttgaagaggttgccggctgttttgatgaatttttggggttcactcattttttaaagaggaagagagttttggtgcttcctcaaaagatagtgtagatattaggataatgtttcttcattttattgttatatatggcgagccgagctgagaaatacatggacaaaagagtaaatgttttagcattttgtttctgcttatgattcattactcttaatctttatatatatatcgataggctttttgtaaatagtttctttttgtaatattgttttctactaggatgatccaagctaacgatctataatacctacgtttttcataaatagttgttcaaattataattatacaatttctgttattgcttcaagccatccggcaacatgaaattaacaagaggaagtccttataggaaaaaggttaagtttgtccaccggcagcttgcacataaaataaaattatcaggtgaatttcaaaaatccgtctcgaacatatacaaattttagcaaacggcatgatccatcaataataaaattaatgttttggtgagtgaacctaggttgtgcaaatgtgtactactcaagtagcgcataattttagtgaggggataaattacactagaggaacacgagtacgtagggtggtacaacgagtacaatccaaattggagaagtcatcattgttagagaattaggcagttggtaccacaaattttgtgctgaaacttttcgacaaaaacgataaagaaaacacacgttcttttaaaattattttatgacatgatcttgaatcaattcccgtttaggctatatataatgattcaaaccacacttgaaattttatttttcctacattaaatcaaaatctccatattgataagattgtgaggctggtttacacgggattgatgaaagcctcaagagtaaaaaggtcacctctctcccttcaaaatttttaggtgccaaataggtgcctcgagggaaaaccatttcggcacctaaactacaagctgacatttgtatattcttgtgtctttagcgaggaaatcatcacaaactgaattatgacgtagaataaaacaaatttaaacaaaatacaaatttcgatataaaactagaaaattcatctaattcattggagtcaaatcattttaattagctttaaacaatctgtcttcaattgaactttggccgtatgacgtggtatgagtgagttcatggccatagaagcacctctaacttagtgtgaagagtagaaagaggagagagacgacaagtattaagaggttcgcacgtactctctctgccgacttctaaataattaaatagaattaaaagtaagctacacaaagttgttatacgttataatcctttttgtcttaataaagataaataattgttacacgtacgttataatcttggattcattatggagttgaagagttatatcatctttattttttttctctgaaaaattaccttcaaaagtcatttttttttgtaactttactttcgatatccacaaaatacagagaaatcctgtgaagtcaaaataaccttcaacataactctcatatatttatttatgaagagtatttatttatttatttacatacattagattttaaattataagaatttattttagtctcctcatcgcgagaaatttgatttaatattttatttaggtttcataatttataaacttgacgatggtgatgacatgctatattgcagagtattttttatttaaggggaggtaaatggaggtaatggataaagttacaaaacatggtgatttggtttcctgccgaaaaacattttcctaatttttttcaaattttcgaataaccctttgtttataactgcaaaattgggatcttgaaccaactcttttacctatgaatttttgggtttctaacgtaattatatttgtagcttgacaaccaatctctcaagtagccccttctcttcaaccaacctatgaattatttaagttactatgtgttcttcattttggttttgggatttggttttataacttatttcttgttgattaagaaaactctcaaccaaacaaaataatggagggtgagagtgagaatcaaacccagagtggaatggataaagagcattagcatcatcaaaactttaaactcaattttctaaatttgtctaacagataattgttataaaaaaagctgtaattctaaaaaccacaacaccagaaatattaaaaaaaaaaaaaaagataaaaataacatatagaaagaacaactaagcagagaatgaaaataaaaaaaaacaactaaaaagaagttataatttataacgtatctgtcgttaaatctgttgaatcgttcttacaaaacacaatcgttacaaaagtcaattgggttcccacgaatcggtggggcccatcacgacgaggtctcttcacataatctcatctcttcttattgatttcacataaagtgttttgtaagaaaatgtttcaatg

SEQ ID NO: 11399 - DNA, 990 bp, Unknown
  misc_feature (1)..( 990): cDNA_ID_1833057_gDNA_ID_2214494_Annot_ID_183750 3000 nt of promoter + ATG
aagctttgcagaagagagagatagagtgagtgagagggagtgattttgtttctctctcttgaagggtaaaacggtcataaaatgtagaagaagaaggagaagaagaacatgttaatggcagtggtgaataaaggaggtcgctttcgttgcccaatacttacgagtctttgtctctctgtggcttgtttcacagatgacccatatcaataaatccatcttatgggtacttttgtaattatgtatttttatatgattttagtgtaatttttttgtttgcttaacatgttcttcttcatcttcttacttcaattactaatttaaattcaggagtttacaaaaagtttggttcagttttctcttctttaattattagtatagttgttgtgtttttgtcaacgttttttagtatagtgaacgtgtgatttctaagtgtttttgtttattactaaatttagaaatatgcatgccaatgatttttggtttagcatcaacacaaaacttaataaaatatgattggttttaggatgttaaccggtttggttggctccggtcggtttgtcacaaaattaatattttgaagctttgagaacgaagtggactaaaactaaaagggtcacaggcccaacaaaagaaggaagaacttaaaaaataataattccttttcattttaacttctctttttttttttgttaaatcatttatttgtttcaataaaaatacacataatattatcttttctcaaaaagtactatatagttagaaaactacatatttattttaacccaaattattatttttccattccttacacactgtacgttacactttttattatcatttgctgtacaacgttaatatttttaaccatttctgcaattgtttacctctttttcatccgcaaatttctaattaaattatatgttgaatgttcatagccataataataatttgtccaacggagataagacgcctctggtgttatccccaatg

SEQ ID NO: 11400 - DNA, 3000 bp, Unknown
  misc_feature (1)..( 3000): cDNA_ID_2706446_gDNA_ID_2214494_Annot_ID_133529 3000 nt of promoter + ATG
tatatatttctgtagtttaatgctcggtctgaatctgtggctgagaaagcgtcttttcgtcgattgcttcccaagaataggtgccttgttgcagttgatgggtatatctatgatctcatctcgtttttaagtgttctaatttatgttcaatctgtgtatgaatcccagtttagtggcagagatgttttaaattctgatcagcaatgttactctttccactcaattcatggttactcttttggctctatctaaacaatctcaaggatcagattgtttgtaaatgtttgcttccattttatcttccatctgcattacaatacgtattgtttatcaatgtatagtgttggatcaaaaaactcatacaaactttcagctagatattttaatttttcatgttacacagatgtgaaatttttctttatacatataaatatacatgcttgtgttgtgtctacgcgaaaaaacttacagtgtgattcgttttgaaggttctatgagtggaagaaggaaggttcaaaaaagcaaccctactacatccattttgaggatgggagacctctcgtatttgctgctctttttgatacttggcagaactcaggaggtgaaccgtttatcttcgttatattaagctctgagtgtctatattcttattgaagccgatcctgaaacatttcctagccttccttttaagagatgtttgaattgcttactatctttctttctcatcacttttaacctccatatatttaggtaggaagttttaacgtgtattagaaaattgaagcaaaacttgctgaatgaatttaagtctttggttttatgtcctttttggtagctacaatatctcgcctgttttcaatttaagtaacagttactttttttttcttgcaggtgagacactttacacctttacgattttgacaaccgcttcctcttcagccctccaatggctccatggttagtaatatatacactggctacatcgtgtgacattttttcttattcagtaatgattctcagtagcacaatgaaacacatagcatatgaagttgggaattgtatatttgtctatggacgcttgaagcttgtgttcctcgttgtttaaaatgaggtttaatcaaacccgcacattaataaagatacaaacttatcatagtagtatgagttgtttctgttttcgtattacatctgatttgataagctcttttagaaaagatacatatgtaattgcatgagaatctttaacttctttaagtactggaatagaacaagcagtggctgtttaaggtagtttaatattgagagtagcgtttcttatacaatgcttacattattagcggctgttgatgattgttttgttgatttgcagcagccctgaatttttgtgttaacacgtgagtttgtttatttttcatgtaagacagaatgcctgtaattcttggtgataaggattcaatcgacacatggttagatgatccctcgacaacgaaactgcagccattactttcaccatatgaaaaatcggatttggtatgcaattgcttacttcctcgcatataagagtggtctttcctttttcatttacttgagattgaagtttgaactttcaggtatggtatccagtaacctctgcaattggtaaaccaacgtttgatggaccagagtgtattcaacaggtacggttaacatctttccctttcttagtagtgtacaactcaaatctcaagtttgatctcaagtcgcattaaacatattgtcaggatcactatgtatttgtacagtctgtatgcttattgtcatttcaaataaggattatgccacctgcagataccgctaaagacttcacaaaatagcttgatctcgaagtttttctcaacaaagcagcccaaaacagatgaaggagacaaagaaaccaaatcaacagatgcaaatatcatagttgatttgaaaaaggaacctacggctgaaaaggacacgttttctgacagcattaagaaaattgaagaactagacggggagaaagatatgtcgaatgtagccaaaaatctggagtttcaagagattgtgaaagcagaaccatttgttgaagataactcagcagttgcgtcacttcctgaacctgtaaagaatgatgttcaggagggtacaaaggaagaaggcaaatccctaaagactggtcttactaaagaaacaggtgagagcagtgccagtataccggctgagtcctacatccttgatctccaaagaatctcaaaagaagaacccgagactcaaagccatcatttctttactgcagatgagagattgaatcagctgcatgaggctgtcgaagatattccaggaaatgaaaaccagaagacagttttaactagcccgacgacgaaggaaggtggcttagtgtttagcgaaaagagtgggacaaagcgagactatgaggtattctcagctcaagaaaagccacagaaacactatgagaggttgcaaaatgttaaaagcagtgggaaacaaggaaagatgcatggaatggggaaatctaacatcaagaaatctaaggagacgcagtctacattacatttctttttcgatgagaaatagttttgagtctacataacatctatgaggaccatgttggcctacttttgttgtagataatgttagataagaccatcgttttgggaatgttgcttgtattgtatgtgtagtgtttgatctttgatctaaggtaatattattatgaatgaattgggtttttaatgtccttggtggatggtaaaaatttgtgaaccaggtttcgataatcaaacccggtcgctaaacgattttatcggtttaaattagatccggtttctaaattaaacatcgaattctaatttcccctgaccagaaccaccaacgctttgaaatcgaaacagacacagatatcatcagaacgaagaacttcagccaaaatctgatttttctctgtttcacgacaagaaatcgaattaacgaaatctaatg

SEQ ID NO: 11401 - DNA, 3000 bp, Unknown
  misc_feature (1)..( 3000): cDNA_ID_2706438_gDNA_ID_2214494_Annot_ID_133531 3000 nt of promoter + ATG
attggagggctgaagaggaagcggttgtcaaaatcgtaaaggtgtaaagtgtctcacctgcaagaaaaaaaaagtaactgttacttaaattgaaaacaggcgagatattgtagctaccaaaaaggacataaaaccaaagacttaaattcattcagcaagttttgcttcaattttctaatacacgttaaaacttcctacctaaatatatggaggttaaaagtgatgagaaagaaagatagtaagcaattcaaacatctcttaaaaggaaggctaggaaatgtttcaggatcggcttcaataagaatatagacactcagagcttaatataacgaagataaacggttcacctcctgagttctgccaagtatcaaaaagagcagcaaatacgagaggtctcccatcctcaaaatggatgtagtagggttgcttttttgaaccttccttcttccactcatagaaccttcaaaacgaatcacactgtaagttttttcgcgtagacacaacacaagcatgtatatttatatgtataaagaaaaatttcacatctgtgtaacatgaaaaattaaaatatctagctgaaagtttgtatgagttttttgatccaacactatacattgataaacaatacgtattgtaatgcagatggaagataaaatggaagcaaacatttacaaacaatctgatccttgagattgtttagatagagccaaaagagtaaccatgaattgagtggaaagagtaacattgctgatcagaatttaaaacatctctgccactaaactgggattcatacacagattgaacataaattagaacacttaaaaacgagatgagatcatagatatacccatcaactgcaacaaggcacctattcttgggaagcaatcgacgaaaagacgctttctcagccacagattcagaccgagcattaaactacagaaatatatataaacaaaaaggatattcagttcttcactatataatagcctcacgtcaacaaaaacagattcaataaacttgtaataagtcccaaatcagaaatagtaaacttataccattttgaagaaatcaggcttatcagttttcttagtgaaacttggcactaatccccacttcatacaatgaacaacaacaccatcaccaacaacttcttcattgtctctccgtagaacaggtatataggatccaggggcaacattgtaagatggacgataactgatttgacaacagaaaggaacagttttagactttgcaaaggttaaaaattggaacttgaaattgattaaagagaaaagagaaataaaccggtcgaggtgaagaaatcgggtaggaacggtgtggcggtgagaagctctggggacatcgtcgggtcttaaagtacatcgagtcctaccgcacatctttactgcttttggtctggacaagtaaaaccctaataagaccgctcaaagtgaaatacgaaggatttggtttgtacggtagtactcgccagagggaagacaacagttctctttcactccggttctgtataaataaatggtcaaccgaaccatagtccttgccttgactagaaaagtaattaaaataaatattccagtggaaacagtttagttttttttttttttcgagtgttttagtttaagttaagaagactagttttttttttttttttaagctccgacgaacaaaaccactgcgaaggcaaaattgaacaaaccccctaagacacaaaacgatcgtctcttgcatgtgatctagaggagaaaggatcttcgatggtgtcttcttccaaaaccgagacggtggtaggagctccgcttaggtagactagttaaaatgaatttttcgatagaatccattttgatttaagatatgtctaatttatgtcatggtttgtttgtttcaatgttcatgtttatgtgtgtgtttttaataatttccgcggttttagtgttgatgtttttcttcggtttgtttcgttggatctttgatttataaaaagaatcaaagaaacataagtcaagtaatgagatttttaggtgatgaattgtgtatcccttgataacaatttattttactcttcataatatacataaaattttcacatttttttagagtcactatatacaactaaaatgttaaaattataactagaaaaaacgtaaataatctgctaaatcagctgtttaatattttataattgtttggcggaaatctttatcaaattcagttctttttgctcgtaattatgtagttattcgttatgtgacaaataaaatgatacaaataattttaaaatcaaattagatgacaatatcttcggatccaaaatagatgatttcatcgtgaacctgaatatcttttttttgtctaaagaacctgaatatcttactcatctttttatcaaagaaaacgtaaaccacacgatcagattaaactatataattatgttaacattttctttttcaacatttttttataaacttcaattaagtcatatactcacaaatgaccttgtgtaaatcatctcaaagaaaaattaaaatttcaatgtgtgtttaaatatatatcacataaacgtactagctatgttgttgctagtgatttgtagtatgttgttgctagtgatttgtagctatgttgttgctagtgatttgtagctatgttgttgcgtcaacataaatccatatagtggctggttaacaaaagaaacctcgttttcaaatttattagatcacatttatttatttagaatattctgttctgtggatggagtatatagtcaactttatagattcaaaaaacaataatatataattgtaatgtcttgtttccacgaagttactcgatctaccaaatcaacaagcaaatcatttttgtcttctcaaaaaagacaatcaaacttcaggattttgtcttcattaaagaaataatcatatttgtctatataagtaaacaatcaaactcgagaataaggtagagacaaaataaagaagtacc

SEQ ID NO: 11402 - DNA, 3000 bp, Unknown
  misc_feature (1)..( 3000): cDNA_ID_2685717_gDNA_ID_2214494_Annot_ID_133534 3000 nt of promoter + ATG
aattaaaaatcattgctgttgcatttttaatgaaactcttagcacgaacattattacagttagaatactaatcgttagttgagtaatatgagggagcatccaggatcaaaagcatcttgattgagtccaaaaaagttgactcgaaaaaacacaaactggatgatgtcattaacaaaatccctcataaagtactactagaaaacttagcaactttttcagactaacgggcgagtaaagtgataaactctgactggccacaaccgtaagcggctagcttgtaatcaagacagactatgaggactcgcatatatgcatcactctagaacgcatccttctttggttgatatgaaatgattcaagcagtggagataacattaaatgtgcatcaacactctcattcaatgctatcgagaagcatcattgcgcttttccattgattctagtaaaatagtacccatgcctcttttttggtaactcttctcacttacggtcagagagatcacattatcaagtctcaccaatcccgtctaattaaagttgtaaataatactcattccgttcctttaatttagagggcagaagcaagagaaaattttagggcctttacttaaactatttttcctatgagaataaattttagaatcttgcaaaaatatggacttatttgtataatgatgtttaatttgtaggagctaaaattagcaaacactacgtaaagacaattgaaatcgatatcataaacgtttaaggaaagacaagagaggagtcgagctgatgaactctttctttaaccctttgaatcactcgtagtgtgacggtttttgtgtgattcaaggatcccatgatacaacctctataaactgatgtcgcaccactcgaaaacagctctaacgaaccaagtttctacgatcctctcaaatacttactttcttaacaaagagagattgttggatatatgtgtttctatatgaacggtgaaattctcaatatgttaagaagaagacatcaaacatgcatatatagaggtttgagattggtttgattcttaagatcaatcaaccacaaccatcgcaaatccaggagaggtggatgataggatgaggcaactatctcacagtgaaaccgagtctcaaagagacgtgaaacaaaaaagactgattctcatggaagtattcaactcgacccaacacacttttggaggtccaatgatagtaaagccaaatcattgtgacccacttctcattcgcacaatttaattttataaagcccacttaactttaaaataaaatttggtccaacataattgagccttacaaaattgtggtctaaaaccatgtttcatctagctagtggctaggcttagaggcaaccctgataatacttgatctaagatccactaacacgatattccaactttgaaatgtatgcacatcattagatgctatatgaccaagaaagatatatttgacagagaaatttgcttagatttgtctaattaattatcttcgctcgagactaaggcaaaacagtccaccaacggtaagcctaataagtcaatgcatttgtttttttctaagacgtcaatgcatttcgttctttttttccattgtcccaaaatactcatccttttatattagaagaatttgtagccaaattttcgtttttaagtgatgttataaattttacattctacaaggttaattgttattctttattgttactgtaaatattgatgcattttattgttattttaatattatgataactttctaaaattttgtatgcataattatgtataaacatcatctaagcgacataagaaaataattttttcgatcttgttatttacagaaaaataaagaaaacaaattgtacaaaactcaaggcacgagtcctaatcttatatttggagatactataggtcacttcgtaggtggtgtttcgagatcaagttagccattgaagaagtcataattgtcatcaaagcagtaaacaaacgtaaaatgaggataaacaattgatgaaatcatagaaaaatcacacataatacggatattgtattattcaaacgtagttggattgtactgattttgagtataataacatcgaatatagattcaattattgagatgcgtattgctttattatcataaattaataaggttctgccattctggtcagttctagttggtggctttaacttgaatgtacaacagcctaagatttaatacggtaacaaaaagaagtgtacttgtacctgacccaaattagcaagaaaagatttgtagtatgatttattttgatggaaccttgaaccttcgaataagtaattaaagtgaaaagctctattacgtatgggtcaattcatgttaacatctcaaataaaattttaattagtgatttttttcctaatatcttgcggattgatgtcaaaatggctttcgagtttattttttaaaatatatttattcctaattccaaatttaagaacatgaaatcaattcaaatgaggttgtacacttcaaaattcgtaataacatcactagacggaaaaagagtgataactgataagaaaacaacatataataagggatgataaaggacaacaacacgatgacaaaaataaacttcattattccaattaataatgaagtacatttccaaataaacaattactaaaacttatacctaacggagaattaatactttattcttgaagtttgaacaaaaataaatatactttatttactcaaatagtagataaataaaaatcctctgttccttccttctcccacaaatcaaacaagtgactttttatatttatcttattaattctgtagtctcgagattcgctttttctcctgcttacttctttttatcatcttctctttgtcggtttgatttggaaaaactttctgcaaaaaaaagagagattcttaaactttttatctcaagatcctttcaaaaaatctgaaaagagaagatttttaataaaaaaga

SEQ ID NO: 11403 - DNA, 3000 bp, Unknown
  misc_feature (1)..( 3000): cDNA_ID_3039833_gDNA_ID_2214494_Annot_ID_133537 3000 nt of promoter + ATG
gagaatgagaatgtgagaagatttccattcttcttcattgagactcaacttacaaatagaactgtgataaagaaacactcagatcctaaaccaaaaccaaccaacaccaggcttgctcaattagtttaaagcttgccccaaaagaacttgttaaccgactgttagttaggttaatgtggtattaaccaacgggtgaactatgcttttgtctttatttttgagatttatcataactgtacattctttttgttggttctgttgtgttctggttcttacttttatcaatatatcccatgatttggactgtcataattgtttggtaacccttatatgcgaggtgttcaaatgtaactgatcagttgattcattaaggtatctgagaaacttctggaaggaaaggagctggagttcaataggtgggaaggggatgcacaagacttgcttaaaggcgtccgtgagaagcttaacgtgcttggggaggtcagattgtcaatgaaaattataactcttcattccaccagttgctaaaatctgatgttttggtgatgcttttgggaaatgaagcactggagtcgggacgagaagaacaaatgcttgaaggaaacggcaaaggcatttaagtatatggggcagatagttcgcttgatcatcttgtaaatatctaggttttaaagttaacagtttccggcaccagacctgtgttcactacggtaagtctggaatagtttcaaaactttcattgtcaactgtctcttcactgaaaatcaaatctcccctgcagattgcattgctccaatatgcataccgcaagcattgtggtctcgctaattcagggcagtgctggaaatgaagctgatgaccaccagccagcctacatggctggaagagtaactttctgttatttgttggcttaagtcagcagtaaagataagtcaccaaattacttattgaaaaatgtagccaaaggttgtggccttcgtctcatgattgtttgataagatattgttgttcctcagttatatatatttgaattttggtgatttgcacactaatcattgcttctaattatctgaataaaaagatcaaatatgactcactagctattttggttgctacatcaacataatagttcatttggctttttacctttttgacattttgaatttaatttatcttcgaattatctaagactctagtatatatcaatctaacccacatccttagcttggaaggccaagggttgtagacgacattaatcgctcatttttatatatatatttgatatctattattcaaaaccgaaaatgaaattttggtcttattcggcaactttataatgaatattttcaaattgtagttttcttataaatatactatcattcgaagttttatttttgaatcaacaattttagttaaagaaaccatgcaaaattgaaagtaaagagacatatagttggcttaatgtgttcgtaaagagatttgtgcgtagtgttaaagagcatacatacttcaatattaagaaatatttggatgtaaaaacacaattttagtggtaatatcagtagtaaatttttaagtaaatgtaaataagatgataatttgcatgtaaaacatttctaaaaaatttgttgaactatatttattacaagattgcaaacctaactttttttagattttgaaataataaataataatatttaacaaattttggtgattcataatttaactttactaaatttttattgggccgtagtgtgtaaacaacttgaatagactaaaaaacactattgggctgtagtgtaacaaaattgggctcaaatgaaaaaacaaaaaacaaaaaagagagacattaaaacgcacgtggagatagaattgtattcaactattcatcatcttcgtttggatttggtttctttctgtttctgacaaaaaccaccggcaaaataaagcgactacgattccattttcaccggcgcttccgtgagacaacatctctccatcttggaactttttctaatggcattattactcctttctcactgctctatcttatcttttcaacctccattatcgtcttcttcttcatttcattcttcacatatccaatctctgagcaaaccagttttcgcttctccttccccaattcgaaattcaatttcttcgtccgtctcttcatcttcttcctccgttagtagctccaattcgattcctcaggtcgtcgtaacacgagaacgaggcaagaacaatcaaatcatcaaagctttggtatgcatttcacagtgaattagatttgggatcatgaaattttctgaagttattcaaaattctgttctttactatggtgaaattgcaggagaaaaatggcatatcatctttagagcttccgttgattcaacatgcgcgaggacctgatttcgatcggcttgcttctgtattaaatggtgatttctgattcgtatacagataatggaggaaaactcttgcttcttcttatttctatgttatgcttaatatatgttgttggatggctatgtttactcttgcttctgtttactttttggtattctgatatgtttagtttcgttttattttgctagataagagctttgactggatcatcataacatctccagaagcaggttctgtttttctcgaggcgtggaagtaagccctggttcttgactcgttttgtgaattttgaactgtttcagtaagctatgtgttgtcagaagaaagctatggaatgtgttgctagtgagttcacttcttgtgttgtcattgttattgttattgataggcaatgggactagtctagcgttttatttagatattcagatatatgtgtaatcttcatggatatttctaacacaactatgtcaatagcgaggtttcccttgagttaaaccccattggtctccattcctcaggacagctagctccccagaagtgcaaataggtgtagtaggagctggaacagccagggtatttgaagaggcaatg

SEQ ID NO: 11404 - DNA, 3000 bp, Unknown
  misc_feature (1)..( 3000): cDNA_ID_2717375_gDNA_ID_2214494_Annot_ID_133539 3000 nt of promoter + ATG
tgttttagttcgtttaaatcttctatttttttttaatttaaggaattttagaccaaaaaattcagaatagtaagattaaatcaaaaacaaaaaatttgtttctttacaactaaaaacgatggtcatactcagtataagaaagaatttgtttggaacttagtgtgattggtttaaacgcagccaatgtggataaaattacaggagtatacaaaagtggacggttgcggttttaaatgttatcaagcagtttaaacgattggtttagcggttgaaaatatatgctttgtaaaaattatataattgataaaatagcggatgtgagaacgatataaagaaaagaaaatttgttaatcaagacggtcaaaaccaaaaagtttcgtccttcgactaaattttaatatgttatcggcttcaattcgaagtgaaaaccctagagaaccgaaagaaatcataaactctagtaattaatgttctaaaattataaaccaagaagggtgaggcccgtgagggatagatggagaggagacgatcataaactaagaagagtgtttataatgacgttttgaatttcctcaatgaaaccttctcacgttttgagaagtaggaaagctttgcaggtacacgtggcatttgagaattagctatcagagtgtttgtctacgtggcatcttgagagagtagtttaccaattgatgagattgatggtttgagaaatctcaataaattttttttcttaatagtaaattttcttaatttatattttaaattaaattatcaaaagtggttagttttgcaaatcatctttcttgattactcaataaatttctctctcatcatattatatatatatatatatatatatatattaaaagcattcaaattcagaaagcaaaaattgaaataataattctgctaatcggataattgtaataagatgatgacgacgacgaattaaggtgtcatttttggtacacattcactcacttactaatcatattcgagattgatgatttgccgtatcaaaattattcattgattttgggttccaattggtcttaataaaatataacactttgcaaatgttcaaacatacaaatttgtatgaaatgcaagatctatttaattctaaaagtattacattaaatcaaatgtaaccggtgaaaaagaataagaaaaaaaaacaaatgtaaccatttctttgcattatagttttaaatagacaaacttaaatataattacaagtacaactcttgattttatattgggatacagggataatagtataggtttgattggtgattatcaaccgcagttttttttcttgtcatcatttcaactgcaatttgggatccaaaaaacaaccaattgtaaatacttcacattggtgggtgagaataaaagtgtcaacttcattttccatctctttatctatctaatcaaagaattctatcaactcaatgatgaagaaacttcaactttgcatgtcttgagaaaaaaagatattccagcatatcaatgtcgaatcatgtgatttgaaaggataaaagtatattgctcacaaaatttctaagtgttttcgcggaaaataataataatatatgcgattctattcttttctttgtcaattgttccaaaaatacattacgaaattttacggtagagcaccacaaaaaaaaacgatattgctcaataaaacattcacatcaagaagttattgctcaataaaaaaaaattgttttgtaataaaaaaaacttttcttttaatatatttttatttttgtaactgtgaggttcaaccataaattttttttttattaaaaccaataaatatagcttaaatctctttcaaacttttttacatatgtgactaaccatcagtgacaattcgaatttaatattactcacggtctagcagatgtgttataaattttgaaatcaattataattttacaaattatatcaaacttggactttgagtatgtctctatttgccttaaatgatcaaatattacataaacaaaaaaacttgaaattaaggttattaataaataatttaatatttatttttgaattttggtggatttagaaagaataaaagtattttttctgggaaaatatgcatatttatattatttgaattgagtatagtaaactaagggtgttaaatgaaaaacaaattgttgtatgtacaaattgacttcatttggtcaatgaaagaaagttgcagtgttgggggataagtattgagcggcggctaaaatactaaagattttctaatattgccataaaagatattttttgtaactttctatttgtcacggcactgattttttcaaaactcccatgacacagctgtctttaccccataatatattgaacgtaaagtaacttctttgaccaattgaccatgcttagttgcttacgttgtttatacaaaagattcattgttggaagtataagtagcagtaatattacatcgtaggttgttttctctcattaacatcgtctctaggtgactagaagaacgatcctttgtgtgtgaactcgtgagcagaatctaaacgaaaattatataaagcttagaattcattagaaaaaagtgacataccaagaaacccgaaaatggggaagttaatttcatttgaacaaaaaaaaacattgtagttttgtaataaaagggttgacatggtcttaatgtggaagaagtaaagaggctcacgaaaagtccatgttgtctacaaaggaagaaacaagaaccaatagaattagagttcaaaccaaaggacgaagtatgcaagttaatttgacaagctaatatcctaagaatgaagacatggtctaactttgaaacagcagccactagtgtcctataaatacatagagttcattaacctctcataatatctcacaatcaaagttctatctcctcaagtatcaatacattgatatccattaaaaaaaagaaatatcaatacattgctttgcttgttctgtaagatg

SEQ ID NO: 11405 - DNA, 3000 bp, Unknown
  misc_feature (1)..( 3000): cDNA_ID_2706409_gDNA_ID_2214494_Annot_ID_133540 3000 nt of promoter + ATG
caattcaaataatataaatatgcatattttcccagaaaaaatacttttattctttctaaatccaccaaaattcaaaaataaatattaaattatttattaataaccttaatttcaagtttttttgtttatgtaatatttgatcatttaaggcaaatagagacatactcaaagtccaagtttgatataatttgtaaaattataattgatttcaaaatttataacacatctgctagaccgtgagtaatattaaattcgaattgtcactgatggttagtcacatatgtaaaaaagtttgaaagagatttaagctatatttattggttttaataaaaaaaaaatttatggttgaacctcacagttacaaaaataaaaatatattaaaagaaaagttttttttattacaaaacaatttttttttattgagcaataacttcttgatgtgaatgttttattgagcaatatcgtttttttttgtggtgctctaccgtaaaatttcgtaatgtatttttggaacaattgacaaagaaaagaatagaatcgcatatattattattattttccgcgaaaacacttagaaattttgtgagcaatatacttttatcctttcaaatcacatgattcgacattgatatgctggaatatctttttttctcaagacatgcaaagttgaagtttcttcatcattgagttgatagaattctttgattagatagataaagagatggaaaatgaagttgacacttttattctcacccaccaatgtgaagtatttacaattggttgttttttggatcccaaattgcagttgaaatgatgacaagaaaaaaaactgcggttgataatcaccaatcaaacctatactattatccctgtatcccaatataaaatcaagagttgtacttgtaattatatttaagtttgtctatttaaaactataatgcaaagaaatggttacatttgtttttttttcttattctttttcaccggttacatttgatttaatgtaatacttttagaattaaatagatcttgcatttcatacaaatttgtatgtttgaacatttgcaaagtgttatattttattaagaccaattggaacccaaaatcaatgaataattttgatacggcaaatcatcaatctcgaatatgattagtaagtgagtgaatgtgtaccaaaaatgacaccttaattcgtcgtcgtcatcatcttattacaattatccgattagcagaattattatttcaatttttgctttctgaatttgaatgcttttaatatatatatatatatatatatatataatatgatgagagagaaatttattgagtaatcaagaaagatgatttgcaaaactaaccacttttgataatttaatttaaaatataaattaagaaaatttactattaagaaaaaaaatttattgagatttctcaaaccatcaatctcatcaattggtaaactactctctcaagatgccacgtagacaaacactctgatagctaattctcaaatgccacgtgtacctgcaaagctttcctacttctcaaaacgtgagaaggtttcattgaggaaattcaaaacgtcattataaacactcttcttagtttatgatcgtctcctctccatctatccctcacgggcctcacccttcttggtttataattttagaacattaattactagagtttatgatttctttcggttctctagggttttcacttcgaattgaagccgataacatattaaaatttagtcgaaggacgaaactttttggttttgaccgtcttgattaacaaattttcttttctttatatcgttctcacatccgctattttatcaattatataatttttacaaagcatatattttcaaccgctaaaccaatcgtttaaactgcttgataacatttaaaaccgcaaccgtccacttttgtatactcctgtaattttatccacattggctgcgtttaaaccaatcacactaagttccaaacaaattctttcttatactgagtatgaccatcgtttttagttgtaaagaaacaaattttttgtttttgatttaatcttactattctgaattttttggtctaaaattccttaaattaaaaaaaaatagaagatttaaacgaactaaaacaattgatacaaatttattttctattaaacaatattacattaaagatcgaatccgggtcgggtaatgtaactcaaaacttgcttggtgcgaccctctccactttgccagcctcattcatctctaaaaataaacaaaaaccagtttttttgttgttgttcaggtcaagtagtttggtttaactactttttatacgtggaccaatgaaacaccaagaagccactaattttctttattaaaaactaaaactgaataacaaaataactaaaaaaaaaggaaaaaaaataaaataaacaaacaaaaccgaacattatgaaagagagagaatgccagatggatgatgaagatgagccgatgagagatagcttcatgatttgtctccgcgaccgcagttatctctttctaatttctgtctgaaataataaattaaacttcttctactacctccgatcatcataatcctccggtaagacttctcttctcttcttgaatcttcttgatgcagcttttttttgtcggcatacaacttttgtatttttcatattttttttttctccagctgataaactcagaattcttgaaattcggaaacttttcatttttctttgaattgtaggaaattatcattgttcgtatttatcttcttaaaaaaacactattaaatcctggaattggtaattatttactcacgtttccgaatttgtttacacaaagatgaaaatccgatgatcttgattaaagtatgtttgattcttgtataccatatttgtttgattagagtaatttgatcatcaaagatgttttgtattcaattttttctcaattagtctttatgttttgtagcaatttcaggttacagggga

SEQ ID NO: 11406 - DNA, 3000 bp, Unknown
  misc_feature (1)..( 3000): cDNA_ID_4359853_gDNA_ID_2214494_Annot_ID_133542 3000 nt of promoter + ATG
agcatcttgcaacgccatgtaagcagcatcaatctgagcatcaagcatgttatcgtaatgcaaatcggttttcgggtcatatatcccttccgttggcttgaaaagagcatagttgatatcaatctccttcggattataagtgtacgccaaaaaagggtaagcattcaaacaaaaaggagacccaatctgctgaaaaaactccaacaatggcttcatgaactgaacaacattctctttaaacacacaagacgaaggcgggtaggaatcagaaaacacagcctgtgaatgagccgtagtgatctgcacagtgtcctccagattcattttcttcaacgcattgtacacatttttagcagcaccaagtaaagctcccgcgagctcagaatcaccgcctccaagaacttcgttacctatagcgataccgcgaatccgagtcttgggtaagaaagactgaatattttctttaacccaagagaaagcatgatcagcatttgaactcatctcttttaaaaacccattaggaagtccaacaacaaggtctaaaccagttccactaaaagcttcaagaacagtgtgatctacatcgtatatacgcacattccgaattttagcttgctttagaagtaaaactactttctccggagatggtatgttgtcagctatccttccataatttatcccatatgttccaacaaatgctccatcaacttgatactcttaaagatcaaaaaaaaaaaaaaaaaatcatcagaaaaaaaacaaccagaaattcaaaatcataacatttaagattcaactatgtttgatcaatcaacgaaattagcaaaacccaacatcgtaataagagttgaaaattgaaatttaaacttaacctagaattttttttttagcaatagaattaataatagaaagacactgtaccaagcgaagtcagattgaagaagaagaagaagaagaacttgagaagaagtaacttagaacttctcatctgagaagagttatcagaaaactgtggaaaaaaagtggaagaagaagcaaagggtcatcgagagtaaacgggaatctgattcgacagcgacatcgaagcaatcagatacttacgatcaaaacagtttttcaggtaaacgcaaaaagtctagaagagattgatgaagctggagaagaagaagaagatgattgtgcttcacttgaatgatttgcaaaaggagaattttcaaaagagagattttttgttcttctgggttttgggcttttgggtttgattggagtttcttgttttcgtcactgtcgaatatatgaataacactttactttttttttattcttgttgaaacttttttatttggttattaaaataagaagttaaattgaatttaataagaaatgataaagaagaataataagatggaaatttcgtagtggttaagtagtgatgtggttggacggtgagtttctttggacgtaccaacattacagctaaatcagacgtgtatggacctcattgtattactttttctcaagtgctttttttctgtttgtaaaatgtatgtttgtttactagggttccaacttttcttgtagactttataatttaactttttagttttgtatagaaagatggatgattgagaatttagcagactatttagatattggctgcgttaagtgatatgagagaggtttggtagagaattagcctaattagattatggaataatcaagtgattaagtttgcaataaataatgtgagttttctaagttaagtgatctgatcattcacttgaactgaatatattaaggctgcaaatggttggataacgatgaaaaaaaatagaaaatttgagttgaaaaaaaaaagttgaatactattcaactcattcctctgcgatattcaactcattcctctgcgaaatatgagatgaacaagttataactttatttttaataattagttcatttttccaacttgaaatggttgtattatttttccaacttattcattttaaatggtaaaatattagatgaatgctcattcaattctttcaacttcttaattctaggcaatcatttgcaccttaaaatttatataaaaaagatagttatttcgaaaaaccctctaaatcaatttgactctcttaatatagattaataatatgacctcaatcgaaccactctgtaatctaagtggatcacgataccatcatttcccatatcgaattcttccaaatgaactactctctaaaccttaatgtttcccccaaatcgatatttcaatggatattttctttaattttcatgtcattttttgttatgttttatggcacaagaaactaatgaaattcatgtcctttttagcgatgtcacgtcatcgatatgaccgaagtttattttgcggatgactttagagttcatatgattaacttgtatagttcggatatgaatggtagatttgtaaacgaaattgacttacaggttttgtttgcagcaaacccaaaaattaaaagcctaatgaagaaaaattcggattgggcttggagttgttcggatgaattgttgtttgtagccttataggggcccttgtttatacaagaagaaagaaaaaacacaagagacgacgcaattgaaagaaaaaaaaaaacgagaagcgttttctttctctccaaaatccattactcgcgaactttcctctgctaaggtattctttaaccttgtcaacacactagccttaaggttgtaaatctctctctctctctctctttttttcaatttctacgaagattggtaaccctagcgttttgttatcttcgcttcaatctgctctgttcgagatttggttttgcaattttcacggatttcgttatctttagtatacatatgattgttgtcaataaactttgcagaagaacttgttttaagccttgatctaagagcaccaagctgaatttattctgatttctctgtttactgaatagtgttcactagaaagaggtggtgattatg

SEQ ID NO: 11407 - DNA, 3000 bp, Unknown
  misc_feature (1)..( 3000): cDNA_ID_3039813_gDNA_ID_2214494_Annot_ID_183780 3000 nt of promoter + ATG
ggttgattgaggtattgattgactgaagagcacaattctgcatcaccttcagctcttggctcctgcaaaataatttagaaatagagttctgagagacaaacaagatcaaagatataagtgattaaggtgaacaaacatacaaacatatctttaagaaaacaaacaagtaacctgcatccagaagaataacttgcggtcatcactgttgaacttcagaatatacaccctgtctgaggattgattaaccttttcaaatagagcttcatctgggaaaacaatttgatcctataaataggtatggtcaaggagaaaacttcgtaactggaacatctggtagcaacaattaataaatccttcagtttttgttctattcatgcatggcaaaaaataaaaaaacctcctaggtggatagagctaagaaatttgaccgtcttgggtcacgaatccactggtatagcaaagacttgatactaggagaatctctagtccttttctaaaattcaaaaaaacaagtgcagaggatacatcttctactgtattctggtttcgatcaagccactggaaatgaatcagtccctcgtcaccctaaaagaaaggataacaggattaaaaaacctaggttaacatttacagagaaccagtaataaacgtgttctgacaccaacaattagattccgatatgctttaacttcaataggaaaagctgatacactccaacgttcaatggaaacgaataaattcaaattactaaatggaaactaaaagcgtcgacattactctagctatgcggacaagtccttttcgtgcatcagggacaactcttgttccctgcaaagacatcttcccagcacgaaactcaagcatgatctcctgccaaaattagtccaaacataagtgtaagaaccttcgtaattagtctaagaacaataagagaaagataaacaccacctatagttacctgcatcacgggaaacgcttcgcttgaactcataatcaccacctctttctagtgaacactattcagtaaacagagaaatcagaataaattcagcttggtgctcttagatcaaggcttaaaacaagttcttctgcaaagtttattgacaacaatcatatgtatactaaagataacgaaatccgtgaaaattgcaaaaccaaatctcgaacagagcagattgaagcgaagataacaaaacgctagggttaccaatcttcgtagaaattgaaaaaaagagagagagagagagagatttacaaccttaaggctagtgtgttgacaaggttaaagaataccttagcagaggaaagttcgcgagtaatggattttggagagaaagaaaacgcttctcgtttttttttttctttcaattgcgtcgtctcttgtgttttttctttcttcttgtataaacaagggcccctataaggctacaaacaacaattcatccgaacaactccaagcccaatccgaatttttcttcattaggcttttaatttttgggtttgctgcaaacaaaacctgtaagtcaatttcgtttacaaatctaccattcatatccgaactatacaagttaatcatatgaactctaaagtcatccgcaaaataaacttcggtcatatcgatgacgtgacatcgctaaaaaggacatgaatttcattagtttcttgtgccataaaacataacaaaaaatgacatgaaaattaaagaaaatatccattgaaatatcgatttgggggaaacattaaggtttagagagtagttcatttggaagaattcgatatgggaaatgatggtatcgtgatccacttagattacagagtggttcgattgaggtcatattattaatctatattaagagagtcaaattgatttagagggtttttcgaaataactatcttttttatataaattttaaggtgcaaatgattgcctagaattaagaagttgaaagaattgaatgagcattcatctaatattttaccatttaaaatgaataagttggaaaaataatacaaccatttcaagttggaaaaatgaactaattattaaaaataaagttataacttgttcatctcatatttcgcagaggaatgagttgaatatcgcagaggaatgagttgaatagtattcaacttttttttttcaactcaaattttctattttttttcatcgttatccaaccatttgcagccttaatatattcagttcaagtgaatgatcagatcacttaacttagaaaactcacattatttattgcaaacttaatcacttgattattccataatctaattaggctaattctctaccaaacctctctcatatcacttaacgcagccaatatctaaatagtctgctaaattctcaatcatccatctttctatacaaaactaaaaagttaaattataaagtctacaagaaaagttggaaccctagtaaacaaacatacattttacaaacagaaaaaaagcacttgagaaaaagtaatacaatgaggtccatacacgtctgatttagctgtaatgttggtacgtccaaagaaactcaccgtccaaccacatcactacttaaccactacgaaatttccatcttattattcttctttatcatttcttattaaattcaatttaacttcttattttaataaccaaataaaaaagtttcaacaagaataaaaaaaaagtaaagtgttattcatatattcgacagtgacgaaaacaagaaactccaatcaaacccaaaagcccaaaacccagaagaacaaaaaatctctcttttgaaaattctccttttgcaaatcattcaagtgaagcacaatcatcttcttcttcttctccagcttcatcaatctcttctagactttttgcgtttacctgaaaaactgttttgatcgtaagtatctgattgcttcgatgtcgctgtcgaatcagattcccgtttactctcgatgaccctttgcttcttcttccactttttttccacagttttctgataactcttctcag

SEQ ID NO: 11408 - DNA, 3000 bp, Unknown; identical to SEQ ID NO: 11405
  misc_feature (1)..( 3000): cDNA_ID_2706409_gDNA_ID_2214494_Annot_ID_183776 3000 nt of promoter + ATG

SEQ ID NO: 11409 - DNA, 3000 bp, Unknown; identical to SEQ ID NO: 11404
  misc_feature (1)..( 3000): cDNA_ID_2717375_gDNA_ID_2214494_Annot_ID_183774 3000 nt of promoter + ATG

SEQ ID NO: 11410 - DNA, 3000 bp, Unknown
  misc_feature (1)..( 3000): cDNA_ID_3039833_gDNA_ID_2214494_Annot_ID_183772 3000 nt of promoter + ATG
acccaggagaaaacattggtataactgaggaaatgagattcgtcgccatgagattacgcaatgttaatggtaaaaaattagatctttctgaagataaaactgacaccgagaaggaagaagaagaagaagaagaagacgatgatgatgatgatgaagtaaaggaagagacttggaagcctagcaaagaagggtttcttaagtacttagttgatagcaagcttgtcttcgatactattgaacgaattgttgacgaatctgagaatgtgtcttgtaagaaccctactttggtctcgaatttgacagtttggtaatgatttgggttaatggggtttgtgttcaatgtacagatgcttactttaggagaacaggattagagagatgtgaaagtattgagaaggatctacaatggttaagagaacaagatttggttataccagaaccaagtaatgtaggagtttcttatgcaaagtatttggaagaacaagcaggagaaagtgctcctttgtttctttctcatttctacagtatctacttttcacatattgctggtggtcaagttcttgtaagacaggttagtttctttggaaagctttcataaagtaacatagaagagttatataactgcataaggtcacatccagcatattgaatggttaaagctagttcgatatattaaagattagtatcgatataaatggattcaggagagttcgatttatcgggagttttgctggtttttagtatacttttcacacattgctggtggtcaagttatttgtaagacaggttagtttctttgataagtgttcacagagtaacatagaagaaattttcaactgcataatgtcacatctaggatattgaatggtaacagctagtttgatagagttagagattgatatagatatagtggattcaggagagttgggtttatcgggagttttgcggttatggtgggtatgagagagtggcgataagaatgagaatgagaatgtgagaagatttccattcttcttcattgagactcaacttacaaatagaactgtgataaagaaacactcagatcctaaaccaaaaccaaccaacaccaggcttgctcaattagtttaaagcttgccccaaaagaacttgttaaccgactgttagttaggttaatgtggtattaaccaacgggtgaactatgcttttgtctttatttttgagatttatcataactgtacattctttttgttggttctgttgtgttctggttcttacttttatcaatatatcccatgatttggactgtcataattgtttggtaacccttatatgcgaggtgttcaaatgtaactgatcagttgattcattaaggtatctgagaaacttctggaaggaaaggagctggagttcaataggtgggaaggggatgcacaagacttgcttaaaggcgtccgtgagaagcttaacgtgcttggggaggtcagattgtcaatgaaaattataactcttcattccaccagttgctaaaatctgatgttttggtgatgcttttgggaaatgaagcactggagtcgggacgagaagaacaaatgcttgaaggaaacggcaaaggcatttaagtatatggggcagatagttcgcttgatcatcttgtaaatatctaggttttaaagttaacagtttccggcaccagacctgtgttcactacggtaagtctggaatagtttcaaaactttcattgtcaactgtctcttcactgaaaatcaaatctcccctgcagattgcattgctccaatatgcataccgcaagcattgtggtctcgctaattcagggcagtgctggaaatgaagctgatgaccaccagccagcctacatggctggaagagtaactttctgttatttgttggcttaagtcagcagtaaagataagtcaccaaattacttattgaaaaatgtagccaaaggttgtggccttcgtctcatgattgtttgataagatattgttgttcctcagttatatatatttgaattttggtgatttgcacactaatcattgcttctaattatctgaataaaaagatcaaatatgactcactagctattttggttgctacatcaacataatagttcatttggctttttacctttttgacattttgaatttaatttatcttcgaattatctaagactctagtatatatcaatctaacccacatccttagcttggaaggccaagggttgtagacgacattaatcgctcatttttatatatatatttgatatctattattcaaaaccgaaaatgaaattttggtcttattcggcaactttataatgaatattttcaaattgtagttttcttataaatatactatcattcgaagttttatttttgaatcaacaattttagttaaagaaaccatgcaaaattgaaagtaaagagacatatagttggcttaatgtgttcgtaaagagatttgtgcgtagtgttaaagagcatacatacttcaatattaagaaatatttggatgtaaaaacacaattttagtggtaatatcagtagtaaatttttaagtaaatgtaaataagatgataatttgcatgtaaaacatttctaaaaaatttgttgaactatatttattacaagattgcaaacctaactttttttagattttgaaataataaataataatatttaacaaattttggtgattcataatttaactttactaaatttttattgggccgtagtgtgtaaacaacttgaatagactaaaaaacactattgggctgtagtgtaacaaaattgggctcaaatgaaaaaacaaaaaacaaaaaagagagacattaaaacgcacgtggagatagaattgtattcaactattcatcatcttcgtttggatttggtttctttctgtttctgacaaaaaccaccggcaaaataaagcgactacgattccattttcaccggcgcttccgtgagacaacatctctccatcttggaactttttctaatg

SEQ ID NO: 11411 - DNA, 3000 bp, Unknown; identical to SEQ ID NO: 11402
  misc_feature (1)..( 3000): cDNA_ID_3039843_gDNA_ID_2214494_Annot_ID_183769 3000 nt of promoter + ATG

SEQ ID NO: 11412 - DNA, 3000 bp, Unknown
  misc_feature (1)..( 3000): cDNA_ID_2989965_gDNA_ID_2214494_Annot_ID_183768 3000 nt of promoter + ATG
agatatagaggctgtggagatggccatgggatttgtccagagtaatcaacccttcttgtgggtgatccgaccaggctctataaacggacaagaatctttagacttcttaccggaacagttcaaccaaacggtgaccgatggaagaggttttgttgtgaaatgggccccacaaaaagaggtattaaggcatagagcagtgggagggttttggaaccatggtggatggaactcgtgcttggagagcataagcagtggtgtaccaatgatttgtaggccgtattctggtgatcagagggtgaatactcgacttatgtcacatgtttggcaaaccgcgtatgagatcgaaggtgaattggaaagaggagctgttgagatggccgtgaggaggctcattgtggatcaagaaggtcaggagatgagaatgagagccaccatattgaaggaagaggttgaagcctctgtcacaaccgaaggctcttctcacaattctttaaacaatttggtccatgcaataatgatgcaaattgacgaacaatgataagtggtaaatttggtgagaacgaaattacgtgtgtggtgttttaatttttaaataaaaatatgtgtttgaagtaatagcggtttttgatgaataaattttacattcatccaaaaaaatacagcaattttgtattgttcttaagttcttaatggttgaagctaattttaggatacaatgatattttcattggtgttaataacaagccagtttttgacatgtgccaagtgtgtatttgcgtacgtaggatccaatcttctttgcaattttatttgtagctattaaggaatatttgtaaataatttatagtttttataaaataaacatgtaagagcatactcactaaacaattcttgatcggtatctttactatatattagtaaataaaatttaagacattatctttccagtgtctaaaatgtcttcctaaagacacaaatgtaatgctaaaagacacttcccattttttaatagggaaaaatgtcaaaaaaagcgcgaactttaaaatttgggacgataaaagcatgaactttcgaaatgtcatttaaatcataaaatttcatttgactttttaaaaaaattgtcaagtttcgttgacttgaccattttgggcacgtcgttaaatttccgttaacagcattaactttctgttacaaatttctgttaaatcgaaacgacgtcgtttttagatctccaaaacgacgtcgtttcattagaaaataatgatgcaaaatccgcgtccgcaatggctcgaacatatgacctattggattcatatagggcaatataccgctgagctacgacaataatttacaataataacaaacattgcatacatatactaaccaatataatatactattaattaaaaatatatgcaattaattaaaaataacaaaattaaaaaatatatattaaataaacttaccataatatattttaaatttcaaatatttaattatatatataaagacatcttctatatttgaaaaattatagatctctctagaattcacataagtctttgcaattgtatttttggaatagataaaaactgaaaaactgaaaattgaaaataatttgcataagtcttttctattgtattttctaaatttggaatacttaaaaattgaaaactaaaaataatttctcaaatataaaaaacatctatatagaaatttaatatttcaaatttcaaaatatatatgtatggtaggtatatttaaaaactttgtatatatttgtttttttgtagttttgtaatatataatttattgtatatattttaaattaattgtatagttttatttgttagtatatatatgctatgttttttttttatcaaactgttctcgtagctcagcggtagattgtcctttaggagtccaataggtcagatgttcgattccatgtgaatgcggatttagcatcattattttctaacgaaacgacgtcgttttggaagctccaaaacgtccaaaacgacgtcgtttcgatttaacagaaatttctaacagaaggttaaccccgttaacggaaatttaacgacgtgcccaaaatgaccaagtcaacgaaacttgacaatttttttaaaaagtcaaacgaaactttgtgatttaaatgacaattcgaaagttcatgtttttttcgtcccaaatttgaaagttcgcgcattttttgacatttttccctttttttatcatattttttattagttttttatttaaagacacccacacataatgatcaatgtggatgctcttacatgcctacaaaacaaacctattttatagttcttctttgggttttcaaatgttcttataatagagattgtgtatagattgagcattatcgatccaaatatataaaaagagaaagaaaaaaatatatatgatttatacccattcattgttttataatgatcggtagacgttgaaaacccaaaaatgataaaattagtagtagctaattgagttctagaaataaggtttgtaaacctcattagtttttttgacatgggatacgacttaagactactaattattaattgttctatttctgttgacacttattttaagaggaaatcgaccctgtttctatttttagggaagaaataaatagtaaaagattgctaggagttagaatattaattttgtaagatgttagatgtgaagtaacaaaagaatgccaaatatagattaagttgacggacacggtggtgaaccaatgaattttcacatcaataatcaaaaaaaggtttaaccaatcattcatctatttgcttcctgccacaactatatttgcatcaccccattgttcttaagctaaaaccaaacccctttcaatctcaaatctaattttaaatctaccttttcttttgtttttttctctcctcacaaattactcaatttatagttgttaattttttgaggagaacaagaaggtggtagtattatttcaaa

SEQ ID NO: 11413 - DNA, 3000 bp, Unknown; identical to SEQ ID NO: 11401
  misc_feature (1)..( 3000): cDNA_ID_2706438_gDNA_ID_2214494_Annot_ID_183767 3000 nt of promoter + ATG

SEQ ID NO: 11414 - DNA, 3000 bp, Unknown; identical to SEQ ID NO: 11400
  misc_feature (1)..( 3000): cDNA_ID_2706446_gDNA_ID_2214494_Annot_ID_183765 3000 nt of promoter + ATG

SEQ ID NO: 11415 - DNA, 3000 bp, Unknown; identical to SEQ ID NO: 11397
  misc_feature (1)..( 3000): cDNA_ID_2706401_gDNA_ID_2214494_Annot_ID_183757 3000 nt of promoter + ATG

SEQ ID NO: 11416 - DNA, 3000 bp, Unknown; identical to SEQ ID NO: 11396
  misc_feature (1)..( 3000): cDNA_ID_3039869_gDNA_ID_2214494_Annot_ID_183753 3000 nt of promoter + ATG

SEQ ID NO: 11417 - DNA, 3000 bp, Unknown
  misc_feature (1)..( 3000): cDNA_ID_3039872_gDNA_ID_2214494_Annot_ID_183751 3000 nt of promoter + ATG
gggtaaggttactcattttgacatctttggttaaaatagttacctctagttttgtttcagtcccacatctcaatttgttttaacacagtcatttcgtcgaacacctcatatgcgttgttgttgtatactaaattactaatactttaaacaaagactaacaaaaatggcttaattcgataatcaaaaccactatttggatcaaacgttgactaatctcacttaaatcactcttctgttttcctctaatgacggatgaagaacagagttagttttcaaggtttatccacagatccactgaaatcaacaatggtgaataaagctccgaagaggaaacatgtatcacctgaatctctccttctctctattctcaatgatttgttgtttctaaattctcaaaagcttgactcttgtttccgtagaaaatcgaattcagatgcgtgtagctttatagttagcttaaattttgcaaaagttggaaattttacttcaagatccaatgaaattgctccattgatcaatgaagctgttgctaaaggcaagaactttgatactgggtgaggacaagaaccttgtagatactgtttttctttaaaacatttgtgtctaaactacatgttttgttaggacaagagttggattagatgttggtcatcttcttaaatctgcattagctggaggaatctcatgtgctttctctgcttttttgatgcatccagtggatactgtcaaggtataatggtaatttcatttcaggttcttcttttgtgtttatgagattgttctgattacttacatttgtcttggatcattaagacacaagttcaagcatcaactacattgtcgtttctcgaaatattgtcaaagattccagagattggtgctcgaggtttatacaaaggctcgattccggctgttgttggtcaatttgctaggtttcatctcttatgctttgccttgtggttattggttataagcattatcatgatttcatctcttgtttaaacatttttcagtcatggtttacgaacaagtatatatgaagcaagtaaacttgcgttaccgctcgttgctcctactcttcttgatattcaagttagtaattgtaaaaagctcattgccaactttattgctacataatgtttcgttctttgaatttttttgcttcttgattattttaggttcagtcaatcgcgtcttttattggtacggtattggggacaacgttgcgaataccgtgtgaagtgttgaaacaacggttacaagccaaccagtttgataacatagtggaagctacagtttcgacttggcatcaagaagggctcaaaggactctttcgtgggaccggtgttacccttctacgtgaggttcccttctacgttgctggcatgggactttacaaccaatcaaagaaggtaatcatgatagaacagaacaatgacatgtctttgtgtaattaataagacgtggttgcgattgagtttcacaggtggtggagagacaattaggaagagagttggagccgtgggaagccatcgcggttggagccttgtccggtggtttcactgcagttttaacaacgccattcgatgtgattaaaacaagaatgatgacggctccacaaggcgtggaattgtcgatgttgatggctgcttattcaattctcacacatgagggtcctcttgctttctacaaaggagctgttccaaggtttttctggactgctcctctcggagccttgaacttagctggctatgaacttcttcaaaaggctatgatcacacctctgaatcaatcagtgcatagtgagtaagattggaaaactagaccaacattttgtgttataataatttatttcatgtttatgtattctaaatcttgagaaaaaaaaatatattctacaaaaataacataatttacttctttttttttttctcaagtgtagtattgtattaaacgtaacccgatcatacacgggctacactaaaagccccacgaaaagtttacagaaatatttgaggcccaacaagagcctatcggataaccgcatactgcataagaaaatttgtttgtactccacctaagcccacgtgtcagcaactggatacaaccacgacacatgctggatgagtaatcgaaagatttccgacatcaaccttcgccgttgagcatcgatttcggtgagaagattatcgccgaaatataatcggtcgttgaatcctttgtttgtcaccgttgctaagctaatcgaaactccaaaaagaaactaacagctttaaggcaatcataatatgcttcgaaagattcttctttccttatgtctctggaaagatttctgcaaaccaaaagctcaaaagaaacaagtcggagaaatccattctttaagtgacacaacacctaaaacatcatcaccaactcagatctaatgagattattgaaacaaaaaaacttaacaaacccaaaactggccgaagacaccgtaaacaagacggcaaatcgccagacataagccagccaacactactttagaagctagtcgatgctggacaggagccggataaaccggacggcgaggatagaacatgcatatgagatcacgatcggactttaccaaaaaaacaaactctctctctcaaaagtttttgagagagaagagagaaagttttcgtcaaggttaatatctcctttaataatttaattatggaaacactttgctcggatttatttttaacataatttacttaacatcatgtattctaaaaaactaatcagctcacccgaatcgattgactattacaaaatactgcttaatatagacaaatatttgatcataaaaataattaaaaagattataattaataaaatattattgatctcatatataaatggcatcgatacatttgcaaatatttatttttcctttgaattaaaaaaaaatatcaaaggccgaataaaaaacatcattcggcaagttcatcgatccacgaaaaaaaagaaacgatg

SEQ ID NO: 11418 - DNA, 3000 bp, Unknown
  misc_feature (1)..( 3000): cDNA_ID_2717367_gDNA_ID_2214494_Annot_ID_133543 3000 nt of promoter + ATG
aagaaaacaaacaagtaacctgcatccagaagaataacttgcggtcatcactgttgaacttcagaatatacaccctgtctgaggattgattaaccttttcaaatagagcttcatctgggaaaacaatttgatcctataaataggtatggtcaaggagaaaacttcgtaactggaacatctggtagcaacaattaataaatccttcagtttttgttctattcatgcatggcaaaaaataaaaaaacctcctaggtggatagagctaagaaatttgaccgtcttgggtcacgaatccactggtatagcaaagacttgatactaggagaatctctagtccttttctaaaattcaaaaaaacaagtgcagaggatacatcttctactgtattctggtttcgatcaagccactggaaatgaatcagtccctcgtcaccctaaaagaaaggataacaggattaaaaaacctaggttaacatttacagagaaccagtaataaacgtgttctgacaccaacaattagattccgatatgctttaacttcaataggaaaagctgatacactccaacgttcaatggaaacgaataaattcaaattactaaatggaaactaaaagcgtcgacattactctagctatgcggacaagtccttttcgtgcatcagggacaactcttgttccctgcaaagacatcttcccagcacgaaactcaagcatgatctcctgccaaaattagtccaaacataagtgtaagaaccttcgtaattagtctaagaacaataagagaaagataaacaccacctatagttacctgcatcacgggaaacgcttcgcttgaactcataatcaccacctctttctagtgaacactattcagtaaacagagaaatcagaataaattcagcttggtgctcttagatcaaggcttaaaacaagttcttctgcaaagtttattgacaacaatcatatgtatactaaagataacgaaatccgtgaaaattgcaaaaccaaatctcgaacagagcagattgaagcgaagataacaaaacgctagggttaccaatcttcgtagaaattgaaaaaaagagagagagagagagagatttacaaccttaaggctagtgtgttgacaaggttaaagaataccttagcagaggaaagttcgcgagtaatggattttggagagaaagaaaacgcttctcgtttttttttttctttcaattgcgtcgtctcttgtgttttttctttcttcttgtataaacaagggcccctataaggctacaaacaacaattcatccgaacaactccaagcccaatccgaatttttcttcattaggcttttaatttttgggtttgctgcaaacaaaacctgtaagtcaatttcgtttacaaatctaccattcatatccgaactatacaagttaatcatatgaactctaaagtcatccgcaaaataaacttcggtcatatcgatgacgtgacatcgctaaaaaggacatgaatttcattagtttcttgtgccataaaacataacaaaaaatgacatgaaaattaaagaaaatatccattgaaatatcgatttgggggaaacattaaggtttagagagtagttcatttggaagaattcgatatgggaaatgatggtatcgtgatccacttagattacagagtggttcgattgaggtcatattattaatctatattaagagagtcaaattgatttagagggtttttcgaaataactatcttttttatataaattttaaggtgcaaatgattgcctagaattaagaagttgaaagaattgaatgagcattcatctaatattttaccatttaaaatgaataagttggaaaaataatacaaccatttcaagttggaaaaatgaactaattattaaaaataaagttataacttgttcatctcatatttcgcagaggaatgagttgaatatcgcagaggaatgagttgaatagtattcaacttttttttttcaactcaaattttctattttttttcatcgttatccaaccatttgcagccttaatatattcagttcaagtgaatgatcagatcacttaacttagaaaactcacattatttattgcaaacttaatcacttgattattccataatctaattaggctaattctctaccaaacctctctcatatcacttaacgcagccaatatctaaatagtctgctaaattctcaatcatccatctttctatacaaaactaaaaagttaaattataaagtctacaagaaaagttggaaccctagtaaacaaacatacattttacaaacagaaaaaaagcacttgagaaaaagtaatacaatgaggtccatacacgtctgatttagctgtaatgttggtacgtccaaagaaactcaccgtccaaccacatcactacttaaccactacgaaatttccatcttattattcttctttatcatttcttattaaattcaatttaacttcttattttaataaccaaataaaaaagtttcaacaagaataaaaaaaaagtaaagtgttattcatatattcgacagtgacgaaaacaagaaactccaatcaaacccaaaagcccaaaacccagaagaacaaaaaatctctcttttgaaaattctccttttgcaaatcattcaagtgaagcacaatcatcttcttcttcttctccagcttcatcaatctcttctagactttttgcgtttacctgaaaaactgttttgatcgtaagtatctgattgcttcgatgtcgctgtcgaatcagattcccgtttactctcgatgaccctttgcttcttcttccactttttttccacagttttctgataactcttctcagatgagaagttctaagttacttcttctcaagttcttcttcttcttcttcttcaatctgacttcgcttggtacagtgtctttctattattaattctattgctaaaaaaaaaattctaggttaagtttaaatttcaattttcaactcttattacg

SEQ ID NO: 11419 - DNA, 2675 bp, Unknown
  misc_feature (1)..( 2675): cDNA_ID_2706425_gDNA_ID_2214494_Annot_ID_133545 3000 nt of promoter + ATG
cttttgtgatttattatatgaaaagggttctgtcttctgagattggggcttcgaactcttgttgctgctcgaattcgatctagagaccaggtacttagtttttgttttgtcagattaataagagtttcacaatttgtagttttgtttttgtttctgggctttgaactttttatcaatctctgattgttttaaaatggttttgttgtgataaaatagtttcacttatttctacttctctgcacacaaaaaaaacttatttcttcttcaaattttcatttatttttgttgcaatattcctataaaagaaccgagaacttggaaaagaaataagtaaaactgattgataagagtgtacgaaatcgactaagtaccttggtagtgacggattcacccacttttgaaggccagctattatattggtttagcacccataatcgctaatgatccttttatgtttagtctgttcgtttgttcaccgcaggcggcagcggcagcggcggcgggaaactctaccgcagcttgttgttcgtttcgttgtcgctgccgctgccgctaccgctgccgctgacgctttatttatgttcgtttggatgtcgctgctgttgccgctgccgcaagtctctatgttcgtttcgccgccgctgcgttagttttaaattttgtgagaaatcataagcataattataacaataaagtagtacaccacgttataagcaaaaaagatagacaaagtcgtaagcataattataacaataaaccaagtcaataaaaaaaacatatctaataaggtaagcgacttttattacattcgttcgtgatgttgtcacgtaaagcttccatcgctctgtcaccggtaggctcatatgcaacatgttcttcttcttcttctccttctccttcttcttcttctccttcttcttcttcttctccttcttcttcttcttcttcttcttcatcatcaacatgatattcttctatgctttgccattgtaaaaaatcatgatcttcccgatgtgaatcccttataaaattgtgtagtgccattgtcgctgttacaatcttaatccacttagccagaccatattttggatgcttacgatctacaatcctccattttgctttccatactccaaatgtcctctcaatcacagatcgcaaacctgaatgctttcggttgaacaactctcgtgcagttactggtggtcctcctctaccaaactgaccaagatgatatcgcatcctacgatgtggaccaagatacccagtcctggtgggatatccggagtcaacaagataatacttcccattaggcggatgtgagaaataaggttcattcgtcgcacaataattcaaaacctttgtatcatgtgctctaccaggtacaccgacatatgcatatatgaatttcatatcgaaattacatatagcaagaacattcattgtaggttctagctttctacctttatatttttttgcagtttgacttggagggcgaaccggaacatgagttccatcaagtgctccaacacaatctctaaaaaaaggccaatatcgatcatcattcttcaacacgtctcatgatatgtccctataagttcaacaaacactacaaatttgaaaccaacttggaggaaatagctatagagacctcaaatcaaaattaaaagagaagagcacaaagtaaatcaaattctcagaaccgtttagatttgagctaagcagagaacttcaacaaaaacccataaacataagatcaaaagagaagagaagaatcaagagaagagaacccatttcgaaaattatcaatctcacaagaacaaacctgatttcgtcaatgtttaagcttgatgaacagaggagcttgatgaacagaggaagctcgacgaacagaggaaggtgatgagcagaggaagctcgtcgggatcaagctgcaaatcgccgagaaaaatttgttgattaacaaatttgtggatgaaaaaatttgtcgatgaccaagctgcgtctgccgcaaccatttttaggtttagacttttgtaatttctcaaaaatattaagggtattattgtcattttcacgtcaatcgcaacttaacgctgattttaattggcgttaataatttttagccgcaacgacttgcgtttgccgcagcgtttggtcgcaacgacgtgcgtccatcaaacgaacaacacctcttgcgtctgccgctgccgcaatgacatgcggccactaaacgaacacactagttgtaacagaacaactgaaatactaaaatttaatatccatttaaattggaacagatagaaaacagtgcattaggaaaacagtttggttttatacaatttaaattaaaacaattacttggtatatgacagaatgtgattgtcacattcaccaaattgaaatttctgttttaaaggagaaaacaaaaaaataaccatatacaatcaaaaacctatatagcatactaaccaatcacaatcattaccaaaaacaactctatttcagttgttaattagtaacaataatcaaaaaaatttcctgacaggtcatcgtgccaagctaactctatataagcagattaagtaggccaacactttcattatctcttagaacaagtattgataaacaacaagttttcttatttctatatataccttaaacaaaagaataagatg

SEQ ID NO: 11420 - DNA, 3000 bp, Unknown
  misc_feature (1)..( 3000): cDNA_ID_2708237_gDNA_ID_2214495_Annot_ID_133548 3000 nt of promoter + ATG
ttttcattgtcaatactaacaagtatatgaaaactttgacacttatgtgcggcaactagtcatgaaggggtatatgaaaacaacaactgagtttttatttagtaatatatatcacatgtggcagacactttccctttcataagtttgaattttggatacaaagtaaagggggaaaaaaggtttgaaagggaaacgaaggccaaggccaagtgatccccttagattagtgacaatgaccatcttctgcatgcgcagcttcaagatttgagaaactcttacatcactaagaaagctacatctctacacagttagagagtcttcttcaacaactcaagaactgttttaatgtcttagagactcaatcagtttgtgacaaatcagtctcctctggacccttattatgaagaaacagccaaatagataagcatacatttgcataaagtttgtaacacaatcatttcagaggcataatgttacaccccatataacaagttttgtctatacaattaaggtgatgaaactattagattagacttaaaaatagaataaaaacaatgatcatatcatatgtgaacgagtaatttaaagccaagcttgtgtgttagtggacacaaatgataatagtaaaaatgaggaataatattaaaaatggaattatcaataagtacctcgtagaacaatttcttatggagtagggacactttagaagatacgctgtgagtgcttttctgaaagaacagtgaaataaagaggcaaaatttattaataagattcaaagtatagagcatctttgcaattaagttcaatgaactagcaagtaaatctttgaaatctccatcttaggattaagataagtcattcaaaacaaggaatgattaagcatcaaagttccaagtatttcaaacgatagcgacaagtgagttattgtctatagagggttatataaaacatagaaaaagggttatcttcaagctatcttcacgtggtaagtggagccatttcctcacccactgcactagatagaaagtaagtaacaaacacggggaagaaaaggacttgagataacacgaaaagacatctaaatgacttagaaatattgagcagacaagatttaggaaccagaagtagtagaagaagttgaagagcaagtcttagtggctgagcttgaaagtctcaacaaagtggaaccactttttgggaaaacaatgtcacaggccatatgaagtaagggacccctcctctaagccatgccttggcttgcgccacgtggaatctaatatgatatggtaggatcaatatcttgaatcttagactgactcatttgactgattgatagataccattcaccaaaaaaaactaactacactgtctgagaaaaagattgtggggttggccaacttttgaaacatcagaagaaaccaacactgtggaaaaaagaaactgtgactgaaagtaaaacaggagcggtaacagcaaggttcaagatttcgtgtaactttttgtatgccacgttacggatttatgttggaacattgtccgaattagctactctatcggaacattgtagaaaggctagaagtttctttgttcaggtgtgatgcttataagagaatcatataagaatattcgaaaacaataaactaaaattgtgaatcggttgctctaggtgtagggctggaatgaaccaaaactcactcttatttgtattggtttgaagacactgatgatttccttccctccttaattagatctctactttattaatctatcatgttacaaaatattcgtttactatagtctattgtagatagcaaatcacttaaagctatactaaaaatgagttatgtacatatagtttcaagttttggagaatgagtaaacacaaaggattcaatggacaatagaaaacgtgcactttgaccaaaacaaaaacatttacgtggacacgtacgatgatctcctttattataaaagttatcgacaaattcgtagagaagctcgtttctgagtataccaaattgtgtatgtgaatcaggcccgactcttgggaggtgctgagtgtgctagtgcatcgggtcctacttctttattcagttttttctttatattttagaatccaaattttcaaataattgcaaaatagaatctggtttttaaatatttagagttttaggtaaagaaatttggagcataccacaagattcaataatttattgggccgtgaatggatttggttgaattgtgttagaagatttttttacgtaaacagaaaatgaacatgacctgcttcatatactcaaacttttacgaattaataaaagcccattatgaaaaaggcccaatatgaaccggcccgttttcacaaagtcgttttttttttgtcaaaggtcggtttaaaggactaaaaaataaataagaaaaaccctctcggctttctcgcatcaaatttccgtttttgctaccgtcgtctctggtcagactcagaggtatgaaccaactttcctctctgatttagcttctctttgtttctcataaagatggatttttaacaattgggttgttgattaggttatgggttttttctcaggaaacacggagcttgagcaactgacaagactgtttcgtgtttggggctttcgaagagagtaacgagattcgcgggtttcgtcaattcctggtaaacttacgatcccagtttcgatttttttctactgaaacctgttgattttctttgcttctttcactgagtatgctctagtatccccttatgaggtgactaggaagcttgatactttgactgttaggtgtttgtttaaattcccaagagagcacttgatactttgagttttagaataaagctaacctctttcttatttgtttaatgcattgtcttgtgtatactaggacacgagaactgatttggaattcttctttgttccagggttttctctagattgctgtttcggtggtgttttcttttgaggatttaagggaaacatg

SEQ ID NO: 11421 - DNA, 3000 bp, Unknown
  misc_feature (1)..( 3000): cDNA_ID_2717398_gDNA_ID_2214495_Annot_ID_133549 3000 nt of promoter + ATG
attttgcgctaaattctaacatgctaaaacacattcattaatagacaaactaatatgttttcttcccctaaatagcaacattatttgtcttcttaccctaaatagtaaattgacaactttatataggtaaaaagcatatgttgaagatttgcttgcaggatttctttgcaataattaaccaaaaccaaatgaaataagaactaatatttctttggtgataatggaactcatagggtctacaacattttttgtttcttcacgggtgatacaacacaagctatataggcaaattggtaagtaggttcaaaatcctaaaataaaattttaaaaaacttttaagaggaaaaatggaggggaaagaagaagaaggagacatatagttttctgaaacgaaagaaagataataacccatcactgcagcaaaaggtatctctaaaataattgaagacaattgaaacctaatgtcaacgaactagccaatgagctcaaactccacaaatcaccacctcgacattctatcttgggaccatttctttctctctttactttacctctctctatataacttgaaattgagatatctaacaatttacaatggtgagagacaagaaaaataagatacatgtatcacatacatagagtaatgattaaatacgttttgtggagtttaaccttatttctgcggcaatggtggtagtttaatatttcatattgtgctcatcatgatgctatctaaacagtcttaatgcccaactatctacttattgcaatcttcacggcgatttacctgtgaaatttagaaaaaggaaaggaaaaataaatataaagaaacttttaagtggaaagtgacactacaatgagacctgcaaaaactcgacaagtttgaaataaacaactaaaaagaatccacacacagaacaataaacctttacaaagaaaaaaccaacaactttgtgccactaaatctatagagtgtcaataatgttgctgtacggaaagggattcacttggggtctacatgaaattcatggtgttctttgatgatgcattgattctctagaacaagaaataggagatacatcattcatattaaccgatatactctgaatttttaatacgaaaactagactaaaatgctctgttatcaatgtgtctaatatagaagaaagtatatcttacttacatgagaagaaaaatgtttctcctgtgtatttgtccactagagcgaccaaggtattgtgagctacgattacaataacaaaggtgaattagccaatgcccccaataattgggacaatgtaatcatgaaaatataaaaaaaacaataaagcaaacagaaaatagaatgtaacaatgaacaattaaaggttgcttctttagtcatgaaaaaggagtaataatgtttaggccactggttttcattgcacacaaaagtcacataagacagatacacgacgaagggtagttattcactgcaaatctattgacataattggttactgtaaactttttgctctcatagactcctttgagtcattatatcctaagactctacttgttggatggtagccacttaatgttactaaaaaagaaagtaaaagtagaagaaagaatgaaacatatcagtctacaatttcaacactctcctattccaataagcaatatcaataccttttcatttatatttattcgtaatgcctcctttgttcaaactgtcactccacattaccatcttcttcagcctttgcttccatttttcccgactatgtaggcgaggcccctacatctttcaatcacacaaaaaacagaacatgacgttattggaagaaacaacacatacccacaagttaacactatacatacatcatatcttctatgtttatttattgcaagtagcacaaagtggtatctatttttctgcacatctttttatgaattttccttttttatgataattctgagcaaagaacacatatcacctccaactaagatctaatttactggagaagaaaaatcatgataaggccttacttggtctatcaggaccaccaataagaacatcaaacttttatatgccctgttcaatatgtcatgctgaaagttgagatttctgtagtactgagataacgcaaagcggttccacatgcagctgtggtacttttttcctttcttaagcaatttacggcaagagaggatacacatgaacgtcaccagggagacctaaaatatgtatacacaacacgattattttctctcttaagatcatgaaaaaaggaatgctaggttacaacatgtgtttaggacagctctgtatccatcctgcaaagaagagtagccgatgctgatgtttggtcctaaggggtaacttacttccaagctttatagtcaaatttatatatactgcaagaactgacaggatcaagtgatgcaaaatggtcccaataagcatgatccaatagagtttaccagtgtagagggtggtgggcaagattgtcttctcttaaactgagctcaagtaccatgagacccaagtaggggccctagtgtacatgctctgacaataaacttagccaaaagacaaaataataacaagtaataactatgcagtaaaataaagtttttacctattatgcagtaaatcttggcagggagagaatgtatgtacccgcgatgtgaattactaacctaccataaaaaagatgagaaatagaagttagaaatacttttctagtaactttcacactatataatatgcaagaaattaattaaaaacgtcacaaagatatcttaatttgcagcaagagacaaaaagtaatggcaatccagctatatagtgaacacaagtatatgactgtaccgcctaaaacctttcctttaaattcccctttctacctctttttttttttccctcagagtagtactctaaacctcaagtttacctctacttctcttataccattccgcctcttattctttgcaatttctctcaacaaagtagaa

SEQ ID NO: 11422 - DNA, 3000 bp, Unknown
  misc_feature (1)..( 3000): cDNA_ID_2706509_gDNA_ID_2214495_Annot_ID_133550 3000 nt of promoter + ATG
aacaacaagactttcctcggaatcttcatgatcttagttctaagctgtataccaggtagaaccaatctttgttccaatcattctgttagtaccccaaaagaattaccttcttcaaatccttcagatattcgttcctcattagtttcactagatttggagggttatataagcttcgacgatgtccacaatgtggccaaggactttggcaacagataccagttaccacctttggcaattctacatccaaggtcagtttttgatatttcatcgatgatgaagcatatagtacatctgggctccacctcaaatcttacagtagcagctagaggccatggtcactcgcttcaaggacaagctctagctcatcaaggtgttgtcatcaaaatggagtcacttcgaagtcctgatatcaggatttataaggggaagcaaccatatgttgatgtctcaggtggtgaaatatggataaacattctacgcgagactctaaaatacggtctttcaccaaagtcctggacagactaccttcatttgaccgttggaggtacactatctaatgctggaatcagcggtcaagcattcaagcatggaccccaaatcaacaacgtctaccagctagagattgttacaggtatttcattcatgctttatctctgcggtagtctcaaaaaaatatgcacctgtaaagaatatccatctcttcatgagcaaaaacactgacgactttaaataatttttgactataaaacaagagtgcataggcacaaatgtgaaatatgcaacacacaattgtaacttgcaccaagaaaaaagttataaaaacaaacaactgataagcaatatatttccaatatttaatcagggaaaggagaagtcgtaacctgttctgagaagcggaattctgaacttttcttcagtgttcttggcgggcttggacagtttggcataatcacccgggcacggatctctcttgaaccagcaccgcatatggtaaagttctatcttgaacaaagttcaaacaatatacgctatgattctaagaaccactttcctgacacagtcaaataacttttaataggttaaatggatcagggtactctactctgacttttctgcattttcaagggaccaagaatatctgatttcgaaggagaaaacttttgattacgttgaaggatttgtgataatcaatagaacagaccttctcaataattggcgatcgtcattcagtcccaacgattccacacaggcaagcagattcaagtcagatgggaaaactctttattgcctagaagtggtcaaatatttcaacccagaagaagctagctctatggatcaggtaagatgtgaaagcaatatataactagacttagtttccacagagagctccaaatcaaccgttggctactagcctactaacataatgaatggttgccgtgcaggaaactggcaagttactttcagagttaaattatattccatccactttgttttcatctgaagtgccatatatcgagtttctggatcgcgtgcatatcgcagagagaaaactaagagcaaagggtttatgggaggttccacatccctggctgaatctcctgattcctaagagcagcatataccaatttgctacagaagttttcaacaacattctcacaagcaacaacaacggtcctatccttatttatccagtcaatcaatccaagtaagtgagcaaaatgccaaaagcaaatgcgtccagtgattctgaaacataaattactaaccatatccaacattttgtggtttcaggtggaagaaacatacatctttgataactccaaatgaagatatattctatctcgtagcctttctcccctctgcagtgccaaattcctcagggaaaaacgatctagagtaccttttgaaacaaaaccaaagagttatgaacttctgcgcagcagcaaacctcaacgtgaagcagtatttgccccattatgaaactcaaaaagagtggaaatcacactttggcaaaagatgggaaacatttgcacagaggaaacaagcctacgaccctctagcgattctagcacctggccaaagaatattccaaaagacaacaggaaaattatctcccatccaactcgcaaagtcaaaggcaacaggaagtcctcaaaggtaccattacgcatcaatactgccgaaacctagaactgtataaaagtttcctgtgtccgtccttgtaaccgctcaggctaggcagcaagaaagtgaaaaattctttcttttttgtttcttttggtgaacaacaaattttacagtctgaaacagattgggacaattgtataggatctccataaaaatcctacgcagtgtcattacttttggtgctccaaaaactcaaaaaacatcatttttaaatctactataagcaaacaaattacaatagctcaaaaaatcaccaaatcagaactctgggtgcaaagcgatttaccttgaagaatcgattctcaattgggtccacgaatctcgttaatggagccaagctacgatttttccaatcgatttttgtactgaaacaacaacgattatcccaatttctcatcaagatggcagaaatttggcgcctttccgccatgaatagtcacgacgagattattttctctcttcagattgtgatttcaaatttcacttcgtttgtcacacgcgtgaagcaacaaaacacacgtgtgtgtatatttttattttattttttgctgggcggtcaggcgaagcagaggctcctgaagaaaatggcgcaacaaagtttatttatttcattaatattacttcttcttcttcttcgttggtaataataataagcaaatcccaaaaaccctaacggtactgtgtagaagctatatacattcctcttacttcacctcaacacgcaagaccagattcgtttccccgagagattcctttccttaagccctaaagtttcgatttttgatttttattttgaaagaatccaatttttgg

SEQ ID NO: 11423 - DNA, 3000 bp, Unknown
  misc_feature (1)..( 3000): cDNA_ID_2706476_gDNA_ID_2214495_Annot_ID_133551 3000 nt of promoter + ATG
ctaacttcccatcatgtcacaccaaatctgactgagcaaagttcaatattttttggagaagtataaacttttcagacttcatattatctaccttgtgatgagtatcttgtaaagtgtctttaaaataggacatgattcgaccggagctacaggtttcttctcttcagagggcaatatacttaagcttgattgactaagcaattggtaaaatgctcccactgcagaaacaccctattcaacaaaaatcccacatcctcataagcaaaacagataccaaaacatttcaaacttctttcaaggctttgttctaacagattaagtacctgaatcattcccttgccgcttatgctatcacccatgtctctatttatttcaccctttgccagcatttgaccgtaccatgcattacgtccttttaataaggtcacataagtgtcagctagcaaaggccctgcaagtttctcaggctcttctgctagtaaatgagttataaatatcatctcagatgtacaatgagcaaaatacaccgacttgcttgtagcgctctcgttagtgagcgccgctaccatacctgaacacaacaagaaggatcaaagtgtgaaaacttgataattatcactcaaatccgtgtctacatacagaaacttaccagctccaatggcgtagacattcttgagacctcccattacttcatgtgtcacaagatcactattgtcccaaacaatgaaatgaggttgtcttaagaacttagctagtggcttcctccatttagcagctccacagattctagcattggcatattccttgttgtaaatttcagcagcaatgtttggtccaccaagatacaggacattgtcaatcggcacaccagctaccacaaacaccaaagtaagaaccaattcaagaaaactaagcaagattgtgtcaatagactcaatataaaaggagcaaaaggaagaagaaaaagcttacttgcttgatgaatcatctttgttggagttatgatatgtggaactggttcaagagcagtttcaataccctttgacagagagataataatcggaaccgttattctctctttccaatacttactaatctcttcaaacacttcacgtgtttcagttgaaggcaatccattaacaacaatatcagcatcccacacagcttcttgcagatttgtcacaaccttaagaggacaaagcggcgtatcaaccatgttaagacaaaacccgtctttcaatatctcatcagcatagagtgtcctatcaccaagccttgcctcgacatatttcagataagcacagcgtcttatcaatctcctcaagatatcttcccttgaattgatcacttcaaacaaatgttctgcagtttctctatcaacagctctcccagctcttctccatatcctgatctgaaacttatccctgaaacctccatagctttcttgaagaagtgctgcaaaaacacttccccaagcaccagcaccaacacttacaatccttaacggatctttttctgatttccccaaaagacgacgaaattcatcaagtttctcctccaaattaagaccaatatgatgaacagacccgtttgattgcagactctttgcctcaatgcttcccaccattccttcttcttatggtccacacacacaagaaagttcaaacaaaccaaagacaataatgaacaatgactagaaatgattttttctggtggttatgtaatccactacagatttatactacatgggtttggatcatatagaacaaagaaatcaagttggatttgaaaagaaaaaagagagaccaacttgagcattaccaatcaaaccaactccttgctccaaaagaatcaatattttcttggttgatttttctcaccaaacaaaatttgagttgttttgtgtcctagcttcttctgtcatgtaagaaatcagacattaatgcatagataccaaaaaattcctttaaatagtaatgccacaaaacatgacacaatgcagagaaaaatcaaagaaagattaaggaataaaataaaggaaaattaatggaatatcaaaaaaacaactttgttagctccgtctttgagttgttcatctaccaaaagaagactgtccaataaaataaaaacacaagtcaagaacaacaaacctttcgtgtcggcaaccataaagaagaaatcaaaatcagctcatgaggattgccaaatcaagaaagtaaaaaacgcatgagaaagattttgggaatcatcgaaagcataaaactttcatgcagaagaagagttaaattaaatagacagagcaaagcttatgtgcaagggagaggaatggacataggcattgatgggtacagttggggaaagggagagacttttttgtaacattatattttggttatggggatatttaagggaaggtgcctaacttcggatacattcattaatggcacatgaaaaaattactccatctttttttggtaccagtcttcttcatcacctccattttttttggtttctcaatctgaacaacatttatgaaatggttttttagttataccggcatttattatacaccgaaaacaaaacaaatagatatacaaattaatcaataaatgggtccgccgcaaataaaaatctatgcgttatcttctgatgtgtcatgtatatataaatgatttgatcacctaacaaagacacactttgtactaatgaagttgatttttacattaaagatgttcatgtcactataataaaccggatttgattattacattaagatactcaaatcggcctttcaagaccttttagttgggccagaagttttaaggagatatgttgttgaattatttctatgggctctctcggatccactgtagaaaccgatagacctctctcattcgatcatttcttcttcttcttcgtcttcgctgcagcctgcatctgttgtttcttctagactttgcaatcacagagatagtgagtgagatagagagagtgataatg

SEQ ID NO: 11424 - DNA, 3000 bp, Unknown
  misc_feature (1)..( 3000): cDNA_ID_2706502_gDNA_ID_2214495_Annot_ID_133554 3000 nt of promoter + ATG
aatcttcaaagaaagtcactgcaatttttcctttctccctattgactgtttgttcattgccattctcatctaccaagaatctcagagaatttgatactctattggcttttactgttgcctgaaaaaacttagaattcttgtctccaccaaccatccatttatccctgctttttaatctccaaaaatcttcttcctctctataagcatcaccaaggacatcttgaagaagagaaatctgcgtccatgatgggaaggtagcacttttctctttatctaactcccttcgtaattttgtaatccgacttttggcattaaaatcattctctcttttccactggctaatggctttcctacattccactagacgaagcataactgaagaagattgattatccagaaaaccattccaagaaacgagaatagctgcagcacaattaggatcctcaataaaccgtttgtcaaatctgaattgacccctgaagacttcctgatcattcacaaatttaaccagaactggtcgatgatcagaacctagtctttcaagaaaccattggtgagagtttggaaacaaagcaaaccattatgagttcccaaaacatcgaactaatttacattggatccattcattattcctagttccaccccaggaataactattccctgtactccccatcacatgtagatcacaagcaaaaatcatatcctgaaaatcctgaaaggaagattctaatctcttaggaccacctattttttctttgttagatagaatatcattaaaatctccgatcatacaccaagctgattttcttgtcaaacctatctcctttaatctgtccaaaagggtatatctaagatgctgtttgggatttccataaacacaagaaacaaaccagcttttactatcctgagaaaccttcatatccagtaaattcttatcttcaaacaaaaactctatctccaagtgttgtttccaaaagattgccaaaccaccactctttccaatcggttcaatagagtgaaaataatcatagcctaaccatctgaatattttcataatgaactgatcagaattcatggtctccatgaggaataacatgtctgggaaatgatctttcttcatttcctttagataccgaattgtccaaggattcctcaagccttggcaattccagctaaggatgccttactgatactgcggtggttcatcatgaaccaccgtttccttaacatccttgctacattcagatttaacagaagcaaccaaatcctttttccttttgaaaacattaggaaattcaaagattttactaacctctgtatcaatagctttctcactaggctccagagagtccaatttcttacggatcacaactgcttttcttttccttggatttttctgtctagaacttaaacctgatgagcacgcttcatttaaggcagagttgaatccctgatccaaatccagatccaaatccagaataattcctttagaacagtcttcttgataagccttctcgtgttcctgactctctttagcttcttttcgaatcttttccactaaaccagtagactgtacctctgaaggtgtagacgacatgattcttgaattcagaaggtttgtctttgttgacaaagcactgtttccttctatcctatctaaatctgaactaggaaggggatgatttgattgtggaaacctaagatcagacttttctttatcctcttttttctcaaaaaaagacctttgaaacccatccatgactgacgattttcctggccgaccagaatcacaatcacctttctcatgagttagtcgttggcataggaagcatctcttcctaattcgttcataatcaaaagtcacagaaactatttcacccgttggaagctgaatctctttaaagttccttaaagggttcctaacatcgatgataacctgaactctgatatagtcttgtgcttgagacttctctaagtcaagttccacctttaaaactttccccacacaagatgctatcttttttattgtgtcctgtgtgtagtagttaactggaatatttctcagcctcatccacaccggaagaaacatcagatactcttccgtcgacttctcaatccaacgttccatcactacacaccattcatcctgagtccacactcctgttttcaaaatttccaatagatcatcctctgatttaaagaaaaattgaaacctttcttgagataaagcaacaccacgaaccctggaatacaatctccaaattctaggcatgtctaaaatccaattagacatcctttgattagaagggttcagaaatcttcctaagatactgcaagtattcctttcaatcgaacaaaactgagcttggtttgacaaaacaagtggttcctcatctttgattgacatctcttgaatcgcttgatccaaatccatactcatcccaatagaatagaagagagaaagattttcaaggcaacagctgaactcaaaactgacaaaaggtaatcgaagattcttctgatcctggctccgctctattagaatcgatgatttgagggagaagttcttaagcccaatttgacgggacggcgttaattacggcgagcaaagtattatccaaaaacgacctcctaaaaaagagaacagagagttttttttgaggattgaggtatgaggtatctaattgaaagacgcaaaagtaatactataaggaaaaaaaaaaaagagcatgtttatggacctaataatattcgtctgggtcggatcatttgatttggttgcctactaattatccgaatgagacgaaaatgaaatttgaatgaatgggccctatccgagcataaaatccgagtaattcgggtcgggtttgggtattccataaaaagcaactctcacaccaatccgttgctcaatcctctctctctctctctcagctgccttcgcgccggcgaagtttgtctctgtgaaaacagagagtggtagtgagagcgtgagaaatg

SEQ ID NO: 11425 - DNA, 3000 bp, Unknown
  misc_feature (1)..( 3000): cDNA_ID_3100792_gDNA_ID_2214495_Annot_ID_133558 3000 nt of promoter + ATG
tattctcgtaatattctcttaatattctcttagggcaacagtacttgtatgtatatatttcatgatgaatgaaaataacagagttttcacaactaaacgagttcgtgaagcattggtatttctaccgccttggcttggtttatgtacaccgagtatgttcagctccatcctatacagattttgggacatgtgcctagggttgaggtttcatatatagaaagaactgaacaaactcggtgtacatagaccaaaccaaggcggtatcaactactaataccctatcaggagaatccagactctccatatcacaccaatataaatttctcttagtgctcttcttactagatccttcaccatactctcggtgaagtactttgagtgcatttttgcttataaagttgtttctggtataaatcataataataaaataaaaactaatttcgcacaaaaattcacttgcgtacttgattaacaaaaccttctatatattattagtgtttgagcaaattgttagggctagaaatatttttttatgtagactaatcattgattgacaaaaaaaaaattaaaaatttagactaatcatttatagtttacctaaacctactttacgccggcttatggttgaattctacgtggatttaagcataagtttacaatagccatagtaattcggtaagtacatgcttttgggtccttatcatctctattggtgtggtcatatctgaataagcagagctactacggatcacgaatctcttcttctcgtatgttttatgtttaagtgaggttcgatctagaatctcatcaattaatatcaataaaagtacacccatgatcaatgagaactcatgtaacaataatctctgttcgtaggttcttggggataaattagtcatcggaatagcataccagagatcgacgatctcattaatcattatgtataagtacaaacttcgtaaaactatccaatgctacaaataacaatacaagatagtacagtggtaccacctaattattgatataattctatgacttctgaacttgaatatgtatgtatgtatggttagtcatatatttataaatctaggaattttattttcttaaggttaatcttctttaacaaagtttaaatctaaaatttaacattgcatcgcagtatatatactagctgtaatataatcttgttcaacattaacataaccaatatattgaattaaaaagccaagacttatttatgcctagtagaagtaaaaagtcatttttttgttcgggtaaagtgatgaaccaactcagaaggctttcaaaagcaatttcctaatggaatatctagcaaattagcaagtgttacaccacttttctatttcttcttgtttaaaactgtaaccactatcttgcgtcatcttgacactactacttctcactgttttgatttaactatttacaataaggataaatataaatagatatagaagtaatgtttaagttttaccatttcatcatcacatccaatataaactcatcattaagcaatcatttacatttacttcatcttgcctctgatttttcctttttgtttcaaatttcatgtgtctgatgtcttcttactctgtctccgactaaccaaacaacatacttttgtgattacataaacacatatcaacagaagaagaaaaccaaacacaaaaaccctaaacaagataggctcttcaacaggagacataacggccaagtacacacaatctcttataagaacaagcaatgtcagtccttgcacaacatttttaaccaccaaaactcttttatttattccttcttctttgcataacttgcatataatcctcaaaaacaaaacaccaaccaccaagaacgttgtactagaccatcctcggtaagagacaatcttccctcccactattaatggctctttcctgcatatacaagacttgcagactccagagaaagtagatgtgaccagagcatcgaatcctgtataataggggagaatcacagcgtctaagtaaagactagcgtggagaataccagagatagtagaggcttcgaagaagacaaaactcgcttctttttcgatattgttctcaaataaaagcactgagagctgaacaagctgtagtatcgcaggtccaaagatggaaattgggaaaagggtattgatcctttgaccttttgcaagaatcaagatgatcaaaggaagagagattggaccagaaggaagtaagtaccttcttgctttgtcatcatcaccatcatcatcattttctcttcttcttcttgatattaccttccttacgacaacaattagcgtcgtcaaataagtaaccgtaacgaagaagaaaactagaacgtcggtgatttgagggtagtcgccggcatagatgctgtcgcagaaatagtggaaaggacagttaataggatcaagtgtgtcctcgaattgccactttgtgcatttgaaaaatgttttctttctatcagaatccatttcccattctgaattcataatttgtttgttttttttgttttgatctatatgtttttggtttccttagaagctacacatatagtttataaggagtgtgtgtgacgtgacatcatcatatggttgattctctttcattgtctggttatagatgcttgaactaaaatggataatgaaactctatctgaaatctgaattctatcttcattttttgtttattaatacaaaaaatcaccctttgaatgaaactatgtattgagagaagccttgatcttcaagggaaataaaagtttggtgtgcagctgatgattgattggttctgtgtaattgttaaattgcatgattacgtaactgagaattcggtttaaccgtttaaattccggtctactgaaattgctacggaaataaaccgaattaaaccgaaccggatcatgattcagtctactttagtttttgtgctccgtagattgagagaagccaattttagggaaaagagagagatg

SEQ ID NO: 11426 - DNA, 3000 bp, Unknown
  misc_feature (1)..( 3000): cDNA_ID_3039901_gDNA_ID_2214495_Annot_ID_183816 3000 nt of promoter + ATG
acgtacgtaagtattgagctggcgaacgaagctagagaagttgcaatgcttgaaaagtgttggtaacagatctctagcgaattctgccggctgccacacgacgaaaccagttccgtattcgttccaagatataaccccgtccgtcgtcggatcctccaccactttgtatgtctttaccaagaacggtggaggcggctgtagctccgccgtggatgttgagtttccgatcataaactccaatggcaaacgctcctcgtcgttaacgttatcgttacaccgtaaatgttcaccagcatcttccatatataaaacgaaaattattattcttgaagaaaacaagtagtagaagatctcaaactagaaagacgtaacacgactccatagaaagagatagagacgttatttaatttaattaggtggttgagacaataatagaaatactttaacaaaagaaaacaataatagaaatactttgaacaattttcaaggaacgtacgcttctaactatttacatattctatagaatatgtaactctaacactaacatgcatataatcatgatgcatacacacacacacgattgtgtttgtaaatatatttttcttatatcaaatgaaaatcgatgtttgatgacaatatgacatgtaatttttcaggtttgaaaccaaccatcgataatatttacgtcgaatccactatacgacataactcttttttttctcaaacacaacgctcgtctctaacatgtataactaacgacattttgcttttaattttagaatgatattggattactttacccccaaaaaaactgatatcaacttaatttgtatagttgatatttagtactggtcttaagtttttcagggaaactgcagtagtcgttgcttttaccaaccgagctatattgtcaatataattttagttgtaacgtgtgtgtttgattagacgtataggaaacaaacgaaaaatgattttaaaaaaaatattaatcacgaggtatatatgtgaatacacatatattaatgtatgttggtaaaattggatattgtgatatgaagcaactcgtttggaccccctttaggtgaggtggtactatcaatttacgaaacgcaaatcatgcatattattcatcatgtctacctatatttgtaagatttagttttctctaatgattaatcaagtactatcattagtaaaatctctcgaatatataatatggattgcaaaaatatcacattaattaccaatctttttttctctataaagtaccagttaaaataccacatagcagaagttatattcttaaacagatcgttttctaaatttcatgttaaattatattcaaagtacaaatcttttgtaatggtatttttaaaaatgattataaacttgatatttcatatagttagttttgttgttttgtaggatcatgtaaattgctcgtttttcaaaattgatgactatctatctttttgactatacatgctttgtctaattgtatgttactttcgacaccttaatttgttgataatatataaacaagtgcttaaaagagtatatatagaaaaagtaagggggttcagttgatctgaatggaaagttaaaaaagtgatcattcatcacggtcgaatttgatcatatatataagtttatggtaacgtataacggtaaaagccagtaaatttatagaaggaattccaaattaaataattctttaaaatttcagttgaataaaagttcccaaagttaaaatctttttttttttccaagacataatcaagtaacttaagtaaatgtcggttttagcacaataatgcaagaaaggaaacctttagatctctattggtcaaagtaggggacagtgatgtaattcaagtcatcgatctactgactactggtgtttgaaggggattaccgacaatgttcctatgacggcgcgtaccttccacgcgtctgtaaaagagagagacaactaataatacaaatcctaacgcttaagctctactatatcgttttaacagtagtgatccatatatatgtcctgttgaaattatttgttgaacaataagattaagggatcacaaaactactccagcatatactacttggatatgtagctcttgtaaggcttaatttagatggtaagatataaacatcgaatttaagaatagtcatcaagaacagcttaggaaacttcaaatggcagatcgaatttggatgacaagtaagaacacggtgggggggtttttttttaaccataaagttatgcttaacgtttagtgatgtggcttcctaacgaatctatacaacatcaagtcatcaaatgtaagtacattttgttgactaaaacattggaagtgcatggaattcagacactagactaaagataaagatccttgctttcattgggctgctcttttttggtcagcttaactttttgacttaagaaaaaatagtctgtcaccttccctcaccaactcctagttcatttcatttccacttcaacctcttcagaactaagtaaactatatagtcttcgcatttagctagttatgctttataaattattagtactaactttttggcgaagcaatccgcacacagattagcccattttccggtgggtttaagaatcttcgtcgtgactaaatattcagtaccaaaacaggcccatttatggcccaatataaaaagcgtcgtccgtccacttaaactcttggcgatctttcccacttaaaaaaaaagcgattggcttatccctccgttgaaaagacgaagtaaaatcagtcaaaacacatctccaccgttcagtcgcttcatcacatatatccaacggctgaaaatcatctaagcctgtggacttggaagcaaagagataatgctgaggcgcgtgaggcacagtcgccaacagaaaatcgggatgtttttttttaactgcaaagccaaagagacaattgtatggtctctggtaaaggtaaggcaatcaaaaaaaatatg

SEQ ID NO: 11427 - DNA, 3000 bp, Unknown
  misc_feature (1)..( 3000): cDNA_ID_3039876_gDNA_ID_2214495_Annot_ID_183813 3000 nt of promoter + ATG
ttctctgttttttactcttctccagattcgtttcgcagagaaatcgaaggtcttagctcttatgagccagttattacccctctgtgctcagaaatctccaatggttagtctttttatttcacctttttaccaactcctgaagaaaacagagttttgatcttttcatcttaatattagaaacagagttagtgtataatctgcataaaacttacggttatcgattcttgtttatgcacgcaggaaccatttgttgtgacagaaccggtttgagatctgatatttgtgtaatgaaaggtgatgttcgaacaaactctgcttcttcctcaatcttcctcttcacctcctccaccaataacaacacaaaaccggaaaagatcaaaccttacactagaaaatgggagactagtgtgatggacaccgttcaagaactcaacctcatcaccaaagattccaacaaatcttcagatcgtgtatgcgatgtgtaccatgatgttcctgctgtgttcttctccactggtggatacaccggtaacgtataccacgagtttaacgacgggattatccctttgtttataacttcacagcattacaacaaaaaagttgtgtttgtgatcgtcgagtatcatgactggtgggagatgaagtatggagatgtcgtttcgcagctctcggattatcctctggttgatttcaatggagatacgagaacacattgtttcaaagaagcaaccgttggattacgtattcacgacgagttaactgtgaattcttctttggtcattgggaatcaaaccattgttgacttcagaaacgttttggataggggttactcgcatcgtatccaaagcttgactcaggaggaaacagaggcgaacgtgaccgcactcgatttcaagaagaagccaaaactggtgattctttcaagaaacgggtcatcaagggcgatattaaacgagaatcttctcgtggagctagcagagaaaacagggttcaatgtggaggttctaagaccacaaaagacaacggaaatggccaagatttatcgttcgttgaacacgagcgatgtaatgatcggtgtacatggagcagcaatgactcatttccttttcttgaaaccgaaaaccgttttcattcagatcatcccattagggacggactgggcggcagagacatattatggagaaccggcgaagaagctaggattgaagtacgttggttacaagattgcgccgaaagagagctctttgtatgaagaatatgggaaagatgaccctgtaatccgagatccggatagtctaaacgacaaaggatgggaatatacgaagaaaatctatctacaaggacagaacgtgaagcttgacttgagaagattcagagaaacgttaactcgttcgtatgatttctccattagaaggagatttagagaagattacttgttacatagagaagattaagaatcgtgtgatattttttttgtaaagttttgaatgacaattaaatttatttattttattaagttttttttggtaagttatttattttattaagttttgtagtatatcgtcgttattcgttaagataataatcaatttgttttcaatattttaggaaatatttgaagcacaagaaaagaaatagtaggtggtcctattggacctatataaataaactaaaatatttattgaatatcaaaattttgtaattgataaagaagtttggacttcatcgccgctcactcctctctcatcaactatcgcctttctcttgttcgccctaatttcagccgcttcttgccgttttcttcgtcggagaccagtggccggtggcttccgtagcattggaactggtttttttgtccttgtagtttatgctttgtcttgtagtagtagagatctcgtccttgattcagttagttttggatagatctgagtaagtgcttggttgattctgcagatctattggccctcgtttggggaatttttcggtttgtttcaagggatgacttttgtttcgttgaggttgcggtaggagcggttagatctgttgatcttttcccgaaccttgcctttccctccgtctcttgtctccttgcttcagccatcaattcccatttggattgccccatttcttttcagaggtttcgttatgtttttgttgtgatagtcttctttgttggcagtcggtctctcctccttagtgtagtttgttgtggttgttagctttctcctacctttgtggtgttctctcacgatgaaggttctcggaggctaggcttctctctttgtcctgcttcagatcttttttgatagctttttgaagacttctatttagatgtatttagacgcctcagtcgtcaccgtcgcacccggaggcttgttcgagtttattccagtttggttggcttgctgggttatgaagttcttggttctggtttcgagagattggctctctttatgataggaggtggcagattttttttcggggtggccgtgggcagccgaagtaagtctcatcgcaagtgcttatgaggaggaggtcttatttgccgcttgtagctattgttttctttggtttttagtcttgttgtctctgtttatgtatttgggttcgttctcttacgtttagggtccaatttttgctgctttgtgttttagtttcttttgtttccctttcatagggctatgcttccggggatatcttcgttttcctccggctttgtctccgagaactttaatttcgttcgtcggctttgtttctcttgtttaggcatcgtgtaattccctggttccacatcaagtttatcaatcaaatttcagtttgagtgacaaaaaaaaaaagaagtttggacttttgttgtcatatgtgtttattataaatagcccaagataagaaaggctaagtggcccaataacaaacaaatatatatatcgaaataggcttcttcgtctcacacgttattgaccagaagagtgaagaaccctagttcccaacaaggtgacg

SEQ ID NO: 11428 - DNA, 3000 bp, Unknown
  misc_feature (1)..( 3000): cDNA_ID_2706488_gDNA_ID_2214495_Annot_ID_183811 3000 nt of promoter + ATG
aagctctagggcggtgcatcgtgaggagaagatctagatcgtttatttaagtgggacctattaataatcaatcggacggtggattaattttctccagcgattgacgtttgttttttatttttattttaaattagcttgcttgtccgttttaggaggacagaggaaaaagaaacaagtgacttgttagggaagtcataccggtcgcatgtgttggaatttagttggaagattttaggagtgtttggatataggtacagatataaactcggcattgagcccattgtagtactattgttatcgccatttgggtcactaaatggaccctttttgaactttggttcagtatacaatcaaaatacagaaaccaacttttgggtaattttattcctgaaatagctaaacattagtacgtgagacaaaactggtcatttgctttgaaggtgacatatatcacccctttttatacgtgtctcacaacatttacagaaattatttaactttataaagatgaaaaaaaaaaaaaaaaactttataatttaatgatatatgaatgctttgaatcaacaactttaaccaaaataaaagaaaattaatgctttggatttatatccatattatgtgagttcaatttttttgcaacaaaatcttactcaggataagttatatttatgaatagagagtttttttatttaagatattactttataaaagaaattaaagatatttctgtctaaagttattactgattacacctaaacattaaatattacagattttatttttattagatgtaaatctttaccatgtgaaaggagtagatactttcaaacagattaaagcaatttggatatccgatacaagaaattaatactatgacattgcagattattaacattgctgacattgtatcagctatatctctccatgatgattttcatttaccaaaaccttgaaacattttgggcatgccaaactaggtgaccactaagacaaggagatagactgtgtccttccacgttaaggaggcaaatccgtgctaccattcgcaatttttttgagtagcatgtgagaaaataatttagaaacaagcagtaaatctgaaaatatgatattactcttgatataacaaaatatgatattaattactcttgggtaaaggaaaacaaatatgatagttagtactctctgtgtttggacaaaaatatttttgcctgcttgcatcggattaccgtaatacgactgtttgtcttcactccgaacaaccggagatgagtacaatacgactacattaaatataagattgtaatatgaattgagagtcaaattaacaagggggaattcagttatttctttgtatgtttaaggaataggtgatgggttagcctggtgtaagactatatatgtttgaatataggaattatttggacttttcttaacagtaatgcattgtgtgggggtaaataatgattgggtaatacaagggtattgctacttattacagtacaagagttctgaatatcaatagtttggactttacaacgttcaatttctggaatggatcaatgagattcgatgatacatatttctatcatgctcataatttaaaatgttgttgaaaaggtatgcagatcgtgttgtgtggattaaaatagcgttggatatcgtttaaaacaagtgctgccgcgatataactatcttgtccaaaaaacgataatagctaggtgtccaaaaaaacgtttcatactttcatctcttttcttttcttgcaagagtgccataaaatgaaagtatgaaacaaattaccacctttgcttgtatacgttgttgttatcagttacaattaaattcaatttttaagtttagtcaatttcacggacgcggttaagatgttaggcggtagccgaccatcaaaatagagttaaacattggattattctctatatatagctacataacaaattcattatccgaaaattttcaggcaataaagaacatattggagcaaacaataatttatcgtaagagtttttttaaaattcgttggaacttggaagggattttaaatattattttgttttccttcatttttataggttaataattgtcaaagatacaactcgatggaccaaaataaaataataaaattcgtcgaatttggtaaagcaaaacggtcgaggatagctaatatttatgcgaaacccgttgtcaaagcagatgttcagcgtcacgcacatgccgcaaaaagaatatacatcaacctcttttgaacttcacgccgttttttaggcccacaataatgctacgtcgtcttctgggttcaccctcgttttttttttaaacttctaaccgataaaataaatggtccactatttcttttcttctctgtgtattgtcgtcagagatggtttaaaagttgaaccgaactataacgattctcttaaaatctgaaaaccaaactgaccgattttcttaactgaaaaaaaaaaaaaaaaaaactgaatttaggccaacttgttgtaatatcacaaagaaaattctacaatttaattcatttaaaaataaagaaaaatttaggtaacaatttaactaagtggtctatctaaatcttgcaaattctttgactttgaccaaacacaacttaagttgacagccgtctcctctctgttgtttccgtgttattaccgaaatatcagaggaaagtccactaaaccccaaatattaaaaatagaaacattactttctttacaaaaggaatctaaattgatccctttcattcgtttcactcgtttcatatagttgtatgtatatatgcgtatgcatcaaaaagtctctttatatcctcagagtcacccaatcttatctctctctccttcgtcctcaagaaaagtaattctctgtttgtgtagttttctttaccggtgaattttctcttcgttttgtgcttcaaacgtcacccaaatcaccaagatcgatcaaaatcgaaacttaacgtttcagaag

SEQ ID NO: 11429 - DNA, 3000 bp, Unknown
  misc_feature (1)..( 3000): cDNA_ID_1022807_gDNA_ID_2214495_Annot_ID_183809 3000 nt of promoter + ATG
aaagaaagtaatgtttctatttttaatatttggggtttagtggactttcctctgatatttcggtaataacacggaaacaacagagaggagacggctgtcaacttaagttgtgtttggtcaaagtcaaagaatttgcaagatttagatagaccacttagttaaattgttacctaaatttttctttatttttaaatgaattaaattgtagaattttctttgtgatattacaacaagttggcctaaattcagtttttttttttttttttttcagttaagaaaatcggtcagtttggttttcagattttaagagaatcgttatagttcggttcaacttttaaaccatctctgacgacaatacacagagaagaaaagaaatagtggaccatttattttatcggttagaagtttaaaaaaaaaacgagggtgaacccagaagacgacgtagcattattgtgggcctaaaaaacggcgtgaagttcaaaagaggttgatgtatattctttttgcggcatgtgcgtgacgctgaacatctgctttgacaacgggtttcgcataaatattagctatcctcgaccgttttgctttaccaaattcgacgaattttattattttattttggtccatcgagttgtatctttgacaattattaacctataaaaatgaaggaaaacaaaataatatttaaaatcccttccaagttccaacgaattttaaaaaaactcttacgataaattattgtttgctccaatatgttctttattgcctgaaaattttcggataatgaatttgttatgtagctatatatagagaataatccaatgtttaactctattttgatggtcggctaccgcctaacatcttaaccgcgtccgtgaaattgactaaacttaaaaattgaatttaattgtaactgataacaacaacgtatacaagcaaaggtggtaatttgtttcatactttcattttatggcactcttgcaagaaaagaaaagagatgaaagtatgaaacgtttttttggacacctagctattatcgttttttggacaagatagttatatcgcggcagcacttgttttaaacgatatccaacgctattttaatccacacaacacgatctgcataccttttcaacaacattttaaattatgagcatgatagaaatatgtatcatcgaatctcattgatccattccagaaattgaacgttgtaaagtccaaactattgatattcagaactcttgtactgtaataagtagcaatacccttgtattacccaatcattatttacccccacacaatgcattactgttaagaaaagtccaaataattcctatattcaaacatatatagtcttacaccaggctaacccatcacctattccttaaacatacaaagaaataactgaattcccccttgttaatttgactctcaattcatattacaatcttatatttaatgtagtcgtattgtactcatctccggttgttcggagtgaagacaaacagtcgtattacggtaatccgatgcaagcaggcaaaaatatttttgtccaaacacagagagtactaactatcatatttgttttcctttacccaagagtaattaatatcatattttgttatatcaagagtaatatcatattttcagatttactgcttgtttctaaattattttctcacatgctactcaaaaaaattgcgaatggtagcacggatttgcctccttaacgtggaaggacacagtctatctccttgtcttagtggtcacctagtttggcatgcccaaaatgtttcaaggttttggtaaatgaaaatcatcatggagagatatagctgatacaatgtcagcaatgttaataatctgcaatgtcatagtattaatttcttgtatcggatatccaaattgctttaatctgtttgaaagtatctactcctttcacatggtaaagatttacatctaataaaaataaaatctgtaatatttaatgtttaggtgtaatcagtaataactttagacagaaatatctttaatttcttttataaagtaatatcttaaataaaaaaactctctattcataaatataacttatcctgagtaagattttgttgcaaaaaaattgaactcacataatatggatataaatccaaagcattaattttcttttattttggttaaagttgttgattcaaagcattcatatatcattaaattataaagtttttttttttttttttcatctttataaagttaaataatttctgtaaatgttgtgagacacgtataaaaaggggtgatatatgtcaccttcaaagcaaatgaccagttttgtctcacgtactaatgtttagctatttcaggaataaaattacccaaaagttggtttctgtattttgattgtatactgaaccaaagttcaaaaagggtccatttagtgacccaaatggcgataacaatagtactacaatgggctcaatgccgagtttatatctgtacctatatccaaacactcctaaaatcttccaactaaattccaacacatgcgaccggtatgacttccctaacaagtcacttgtttctttttcctctgtcctcctaaaacggacaagcaagctaatttaaaataaaaataaaaaacaaacgtcaatcgctggagaaaattaatccaccgtccgattgattattaataggtcccacttaaataaacgatctagatcttctcctcacgatgcaccgccctagagcttaattttccctcatctctttgtctataaaaccggaaaccaaacctacggattctctccttctccacataagttacatctctcgtgttttgttttctttgtctccgatttttttcgcgacgaagaagaagacgagagatagagagagaagtagagaaatcgaaggaatctgtaaccgattttaagatctcaatttttagggttgttgatttttcaatttctgggttaattttttttagggttttcatttggaatcatg

SEQ ID NO: 11430 - DNA, 3000 bp, Unknown; identical to SEQ ID NO: 11425
  misc_feature (1)..( 3000): cDNA_ID_2990156_gDNA_ID_2214495_Annot_ID_183806 3000 nt of promoter + ATG

SEQ ID NO: 11431 - DNA, 3000 bp, Unknown; identical to SEQ ID NO: 11424
  misc_feature (1)..( 3000): cDNA_ID_3039922_gDNA_ID_2214495_Annot_ID_183803 3000 nt of promoter + ATG

SEQ ID NO: 11432 - DNA, 3000 bp, Unknown; identical to SEQ ID NO: 11423
  misc_feature (1)..( 3000): cDNA_ID_2706476_gDNA_ID_2214495_Annot_ID_183800 3000 nt of promoter + ATG

SEQ ID NO: 11433 - DNA, 3000 bp, Unknown; identical to SEQ ID NO: 11421
  misc_feature (1)..( 3000): cDNA_ID_3039929_gDNA_ID_2214495_Annot_ID_183799 3000 nt of promoter + ATG

SEQ ID NO: 11434 - DNA, 3000 bp, Unknown
  misc_feature (1)..( 3000): cDNA_ID_2706513_gDNA_ID_2214495_Annot_ID_183817 3000 nt of promoter + ATG
acacagagctcgattacttacactgccaaaaaccttaagaaagaagcaaagaggaactcctcaagtacctcctgaagaagaagaagacggagaattggcggtggcggagactctgaggcggagggaatcagaagagcgagttcgggttggttgacggaggagataggagccgccgtgacgtgtggtagtagtagtagtgagaaagaagagatgaggaggaggagaaagagcggatgaggcggcggagacacggtgaggcgatgagacggaggcaataccgatgcctatcttgggagacgcagccatattttttttgattgccttacctttaccagagaccatacaattgtctctttggctttgcagttaaaaaaaaacatcccgattttctgttggcgactgtgcctcacgcgcctcagcattatctctttgcttccaagtccacaggcttagatgattttcagccgttggatatatgtgatgaagcgactgaacggtggagatgtgttttgactgattttacttcgtcttttcaacggagggataagccaatcgctttttttttaagtgggaaagatcgccaagagtttaagtggacggacgacgctttttatattgggccataaatgggcctgttttggtactgaatatttagtcacgacgaagattcttaaacccaccggaaaatgggctaatctgtgtgcggattgcttcgccaaaaagttagtactaataatttataaagcataactagctaaatgcgaagactatatagtttacttagttctgaagaggttgaagtggaaatgaaatgaactaggagttggtgagggaaggtgacagactattttttcttaagtcaaaaagttaagctgaccaaaaaagagcagcccaatgaaagcaaggatctttatctttagtctagtgtctgaattccatgcacttccaatgttttagtcaacaaaatgtacttacatttgatgacttgatgttgtatagattcgttaggaagccacatcactaaacgttaagcataactttatggttaaaaaaaaacccccccaccgtgttcttacttgtcatccaaattcgatctgccatttgaagtttcctaagctgttcttgatgactattcttaaattcgatgtttatatcttaccatctaaattaagccttacaagagctacatatccaagtagtatatgctggagtagttttgtgatcccttaatcttattgttcaacaaataatttcaacaggacatatatatggatcactactgttaaaacgatatagtagagcttaagcgttaggatttgtattattagttgtctctctcttttacagacgcgtggaaggtacgcgccgtcataggaacattgtcggtaatccccttcaaacaccagtagtcagtagatcgatgacttgaattacatcactgtcccctactttgaccaatagagatctaaaggtttcctttcttgcattattgtgctaaaaccgacatttacttaagttacttgattatgtcttggaaaaaaaaaaagattttaactttgggaacttttattcaactgaaattttaaagaattatttaatttggaattccttctataaatttactggcttttaccgttatacgttaccataaacttatatatatgatcaaattcgaccgtgatgaatgatcacttttttaactttccattcagatcaactgaacccccttactttttctatatatactcttttaagcacttgtttatatattatcaacaaattaaggtgtcgaaagtaacatacaattagacaaagcatgtatagtcaaaaagatagatagtcatcaattttgaaaaacgagcaatttacatgatcctacaaaacaacaaaactaactatatgaaatatcaagtttataatcatttttaaaaataccattacaaaagatttgtactttgaatataatttaacatgaaatttagaaaacgatctgtttaagaatataacttctgctatgtggtattttaactggtactttatagagaaaaaaagattggtaattaatgtgatatttttgcaatccatattatatattcgagagattttactaatgatagtacttgattaatcattagagaaaactaaatcttacaaatataggtagacatgatgaataatatgcatgatttgcgtttcgtaaattgatagtaccacctcacctaaagggggtccaaacgagttgcttcatatcacaatatccaattttaccaacatacattaatatatgtgtattcacatatatacctcgtgattaatattttttttaaaatcatttttcgtttgtttcctatacgtctaatcaaacacacacgttacaactaaaattatattgacaatatagctcggttggtaaaagcaacgactactgcagtttccctgaaaaacttaagaccagtactaaatatcaactatacaaattaagttgatatcagtttttttgggggtaaagtaatccaatatcattctaaaattaaaagcaaaatgtcgttagttatacatgttagagacgagcgttgtgtttgagaaaaaaaagagttatgtcgtatagtggattcgacgtaaatattatcgatggttggtttcaaacctgaaaaattacatgtcatattgtcatcaaacatcgattttcatttgatataagaaaaatatatttacaaacacaatcgtgtgtgtgtgtatgcatcatgattatatgcatgttagtgttagagttacatattctatagaatatgtaaatagttagaagcgtacgttccttgaaaattgttcaaagtatttctattattgttttcttttgttaaagtatttctattattgtctcaaccacctaattaaattaaataacgtctctatctctttctatggagtcgtgttacgtctttctagtttgagatcttctactacttgttttcttcaagaataataattttcgttttatat

SEQ ID NO: 11435 - DNA, 3000 bp, Unknown; identical to SEQ ID NO: 11420
  misc_feature (1)..( 3000): cDNA_ID_2708237_gDNA_ID_2214495_Annot_ID_183798 3000 nt of promoter + ATG

SEQ ID NO: 11436 - DNA, 3000 bp, Unknown
  misc_feature (1)..( 3000): cDNA_ID_2706492_gDNA_ID_2214495_Annot_ID_133560 3000 nt of promoter + ATG
gaaccaaagttcaaaaagggtccatttagtgacccaaatggcgataacaatagtactacaatgggctcaatgccgagtttatatctgtacctatatccaaacactcctaaaatcttccaactaaattccaacacatgcgaccggtatgacttccctaacaagtcacttgtttctttttcctctgtcctcctaaaacggacaagcaagctaatttaaaataaaaataaaaaacaaacgtcaatcgctggagaaaattaatccaccgtccgattgattattaataggtcccacttaaataaacgatctagatcttctcctcacgatgcaccgccctagagcttaattttccctcatctctttgtctataaaaccggaaaccaaacctacggattctctccttctccacataagttacatctctcgtgttttgttttctttgtctccgatttttttcgcgacgaagaagaagacgagagatagagagagaagtagagaaatcgaaggaatctgtaaccgattttaagatctcaatttttagggttgttgatttttcaatttctgggttaattttttttagggttttcatttggaatcatgtcggatgcgtattgtacggattgtaaaaaggagacggagttggttgtcgatcactcagccggagataccctttgctccgagtgtggtttggttttggaatctcactccattgatgagacctctgagtggcgtaccttcgctaatgaatcttccaacagcgatcccaatcgtgtcggtggtccaaccaacccgcttctcgctgatagtgctttaaccactgttatcgctaagcccaatggttcatctggtgatttcttgtcttcttctctcgggaggtggcagaatcgtaactccaattccgatcgtggtttgattcaagcttttaaaaccattgctaccatgtctgaaaggtagtccccattttgagatctcaccttctctgagattggattgcaactttataaacaattgaaacgtttagatcacacgatccttaatcctattggagattgattttgtatgaacttgctttgatttatcatcacgcctcttgcatacgtttgtgaaattacattgtcaattaaagaacaaaaggagcttcctttttaatctttcattgagagttttcactttccttgtactttatgcgtttagctcgtgatgtgttagtctgttcctcaaagggatgaagtttctgttggttgtttagagtgtttgtttacattgccagatttatgttctgctgtgtatgtacattattatccttgtgataatagagaacactaacttgttgatattttttccaggttgggacttgttgcaactatcaaggtaaacttgttcgtctctgctaacttaatatgtttgtggaatgtatatgttaggatgtgctgttggagcatttcatttacagctttggtggattttcgtgatatgtaggatcgggctaatgagttatataagaggctggaggatcagaagtcaagcaggggaagaaatcaggatgcactttatgcagcctgtctgtacattgcttgtcgccaagaggacaagccacgaactattaagggtacatttcaaagatttctcatttgagagagtcttgttacctcttgatatagctttgacataagtcaatcaaactcgtgaaccttgtgaatagaaatatgcgttattgccaatggggcgacaaagaaggaaattggccgagcaaaagactacattgttaagacattgggactggagcctggtcagtctgtggatttaggaactatacacgctggtgatttcatggtgagtttgtctaaaactaaaattgttgctgataccagaacctagctagagtgtgctaattatgttatgaaacagttgattatgctggctgcattgactacgtggtttcataactctgtatttgatgaaattgcagagaaggttctgctccaaccttgcaatgtctaaccatgcggtgaaagctgctcaggaagctgtgcaaaaatctgaggaatttgatataaggtacatttcaattatttccctcagttcgggacggagataaacacagcagaatcttaaagatgtttattttgggaaattgcaggaggagtcctatatcaatagcagcagtagtcatctatatcataacccagctgtctgatgacaagaagactctcaaaggttcggttttttcattctttcgggtctcatttattctcattgattcgttttaaacaaaacatagactgattaatatttggggtggggtgcagatatatcgcatgcgacaggagtagcagaagggacaataaggaattcatacaaagacttgtatccacatctgtcaaagatagcaccaagttggtatgcaaaggaagaggatctgaaaaacctgtcaagtccttgaagtcgtttcttgattcttctatatgcaatagagaactatctatatctataaatctatatcgactgaggaagatacaaagcaattgttctctctctctagtagagccttttgtttctttttcaaatcttttttgaagtcctttgcttaagattcttgtaatggcgttaaaaaacttgaagaaaggaatattattattgttatagtaagatggtaattttttcataatcttattcccccatacaatattcgcaaagcggaaaaaaactttgttcatgaaaagaaaatgagacaaaaatatgtttggatttacagagcatttttgatggctttttaatttgtcttcattggttgtctaattcttaaaaatgggctaaatacagtaaatagctattttttcttatcgaatttaaagaaattctatatattaacagaaaagtataattagtcgtaaaaggtaataacataaaacaaaataaatcaaaaaggtttgaatcccgacggaaaccctctctttgctgcttccccgactgcgtagtagtagctcgaatccaaaatcaatg

SEQ ID NO: 11437 - DNA, 3000 bp, Unknown; identical to SEQ ID NO: 11429
  misc_feature (1)..( 3000): cDNA_ID_1022807_gDNA_ID_2214495_Annot_ID_133561 3000 nt of promoter + ATG

SEQ ID NO: 11438 - DNA, 3000 bp, Unknown; identical to SEQ ID NO: 11428
  misc_feature (1)..( 3000): cDNA_ID_2706488_gDNA_ID_2214495_Annot_ID_133562 3000 nt of promoter + ATG

SEQ ID NO: 11439 - DNA, 3000 bp, Unknown; identical to SEQ ID NO: 11427
  misc_feature (1)..( 3000): cDNA_ID_3039876_gDNA_ID_2214495_Annot_ID_133563 3000 nt of promoter + ATG

SEQ ID NO: 11440 - DNA, 3000 bp, Unknown; identical to SEQ ID NO: 11426
  misc_feature (1)..( 3000): cDNA_ID_2706480_gDNA_ID_2214495_Annot_ID_133566 3000 nt of promoter + ATG

SEQ ID NO: 11441 - DNA, 3000 bp, Unknown; identical to SEQ ID NO: 11434
  misc_feature (1)..( 3000): cDNA_ID_2706513_gDNA_ID_2214495_Annot_ID_133567 3000 nt of promoter + ATG

SEQ ID NO: 11442 - DNA, 1592 bp, Unknown
  misc_feature (1)..( 1592): cDNA_ID_2707368_gDNA_ID_2214496_Annot_ID_133568 3000 nt of promoter + ATG
taatgaacaaataaattaaaatcaataaaacaaaacaaattaaggaaacaaattctgtagaatttttattaaagaaattattggtttgggtttttaaaattgttgttagtgtttatattttgtgattgaacgaaattatattttggtttaggttgataaaataatggttagggtttagattttgtgattaaaacgaaattatattttggtttgggttgataaaatagtggttagggtttagattttgtgattaaaacgaaattatatttcggtttgggttgataaaatagcggttagagtttagattttgtgaacaaaattatattttggtttgggttgataaaatagtggttaagatttagattttgtgatttaatttatttattctttaaatagatgatatgtcaaattctaattggtaaattaaaaaggatgaatgaatggattcatccctaaggggtgaacccaagaattgtttttttcttcgtatgtgtgaaaacactaaaaaataaattatttggaaacagtaggagtaagaaacaaattagagaaaatgacccctatcatctagtagattggagaaactataccaatcttcaggaagctatatcattggaattagctctgtacaatctatttcaaacatatgacaatctattaaaaaatattcttcatgacctatattacactttcgatctccgaatcaaaaagaagttgaactcctccgttgagacattgcccctaatagcattatttatgcgtttacttgcaatcaaatccaacctaaaccactaatgaaatcagaaaacttccagaagccatcaatttgacatgtagttacttcgaaaataccattctaaaacataaatagtaagctggatcaacttgacccacatgtatctatgagaaaatatctcatcaacgactaaaggtaagggttatagtattatatatgctgtagttgggttgagaatcagtagaaactgatacggtcgcatatgatgattgttagaaatttttgatttgttaaatttaatggatgtgaactttaaaacactctagaaaagataaataagctttttttttaatggagttttcgatctcaatcctttcaattaatatgtgtagtagaatatcatgtaaataataaaaatacaaaagaccgtttagataatatacataaagacttttgaagcagagtaaattaaaatatatcaaccaaccttagctgtgtattaatttttaatttctcaaccgtacatagctgtatctgtttttgtcaaccagctaagcttagctgtatataaaatgtcaaaacaatgattttccttacgctaccgtaataatagcatttagctcataatttaaatatttgccactgaaactaaatgactcaataaacaattacgactaggtcatatcattatgaaatatatcgtaaagaaattgcaaatgggagttggaaagcttgaaaattaaaacggggacagcacatttcagtggtttgtttttatatatagacatatgtaaaggcaaaaggataccaatatcccaaaaccctctcataaacaatctccggttgagcagccatg

SEQ ID NO: 11443 - DNA, 3000 bp, Unknown
  misc_feature (1)..( 3000): cDNA_ID_1808188_gDNA_ID_2214496_Annot_ID_183845 3000 nt of promoter + ATG
gatatacttcaaggcttcaattcccatggcaggaccaattgtattagtaatgcctgcactccaatacgtccaccatggtgctccaccgttaccagcatttgaccagagcttgatcactggacattatcacattacagacaaatacaacatttcagctccattagtctgtattcgatgataacaaagtagagatggaattgcacaagtgctcacttatataagaccagatcaagcagactacactttgagctaagttcaagaatgcaagatgctcgaacctcttctcatctggaccaaatctcttcgtggacctaatcagataaacgaatttcattagtccatgtaccaagaacaaattccggcagctatgtctatagaaattcaaaccacagattgcgaatagaaacgaatcaatgactctgtagcaactatttcgcaacaacaagctgaatcgagcaatgaagacgacgagaatcgatatgacctaacaattttacttacagagtctcttgaagaacgccttggtagatgtaggcggaccagatcccggagatacacaacgccaacaacagaattcgacggaatccggagccatggacctccatcgccgctccgggaaacgctcccacaccggcgatgattcttccggcggcgcttcgattcgaatttcactgatcgaatccgagaatcgcaaactaaaaatgtttgttttggatttgggaagatgaagctgttacaaaggcgcgaaaatagatacgtcgatgttccacgtggaagctaatcactggactgatgatctcacttgacgtttctgattggttaacgatgacgcgtgtacttttggagtgcagctcgtgaaatggtttccgtgtttgaattataaatataaactacacgccgttttctaatcgtaaaaaccacacgctagtctttgtaagttgcaaaatgatggaaagtttcggtgggtgctttgaagttgacaaaaagtagagtcacatcatttaagggtcgttaatctttgatttagatggagttttaagagttttaatctctacttaagtgttttgattgaatcatccaaacttcaaagcgacaaactgaataaaactcgtatgttcaatttatggattttgataaaatattaaaccaaagatgataagatactaaagagtgtaaagcaaagatagaattgttgacaaagaaaagattgaaagtataaatatgatagcaaataaaataatatgcactcaaacataatctataaactacgtttactacttttttagtccatgatcttttttatccataaatatcataatgcatcgatggcatggatagataatatggttgacaaatctatatataagaagagtttgaaatagtcaaaagattactattgaatgcttctttttgtcgtgtttatactattcacatgcttcgtgttaaaaccttaggatatttatataaatcacttggagatatatatgtatcaagttgcaaaatacggacattaaacttttaatgctattcaattgccgacaaaagaattgttatagtacaattttagtaatctgagcggcacaaccgtaacttgtctcactgaaaaagtaaaatgtaaacttaaattgtgatgagtgatgactgatgaccatgatatgtattttaacttcatcaactcataatggatgatttcaacactaccccgtatattacatgtttacaattataattttttttttttttgcctttcttctatgacaacttttagtggaatcatgatttgtgttaacaaattttacaattccataaaatggacgaataaataacacattttactcatttgataatctatttttagtgattgttctggtaaacaatgctttatgatactctctttctttatttttaaatgatgttttagttcaaaaaaaattgtttcattttaagtgatgtttttaactttttatgcaaatattaaatatatttaataatttttgaacaattatttttattggttaaattcattctatttaataatatttgtatagaaaagagaaaaattatatatttttttaatctgtgtgtaataaccttaaacatcacttaaaaagaaactgaggaaatagtaatttgcaaaaaaaaatcattattcgaatatcatttccacgtgtcaatgtgtagtgtccaaaaaaagctcttggatttgtcggtcaaacataatgtgaatgatagaggaattctttttggggtcaatgcatgaaataaagttttttttggttaatatgaataaagttttgatacacttgaaattaaaatattccaaaagcgtgttaactaatctctttctataattaaacagtactaaaccatctgtactccaattcgaattaattaataaaaaattttacattatctaaaaatgacaaaaatttaatggaatcttttaccaaaaattaatctttagatttgatgcatcttttaggagttttgcttttgcttaaaggtgaatgtaaaaaagctttgaagaaaaaatctgacgtggatctgcttacgcaagcaaagacgttgccaggtggtccagatctactaacacagtattttaccaaactatccctgattccccttatttgatacccgcgttaaaccaaaaatattcgccgaaaggaagggtagtatagtcatttaagagaaaaagccacggaccacggcgaacaaaagcaaacaaagggcagaatcgtaattttctcaaaaccccaccaccaacaccacgactttttgtatgtatggttgtgctgtgattctctgtgttccttcttccttccttcttcttcttcttcttctctaattctggtttcaaaaatcttctttttcttttctttagttggataatttagtgattataattattacaatcagcttttgcgccgcagagtaaacaaaaaaaaagctcgttggctttgttcctttgaatctgttgattgttttatcgagtgagaaatg

SEQ ID NO: 11444 - DNA, 3000 bp, Unknown
  misc_feature (1)..( 3000): cDNA_ID_3039953_gDNA_ID_2214496_Annot_ID_183844 3000 nt of promoter + ATG
aacgttaagaaaattcgttgatggtactcaccaccatggacgcctccggctcggagattcgttgacgatatttgtgggtagtgagatgtccatacttcaagttttactgggattatgaatttttttcttgttgatgtttgaacaatgaaaccttttccagttgtatttataattcacggtgatatttaagggtttggattagatcaaatattaccaaaatatattctctttttccccattcttatcttcttcaactattataaattagattattaaacaaatattttatattataaaccacaagttataaactaggtagacatgcttcttcgattgattatgtgtatcatcttctttctattcctcctccttggttgataaacttgttctattacccatttactatctaaataaatttcaggcgttaaaaaaattctttatattatagaaatatttactcagctgttataaaaaagtaaaaatattatatgtctgtttttacaaatttgtttttatcgatattatacccttgtacacttatttgtttttataatattatacccttgtatacttatttttttatcgattgaatattatatgtctgtttttacaaatttgaattacaccatatgcaggaaaaaaactaatattttattaactatatgtattttatatataagttaaaataaattagatataataacaaatatagtgacagacaaattatatatttatatttaatttcaatatagaaattttagaaaattagccttaatcgaatataaaatttagttaaagataaaaatttaagaaagagttaattcaaagaattaatgcaatttaacgatttgtaagtttttagaaataaaatatttgattgagatagaatttgtaaggagcagaattttaatagtaaatagtatagacatttttgaccaaaaagtctaccaaaaatgtatatttagatggttcttccatatataactttaagtacttattgctctgaattattttagttcttgatgtcaaaaaaagataaaaaataaataaattatatttatatatatatatatatattaatttgttggctttgatcctttgaagctctctaggaaaaatgtttttcaaaattaacacaggctcctttggatacataagatgggaaactggaattggtatataggtcaagtcaggtaattctaattaacccgtccggaaggtagctcttcatatgattctacgttaacctagtttagaaatattattctactatatactttgttcataggattatgtattatattataggtaactacattatcctgtgaataaaaaataataaaaagtaactacattatcgattattattatattgagatgtaaatgtgatctttcacaatttaactaaatataaaatacacgaaaatgtgaaaacaatttgaagccagagaataaaggttctctgacatgaagccacaattagtttttacaaaagcccaataagagcccaaataatatatatgaaagttggttaactctctccatataaatgacacatcatcacacaacaaagtgacatatgttatttgatgtttttcaaattaataaaactaataaaattaaataagcaaattaaatatatcatcaattctactcttaattgatttttccaaaataaaaataaaaaataaaattatgtaaacaaattaagtactactttcattatactctttttattttattaattttttttatcaataatcatgactaaattttttattgtgttgtaattgtttgctacctaacctcttattagtttagtaatttaattttgattctttgataacattgacattcatgttttttcaaataataaaccttcaaaatattagacctaccaaataatgtaatatagatcatttcttttatattaatatatgcaatgacagaagatctaaaagtattgactttaatgatactttaatttttgcattctttttattcttttcatatgaatactcttgaaatcttgtttagtttatatcaattctatatatttaatcatgagcctataacataattgttggagtattatatctggagaataaataaaaccataaatagtttatttataattaagttgaacaattttcaaatcatccaagacacgataatttctctaatattgatatatgcaatgacaaaatatccaaaagtgttgacttcaatgacattcaatttttgctatctttttatttttttgtacgaatactcttcagatctttttcagttcatgtaaatcgaaactttaatcatgagtctattacaatgttgttgaagtacataaaacaaggaattgatttatgtataatcgagttaggaaaattttaaaccacaaaaataaaatagttacatagaattgtatcaaaatatcattattattgttatatgtattcatgaagtgaaaaaatattaaaatcttataaataatcagctttatacacaaaaatatataaattgatatttcaagtcacaaatgaatctaaaccataaaattgtaactacatattatgaatctaattttattaacaatactagaataaacaaatagtaaatataaattagcataaagaacaatcaatgtaatttttttttaacaattttcaaaacaaactcacgcgtagcgtgggtactcatctagtaaaattaaagcagaaagagactcatgctgtcaagagtcgagacatagtacgacacaatggtcacaatggtgtggtgaaggaggacgaaaaattcagagctagcacagagattcaacttttctcagagggacagctggataaggttccagattgttctgctcgttttataaaaggactcgtttttgtagtatcaaaaacatgtaaaaaaaataaagcttgagagactttctttcattcacagagagctagagttgcaaaatgaagtttaaattaaccatatggcttaactgctacactg

SEQ ID NO: 11445 - DNA, 3000 bp, Unknown
  misc_feature (1)..( 3000): cDNA_ID_3039965_gDNA_ID_2214496_Annot_ID_183841 3000 nt of promoter + ATG
taaatgtttgttaattacgtttattcaaattgtgtaagggtggtacaataagtcaatcaaccaaagtggatgaacacataatgaccaaaaaaaaaagaaactttcttttttctttttattgtagtaatgaattattactacgttaactatgacattatctatagtacacactaaattttattagaatcatcgttctgtcaccatctaaattaaaattaaattattagaatgctaagtgtcatatcatatgatttagctataaatagttaaccaaaaaaagaagctataaacatataatactttataatcttcacttcatttacaaaaatatactgctaaaactgtaatttggtataagaacaactgatacttgaatttcaaattatttaattaacagatcaagtcgaatattttataaatattatcaaaagctgattaaaacaacagaaagactcttttcattctcgttactcaaatcgctctgttgacgtacataaacaattgtgtttactcctctaagtctatctcatattgacttacataaacaattgcccaacaaatgtctatattcaattaaaagcaacaaagaaaaaacactaactaaaaaaatagaatcataatctgaaacgaaaactaactttttctttgtctcaatgccgatcaattagcctccatgagcagtaatcctacaattataaagaaacgtattataatggttaaaactcttgtcatcaatccaaaaacactcatacttaatcttagatctcaatttgagataaattcgaaataagcctagatttctaagttacaacaaattttattgattttaatcaaataataaaaacatataaataattatttcattcacataaatatatctaagaaagatagacacacataattaacaaaagataaactaaatcgtattagagtcatcattttgtcaccatccaaattcaaattaaactattagaatgttaagtgtcatatcatgtggtttagctataaacatgtaatactttataatcattttaagttatttcttattaccatcattcactggaatttgttttacaacttttgtacagttgatctttaataaatgagctaaaactaaatagaagattttaaattttgatgattgtctatatatttagtgtaaaacagtaaatgaaaggcaaaaaagctgcaaatcagattctgaataaaaaacatgttatgacgtctaatcaaagttttaggatccgagaagtttacttttcttgaaacacaataatcgaaagttttgtttaatcaaaagaagctcataaataaattctaggatcctaaatagctaagtaaaaaacaaactgaaatagattacaatgaattcatacattacatttttgtagtttgagaccctagaaatacgatcttgttcctcctcttttgtttataggctcagttttaaaccttaataaattaataatctcggaaccgataaattctaattaatttataaaggtattaatttattaataaatcttatagagagattttattaattttgtaattttttaaaatttctatgtgagaagtagtttttgtctttataatcaatgtctttcaaaaataaattacaaataaaaaaccaattgttaagttagtaaacaaaaaacactttgttcaatatagtaaaaatattagaaatgaactctactaaaaattttatacaaatttaagaaaaatgaacaatactagagttaaatcccactaatttaattaaatatatatatatatatattaataagtgtaaaattattaatttatgatattgatgagatcatatgtttacgtaagagtttttaaaaacttattattttataatttcattgatttgtgttatttattacattgaaaacgtcaagaatttattaatttgtaaaaatagtaatttatcgaggattagtttataaataatttactgtattagcattcacaaggaataagcatagtacatatatgtcccaatgttaagtaaatcattttttgtataattacttgtcaaaaaaaaaaaaaaaaaaaaaatcatatagaaactaaaatatttggaaatatatatggactcaaaggttgtacaattttgggcctaaccgtattatatataatatacgggctaaatgttacacgtatgaagcccaaaataacctctctttttttttgtcaaacttgatttgtaattgaattttaataaaattaaataattgaattttaataaaaattaaataattgaattttaaatgcatatttttcgataaaaaaaaaatgtctgttgcagaaaatattaaatgatactttcgcagtgacgattattccaaggccgtttgcatgtgcagatgtgcttgatcatataaaatccattcaaattttctaacattagtaaatgaacagttcatcagaataaaagaaacagctcgacatttggtagaatctctaaccacacttttaaagaaaagacacaaacctaatggcttctctctctctctcgaagacaaaacacgacataaatttcttaatcctcattacctatcaccgacaagtaatgaaacatctctataatcttatctgatcaatcatatataaccaaaagcacttgttttactaataaaacaaagcaaaaatcatgtgaaatacaagttcttattgttaatttgttatagtagtaatcaaatcaaataaataaacatttcatcttcttggattcattgcaaaacagtctgtcaagttgaggttgtgcaatgtgcagtaatgaacaaacaaccaaaccaagtttaagaacttaaagattgcatttattgcctccaccttaattggcttttctactttcatttacttcttcttcttcttctcttgatccaaagttttcctctacactacctatagatctgtctttgttcctagaaaaatgataactttcagtgagtttctgtttctctaaaggcaaaacacatcttcactatg

SEQ ID NO: 11446 - DNA, 3000 bp, Unknown
  misc_feature (1)..( 3000): cDNA_ID_3039977_gDNA_ID_2214496_Annot_ID_183836 3000 nt of promoter + ATG
tggtattgatcttgaagaaatggaaaggaagataaaacatgatgtcttagcattagcagaaagattttactctgctgatgaagtgaagtttttgtcagctataccagacccggaagttcagcgaaaggagtttattaagttatggactcttaaggtagtttctactaacaacagataatactatatttaagattctgtaaatcgtttcttctcgaaagttaaaaactgttgtgatggttctgtttccaggaagcatatgtgaaagcattaggaaaaggcttctctggtgcaccttttaataccttcacaatccagtctaaggctggaacaaatggaggctacaatctttgcaagtttttttttagactttcatcacactctggaattgaatagggtgcttttatcaaatgcgattagttgttgcattgtacactttgtaaaaatttcctttgcagtgtctttttcatttccttttaagaaaaggtttttgcaagtatagtgtataaatagacagtagcgatataattttgagacgcttgaattgttttctttagacatctgaaatgtctgtcgattcacaggagaagacaaagaaatgcaacggagaatggaagtttgccctattggagttggctgattctcattatgctgcaatctgtattgaagatgatcaagctagtggaggtgcagttacagttgacataggtcctatgagggtaattgttcatttagtggtttcttcatcacaactttgtccttcttgcaggagctcctatgagggtaattgttcggaaaaccatcccgtttgttgaagatgaacttatttctgagaacaaaaatctttagtgcagtgtagcctttaagttcaccatcagatttttgtaagcattttgttttcaatacgtacctctgtagtgcatttcgtgcaagcgtaatatcaaagcttataatctgagtaccaagtttgtgactcttggaaaatcaccagtaatcctttcacgagcagaacccatcataaggttgaatataaacttgtttgtgaactgattgcagtaacgaagatggagagaaaggaaatgtgtaccagtttggagtgatactactacagctcatcacaggcaagtagtggctgcaggctcttcagagatgggaagtttgaagcttcaggtctgttctgttttagtcagaaccttttcatctttgtaaatccgacacggcttaaaagtttggaacctctatgttatttcctgcagctggagaacggtttgagagatataccatcagtattgaacagcttagcagatcctctgtgaaaggatcataagctcagtcattgaggacaacagtggaatttgctatcaactctcttggaatctgcagtatacaattcaagtgcagcaaaagatggaggccaagcagtgggaatcatgaaaatcatctatgaagacattgtgttaaacaaatgatcataatgagagacaacaaaaaatgtagaaacagtgacaagtgttaacaaatgaatatgcagtttcagggagaacttgacatatcttctattagctaaatttgtaaactgttttaccaaatataaagcaaaagaagaagatctgcgactgaaatacatatgataattatgaagatgaatgtggttacgaaaatacaaagaaaaaaaacatgaagagcaacaaatcacagagtttgaaaaacacagaaagacataaaagagagtggtagggagagtaaacttctctcagagatgtgatggtcgaaatcagatacaagagaggaggtttaatgttatttgaagacaaatgctacaatgatataattactagtcggcagtccagctttgttcgacaacctcgcggactcttctgttgtactcgcgcttgctttcactgaacattcgtgcagcttccgaatttgcaggagaattcggattaggatcacatagcaatgactgtgataaaaaaaggacggcgattgtttagccactaatgtaatcagattagatcaaagatccgtgtaaaagatcaggggaggaagcagaataacaacaatcatcaacggttttactgagaagcatttcgatatgacatttcttgtatatatacctgaatggaggttagtatagcagcgacatcgtatattggactccattggttttggagaatgtccaagcatatactcccatcagcataaactgcacaacattgaccaagtgtgagctttcgttgatcacatgtactcagagtaagaaactatgatgtgataatctccaacttactgtttggatggaacatccgtgaaacaaaccgcactgttggtggtttatttggataatcttccgaaaactgcagtgacaatttgaaagtacctaacaagaccatacaaaagagacataagaccagatacataaaagattgccaaaattctcaagttaagtgattacaataacaaaactttacctccatcccaaggggtatcatcaggcctgcaaatccacaatcagaagctttaataagtacagtgcagagaaacctatcaagtatcgttttttttttttgttactttagttcaattacccgaatataacagcattccacaacatgatattgttgtcttgtggagcaccactaattcctgcaggtgggtcttgctgcaacctcttgaaatccctcatcaatctcttcctcgctggagtcgacatccttctcttactctatcaaatcccagtaaccaaccattacagtatttcaaaaaccaactatctcagagcttggatatgcaattatctcaaaccatttgaatctgccaagcaagtttataacctaacctaatgatcatcacctaaatagcttataagcacaactaggaagctttgagatcaattctatacaaaactacacaattctctttaacctaggaagctttgagatcaattcacacgaaaatgtccaaaggatgatgataacatctgaaaagaaactaaaatcaatg

SEQ ID NO: 11447 - DNA, 3000 bp, Unknown
  misc_feature (1)..( 3000): cDNA_ID_3039981_gDNA_ID_2214496_Annot_ID_183835 3000 nt of promoter + ATG
aaaagcacaatacaattacaatcccttaaacattatacataaggcctgatacaagtagcaacaattgttcgaagaagcaccaaccaaaatagcttctgaaacggtatccaaatgcttggtcaagttcgacactgcattttccatgttccgcttcgttacacacatgatatcagagaatgaaattccctaccacagaaacaaacatcagcttcagagaaaatttatcctacaaaagactttagtgatataactgttattggaactctataagataccttgaaccacatatagccatagcctaatgctcccaatgtcgctgccgggacaataaacggtgtaaaatcagctggaaaatgtagaagtgagaaagttagagattaacaatcgttcatcaaaactaccaaatcaaaaactagccgagagacaaacctccctgagctccattcataacagttatctgccgcgacgaagccaattgccgaacctccattgctaatcgttgcatctacaaaatacccgcacatttatatatgattgttccaaaaatttgatcttttttaacaaacagatgcacaaaatatacctgagtagtcatggcatcagaatcatcatctacatgatctccagatttctcaaatcgcttaaccaaagccttcgaatttgaagtcaaaagaacaaactttttactatgtcccttctaatccaaaattgagaagaacaaagaaacttttactaatcgtacctgaagctcacccaaaatatctgccatcttcccattcttaaccagaatcgtactagtataaccttcagattcaaagacaacaaattagccaaaagggtcttttaaatcttcaaaattggggaaaatcacaagctcgagaaaccctagatacctgctccagctagaatcaaaatcttcgataacccaataccagattgcatagccatggtcgcagactcacaggtgcaacaaaaggaagttgtcttcttcgtcgagttcgctcgccggcgtaagaaactgtcaggtcaatgtcggtttctgttgaacggtgtcgtttcctactttataactcagttataaactctttgaccttgcactaaacgtaatgaataaatctgtaccgtgcattaaagtatcttagtcaactttctagaaatattgggtcaattttgtaaggtttttaatattgtcgggtaaaaacgaattaacgaaaactcatctcccataaaaacaatttatttgaatctgggagtatttttttttttgaatcaatcaaattttctataaaaattaaaatatatataatgctaggaaccaacatcaaaagtttaaaggatcaatgctaatatataagatacattgactaatctactcattgtcaacactaatatataagatacattaaaatgttgttgatttttaactttttaatgattttatcagattttaggtataaacaaatgaatcatatttactattttaattagaatttagatgttgatataagactacactagatttagattcaatttggttgattagtttttctttcaaatatagtagttgatttggtcacgattaaatgaaattatggagttgttcaaaaaaaaaatatgcagaataattttcatttgttgatgcatatcatcgtagattatataaatacatctattgtttgaatgtttaattgatagatcaaatagtgaaatatgtatagaaaatgattacaaagcaataacattatagccaaaagcaataaatttatatgctactcgatgacatgttagagagaagaggcaaattaatgacacttcgactcttgaagaacgaattattcagtaattatctgttgtttacagaagtttttttcacgtcgaatacatttttttggaagttacagttttataaaagaactttaatcttagagagactttgtttttgtttttaaaaaaaatacataattaagattttaatatagtttctgaatgttatctaatactttaacgacacaagaaatttgttaagtcatacatttgtatataatcagatttaactattttcgagattagcaaacttttgacttagatgttgaaaaacaacaatccatccattagagtatctcacgaaactgaatagttatcgtgtaagcctaaatctagttagaggatgtaaaattgttactttttctgcagttgaggtacaaaagttcaatcagtttagttttgatgtgtctgtagatttcaatatacactttttttttaattctttttaatttcagatccttgggaatgagtcatctataacggtttaattgcatggttcccctcattaaaattgcttgggagaggacttacttgctgagtggatgcatcaaactctaacgtcaatagttttttttttttttttttcgcaaacaccattttaagtcaatagttgtaactaaatacaacaaatacatttttgttgaattagattatatgttttgcaagattttttgaaactctggagtagctaaaaaaaaaatagtatgcaatatatttttttctattgatgcgtatcatcgtacattatatatttatatattgtttgattgtttaattgatttatcaaatagtgaaaatatgtacagaaaatgacttaaaacattataagttagaatcaagagcaataaactcatatgctactggataatatgttcaagagaagagacaaattaatgatgcacaaactcttgaatatgaaattactaacgtcgattcttttctcgttaatgtttattttcatgtttcgaaaatgtttattttcatctcttgttaatgtcttgcaaaagttggagggctttcttataaacgttggttatattggggcacatttgtaagatgttaaatatgattgggtaaaaaacgaattaacagaaagtattctctcctaaacccttttcgtcatcgtaatcccgcggtgaagaagacgaagaagcattgagagtgaaaagaaaaaca

SEQ ID NO: 11448 - DNA, 3000 bp, Unknown
  misc_feature (1)..( 3000): cDNA_ID_2706525_gDNA_ID_2214496_Annot_ID_183833 3000 nt of promoter + ATG
gttctcgtcccgaaatcgggacctgaaccgccacaaaattggtgactttaccatcatctttcccaaaaacaggacacatatgaaacaacatccaaaacggagacccagatttacgataattcaacaagctcacttgcactgatctctcttcacgaatcgcttcacgaatctccatgatcgatcttcgattagtcttaggtccttgaaaaactttaccgtttcttccgatcacttcttctcgtgaatagccagtcattttcaaaaaccctaagctcgcgaaaacaatcgggtgacccgaaataaacgggtcggtgattgtgaaattgtgtggaagctcctctaatgcttctttgatccataacgtgtatcgaccgctaaaggaatcttcttcttcttcttcagtgaaaactgattctgaagatttcgttaaggacataatcgtaataaacactcgatgatgattactcttcttcttcttgtcagtctagtgtttagttccaatcccatgtgggttttcaggcgaaattgagaaactttttcttcaaagtgaattcgaaacacgaaatccagattgtgaaatttgaaatcaggaatcaagaaaatgttttcattgaaaaaaagcgtaactttggagaagataagacagaggagagaaagagaaaccagagatccttaagtaaaggagaagaagaagaagatgaaatgagagatacggaattgagaaattaagagtcaatttgattgtaatctctatctgttagaagaaacgttcttctttcttcttgtctgatttttgttttgtggctatcggaagaggacgattggttttgtcgcgtttctcagttcttcgagttgttaagatattaaaaataaatattttcagatatttgttttcctaatttggtaaatacaaaatttataaattaaattttcaacaatttatctaaagtgatttagggataagtacaaggtttatgtagggtagacacaaattggataagataagtgaacttaatagttcatttagtaactaatgtgttgcgaaaaaaaaaaaaatgtttttgataataatatcttaatttgccgaccaaacaaaataattaatttaaaaatttataatttgtgataacattaaacaatagtgtaggttaaaaaaattttaattaattaatttggacataaatttttttgatctattaattgattaaaagtttattaataattttataccaaaaaatttaaaattcgaatttcaaatattataatttattacaaatttacagattaataaaaataaatgtataaaaaatttacaacaaaatataattataatcgttcaccaaaattttattaaaaacaaattttattaaaaatatttataacataaaaaaagaatacattgtatatcataaatctaataaaattaaaaaaattatctataaaaaaattatatataacattttttataatttacaataaaaaaataaatattctaaaaaccaaaaaaaatcactccggatatttggactaatctaatgctaattgtatttgttaaatataaaattatgcacctcttatttaaggagtgtagtgggtcctagaaaccgagattccacgtaaacaaaggctggaaaaagacaaaagctgactgtccatacttatctatttctcttgtgtcgtgtggctttgtttgtgttatcaaatcgatgcaacctggcttacgtggcatttatcatttgtacgttactctccggtgctaacatgtgtcattcactcatcgcttattattgattcgagtaaggaggcccattgggctgtattaagctgttttgtttttaaaacaggttcgcagacgaaaataacaaattgtcgccaatgttcatatcggccaactcaaatctatcatctaagagtaagaccaaaattaaaattcacagtacattgctacactactactatagaaaatggtgaaatacctaaaatgtgaagtctatgttcatgtttgcagttgctaaagactgataccaacgattgcgatcatcaaaagttattgcgcgcaacacattttttgttcgtttggtagtcgaacaaaaaatttggtcgttggtcgttatataacattttagggtgaaggattcgaaagaattttttataaaatactaaaatgaaacactttaattgctcgttataaatcaacttttaatcagaattttaatttatgtttcaaaagttaaaaatctcaaaacagtaaaacgaaatactgactagatatttgtttaaacggaatcatacgttttttttttttttttttaaatatcaggaggttttggactgaagcccgtaatcccctaggtctgaaaccacagcatgtaatattagtttcgtctcaagcgtcactcgaatttcgccaattgagctaacaacacttggtggaatcatacgtttatctgtttatattttcaacaaaaattatcattccgtaatcttatgatttctttgtaagtgcaagtggtctttgaagtttttgattgaattttgttggcttttagtaagaaatgatttgttactgaattcattttgtaatcaatcctaagttaatcaaaaattataaacaagaaaacccaaataagagtaatatttaggtttaaagacaaaaataactgaatatattccacaaaagaaggacaaacaaagaaagaacaataaaaaaaaccacacaaactataattggtttacaggaaaagtaacagagatatttacaaatcaatggtaacctaataattactctgttaatcgttaaatcctccattaatgtctttcattttccctctctctttcaagttccttgttatttaagaaagccatgaatccgattatctatttctaaccctgggccgaccagaaaactttttggacgacccaaacttcaagggttctaataaattcatcaccggaaaaagatacatataaaataaaaatctctcaccactgctgattcaa

SEQ ID NO: 11449 - DNA, 3000 bp, Unknown
  misc_feature (1)..( 3000): cDNA_ID_3039992_gDNA_ID_2214496_Annot_ID_183831 3000 nt of promoter + ATG
tcaatgcctagtttcctatatcacgttaaaatatataacacattgttaattgctttcgcagctttcagcttctcggactcacttgcttcatagtgttcccaatcctctaatcctacaatacaacaatgctttagaaccctagttttggaggcaagagatagtccactgcaatgatttagaacccttaattctattgttagaacgtccatgaagcaattaagcaaagattaagctatagaataaacttttctaactgattcaaagctctaagacgaatttcacaaacaagtaatacgcataactttaaaaccccaaccttgttcatcatcatattccaccggcaaaaatcaatcctgatgcacgaaattaccaaaacaaacctctcttcgacaagaaccaatcaccaattcagttttatccaactcaattctcaacctccaatgatgtactcgtcccgaaattaggacataacttgtgattgtgaaattgtgaggaatctcttataatgctggatctaaagtgtctgtgattgtgaaattcttacagtcctcaattaatcacacacgtccccgagccctaacttgcacagcaaacaaacacacagaaaaagaggggtgaaccaaaaaagccgagaaacggttagtcaactaacaaatcctctaaccacgttacttcctagtgttaaagcccatttagagcccatttctgttttcattttcggataacaataagtcaaatcaagttaatcaaccacagtaaacaaatccgaacgttgtaaaaaaatcaacaacggtcatgagtgaatttaagttaattttttatcacgtgattaaaagaaacgtaacggctaataccaacaagtaacaacgttcaaaattctctacttctatataataagaaggaaactcaagtacattcttccccaaccgaatggccgactttctcatcatatttggaagagttacagaacgataaaaatgagttcacaagctttttttttttatctttaatctctcgtagtgctaatgttaaagcggattttttgtcacgaaaagttcgtatccaaccgcttcatattacatttgtaaacaacattcttcagaattgtcttttttgagtcctaattaattttcggatgacaaaaaaaagaaaaaaactctaagtacactcctctcttgttacagccaaataaaatgtttgagatttttcaaaattcagtctaattatatccctctgctaattagattgtcgtcaatcacgtgatgttaatgtttgtaggagatactcaatttcaaggttagatagcctctctctatcttattcatctcagatttggatttacttcttttttttgcagatttactatttgcagaaattacctgatcactgttttcaatatgtatttttggttttctctttattttatcttccaacaatttttattatttttaaatattccaacaaaaaatttggattcccaattcaacttcaatggtccatgtgccttcaatattatgttagaagtcaaaatattccaacctgtgtactttccattgtttattaatattttgaagtattaaattgtttttcttaaaatatcacatttataaggttattatcaaaaatatcactatatattagttttttttgtcatcgcgattttaattagagcacaaaacgaggcaaatttgagaaatgttgtttatataagtgatatgaagcgtttcagtgcgaacttttcgcgccaaattatgcgcttttatatttacattacaagaaattaaagataaagaaaaattagttaattctttcttgtcgctctgtagttttccaaataagctgagaacgccgacaattcttttggagaagacaccatattcaccagatttgaacagttcgtaaaaaaatgctacaccttgattatcggccaatcatacacttcatcacctagattgcagcttctacttcgacttcactattaatttaatatatcaaaactactatcaaaacttttggatttatcagagtatcatagacacaaaacattaaggtttggattaactattttggttttagagtatagttttaaatgatatggtttatagtttagtgtttagggtttagggtataaatttaaatcttaacaaaatcttctaaatataataattaaaaatttaatactttaccaagtgtcattagctcaattggtaaagatcctacgtgaagtttagaagtcgccggttcgagtgacacttgggacgaaattattattacatgttgtggtttcggccttgagagaattatagatttcggtttagaacttcctgatatttaagaaaaaaaaatcacatttacggattagaaagattaagttaattttccggtttttgttaaaatccgaaaatattctgctaaattaatactccaaaaacaataaagcttttataccttttagataaaataggaaaatggtcttaaaaccaatggcatgaaaatttaaatttctcaattattagtagatatacaaaaaaatcgttgagataaataatacaataataaagactttataaaacagactaaattaatattatagctgtattttgcctttttaaaatagaaagtttcagcttagctgtatttgttgtttttatcaaccagctttagctgtataagtttaaacaatgactttcttacagaagatgcattaatatatctcattatgttatcgtacataagatgcattaatatatatcatcatgttattgtaataatactgtgaaaatagcatatagcccatagtttatgtgccacttgaattatatgacatgttcactcatcaaaaactcacgactaaattatatcattatgaaagaaatattaaacaaattgcaaatgggaggacatcacgtttcagtatgtatgtgtctatagatatgtaaaggcaagaacgatagcaatatcccaaaaacctcttaaaaatagtctccgatctaagcagac

SEQ ID NO: 11450 - DNA, 3000 bp, Unknown
  misc_feature (1)..( 3000): cDNA_ID_3039996_gDNA_ID_2214496_Annot_ID_183830 3000 nt of promoter + ATG
tgtcaggcatgtgctcttccaatcaacgaggaaaacttttatatatgtgtggaatgtgacttcattctacacgaaacatgtgcagaagctccgcaaaagaagtttcatccattacatccccatgcacttcaacaaaaggttgtccatgaaaatgatttattcttatgtgatgcatgtgatcgcttatgtaatggtttcggatatgagtgtacgttcgaggattgtgattacatactagatgtagtatgtgcatcggcttctgagccgttcaactatcaaggccatcaacacccattattcctagcgttacgcccaaacgtaaagccaatgtgccacatttgcaagtcaacgaaagaaaaccaggtactcaactgcattgagggtgactttattatatgttttgaatgcgctaccttaccatatgtgataagatataagcatgatgatcattacctcacattatgtcatggagaggaggcaagtgactcagattggtgtgagttatgcgagggaaaattgtcaactggaggagaaaaagggttctataagtgcgatgattgttgtactacgcttcatattaattgcttacttggccctaatccatttttgaagcccggtcaaactttcacgttgggtcgtaacgaatttctagttatacgcaacaattctcctcgtccaatttgcggcacctgcaatatgcgtcgtccgtatccagtaatgtttttctgggaatcggtaagctcatatcgttttctatgttcccctactggttgtattactatttgagttatcctttttttttttttcttaaagtttaattttgtttttttttttgtccttttttccattgtctttgattttggctctatgtttttgagctctgttttttcatttatttggtgacttggtttgtagcagacttttatttaattcagtatttggtgactttatttgtatactttttttggtgacttggttcttgtttttgttctctacgacaatgaaacagtaacagagtgtgaaagacagagagagatatgacaaaccttaaagagtgaaagaggtgagaattataacaaaaaaggcatcactcgcgtaaatgataggcatgtcgggtaagcatggattggttctgaatagttaaagaaacaatgtcatggggataatctatagtagcagactgtaattccatagtaaaacgaacaaaataacccaaaacacacaatacgaaactttgtttgctaatttcttctcattcatccacccaaaaaagccacattccttgagattttttgctaaaaaaaaattttgaacatataatatactgttttagaccaaagatagaaaacaaaaaatgaagaaaaaaaaacagatgaaaaacaattcacaaacaataaaaggcacccattttttatgcaaacggttttggttgcaaggtcttttatttttcaagacaaattctcactcacaatgcacatgttgagatgtccattccaattgaggtgatcataaccaaaccaaaataattattgaaaccgaaccaaaaagaaaataaacttttatagttgtaattttttgtatcaggatcatcgatcgataaccaaaccaaaagaaaaatcaagtaaaacgttagtgtaaaggctacatataatgcaatgtataagattttaacaatcccgtttgagaagagggtggatactagtattatgaaacaggaagagtcaactggatcaactaggcatatgaatatctactaataaaattttatattttacaattcaaatttaatggtccatgtgccatatataatataattgatctgacgatctcatcaacgaacaataagaccatctccaatggtttttcaactttgaaagtgagtcacccatttcactgattgggttcctagaaagaactgcatgaattcaataaacatttatgtacaatgacattgggtgttaaagaacataccgagactgttcaagtctttcagtagatcgagcttgcaaatggagaagattcattgtctacaaaaagtgaaacaataacgaataagtaatcaatagtagcttgtgacgcaaagacaaaaaaaactgttgattcgtgtcttataactcaccattcaaaatcaaggtccgtaaattgacaagagaagaggtcaacttaatcatccactcatgtccgtatagcactactttccattgtttattgatattcagaaatattaaatcgtgtcaacaactctcccacgatttaacacatgctagaggattttcctattaatacggttgatatgatctcatataatacaaaaagaccgttgagaaaataattaatacataaaaacttttggaaacaaagttaattaatactccctctgtttctcaatagtttaaggtttttgtacacaaattaataaaacatataaatttcatttaatttatctttttcctataaaaacatcattaattacaactaatccaaccaataaaaaaatataatgtaaaatataattggttaaaaactattaaatatatttaatgtttacatagaaaagtgaaaacaacacgtatattgaaaaaataaaaaacctttaaactacacttaattagaaacaggggagtatatactatgaaccagccttatcttagctgtatctaatttttttacttcagcttagctgtataaaattataactaaaacaataactttctaagtgaagatggattaatttatttccttacgatatcgtaaccaataatcttgtgaatatagttttataacccaaagtttatttatgagaaatacgaccactgaaactgtattactcaataaacaattacgactagatcatatcagtatgaaataagtattaaactgatcgcaaatgggagttgtttaagtctttggaaagcttggacaaagcacatttatatataaacgtcttcaggataaaaatatcccaatatcctctaacaaataatctccgattgagcagcc

SEQ ID NO: 11451 - DNA, 3000 bp, Unknown
  misc_feature (1)..( 3000): cDNA_ID_2717424_gDNA_ID_2214496_Annot_ID_133571 3000 nt of promoter + ATG
ttttgtcgcctcgccagcatttatcgatcgcgtttagggattcaaaccttcctccacgtctagttgttttcttaccgcgtccgacctgacggagatccctccttgtttcgtttactatccctgtcgtctccatagctctgagaaagaaaacaagaaaacattagtttcttccggaagaagttaggttttgataacaaatcaaaaaccctaactaggttaaattttagagaacccacaaggcggcatggtagttaaagtggtccgtgacgttctctgggttcgggtcataagattccaaagtttctcgcaatgcgttggtttgacgctgcgtccagtattcatcatattcggcgatgtgggcttgaaccgatggaaccaccacggtgagagacaacgcgacaaagacgaaaacgtagctcccaagattcaccatttgaatcagcagtggtgagagatttttattttatatgtatctttttccggtgatgaatttattagaacccttgaagtttgggtcgtccaaaaagttttctggtcggcccagggttagaaatagataatcggattcatggctttcttaaataacaaggaacttgaaagagagagggaaaatgaaagacattaatggaggatttaacgattaacagagtaattattaggttaccattgatttgtaaatatctctgttacttttcctgtaaaccaattatagtttgtgtggttttttttattgttctttctttgtttgtccttcttttgtggaatatattcagttatttttgtctttaaacctaaatattactcttatttgggttttcttgtttataatttttgattaacttaggattgattacaaaatgaattcagtaacaaatcatttcttactaaaagccaacaaaattcaatcaaaaacttcaaagaccacttgcacttacaaagaaatcataagattacggaatgataatttttgttgaaaatataaacagataaacgtatgattccaccaagtgttgttagctcaattggcgaaattcgagtgacgcttgagacgaaactaatattacatgctgtggtttcagacctaggggattacgggcttcagtccaaaacctcctgatatttaaaaaaaaaaaaaaaaaacgtatgattccgtttaaacaaatatctagtcagtatttcgttttactgttttgagatttttaacttttgaaacataaattaaaattctgattaaaagttgatttataacgagcaattaaagtgtttcattttagtattttataaaaaattctttcgaatccttcaccctaaaatgttatataacgaccaacgaccaaattttttgttcgactaccaaacgaacaaaaaatgtgttgcgcgcaataacttttgatgatcgcaatcgttggtatcagtctttagcaactgcaaacatgaacatagacttcacattttaggtatttcaccattttctatagtagtagtgtagcaatgtactgtgaattttaattttggtcttactcttagatgatagatttgagttggccgatatgaacattggcgacaatttgttattttcgtctgcgaacctgttttaaaaacaaaacagcttaatacagcccaatgggcctccttactcgaatcaataataagcgatgagtgaatgacacatgttagcaccggagagtaacgtacaaatgataaatgccacgtaagccaggttgcatcgatttgataacacaaacaaagccacacgacacaagagaaatagataagtatggacagtcagcttttgtctttttccagcctttgtttacgtggaatctcggtttctaggacccactacactccttaaataagaggtgcataattttatatttaacaaatacaattagcattagattagtccaaatatccggagtgattttttttggtttttagaatatttatttttttattgtaaattataaaaaatgttatatataatttttttatagataatttttttaattttattagatttatgatatacaatgtattctttttttatgttataaatatttttaataaaatttgtttttaataaaattttggtgaacgattataattatattttgttgtaaattttttatacatttatttttattaatctgtaaatttgtaataaattataatatttgaaattcgaattttaaattttttggtataaaattattaataaacttttaatcaattaatagatcaaaaaaatttatgtccaaattaattaattaaaatttttttaacctacactattgtttaatgttatcacaaattataaatttttaaattaattattttgtttggtcggcaaattaagatattattatcaaaaacatttttttttttttcgcaacacattagttactaaatgaactattaagttcacttatcttatccaatttgtgtctaccctacataaaccttgtacttatccctaaatcactttagataaattgttgaaaatttaatttataaattttgtatttaccaaattaggaaaacaaatatctgaaaatatttatttttaatatcttaacaactcgaagaactgagaaacgcgacaaaaccaatcgtcctcttccgatagccacaaaacaaaaatcagacaagaagaaagaagaacgtttcttctaacagatagagattacaatcaaattgactcttaatttctcaattccgtatctctcatttcatcttcttcttcttctcctttacttaaggatctctggtttctctttctctcctctgtcttatcttctccaaagttacgctttttttcaatgaaaacattttcttgattcctgatttcaaatttcacaatctggatttcgtgtttcgaattcactttgaagaaaaagtttctcaatttcgcctgaaaacccacatgggattggaactaaacactagactgacaagaagaagaagagtaatcatcatcgagtgtttattacgattatg

SEQ ID NO: 11452 - DNA, 3000 bp, Unknown; identical to SEQ ID NO: 11448
  misc_feature (1)..( 3000): cDNA_ID_2706525_gDNA_ID_2214496_Annot_ID_133572 3000 nt of promoter + ATG

SEQ ID NO: 11453 - DNA, 3000 bp, Unknown; identical to SEQ ID NO: 11447
  misc_feature (1)..( 3000): cDNA_ID_2717417_gDNA_ID_2214496_Annot_ID_133574 3000 nt of promoter + ATG

SEQ ID NO: 11454 - DNA, 3000 bp, Unknown
  misc_feature (1)..( 3000): cDNA_ID_2717413_gDNA_ID_2214496_Annot_ID_133577 3000 nt of promoter + ATG
tgggaatttttgtgatcagactgtaggaagaaagaggtactgaaatggcctcagagaatggcgatagcaataggagtcgctcgagggatacagttcttgcatatgggagtagcaccaggaatctttgggaacaatttgaagatagagaacatcatgcttgatgaaacactcacagtaaaaatcagtggctatactattcctttaccatccaaggtataaaactttgttttatttcttcttctattaattgaatctaagaaaatttaatggcatttctaggttggagaagagaggcctcaagccaaaaaacctcggaggttgttgttgtttcttaagatatgatcaaatgtgttctcttctatcaaattttgaaacttgttaatgaataatgtgcagtaatgaagatagagagaaagaagatgtgtaccagtttggagtgatactactacaaatcatcacagggaaagtagttgctgcaggatcttcagagatgggaagtttgaagcttcaggtctgttctgtttcagtcagaaccttttcatctttaagaatccgacacggcttacaaatttagaacctcaatgttattatttcctgcagctggagaacggtttgagagatgaaccatcagtattgagcagcttagcagatccatctgttaaaggatcatatgcttatgagtcgttgaggacgacagtagagtttgctatcaactgtctttgcgaagatcagagcaagcgtccttccatagaagacgttgtgtggaatctacagtatacaattcaagtgcagcaaggatggagaccaagcagtgggaatcatgaatcatccatgaaagcaatatatgaatgaaatgatcataaagagaggcaaaaactgtagaaacaataataagtttcaaacaagtcaagatgtagtttcatggactacctgaaatatcttttattagctaacttagtaatctgtgaataaaaagcaaaaggagttgaaaaacacacaaagacatgtaagagagtgtgtccagctttgctcgacaacattgcagactcttctgttgtattcgcgcttgctttcgctgaacattcgtgcatctcttaaaacaaatcagcagtctacaatcttgctaacctgcttgatgaagacatcaaaatcttcaaaaaccttcacaggttctttataacaagaatctctgtgcctggaatactatagaaaatcccaaaagttactgcaaacctctcactatgctcacgtctaacctctccatctcaaccacactccgtgtttcgggcaatctccaatacagaagtctctacctcatccagcattctataaacttcctttgttatgacttgtatcgctagctaaaaacaagtgcttgtgttccacataactataataaccatagctatacccaggttaggtaagatgtcgaaaacagcaagtggctttgccaagttacctcacctagcatacatactactgatcaatgcattttcgctcacaaaacaaattttgttacaataccattggcttttactagcttcttacttcttgaccaatctcttgagcctccaagatagataggcacaagaagacaggatcatgacaaacgctcgatgatcacaaacacatacacaccagcttccttcattcgagtttgatatgtgagctctcgtagacgcacgttccatggcgtcgagaagccaccgcagcgacggtcatggatattggcactttcgatgagcttggcgtgtggggtatttgtttatgtgtctatgaaccatttattggcaaaagggtatcgaccaaacaagatggtccatgtggatgagcctggttataagtttttggctgtgttgtttgaagttgttgtcattgccattgttatgatatgggacacttgaaaaaaacaccaattgactcattgatttctcaggtttgtaaagaaaggatgttgattttgaattgtttatagcaatcctcgtattgtagtgtactttgtagtttgtagcatcaaaaataacaacaacaatagtagaagagatgtttctctttttttttttttcgccagaagagatgtttctctcttattccattttgacaaggtttatcttaacggtacagtataaagatgggcctataattgttgagttgggcctgtagtggccttgtaggtgttgttattggcttcatttgggcccgccactagaacaccaaatggaccaatgggtgatttattttggatatcagtagaccaaaaattatatcaaattataaatttgggtctgatttgtatcagtggactgatatctttgatactcagtatcatgtgacgttgcagcatacggttggtcaatattttcgctcaaatcagagaaaaaaaaaatctttagtaatcttatgttataatatattaatttttgaatttgcaaaaaaaatttttttatacttaaccggtctcaccaatataatcatatttagtaggagtatcataaaaaatctcaaataaaaatcaaatattataaataatactaaaaaattactcatgatactatataagtatcaccccatatcatgctcttagaattgtgaaacttataaaactggtctttttgttaggcaatggtgaggcttttttactttcaggtttaaaaaacatgttgaagcattagagtgttgatgaatataagtttccctagtaaatagtatcttcagtctcagtcgtggaaggtgtagaaatgggaaaatctcatagaagaagtaattatgagtcatcgtaaactagaaagaagacgaaaagatagcattacgatagtattgatgacgttctggtttcgtaattaaagtgttttcatttcccaatacaaatgacttttgatatttcttctctaataaagaaagtcgcttataaatctcaatcatagcgagaagttttcatttcttctaaacttattcaaaaccctagtttattcttacaataatccttctgatttagctatg

SEQ ID NO: 11455 - DNA, 3000 bp, Unknown; identical to SEQ ID NO: 11445
  misc_feature (1)..( 3000): cDNA_ID_2717410_gDNA_ID_2214496_Annot_ID_133578 3000 nt of promoter + ATG

SEQ ID NO: 11456 - DNA, 3000 bp, Unknown; identical to SEQ ID NO: 11443
  misc_feature (1)..( 3000): cDNA_ID_1808188_gDNA_ID_2214496_Annot_ID_133580 3000 nt of promoter + ATG

SEQ ID NO: 11457 - DNA, 1020 bp, Unknown
  misc_feature (1)..( 1020): cDNA_ID_2717438_gDNA_ID_2214497_Annot_ID_133584 3000 nt of promoter + ATG
tatgaatttgtaagaaaacaacaaaaattaagccgatctatttgtcggcccagccgctaaagagtcaattatacccctataattctcacgcggtttaagaaaatgcaacaacaagtaaggggtgtatctgtcttctcacacataagatttttttttttgcttattaaaactcttacgtattgttgtttcctattctcaaatttgtattttccagattttccagaaaaatctcacagcggtaagaaaaaaagaaaaagaagagtcagtggtcttgttgtttcgttcttccttgttcgctcgacctggccgatgtctaaccaggaccaggagacgcgcacacaattcgcagaatgtaacgttgttgctactcttcttctctcgtttctgtgacctaagaaccattcgaattcgctgctccgtctctctggtttcgtccttgaaaaatcgtctactcgagattcctttctctagccacccatctcaactgctgagtagcaagctgtatttttgttgacctaactaaaccctagcttcttcgaggttttctcttgattcccttgtcttttctagctcccgaatttgccagttttacttgattttcatttttcatgtgtgatgtgtgtttttctatgtaattggatcttagggttttttgatttgggaataactctttgaaatcgcatttaagattgtgtctcaatgcttttttacgatccaattccttgagatgttttgtagatttctttcagtcgcttaattaggggaatgattggatgatccttcctgtgtagtaggaagaacagataaagttacatcagattccaatttttaaaagagaaccctagtttactattaagtatgtggacgattctatttcatatgaaaggtcttggtgttatatatgtcatctgtgtatatttatctaaaactgagtcagtatagtgcatgctttaattgatgagactgtctttcactttggcagtggcatttttttgacgagtgcttctcttccttatcatg

SEQ ID NO: 11458 - DNA, 3000 bp, Unknown
  misc_feature (1)..( 3000): cDNA_ID_1831425_gDNA_ID_2214497_Annot_ID_133585 3000 nt of promoter + ATG
agcagctcaaaatgctcgatccttgctttctaaaatttctggaagctcttcggatgaagttgatgatgataatgattcatccaacagtgaatctgatagaagcatacccactttgcgacagttggacaaaccatctcagatgctggaatctctttcaaatgacaaacagaagaaaagattgattgtaaagatctctgttaagaagccagcagagtctatgggaagcaagggagatgtgataaatcaggctgatttagagcaactatcttccaaacctttggaggagaatcacagagtgattggtatatattccagagaacccgggtcaagttctgtagatgcaaaaggtgattcagggtgtcagagtattccctactctatgaatacgccacagagagaaaaggccgataatcagttgataagatcttcagatcaagaccagaatatgtgcaagtggagggaagagattcctgtttgtgaacctaccgaattaactgcgcctgagaacatagaagaagcccaaccattttatgggtagggaaatcagactataatgggaacgttatgtttgtattatatttccgcaatatctaattcatcgtattctcttgcagggatgaagctgatgagattcttccaaagaaagttcgacgactgaggttaaagcttcggcatcccaacagtcctcgaaaactagaacctgatgaggtggcagatgatttggcagatggtggagatgggtttgcatccatagctccctctttcatgaatccgattatggattctgaacctgtgatagatagcgttagagattcttctgcacataactttgagtttggagaagctacagctgatgtgatacgtaggaaaagatccataagaagtgaatctagtacaagaaatagcgcattacgcataaggttgggctctggatctgtagacaaaataaagaaacaagggattccttccacaagcgtgtatgatgatgcatcacttgaagaatggccttctacctcaaaagctgggtccaggtctagatctgcaagcgtcagcaaaccaagtcttcatactgggataaggttgaatagtgtctcaggaaaaatctcatggttattgttgtctgaacacgaggaaggctgccgttatatacctcagctaggggatgaagttatttacttcaagcaggtacgtcctcttggctgctaattcgttgttcacttccttgtattaatttgccagctgtgatattaataaactttccttgactgtcgttttcagggtcatcaagagttccttaaaactaaagaattaaatgacagggaccgatcaaggtaccttccccgaaacctaggagcagtagagatttgcaaagtcgagaaacttaactatgatacatatcctggttctggagatagctgctgcaaaatgaccctcagggttctggattcttcttcatcacatgcctcccgcaaagagtttcaactgacacttcctgagctcattaatttccctgattttattgtggagaagactcgatacgacgctgcaattcaaacaaactggaaaattggtaatgagtgccgtgtgtggtggagagacgcaaccggtgaaggcggggcttggtgggaaggtaggattgagtcttcacaagtaaaatccactgacttcccagagagtccatgggaaagatacagagttgtctatgaaacaggggaaacgagtcttcacagcccgtgggagtttgacaatcccgagtttccctgggaaaaatctaccatcgaagatgagagaagagagaaactgctttcattatttgctggactagtaaaatcaatcagcaagcatcaggtttgtcttctctcccgaaactatcatttctcatcttgctgttatccttgcttgcctcgtaactgttatttgcttttgttatatattttcttcaggatagttacgggatccaaaagctaaacgaagcagctcaaaagatggatttctgcaataggtacgatacttcacaacacttagctctctgcaattgattctttcaaaacctccctagtcctataaactcgaacatgaaaacccatgtggtatacttgagaagcagaaacgatagttgagtcggtgcttatttaaataactcatatgatcaaacttgtggattttcttatctggcagtaatgattcatgcattgtgtaactctggtttaaaatcgcaggttcccggttccattataccctgagctgattcacgaaagactagagaatcagtactacagaagtattgaatcgtttaaacacgacgtggatgcaatgctctcaaatgcggagttgtatttcgttagaagtgcacatatgctttcgaagataaagcgactgcgagataaattgacaaaaacgttaagaaagctgatctgaggataaggcaacaccggtatgcttcttttggtcctttcttgatcttgtaaacacgttaggctgcggcagttttttcattatatagcgaagagagtgttaaaaagaaaatttaaaagttttcactctaaacaaaagaagtcggttttgtttgtagtaacccgacacaggtttcatgtatagttttagtaccacatgtctgtaaccgaaatttactctgttgtcacaaaaatgacatcataagtctaattttattacaagaagattattatcatttcatttgcaaactaaattgtttttcgttttaactactaatattaacattttattttcgttttaactactaatattaacattttattttcgtttaaaaggtttgtgaaatcgaaaacaaacattacttgagatgaaatgtaataaaattaaattaaatgaaaaccgaccagagaaaagaataaaataaaaacagagtaggttgaatagaaaacacggctgagagaaagtaaagagaaaaaccctaatcttcatcttcatcttctcccgccgtcggccgtaagaggtttcgaagaagcaaagtgagcaaca

SEQ ID NO: 11459 - DNA, 3000 bp, Unknown
  misc_feature (1)..( 3000): cDNA_ID_2706573_gDNA_ID_2214497_Annot_ID_183866 3000 nt of promoter + ATG
tagacttgtcctgagtttcctcagaggagaagacgaaagggccaacggtgaaaagcttcatcttaagcttgttttctaggagacgatagttttggagaatggctccgctgattccacggttaatctccgtcggaaaagaacacgtgtcagatggagaaagctcaagaaacgccctgcactctttgatcttgatcaccttcttataatccttcacctccgacgaagaaagcgtcgccaagaaataaccctttgcatccgtcgcttggctaagcaccgtcacatcctccgcttcgtaaccatattcatcagttctctcacatgtcactctcgccactgcacctgtccacatatatcaaacaaaagcttagacgagaccttgaactccaatcctagtttacaatatatacatgatgagatttaccttggataggtgtaagcttagatcctcgtttgcagtagatgagaccttggactccgatcatcgaggaaagcagttccccctcggtgattgtggctattccggcggcaaacagagacgagagaagcagcatgtagggaatgtagagaatcgaacaagtttgggccattttttaaaagtttaattcaatatttgaatatatgtctaaatgtgtttcgttgatgaatgaaagttgtaccatgagagttatatagggttttagcgataggttaatatataaatccaaagttatatgagaataagggatctgacttgagcgcacgttttagctcgtgatcctaatcattgcattcttatgctcctaaatgtgacttttgatatagtataggacgtgcagagacacttctttttttttttttttgatttttaaacatcagtgtctgtttcaattccgttcgatgatagagctagcgagcctcttcttttcaccagaaaaataaaatcgctatataccttttctctttctaatggtaagctttgtacttgtctatttgagattttaaataaatattaaatgaaagcgtttactaaatacttaccattttaccaattacgtggaaaaaaaagtactcaccatcaccgcgtcacgactaatctgtaggcaacatataagacgaatagaagaaagtcccagacccagaataatgttattaatgcatacgtttttcaacttctctttactcaaattttaagaagctttctaatgggacggatgatgaccgtcaatgaaatatagttcttaatttctaatctacaccaaaactgtcaaagtttcaacggaaccaattgggataaaacaaaaaatattatctttaaataatttgttaaatctaccaagtatttctttaaaggtggttttaaggtaataatttatgacagtaatggctaaaaccaatctttttcaatcagacacatattggatgaaagattttcactgaaatgtaacgattttgttatatcagtatattggaattaatcatccaagtaacatcttatatgcattctcttttcttttcttgttgacagctttttcttattaggaaactaagtaatatttcattaatgtattattattcaacatagcaaaaggatagccaagattaataaaaaagaatgagaatacaaataaaccgcgatataatgactgattgtgatccctagtaaacgggtttgggagccactggacttgagaaatagaaaggttcaagggtgtagagggtcaagttgtcgtggctaaggaacttggagttgtcgggagagagtggagctccggtgacacctttgttgacattggtcggagtcttacacgtgaagaccggagagctctcgagtttcactttgcagctgctgatgttattcaccttgtgtgagagtccgtacgtgatgaagtagaagtatcccttcaagtccgttgggtagctagagattgtaaccttagccactagctttccatatgaatccacgacaggacacacaaccttaaccttgccccctgtcaagtacatcaccggtttggtaagatgtcatgggatgtaacacatataatgtgaaatcgaaaatgtagttgcaccttggatggggtaggttttgtagccagatttgcacaagatgaaaccttcgatggcgatgtcagggtttgattttggcaagtatggagtcttaaccggtgatgtgtaggtggttgttggtttgggaacgtaaggttgtggttgcgcatagtaatcggcagtagccacaaccaccaccatcgcgaggaggaggaggttagtggcggcgcctgtggatgccattgttagtagttgctcgtctgttgttggttgtttaaggtctgatcacaagacatggcctcctttatatatgtggaacacaatgtcgacagaagtatcttaagattatataggacaagtgtcaactagatgttggccggaagagaagagacataattgggtgcacgtttaaatttttatatttccccaccaaaacctaataatattgatcgagaaatgttttgataattattactcatcacactacaccaagctaggatccgaattgagaaggaaggaattactgttttgtggttaattcttgagtgaagtatttataaatacgtatttacatgcatgattagataaattaactaaaacaaatagaagaatttggtaggaattaatattacgccatgtaatatagtatttgatgtgggagtagaaataattaagaaagcgttatggttcaaatgataactgcaaattctatgattaattaacttattattatttataagttgttaatggtagttgcaaaaggttatagagcacacagtaaataaagtagatgatattaataaaagtttctagaagaacttggtcgtcaagcaaaaacagcaacaactctgacattgtctcactatataaaacccaaattctctttctcttttaggactcggttcaaaaacgaaaacgcaaatacgtcttgttctagtttggagttggaagcgtaaaaaacaaaaaacaaaaatg

SEQ ID NO: 11460 - DNA, 3000 bp, Unknown
  misc_feature (1)..( 3000): cDNA_ID_3409345_gDNA_ID_2214497_Annot_ID_183865 3000 nt of promoter + ATG
tgaaggatctatcttgctctttgtagaagaggtattttctgatatgcagccattgatccgttctgttcttgatggatacaatgtctgcatatttgcatatggtcaaactggatcaggaaaaacattcacaatggtaagattagagttgaataaattttgaagactgttaacatttgaagctagagaattttaatgtttccatttttgtaaattttctagagtggaccaagagatctaacggagaagagccagggagttaattacagagcacttggtgatctgtttcttcttgctgaacaaagaaaagacacattccgctacgatattgcagttcagatgattgagatttacaatgagcaagttagagaccttttggttactgatggaagcaataaaagatatcctttttcatgaatggatatacttcttaatgttttgattagatagagagagagagatcattttcatgtttcagtttcatattccttaacattttttggtacgttagagatcaggaatagctctcaaaagggtctaagtgtaccggatgcaagtcttgttccagtctcttcaacatttgatgttattgatctaatgaaaactgggcacaagaatcgagccgttggatcaacagccttgaatgatcgaagcagtcgttctcataggtaaaagacaaaatgttttcaagagcagcgagaacaaaaaataatcttcaagagtcttactcaatataacatttttcaatcttatttttttttgcagctgcttgactgttcatgttcaaggaagagacttgacttcaggagctgtgcttcgaggatgcatgcatcttgtggatctagcaggcagtgagagggtagacaaatccgaggttactggagacagactaaaagaagcacagcacatcaatagatcgctctctgctttaggagatgtgattgcttcgctagctcacaagaacccacatgttccttacagaaacagcaaactcacacaactccttcaggactctcttggtaaaaggatacaagtaatttagtcctgaatatttgcagctaaataaaaactcacctttttcttaacttgggattgcaaatatgttatatcaggaggacaagcaaagacattgatgtttgtccacattagtcctgaggcagatgcagttggggaaacaataagcactttgaagtttgcagagagagtagctacggttgagcttggggctgcacgagtgaacaatgatacttcagatgttaaggaactcaaagaacaggttttttttttctctttttgcattaactgaatctgatggtttcactttcttggttgatagtatttgattgtctcacacacatgggcttttgctttgtttacagattgctactcttaaagcagcactcgcgagaaaagaagcagagtcacagcagaacaacatcttgaaaactcctggtggctctgagaaacacaaagccaaaactggtgaagtagaggtgattcttcttttctcaagcaccttctctatgatttaaaatcagatctcaaagtggacattgttttctgagtgattgcagattcataacaataacatcatgacaaagaaatctgagagttgtgaagtggaggagattacagtgaactcaccaccttggccaccagtagcaagtccaggacaagcctacagagaggatgaccgaagtttcgggtccagcgagtgggttgacaaggtgatggtgaataacagacaagacgagatgagaagagtggagagtctttggggaggagccacaacagagaatggtattggtattctgccggaagatttttacaggagagatttggcttcagacacttcaagaatattctctgaacattcttacaacatcttcatgggaaacaacaacagcacagacgatctagatgcagccacaagtgactcatctgagccagatttgctctggcaattcaaccagtccaccaagatacctacaagaagcaatattgagtcaaaactcaagaaacccgtctcaaaacctataagaagtcctcaatccaggtaagtgtcctttactcggtcaaaaactaaatgaaacaacaatatagaaaatctttaacagtttcttttgaatggttccaaaaaaaatgcaggaacaactcaaacaacacggtttcacgtcctttggcttcacagaaggtagggaatggtcctcgtggcatgaaacagttcggtcctgctgatatgaagcggaaagctactaacgccagacattgaaggccactcactcacacggatacatacatacacactcacatggcttcttattggttttgatttgtttatttttcatccattggtttttattgtttcttcttctctcgtttggttgtgcgagcttttatatacataacacagacaaagacaatagctagacaatgcaacaacagtttcttcttgttgctctctttcttgggttttgttttacttttctgttctatgtatattcttccactagctgaacataaaaaatatgaaagatttgtttgttaactatttgcttgagagtttttttagtatattctataatgcttcaaatcagagacttgttgcatttcttctaattagttacaacttttgcaatctttgctagtataaaaatattttattagaaatatgtaaaatttgggaaagtattatttcacaacagaaaaaaaaaaagcatagtacttttcaaatatcgaccaaccttctgattcgttgaatccgtttctcgaatattataattttatttttgttgtttgccctatctttctttctccctctgctcttgtgcaacttgatccgtcgtcttctctcagctctccatctccgtcttccaaggtttttgtttttgctatttacgtttacagattcgtaatcctatcctggattgagaaatgcgtagtttgatgattcttcgctcgcctctttgttgactgcagttttactgtcaggtagaagaatcc

SEQ ID NO: 11461 - DNA, 3000 bp, Unknown
  misc_feature (1)..( 3000): cDNA_ID_2994744_gDNA_ID_2214497_Annot_ID_183859 3000 nt of promoter + ATG
ctcaagacgtctccgccgtaatcatgacgaacgcttcttcagcgccaccgccgccgcaggcaaaacgcagacttgggagaacgagtaggtccgctatgaaaccaaaaatccacagaacaaaaactcgtaaaacgaagaaaacgtctgcaccaccggagcctaacgccgatgtagctggggctgataaagaagcattaatggtggagtcaagtggagccgaggctgagctaggacgaccatgtgactactatggagatgattgtaacaaaaatctcatgagcattaatggcgataatggagttttaacgtttgatgatgatatcatcgatcttttgttggacgagtcagatcctggccacttgtacacaaacacaacgtgcggtggtgatggggagttgcataacataagagactctgaaggagccagagggttctcggatacttggaaccaagggaatctcgactgtcttcttcagtcttgtccatcggtggagtcgtttctcaactacgaccaccaagttaacgatgcgtcgacggatgagtttatcgattgggattgtgtttggcaagaaggtagtgataataatctttggcatgagaaagagaatcccgactcaatggtctcgtggcttttagacggtgatgatgaggccacgatcgggaatagtaattgtgagaactttggagaaccgttagatcatgacgacgaaagcgctttggtcgcttggcttctgtcatgatgatattgattgatccgttatgtaatcttttttgtgcattcacagtttgaatctattccacgtcgtatcatatcataaagtttaggatctaaatattagtccattagttaaaattatctaatgcaataaaacccatgggatgtttggattgtacgtaaggttaaaatattgcagtctttgctttagtggaagaattaaactaatatgatgtttttctttgtaacgtatttactattttcatgtaatttaataaagagggtacgaaatgtaggtgtacatttgtttgggctgtatatatttctattgacattaaatacgccaaattagaaaagaaaatctttagttggaagcatctattatatgtacctctttcggaatgtaaaatcacgtttaatatttctgaactggtaatcaatctcatctcctaaaatttaatacatatcatcattgtcaaacaatcggagtagcgacgagaactatcattgtttttctcttgtgatattgccggccaaatattattacctcaatcattttgaagcgagtaaacatagtttttttcccccttttttttgttcttgtacaccaacagaaagctgcatcacatctgcgaatcatcacgtgccattcaagtgattactggaacgtgacatgaacgaatcttcacattgagtgttccaactctcctttgtacgaaactccaaacaagtagatatatattcaattattatggatgttggaacaatcaaattaactcttgtccttcttatcgtagagacatgaaattaacccaattctgtaaatgagtagtaagtaatctatatatatatagttgacaacagataacactataatatatgcgtccttataatgttaatgtaattatcatggtttgagttaacgtatagaagcattgaaacttagttgcagaccgaaaatgatatacgatcttaagagttaagaatcttgaactcggcaaattttatgaaaaaaaaacaatttcaaccatttctaactagtgattagatgaccaatagcaagcatgcaccaacgacttcatttttataaacatcatagggacctagacatatgcattttgtgggcaacggcctacgcattaaatttgtgtttcgaagattaaatttatgaacagaaggcaacttgcaaatttgctatgtacaaaaaacacaaaggaaaagtttgtaaatagagacaataagggagaaataaaaagatcgctttctcataagtccgacttggttccacggtatctagaatgcccacgtgatgtcatgtacttttccttcttctctattctaatatgttgtttaacaaaaagaaaattgattgataaaaaaaattgaaaaatttcatagtgatatctaaagtttaaacaaattatctctaagaaaattgttagtatgccttggaatataatttctcaacacacaaactgaagaaattgcttttaaaactgaaatttatatggtaatggcatactaataaacagctaaacttttgtagttttatgtgtgtgtattaagagatttttcaaagtgaatgcaccttaaggtcatgttttgtgaggtttgatgttggagagagtctttgatccgctgaagaattggccaggtatcaaaatcatttcttaatttatatataaaatttcaactttaaaaaagaaacgttcaatctgagtctcttaaaataacaatgtgaatgttaacactttgtagatatcagactatcatagataagattgctacttaaaacattgaaatgttttgatgattcgttaagcctagcaatatatcatgtcgttattgggcttgtttacttacccagttacccgtattccagttataagcccattaatcagcctcgtacagttctattgttggtcagattattaatttttaaaataagggcgtattttccgaaactaaagaaagtatagggtcttcttcttttctctaattaggaaaaagactttttcaattgtcttgtccgtgaaattatgtggagagctaaaccattcatagcccgacatgtaacccagccacgtaattagaccactcgatcaccgttcgtattaatgtgattaaatcaacgattgatatcacgccacgtcattgtttttcttttttcctttgtatcttctgttctaagggaagaaataataacgagagaagaacgttttaataaacagagagcagagcacttgttctaaagatcaaagcttaagtgagaagcagaaaaaaaa

SEQ ID NO: 11462 - DNA, 3000 bp, Unknown
  misc_feature (1)..( 3000): cDNA_ID_2706561_gDNA_ID_2214497_Annot_ID_183858 3000 nt of promoter + ATG
attgaagtggaagacgagagagggttaacggcgttggaactagcgagggagattctgaagacgacgccgaaggggaatccgatgcagttcgggaggagaattgggttagagaaagtgatcaatgtcctggaaggacaagtgttcgagtacgccgaggtggatgagatcgtagagaaacgagggaaaggcaaagacgttgaatatctggtcagatggaaggacggtggagattgcgagtgggtgaaaggtgtacacgtggcggaagatgtggctaaggactacgaggatgggctggagtacgctgtagcggagagtgtgatcgggaagagggtgggagacgatgggaagaccatcgagtatcttgtcaaatggactgatatgtctgatgccacttgggagcctcaggacaatgtcgactctactcttgttctactctaccaacaacaacaaccaatgaatgaatgattgattttgatgattacattcttctcaatttgcttctttctcatatgtgttggttcatctgaccggttcggttggtacgtaccggtacattttcattttcttttaagatgtgatcttgatggtttttggccttttggggacactatttgattttatatccatgctttgaattttgcttccctttttggggagattcatgatgctggctgacttgctctttatcgtcccaggtttagagaatacatcgtcttaggcttttctttatctcaaaacccatttacatttaattgggcctatatatttcatataggaagagagtacatgtaaacccaatacacaacttttatttatgggtccgtttcttgtaacatttgttggtgataaaaacaacttctgaagagtgataatgtacaactgcactttgcgattaaggaaattatagaaagatacaaagtctgaataaatgactagaaaatatgaataagtagtatccattcttctctaattcaacatcatttttttttttttttttttttgacgatattcgatgcattgtgtctatatgagagaaattttggtttgtcagttaatggctagacttttattattatgagcatctagattttcagtgcatgtgatgttacgttgatgatggacataaggagacaaaaaggacggagttgatttagtacacattttcgtttctttgtgaatacaacgatcgcctatttttcgtttgtaattttcctcttaattcgagaggggcctctagtcatgtgtgttacttctagttatagtgacatgaacggatgagaaaagtttctttttgtaaacaacatgcgtacgtaaatcaaccaaatatatttagtataacaaccaaattactgttggacaaccaaccaaacaacaattatgtagattatagattagagaaaacaaggaactaggtcgattaaccgcgaccacattagccaagtcctccagtcgattaatataaattgatgccaaatatattagttttcactgggttttatattatactatcagaccacagaagacatcacgtcacagttaacaacactacatatttcagattttgtatgaaacgtaactaggtttatatatgagaccttttaaccaattaaatgatagtgatatggtttgtaacattgtattgtatgtattttagttgatgtgtgtggttggtaaggtataaattagctagtgttacgaaaaatgacttcttgctttttctttcaaattgaacgacgctctatttcacttaaataaaaccacatttagttatttcaatgacaacatactaagttttttcttacataaattaaaaagtaattttggtttcagtccaaatttttctagttataggaaagaaaatgaaagagttgctttcaaaatattgaatccattgtatttaattttgaatattgaatagtatgtactaaagtcttttctttagtagaccaatctaaatacgaacgaaagtaccaaaaccatacgaaacggcaaataatgacatgtggggaacacgtagttagatgagcagtaaatgggaaacatattttgatggttgtcctcatattttcgtgtatcgagttagataaggaaacctgtgaaaatttatttctcaaaagattccgtaagattccgtcgaatataattgatatttcagtattttggactggcagcgaatatggcagactatacagattgatcgtcttccggcgttgttatagacattaacaaactttaactactcgtttgcttaattaggaccatctgatgactttattctaagttcaaatttagatgacctctctttcttgaacatatacttgttacatacttaattcattgtgttattgcaataagtgaattgtgtggttatcactaacacgctgacgtaaatttacacgtgtttatatgaacgcacacgtgttttgtagctcgagcaaaagaccatctggtcaacggactaggaggatccggcgtaaatcctttatataatttttatcaaaattataagaagaacaaaaaatgtgcgattactatctgatctacgtattcacgtgacaaacaacaattaatttcaataaagatctactaactttagagaaaaaatcttatgtgttaataaaaaagtaacgtcaatgatctcggcacacactagaattagtgtctaagagaaccacgacgaacctgcacggaccgaccacgagtctctcgacggtgaataagccacgacttcagtctccttctaaaccaacgtggcgcttcttacaccacacacgtgtcatcatctccttctccctcgaacccgcaagctcttttaatccctttcaattaattaattaactatatatcacctgcccctatatatatctaaatcagtcactttttgcttctgttgtctgtcactcagtaacttctctttctcacttacacactctctctctctctctccattgccttgacttttgtggtcagtggaataaacacatataaccgccggagaaa

SEQ ID NO: 11463 - DNA, 3000 bp, Unknown
  misc_feature (1)..( 3000): cDNA_ID_3040052_gDNA_ID_2214497_Annot_ID_183857 3000 nt of promoter + ATG
aatgttctttaatttataatctagctagtataaatcacatatcctatttcatatgcgagatatgaacaacaaagtagtatacttaattgaatcaataataatccaaattaaatttatatggtttagatcatagagaacctaaatatctaaaactaacaaagtctaaaccacctcgattaattgggaataggatgataatataaagtctagattttgttttagttcaaaaatcgaaacaaaatcttactgtaattaacttactacgttcccttactgaagattgatcaccacacggtaaaaaaaacaccgttaaaaggttaaaccaaaaatattgctaagaagacattatttggttagttgaatgaaaaattagggaatgggaagtgtgaaacctacctaaaatatggctatgtagatgatattcattgaagagagagagaatatagaagtgtaaaaagagaaaatggtgccagctatgaattagaaggatcaaagctttctctgaagctgtcatctatctctctctttccttatagtgctctgtttctctccacattcacacactctccctctctctctccattattaaatcacttgttgttgtctttcttttttcaaaccttggaagcaaggaattcttttttgatgatttaatcgaaagcttcttcctccaaacaaacatcaatggcggtttatcctaacgttaatggcgataagaagcactggtggttcactcacagaaaggtataagcgatctctaacctggaaatacagttcttgattcaaagatcatcatcaatcatgttaactttttttgggttttctcagcttgttgataagtatataaaggatgcaacaactttaatggcaagtgaggaggcaaacgacgtcgcttcagctcttcatttactagacgcagccttatctatctccccgcgtttggaaactgcgttagagctcaaggctagatctctcctcttcctccgtcgtttcaaggatgtcgccgatatgcttcaggattatatccccagtcttaaactcgacgacgaaggatccgcttcttctcaaggctcttcttcctccgacggtatcaaccttctctccgacgcctcttcccctggctcctttaaatgcttctctgtttccgacttgaagaagaaagtcatggcaggcatttgtaaaaaatgcgacaaagaagggcaatggaggtaatataacttttaactctcttttttgttttacttattactttcaagcaaaacgcaatcgttgatttttaaacgctgtttcaggtatgtggtgttgggtcaagcttgttgccatctaggactaatggaggatgccatggttctcctacaaaccggtaaacgcctcgcctccgccgagttccgtcgccggagtatttgctggtccgacgatagcttccttctcctctccgaatcctcctctgcttcttctccaccacccgagagcgagaacttcacccatctcctcgctcacatcaagcttcttctccgtcgtcgcgccgctgcaatcgccgctctcgacgctggactgttctccgagtcgatccgtcacttctccaagatcgtcgatggccgtcgccctgcgcctcaaggattcctcgccgaatgctacatgcatcgagccgccgcttatagatccgccggtagaatcgcggaagcgatcgccgattgcaataaaaccctagctcttgaaccctcgtgtatccaggcgttagaaaccagagccgcgcttctagaaacggtcaggtgttttccagattcgcttcacgatctagaacacttgaagcttctctacaacaccattttacgcgatcggaagcttccgggtccggtgtggaagcggcacaacgtgaaatacagagagattcctgggaaattgtgcgttttgacaacgaaaacgcagaaacttaagcagaaaatcgcaaacggagaaactgggaatgtcgattattacggcttgatcggagtcagacgcggatgcaccagatcggagctcgatcgagctcatctattgctatgtctcagatacaaacccgatagagcctcttctttcatcgaacggtgcgagttcaccgatcaaaacgacgtcgattcggttagagatcgagccaaaatgtcgtctctgttgctttaccgtttgattcagaaaggatacaccgccgtgacagcgatcatagccgaggagcagaggaagaacgccattgctcacgctcaaaagattgaagaacgcaaaccggttgaaaaatccggttctattaagagaaccggaaacgctgaaacgaaaccggtaaattccaatgcgtaccaaggagtattctgtagagatctcgctgcggttgggaatctactaaccagggctggtttcaaccatccaatcccggttaaatacgaagcgctcacctgctaaaaaatattgaaccgaattttttatcctaccatgtcagccactggaaacgtcgtcgtttccgtagattcgtcttcggacagaaaaacaaatcattcagccgtcaaaaaagaaaataaaataagaaaatatatatacatttgatgtatgaatacaaatgaaacaatgtatttaggtttggaagattattccaactacaagaaaattttgtcactttacttttatcttcaatgttcgtctcctttgtttcttcttcatcttcatgtgcatataaaacgacagaagcttgatttgcacgtaaattaaaatactagtatcaaaactttttttttcattttattatcaaaattatctcttaagctattgagcactaatttattttttattattgagttctcgagatttgcctagaaatagtcgatgagtctggctcacgtcagtaatattcggatgagtccttatctataaagtttggctgccatttgatggtattgggatgattaatttaattaggcaaataaaatatagatggtgaaaactaaataaaaactattcacttgctgtataata

SEQ ID NO: 11464 - DNA, 3000 bp, Unknown
  misc_feature (1)..( 3000): cDNA_ID_2706557_gDNA_ID_2214497_Annot_ID_183856 3000 nt of promoter + ATG
aaatgaaatgagtatagtaaaatatcttctcgatatatgtcattataataacagatagattcccagtgctttaaatttactcgaaccatcctggcaaaatctgtgaccactagctttaaacctaacgtcttcatcaatgacagtgtctgatatatatgtatatgagaataaatttataatttctcccctgtacgttaacgttgtgtctcaatgtaattataattactattagctcacgtaatgagtgcaggattaagattattgaattcgaaatgaatatatttggactcacccatataacatatatatatatacaggtccaaataaatgcgggaggaaaattgtacctgtaaaataaccaattaatcatatttttctttctttcttgttgttggattatagtgattttcttatctaggaaaatagagttcccaattataagggctaactgtcccttgacagaaaaaaagaatcctatgagaagaaaattgaatgatatttgcatctatctataatcgtttcatttgattttactattagcaacaaatttatttgatttaatacaaacttcaaaggaagtcgaggcagaaccagaacatgtgttttttccacttatgcatttatttgtttatgatgagcctgtcctttttgtttttgccctcttcttattttatgtaccacaaactccatcaacgcgatatatcacgggtattctttttttccattgttttatacaaactattgtaactagcattatatatataaaaaaggactttaattttgtagtttttatacgtaacgactgttcatatcattgactttatacctttatacgaaacctttttcacgtatagaaaattatatctaagtttttattataaatgtttttgttattgttaacctactttaacaagaagaagaagaaaaaaaaataggaaaggttttgttgtaagaaattgtattaaaaaataacatatttacaacacgatgtgctgttataaaagcaaacttatgagtccgaatgtttttgatctgatttaaaataccaaaaactaaaaaagaaaagaaaacacacaatgactttaatatgtaaaatacaaacaaatgttgcaaaagaaattaagagagtttggtaatgccaaataggcaaaagaataatttatgtgtggcaagcaatgaacaaagctgagctgtacatgtaccacacctttcattcattggttaccatctaactgaaagtgacacgtgtcttataatcaacaaggcttttctgacgtggcagtgcatttaattatttgatttgacaagtttaggctatcgttgtcaaacaaattaacttaattgtatcaaaattgctcgcacagtacgtaattctattttaagtttaaaatcaacggagacactagtgtcctatttaattatctccaagtaaagaaaagaaaaaataaatatttgtgcttagttgattaaaaattaaaaagcacgattcttgtcttgagctccttacagcttacaagataattaagaaccaaatcactttttttggttaaaacaaatcataatgttagaggctagagatacttatgatgttaccatgcactttccccttaataactagctcacttaattacagtaataccatacagtaatatctacttgatgtgcctattgagtcatcgatccaatgaacttattcactgcttcaattttatgaaatatcattattttaacgtaaacatcattactagtgtttttatcatcaaattaccgatttagtgtaagtaaatcgaatcagtttttaaatactgttggacacatatatacatagacatgccaattactcaagtatcatgttggtttgcatatactctagttttaatcagggtttatattatttcaatttaagtaaacgcatgctaaatgatagatcatgaaatagaattagggtatccattgtttaatgaaatgaatcgttgaactggtataacatgcaaaaagataatgtatccactatgtaagcattataaggtgccgctataacaaaaatatccacatggtcaagactgaaacgtcgcattatcaaacaatattacatgctcaattgttaaattttctagccaaattaataatatcgtcatggaggaaaaaaaatagagttgaataattggcaatgatcataatggatatgggtttctcaaaaacgcaatcatatatcgtgcgacaaggttacagtaatatagatatcatgcttattccaaaacgacgactaaaacgtaaaagattacagaactagtaaacgagtatataatgttagggaatgttctttaatttataatctagctagtataaatcacatatcctatttcatatgcgagatatgaacaacaaagtagtatacttaattgaatcaataataatccaaattaaatttatatggtttagatcatagagaacctaaatatctaaaactaacaaagtctaaaccacctcgattaattgggaataggatgataatataaagtctagattttgttttagttcaaaaatcgaaacaaaatcttactgtaattaacttactacgttcccttactgaagattgatcaccacacggtaaaaaaaacaccgttaaaaggttaaaccaaaaatattgctaagaagacattatttggttagttgaatgaaaaattagggaatgggaagtgtgaaacctacctaaaatatggctatgtagatgatattcattgaagagagagagaatatagaagtgtaaaaagagaaaatggtgccagctatgaattagaaggatcaaagctttctctgaagctgtcatctatctctctctttccttatagtgctctgtttctctccacattcacacactctccctctctctctccattattaaatcacttgttgttgtctttcttttttcaaaccttggaagcaaggaattcttttttgatgatttaatcgaaagcttcttcctccaaacaaacatca

SEQ ID NO: 11465 - DNA, 3000 bp, Unknown
  misc_feature (1)..( 3000): cDNA_ID_2706553_gDNA_ID_2214497_Annot_ID_183855 3000 nt of promoter + ATG
aatccctaatttttcaaacactaataatattaaattctcagtttcttctttttactctgttattgtatagctttttgatccatacgttaagcaatatatgccttgttttattcgtttttattttattttttgaaatagatagttgttgcttatgaaaacgaggtagttagatttgatttagaattattataaaaaaatacattcggactctgacgttgaatgattatattagaatgaagacatgaattcaccaaacctcattcaaaaaaagaaaaaaaatcttaaaccgaatgataatttgtttcgtcgtcatttaaaatcgtcatcaatttatttttaagaaaagaaattaaaagaaagcatcggaaaaagagggccagacaccagcttggcaatgctttgctgaaaagttgtgaataatgcaattaaaaacgaacgaaaataaataaacaaatattaaagaaattcgaatgggaatatcaacaaaattatttattttttagttatggagacaagaatcgatccaaaggttgtactctggacttgaaagtaaaaataaaaagggaatgacaataattgggaaaacatgtgataaaagtctgaattcacagactttgacagtagtttatagtttcatgggcttttttttttcctctctcacaggacacagaatcttatctaataggagcagccgctaatatgcactgtgtttggcatgttacgattagcgttttagagaattagagtttgattgaagtgtgttttatatattgatagtgggacattacttataaaaagcacaaggatacaacaatagagacagtcacatgtatatcacataagtggatggtcctcaatgtgttgcttgtaggacatttgtgagtatgtcaaaaacttatttcacatggtacactcatagattagccccacttaggagtgtctagaaaaagattgggactaaagtcttgttggatcgaatatgattccaaacacgttaatatttccctaaaacccatttcgaaaagtatggaatgatgaacacattataaatattttggttgtgcgaaataggggtcaaatgtaaaggttaactttgtattagttgatggatagtaaaaggtcaaatttagaagtattgggccaaatagaaaacataatgggccaaacagaccaaaagaaagacaacggtgaacgggtcagaacattaaaacatacattttctcgctacaattaacgctatcaatatatttataaaaccatttgtcatttcacttccttaactaatcacataaatgatttttttttgtgtgtccctactttttttatataaaatttaaaccggaaagttacattggataaagctttaacaatcaaaaacgtgttggatatatatataagtaacaaatttacttcttttaataattataataatattacattaaaatataataaagcatatgttacttttgaagaaaactaattttggattaaaaatttcacttttattatatttaatatgtgatctcaaaatttataaaagattatcgtcaaacaagtttatatcataattttatggtatatatatttatcgtgtgaccattataatctaatctatggtgtatatggtatatatgactaaattaccgtatttggagaagtgaaaatgttgcatcgtcccacgactcttagaaaatttgttagtcaaatcattcttttaattaaaaatttagatgtaagtttaagtcgtgaatttacatctaaaattttagatttaagtggcgaatttcgcagccaaactattattttaccacagacatgcagtgttgaaatctaaggtagtatgtggattttttttttggcagcaaaacgtaaagttaatttatctttatatatattaaaatgtaatttatctttttatacatatatatttatacacatcatatcataagacatacatacataaatctctaaatatgtaaggggtgtcatcagttttgccttctgtttatggttcactcgatttcacattaattattcactcaaattcacaaaggttatttcgttttcattagcgccctttctctcgactttcttgatgaatctttatttcttctatgtgaaatctaattaagactattttcgtgttatattgatgtttaaaaatgaaaatcttttggtttttatgtttaatcattttcatgagtattaaatgtaatagatttaagttaaaactaatatccgaatgcctgagatattgtttcctaaaatgagatgattgtttttatttattaccatgatttgtttgtactaagcttcctttcccctttgcaatacataggatataaattcatacatgttcctaattttatttttgcacttgagtttatggttttctttggtggaagatctatatgtatctatatctatattattttactcttttcttcgtcgtcatttatagtatattatatatatgcacacacacacacacctatatgtatagctcaattctagataaaatatatagaaatggatcttgagaatcattttttttgtattcttttgttatcaaagggtttcgactttgctccgaggaagaagataatatgaaaagagctttttagggtttatcattctccttgactttgcaaaacgtgaaatgtaaggcactttgatcgttgtactttgttgctttttatacgtatcgcttcctacaataagttaacaatgcttcctcgtagaattgcaaaacatttgtggaccgtgatttacatgactgagctcttttcagtggcttctttgcagcagcttcttccttggaggactaatcaagacagaaatctgttcctctaaaaacgatcgccgttctaggtaatcttgccattcttgacgagtcttgatctttagaatcaaatttataagggatcacgagatacacgtattaattattattttttttttttttgctttttgtggttatacaagttcactcaaatgatg

SEQ ID NO: 11466 - DNA, 3000 bp, Unknown; identical to SEQ ID NO: 11458
  misc_feature (1)..( 3000): cDNA_ID_1831425_gDNA_ID_2214497_Annot_ID_183854 3000 nt of promoter + ATG

SEQ ID NO: 11467 - DNA, 3000 bp, Unknown
  misc_feature (1)..( 3000): cDNA_ID_2706551_gDNA_ID_2214497_Annot_ID_183875 3000 nt of promoter + ATG
taataagtcaactgaacacttgtcctcactggggaaaagaatctggcacaccaaaaagaagcttacaacttttagaagaaactgatgaaacctgtagcctgatcgatcgaacagtatcaagaggatgcgaaacaaacggaacatgcaaaaagatttctttccagagaatctgtaacacaaactaaacattgcaaaggatccaatggcatgtaaccgaaatccaatctataaccaatgctaataacaattgcatgttccactgtatgcgtaatcaaaatccagaggtaaccagatcaaaagattataactttcatcatgggttcagtaaaacaagttgggttcttttcacaaaaccataattttcaacgaacaaatctcaacaaaaatagctaaaaaataagaaaagaacagatgaaacagagtgagccacgcgacgaaattgatcaatgcggacgtaccggagaatatctcggtgagcggcattcacaatacgccgatcacgggagagattttccgacaaacggaaatcgagaggagctgattggaatcggtcaagcgttggatattgcggtggagacttgggagccatttatacacatctctctaatctctgcatgacacacttcaattattgtatcgaaacgaggattcaagcgtacatcgaccgacacgtgatcttatctaattggatgatttacttgactaactaggattaattaatctcgcctttctttggtaaggtttaagaatatgagacctcaattgcaagttttttttatatctttttactccctgaattttgtttcatttcatccttataagcattagattttaatttcaacctgagtaatattagttttatcatctcctcgagtttagatattatcataaacatatatcttactaaaaacctgacctgactaatttattttctttataaaagataaacatgataaatatgaagtgtgaacgcattatcaaatcagaattagtggatatatatgtattttgtttttttctgattaaaaaaattattgagatatatacaattgaactatgaggacaaaaaatatatatatatatatatatcttattatataaagtatggttttcaaaattgacttggcacagtgtcaagtcaaacgattagatgtttacatgtgtcattcaaaatttaacttttttattctttaaaaaaatagaaaatcttaaaaagtaaacaaatttacatatactaatttatatgtctatatatttataaacaattaacatttattcaacaaaagcaaaattaacaaatttgtctttaactcatgtaatcataagtgaaaatagaacactttgagaaaaatagcttagcttataggatttaacttttcaattattttcatttattaattttaactcatttaatattaatttgcatgatgtaaaattaacttacgagattacgtgggtgattggtttgtctgtaactgtagatttactgctgtagaatttttgttgtaggtgtgatgactgtagctgtaagttttattgctgtagaaattagactgtaggttttattaatataattattacttaaagaaattgggtagaaataagattttggttgtatgtatttttaaacaaaaaaatattatcgggtcgggttcggtttgggttcgggttcgggttcgagttatttatatattgaaatatcaaattttgtgtgcaaatctattaaattacttgaaattttcaaaaattcccaaaacaacatgagtagttttgcttgaatatatctaaaaatacacaaaaataactaaaatatccaaaaaaattctaatattttctatatataagtataaatataactaatatatacttatatttgagatatgtttgcatacctattcgggtttgggtttgagtttttcgggttttaaagtttatatccgttcgagtatttgaaaatttcgggtacacccgcctaaataggcggaccttatctagtatatatatacatttgaactatattgtttactttttagttgatttaggctatgtatgacattgacataaatctacctgttatttatcacgtgtaattcgtgtaaagtgtaaactagaaagttcaaatacgtatttgtttttgttctgttatataggattgtcatagttgtaaatctacaatttattacaacatgaataagtacacaagcaatgtaattggatttaattgctaaactctttacatggtcaatctaaatttgataagaaatacgtcacatattactaagactgatagtttttttgttgtcaccaattatttttgttaaattgacgaaaacaattccaaaaactcaaatgtacaaaatcatacagtctcacaaacatctcatagagaaagatataaatctcccatatgggaacgataacacgaggtcgaaatactattcgtaaaactaaaacgccttagttataaatcgttagttgtaaccgcggtcgagaatacatacagatccacgaaactactactacacatgctgctgaattggaatttggaaaagaccatcttctttaggaagagctcacccaatgagtgacaaaggtgtcggtggcttgttttctacccatatgtatacatcaaatggtagtttcattaacgtttggttttgagaaaagtaagactttggctagtagctaggttcgtatataataaactcttttgagaaagttcatcactggtggaaaatgttaaaccggttttttctcattttttccgccatgttaaccaccggtttaaaaagaccgtaacacattgaaagattaataagggtatatttgtaattacggtttgctggcaatttttaattattattttaattagagaaaatagagaagccctatcaatgtacatggtatatatataaaaggcaaaaccctagaaaacgatactcttcgactcagccgtcctttcgcagaaaccatttggagttggagctttggacgacgaca

SEQ ID NO: 11468 - DNA, 3000 bp, Unknown
  misc_feature (1)..( 3000): cDNA_ID_3410317_gDNA_ID_2214497_Annot_ID_183873 3000 nt of promoter + ATG
cgtcaccttcttccacttatggataagcctcttcttccatatttgatcagataactgaagacctttaatttgactgattaaacgaaactataatgaattaaagtaaaaaactcgcaaagtgaactttaaactaaaggtttatggatgattggtttgttcttttttatttacgaattcttggatatctaataaaagagaaacaagaagcaatcattatttgatgttggattggtgaaagaaaagtctttgtagtgtagctgtttttctttgttgctgatgaggtcagcgattattaggtccaaaactcgtgcgtcaagagaattgagtgagctctctcctttttttgaaatattgggcgaaggacactcctccatgcatttaagttatcaaaagcattaattagacgatggttcaataaatgagtgagcatttagtgggaaacacgagtgtgatacggacacgtaaaagcattaatgcatgtgtttatagatttggtgatgacttcattgtctgactctgtctcctctttttacaagacaaaagatttgttgctgattcatctctgcctctctggtctgtgtgacacacactgcctaattagtgttattctgtatctcagctcttgcttactagcttatcttagtacttagtagtaaaacattaatgggtcattatgtatatgtccaatgaatcaccactttaaacattaatggatcacttgctagcatcttcaattactatataacaatttaactagctatagtaagaccattaatctagagatcatatttacctatcctgagtccatgtgtggactgaggaggattatacattaatcatagaccatatatataatatacacaatcaactaatgaaagagggaggaatggtatcaacatagggaccttttttttttccatgttagagaaagttaggacaacacgcaaagccctacgtgcactctttcattattcctctcttcttttgcccccaacagtctttgacgacccaccttgcccttttgacccttctctctcacgcacatgtatgttattaattcaaatggttcttttatgcttcggcatttatcatcatgatatacatacatatcgatcgatagaggaaaaaaaaaaatcatttatgtagtagaaaatttacagatatatatatatatatatatatatcgtataatgtatatcaatatttgaatttgaagagtttcaatataaactgaaacaaagttaagtgtagattattattagtgaggaactagtggatatccagtttattttggtatataccggtaattcattctaatgaagtgaaagaatatggatactgtatttttttaccatgccatagagtagatgctagctaaagattagtcgtaagagaggtctaaggtcttgcttgtcaacgcgtgaccggcttcataggatcctagcaataagacaatatggtacgcctagcaacctagcacttatatatgtagagtttgtgaaatttagggcagacaagcccccacactaaaaaaacagtaatatggaataaaaaaaagctttcaaaacttagcagttattagacaaggtattgtttggccctagctagcgatcgtttagctctcttcactctctcacttttttagttcaacccttcttttgcgtgagatgccatcatggcatggtatggttcttttgccttacgtaaaacacactcacgccagcacacacacacacacacataacatatacggatgtgcgtgtgagctagtcttccattaatgcaatctttgggcctatatatacaaacctttccataaccaaagttctcatactacaaacgcccctcatgtgcttggaaatgcgggtgagaatctccatgttggagaagcagggcacgtgcaaaccaacaaacacgaaatccgtctcatttgcttatttgcacgtacttaacttctccaacatgagctcttcacccattgatgttatatatcccttaaaccttattgataatgtgtttttcgttgttcttgactagctcttcgttgtttgtgtgtatatgtgtgttaaatcatttgtgttcgacggttgattaaatctttatagttctcatatatgtaagtgttgctttggttattttgaaccttattgtgtgctgaccaaaatgtagcgtttctagatgggattgacggtgcacaatgcacatgaaactaaaagggtaatttcaagctctgtcttcgccatatatagttctcattgagctctttggcttgcattaattacgagagtgttttcgaacttgtggttgtatacttcactgcatggaccgttattcgtttcaaattacctacagagttatacatttagcttttgtgatggtttttgcagcatatgtaacgcattgatcagaggttcatatacacaaaatggaacgaatatatggagagtcccatgatatgtaagatcgaattaatcacttgtttgaagatcagaaactgtactttagctactttaatctctaattttgtcattttcaatttttattctggttttacaataatgttagttttatcttcatttttataaatctttttttatatgtgtaaaaatggcaaaatgataaaacataggaaacttataattgagacctttatgattttaaataaatttattattcaaaaattttaatttcaaattttatattaattgacaaaatatatttcaataaaactgttcagaactataataggatttaaaaatgttaagaaaattcgtatttttttccttcattagtagtgtttataatagaaaaaaatcaatcaatatttctaaagttgaaaataaaataacagtgctacgatatattttaaatacattttattaaaatatttgatctaaacagaagaaattgtgtggggaaaatcgacgagagcttatcaattcatctcacactcttcttcactctcttctctctacacacacacacacacacacacacaaa

SEQ ID NO: 11469 - DNA, 3000 bp, Unknown
  misc_feature (1)..( 3000): cDNA_ID_2706590_gDNA_ID_2214497_Annot_ID_183872 3000 nt of promoter + ATG
tctacttttcttgcttctcaatgttcaacagcattacaattattataaatatacaaaaagttaacgtagttttaatatattggccaaggttagtgaaatgttgtttaaaatagtatttcgatgtacaagttgtttttttaattcacgggtttgctcatacgtcggccgcagaaatagcgaatctatgggtattcacttaagttgccatgttgggtaatttatttgattattgtttaaccaacagcaataagagagagaaaagattgtattatgatttgatgaacaagataaggttgcccattggtcaaaacattccccaagttgggatatatttctattttcatcatccttccatgtgatgtgccgtgcggcaaatctagaataatgtactatcaaagttgtcaaaaagtaaaaaaacataccaaaatatcaaaaacaatctttgttagtttgtttcctttccgatggaatcaatttacgacacaccaaaataaaatgcaatctaggaccatgttttgttgtttgaatttcattcagttaataaaatgatgatacaagaaataatcattcacatttctatgaaacttcagatgaccactttctctttttaaaattttcttagaaaggatattggtagtcaagaaaaggcaagagagaaaaacatttacaaaagagttaggctgaaaatagggacatttgtgaaaaagtaagaattgattttacagaaaaaggaagtaaatacaataaaataaagaaggatagcgctactagtatctattttaaaataaaataattccctattttagtaaattatttatcaaaaacacaatttatttcacaaattattttataattaaggtcacttttatatttagtaaaattgtaaacaaatgatatattaagaataaatagtactagataaatctaagtagtttcgataattcttttttcaaaattttgattttgtaatatgatgtaacaccaagtcaaggtttatacattgagcctagtcatggccaacgcattcctctccctttcttcccctttattactttcttttttccttgtaacgtttttttgcctcacctttatttatttattttggttttctttctttcaagtcatttcgaatccaaaagattaaagaaaaactggaacaataacacgtaccagcttacttattagcaatcagaaagaaagacagtgactgacgccaatatcttagacattacaaagatgaggaaacccaacgtacgttcttcacttacacaatctaatcatagcgtgagaagatcttttggatcaattaaaggtattgacaaagagagttacccaaatgaaaaaggatcaaacatttgatctaatccaaaacccgataatgcgcaaataaaaaaggaaaagacaagttttgaaagtcgaaaggtaaccgattacttcagaaaaatttcaagtattactctagttcatcagaaatccaatttgccatttatgataactaatcaaatcaaatactataaggagcaaaagcagaactaaaagagagaaagattttctcctacttagttttcatatatatatatcattatagcaatgtaaaagtataatccataatagttaaaagataaactcaagtcatacacagactgaccatgaagtttcgtagctaggcttagaccttgaaacctctgctccttcttcttcctcttgctatctcaatttttttaccagtttgacgtacatacggtttggtgtggctgtgaggcacaccaggagctggtccaaagtgcttcactgcttcacgtgtgttcttaggacctctaagcagaacctgcaatcattacggaatgctacatcaatcgctactgcaataataaaaagtgaaaatataacccttgtaaactgagtacaagtggtcctcgagatagatattctctaattttcatcgagatagccttttaaacaaaggcttacaagccactagattttgaaagttaggacagtaacctcaaattccaatcatcatgaaacgagacatagtaactgaactaagctacatacgtcacgaacaagtaaacgattagcacaagtttccacatttcgacaactgaactaagagtgaaacaagaatgggatataccgtgttctctgaccaagtggggcacggaagagcgagctgatcaaaagtgaggcactctccaccagccttgtggatcctagctctagcgctctcagtgaacctcaatgcagtaactgtaagagccggaacatcttcgattctaacatcatcagtcacagtaccaacaataacagcaatctttccatcctaataaaatcaaacacacagagcattagttcatgagtcgccaccaagtaacataacatcgaactcaatgcagtaacaacctaaacaacaacaaaattcaaacctttccgtccatgtatcggaccagacgagagagagacagtggcgctttgttcactttgctcatgaacaaacgcttcaaaatcacggcattgaacttgctttctgttctcctcaccagatatcggttcgcctaaaaaaaaaaaaaatttaatctctgacggatttttagtcaaatcctcaaccttgacaaggagcttgagatagacatcgtcggatttaggctcagtacgtttcgtcttcttgctcttacctccggctatcaaatcgataccctaaaatgatgaaacacacagaagaagcccaaagtgagagtcaaaatctagaaagaagcagaaccgaagattgcttgggagtgaagataagaagtgaaactactaataatatgtatcagtttagggtttttgatgggctaaatatattaatcggcccactaataagaatattgggctaactgatgggcttattagggctttaggaggaacagagttaaacctcacttttttttattaattcgattttgggtggttccggctaataatcttctccgaattcgacggagagatttggtgaagacg

SEQ ID NO: 11470 - DNA, 3000 bp, Unknown
  misc_feature (1)..( 3000): cDNA_ID_3040033_gDNA_ID_2214497_Annot_ID_183869 3000 nt of promoter + ATG
ctcatctactgcaaacgaggatctaagcttacacctatccaaggtaaatctcatcatgtatatattgtaaactaggattggagttcaaggtctcgtctaagcttttgtttgatatatgtggacaggtgcagtggcgagagtgacatgtgagagaactgatgaatatggttacgaagcggaggatgtgacggtgcttagccaagcgacggatgcaaagggttatttcttggcgacgctttcttcgtcggaggtgaaggattataagaaggtgatcaagatcaaagagtgcagggcgtttcttgagctttctccatctgacacgtgttcttttccgacggagattaaccgtggaatcagcggagccattctccaaaactatcgtctcctagaaaacaagcttaagatgaagcttttcaccgttggccctttcgtcttctcctctgaggaaactcaggacaagtctatccccaacggctactaaatttaacaatgttttttttttttctttttcagtttctaatgccctaatgggtcatattggcccatatatcataatatatttatgtatttagtggctttttgattgcataactcacacatgcaacaattactgaaaatatactgaatatctattaatgcacgtgatttttaacttttatacacactatagataaatcaaagatcaaaattgcaatataattacggaatccaatatcttctaaatttgaaattgtgagtaagaatatatatttatgctgcataattatagtgtttatacagtgcataattacctccgtacgttaatgtagtttccaataagcaaactatcaaattattacactttaatgggacaagtgcttcgtataatagtgattattaattactacagaagggcacaagacaaaattgagagtcaaataattaataaacacaactcgaaagaaacttgccttaaatatgaagaaggcacatgctttttccgcgtaatttgaacaactagtgctagtgggttttgcttaacagcttaagtagatacattacacaaaattttgaaaattgagtcattaaaatatacaaattatcttaaatatgcttgacttttacaaaagtggtttaaattttcttgagttacgcaaacgggccaattcctttggcattgcatgaattttcttcacgcgttatactttcatatcaaataaaacgtcgccgttcagagatacactttttattcagtccttggacttggatatggaacacggtttttagttgatcagaagtcaaactcattgtcctatcttgccgaatttagaggatttatttaaaaaatattaaataaataacgcatgataatgataatttataaaaagtataaccaaaaaaatatctcttaaagaaaagaaagaaaacaaaatgtagttttgagtttattggttatctggatttcggaagatatatatgattcataattttttaggagttaaatttattttttaagactttaaaagaaaagaaaaaagttagtagacattgtttcccataaaaaaacaccaggtctcttaagtctcaagtctaaaccatttttccttttctggtcagataattctatcacacatgcttgaatttgaatagaaagacaacaaaagatggtttaaaaaaaaaaaaaaaaaaaaaaaaagacaacaaaagacaacactgggaacatatttacccaaaattcgataatggacaagctacattcaatctatgcttatgttttcgttgcatgcgaatgcatgttgtattacgtttatgagggttgtgctctacgatgtatactcttcacatgacaatatgtacactaatctacattgataatacatatatttgttaagttcaaatagcattatcacaaatgattaagctatatgtatgttgtggtgaattttccataaataatttgtcatctgtcaataaaattttaatgtatattctataacggaattacggtcagatacatgtgtaggtaatgaattaagtaagatattaatatctgtcgacaaataaaagcatcaatatgtatgtacattctcttaaaactgattcgatttcattgtgtcactgtgtatattgtatagaaacatatccaaatacgtatctcatgcctgtcctctaacttaaaaacaaaagaaaaaattatcataccagccaatttaatgcacaagattaactaattgatcaataattggatacgttacaactctataaaatcatatccattacgctttgggcaatggcaaattggcaatggaagtaaaatcaaaagttaaacaaatgaattaccatttgaaacactccaaattggtattcgtgtccaaaataatttttccaaatgtcccatcattctaaagtttttcaccttatgcatggaaccttcctagtatatatacagttctaaaacgaattttatttgcaatggtctatcagagattataatgtcaagatcttgactttttgctgatgtgtagtgtaatgtgctgttttaccaacatgttatatatataatcgaattttttcttgaaatgcctaacgttggttgacaattttatattacgaaaacctttccctgattatgcatattcaaattgcggtaacagaagtttggtcaaaatttgactttcatgtaaaaaaaaaaaaactcaattgaccttaaacttaaattaaacacccatttatatataattatcacggatggaatttactccttaattacagtgattatttatctaatttttggtgagagacagatctatgcgtgtgaatattatcacaatatggtatatatgttgaattttttgacaccgccacaattatatatgtagtatgtacacacacattatcattgacttgaatttgtatgtatattcaaattcaacgttctcaaaaccctatatatataatccaaaacatttagcaaaatatctccaaaccaaaacacaattaagctaaaaaaaaaaccaaagg

SEQ ID NO: 11471 - DNA, 1020 bp, Unknown; identical to SEQ ID NO: 11457
  misc_feature (1)..( 1020): cDNA_ID_3040056_gDNA_ID_2214497_Annot_ID_183853 3000 nt of promoter + ATG

SEQ ID NO: 11472 - DNA, 3000 bp, Unknown
  misc_feature (1)..( 3000): cDNA_ID_2706553_gDNA_ID_2214497_Annot_ID_133586 3000 nt of promoter + ATG
aaaaatccctaatttttcaaacactaataatattaaattctcagtttcttctttttactctgttattgtatagctttttgatccatacgttaagcaatatatgccttgttttattcgtttttattttattttttgaaatagatagttgttgcttatgaaaacgaggtagttagatttgatttagaattattataaaaaaatacattcggactctgacgttgaatgattatattagaatgaagacatgaattcaccaaacctcattcaaaaaaagaaaaaaaatcttaaaccgaatgataatttgtttcgtcgtcatttaaaatcgtcatcaatttatttttaagaaaagaaattaaaagaaagcatcggaaaaagagggccagacaccagcttggcaatgctttgctgaaaagttgtgaataatgcaattaaaaacgaacgaaaataaataaacaaatattaaagaaattcgaatgggaatatcaacaaaattatttattttttagttatggagacaagaatcgatccaaaggttgtactctggacttgaaagtaaaaataaaaagggaatgacaataattgggaaaacatgtgataaaagtctgaattcacagactttgacagtagtttatagtttcatgggcttttttttttcctctctcacaggacacagaatcttatctaataggagcagccgctaatatgcactgtgtttggcatgttacgattagcgttttagagaattagagtttgattgaagtgtgttttatatattgatagtgggacattacttataaaaagcacaaggatacaacaatagagacagtcacatgtatatcacataagtggatggtcctcaatgtgttgcttgtaggacatttgtgagtatgtcaaaaacttatttcacatggtacactcatagattagccccacttaggagtgtctagaaaaagattgggactaaagtcttgttggatcgaatatgattccaaacacgttaatatttccctaaaacccatttcgaaaagtatggaatgatgaacacattataaatattttggttgtgcgaaataggggtcaaatgtaaaggttaactttgtattagttgatggatagtaaaaggtcaaatttagaagtattgggccaaatagaaaacataatgggccaaacagaccaaaagaaagacaacggtgaacgggtcagaacattaaaacatacattttctcgctacaattaacgctatcaatatatttataaaaccatttgtcatttcacttccttaactaatcacataaatgatttttttttgtgtgtccctactttttttatataaaatttaaaccggaaagttacattggataaagctttaacaatcaaaaacgtgttggatatatatataagtaacaaatttacttcttttaataattataataatattacattaaaatataataaagcatatgttacttttgaagaaaactaattttggattaaaaatttcacttttattatatttaatatgtgatctcaaaatttataaaagattatcgtcaaacaagtttatatcataattttatggtatatatatttatcgtgtgaccattataatctaatctatggtgtatatggtatatatgactaaattaccgtatttggagaagtgaaaatgttgcatcgtcccacgactcttagaaaatttgttagtcaaatcattcttttaattaaaaatttagatgtaagtttaagtcgtgaatttacatctaaaattttagatttaagtggcgaatttcgcagccaaactattattttaccacagacatgcagtgttgaaatctaaggtagtatgtggattttttttttggcagcaaaacgtaaagttaatttatctttatatatattaaaatgtaatttatctttttatacatatatatttatacacatcatatcataagacatacatacataaatctctaaatatgtaaggggtgtcatcagttttgccttctgtttatggttcactcgatttcacattaattattcactcaaattcacaaaggttatttcgttttcattagcgccctttctctcgactttcttgatgaatctttatttcttctatgtgaaatctaattaagactattttcgtgttatattgatgtttaaaaatgaaaatcttttggtttttatgtttaatcattttcatgagtattaaatgtaatagatttaagttaaaactaatatccgaatgcctgagatattgtttcctaaaatgagatgattgtttttatttattaccatgatttgtttgtactaagcttcctttcccctttgcaatacataggatataaattcatacatgttcctaattttatttttgcacttgagtttatggttttctttggtggaagatctatatgtatctatatctatattattttactcttttcttcgtcgtcatttatagtatattatatatatgcacacacacacacacctatatgtatagctcaattctagataaaatatatagaaatggatcttgagaatcattttttttgtattcttttgttatcaaagggtttcgactttgctccgaggaagaagataatatgaaaagagctttttagggtttatcattctccttgactttgcaaaacgtgaaatgtaaggcactttgatcgttgtactttgttgctttttatacgtatcgcttcctacaataagttaacaatgcttcctcgtagaattgcaaaacatttgtggaccgtgatttacatgactgagctcttttcagtggcttctttgcagcagcttcttccttggaggactaatcaagacagaaatctgttcctctaaaaacgatcgccgttctaggtaatcttgccattcttgacgagtcttgatctttagaatcaaatttataagggatcacgagatacacgtattaattattattttttttttttttgctttttgtggttatacaagttcactcaaatg

SEQ ID NO: 11473 - DNA, 3000 bp, Unknown; identical to SEQ ID NO: 11464
  misc_feature (1)..( 3000): cDNA_ID_2706557_gDNA_ID_2214497_Annot_ID_133587 3000 nt of promoter + ATG

SEQ ID NO: 11474 - DNA, 3000 bp, Unknown; identical to SEQ ID NO: 11462
  misc_feature (1)..( 3000): cDNA_ID_2706561_gDNA_ID_2214497_Annot_ID_133589 3000 nt of promoter + ATG

SEQ ID NO: 11475 - DNA, 3000 bp, Unknown; identical to SEQ ID NO: 11461
  misc_feature (1)..( 3000): cDNA_ID_2994744_gDNA_ID_2214497_Annot_ID_133590 3000 nt of promoter + ATG

SEQ ID NO: 11476 - DNA, 3000 bp, Unknown
  misc_feature (1)..( 3000): cDNA_ID_2706569_gDNA_ID_2214497_Annot_ID_133593 3000 nt of promoter + ATG
ctttggttgcaccacaagtcaaatgcagtttatttgtgaaattccctgattaagctaaacaacaagaaaaaaaaggaaacgaggaagggaaaataaagttatagggaaaaaacgaaacatatgaatcgaaagtacatcttttgtgatggcagcaatttgtaattcccccatacgattacaatcatgtttgtgggatcgggattcatgtgatctcactgcggtgagtttaatttttttaatacatatacttcattttgtttttaggatgttttacagtaaataaagtcaatactagtagttagccaatatgcttttaattagtagtatgcctaatcatctcccatgtcgtgattccagttcaatagcggccataactgcttaaggatgatgtgtaaattttagctcacgtacgccgttatgtttcaccataatgctagctagaataatctaattcacacttgattataagattttcaggttaggtttcattttatgaaaagtgtgtagtcaagattttaataaaattgttattttcagagttgtataaatgttgttttgtgctaatctctttacaaaaatggaataaaagatggattattaggggaataaaagatgcttaaaaattaactttttttttaaaaagggcaaaggtattgaaacatcaaaactgtcatggaactatgattgaatctcacatgctctgttttttcttcatctttattctttctcctctattttgtttaatggaaaagccttttctaaaagtaattacagtaaatttgttatgtttacataatgattatatatcaatcgttctactgtttaatcaccaaaattgaattattttttatattagccggctcctatgaaatggttgcatttcgaaatttcaatttggataaagaaaaaaattctttaggttctaatttatttatgcttatttttttgtttggttaggcgtgaagtgggcgagacacggtcacgcgccaagtcagccgagtggtcgtttctcttcgaaagagagaaaatgtaaccgaaaccacgtggcagatatcgattcgttcgtgttattgacttgggtgacagtcggtcgtagcaccaaccacattcgattttctttgtgagacgtgtgtcctcgtcaaagacgctctacgtggggttacatgctaggctcggtttccgaaccttgattccgaggctctgatttgaattttttgaacgttgaagccaacccactttggttcgtctctctatcttcaccatattttccctttttgttttagcaattgttttcttcaatttgaaattccattcattataatatcaatatgtgcataatcggactcacaaaatatcgccgtcaatgtttggtggtgtgatgatctcatttgacaccgtaggatgttgactcgttgcccatatacattgtttattatcgatcgacatggaattcaaaaccgtgattatagatatatatgtcactaattaagtgcgttcgttatgttatgagaaaaaaaatgaaattacatgattaatcttgtctggagttacacactaagatacatgaactaagtactaaccatgcgttaatacaacatactcttcacagaggagttataagttttcttttaacatttctcgagttaccttttaaatgttctctagtaaagtcatgtatgaagataatttttttttacgagaattttacgtaataaatacaacgattatagtacatatttcttttaggatgggaaagaatcctatatatgttagttaccaaataatgaaatggacgttttattaggaaaaaacgagaatgaaatagtaattgggtaatggacctaattgcagtaactttcaactaactctatatttctcaagggataatttggaaaggaatgtctcgcctaacattcttcttctatataacaacattataaaataacaaatcattgcaattaattgttgtttcgctcaatactaaagtatcactttttataaaaaatttctttcttagctttgcttctaaagcattgcaaagacacatggaatcaactaattcacaactactgtgctactagctacatcgatttgtggaatgttttaatgacacatcctcttgtctcatatttacaatcttacatataagagaaaaacaattactaatactaatagaaaatacaaatgagataattatatagaaaaaatacaatttggagtaattcacaatactagtattaataatcacattacgatttccatggttactataataaaacaaaacacgatcccactaagttttattgaaacggaaaatctgaccattttccaagaaaagtatacaatgatcttggattcaattaaaaatgatactagtaataatgaaacatcagtagtatcatctagatctagtaataatatattaggaacaaatatcattgatgagtgatatataatccaatataagcaacaatagtaaatggtaacaaacttaaatagagagatataaatagtaaggtttttaataaaatccaaacggtagaggctaaccgaaaaagattctcgcgtgatcgtgaaaaaagaattataaagaattataaggtttggttagggagggaaaaaagaaacgaagcaagaggttcggaaagaatagagagaaggagaaagagtgaagaggacaacagagtataaagcagttatagctttacaaccttgtatttgtgagaccattcatggagcttatgagttctcaactttttttcttttctaattaaatctctcattaccttttaaatctatccccaaacttgttaaccaaaaaaaacagagaagaaatctcccaaatcctctttttttttgtttgttctaccgtttctcatatatctctctgtctccgatcttatttggatcggactagtgtcattggcagtgaagtttcattgactttggggttttcgcttttgatgctgtgagcttattattattgttattacggagttg

SEQ ID NO: 11477 - DNA, 3000 bp, Unknown; identical to SEQ ID NO: 11460
  misc_feature (1)..( 3000): cDNA_ID_3409345_gDNA_ID_2214497_Annot_ID_133594 3000 nt of promoter + ATG

SEQ ID NO: 11478 - DNA, 3000 bp, Unknown; identical to SEQ ID NO: 11459
  misc_feature (1)..( 3000): cDNA_ID_2706573_gDNA_ID_2214497_Annot_ID_133595 3000 nt of promoter + ATG

SEQ ID NO: 11479 - DNA, 3000 bp, Unknown
  misc_feature (1)..( 3000): cDNA_ID_2706582_gDNA_ID_2214497_Annot_ID_133598 3000 nt of promoter + ATG
ctcgtctaagcttttgtttgatatatgtggacaggtgcagtggcgagagtgacatgtgagagaactgatgaatatggttacgaagcggaggatgtgacggtgcttagccaagcgacggatgcaaagggttatttcttggcgacgctttcttcgtcggaggtgaaggattataagaaggtgatcaagatcaaagagtgcagggcgtttcttgagctttctccatctgacacgtgttcttttccgacggagattaaccgtggaatcagcggagccattctccaaaactatcgtctcctagaaaacaagcttaagatgaagcttttcaccgttggccctttcgtcttctcctctgaggaaactcaggacaagtctatccccaacggctactaaatttaacaatgttttttttttttctttttcagtttctaatgccctaatgggtcatattggcccatatatcataatatatttatgtatttagtggctttttgattgcataactcacacatgcaacaattactgaaaatatactgaatatctattaatgcacgtgatttttaacttttatacacactatagataaatcaaagatcaaaattgcaatataattacggaatccaatatcttctaaatttgaaattgtgagtaagaatatatatttatgctgcataattatagtgtttatacagtgcataattacctccgtacgttaatgtagtttccaataagcaaactatcaaattattacactttaatgggacaagtgcttcgtataatagtgattattaattactacagaagggcacaagacaaaattgagagtcaaataattaataaacacaactcgaaagaaacttgccttaaatatgaagaaggcacatgctttttccgcgtaatttgaacaactagtgctagtgggttttgcttaacagcttaagtagatacattacacaaaattttgaaaattgagtcattaaaatatacaaattatcttaaatatgcttgacttttacaaaagtggtttaaattttcttgagttacgcaaacgggccaattcctttggcattgcatgaattttcttcacgcgttatactttcatatcaaataaaacgtcgccgttcagagatacactttttattcagtccttggacttggatatggaacacggtttttagttgatcagaagtcaaactcattgtcctatcttgccgaatttagaggatttatttaaaaaatattaaataaataacgcatgataatgataatttataaaaagtataaccaaaaaaatatctcttaaagaaaagaaagaaaacaaaatgtagttttgagtttattggttatctggatttcggaagatatatatgattcataattttttaggagttaaatttattttttaagactttaaaagaaaagaaaaaagttagtagacattgtttcccataaaaaaacaccaggtctcttaagtctcaagtctaaaccatttttccttttctggtcagataattctatcacacatgcttgaatttgaatagaaagacaacaaaagatggtttaaaaaaaaaaaaaaaaaaaaaaaaagacaacaaaagacaacactgggaacatatttacccaaaattcgataatggacaagctacattcaatctatgcttatgttttcgttgcatgcgaatgcatgttgtattacgtttatgagggttgtgctctacgatgtatactcttcacatgacaatatgtacactaatctacattgataatacatatatttgttaagttcaaatagcattatcacaaatgattaagctatatgtatgttgtggtgaattttccataaataatttgtcatctgtcaataaaattttaatgtatattctataacggaattacggtcagatacatgtgtaggtaatgaattaagtaagatattaatatctgtcgacaaataaaagcatcaatatgtatgtacattctcttaaaactgattcgatttcattgtgtcactgtgtatattgtatagaaacatatccaaatacgtatctcatgcctgtcctctaacttaaaaacaaaagaaaaaattatcataccagccaatttaatgcacaagattaactaattgatcaataattggatacgttacaactctataaaatcatatccattacgctttgggcaatggcaaattggcaatggaagtaaaatcaaaagttaaacaaatgaattaccatttgaaacactccaaattggtattcgtgtccaaaataatttttccaaatgtcccatcattctaaagtttttcaccttatgcatggaaccttcctagtatatatacagttctaaaacgaattttatttgcaatggtctatcagagattataatgtcaagatcttgactttttgctgatgtgtagtgtaatgtgctgttttaccaacatgttatatatataatcgaattttttcttgaaatgcctaacgttggttgacaattttatattacgaaaacctttccctgattatgcatattcaaattgcggtaacagaagtttggtcaaaatttgactttcatgtaaaaaaaaaaaaactcaattgaccttaaacttaaattaaacacccatttatatataattatcacggatggaatttactccttaattacagtgattatttatctaatttttggtgagagacagatctatgcgtgtgaatattatcacaatatggtatatatgttgaattttttgacaccgccacaattatatatgtagtatgtacacacacattatcattgacttgaatttgtatgtatattcaaattcaacgttctcaaaaccctatatatataatccaaaacatttagcaaaatatctccaaaccaaaacacaattaagctaaaaaaaaaaccaaaggatgtctcagaaactcatgttcttgttcacccttgcctgcctctcctcgttaccatctccttttatctccgcccaaataccggccattggaa

SEQ ID NO: 11480 - DNA, 3000 bp, Unknown; identical to SEQ ID NO: 11469
  misc_feature (1)..( 3000): cDNA_ID_2706590_gDNA_ID_2214497_Annot_ID_133600 3000 nt of promoter + ATG

SEQ ID NO: 11481 - DNA, 3000 bp, Unknown; identical to SEQ ID NO: 11468
  misc_feature (1)..( 3000): cDNA_ID_3410317_gDNA_ID_2214497_Annot_ID_133601 3000 nt of promoter + ATG

SEQ ID NO: 11482 - DNA, 3000 bp, Unknown
  misc_feature (1)..( 3000): cDNA_ID_2706594_gDNA_ID_2214497_Annot_ID_133602 3000 nt of promoter + ATG
tggtttctgcgaaaggacggctgagtcgaagagtatcgttttctagggttttgccttttatatatataccatgtacattgatagggcttctctattttctctaattaaaataataattaaaaattgccagcaaaccgtaattacaaatatacccttattaatctttcaatgtgttacggtctttttaaaccggtggttaacatggcggaaaaaatgagaaaaaaccggtttaacattttccaccagtgatgaactttctcaaaagagtttattatatacgaacctagctactagccaaagtcttacttttctcaaaaccaaacgttaatgaaactaccatttgatgtatacatatgggtagaaaacaagccaccgacacctttgtcactcattgggtgagctcttcctaaagaagatggtcttttccaaattccaattcagcagcatgtgtagtagtagtttcgtggatctgtatgtattctcgaccgcggttacaactaacgatttataactaaggcgttttagttttacgaatagtatttcgacctcgtgttatcgttcccatatgggagatttatatctttctctatgagatgtttgtgagactgtatgattttgtacatttgagtttttggaattgttttcgtcaatttaacaaaaataattggtgacaacaaaaaaactatcagtcttagtaatatgtgacgtatttcttatcaaatttagattgaccatgtaaagagtttagcaattaaatccaattacattgcttgtgtacttattcatgttgtaataaattgtagatttacaactatgacaatcctatataacagaacaaaaacaaatacgtatttgaactttctagtttacactttacacgaattacacgtgataaataacaggtagatttatgtcaatgtcatacatagcctaaatcaactaaaaagtaaacaatatagttcaaatgtatatatatactagataaggtccgcctatttaggcgggtgtacccgaaattttcaaatactcgaacggatataaactttaaaacccgaaaaactcaaacccaaacccgaataggtatgcaaacatatctcaaatataagtatatattagttatatttatacttatatatagaaaatattagaatttttttggatattttagttatttttgtgtatttttagatatattcaagcaaaactactcatgttgttttgggaatttttgaaaatttcaagtaatttaatagatttgcacacaaaatttgatatttcaatatataaataactcgaacccgaacccgaacccaaaccgaacccgacccgataatatttttttgtttaaaaatacatacaaccaaaatcttatttctacccaatttctttaagtaataattatattaataaaacctacagtctaatttctacagcaataaaacttacagctacagtcatcacacctacaacaaaaattctacagcagtaaatctacagttacagacaaaccaatcacccacgtaatctcgtaagttaattttacatcatgcaaattaatattaaatgagttaaaattaataaatgaaaataattgaaaagttaaatcctataagctaagctatttttctcaaagtgttctattttcacttatgattacatgagttaaagacaaatttgttaattttgcttttgttgaataaatgttaattgtttataaatatatagacatataaattagtatatgtaaatttgtttactttttaagattttctatttttttaaagaataaaaaagttaaattttgaatgacacatgtaaacatctaatcgtttgacttgacactgtgccaagtcaattttgaaaaccatactttatataataagatatatatatatatatatattttttgtcctcatagttcaattgtatatatctcaataatttttttaatcagaaaaaaacaaaatacatatatatccactaattctgatttgataatgcgttcacacttcatatttatcatgtttatcttttataaagaaaataaattagtcaggtcaggtttttagtaagatatatgtttatgataatatctaaactcgaggagatgataaaactaatattactcaggttgaaattaaaatctaatgcttataaggatgaaatgaaacaaaattcagggagtaaaaagatataaaaaaaacttgcaattgaggtctcatattcttaaaccttaccaaagaaaggcgagattaattaatcctagttagtcaagtaaatcatccaattagataagatcacgtgtcggtcgatgtacgcttgaatcctcgtttcgatacaataattgaagtgtgtcatgcagagattagagagatgtgtataaatggctcccaagtctccaccgcaatatccaacgcttgaccgattccaatcagctcctctcgatttccgtttgtcggaaaatctctcccgtgatcggcgtattgtgaatgccgctcaccgagatattctccggtacgtccgcattgatcaatttcgtcgcgtggctcactctgtttcatctgttcttttcttattttttagctatttttgttgagatttgttcgttgaaaattatggttttgtgaaaagaacccaacttgttttactgaacccatgatgaaagttataatcttttgatctggttacctctggattttgattacgcatacagtggaacatgcaattgttattagcattggttatagattggatttcggttacatgccattggatcctttgcaatgtttagtttgtgttacagattctctggaaagaaatctttttgcatgttccgtttgtttcgcatcctcttgatactgttcgatcgatcaggctacaggtttcatcagtttcttctaaaagttgtaagcttctttttggtgtgccagattcttttccccagtgaggacaagtgttcagttgacttattaggaggtggggtttgaataagttacaatg

SEQ ID NO: 11483 - DNA, 3000 bp, Unknown; identical to SEQ ID NO: 11467
  misc_feature (1)..( 3000): cDNA_ID_2706551_gDNA_ID_2214497_Annot_ID_133603 3000 nt of promoter + ATG

SEQ ID NO: 11484 - DNA, 3000 bp, Unknown
  misc_feature (1)..( 3000): cDNA_ID_2706643_gDNA_ID_2214498_Annot_ID_133606 3000 nt of promoter + ATG
acgtctcaagcggaagaatcttttaaacattttatttctttaaaataggttaaaacttttaataattttttgttttcttcttttatatactttctagaagctaatttttgtttttttcgataattgaaatgtttgactttctagacaatattcttgtggaatcgtgggaggttcgggtttacgattattacgagttctatttctgcataattttttccctctggttttgtattttttatatgattacactataatctagtaagtaggtatgaaattttataaatctatataattcaaatccacattataataatgataaatcacaaatagaatttcgcaaactttttaccaagaaaatccttattaaatatgtaaggattatgaaaatctataacaaaatatcattgggattggctatagcgtaattaactaacactatctgaatataatggacgtttagaaattctatgtatacttttttcctcacttgcgatgtgtttttctcgcttatccaaatggactgagaaatagacttattgatcgattgactgatacttaacataagataagtacaaatgggaccataattaatcaagataacaaatataatattttaaaattacagatatgagccgacaagtaaccacaattacaaacgtgtatatatgcatgtgtgtcacggtggtgatggtgatgatgcatgatgatgatggaactacacatgacacatcaaaagataacccgcatcatgtattcatatttgatcaagttggcattataaatcaactaagaaaaatattaaatctgagctgcctcttacatagaaagagtttattaagatgatcaaaacagagaatctgcaagtacttggataacttgagaagatttgccgagcgaacacaaaagaaggaaggggttttgatgtatggagatgaccctcaagttattaacgtcatacatttacagacaccaacttggtggttggttcttgtaatataacacacagagaacataggaacaagaacaagaacaatggctagtcacatctaactatcatattcgatagtttctacaacggtcgatgatggtgtttctatcctcgttagaacttcaggcactccttcggtatctcttactatctacgagaaaaaacaaccaaaagcggataaaactcggttagtgcaacgatctcagtctctctcaccattcttaacaaaatattcaacaaacttacaagaatctcttcatctagataagatatcatgaaaaatctttcaaaggatccacctgaagcaaacatcactagttggttcagtgcagatttgagcggaaaatggttaaatgtataaaaaatggataaagtagcttactaaggggaattctcagaccactggctagagtatccttgataagagcaggaagctgctgcaacgttgtggcagcttgtcccaaagcgctttttagctgttcaggaactgcttcttcaatgactgttggagtttcaagcataccttcaacatattcttctttcaatctcagtggtccctcaacagtcaattttgatgacagaatgattttgctttctatctgcatttttctgccactgtgagaaacctcctttgtgattctgagtaaacaaataatcaaactttggaaaaagggtttgagtgtgttaccgagttcaaaagtttgatatttgcagtcgcctttgcgttagcatccttgatcagtatctccattcttgataaattcgccaatgttgaaggaaacctcctgaaacaatacaatcagatggcaaaacacttaaaacgttgaataaagtttggtgagctttaagatgagaaaatgataagtacagactcgaatataactcgagcagcgagtaaaccaggacttccagatccaaaccactcaaaattccacctgccttcgaaacaaggagacctggaaagctataggaaccagttaaaagacaattatcctaaaaccgaagcaaaaaattgtaaccaaaagattaaagaaggacctacgtggttggtctcggagttggattaagccgctctagactcgtaatcctctcattaacatcgatcctttgcatattagttgttttccctgtaactaaagcctcaaagcctccagcatccttcaactgtacatagatggcttcaggacaaaaatagtttgacagttccaaacacacagagctctgttcctatactaagaaaaactcaattgagctgaaacatgatcattcaatttctggactttgagaaaaaaattctcttttgttatctgcaaaatctcgattacatctaacaaatacacaattcacctaaagtcttcccatttatcctcagcttacgacagagatagtaaaagagacacaatttcaaaatcagagtaaaattgaagatctaaacaaatcatatattcacataacaaccaagtaattcaaagagtttataaaagtgagagaagttatacagcgagaagtagcgattccttagcagaaaggcgctccatttctctggcgtaaaccaaaggagatccttgaactgtttcctgcaccattgctcttaaaacccttctccggcacgaattcttccaaccctgcttcaccaccggaacattgagacaaaatctcgacggtgacgctgaggttgaaaaaaccaatcgaaccgcagacgtaccaggaaccgaaccatgtatcaacgccattgaagaagaagaagaagaagaaggtgaaaaacgaaagattgagaatttgtttgctttgagcaaccaaacctcaggaaaaaagagttaaggtgggagtgtctggttcaaccggtttatatccggttcaaattaaacctcttacagttaaccgggttttgtgtttggttcgattgttcataaaagaaagaagactcttgtcgtcgattagtgccaaagttgaaagttgaaaccttttctcagaattttctgctcagttctgagtttttttttcccgccatg

SEQ ID NO: 11485 - DNA, 3000 bp, Unknown
  misc_feature (1)..( 3000): cDNA_ID_2706628_gDNA_ID_2214498_Annot_ID_133610 3000 nt of promoter + ATG
ttgggaatattcttctttttattttattttattaaggaaacgtcttcttttattggcaagaaaaacaacaacaacgacaacaaacaaagaaatatgaaagaaagaaatcagatttatgaaatgaaaatccctcaaaagaatttatttcatcagaacaaagcattaaaagaactcaaaagcatttcgtgtgaacaatggccggtccattttcttcatactcagctttagtaatccacatctgcatatatatacatcacaacaacttgacattacaacatcccaaaagagatacgcacgttaaattaataatacaattagtattatcttatttacctgttcatatgtgcttagagaagccaaaatggagcctccaatccaaacactatatttcctttccgggggagcaacaattttaatcctcatattagcggctgcaagcgcattgatctctttggtcatcctctcttcaatccctcggaacatcgtcgtcccaccactcaacacaatgtttccatacaaatccttccttatatcatcatcacacttcatgattgaattgtaagtcttctcatgaataccagaagtttccattccaatcaaagacggctggaaaagaacctcagggcacctgaatctctcagctcctatcgtgatcacttgaccatctggaagctcgtaggttctatcgattgccgaactctttgtagccttctccatttcttgctcgtagtcaagagctatgtaaccaaattgttctttgatgtctcggactacctcacgctcggcggatgtgtagccacgttccatcatgattttcatgaggtagttggttaggtgacggcctgctaaatctagccgcaagattgcatgtgggagtgctgaaccttcgtagattggaactatgtagctcacaccatctcctgaatccaacacagtacctaaacacaaataaagggaacccattattgattgtttcaaacaaaacaaaaaaatcacatttcaaggttttccaaaaaatatttttgttaagtgcaaacacaaacgccaaaatcgaccaaataaatttgcattccgattgcgtttggtatttatcgtgtatattaaccaaaacaaattgcttcaaatgttttaaagtcgtaggttcatttttaaaacatcaaaacgtaaaaactaatattgccagcaaaatccagctacatttttgactacgctgcaagtaatgttttttaaaagcttgtaaaaactttaaattgctgccttcgaatatctactgtagtaaagcctctctaccgacgttgtagttggtactaccatgcaagcaaaaaaaaccacaaaatttctagcttacaaactaaaaatttgaattgtgaaatttgagttgcagttactttacctgtggtacgaccactggcatggagggagagagcggcctgcataccaatatacatactaggaacagcaaatgtctcaaacatgatctgagtcatcttctcacgatcggctttcgggttaagaggagcttcagtgagaagcacagggtgttcttcaggagccacacgtagctcactgtaaaacgtatggtaccaaatcttctccatgtcatcccaattgctaacaacaccgtgctccattgggtagtcaagtgtaagtataccgctcctggcttcagcgtcgtctcccacaaataaatcgttctcattcattcctaccatccctcccgtatgtggtggacgacccacagtgcttggaacacaacacttggtgcatcttctccagcatatcctgccttcaatatgttttaccaatcattagatctgccacgttgttttataatgtgcattaattggttgtttacttttacattttgcatatttttccgaatcaatactcaaacatagaagaagctcactagaaaaaaaaaaaattgtattgttaaatgaaaattgaaaatagaaagtttctttgttgacattttgactttgttataattatatttcaaaattatgatatttttaaatgtaaacgcaatacaaatgcgtaaattgtgtttggaaaacaaacgacgcatcacaaattaataatagagagtgttcttattttctccttaccttgatcattccagttccattgtcacacacgatagcccggttttcgccctctacttccgacattatctagagtataacatatcacgttcacagtttcaacaaatttgttattcaaatatcatcattaaaaagttctaacacagcattaacataaaagaaactgtaaaatccatggctcattagaacacaatcgttgtcattcctcgaactatatccaaactaaaacaaagaatcaatcagttaacactactcatttcacatagcagatctaataagtataacaaagaaagtacaaacacaaaagcaagatcccttttatcatcttttaacatacacatttcaaaactaaacatcaacaagaacaacgaacaataaagtaatttgatataaatctcagtaaacttagctacaaaaaaacacagatttaacatgcatgaaatttccttgcgtgactctcaccccaacacacacctcttactgttttagcggtgctactcggaacagtcactgtcgtctcgtctttgttgataagaatgctgctgacagctcaaaaaagcattcagggatattattgtttacttcgtctcataatggcctttttatcgtcgtctttattatatgggccgaaccaaaagcccatatttctgctcttatataaattgggaaaaatatatactgtaaaacactatcatatcgacatgttgggcggacttatcgaacaaatgacactggctaaggcccattaataagagtcaaaacacaaaattgaagcatctcaatatcggaagaacgacgaatcaaaaaatcagaaagaagaagcatcgtcgtctcttttcttctctccgagtagcttaagctttcgtcgtcgagctctttcccgcttctggcgatg

SEQ ID NO: 11486 - DNA, 3000 bp, Unknown
  misc_feature (1)..( 3000): cDNA_ID_2706624_gDNA_ID_2214498_Annot_ID_133613 3000 nt of promoter + ATG
acagatccaaaacccaaatttgccaccatttatatatatatatatatatatacatataactaataataagaaatttagcaagtatttgatagtatttgcatcagcataaatcaaaattttctcaaaatgtctgtctagctatttcagaacctagacgtagttgtaaaactagtcaggggttaggagatcgatcaggtctttagtttcagggttaaaccaatgcagccaaacaagtggaaaccactttcactaaataaagctaaacaaaaagaacaaatcaaaacctaaacctataaaataatactatactacagtttacacagactctgatggatgatgtctatgactccgatttaacttttcatacttttcattataacgaatagatctttctttagatattgtataggtacaaattatcaaaaataaaaaaaagaagtccaaaaataaaactaatttggctttaactagcaaagagaaacaaacaaactcaaaatcaagataataattagaagaagaaaaaacccatttttgtatatttaaacatgagagaaagaggtttaacaaataaaaataagagtactgaattcatttatagggttgcttgcacatctgccgacaccaactagttcccttgaagtgtcacatcttttgttgtgttccaataactgtactgctcatatttcagtctttaatacttttaaccttttcacgatcagtataaaaaaatttcttatcatattcgtcgttactctttaactaactacagtatagaagaagaaactacctatttatagaactctgatctcctcggcagtttcctattggttaccactgctgagtatatagaatctatggagaatagtatttttaaatttagaatgttactattaacttaagtacaaatcaatatcagattatcaaaattggtatagttggatgttctatggctatggggagtctgaatattgctccctggtctcagatagatgctttcaaaatttaatactacttaaatttaaacatacatcgccacatgacccatcactatcacggttacttatggatatccaacattaaagagtaccacccaacactaggactcttataaaacacataaactccaaaattttatacctaatatccctggacaatatcaataaagttttattggtttcttttttgcaacaaacgcaagagaaatttttattcgtcacggattgaggttttacgcacaccggtacaaaagtgtctatgaagaaaataacaaaccatgcaaacgtgtttaacgggctttacaaatatgttcagaaattactcgcatgcgagattaaagaaatacaaaaaacaagtttggaaccggaggattgcaattatcatctattctatatcgcgtgtgtgtgtgtgtaaaattatgatttataatgtatcgaggtcttagattttaccttgcgatcctagagtttcgtacatatatatcgactattcaagttcttctttcatctttttgtatcttaataagttccacaaatttcgacgatagagaccatacatttgttgttatcctctactcacgaagacaaccagtctaacgttattgcataagttccacgtaaattaaaattgtgtttcttttgttaatattgaaaataggttaaaatgtcgccaaaaaataagctttgaaaacttgaggtaggaaaaaatcatggttcttttgcacatgctccggaccaatcatgtttactactaaaattcttactgcttttataataatcatctcgactggcgcgtgtagaactctagatgaatgccaagtcttattttctaattataaacgcaaataataaaaaggtttaagaatatttaaatttcacatgacaatatgacacaataaatactacttgaaaaatgatctttgaaatttcatattttctaatcaaaaacaattccttcatattttgaaatataatcgatctctcatatttaatttccaattagagaattatatccacatgatttgctttcaaatatgtctatttaacgtgtacgttgaacttgaacctatttattatttaattcattcccaaactaaaaatattttattttctaaaaaatatagtcgtaagcgtacttgtgtaaatatgttctaaagttaataatgggtttagacatttagtagaaatatatattttttggtttttggtttggttggttcggataatcaaaattttcagtattcgactaaaatacatttttgagttatatttctttacttaattttcataattgtaagtatttaaccttgtgtacgattaaaaaaaaaaaagtattttaaccttgtgtatcattcataatgtaggttttctttccattttgaaaaaaagttttgatattggttcgcattcatcagttgaaaaccaagtcaaatttatggtagattggcaatggacaaacacaaaatatcatctccatttattgccaacctcataatgccaaatggtggaccaaaaggaaaaacatgcatttatttattctcttgacataagagaaaatgcatttaacttgtcaaataattgcaaggaaaaactctataaaaagatagaaatgtgaacagtataaagtaaataaagaaatatgtgtacatgaaagacctctccaatgttcacttgctccagtttctccaagattagaaactgctacgtctctctctatagctccctcgttttgctatgtggtaattaacaacagacaacagtttttgtttgtccgtaccgttttacttactctctcactgtctttgtctattaccactctcgtctctttcttttttccttctgttctgtttctctctctaaacccaaaacagtcaaaatcagggaagccgaaattttctttgctttcttctcctttggtcctttctttaaacccgagacagttaggtttgtgtgagagagagaatgatgagtaaaaccctttctgtctgagtaagaggaaaccaac

SEQ ID NO: 11487 - DNA, 3000 bp, Unknown
  misc_feature (1)..( 3000): cDNA_ID_1807579_gDNA_ID_2214498_Annot_ID_183905 3000 nt of promoter + ATG
gccctcgattatcatcaagaagatgaatttcgtcgattataagaagcctcacaagctgtgtataagtgcgatctccagatttcctggtgatgatatcccacttctctggcgttgtaacaattatctgagtctctttgatttcttgcccagtaagggactgatccccactgagttccttcacagtaactccaaaatccttcaaacgttgagatagactatccacgacctcagcaacaagggctttcattggtgcaacatagacaattttgtaattaccatgattaaacgttccaccagggttcatattcaatccaagctggtgcagtatggtgagcacggcaacattggtcttcccagcaccagttggagcacaaagaagaatgttgtcagccttaaaaagagcagtgccgtacactttgctctgaaccctattcaactgctgcattcccctaaaagctggttgggcccactctggcaaatcgctaattttcacaagcttttcattactatcaaactttttagaaacccacggcacatgaacctcatcaaattccttgccacgtattctgaaagagcgatcaggaagctcacacttgttattctccctcgtgaaaccaccttggttaaaagcaaggctctccaggtccatcacctgacgctggcccttcaaccaaccattctccaaatctaaatcatcaacatctctcatgcctctgtctccgtcaacaccagaatcatcatccataagatgttgagcttcttctttgatatctttctcccgtttctcctccctttctttggctgttgctcttttggcatgcaactccttaacaattgctgccaactctgaacctaaccccaacatctcctcctcaatttgattcctctcttcctggtctcttcccctagccaaacgggtgcaccacacaactttaagacggttttgcaacagaaatttaacaaggctgaacttttcaaactgaaggtgctcaagcagcttgatctcaacatccctatcattaccctcagcaagtatcttaagcagctcttctgcgagttcctggcactcttgtgcatcaatcttctgctcatattcttgagatatctttctctgaagccaataagcatcaatatccagaacattaagactcgtatcctcctttgcctgtcttgcatcctcgccgtttattgccacacccacctggacaactccagttttgttaagctcaacaacatcttcatcctcctcatctttttcatcctggaccatatcaagatcactctcatcatcatcctcttcacattcaagggcaacaccaatatcataatcaagtcctccatcctcactagctttaccacttaaagaatcaccaccctcttcatagtctgtaatcagttttccaatcgaaacaaactgactgaaaacctgatcagtaataacgtttagtagtttctcaatctctaccttcttttcatggtttttgacggattcattcttaagaactgccaaaatctcatcagccgcaccgcaaacaatgtccaaaggctgcccacccaattgctgctggataagaccaagcataatctcaaaagcaacccttgtttccttagtcttcggctgataaacaccatcctccgtatcattaagtacactcacctccctaagacgaactcttttgctctcacgagcagacaccaaatcatcacaacgttccttcttcttcttagatttattaagccgctcatctaactcatgaggccttcccctaacgacacgatctccaaaggatttcggatcaatcctacccctgagactctccggttcaccagaagattcatgcgtatcacgacgacgctcatcactgttaagaacaagactggaattgactttgtacccatactgcttcaacctggcttgctcctccgcaccaccaccacccaaattcgtcatcaccaaatcggaaaaacaaaccccaaattccaagaattaaatcaatgaaacaaaacaaaattcggaacgaaaaactcttctattacctctctcccgttctccgtaatcgtcgtcttaagaatttgatcgagtcgatgagttttttttttttttcgttcaacagtcttatatatacaccctaaacaagtcttaaaccgacaatacattgtcggccacaaattccaaacccacgaaggcctgtccggaagccgactaaaattatggaattgtccggttcaatccgttttaactataattagaagaaaacattaattagagttggttcttgatgagtgttttcgtataatcagagcaagttatcgtatcattagaccgtaccaactagccaatccggttttctggtattagtaaaaagcagcggttggatcctatgacaattaacggtgaggattcgatcttgaaagcaatgcgtacgtaaatagaattgggccacaagcccagttttattcagaagggcaaaattgaaatctgacaaagaatttgacgaattgtgacaatgtgcgctttgaaaaaaaacgaaatttatcccgcgtgagatgaaaaattcaaaatatttcacacaggtgaaaccactttgacacgtgcgagctcgaaatttttcattttcaattacaaaacccgcctagaaaatggtctaaattttgtttgccagatcgtctctctctcaaaagcttttctctctttttctcctttgtcccctccactttaccgttcacgaagccattccgagctatcacgaaggaatctattgaagattcataggtaaatccatggtttgatttgttcaagtaggttctttgtgatgtgacggagatttgttgcgaaaacgaagagttgatctctttttcttgttgtttatgaggtttcgagaaaatctgattaacaatggagaacaagactgagttcttgggttttaatgttgcgatttcgattttgggtgtgttctaatggcatagttgtttgatttcttcagcgctcaatcacaaatg

SEQ ID NO: 11488 - DNA, 3000 bp, Unknown
  misc_feature (1)..( 3000): cDNA_ID_2706616_gDNA_ID_2214498_Annot_ID_183904 3000 nt of promoter + ATG
ccaagcataatctcaaaagcaacccttgtttccttagtcttcggctgataaacaccatcctccgtatcattaagtacactcacctccctaagacgaactcttttgctctcacgagcagacaccaaatcatcacaacgttccttcttcttcttagatttattaagccgctcatctaactcatgaggccttcccctaacgacacgatctccaaaggatttcggatcaatcctacccctgagactctccggttcaccagaagattcatgcgtatcacgacgacgctcatcactgttaagaacaagactggaattgactttgtacccatactgcttcaacctggcttgctcctccgcaccaccaccacccaaattcgtcatcaccaaatcggaaaaacaaaccccaaattccaagaattaaatcaatgaaacaaaacaaaattcggaacgaaaaactcttctattacctctctcccgttctccgtaatcgtcgtcttaagaatttgatcgagtcgatgagttttttttttttttcgttcaacagtcttatatatacaccctaaacaagtcttaaaccgacaatacattgtcggccacaaattccaaacccacgaaggcctgtccggaagccgactaaaattatggaattgtccggttcaatccgttttaactataattagaagaaaacattaattagagttggttcttgatgagtgttttcgtataatcagagcaagttatcgtatcattagaccgtaccaactagccaatccggttttctggtattagtaaaaagcagcggttggatcctatgacaattaacggtgaggattcgatcttgaaagcaatgcgtacgtaaatagaattgggccacaagcccagttttattcagaagggcaaaattgaaatctgacaaagaatttgacgaattgtgacaatgtgcgctttgaaaaaaaacgaaatttatcccgcgtgagatgaaaaattcaaaatatttcacacaggtgaaaccactttgacacgtgcgagctcgaaatttttcattttcaattacaaaacccgcctagaaaatggtctaaattttgtttgccagatcgtctctctctcaaaagcttttctctctttttctcctttgtcccctccactttaccgttcacgaagccattccgagctatcacgaaggaatctattgaagattcataggtaaatccatggtttgatttgttcaagtaggttctttgtgatgtgacggagatttgttgcgaaaacgaagagttgatctctttttcttgttgtttatgaggtttcgagaaaatctgattaacaatggagaacaagactgagttcttgggttttaatgttgcgatttcgattttgggtgtgttctaatggcatagttgtttgatttcttcagcgctcaatcacaaatgccagaagcacgagatcgaatagagaggcaagttgattacccagccgcatttctcaatagacgctcgcatggtattttacttgacgaaccagcaacacagcacaatttgtttgggtctccggttcagagagtgccatcggaagctacaggaggacttgggtcaattggtcaaggatctatgacgggaagaggtgggcttgtgaggggtaatttcggtattcggcggactggtggtggtagaagaggtcaaattcaatttagatcgccacagggacgagagaacatgagcttgggtgttacaaggcgtggaagggctcgtgcttcaaattctgtcttaccttcttggtatccaagaacgcccctccgtgatatttctgccgttgttagggttagttcactaaacctagtctcattttggatttgtctgcttattcttagatttaactggagtttttttcattgatatatagctaatttgtgatctgtttatatctggtttgtgatttgcatattggttcagaatctgctgcttataagctagattagtcttctgtaacaggcttgcttagcctctttgttaactatatcataagtcataacctgttaccaaaaggcttgcttagtctggctatttacaaactcttatatgcaggctattgagagaaggagagctcgtatgggagaaggtgttggccgagatattgagaccccaactccacaacaacttggggttcttgattctctagtaccgttgtcaggtgctcatctcgagcacgactattctatggttactcccggtccatctattggattcaagcgtccttggccaccctcaactgctaaagtccatcagattttgctcgacatcacaagagaaaacacaggggaagaagatgccctcactccagagaagaagctcctcaactctattgataaagtggagaaggttgtgatggaagagattcagaaaatgaagagcactcctagtgctaaaagagcagaaagggagaaaagagttaggacgctaatgtcgatgcgatgatgattcatcatcctctggtgattcactagaaagaggtaatcatctctgtgatgatatatagtagggagattctatcatttttctaatgataaaaaagaagaagaaattcatcttctgatgatatatcatatgggagataactgttagatagttcacgggtttatgttggatcccttttacttttaggctttttgtatgatgaggatgtcttcttgattcaggatattgtagttaaacagttgtacagaagtttggtttgttggtagaaattgcagatgttcttgtatgtgtgtatctgtaattgtcacaatctaggaagtgccttcgaataataaaaacttctaatcattttttttttttaattcccatcaaacaattttcatatatgttacgtcacacattttatatttggtaaaaggtcacatctgttgttttgttttctttacaatgagcatctaataaacaagattcgtctgtgtctggatataaatacaagcatacttcaaaaattgtatcaatacctgcctgcaatg

SEQ ID NO: 11489 - DNA, 3000 bp, Unknown
  misc_feature (1)..( 3000): cDNA_ID_3040088_gDNA_ID_2214498_Annot_ID_183903 3000 nt of promoter + ATG
tctttgaaatacatgtggaacgctgtagtgagttctcgttttcggttttcttcgagaggtgtttctctcaaggattgtcttgtttcctctaagttcttaagctgctcaaaaccaaaacacagttaagggatcagatgctgaagtatggatgaaaaagaaacgagcaattttatgcggaaagcaaataaaaaacatacgtttgtctgctgcactgccttatatgcatctggcaatggaaatggattgtctttcgtggaaccaatcgcctcacccgcaaaccagtttgggatctgaaccagagacattgatgtgagaaattaacccacgaacacaatcttaataaccaatatcactagttactagaggaaaattaaactaacaaaaaggggaatctaaccaaaaaggtagtgaactggtcagggtccacacaagaagccggttcagcttgtttatcagaggcaccagtcggatgtgatagtgagtcatgcggatcaattgctccgagcgccaaggattcgttccatttgttgatagttggctgaattcctacctcggttatgtgctcctccaagtgtgagtaaaatgtattatatggagcaacctggaacagataacagtcacattgatgccaacagttatagacaacacatcagaagatgtttccacttaactcagttgaagaagtgactttaacagcatgctcaattttccaaacaccaggaaccattaatacgatcatgactataccaggatattaacacaggaaagatttagcctagagttaaaagaaaaactgtagtctatttattaatttcagctgaatatcagggcgggaaagaagagttatgtatgcagctcaatcttaaatagacatatcacctgtagtttgtggttatcaccaactataagaggtcgctgattgactcccaaaaagaacacacattcacggcaattggcgatgcaaattcgtttggtagctacaatcacatgaactctctcacaatgctcaacttttactgcctgcaaagaacataaaatattatcactgcattctaacctgaacctcgctaacaaagactaaaacagaaaggagtatatttgccgtaccttgccagcagctcccagaacgatagtagaatcagaacacccatacacagttgcatatctcaatggcgctaacagataaataacagaatcatggcaattggcaacctgcagaatacacaaaacatgcaattgacgtgcatacatgagtaaacgaaactaaatgagggattgctgtttaaaatgcaaattagttgttcaatacggaccttcactgatctacccttaagatcagaagcctgcttgaaaagtgaggtcttagagactccctcaataatacatggacctctgtcgttagatgaaactttattaagagctacactagaatcagccattgcagcattctgatcagaggcattagatgccccattttctttcccagagattctgttagaaatgctttctaaggcggaagctatgtctttgagaagccaatcattcacttgggaagcaggaacggggacagcgggcatatcaggatcagaattcgcaaaaaaaggagtagcttggcttaaagaaggtacatcaaatcccttatcaccataatgaacaagaaacccaatgtgctccaaactctccatagacaggacctgaggaggagattcggaccatctagcatgagatattcgttcttttccatttcccataatattgcatcacaacataaaattttctatccatctgatacaaacataaaaaaagtttagcacataccaaagaatcatctccttgtccctccacaggctctgcaaggagagaaataatatttgcaatgtgcttttgcagatacgataattgatgagcttcttcatctgtcggtgatggcataaaccgacggctgttgctacgaacaagctgcaagatgatgaaaggaaatttaacttaaactcaacagctacaaggatgtctctacccatatgatagaaacagtaatgagaacaattatcggtaaaatatttcaaatatcagacaatccttttcatatgtttctgaatgataacgtaatattatttaacttgcattgcaaaattatagtaaaatccaatgcaaaatgaaattttttaaaccaaatagatcacaagataacgttttgagccacattacatgattaagagaataaaaaagcttgcctgaattggagataatgccgacaagtatccatcaaaagcagaagtcgaaggccaaacatcagccacagaagcagagtctttatgcgtcctaggcaataacttcttatacgattgaatgtagagaaacaatatcagatccctcaaatcagctcccacggaatcaacttcctcaggtttggccaaaaccaatgggtcagtctcgcaatggagcaccgaagagagagtttcgagaacgaggcgcgcatggtcatcggagatcgagagtgcatcggaaatggcagcagatccgacgcgatgattcgtcgccaaagaagctaacttttgcttgatcggagctagagtttgaatcgggtcggtaaaaacgagcttctggatcggaagaaggccgtgctcgaaaggaacacgtcttgggtggattattaaattcgaattttgaatcgggtctgggtcaggtggtggtgattggtcgatgagctcttccgtcattatgctttaaaccagagaacgagagaaaaagaactgttatgaatgaagttgcagatctttgaacataggaacaattgtcatcaagaagaagaaaaaaagagagagagtgttatgttacagtgtgtgcaaccacatgctattatcctacgcctggtgatgaacaatgggtcaaaaaggccgatatttaaatgggctttaaacggcccattaagtaacgcgattagtttcttctccgttgtaaactgcgactttcaccggccacgagattaagtcgttgtca

SEQ ID NO: 11490 - DNA, 3000 bp, Unknown
  misc_feature (1)..( 3000): cDNA_ID_1809105_gDNA_ID_2214498_Annot_ID_183901 3000 nt of promoter + ATG
acaacaacaacaacaacaacaacaacaacaacaacaacaacaatacatggcgagcttcttcaggttttggcccgatgacggttacaatggctcaaccaccacctgcacctagccagcatcagtatctgaacccgccttgggtattcaaggacaatgataatgatatgtctcctgttttgaatttaggtcgatacaccgagccagataattgtcagataagtagtggcacggcaatgggtgagttcgagttatctgatcaccatcatcaaagtaggagacagtacatggaagatgagaacacaagggcttatgactcttcttctcaccataccaactggtctctctgacttgtctttgcatcagagaatcttcttacaatgaacgattctgcaatatcttatctttttgcttctttgtttattctgttatctgctatcaataaaccagacaattgttgccagataatggcttttgattttgatttgttgttttatctccatgaaaatccaagttatgagatcagattgatttctttagcacatcaaggttccatataatgaatctataatcatcctagtatattagtcaaagcaggagctaacattaccttttaacttaaggcttaagccatagcattatcatcagctttgctcaaactcaacatcttaaacacttaattagactcagagatctatcgaccaacgaagtgaactgctttttccccaaaaccctaaccacccactttcaaagattcgtcctttatggatttagctcccctgtttccaaatgaaacctcaaaaaacttgaaccatatatactcatcagaagacaacttaactatggcagcttttcaaatatgattcttatctttataaaaatctttcgtcagaaacagtaaaagtaagacgatgatagagacctttcttcctaaagatctctcatcatctttcatggtcgtcagagctttgctacagagacgtgaagagagaatatcataaatgggctatataatgggccctaagaggcccacatgaatttccgtatgattcttgtaattgggctttctctggctctactgactcgtctcctgaagaacaacaacaaaacatatttcattgagctcctccactgaatcgctctcatccttcgcttcttcgaattccaaaggttagactttcctgaatccttcaataatctctcttcgttgtcttctgtaacatttcttctattgttagtgatggattccattattttccttgtgttacaactttgatgagctcaatgctttcacaaactaggtttcggaatttttgtttcaatccaatgtctctatttgggtctttaaaccagattatattgaagatctggaaaatgggtttataattttgtaaagaccgcgactttgaaaacttcaatttggtgaaattctttcaaatccgcatcttgtaaaaatcacatttttatatttttgttgattgatcttgttctctgttgaatgtttaacttgtgtgcgttaggtagaacagtagaagaaatcatggatccagctgaaatgagatatttggaagaagaggatggtccgttgatgaagacaatcaaaggtagtatcactggttttggtgctgggactatttacggaaccattttagccacatggaaagatgttccaagagtggagagaaatgtggctcttccaggacttattagaacactgaagatgatgggaacccatgggctgacttttgctgctataggaggtgtttacatcggtgttgaacagctggttcagaattttagatccaagagagatttttacaatggtgctattggtggttttgtcgctggagcttctgtgcttggctatagaggtaatggtttttcttcttcactcatggttcgttcgttttcattgtgtttgcataaaacaatgtctcgatggttaagtagtttagaactgatgtgattttggtgaagaccatttgaagttactggaattagcagtatgtagttcacttcatgtgttttacgagcttagtagttattgatggacaaacaatgatctcgagtgggagtaactaaaggaattgtaatgggaagaaattgattcttccttacctcaagttaatgttatttggtgcctagtgtagcaattctataggatagcacaagtgtcaagactttgatattgagtgtatacaggaaactctcaaaatcatatatatgtaaagatcgaaagtacatagctttgagtgagagatgatgctatagattcgtgcattcttatgatgctatacttaattgttatttggtttactttggttttcctctttttttacagcaaggagcatcccgacagcgatagctgcaggtgcaacactagctgttacctctgctttgattgattctggaggtcagaccacaagagtagacaatggcagagaatactatccttacaccgtcgagaaaagagctgaagctgattcctgatttctcttttggtcactgagattaataagatgtgcattcgctgatccggggatcttgagataatctcttttgtttattttatctggatatgtgatatcatgatactctttgctcttgtttcttcttgttttcttgagagcgactttctcacatcttttgtctgaatgtttcctgcaataaaaattcaactttgtctgcagatgtaaacaaatgttttagctttcagtaatcattttaatcagacatttgcttgcttctgttaacctcaagctagtttctttatctgaaactataatagatttgaacatgacaagcataaggaaacaaacatgtaacatgtataacaatcagatgatatggatttggagatctacatgtaaaagtagagtgaatacgtggcaataactcattggctatcttaaatttccttgtggtatggctaatctagtggttcttgtccaagtaactatcgcatcacagtgacgagtttttttcctagagacctctgctgca

SEQ ID NO: 11491 - DNA, 3000 bp, Unknown; identical to SEQ ID NO: 11486
  misc_feature (1)..( 3000): cDNA_ID_2706624_gDNA_ID_2214498_Annot_ID_183899 3000 nt of promoter + ATG

SEQ ID NO: 11492 - DNA, 3000 bp, Unknown
  misc_feature (1)..( 3000): cDNA_ID_3040104_gDNA_ID_2214498_Annot_ID_183896 3000 nt of promoter + ATG
actcgattacaatctgttccacaaaaataaaaccactgaggcaaactgatgatctaagattcatattctttttccaggaaaaaaaaaatggctaagggtggttgaatatcatactgaatcaactttgctgttaaagatagctccgctaattcctgtatcctcactacactcacagaggccacagtccccctggtgtgacagacaactggtgctcatctctactgactttccatcaatttttgaatggtttaaccgatgaacatagctgtcaccaacataatcccagatttgttgtgttcgcaaatcaagagaatagcagtgatgcgtttctttccagtgcctaatagaatgcccttccttgtatctaaaattggaaaacagaatccactgtgaatgaacttccacctctaaagaagataaaagatgtggatataaattcaggttaactaaatcttagaaaggcaaaccaagaattaccttccacaacctacgaagccacagacaaggcatgcccatacattctcagtttttccacaaatagaacagtttaatatctcatcttgctgttgacacaatcgacaaacctacaaacgaaatgagcatgttgtgacacaagtgcaaggtatttgttaataaatggatgaatcagattcattttatggaacaaaatgtattagctgagggaacactgccaataaatgaacaccgaaaatgcaacactaacccatcatataaagtggaaattcaatgaaaggaatgaaggagaaccactcacctgacaagacagataagtccatttcgaagtgcaagaacactgaaacgagtgatcacaaagagtgctaactataccactggtgtcaggatctaatctctctacaggagtcaaatcccaaatatagatatcagaaaaaaaggtactgaagaattcaaagtgataataacatagaaaacgtcttctttagcacaaaactcaccaagacatattggacacgtaggtaactcggtaaatccagtaggtgcttctgcagcaacctcatcaaattctgtgtgttccaccgacattacatatagaatatgacaaacctcagcctaaaacccaaagaaaagtcaatttcatgcaatcaaatgaacataaatacaaaataaacgataagctcgtttccatattataacctcagatggtgcgaactttttcccattcaagttgttgtagaaaccatcagcttcggattgatcagaaaatgtgataagaacactatatctatcttccattccatcgttcctgataatttacaagaatcatcaaatcaacataatcattctcgtcaaatcaagtaatcacaacaccaatgaatttcttgaatttgatcatctaacagataatgaatggaactttcaacgaacctgatgaagaggatgtcggagacttgggagatgcgggaatcacagaaacggataaaatcgagagaggagagataattgggaacagcgacgatgaagagagtggtggatcgggagctagggttaggcagagagctatgtgaagatttgcgatagagatggatcaagcctttgcggtcggtgagtttgagagatggttgtatgagtttaagaggaggctgagctcttttcgatgcgtaagtgaaacctgattcttcttcttcaacggagattggtctctcggagtcaacggaatgaactctgaggatgaacatcgccagaagcgggaaagagctcgacgacgaaagcttaagctactcggagagaagaaaagagacgacgatgcttcttctttctgattttttgattcgtcgttcttccgatattgagatgcttcaattttgtgttttgactcttattaatgggccttagccagtgtcatttgttcgataagtccgcccaacatgtcgatatgatagtgttttacagtatatatttttcccaatttatataagagcagaaatatgggcttttggttcggcccatataataaagacgacgataaaaaggccattatgagacgaagtaaacaataatatccctgaatgcttttttgagctgtcagcagcattcttatcaacaaagacgagacgacagtgactgttccgagtagcaccgctaaaacagtaagaggtgtgtgttggggtgagagtcacgcaaggaaatttcatgcatgttaaatctgtgtttttttgtagctaagtttactgagatttatatcaaattactttattgttcgttgttcttgttgatgtttagttttgaaatgtgtatgttaaaagatgataaaagggatcttgcttttgtgtttgtactttctttgttatacttattagatctgctatgtgaaatgagtagtgttaactgattgattctttgttttagtttggatatagttcgaggaatgacaacgattgtgttctaatgagccatggattttacagtttcttttatgttaatgctgtgttagaactttttaatgatgatatttgaataacaaatttgttgaaactgtgaacgtgatatgttatactctagataatgtcggaagtagagggcgaaaaccgggctatcgtgtgtgacaatggaactggaatgatcaaggtaaggagaaaataagaacactctctattattaatttgtgatgcgtcgtttgttttccaaacacaatttacgcatttgtattgcgtttacatttaaaaatatcataattttgaaatataattataacaaagtcaaaatgtcaacaaagaaactttctattttcaattttcatttaacaatacaattttttttttttctagtgagcttcttctatgtttgagtattgattcggaaaaatatgcaaaatgtaaaagtaaacaaccaattaatgcacattataaaacaacgtggcagatctaatgattggtaaaacatattgaaggcaggatatgctggagaagatgcaccaagtgttgtgttccaagcactgtgggtcgtccaccacatacgggaggg

SEQ ID NO: 11493 - DNA, 3000 bp, Unknown; identical to SEQ ID NO: 11490
  misc_feature (1)..( 3000): cDNA_ID_1809105_gDNA_ID_2214498_Annot_ID_133615 3000 nt of promoter + ATG

SEQ ID NO: 11494 - DNA, 3000 bp, Unknown
  misc_feature (1)..( 3000): cDNA_ID_2706620_gDNA_ID_2214498_Annot_ID_133616 3000 nt of promoter + ATG
ttccacacagagatcataagtacaaaccaaatgcaattcataagagagccaaatatgttccaagctttttcctaaaattcttagctaaaacccaaaaacaaacacgagattctttctaggcgaaagaggaattaaagtgttacctgttgaaggattttaggtctttcgaggtctcagattgcagagacgagaggctcctgcttacgtctccatttttcaccggagctcatgcggatgagaatttccgggattttagtttactagtcggagtgaaacgactgtgtttcgacgtgggccacaaatgggctttgactcagatttaaacggcgtcgttttacgtgggccataaatggtctttgacggtaactcacagttagtttgctactacgatgacgattaaacttgaccatatggattattgacgaccccaacaacactattctcctcctttgggtatgaaggaaccatgataaattataatctgcggactctaactatacatacatatagcaaagttcagtacctatgctgttttggcatgacatttctactttatctttacttatcagagcttaatcaattctaaccctaattaatcttcttacgcattcccatccgtgatctagcatatctaatattgcttgttaagtcagtttttcggaaagcggtgaagtcccacgagtaaaaaacaaagaaataaaatgggaagaagtgaaggatactgcagcctcaaaacttccccagtgagggatgagtaaagcactgtgccttgaagagtatgtagtgcttcacttgagcaactgacgtcctgcaaagccacatatcaaagtaaacatgcgagagtcaattcactctttaaacaaactaggatctctctcgatttaaagaaaaagatattgcaagagctgtacctggaaatcaacaaatgcaacaggagtcccatatgtaccctgaatcttcagcttcaagaatccacggcatctgagaggaaagagagtgaaaactatctctagtggttacagttttgcgtggagaatagagtattcttacctcgagaaaacttgaattagctcagcttcggtgcaatttggtcccatattcgctatgaaaagtgttggacaaggatctgccgccttactctgtcaaaggaacaaagattgtcatgttcactggtaagaatagtttacctcactgtttttcgtccagacagaaaacaatactcatatgaagtataaaataggcagaagcttacaggttttctagaagtcggtgccctcccagcaacattagcaattccttgactgaacgagcaaaaagaatttaatgagaccctgagtttcgtgagctaatagctaagaaagaacaagcactctcgtaaccagtatctagacatgtgagctaggactagttcagctaatccttaagtaggtcagattttcaaggcagaggtacaagaaaagagtgtgcaacaaagaaacagaatctaagcattcacaaggaactagaaatgtgctcaagtagtgcagatgacctttgtgcaggtgaataaccaattgtgttgtaagcagaactactcattccaggagtttgaaagctgccaaaacctgctagtgcccaaacgtgcaagaatgtgcagtgtgagttttcagaaacgtgaaaccatgttgacggcacttaaagcccaagtgtgaaatcttaaaccaaaaagagctagcatgcatgagcgtgatggtcatgaagattggaagtttgaaaatatatatactacacaaacattcagttacaagaaacataaaatacagaaggttacaagaagcctcaagatgaaggtgtgtgccaatgatcttaccagattcagtagtagtgttccaagacttgagttttttcaagctttcccaaccatcatctaccatatcacaaaaatcacaaaataaaaattaacacaacaatagcaaaggtcaaatttttattgagctaccgaaccgaaagaatcctactacttgcctgttcttgaacgcttagatttgggatttgatttggcaaggtcaatgtgaagagtagaatgcttttcaagatcaaacaccattccctgaaaggttcagaaataaaattcagaaagtttcttaatctaggcaaatgacaaagcttattcacttacgcatacaaatcccaaccgaatgatttcaatttactagattgaattaagaacaaccataaagataccaaatttacttaatgctttgtaagtagatacatcggcgacacattgcaagagcaagtttgaagaaatttgtactcacattgagagcatgcatcaccgctacagctgattgcagatccgagaacacagcaaatgcgaagggctaccaaacaaataaagtaagattctcagtctcttcgccgggaaacatcattacccaaatcacaaatccggagagatagaaaatgattaccttagctccatctgagctccggagatgcgaagtctcatatcctgggaactcacgaaagagattgtagatctcccgaggcttgacatcttcaggaagtccggcgacgaaaagcgtcctaacctcatcgcgagctccaattgagacatgggtaggcaaatagacggaatgagctgaagtaattggaatcggagaaactcccggcggcggaggaggaaccatcgccggtaaattatagtgagaatagtaagcttccaaatcatccattgacaacgacttaatctcgtggccggtgaaagtcgcagtttacaacggagaagaaactaatcgcgttacttaatgggccgtttaaagcccatttaaatatcggcctttttgacccattgttcatcaccaggcgtaggataatagcatgtggttgcacacactgtaacataacactctctctctttttttcttcttcttgatgacaattgttcctatgttcaaagatctgcaacttcattcataacagttctttttctctcgttctctggtttaaagcataatg

SEQ ID NO: 11495 - DNA, 3000 bp, Unknown
  misc_feature (1)..( 3000): cDNA_ID_2717442_gDNA_ID_2214498_Annot_ID_133617 3000 nt of promoter + ATG
ttttcttcgagaggtgtttctctcaaggattgtcttgtttcctctaagttcttaagctgctcaaaaccaaaacacagttaagggatcagatgctgaagtatggatgaaaaagaaacgagcaattttatgcggaaagcaaataaaaaacatacgtttgtctgctgcactgccttatatgcatctggcaatggaaatggattgtctttcgtggaaccaatcgcctcacccgcaaaccagtttgggatctgaaccagagacattgatgtgagaaattaacccacgaacacaatcttaataaccaatatcactagttactagaggaaaattaaactaacaaaaaggggaatctaaccaaaaaggtagtgaactggtcagggtccacacaagaagccggttcagcttgtttatcagaggcaccagtcggatgtgatagtgagtcatgcggatcaattgctccgagcgccaaggattcgttccatttgttgatagttggctgaattcctacctcggttatgtgctcctccaagtgtgagtaaaatgtattatatggagcaacctggaacagataacagtcacattgatgccaacagttatagacaacacatcagaagatgtttccacttaactcagttgaagaagtgactttaacagcatgctcaattttccaaacaccaggaaccattaatacgatcatgactataccaggatattaacacaggaaagatttagcctagagttaaaagaaaaactgtagtctatttattaatttcagctgaatatcagggcgggaaagaagagttatgtatgcagctcaatcttaaatagacatatcacctgtagtttgtggttatcaccaactataagaggtcgctgattgactcccaaaaagaacacacattcacggcaattggcgatgcaaattcgtttggtagctacaatcacatgaactctctcacaatgctcaacttttactgcctgcaaagaacataaaatattatcactgcattctaacctgaacctcgctaacaaagactaaaacagaaaggagtatatttgccgtaccttgccagcagctcccagaacgatagtagaatcagaacacccatacacagttgcatatctcaatggcgctaacagataaataacagaatcatggcaattggcaacctgcagaatacacaaaacatgcaattgacgtgcatacatgagtaaacgaaactaaatgagggattgctgtttaaaatgcaaattagttgttcaatacggaccttcactgatctacccttaagatcagaagcctgcttgaaaagtgaggtcttagagactccctcaataatacatggacctctgtcgttagatgaaactttattaagagctacactagaatcagccattgcagcattctgatcagaggcattagatgccccattttctttcccagagattctgttagaaatgctttctaaggcggaagctatgtctttgagaagccaatcattcacttgggaagcaggaacggggacagcgggcatatcaggatcagaattcgcaaaaaaaggagtagcttggcttaaagaaggtacatcaaatcccttatcaccataatgaacaagaaacccaatgtgctccaaactctccatagacaggacctgaggaggagattcggaccatctagcatgagatattcgttcttttccatttcccataatattgcatcacaacataaaattttctatccatctgatacaaacataaaaaaagtttagcacataccaaagaatcatctccttgtccctccacaggctctgcaaggagagaaataatatttgcaatgtgcttttgcagatacgataattgatgagcttcttcatctgtcggtgatggcataaaccgacggctgttgctacgaacaagctgcaagatgatgaaaggaaatttaacttaaactcaacagctacaaggatgtctctacccatatgatagaaacagtaatgagaacaattatcggtaaaatatttcaaatatcagacaatccttttcatatgtttctgaatgataacgtaatattatttaacttgcattgcaaaattatagtaaaatccaatgcaaaatgaaattttttaaaccaaatagatcacaagataacgttttgagccacattacatgattaagagaataaaaaagcttgcctgaattggagataatgccgacaagtatccatcaaaagcagaagtcgaaggccaaacatcagccacagaagcagagtctttatgcgtcctaggcaataacttcttatacgattgaatgtagagaaacaatatcagatccctcaaatcagctcccacggaatcaacttcctcaggtttggccaaaaccaatgggtcagtctcgcaatggagcaccgaagagagagtttcgagaacgaggcgcgcatggtcatcggagatcgagagtgcatcggaaatggcagcagatccgacgcgatgattcgtcgccaaagaagctaacttttgcttgatcggagctagagtttgaatcgggtcggtaaaaacgagcttctggatcggaagaaggccgtgctcgaaaggaacacgtcttgggtggattattaaattcgaattttgaatcgggtctgggtcaggtggtggtgattggtcgatgagctcttccgtcattatgctttaaaccagagaacgagagaaaaagaactgttatgaatgaagttgcagatctttgaacataggaacaattgtcatcaagaagaagaaaaaaagagagagagtgttatgttacagtgtgtgcaaccacatgctattatcctacgcctggtgatgaacaatgggtcaaaaaggccgatatttaaatgggctttaaacggcccattaagtaacgcgattagtttcttctccgttgtaaactgcgactttcaccggccacgagattaagtcgttgtcaatggatgatttggaagcttactattctcactataatttaccggcg

SEQ ID NO: 11496 - DNA, 3000 bp, Unknown; identical to SEQ ID NO: 11488
  misc_feature (1)..( 3000): cDNA_ID_2706616_gDNA_ID_2214498_Annot_ID_133618 3000 nt of promoter + ATG

SEQ ID NO: 11497 - DNA, 3000 bp, Unknown; identical to SEQ ID NO: 11487
  misc_feature (1)..( 3000): cDNA_ID_1807579_gDNA_ID_2214498_Annot_ID_133619 3000 nt of promoter + ATG

SEQ ID NO: 11498 - DNA, 2014 bp, Unknown
  misc_feature (1)..( 2014): cDNA_ID_2706608_gDNA_ID_2214498_Annot_ID_133621 3000 nt of promoter + ATG
acagctcgaagttttaagactatgtagcttagcctatgtcaatgtcatcaatctatatgcaatatatatagagcctcaggcacataaaccgtagtccccatataaaaaagggaatgaaacagctaataactccatagagaataaattcacattcaaagcaaattcaccaccccaatcttctcaatggttcggtttcttttttcaattcttacattgtactaaaagctaaaaattcagactgatacgatacgaataggtttttgaaaatataaaaattaatcaatttccattaaagggctgaatagctaaaaactccatagagaacaagtcgctttattggatttagattttaaaaagacggcgctcgtgaattattaaagtttaaactaagataagatttaaagagatttagaggagacgtaatctggtgtatatcgttcacatagagtcacgtcactgtataatccatcgaccactaaggttttagagtttagtttcaaatcttactttttcatgcaggtgtaccgtatgtcacacagattatagtagtcgccaacttacgttcccaatgggtgataacggcgtcaacgtcctccgtcacgatcgtgtcgtaagctgtacactgtataggttccgtgaaccttaaaatcggatttggaaagctacgtacgtacgtaaatattggttaaaaagttcaaacagttttgatctctcttttattacaaacaaactgtacttccgacaattttctttctttctatttcaagtacgttttcgtgtctaactatattaacatctaacttctgacttttatactctgatgggacaatctttaattcttaaattctaagttgtaccatgcgaatggatattagattttgtcagtacaattgctgactatgaatgaagtactctaacatcattattggttcctgaataatgagtacttaaacaaaacaaatttgaagtaacgtaaccatgacatattagatccatgtcccctaaaacgtattaaaattatttccttacgtcgttaaatttcgaatctagtgttaaattgttacattggttgttaaactaccgacccaataaaaaaaaagaaactaatatttatgattggtgcatcttgttgtaaattgtaatcgtatggcctaccagcgatttcattgtccccaacatacagatatttttgttcgtgtgttataaattagggtagaaacatcacatattttacagagacaaagaaaaaaacaagaatcgtaataaaatgatattatggatacatgtagattataagatgagaaataataatttgtcacgggtccatcagtatactcgtcaaaattgattaggtaggtaatttacttcacatgctcttcctgtatacaagtataaagtatgtattttcatctaaaatctactcttttctcaattacattttatatagaaaaattcatattcttaagaaatagtagtaaaattgttcttgaaaaaaaatatgaaaaggcattttccgtgactcagcctcacaggcggcttaaaacgacgtctttttcaattttaataaatttttggtaaaaaagcttttggatccgccgctatcttcagcaattaaagttggacgcagaaactcagaagcaaaaagacgataaatattcatcatcaccttcatctctctcttcctctcatcagacttcaccgttcttctttctctcttcttcatcttcagacgaaacctcctttacttccccttcaaggttttatatttcccaaatcctacacctgctcacatctcaagctcaagttttgttttcccgggaaaagtgacacaaacaagaacttaacaagggagaagaaaaagcttatattcatatcaacggttgacgttggaaagctattaagatttggttttctacaaatttgttcttcctgaaacgtcacgagacagagcttacaagaagagaaaacagaggaaatttcgttgcattttttttacatattgattcgattaatg

SEQ ID NO: 11499 - DNA, 3000 bp, Unknown
  misc_feature (1)..( 3000): cDNA_ID_2717452_gDNA_ID_2214499_Annot_ID_133624 3000 nt of promoter + ATG
gactgtgatcctcgtatccctatctgctcgtgtgggtttaatcacttgaagaatttcttgaagagtaggatccaggaaagggtttctactcatcgtcttgctccctctacaataacaccaaacacacattgccaagttatctcaaagaaaacatcatgcaacaataacacaaggacttcacaagctccaatcaaagtaaattcttgagattaaaggttcagtttttctgatatcttgctcacttactactccaaaggaacaacctttgtcactaaaagcaagattcttcattctctagacccagtggcccacattttagtatcatcaaaactgtgaaaactctacccaaaaccttacaaaattcctaataaaaagaatcagtgagtactgggttttcacatccactggacttacaaaaggatgattcgaaggagatgaagaaacctttagcccaagaacccagaatctaattccaatctagggtttttctctcccaaatcagtaatccgtaccgaatcacccaacttgagaatgctcggagataattttagcgctcgcaggcgaagacaatgaaaagtctttggaaggtttactttattttattcaatgcgacgaaggaaacacttctttatttcattttatttaatgaatgatgtgaccatcttttttaggaaccaataacattattacaaaatatactatagaaaattgttggatttttaaaatcaatgctaaattaaagggtatatattcaatcaaatattttgagataatttattttacatattaaaaaaattgcatgttatttgatcatagattttacaaagtcatattaaatatgatgttaatggttagtatttgtaaatatctcttaaaccctagttattaaactgatgaattttctttacatctatttttattagaaacattttagacaatgtttatttatgattttgatgtggttgcatacttgcatgcacatggaaaattatccttttgacaaaaactagttggctttcttctttttgttcaatcttttatcctcctctacacattgtctcatattttattgcaatggtaacctcaactctttttacagttaaacctccataaattaatactcgataaattagtaacctctataaattaataaattcaccagatcccaagttaggaccaatgtaaaaagtgtaacacatcgataaattaataagataataacttttttgaaagtcctatgtaaatatatagtctcatcaatatcataaattaataattgcataaatgtatcaactatatatatacattatatgtaagaaatgtttttgatttttttttacttaaatttgtagttattcttatttgaaatttagttctaatgtgttactgtatcaaaaaaaatttggtattgttttctagacatgatataattttgtacttgtaattgattttagaaagatattttctataatgaaaaaaatcttataaaactttttaaaaagttaccaaattaggaaaatttctctataattaaaaaatattaatttatcgataaattaaaacctttttaaattaataaaattttgcagtcccaacattattaatttataaaggttttactgtacttcattttctaacctcagtatgttaaaagtcatgtatgtgtactaagaatcaaacctggcacgcaaacttttgctaattttgtcacatacagttaacatttagcattgtgcgagtagctccaccacattattatcaatcgtttggttcttcaacatgtcttatatatggatcaataatagtttaatatcatatcagtaatctttgttctcttgtcttgcatgtagaacatgtacatattgcttcgtcggcagcgaatgaagcctaaaattaaaatttggttttgtccattgatgatatgatggctcgttccacatgagagaatggttgagaaaactgaaaataatgaagaggatgagaaattataatgatcagacaagtgaagtgtttcattttatagcttagtgtagaaaacgattgcttgtgattgtgaatatatagttttagatgagttgtttttatagtaactttgagggaacaataaactatgatatagttatcatttttattttaaaacaagtaaattcatatgaatttctgatatattcatattttcactatgaatttaaacactataatcttatttcatattttagcatatgatattttgcatgatgctatcttagcctcgactatctttacttcatcttctaaactatatatttatcaaatcttacgtatgcattgcatcacttgtttttacattttgtgtaaagaaaaagttgcattaattagtttttagcggtttagtacaatatggttaatttgataaccacatacttgatacctgttgtatctagagttgtatataacaaaattagaattatattctattggctaagccaatttctctccaccaatcagtttacatcggttatttggaacattattatcgataagcaatgtcattatccaaaattttggaatgttatcgtatgaagaagagtgtagaagtatcttgatcacatatgaatggcttacctcaatcctcaaaaaaaaaaaaaaaaacaatgattttccaaagcatatgtggtaataaataatgttataatcttcacttgaaaaaaaaaacaaatccattggcacagattagccatttgacgacaacctcataaacatattccacgtggaccaatcaaaatagaatcctcctaatcatcttcctcgtggcaacttggccaatccgcatcgtgtggcgatcagagagttaagccttgaagacgaagagataacgaattggttgttgatcactcgctttataaatctctcagtttcttgctcacaccaacatctctctaagcttcttcttctaccaatctaattcctctcttcagcttcttgtgttgtgacgcatactcgtcgcagtcttgagatatg

SEQ ID NO: 11500 - DNA, 3000 bp, Unknown; identical to SEQ ID NO: 11499
  misc_feature (1)..( 3000): cDNA_ID_2706669_gDNA_ID_2214499_Annot_ID_133625 3000 nt of promoter + ATG

SEQ ID NO: 11501 - DNA, 3000 bp, Unknown
  misc_feature (1)..( 3000): cDNA_ID_1807971_gDNA_ID_2214499_Annot_ID_133627 3000 nt of promoter + ATG
aaaaaaaaaaaaaaaaaaaaaaattagctcacaaaacttccattaataatacacccgacatctttaatggattactattacactaagcaccaagcaccaagtcccaaatgcattatataaaccggatcatacaaataaggcagatgatccttcatacaaggttttaatctttaaaaatatatagtttcgtaaagttgttctctctgttactattgccattgtttctagtgtcaaagtatagctcaagttgtaggttgatgaaaaggattccatggcagtacctttaaactaagttttaccacattgatagtaacaccaattcaatgcaggacctatacattctactatctcatcatatgataacaatgttgcaattaaagcacgaaaacatgtattcaaaagaaaaatacacgagtgtgagtctatataggcatctaaaagtgcagactgaaaaaacctgaaactatatgcaacccgtacctcccaagtttgctggagatgcaacaaattctaagcagaacgctttgagctgtaagaattggtgctgttcagccaacgcaagtgttgttgccacattatcaacatcaagtttttcgcatagcaaaacttcacataatatctttaaccttgcaaggtcatagaggtcagcagctgccaagagatgttgtatcatgtttgtaaacgaactggcagaagttgacccggtaatttcatgcacattaggaagtacatcggtgtaaatgaagctaagcatagcctgtaaaattaaaacatcccgagtcagcaaaactgtagttgcatgtactgccaactattcacgatgtaatattgaacaaaaattaccttgaagatagaaggttcgatgtcgtctatcactattctatccacattgttattcccaattggtccaaaaaactgagctctaaaaactggggagcgtgccgcgagaatcagtttgtgagctttgtatgtttcatctccgacttggaaagctatgtcacaaccaacttcagaatctaacaagtctttcaatccctgacccatattcgacaggggtagcacaatgccatactgttttggaccctcgagtcgggctctaacaacgccaacagtacaattgatgacaagacaatcatcctttaagtagtcagaggtttctaaagctgatcgtttgaaaaagcgtttgtaacccctgaaatttgtgatgataagtcatgatagagaaaacaccaacttccagaaggaaacctcactttcaaggaaatgagtcaatatatgaaatcaacagatgatgcaagagttcaaaaaaagattcacgaaacttcaaaagcaacatgcacacaccttaaacctctcaagggattcaaaagccatactttaaagaaagagaaagaacaatatgaaccatacaattaaaaaaacttgtgctttacacaattttagccgtaagcaaacaaaagcacaaacacattgataaagttccttaattgcttctgacagagaagcactagcagctcattccaccacaaacatttctgcaaaataaactatcaacatgcaattcaagcagaagataaacaacattactaaaacctaaatgcaacaagccacagtaacctaacaaatgcgattatatcatactacaacagcaaaatgaaatggaaacgaagcaattaccacatgcttcctttatacttaagtgtataaggaccaccttcaagcgcccgatcaaagtgactatgcaccttatgtttccctttcccactctgatccataagcgtaagctcaaacaaagccctaatatcattagaatcactcgctaaagcgatgaacaaagagatatacgaggactggtcctccgggttcttcccatcaggatagaagtaaatcgcccaatcgtatccaccaacggagaagatatcgctctgtataaacttcccagggctcatgcctttggctagagagtaaccttgaatcgtgaactggtgcgaaccgttcaccgtttcgatgaacgacgttgaaacggaatcaggtatcaactgctctatacctccgacggtactcatgatctcttcgtcgtcgattacgaagaattttccgatgggagaattgtgaacttcatgaatcgacgaaattggattaacctagaagacgagaggttgtttgtgaaaattatgagaatttgggggaaactgttttcgccttctttattttttattttaaaggatattaaatgtaatgggctcgaaagtagtgtccaacgaccataagccaacattattgtacattcttaatttcatttaaacctttgtctctctttcttttcaatcttgtttgaatggttatcgcagtcgaggtggacaaatccgtttgcgattagtccgtttcatctacaagatggacaacaaaccgctacaaatcaattatatttgtatgtaaaaacaatccattgttagtttacaatgattttttaggtaaatgaaaaacgttttaatccgtatacggatttgttcgcttcaaccattatattcatttgcatgaagactgaaccgcactgtgtgatataattttaatagtaaaacaaatatttattactattagaatctcatcgcactttatcataagaacatttaacataaatattttataaatatgattatattcaatcacatgattaaaaaaaaccagtttttagtaaaatcttttcatcatttgccgataacgtttaacaaactatcatgtactatttttttttttttttttttttttgctgaattagattttaacaagacatgctattgaaaagaccctttttatataaaactctctgcaactttctgatcttttaactaaattctgcaaattcttctgtagtgataattttaccgaacgccagaaaaatccaaaagcaacaactgtaaaattacactaatcatcctctctcacacaacaacactacgcagatccagagatcgctgatccttcacacgcaagctaatg

SEQ ID NO: 11502 - DNA, 3000 bp, Unknown
  misc_feature (1)..( 3000): cDNA_ID_2717448_gDNA_ID_2214499_Annot_ID_133628 3000 nt of promoter + ATG
ttcttctgttgttatgcttccacatgcaggtagcaagatatggccttgtatcacaaacaaagaaaaacagaaagattagcagctgtaccaaacattatcgggatcatctgattcatcacaaagaggaggtttagtcccagcctcacgactcaaatagcagtcgttgttgaaaggcttctgccagattgcaacgtatccttccttctttaccaatttccagcagaggctaatagtaagattcagcatttctggaaaacaaaatgtgagattaaaagagtacacatattggctgaatcaaagtagtaataaagaaaaaaaaaaactctccttaaacccacagagacaaactgtagtaaataataaagccacgtacaatgattactaactccaaaaagtttattaagaccaaagaattttatcaaccctgaattacaggcctactcaaagcagattaaaaggatgttacctgtccattgttcttccaaagcgggttcatgcttataaacaggctgtgcagcccaagcaaaatatcctccagcgcgcagcattctattgatctcaaggagcaaaattccatctttatcacaaagaatgaaacagcagagtgagaattttctgtacaagtaataaaagctagagcatagttcacacagggagttaaaaattacagtaggtgcaatcttaatctttttctgatgtattaggtgaagaatcaagcacaccatagaaccttaccatcacgagtccagttgattctacatcttgaacaatgaataagatcaaaagcttggcttggatataacaaacgccttgtcgcaaatgctgccgccatagcaggcacaccacgctcaagagcaaattgaatttggttctcatggacatcttttggtgcaacagacattgtcatgacatcacgagacaatagataagcaccaaaactcgccacaccacaaccaacatccatagcaaccctaatatgcttgccaaacgtaatatcagaaaccatctgcagacacaaactccagagctcaacatcagatgaaaagatacataaacagttgacgcgaaaaacaagaactactacttggaaaaatgagccaccttagacatctggtccaagtactgatcagccccatgaataaactgtgtaccacctccaggaaacttgaacttgttcttgtctcgtgaaatccagttctgacctcctttgtcttcaacaagccgagtatgaggaacattgctaaaccatacctatccataagtaaattccaaatactacttaaactaaatcccaagacatgttatccaaccaaaatgcaaaactcatgcaaacaaaggagtacctcgtcacggcttttaggccatggaatcggctgacggtaacctttaggaggtggaactaagcaattcaagcctttacctttctcaggacaatgacgctcgaatctctcacctcgctctgtcgatttaagcttctttatcacatcagtattatccaaacaaggtatatactctctcatactctcaggacacatcccaaatttcttaattctaaccctagccttagaatcaccgtcgcttttcgcctcaacgatctcagtctgattcccccaatcttccactgtatcactctcaacctcacccacctcaaaatcgtcagacatcacaccgttcgcatcaactatcccaaagctcttaaccggaccaggcggaggaggaggtgaaggagaaggaggtggaggaggaggaggattagcttccaccttaaccttctccgtgtccgccaccaccgacggaggttgttgtcgtattgtggcggggatttcaatctgggtatggttagtaggaattatcgctgataaattaaagactctgttactattcggtgaaacggagacctccgggatcgagctaccggaagtggaagaggagaagaagacgagctgttggtagccatcgtcggaccaatgcttgcctaagtagaagaaagcgacggtgacgaaaactaaggcggagatcttgatcagagttggggatttgaacagatcgccattagtgagaggcttcattagcttgcgtgtgaaggatcagcgatctctggatctgcgtagtgttgttgtgtgagagaggatgattagtgtaattttacagttgttgcttttggatttttctggcgttcggtaaaattatcactacagaagaatttgcagaatttagttaaaagatcagaaagttgcagagagttttatataaaaagggtcttttcaatagcatgtcttgttaaaatctaattcagcaaaaaaaaaaaaaaaaaaaaaaatagtacatgatagtttgttaaacgttatcggcaaatgatgaaaagattttactaaaaactggttttttttaatcatgtgattgaatataatcatatttataaaatatttatgttaaatgttcttatgataaagtgcgatgagattctaatagtaataaatatttgttttactattaaaattatatcacacagtgcggttcagtcttcatgcaaatgaatataatggttgaagcgaacaaatccgtatacggattaaaacgtttttcatttacctaaaaaatcattgtaaactaacaatggattgtttttacatacaaatataattgatttgtagcggtttgttgtccatcttgtagatgaaacggactaatcgcaaacggatttgtccacctcgactgcgataaccattcaaacaagattgaaaagaaagagagacaaaggtttaaatgaaattaagaatgtacaataatgttggcttatggtcgttggacactactttcgagcccattacatttaatatcctttaaaataaaaaataaagaaggcgaaaacagtttcccccaaattctcataattttcacaaacaacctctcgtcttctaggttaatccaatttcgtcgattcatgaagttcacaattctcccatcggaaaattcttcgtaatcgacgacgaagagatc

SEQ ID NO: 11503 - DNA, 3000 bp, Unknown
  misc_feature (1)..( 3000): cDNA_ID_1443075_gDNA_ID_2214499_Annot_ID_133629 3000 nt of promoter + ATG
tcaaagctgaaatcaaggtgctgcctaactacgatgttgctttggtatctttccataactttctctttttgtgacttttttttttttttttttttcatttctaaattccttcatttaacttttctaaagtattgtagtattactttaaaatcaaccaaaatttatacagtattgttactatgatgtgtgtatgcatatggggtcaccgcgtttgatggtggcgtgtatttgtcaaaatggactatgcttttaattaaacgttagatctggggttctctattcttcttttttagtcataaatcataatatatacgttatgatataatattgtagcctctatgtttcgatttttgttcctcgatgtatcaatcttgaaaagaatcttagtttcattctaggtaatctcaaggtgtgaaaatcctatgtacataaatatgtaaagaattctcaaccattattcttaaaccaaaaatctctatcaaaaccggtccaacaccagaacatcttgatgatctagacaaatcagtttcttaaaaaaattattgatatgcaccactttactaagaaggagaataacaaaaaaaacaaaatgaaggtaccttgtcggtgtcacgtggggaagaacatgtgaaaacaaacgaacaataattggaagaaaaaaaaatgtgaatcttgtgatggatcaaattaggtatattctttgtagctctttagtgttcgttcactcacagcctcaggccctcagctttggtcttatccaaacgactggcccgcataacagagacattacacaatacgaatgcgtttctatattactgctccatactcaaatcgaatcctggagacagattcttattttttttgttatattcaattgtttagattactaaaagccaaaatcataaaaactttaaacgatttgattattatatcaccaaaatattggcttttaatccatgttaatactgattaacttgaaatatacttatatttttggttattggggaggaaggaatacaaataatctttttcgacactgaatagtttcctttgaatgaaagctgataaaatagtgtataagttcatttttttataacgtaattttttttttggtaatgtgaacaccctaaaaagatctccttctgatgtagaaatattatacccatacacatcgataagttagtttgtggaaagaaaaactaactaacaaaataacaccttcaattcgacaaaagagcataagtttaataaaatacctacagaaatttttgacgatgataccactaccattcgccaaaaccacaataattcaattcttctaaatgtagattctattaatatggtcgattgtcattattccaaataatttatttttttaaatgaaaaattcataactctaaatatacaaaagcaattgctgatttggattcaaattttcaaagagaacttgtagttatgcatatacataaaaaggtaagtcagtttttttttttggctaataaaaacggtaaaatcatgttattgataaaaaatttgaaaacagtaaaagaaatatgaccatatttgaaaatttacctaaaaactataatgatgtaatagtttgatttacttacatttaactaatttttaaggtctgttgatcgaactcgttaccttgaacaattagtaggacaactcaaaccactaaaccattatactttaaggatttatgtaaaatttcaaatatatatagtttagtagatgcacttatcatcacactcaccaattggatgtcaacacctggttctagctttttaattaccaaagtgaaaaaactgactttttctaaaaaaaattcgttctagatggatgctcttcaaattcgttctaaaaaaaactgacataataccatccctttaaaaacacagaattttttttatcatctctgaaacaaatcatttacagtagtaaatgtcaacacaacattaattctgtttgttgttggcatttacaattgcaaaatcattttctcatttattattcgtatttattttgtcaagaacccttgtctctaaaatattcatagaaaaagaaaagagccattaattaatggcttgaagaaagattggtgtataagcgtctacgtgacctttaattaatttacttcccccaaaaaagtcaacattcaacatgtgaataaaaatcaatattggtttctaagtaagtaagtaccatattattaaattatttattttggtaaatacgcactcaatttttctctcaacggtgtatataaacaaaaggagtctcctttggaaaaaacttgcctatcattttgccaacgaacgttctttcttcttaatcacagctcagcctgacgcaaccgctcaggctgatctcttccaatttacagccatttcccagctcagatctctgatccggtgagatctctctcaaggtaatgcccctgcaattttgcttacttctctggttgtgatatgcatgttcttcgaattttcatcgtttgtgatttgaattctcattttgtatttgctgttgttggtttttaattcgattttccggaacagattatgggatttgtattcgaatcttcgatttgatgacataatgtcccagccttttatgtttaatcttgaaatgatggacttttatccgatctgggtttaaagctggaattttgattgtgggtactattaggtttcattgatttattgcttggtccaacatttttagcagctggtattgagctcttgttgtctgaattttggaaagaactatttttgttgtatcgttttgatttatttggatctgaattcattcacctttttctctgattattgttttgtgtcggttgcatccactttgattagatctgaatgaatcatttttttatgtgctcaagttattgtatggattgttctgtttctagcatgttttggttagacattgttaagatctgacgtttgcattttcaggaaaaggagttagagcatcatcaag

SEQ ID NO: 11504 - DNA, 3000 bp, Unknown
  misc_feature (1)..( 3000): cDNA_ID_2706663_gDNA_ID_2214499_Annot_ID_133631 3000 nt of promoter + ATG
gtggccttcatgttgttatcgatctgactttaaagagaaggaggtaaaacattcataattggtcctcgttagacttttcttaagtttaagtagattgatagatggtaatacaagtcatgtttttatatcataagagaagattctgagaggaggaaaatttgcagatttcaacgttgatggatggtcttgagaagtactggcctagtctcagttgtggttctccatcatcatgcaatggtgggaaagggtcattttggggccacgaggtgattatcttttcacatctgttattaacttttcatagataggtgtttccatctcctatgacattgtctttcagtcttcaccaaaactaactctgtttcatttgttggttgtcatgtatatctttgcaatacacgctggcagtggggtaattatattcaatctttacttctttaatttgatttttctttcgatttccttccacataatttgtatagaacttgattcattggtgttgttatagagttccatgcttaatctcacaaccttttgcataacagtgagttagttagcagaatacattcgggtttggttatatgctaattcgataacataggttctctctctaacgattttgctgataattttttattttcagagaaacatgggacttgttcttctcctgtttttcatgatgagtataattacttccttaccacacttaatctctacttgaagcataatgtcacggtaagtcttcatcgagttatgcttttatgttatgatataatgcatagtggactggttaaataagaaagttgggcatacggaagatttacatgtgttaactatttgcttgcattcttctgcaatgtagtttttctatgcgatgtaaatgatcatgtatcttagatttcctctgctctgtcagtttatcagtttgtgaagacactttcttacattttttctctcttggataagttcttaatgcctctgcatctgtaaatgtggtaggatgtcctttatcaagctggctatgttgcttccaacagtgaaaagtatcctctaggaggtatcgtaacagccattcagaatgcatttcatatcacccctgaagtggtttgcaaaagagatgcaatcgatgaaatacgtatatgcttctataaagattttaaggtttgttttcgagattcattcttagattgttgatttccttttaaagtctgaaattgctctcgcatgataagaaaactcaaataacatgtctccaagcattatgaaattatcagacaaagtcttaatgctgtgtgtagaaattgcttggtttggcaagatttgctaatcattaacattattactgtttttcctggtttaaagctaaaacatcttgctagactttgagaatggcaccagtttctgacagttttgttaattcatgactacagcccagggactgtgttggttcacaagatttgacatctagaaagtcatgccccaagtacgtaagtttgccggaatacacgccattaggtaagtaaaaatcatatcttgaaggaggcataattgcaagagtattagataagtaatggatatatgataaaaatgataagaagtaatgtgatgacatctatatttgtgggttatgcagatggtgaagctatggttctgaagatgccaacagaaagagaagctctttgaatcggaaaagatgggagctttgttatcttctgagagacaatacatacatgtctctgatgttgtaactttactaccaaaacctataaagattggcttatttcgttctattggatatgtatcatcattactggtaaatcaagtttctttctaataatgtagaagatcagaaaatccataagaagatatcaacatttgagttctatggtaaattgaattatatcaacttagttgcaatgattcattcttgactgatgcattgatggcttatcaaaccagtttacaaaattcgattagatatttatgcttaattgcttacgtataattaacgaatatatctgaccaacaagaaatatatacagatatatacaacgaatagatgctatagaaagataaactcatatcaaatcaactacaactgatcgtaaatcttaacaataatcccccaaattgttttataaaaaagaaaaagaaaataaaactcaagtcactgtccaaagaaaaagtgatgacaaagataacttttatgttactacaatcgtatgaattagttccaaagacaattcaagagttcctttatccacgatacaacgatcactgttcaaatcaacgagacgagctgcaccagagaactttccatcctttggcaatcgaatcttagcccgacctatggcaacttctccatctgatgttgcaggatctctagaagaatgttttctaaacaattctaggtaaagatattttgcaggagaatctaagggaatcgccaattctgtattatacttccaatagttgcctttggaaacccatacctgtgttgtgtatggttctacagggtctgtccatgcaataactttatagtagtttggatgttgcaaaagattttggtcatcggttgtgcatgcacgtaatatcttcacgattagctttgtttctatgtgatgatcaatctttctcttcccttcgcgaatcagtctccttttttgtctccctaagtttgtcattgagactctggctgttaggtcttgtgaattttaaatatatatatatatatatatatatatatatatatttctaggggaaactaaaaaaaaagagtatccttttatttcggaaaatattttataaattgcgtttgagatgaacaggctaaacctaacgaagtttcatcataatccaaacaatttaaataagtaatactaaaaagattctgagaagcttaagagtaaacacaatatacatcgtatcaggaaaaatatatatagttagaggcatatatatcgaacttatttcttttagaaaaaaattaagtcactagct

SEQ ID NO: 11505 - DNA, 3000 bp, Unknown
  misc_feature (1)..( 3000): cDNA_ID_3593715_gDNA_ID_2214499_Annot_ID_133632 3000 nt of promoter + ATG
gttccaatttttttttttttattttgttacaatacaattgtggtctatattaaaaactctttaaaacataatccataaaaattcgaggcgtatgcgttcactatctataatgtcatgttcaactatgacgcattggctctatatatatattatgtatgtattacatatattatcaatgtttggtatgagtcgggaaaaaataaaggtccgatccactatactaatctttgtgcttctttcgtatcgacgccatcatttcatcggactccattttaatctagttcatgctataataaacaaataataaacacacgtggatcaatttcatgcgagaaagaaaaagtcgtttagacatacacatcacttcttatcatttacccaaaatgctaagaaatataaattccattttcgaccattttaaaacctatttctccacgtaaacaaaaaaactacgcaaaaaatcgaaaaagtagttttttctctctctctttttcacactcattatatctataacccacatattctaacaaatactagtagcatttacgaatcaagattctccaacataaaatgtatttctcacttacttctccattatcgttttatgtacccttttttttacgtaccaatcaaaatcgcatctttcttttcaaatataattatgtatatatacgcatgtgcagctgctgcgtgtctatgcatacttgagtctaaataactatccctgactatgatatgtcgttggttacgaatgtgatctttagttaaaataacaagaataatatcacacagacaaaaacaaataagtgcatattatttcaacaagattggagtgggtgggcctaaaggcttaaaaaaatagagcacatgcacagaggaccattgattccccagagacaatcagacatctgagaccctaatcgcatcaagccgcgtgcccttcttccattaactaattttgtgtgtttgttttggcttaaacctgagaattacattgattactttatttgtttcattttctccatgaaggagataaaaagagtaaaaattagagattgatgaaaactgaaaaagaaactgaagtcggtaagataggtgttggaacttggaataatggcttggctttgaacaaaacgcatgcaccattcattgccttcaagttttttgcaattagctttgtttttgtttttgtttttgtttttgggagaggttctaatgaccaagaatcaagagcgttgtctaaaatctaaaccatatgatacggtttttaatattctcatgcattaaaatgtactatttctatatatgatcttatatacccaacatcttggaattaatagtttgattcgttatcatttgaagaagctctcaacagcttcaaaaagcgaaatgtagcatcatgaagcggtatccaatttcaagaagctaccagtagcttgtggaagttttcaagaagttttccggaagatccaacgattgtggaagcccctcatagtttttggaagttttcaatgatattagcagcgttgagcgtggcatggctagacaatgtaagagatttgatttgcaacacatttgatgtatttttttacttttgagttacaattgtaatgtattattgattttgcccagttatgatttataaaccctacaatttagtatcaaagtttttatttaaaattctgaatctgacattaatgatatctggctcatttacagagccaatgagatggatgatgttcgaaactggattggccattatttatcttttttttatctggagaatctcgaggttggcacaaacattatcatattagcctttagaaattggattggctaatcacacatttatatatattcttaccaaaataaatcacctctcccgtaattgaaaaatatctaaatactgtaagtctgaaaaaattcacaagggttcgaagaaagaaggaaatatctaagcatcattaataaactatctgtaacctgagggaaaatcatttcatgttgaaatatgtggatttggaagttttataatctatctgaatttgtgaaatttgataacaagtaagatttgtttcttaacacaaatctaaaatttgttttctaattaggtttgagagagagagagaaagaaacgctttgtatgatacacatctaggctatgaatgaaggcagcggacaaagcggtctaatttgtctgcggtttagtccatctcatttttggggtggacaataaaccgctgcggaccaagtttatttgtatgtaaaaacggtccgcagatggtccgcaacgattttcttctatttttttaagtccagaccactgcggactataattgatgaatgataaataaaaaacggtctgatccgttgacggttttgtccgccccaaccgccataaccattcaaacccctaattatttcatcagataacattatacactaataatcattgcactcaaatatgtcacacaatcatataataaaataataacaatgattaaaatgaaaaaattgttgtggcgccgcataaaatagaaatcgtgagagacgacgtcatctaaaaattgccttgctgtccacttttcactttgtcctctcttctcatctccgttcacttccacggcgtttcctcagccgccgattttatttatttcccaaaatacccatcacctatagcgccacaatcctctacatcacaccctaatctcattaccatacaccacccaacgaacacgcgccacttcatttgttagtatctaaaataccaaacctacccttagttccacacgtggcgtttcctggtttgataacagagcctgagtctctggtgtcgctggtgtttataaaccccttcatatcttccttggtgatctccacctttccctcacctgatatttattttcttaccttaaatacgacggtgcttcactgagtccgactcagttaactcgttcctctctctgtgtgtggttttggtagacgacgacgacgataatg

SEQ ID NO: 11506 - DNA, 3000 bp, Unknown
  misc_feature (1)..( 3000): cDNA_ID_2706659_gDNA_ID_2214499_Annot_ID_133633 3000 nt of promoter + ATG
tttcattttctggtaacgacattcttagttctaccgcagcacatcaaaatctaaaggtttttacatatatatgttttgtctggtgttgaccgtctcatggagattaaggaaagaaccagaccttgatgaagattgaaagaaccatttgcagaccaaatgctgcagccattacaaccgtgatatcattgttcgtctcgaggtaagaccgtagattcagggcaacaaaacacgatgatgcactaccagctaagagtataatcacccatctcagaaactctactggaataagcaatggaagctgcaaaatagaacatcctgagtgttattatgcttaaacagtatgaagtataaagttgtgatatcaagttaggttgatttatgtcattgtacatggtcattgaaagtgaagttaccaaaccattgtgtatcaagtatatgcatttgtctttagtgttactgatcatcaattgattaattttaacagcaaaagagaccgaagttactgaagatacttacagaggttggaacgaaaatgaagagagagtatccccaaaggcaccagaatcttagaagatcagctttggaccccatataacggagtgcaaaataaaatcccagaggcacaattattgcatatccatatattatagatgctgccaaattcatatagttcacatcaaagatccaaggagcattactgtcggttcgtttcttcacgagatatgtagcacaatttccgagagaagcaagcacaaacacaagcgtagtgcagatccagacaagtccatacctaacagaagcacacacgagtcattaatcaagaataatttgtgaaaggcctagcttttagccaatctttagaggataacatattatgatgctttctgttcatttgtccaagagaaaatgaggatattttaatcaatcgcctgaagtaacataggagtaaatgaatagcaagatcatgctttcggaaaggtgcagaagataacacttagaacggtaacaaattaacggcatgactgagcaatggaccgattaaagaaattcgaaagaactctctcatggtaagtacaatcaccaagaagagtgaaggagaaaaaggcattaaaagacttacaaatcagggtttgcatcaatcttgttgaaaaaatctccactagtaggatataaagagctcattaatctgttcaaaacaacgtccgtgtccacgtcgaagtattgggtatatgagtagacattaaaaaagcccttccagttgtttgatggctgttgtgctggtccttctactggagcagataagatatatcaccatataagacagaacaaggtgaaaacaaaggtatataggatcttgacatccataagaaaaacgaggttgactcacacaagtattctttcaaccattgtactgattcatggtgactacagataaaaatatctcctaaaaaaggaatctaaaaggagcatatatacctgttgggctctcaagagtttgataaccctttgtattgtttcctagattcggtggaaatatttgcatgcttgcagaagggcctgcaataatgcagaagacatacaacactcaatgtctttcactaccggaaaagttctttgcaaaagataattcaagcagaaactagcaaaagaacacaccttcattgacgcttgctattggtacatttgtgcttctcttgtcgtcgctgatcacagcctaagaatacagatgtttgtatcagacataataacacggggatagtcaatccattcactcaaaacatttatcttagcggattcaatccaaaatgaagctatcatgcaagcatttaaactcaaatacagttttgtttttcatacgaattgtctcctaaaatggtgaaaaaacttaaataaaacgccttaacaaatatagaaacccagaaatgcaaataaggaaatcgtccattgttctatgagtgtgaagactttaggcatcatcgtggacgcgaaaaaatatgacaaaaaaatctgaaaagtttcaaaattctacttcctaatgtaacacttgagacagaacaacaaacaaaatgatggcatgaacaaaaaacgttaattttcccttcacacaaacaaggatcatagaaaaactcaatcaaagagcttattgatggtgaaatgaaagaagcaatagatgtaatatagacttaccggaactgaaccaagcaaatggcttgattgtagattagcgaacgactcatccatcgatcaaagagaaaaagatatcaaagaaaaacttagaagataggttcttctaatctcattcaaaaatcgataagatcggaaaaaaggtcgtccctttttctgaatttttaaggtttctgggtttgcttctcctcctccgtcgtcgtggaagcaattgggaaaggaagagaaactaaagaaagaacgatccacgcgctttcttagcaagtcggtaaaacacgcgctgttcactttcggacacgtgatttgccgacttgggcccagacaatcacaagattcacacaagacttcaaaaacaaaggcccatatttaaattttgacccgaatcgtgatttgccgacttgggcccagacaatcacaagattcacacaagacttcaaaaagaaaggcccatatttaaaatttgacccgaattaaacaatccgacttgacccgtttgaggagaaattcactcaacagtgtttcctctcttcgtcttccctcccgagaaagctcaacggagccctagactggttttatcactctcgccaacaccaaccacgctttttctctctttacctccatttttgtattcgtcaccggagtagatggatacgagagaaatcaacggttttgcctccgccgcgagatcgatatctcttcctacgcagcctaattacagtagcaagcctgttcaggttcttccgctttatacctttttatttctccactgaattagtttagctcaggtcttaggatttctaggttcagcttaaaaaa

SEQ ID NO: 11507 - DNA, 3000 bp, Unknown
  misc_feature (1)..( 3000): cDNA_ID_3040159_gDNA_ID_2214499_Annot_ID_133634 3000 nt of promoter + ATG
tgtgccatacatttattaattggtgtagcttacaaactttccaaattatatttcaggaagcttgtaggattctacctgaaatatgcggtccagaaacctaccccaaagttgcgcaagtcctgttagaaagggataaccctgaaacagctcttatggtcttgcgttggtctggtcgtgatggtgtatcagaattggtttcaattggtgaagctgtcacagctcttcgtgtgagagtggaatgtggtcttttgagtgaagcattcacataccaaaggacactctgcttgaaagtaaaggaaaataatttgaaaaatggagctgtgaaacatgcgtctgatgatctagacatctggagttggacggaatggatggagatacttgtcaatgaattctgctgtctttctattcggagaaacttggttgatcgaatcattgagttaccgtggaacccagatgaggagaaatatctgcacagatgcttattagattcggcaactgatgacccctcatcagctgtgggtagtctcttggttgtcttttatcttcaggtaagtaattatattttcaaactttaaataacttcacttgaacaatgggctgagaattgtttttcagaacgagaatagctttagcaacaggcaaatagatatttagacagcagcttaaacctcccgagctttaagctacatattgaaaattttaataagggatctcaatgatggctctgtatagaattagctcattctatagagactggtatatgttctcgtatttgatgtgtggcttcaacaatcttttataattcgagcttggtgtagtctgggatgttggttaacaagcatgaaattatttgaacaaccagggaaactgcatcactatagaccatgcttattttctggaaagttattatcttttgtatatggtctttctttgactagaaattactggttgttcacattgctgcagcgctaccgttacatccaggcataccaagtcgatcttaggcttcagaaaatcgaagaggctttcgtatccgacaatcaaattggggaagaagttatgttcagaatgcgatcacagagtcattggagaaaagagttagttgtaagtatttcagccaactttccatgtacaagtggatccttccatagttccttgttaaaggctacatcctcacatttgcgttttagtgcttaataacctgttgatgcttgcaggattgtctagtattctgaaacttgaatgtacaatattacttgatactggctttttttaactggacatttaaacctcccgtgtctctgctcctttgaaacaggatagagccatagatatacttccagtaattcagcagcagcaagttagatctggacaattttctgagatggaagatgcctctgaaggagcaaaaaaatctgatcttcctgatgcacctgacatgattacttcttcagttccctttgccactactaattccgtttttctccaaagtgctaacaatgccagagctagagagccagtggctaataatggcagtccttttcaacctggtcatatgataggaaacgcgtcccatgatctttcacatggaaggttatttacaaacgcaaatagaggacaaaagagtgaagttagaagcgtaaccaagaatctgaaattcggtgaaatgtcaactccgttcaaagatctaaatagagctcgtgggaacagccagctccaagggaaaaggactgaagaatcctctccagaagtaaatgttgatagatacatagagaataatatgagctctccttatctccgccgaatcacagctaacaatcccgtgacagtgaaatctagcagcaaccatctcaatggatcttcacagaaaccggaatccaccttttttggcacaaggatgcaaccagacaaagataactttgttgatttggatgatccaatggacatgtcttcgaggtattcctctcttctttatctcttagccatttgttcctttctgaatcgtgccattaaagtagaggacactggtattgtttggtataaaactattgttaccgtttggtttgaaaataaagtccagtttggtttcagtctaaggaactttgtttggttcttatgtccacggcttttagtcttatattggatgagctacatatcaattgtgtgtattatgaattgcagcttaaaggacaacaacaacaatgtcttggccacggagagcagaaataacagtggtggattgagatggcggtcagatgaaacaagcgatgacgaagatgaactgactagttttggttccatgccggtgaagggaaggaggagacgtagattcgcagcaagatgaaatgaaacaaacactcgaaaagaccatcatcaattatgtttaaagcatagagaaagagagagagaggtagagcaagttgtgtaaagaggggagagagactgttacagtgagcgttgttctcctgttattttttgtgctgaattttgtgtatttcttctctagtctaccttttttggacagttattttaaagatatcattgtgatgagcggagtgatattattattatgagtatgtttaatttcttatattggtgcagctgattgttgaatcgtagaagttataacaacacattgagattaaatcattttctttttacattcacaatttcctctcaaaattttaatttttaacttttttattatttaccaaaactaataaatggaaataagtagcataagcttgttccaagtttctgatatataaatagggttttcggaagagagaatagggtctcttcctatcgttccgtcactttttgttccgatttgtcgacaaggtaaaccttaaaactaaatctttcaatatagcataaccaatgatccgaaaacctaaatctttcattctctgtttctgccttggatctgtattgaaattcataatctcatattaggttttcgtgttacttaattccgcaggtgtttgttggatccatatc

SEQ ID NO: 11508 - DNA, 3000 bp, Unknown
  misc_feature (1)..( 3000): cDNA_ID_3040159_gDNA_ID_2214499_Annot_ID_183930 3000 nt of promoter + ATG
ttgaaaacttcctttttttcttttatatatttttactccataagcaaaataagtggtagcaaacaaaaccaaaaaatgaaaaaacacaatcgttacaagcaacgatgaaaatccgccagtaaaaacgaaaccgaatgatttagcggatatgttccttcttctactttgtgggtttcattttctggtaacgacattcttagttctaccgcagcacatcaaaatctaaaggtttttacatatatatgttttgtctggtgttgaccgtctcatggagattaaggaaagaaccagaccttgatgaagattgaaagaaccatttgcagaccaaatgctgcagccattacaaccgtgatatcattgttcgtctcgaggtaagaccgtagattcagggcaacaaaacacgatgatgcactaccagctaagagtataatcacccatctcagaaactctactggaataagcaatggaagctgcaaaatagaacatcctgagtgttattatgcttaaacagtatgaagtataaagttgtgatatcaagttaggttgatttatgtcattgtacatggtcattgaaagtgaagttaccaaaccattgtgtatcaagtatatgcatttgtctttagtgttactgatcatcaattgattaattttaacagcaaaagagaccgaagttactgaagatacttacagaggttggaacgaaaatgaagagagagtatccccaaaggcaccagaatcttagaagatcagctttggaccccatataacggagtgcaaaataaaatcccagaggcacaattattgcatatccatatattatagatgctgccaaattcatatagttcacatcaaagatccaaggagcattactgtcggttcgtttcttcacgagatatgtagcacaatttccgagagaagcaagcacaaacacaagcgtagtgcagatccagacaagtccatacctaacagaagcacacacgagtcattaatcaagaataatttgtgaaaggcctagcttttagccaatctttagaggataacatattatgatgctttctgttcatttgtccaagagaaaatgaggatattttaatcaatcgcctgaagtaacataggagtaaatgaatagcaagatcatgctttcggaaaggtgcagaagataacacttagaacggtaacaaattaacggcatgactgagcaatggaccgattaaagaaattcgaaagaactctctcatggtaagtacaatcaccaagaagagtgaaggagaaaaaggcattaaaagacttacaaatcagggtttgcatcaatcttgttgaaaaaatctccactagtaggatataaagagctcattaatctgttcaaaacaacgtccgtgtccacgtcgaagtattgggtatatgagtagacattaaaaaagcccttccagttgtttgatggctgttgtgctggtccttctactggagcagataagatatatcaccatataagacagaacaaggtgaaaacaaaggtatataggatcttgacatccataagaaaaacgaggttgactcacacaagtattctttcaaccattgtactgattcatggtgactacagataaaaatatctcctaaaaaaggaatctaaaaggagcatatatacctgttgggctctcaagagtttgataaccctttgtattgtttcctagattcggtggaaatatttgcatgcttgcagaagggcctgcaataatgcagaagacatacaacactcaatgtctttcactaccggaaaagttctttgcaaaagataattcaagcagaaactagcaaaagaacacaccttcattgacgcttgctattggtacatttgtgcttctcttgtcgtcgctgatcacagcctaagaatacagatgtttgtatcagacataataacacggggatagtcaatccattcactcaaaacatttatcttagcggattcaatccaaaatgaagctatcatgcaagcatttaaactcaaatacagttttgtttttcatacgaattgtctcctaaaatggtgaaaaaacttaaataaaacgccttaacaaatatagaaacccagaaatgcaaataaggaaatcgtccattgttctatgagtgtgaagactttaggcatcatcgtggacgcgaaaaaatatgacaaaaaaatctgaaaagtttcaaaattctacttcctaatgtaacacttgagacagaacaacaaacaaaatgatggcatgaacaaaaaacgttaattttcccttcacacaaacaaggatcatagaaaaactcaatcaaagagcttattgatggtgaaatgaaagaagcaatagatgtaatatagacttaccggaactgaaccaagcaaatggcttgattgtagattagcgaacgactcatccatcgatcaaagagaaaaagatatcaaagaaaaacttagaagataggttcttctaatctcattcaaaaatcgataagatcggaaaaaaggtcgtccctttttctgaatttttaaggtttctgggtttgcttctcctcctccgtcgtcgtggaagcaattgggaaaggaagagaaactaaagaaagaacgatccacgcgctttcttagcaagtcggtaaaacacgcgctgttcactttcggacacgtgatttgccgacttgggcccagacaatcacaagattcacacaagacttcaaaaacaaaggcccatatttaaattttgacccgaatcgtgatttgccgacttgggcccagacaatcacaagattcacacaagacttcaaaaagaaaggcccatatttaaaatttgacccgaattaaacaatccgacttgacccgtttgaggagaaattcactcaacagtgtttcctctcttcgtcttccctcccgagaaagctcaacggagccctagactggttttatcactctcgccaacaccaaccacgctttttctctctttacctccatttttgtattcgtcaccggagtag

SEQ ID NO: 11509 - DNA, 3000 bp, Unknown; identical to SEQ ID NO: 11505
  misc_feature (1)..( 3000): cDNA_ID_3593715_gDNA_ID_2214499_Annot_ID_183928 3000 nt of promoter + ATG

SEQ ID NO: 11510 - DNA, 3000 bp, Unknown
  misc_feature (1)..( 3000): cDNA_ID_3040116_gDNA_ID_2214499_Annot_ID_183927 3000 nt of promoter + ATG
aaagataacttttatgttactacaatcgtatgaattagttccaaagacaattcaagagttcctttatccacgatacaacgatcactgttcaaatcaacgagacgagctgcaccagagaactttccatcctttggcaatcgaatcttagcccgacctatggcaacttctccatctgatgttgcaggatctctagaagaatgttttctaaacaattctaggtaaagatattttgcaggagaatctaagggaatcgccaattctgtattatacttccaatagttgcctttggaaacccatacctgtgttgtgtatggttctacagggtctgtccatgcaataactttatagtagtttggatgttgcaaaagattttggtcatcggttgtgcatgcacgtaatatcttcacgattagctttgtttctatgtgatgatcaatctttctcttcccttcgcgaatcagtctccttttttgtctccctaagtttgtcattgagactctggctgttaggtcttgtgaattttaaatatatatatatatatatatatatatatatatatttctaggggaaactaaaaaaaaagagtatccttttatttcggaaaatattttataaattgcgtttgagatgaacaggctaaacctaacgaagtttcatcataatccaaacaatttaaataagtaatactaaaaagattctgagaagcttaagagtaaacacaatatacatcgtatcaggaaaaatatatatagttagaggcatatatatcgaacttatttcttttagaaaaaaattaagtcactagctatggcttttgcttggtgcgtacgcaggtcagcatctaagttggcttccgcatgtggtcaagcccggtctatctccgccgttgtgaaccgtccgtctcttgctctcaacccgtctccgctgagtcctttcgtctctcgtggctttctttacacgatggctgttgataagctgagctctgagcaaacccttcaccttgtgattgactccgagctcaattctgctttgcaaaccgatgatcccaatttggtaaaactttcacatctttgctcaaaatttcattcctaacaaaacataaattagtatcgtttagctttactttgcgaataagtttctgataatattcttacgagacttttttttttttttgttctgacattctattggggtttgtttgggggcagaatgaagagatggctccaggaagcttccctttgaaaattagagacaagcctggagatcagagtgtaacattgacagcatattacaatgacgaacgtattcatgttgatgtaggaatgccttatcttggtgatgatgtcattgatgtgtttggtcctaataatgatgaactaagttttccactagttgtgactgttatcaagaagaacggagtcagcatagagtttacctgccaggcttatgctgattatattgacttaacagatttaactgtgcatgattatcagtatcaaatgggagaaactgactggcctcgtttcaagtaagctctttgaattcaataattaatattttttagagatgggcatgagcatagacgtttattggtgtgtgtttccatcgcattttgtagaaacttggacgataatctgaagaaggcgttccacaggtatctggcgaccagacttgacgcaaacataacgaaactcttgcataagtacatggtgagcaaaataaagagagagtacttgctatggttgaagaatgttaacaagtttgtggatggatgaaaggtaataagtttggatattgttaaaaaaagtctcttcttgtgttagttgatagcattcaaatgtgtttttagcaatttgcataatcttttgagaacatttgaatgtgtttaaatgactttcaagttctgatgtgagtttgatattcacttatgcttcccaattaataccaatccaaacttaaatccaaagatatagataaaaaaagaaaagaaaatgataaggagtagaggatcatctaatactatatatcagaaaggtgtaggtataaaatgttcttcatgaatcgtatttttggtgtgtgtaaatttctctttgtccacataagaaaaagaaagagggattgaagaagaagagaatgctagtttcttccactctgtttatcaaacagtgcataataatctatataagtgttaggaaaaaaaatgggtgtgtttgcaaaatagtcactttttcaaacttaattaggaaaatagtcactttactattcataatttgcaaaatagtcacttttcactgtttgattcgtacacttggattgtacatcacttttagtgtacaaatataaaatgtacgctgtgtatttttatatatatttgtacactaaaagtgatgtacaatccaagtgtacaaatcaaacagtgaaaaagtgactattttgcaaattatgaatagtaaagtgactacttttccaattaagtttaaaaaagtgactaaatagcaacttaagccaaaaaaaatctatgttcaagcacaatgttttgagaatttagggtaatgactttcaagttgagatacgagtttggaattcacttttaacaatatgttcttcatgttcttacttataatttaccttactcaataataataaacatatttatttatttttgtcatttattcacttcaataaaaatttatttatattggcacctgatctgattaattaagtaaatcaattaagaaaaaaaaaactaaaaaaattaataaaaatattttgaattttacagattttttgtaatgcaatttgttagatgataaatttccccctaatatttttggcttgatttagaatgttatttggttcgttgatttgaattaaccatcgaaccgaaccgggctgatacggagcctcaacttcaatcgctgttaaaaccttaaaacccttgaaactccattttcttccttcactcacagaagaagagagaatcaatcaaatcaaatcacc

SEQ ID NO: 11511 - DNA, 3000 bp, Unknown; identical to SEQ ID NO: 11504
  misc_feature (1)..( 3000): cDNA_ID_3040120_gDNA_ID_2214499_Annot_ID_183926 3000 nt of promoter + ATG

SEQ ID NO: 11512 - DNA, 3000 bp, Unknown; identical to SEQ ID NO: 11503
  misc_feature (1)..( 3000): cDNA_ID_1443075_gDNA_ID_2214499_Annot_ID_183923 3000 nt of promoter + ATG

SEQ ID NO: 11513 - DNA, 3000 bp, Unknown; identical to SEQ ID NO: 11502
  misc_feature (1)..( 3000): cDNA_ID_2717448_gDNA_ID_2214499_Annot_ID_183922 3000 nt of promoter + ATG

SEQ ID NO: 11514 - DNA, 3000 bp, Unknown; identical to SEQ ID NO: 11501
  misc_feature (1)..( 3000): cDNA_ID_1807971_gDNA_ID_2214499_Annot_ID_183921 3000 nt of promoter + ATG

SEQ ID NO: 11515 - DNA, 3000 bp, Unknown
  misc_feature (1)..( 3000): cDNA_ID_3040126_gDNA_ID_2214499_Annot_ID_183920 3000 nt of promoter + ATG
atcgatttaaacacatctactaaatctatagttcacaagtagagaataaaagaagcatcaaagtatctttagatttcctagttaaagtcctgattcttctgttctgtcagagaatctcaaagtgattcaaacgatcaaattcttgagctatatttgtaaaaaccaaagctattcaagtggtggataagcacaaagcgttaagattatgttaaaagtaacattaaaccactaatggagattgaagtgtaccggagctctgttgatggcaccgacggtggaaactgcggcggccatatctcaagactgcgacgagtatgcgtcacaacacaagaagctgaagagaggaattagattggtagaagaagaagcttagagagatgttggtgtgagcaagaaactgagagatttataaagcgagtgatcaacaaccaattcgttatctcttcgtcttcaaggcttaactctctgatcgccacacgatgcggattggccaagttgccacgaggaagatgattaggaggattctattttgattggtccacgtggaatatgtttatgaggttgtcgtcaaatggctaatctgtgccaatggatttgttttttttttcaagtgaagattataacattatttattaccacatatgctttggaaaatcattgtttttttttttttttttgaggattgaggtaagccattcatatgtgatcaagatacttctacactcttcttcatacgataacattccaaaattttggataatgacattgcttatcgataataatgttccaaataaccgatgtaaactgattggtggagagaaattggcttagccaatagaatataattctaattttgttatatacaactctagatacaacaggtatcaagtatgtggttatcaaattaaccatattgtactaaaccgctaaaaactaattaatgcaactttttctttacacaaaatgtaaaaacaagtgatgcaatgcatacgtaagatttgataaatatatagtttagaagatgaagtaaagatagtcgaggctaagatagcatcatgcaaaatatcatatgctaaaatatgaaataagattatagtgtttaaattcatagtgaaaatatgaatatatcagaaattcatatgaatttacttgttttaaaataaaaatgataactatatcatagtttattgttccctcaaagttactataaaaacaactcatctaaaactatatattcacaatcacaagcaatcgttttctacactaagctataaaatgaaacacttcacttgtctgatcattataatttctcatcctcttcattattttcagttttctcaaccattctctcatgtggaacgagccatcatatcatcaatggacaaaaccaaattttaattttaggcttcattcgctgccgacgaagcaatatgtacatgttctacatgcaagacaagagaacaaagattactgatatgatattaaactattattgatccatatataagacatgttgaagaaccaaacgattgataataatgtggtggagctactcgcacaatgctaaatgttaactgtatgtgacaaaattagcaaaagtttgcgtgccaggtttgattcttagtacacatacatgacttttaacatactgaggttagaaaatgaagtacagtaaaacctttataaattaataatgttgggactgcaaaattttattaatttaaaaaggttttaatttatcgataaattaatattttttaattatagagaaattttcctaatttggtaactttttaaaaagttttataagatttttttcattatagaaaatatctttctaaaatcaattacaagtacaaaattatatcatgtctagaaaacaataccaaattttttttgatacagtaacacattagaactaaatttcaaataagaataactacaaatttaagtaaaaaaaaatcaaaaacatttcttacatataatgtatatatatagttgatacatttatgcaattattaatttatgatattgatgagactatatatttacataggactttcaaaaaagttattatcttattaatttatcgatgtgttacactttttacattggtcctaacttgggatctggtgaatttattaatttatagaggttactaatttatcgagtattaatttatggaggtttaactgtaaaaagagttgaggttaccattgcaataaaatatgagacaatgtgtagaggaggataaaagattgaacaaaaagaagaaagccaactagtttttgtcaaaaggataattttccatgtgcatgcaagtatgcaaccacatcaaaatcataaataaacattgtctaaaatgtttctaataaaaatagatgtaaagaaaattcatcagtttaataactagggtttaagagatatttacaaatactaaccattaacatcatatttaatatgactttgtaaaatctatgatcaaataacatgcaatttttttaatatgtaaaataaattatctcaaaatatttgattgaatatataccctttaatttagcattgattttaaaaatccaacaattttctatagtatattttgtaataatgttattggttcctaaaaaagatggtcacatcattcattaaataaaatgaaataaagaagtgtttccttcgtcgcattgaataaaataaagtaaaccttccaaagacttttcattgtcttcgcctgcgagcgctaaaattatctccgagcattctcaagttgggtgattcggtacggattactgatttgggagagaaaaaccctagattggaattagattctgggttcttgggctaaaggtttcttcatctccttcgaatcatccttttgtaagtccagtggatgtgaaaacccagtactcactgattctttttattaggaattttgtaaggttttgggtagagttttcacagttttgatgatactaaaatgtgggccactgggtctagaga

SEQ ID NO: 11516 - DNA, 3000 bp, Unknown; identical to SEQ ID NO: 11499
  misc_feature (1)..( 3000): cDNA_ID_2706669_gDNA_ID_2214499_Annot_ID_183919 3000 nt of promoter + ATG

SEQ ID NO: 11517 - DNA, 2281 bp, Unknown
  misc_feature (1)..( 2281): cDNA_ID_3040253_gDNA_ID_2214500_Annot_ID_133637 3000 nt of promoter + ATG
gaattcttgtttttaactataaggataaattcacaattatatctaaaaatgtgtgtgcgtgagttgtagacaattaaaactattgatcattaaaatttactataaagtcgttggagaaaaagtttactataattgttggaaaaaaaaaatttactataaggtctcattcgtattctgaccatagttttcattggactgttaaatttgttatattctttgtatgactaaaagaacatctacatgcatgccaaataaagcgaccacattaaaaagtttgatccagttttggttcgaatttaatttggaaatttgagttttgtgtttattttgtaatgtagaagaataaacttgaaagtgttaatacgttcaattatatttggtttcgattgaaattcaatctaatgtggttagatgagtcctatattaccatgtcattgttaatacccattgccaaaaataaaagtgaagcagaaggagaaattgtttttgtatacccgaaggaattaagatgtacgatcttaaaatagacatttcggccatctatcaaaataaatgtctaaaagttttgtggtcgtcttaaatactacttcgagttcagacgtatacgtctcaccaaagtaatgcacatacttgatgttaagtttatctctttttactatttcaaatttcgcgtttgacaacactttaagtctacattatccatagagaatataacataaagatcatgaacttctcatgaatgtataagacaaatcaagcttatatatgagatctatttagtaatttgatatgtatgtaatatatgataaatctttgatgcaatattttattatgattattagatatacactagtcaactttaactttagaagattaatcattccgtcgcaaaccataccataaattagcaagggatcgacttaatatctccgatccgctatatatttaagaagcatttagattgtttataatacatgtcatgattttataattatgtatatataaatactaattgatgtatgaagtacgtagataatgttacgatctattaatctatttacattaacttttaattagtgttgagtagggaaaattaacatataaacctttagcagttggttgtattattaaaaataatttgaacttaaaatccaccttcgaaaagataaatcaaacaagtataaaaaatgctataaatccagaatatttacctaaggtttttattcttctacttaataatgtaagataaaaccggcacaatacttgttacgtatgcatggtaggtaccgcaattgtgtaagcaaatcggcacaatactaaggttacatatactaactaaataaaacaatctgatttcagtgacaccgtatatctaacctttattcaaatccaagggaacatgacttgacttcttctgttggaactaactcgatccctcaaccatctccagggatagaagagttagtaaaatcaaacttgaagtgaggaagtaagcagtttaacgactccatatgactacagttatatacaaagttgggcacaaagtacaagtactaaatactcaaagtcagataataattttaataagtacaaactatatatatgcagtacaattattgagtatatataaacgagactggtgatttggggcattgtccaccagggtgttatatcccaattgaaatttgaaaatttaagtgtgtgagtgttacgacaaaaaaaagtgtgtgaattgtaggcgcggtgaaaaggtaaattaagattggaactagaaaaatagttgaatatcctttactaaaagttgtcaattccggttttagtaaaaaaaaattttaaaatagaaattttatccaaaagacttcaaacacacatattcgcatatataacataagatatcattttttgtaaacagttaaaaagaaaaacacatgtttttttttttaatttagaaaaaaacatgttattatacaaaacagagttttgcccacttttaatatgttatgaaaagaaaaatgattttcttgggtttggtcagagagattggttgtggtaagaatgggaatcttaattacaaagaattggattttgggtcgacctaccacctaaaacgacgtcgcctccatctctggtttccaaatctctttctcctctccctttataagcttgcgttggccagtcgctcatctcgaaaacagagagaaaaagactaaaaacacagtttaagaagaaggagagatagagagagaagagaaagatagagagggagatggggtctcatatg

SEQ ID NO: 11518 - DNA, 3000 bp, Unknown
  misc_feature (1)..( 3000): cDNA_ID_1020005_gDNA_ID_2214500_Annot_ID_133641 3000 nt of promoter + ATG
ttttatgctgaatgtagatagctagaaacctaattgtttaaagatggagaaaaaaaaactatagtgtcctccataaaaaacaggtcatctccgaagagttattttcaaaatcgacattaatgatcagttacatattttttaatcattatttgaaacaattattttataattttagctaagtatgtgattaaaacaaatgaaaaaaaaaaactctaaaatggagggatgaacatatttggggaagtgatagacaatgatatttcatatttaaccattcgttattgaatttaggagttgataattgaatgcctatgaaaaatatgttcctattgttagaggtgggttggagtcttgaagacagaagacgctctaatatacaactgaagtttgagttgcttgtaaattcaagttttgtataatttattttcattaactgcaaactaaaatttatataatattgcgtgaaacagaagcaaaagcaagcaactcgttgggtaaaatctgcagtttctgcaccaaattaaagaagacctgcaacattgccgcctttacataaatacacacactagatacataggctctatgtatcttatagtatacgatatttgtttagaatattctgcaagttgattaaatttcatggatcagtagacttgtttatattctaaagtttcaagaaatagtcaatttgtctacgtataattaaaccgtttcttagctggaagtttacgataacgtatccaacatttaagtattgtcgagccatataattagagaaaatgactagtgagaacactgagaggtttagcagctgagcaagcaagttacttacaaaacttggaaacaaaggttgtcacactaatattcacactacgtgagaattcgtacagtgcacatcaatataatatttttaaaacagcaaagtgaaaaatgaacatgatactatatatatccaatttattaacaaaattttataacttatagtatcaaaaatagtaagactcatattagaccaatatatattaatgcctacctacctttgaccttaggagaaagtatgaataattaacatgtatccaggaatggcattgtagaaaatactattttacattactatttcatctaaggattgagatttcatatgaattcaatgatttatatttactgccaatatttttttatcttactaatttaaacgaaagagatattttaacttgaaataattagaaaataggttatagatcattcaaacataaaattattaaactgttcaactatttctaaatgatttatgttagccgtcagataattaacatggaaaattctagtttcatcatgataatactccaactatatgtgttaatatgcgtataagagagagtatggcgtagtatccaatcatttcttagtatcatgtagtatttggtatatgccgtatagtagtacccaattatttctttgatgggcaaatgctaatgactaatgagtattttgcaaactcatgatcactgaaaacatgagccttcggtcgacgatcaggtgtcttaaatttgtctgctctttaatttttgtaggataaaaaattgaaaaatttgaactttagaccatagaatagattattccagctagtaatctagaataagaatgatgtgaaaaacttgtatttagtggttgatcatataaccaaaccaaaggatgattacgttttccttaaactctaaaaacatgcagattattgatctgtccatcctagttttaggtacggtattaaatttagatagctgttgaaaaaaaacaaaagtgaagatatctaaatctagatatgttggagcaaatccagtagtggattctaagcaaagtttctaacctataataataataataaaataataaataatattatttaattaagatagtttataaggaaatgtgagagagtttctaattcaagagattttgaagactcttctaactatttttagaaacttttcaaattaaataatattatttcttattttattattattttagtagattagaaactatggttagaaaccaccattgagtatgctcttaatttatatcctataacaagtcaataaatcgtcaaacattaatacgttgcattatttgtttgtcatcatatcttaaatatttcgaattaaatgatacgttttcgtcacacaactaatgctttttagtagatgaaatatagtaaaatacgattttatgtattttgaacccatgtggcgttatgttttaatttattattggatagtagaagaagccggaaattctggatgtcaaatagtcacattaatattcaatgcgaaaacgtaaaaaaaagtaagatgctaccgttacctaaacaaaagttaatggtgtgattttacagcacctgtttaatatttttaaaattacataaaaaaaccaaagagaagtaagaaaaaatgaaaaagagagattggtatataaaaaggaggagtagggggtgaagcccgaagcatcttatagtatttttagcttcattccttcttttgctctgatcaaagtcttctccttcccttctctctctctttcctcctctgcacatttctgggttcttctcttcttatgctctgtttcttttaagacacagaagaaacagtacagagttgagattttcttaaacaaaagtgaaaagagaagaaacaagtgacagctcaaacggacaaaaaccactcttgggtctttcttgcttctgattctttctcttctctaatagaagaaaacgtaagtcactctctctactctcttttttcacactgaagaagagaaaaaacgtgaacaaagaactgtcaattctctttccctctctgttttatcttcttgaattctccaagattgagatctctctcagtctcttatgtgctctgttttctcctctctgttttcacttagttactaaacacaatcgattctttcgctctgttttatttctcagatctagaagctaaaaaa

SEQ ID NO: 11519 - DNA, 3000 bp, Unknown
  misc_feature (1)..( 3000): cDNA_ID_2717466_gDNA_ID_2214500_Annot_ID_133646 3000 nt of promoter + ATG
tttcatttatgattatgattctttggaagaagatatgattttttatgaggcatgattacgataccttctaagaagatatgatctaaatgataacataagtttcttattccgtacacattagaggacccactcgtcatatggtttgtgaccacgttaggctaaatgccataacaagtaagactgtaagaacacatgcatgtaggagctttgattcccatatagtatagaaatcttatataacaaagacaaaaatatattaatagattgtctaaccaagaagggtcgataacaacatctaaccacatgcaagtgagaagtgcatagacgtatcctcaagaaggcagcttccgggaagtttcctttaaggcttttatcgttgattacatttttttagtttcttggccttttcatcattgtgacccctactcctttcgtttattgttgcccatacgtatataagattgaaccaaatcaagaagtttgtgtaacttccaaaatcactaaagatttgtggggctttaataatgttgttctgtattcggacaagacaaatgagtttctcagctgtgtttgcgtctttatttacccacttggattccctaattctctaaactttggcagtatgcgtacggttgagtacttaagtatggttttagaaatcataatttcaataagtacttatattttgatagatttaacttatattctcaggctcaatcattgtcagtggacaaggactacataactagagagcttatgctatcggttttacaaccaaatttaattctccgggactactggctctataatctaattaagattctctacgccactgagttaggagaaagatttataaaaatgtacaatagatgggggtatatgtggatgcactatgcataaatatttatgaaataattttagaatcttttacttgagctttatttgtttcaatactatatagcctaattctcgtatcttcggcagcatccgcttgagtactgcagtgcagtttacacaccataattcattaaatactaatattttgaatctttgatctatttaaattctcaggctcaatcgttatcaatggacgaggactacataaatagaacacttttttctctttggacaaagcatagatagatcacttatgatctttttttataatgaaaatttagttatccgggactaggggcgctataatctaagattctctaggccattgagttaggagaaagaacttaaggaaaggaacaattgatagggatgcattacgcaatgtataagaaatcatcttaaaaggatttatttacgttgttgcacaatatataattatatatagttaaaatatcatttaattacgcaccaccacacagtatagtttaaattcatcgatccttgatttattcatgacatctttccaaaatctccaatactcttatttaatggtatagactcgatggtggtagcaaagtcattataatgttttggagcgtaattgactttagataaccctatttttatccctatagttagatctaaggtcctaattaaatatcgatgacatccaataaatttggaacgataaagaaagtttactgatttgtttcgacaaagtcaatatttctgatttgagacaaatcagaaacaaagtgaatttgtcaaaattccaagagcgatggcgtgacgaattgcgtgaagaacagccgtagcttcagccgtgagcttctatggccctgatttaaatcataattttatagatgaatatgaaataacatcatgctagaagttaaacataataaacactagcgaacaaaagccaccagccaccttctgccttttatgaagctattacctcctcgttaaccgaaaaagccacatggcaaaaccatcaacatcgcattcgtactaacgacacaatttggacccttaggatattctaaagaatactcttaaagcatgtgttatagacttatagcgacgctaatttgttttcgtatgtgaatttcattttgatacagaagtacagatccgggtgtcttgaattctccggtttactgtgtataaccagttttcaaggcttttttttattttttaatttcatttttaggtttctcattttcggtcattcatgtcataccaacctactggagtggctaatgaatcatggttcgataacaattcatcaccgacgaacttctctgaaggaccatgttgacaaaaaatgtcttgacacccacgcaactagtagacctttttactaaaaccttgggtcaaaaagagttcgactgtttctagtctccacatttccacttgaagagttgtacggagacttgagatatagtatatttttaagttatagattttggttttacttttttttttgtagctatctcaaaacttgtaaagaaggcaaataacatcaataagaagattatttaatcaatgatttttaggatactaatgaatttttgattttatagtatatatttttccttacatagtttttcctttccaaacaccattgaatgtgaaaatcaaattttagtcttcaacatattccttgcttagtaatgaaagataagaccatcacataactcttttgctattagataaatatattactaagcaaaattaactttataatttagtatgatttccaaagagttatttcccaaaaatcaagatttgagagccatgtgttacaactttcaactgcaagatctatattaaccatttctgattttggtttccaaatattaaaaccataaatcccaaaaaattaaataattaaaatctcaaagggaaacttgggaaacttcgtggaagttgccttggtggacccaataaacaaaactaatcagtagtatttaaacaaatcatgacgccatttctttacaaaacaaacataaagaatcagcaaagcaaaattcgaagagacacaaaaaaaccttcgtttgtgtctcagaatttacaaagttttgagtcagtagagaaatg

SEQ ID NO: 11520 - DNA, 3000 bp, Unknown; identical to SEQ ID NO: 11518
  misc_feature (1)..( 3000): cDNA_ID_1020005_gDNA_ID_2214500_Annot_ID_183949 3000 nt of promoter + ATG

SEQ ID NO: 11521 - DNA, 3000 bp, Unknown; identical to SEQ ID NO: 11519
  misc_feature (1)..( 3000): cDNA_ID_2717466_gDNA_ID_2214500_Annot_ID_183956 3000 nt of promoter + ATG

SEQ ID NO: 11522 - DNA, 3000 bp, Unknown
  misc_feature (1)..( 3000): cDNA_ID_3040210_gDNA_ID_2214500_Annot_ID_183962 3000 nt of promoter + ATG
ggtcatggaatctaattcagggttagtcaaatggaagttcctgcttaagatgcattgattacattgcttatcatgagttaataaaagttctttacagggagtggtatgattcaattggatataagtaagtctaaaggttattatcttactgtggctaacttgaagaggaaggacgtagaggtaattataatcaagttatgactttggattaagttttggtttctgttgtgtttctgcacagtccacagtacactgttttacttgacataatgtttgttcaggtggaactggatattgatgtgaaggttgtcttgtatgatactaaacaatcatcctacaattgttccttcagcaatggcgagtgctcattcaaaatgaatgaaaggtcccctgttgaaaattatgctgtcgtaacttcaccagcactgggtcaggtatgtactcgtaatacgaaacactaacaatattgttactgttattattattatgactcttagctgaatgaatgtttgtctcactgccttagggagtatccatcgatgatgaatggtatatcgagttgtcatatcaacctagattgattgcatatggaagcttcacaggtaaacttttcaatcttttcaaagtcaacttgattattggatttaagcatttgttagtttctctgtaacaaggaagcaattacatgtagtattattgcgtatgcaggtgtgttgctttccttcatgctggtagctatacacttctgcaacaagttaaagtgttgtggtggagagggatttttatccgaagatgattcagtgagaacatgtctacttgcagacaaaggtgacaatgattgttgtaatgatgtcgaagcaagtaacaaaagtctctgtgccatttgttttgatgctccaagagattgttgtttcctcccgtgtggccattgcgtctcctgttaccaatgcggaacaaagtaagttttttatcaactaagtacaacttctggattgcataattgtaatggtaatgtgtttaccatattgggattgatctaaaatattgaacgttgtgatttgacaatatttgcaggataaaaagaaccaaggggaggtgtccaatatgtcgaaagaaaataatgcatgtgaagcgaatctatacagcttaagatgtattattatctgtccaatgtgatgttgaatcgttagagcattaataaaaatcatataatttgatattgacaaggctcaggtctttctttgcattaattcgtttcatctcttaaccatctttgtgacaacaccattggttaactaccatagggtaggcaatatagtgaaccattgtttgttgactcacatcacaaaatggttcgaaacccgaatcgataattaaggatttcataaattaattgttaatttctgaataaattcggattttgtatatttcctccgtttcgtaatataagtagttttggaccaatttttttgtttcacaacataaattgtttttaactttctatgtaaataatatattattttaatattttttgattatttatattatgtaatctcttttatgattagctaaactttttaaaaataaatatttttaatttgcatatttttatttaaaacaacgtatattgtgaaatgaaaagagtataaattattgattaaataattaaggactgtaatttattttattaaatttaatattcttttccaaattctccacatattttataccataaaaaaagaacaacacccttacacacataacatatccgaatcagtggttcttcgacatcacacgatggtatagggaaatgagcttccacgtcaacaagataataatctcttcgggactatacatttacaacaaaaagaaacaaatcttgtggtcaaagtttccatacgtagcttctcttctctacactcacgtccaccacaatcctcgtgctccttcctctaaacccgtccgattcacgtacttttactatcttttctcaatccaacagctcacagtccacaaacaaatttcaaatcgcgtcctataaaatcccctctcctctgctccacactctctcaaaaccctagaaaaaatggcaggaaccggagttgtggcggtgtacggcgaaggagccatgacggagacgaaacagaaatctcccttctccgtgaaagttggtctcgctcagatgcttcgtggcggtgtaatcatggatgtcgtcaacgcagagcaagctcgaatcgctgaagaagctggcgcatgcgccgtgatggctcttgaacgtgttcccgccgatattcgagctcaaggcggtgttgcacgtttttgttagttgacatggtcatacttaattaggagaaaccattacataatgtttttaggcactgtattttttttttgttaaaataaacattatgtaattaattgtgcaataatacattcaataattgttaagataacacatatgaataaacaatttcacataagtatattgaaattgctaagttcaatcaatatattttgttttagaatactaattaaacactaaaacttaacagttgattaattttaacttactatactgttaaacttaacagtttaattaacgttaaccgaaggataaaattggaatttcacgaaagaatctcttcaaataatataataaaaaaacaaaatcctcacagacacaaacaaaagtctgaaaaataatgttattattttatataataaagttataaaaataccctcaagactctggtcgtcattaccgttcaaacgacggagagaaaagaagaagactagccggagaaccaaaatcgaacgataaccgttacactaataaacttaccctatcatcttatctttcatggattcacttcctcacaaattctcaggtgttttattttatctttacttatcctataaatctctagggtttcttctatccaattcatttcttacctcataattttttttttgttatctctttctctaagaatcaccgaa

SEQ ID NO: 11523 - DNA, 3000 bp, Unknown
  misc_feature (1)..( 3000): cDNA_ID_2706677_gDNA_ID_2214500_Annot_ID_183965 3000 nt of promoter + ATG
catcttctgtttggcgcaacattgttgaatgattttggatgactgaaattcccaaaagaataattataaaatactcaaaaactaatttaaatgattttttttcagttatatctctaacatgtctatgatatataacaaaacgtttaagacaaatgtttaaacatgagaatagaatcacgctttcaaaacgtgacaactaaagaaataccatttatcaatctaactctgttaaattcgattatctattgtttttctttgtacaaatggtattttgatgctatacattagcatatataataggaacgttcttttagatggtattaaattcatttcatcctatatatctatttctttcatcttctagatcgagatatgtcaaaaggaaatactagatccgtgatgttgacaaaagaaattgtccgcctaatatgttgaatattgtgaacgtaaatgatgtgatatagtgtgataaataaataaataaatgaatcaattaccagataaggatttttagtggcattcatagatttgccgaaaaaattatatctaaagttacaatttacacatttaggtttacttggttctatttttttagggtataatatttgttattatgtattttataaaaaaaaaatggaaacataatgaaacaaaattctcaaatacatatttttatttaaaaagtttctcaaaattttagcttttaagtggcagaaaatagttttttttttttttatagataaagtgaaaaatctaaaatggcaaaatcaacaataatccaaaacaacaaaatcaacaaatctaaaaaactcgttgattgttttgaagacaacagctatgtggtgaagaaaaaatgaagaaaaaccaaaatcgacatgtgggctactgtgtaagatgcattcatttacagctaccaaacgcacacgtgacaattttttttttttttttttttttgtttgtatatattatataaatttaaatacaatcgaaaacaaaaattcttcgttaaactcttttcaatgctgtatttgaagcttcctatttttattattaaaaatatgttgtttctaaaaaatatatatatatatatatataaaaattcttttcttgactctacaaaatttttgtttgctaacaattttaccttcactgtttactatacaaaaaatctctgttttagtgaataatatatgcaactaagtttttcgcaataaaaatacaataaaaaaattgtagctagctatagtctggtcacaaaccataggaaatgtagcctctaaaaataaaatcaataacaaatttgtactgatctttttatatcgacataaatttggtgaaagtccaaataacatgtttttcgtaccataatcaaccaagtggtgttccttcaacagatacataaaacgaggcaaaataaaagtgaacgaggcagacaaagaattttccaaacctcatttaagggactaggttgactttagtcctttactttagaagagagttgcagttttcatctattgtaggggttacacaaaatttgttcttatgtgagtccaattgccaaattgtacatcactcgaagacaaattgggcccaaactgtgtagaatgggtttgggctgccaacccataataaaccttaagttgaaaatgaattagtttggcacatgcttttttttgtcatgttcatgcttttaaaaaaattcaaaattggcctaacaagtttcacatctctagaatgttgttcctagctggctagttccacgcacgtgtcacactataatttgtcatttcgtgaatgaagaaatcattccaacacttttgttattttgataaccatacaaggaataacacgtgaaggaatttaggaaacgagagattctagagaagtcacctagttttgtatttaaaaaaggtgctcaaaattagaaaaatatcgaattttgttgaaaaagggaaaaataaacaaagacaaagtagtaaatagaaacttgggcatgaagctaaggatatgactggtcgccgagaattaataaccacacagtattattacaaaaagtatacaaaccgaaacttctcgcggtgatgatgaaacctcaacgcaatgttatcgtcacatcaatttgattcctcattatagtatgaatgaaaaagcagattaaacagaaaatacataaagagctctataactcaataggaaatatttaccactcacctatgtttttcttacactttcactctaatttattttgacaaaagaaaaattgtattatattatttaaagacttgactttctctttaatattttactgttttttatatttaaagcaatataaaaaattatcatcattttaattaaatttattatccctaccattttaccaaaccaactcagtaataaactcatttcatacacatatttgacaaatatgtcgactgtcagaatctagaatactatttgtcaaatgaaagtgattacattatgagataacgatagaaatatccacatctctcctgatcaccagtcaacatatcttttattaacgaattgactggtagtttaagacgctaattatcctttgctctataataccatttcaatcgatattttaactaattatatactattagaaatgaaatgacaaatctgccgaaagcttttttctttttaatattttgtcaaaagaagacacacaaaaaaaaagtaaattgtattagaaaaaatccaagacagagaaaaaagtaaacgcgtagacagatggcgacaggagaaagagagagtggagaagaagaaaagaattgcgatcaaagaaaattagacttctttcttccaacgttttcacattacaaatacacaaaaaccaaaagataaagaaaaacaagaaatattttgtttttcgatctgaaaaagtgaaagcttcttcaaaatctttgctttagagatcgtttggtgattttttttctttattttttttttatagtttcttcttcttgattctttcat

SEQ ID NO: 11524 - DNA, 3000 bp, Unknown
  misc_feature (1)..( 3000): cDNA_ID_2706721_gDNA_ID_2214500_Annot_ID_183957 3000 nt of promoter + ATG
aattagcgtcgctataagtctataacacatgctttaagagtattctttagaatatcctaagggtccaaattgtgtcgttagtacgaatgcgatgttgatggttttgccatgtggctttttcggttaacgaggaggtaatagcttcataaaaggcagaaggtggctggtggcttttgttcgctagtgtttattatgtttaacttctagcatgatgttatttcatattcatctataaaattatgatttaaatcagggccatagaagctcacggctgaagctacggctgttcttcacgcaattcgtcacgccatcgctcttggaattttgacaaattcactttgtttctgatttgtctcaaatcagaaatattgactttgtcgaaacaaatcagtaaactttctttatcgttccaaatttattggatgtcatcgatatttaattaggaccttagatctaactatagggataaaaatagggttatctaaagtcaattacgctccaaaacattataatgactttgctaccaccatcgagtctataccattaaataagagtattggagattttggaaagatgtcatgaataaatcaaggatcgatgaatttaaactatactgtgtggtggtgcgtaattaaatgatattttaactatatataattatatattgtgcaacaacgtaaataaatccttttaagatgatttcttatacattgcgtaatgcatccctatcaattgttcctttccttaagttctttctcctaactcaatggcctagagaatcttagattatagcgcccctagtcccggataactaaattttcattataaaaaaagatcataagtgatctatctatgctttgtccaaagagaaaaaagtgttctatttatgtagtcctcgtccattgataacgattgagcctgagaatttaaatagatcaaagattcaaaatattagtatttaatgaattatggtgtgtaaactgcactgcagtactcaagcggatgctgccgaagatacgagaattaggctatatagtattgaaacaaataaagctcaagtaaaagattctaaaattatttcataaatatttatgcatagtgcatccacatatacccccatctattgtacatttttataaatctttctcctaactcagtggcgtagagaatcttaattagattatagagccagtagtcccggagaattaaatttggttgtaaaaccgatagcataagctctctagttatgtagtccttgtccactgacaatgattgagcctgagaatataagttaaatctatcaaaatataagtacttattgaaattatgatttctaaaaccatacttaagtactcaaccgtacgcatactgccaaagtttagagaattagggaatccaagtgggtaaataaagacgcaaacacagctgagaaactcatttgtcttgtccgaatacagaacaacattattaaagccccacaaatctttagtgattttggaagttacacaaacttcttgatttggttcaatcttatatacgtatgggcaacaataaacgaaaggagtaggggtcacaatgatgaaaaggccaagaaactaaaaaaatgtaatcaacgataaaagccttaaaggaaacttcccggaagctgccttcttgaggatacgtctatgcacttctcacttgcatgtggttagatgttgttatcgacccttcttggttagacaatctattaatatatttttgtctttgttatataagatttctatactatatgggaatcaaagctcctacatgcatgtgttcttacagtcttacttgttatggcatttagcctaacgtggtcacaaaccatatgacgagtgggtcctctaatgtgtacggaataagaaacttatgttatcatttagatcatatcttcttagaaggtatcgtaatcatgcctcataaaaaatcatatcttcttccaaagaatcataatcataaatgaaaatgaccattaaatccacgaatataaccgcttattcatttataattgtttatcactcctgcatcaatctttgaacagatcgatagaagcatccgagatactctcttcactagcaaatatcctaagagtaagagatgtggttgattgcgtcttagtggttgatttgtttagtttctgtctggcttttattttaattcctcttttgccaaagaagtttcttgttaagtaatttgccattagaatttacatataaggggacgacgctgaaaatcaagctgaatgattgtacaaaattcaagatgaaaattgcgttctacttccagcaacctaaagaaaatatgcttaagcttgatgattagtgatgctcatataaaataaaacaaacatataaataatatgtgacctaatcacattatataaaacaaaattatatcacattattaaattccatcatttaaggtagcttgattttgttttatcagaatgaaatatgatttataaacctaatggagcaggtgaaccaccccaatgtgagaaccactcaaacctaaaaaagcatgacaactttaaaggtactaaaactgtattggaagttggaatcaaaattgtttattcactaaacgaattttcccctaggatcttctgatttgactgattcgtttagtatattgtttaatcttcttttttttttggaacaaaagaagaactgttgagtactagagaattaaaaaaaataaaaattgattctttgattatttttatttttttgtttacctgaattgattctttgattattttaagaattctttttaaggaattttggtcctgatgtgttgctttttttcagtagtgcgatctgacgactgtcacaaaggcataaaccctttatgcatggactaatcaattaaattaattaaatagcttctcttatttttcttataatctcgaagttggtcgaagcaaagcaaaagcaaaattctcttggccgagagaagaaacattgatcgtcgatc

SEQ ID NO: 11525 - DNA, 3000 bp, Unknown
  misc_feature (1)..( 3000): cDNA_ID_3040228_gDNA_ID_2214500_Annot_ID_183954 3000 nt of promoter + ATG
ttttactgtcaaaaactgcataactgttgcttccgccaaaaccgaaaaataacattttccgtttaaactgcgaaattctgttttatgtgattgtaacttttattgaaaagtttgtgaaactacataggctagtgaaaaataaatatccctggaaactaagagaaaatgttgaaaaatgttgaaattctcgaagaagataacaactctcactaaaaacatttggtcttcacgttcattgttttttcacaaaaaaaaaaattctcacaaaatccacgttttcttgcaaaaaccgtcaattaattgggtataaataggtttaaaattaattggggtgggttccaatttaataagattactacatactacatgctactactagattgacaatgataattattccctaacaccaaattgtgataattttatctttcagaacaaaatgccattcacttgggacatcaagcgatgaacaatgtcgtcactgcaacaggaggaggagttttctcatcttaaacgaagacaagtaccaatgtgttgaaacaaaatttccaaagcgagagacaatggagaaaggaaaacaaaaaccaattttcttgattcatttataaatattgaaagatttgtcagagagattcctgagattcagtgagtattatttcatttttcaaaaatgttgggtgtcttgatgaagatgagttttgagaactttataaattcttcttgtgggtgggttttgcaatgaactatctatgaatgtcttgtgtcaaatgttctatctctttttattaatggttttatcattttttctgagtagtcaatactataaaactataaataaatggaatttttgattttcctttataatcgaggtagaacattgtttctaccaatagaaatccaaattcaaataatcatatatctcatcaagtcaaaatcagaccttcggtgggattgagaatgtcagaaaaaaaaaagggtcagacctttattggtgagcttttgtgggttaaaagcccaatgaataagctattgggccatttagatttatatctgcaaaacaaataaatgaagtgaagagtttgaattcacacgaaaaacgaggctgcttcattggtcagtccaattcaaatatcaaccgtcaaatcagtcaatcgccgttgtatatccaacggttcagatcttagattcattcactaggccctactttatttacatctataccctctcctaacgctccacctccagaaaaaattttaaagaacacctgagaaatcagaacagtggcagtttcgtgaatatacgactgaatcaatctctgtaaaatttcttcttcctcctttttagccattatcactcttcttcttcttcgttttgtttctccattgttaaccttgtgtttcgctgttttttgcttggtgctatgatcttcaacaaatgatcagctagaagtgatattacaacgaagaggttttgagaaatggagaatgtggtggtggttcgtgatggagatgaagaactctctctatttctggagatgcgaagacgcgagaagcttcaaggcgtttcttctctttcacaacctggtgagttttatccgatcttcgtttctctaaattttgacttcgatttctctgaatctgagctcctggaacctaaatctaagaatatgactaagtaattatgcttaatctctgcttatttgaactagtttcgtgcatttggattcactttagagtaatttagagttgactggtcagctcttgttgctgatttcttgtcaacattttaatttcacggcgttttgttgtgtgtgtgtgtgctcgtggtgactgtagctatgattgatttgatcaagttgatgaatttttgacaggagcaaacagtgttgagaagactagcacaaagagtttggagcttttgaaaacgagctgtgttaagttgcgtaggagttctgttgaaaagttcttggactctgagaacgacaagtcagattatgagtggtaacttctttggttgttgtttttttcttgtggattttgagatgtttgtgtgttatctgtcacagtagagtttccaatgtgatgcttctaataggcttatatgtctgcatgactggtcacatctggttgccattggatagaatcttcgaatagagtactctctttattgttgagatatattcatctagagatgatttgattccaggttacttgcggctcctgagatcacactactaggaggaaaagagaactcaatggttaaactcaaggagcctaaagctaagtccactgctttaaaacaacgggtgagaactagtccccttcttagccatcttttgtctttactaaagactctttagggaacatataagattgatatgtgtcatgttatttaaggtttttgccagtctatcctagacttcctagtcttaagtactatgttcacatcattgtggtattgtggtccatttttacaactactagtagctagtttcagcattcctcaggtttagatttatgcgtacctttaatgattgcttggtgctggttcatgttatgcttttgttttaaggttgaaaacatcccgcaggaaccattgacacggagcgttaaggtttccaagccaaccccaagaactgtttctagcaagcaagccaacacagctgcagaagtaaaaccaagcattaaaccgtcaagacaagccacaccaacttcacgtgctacattaccctccacaagactaaccaactctgctcagaaatcaaattcagaaagtataaccacttcaatcaaatccaatacacgagcatctgcttttcctcgttcatcctcggttggaaaatcagtttctagtgctaaatgtacaactccaaaaatccctgaaacacgtgctagacctgtctcaacctcaagaagcagagtctacagttcaggtgacagatcaacgggacgatcgaagattagtaatgatgtgaatcctgtgttgatggggactcaaatg

SEQ ID NO: 11526 - DNA, 2269 bp, Unknown
  misc_feature (1)..( 2269): cDNA_ID_3040253_gDNA_ID_2214500_Annot_ID_183944 3000 nt of promoter + ATG
gaattcttgtttttaactataaggataaattcacaattatatctaaaaatgtgtgtgcgtgagttgtagacaattaaaactattgatcattaaaatttactataaagtcgttggagaaaaagtttactataattgttggaaaaaaaaaatttactataaggtctcattcgtattctgaccatagttttcattggactgttaaatttgttatattctttgtatgactaaaagaacatctacatgcatgccaaataaagcgaccacattaaaaagtttgatccagttttggttcgaatttaatttggaaatttgagttttgtgtttattttgtaatgtagaagaataaacttgaaagtgttaatacgttcaattatatttggtttcgattgaaattcaatctaatgtggttagatgagtcctatattaccatgtcattgttaatacccattgccaaaaataaaagtgaagcagaaggagaaattgtttttgtatacccgaaggaattaagatgtacgatcttaaaatagacatttcggccatctatcaaaataaatgtctaaaagttttgtggtcgtcttaaatactacttcgagttcagacgtatacgtctcaccaaagtaatgcacatacttgatgttaagtttatctctttttactatttcaaatttcgcgtttgacaacactttaagtctacattatccatagagaatataacataaagatcatgaacttctcatgaatgtataagacaaatcaagcttatatatgagatctatttagtaatttgatatgtatgtaatatatgataaatctttgatgcaatattttattatgattattagatatacactagtcaactttaactttagaagattaatcattccgtcgcaaaccataccataaattagcaagggatcgacttaatatctccgatccgctatatatttaagaagcatttagattgtttataatacatgtcatgattttataattatgtatatataaatactaattgatgtatgaagtacgtagataatgttacgatctattaatctatttacattaacttttaattagtgttgagtagggaaaattaacatataaacctttagcagttggttgtattattaaaaataatttgaacttaaaatccaccttcgaaaagataaatcaaacaagtataaaaaatgctataaatccagaatatttacctaaggtttttattcttctacttaataatgtaagataaaaccggcacaatacttgttacgtatgcatggtaggtaccgcaattgtgtaagcaaatcggcacaatactaaggttacatatactaactaaataaaacaatctgatttcagtgacaccgtatatctaacctttattcaaatccaagggaacatgacttgacttcttctgttggaactaactcgatccctcaaccatctccagggatagaagagttagtaaaatcaaacttgaagtgaggaagtaagcagtttaacgactccatatgactacagttatatacaaagttgggcacaaagtacaagtactaaatactcaaagtcagataataattttaataagtacaaactatatatatgcagtacaattattgagtatatataaacgagactggtgatttggggcattgtccaccagggtgttatatcccaattgaaatttgaaaatttaagtgtgtgagtgttacgacaaaaaaaagtgtgtgaattgtaggcgcggtgaaaaggtaaattaagattggaactagaaaaatagttgaatatcctttactaaaagttgtcaattccggttttagtaaaaaaaaattttaaaatagaaattttatccaaaagacttcaaacacacatattcgcatatataacataagatatcattttttgtaaacagttaaaaagaaaaacacatgtttttttttttaatttagaaaaaaacatgttattatacaaaacagagttttgcccacttttaatatgttatgaaaagaaaaatgattttcttgggtttggtcagagagattggttgtggtaagaatgggaatcttaattacaaagaattggattttgggtcgacctaccacctaaaacgacgtcgcctccatctctggtttccaaatctctttctcctctccctttataagcttgcgttggccagtcgctcatctcgaaaacagagagaaaaagactaaaaacacagtttaagaagaaggagagatagagagagaagagaaagatagagagggagatg

SEQ ID NO: 11527 - DNA, 3000 bp, Unknown; identical to SEQ ID NO: 11524
  misc_feature (1)..( 3000): cDNA_ID_2706721_gDNA_ID_2214500_Annot_ID_133647 3000 nt of promoter + ATG

SEQ ID NO: 11528 - DNA, 3000 bp, Unknown; identical to SEQ ID NO: 11523
  misc_feature (1)..( 3000): cDNA_ID_2706677_gDNA_ID_2214500_Annot_ID_133654 3000 nt of promoter + ATG

SEQ ID NO: 11529 - DNA, 1151 bp, Unknown
  misc_feature (1)..( 1151): cDNA_ID_2706705_gDNA_ID_2214500_Annot_ID_133656 3000 nt of promoter + ATG
atgcatttcaaggcactgaatctagtccttgagcgtggtaaggagcgtaaagagaaccctgatggagacgagcctcaaaatccgaccttggtgaggcggcggagccaagttagaaggaaggttaatgaccaatatggtcgcagtcctgcttctcttccagatgccactccttttaccgatggtggcggcggcggcggcggtgatacaggacggagcaacggtcacgtttatgtcgatgaaattcctcctggtctccctaggcttcatacgccatctgaaggtatgagaaccaaacctgaattgatcagattagattgtggattataaaaattgatcctttaatcctttgatgatgctgatagatagtttgtgattgctttttttcagggagagcttctgtacatggagctagtagtatcaggaaaactggaagctttgttagaccaatatctccgaaatcccctgttgctagtgctagtgcttttgagagtgtggaagaatcagatgatgatgataatttgactaatagtgagggtttagatgcttcctacttgcaagctaatggtgacaatgagatggtgagtttctttatttatcattactttttcaatccctgttctgtgattgaataggtgggtttacaagtaagatgttttttgcagcctgcagatgctaatgaagaacaaatatctatggctgcttcaagtatgattcgatcccatagtgtgtctggtgacttacatggagttcagcctgatcctattgctgctgacattcttcgtaaggagccagagcaagagacctttgtccgtcttaatgttcctcttggtaagaatggtcactttttgtttcgttctgtcatcttgccttacttctggttcctgtatgcttagtactcttttcctattgttacaaatcatgacatgtttgttttataagtcccactacttgaaaagttttttgctagtggcaagtaattaagtggagttacggacaattaaataagtagtcttgagtaagagaagcaagggtcagttaaggctttactcagtgtgggagctgagccattgaaattcttagattatagtttaagaattatagcttgaaacggttaagacgtcaacacatatcttattcatattttactcatg

SEQ ID NO: 11530 - DNA, 3000 bp, Unknown
  misc_feature (1)..( 3000): cDNA_ID_2706769_gDNA_ID_2214501_Annot_ID_133658 3000 nt of promoter + ATG
aaactcttaaaatcactacataatctaagacttcctaagacacaaatactcctatggacattaaaacaagattttatcaacagtgaagccatattatcatcactgtagttctgaaaatgccatattgcccaaagtcttttctagctagtatgccatagtggctaacatcttcttctttcttttcatctctctaaataagcaaaaaattgagaggctttctcttcctcttctattcctctccaacatagtattcattctctcctcatctcatctcttgtttcttttcagccggagcttgtgccgatggttctacgtcgatctcactctctcaacgacgaagaaaacatcccccaaagcctccttctatgtccaaatgtaaagcttctccgcagcacacaaccttccaccgctgtaccaccaccgttcctacttttctgacatggaactgaagctttatcaagttttatgttaagtaatgttaatcggaagtcctttaggcaagatgtctagctaaatgttatagaaattctagggtgacaatttttgttttcaggcagacaatggtaactagtaactggacaaattaatttgaagtatacaaattattatggacaatatttttctaatatttgtagacaatttttattacatataagatcaattactcaaattttgttttaaaatatattttttcgaacgaaatatgattttaggatgaaacaagaggccatatagtacgacgaacatgacccatccacaagcttaatttgttcttgttttccaactcactcttttctaatttgaagattaatgcttactgacctttaagattaagatgttgtagttttgtttttcaagttttcaccgtttaaaatacacaaataccaaaagtctttagttacactttgttatgtaacaaaaaacattgctggcatagtggcatattgacaaaccttccaaaatttgatttatctgtttgaaatatcacagttaaaaaaacaaacccaaaaaaaagagatgtttatgacaaatgaactccatgaatatgtattattccctggcatatgtaacaacataactttattaaccaactcttgtctcattataaatttctgaaacaatgtatacaataattactcactaattcttgtagcaaattaaacccaaaaatagttaagaagaaaattaacaaaaaaaaatatggttgcatacgagaagagtcctattgtttttctatttgctacaatgatgcttgtaatgtttttgttttgtggaagtggagaagcaagaacattagggtacggatctattaaaggagaccgaattccggcatgtggctataaaaaccccaattcatgtgtcaaacaaccagttaaccattaccatagaggttgtgaaaaaattaccaggtgtgctcgtgatgctgctcgttatactgaatccttcaatgtcgatgacgatgaaagtcccattattaatctccattgaaatttaatctttaatttactttcgttgatactacaaagattcatgtatttatacgtcgtgtagcttgaatatattcatatacctaattatcagtctattaaaatgtgaaagattatattttattaatttgtgtttttatgtaaagtcactaattgttgtcttaaatttttatgtattctatgcttttcctgagattatttatttatttgtttataatttttttttaattaaaaaataaattatgtgtgactactctttctctagatatgccttaagcaataaaagggggaaaaacattttttgatgacaaattagtttgtcatatgaatgaaattgtggtttagatgaatttcatccaagaattcttaatagaaccgaaaatctctttaagttttaacataatcaacaaagataaattctatgaacattcctaatatttcctttaagattactcaatgaattcttgtccgagcgcttgcatttgtctaatcatcaacatagacgaatcatacatttgcttgcggctaacgtcaccttcctttcctccttcctcttcgaagagcctaccatccaatatactcagcacatagacaaaaatctatatgagttacaaaaattcatccattgagttgttacaatttaatttgattgaaaattgttcattagacattaggtgaggaatgcaatgttgtgtgagttaaatttaagttactactgctactattgattcaagtccgtcatacaaaattctagagaaaattaatatatatatcctctcgttttcccatatcttaaaattgttaaattgaaatccagagggtaagtgagagaagcaatcgacctcagcaagaggtgtagtattcataaaagttttacgttgtatatttaatgacactacaaagtcattggaaaatatatttttgtaaggtatattcttatagattcttttaaatgtacttttcgtttctagagttctctgaagactttagttccacttcagcgtttcaacagttcaaagtttccacctcatgcatgtgttatgtgtacatatttcttctatacatccttttttttcagtgaactatatgttataaaacagtaactcttatagttaagtgtaaactggttggtttaagaataaactaaatattttttattaaattgtagtaaattgattagtttaagatagaaaccaaaaccaagcttaataaagttagattgattcctaacgttagaaaaaaaaagttagattgattcctcacgtttcaaaaggggatcgttggttcttggcctcacacatacttttccttgactctttcaaaaaagacaacctttgacaaatcgcttataaactgcatttaattttacatagataactgcactcactgtcacatgcatgttcacaatatcttgactatataataattacatttataaaatactagcctatgtgatcaaaaattgttgtatcaagattttctctcaggtgactgaacaacagagaaaaacatg

SEQ ID NO: 11531 - DNA, 3000 bp, Unknown
  misc_feature (1)..( 3000): cDNA_ID_2706737_gDNA_ID_2214501_Annot_ID_133660 3000 nt of promoter + ATG
catcccgcccaatcgtttcaatttaattataggataaaaaaaagactatcatttactatatatgaaatcatatacacccataataaataatgacgtaccttgtaacgggtatagaagtcgactccctcatctccatcgccattttgttgaaccttctctgaaagatgccacaatattggtgatacattttcttttaagaaaagcttttggtaaaataaaatacaattcataatcacttggtaatttataccaggaaacatgtgtgtaaattcgtcccatgaggtcaagcctctcccagaaccctttttagcaccttcaacctaaaagtcaaaccaatttgaaaatgataagactgatcttctatatatcatcaatgttataatgtgtttatatgtatgttgacctgatatgcggaaacagatgttccaaatatgaaatctgcggggaaatcttgcttgtggatctcaaactcgggtccaatgatggtgcccaaatcatcatcatttaggttggtctgcggtccaacggtggtgcccatgtccatgtcaatgtcttcgtcatctacggtcgcatgtggtccaatcacgatgcctatctcgtcatcgaagctagtttgatgaggtccaatgatggtaccaagatcctcatcacttggttgaggcctagcatcggcgttgaagctaagtatggtactagttaaggctaagagccctaggaaaagagtgagagtagctgtagccatatgagtgttttttcttgtgaattttattagttttttttttttttatgcttcttccatttccaatccattctatttataggaaagaagcttcaagtgtgtgttatgtgaaagggaatttgtgatttccttgtgttgcactcatattttgcggggcatctttagtttagttataggattagttaaaaaaagtttataatattatgaacatttacttcctttatatttctgaattcgtcaagcgtcattgtccataacaaagcacgaagtgcattttaatgactttaataaaaaaaaaagtattctaataccttgctcaaaactttaaatattataatattccaatcgtctttactagcatatatccatcattttcatatatttcctttactcacctcattttctacttattaacacaacaataagagacaaagcggcattcctggtgaatatccacgatactacattcatttaaaacaatttcgtcaaagtttacatcaacttcacattaatcccaaaatagtccaaagacccaacaaaaaataaaaactgagttctaagaagacatgggcttgttaatatcattttcatgggaatagatagcgccagtttagtttttttagaagctgttttcatataaaattcagagaagaattgttgaacatagtcaatcttaatgctgaatgcaaatccttgatgcacaacatttctcttaagataggttctttaaggaatgacattctgaaatccaatccaataacattacccctatgtccgcttgtgtccagcatccgtacgtcggtttctacagcagtggttggctggcttatgtctagggtttcaccgttcgtctcctgtatcttgtctagggtttattttgttttggttttggtgaagtggtgttgtagatctgtgaaagtttcgacaccggtccctttggtgatgatcaataatgtgctcaagccatcgataatctaaagttacaataagttcaagctttttttttggaagaaaaaccttgtgttatagctttgagtaaaccggtaaatgtccctcaagtctccttccgagaaccgaattctctaatcatttttcagtgctttttattaagttcaagaacccacatgtcgcgatttgattgtagccaattctgataagaacatgcattctagaattagagcaaatcaacaagtgtaaaattgtaaaatcatctctatatttgcaacagaaattacctaaatgtatctcataacgtttaaaatacaaactttatgataaaatgtacaaatgcgtcaacaaatgtgaaataatcaaataaaaataggtattgggagggtcacggtccacgttcaggttcacgtcttaattttacggcttattatacaaaaccataaccaaaatgttcttatctcactttcctttctattcccggatttgccgctttcttcttcttcatcatctctctctcaaaatcaccccttttaaagttgtttcctttatacgcaaaagtgaacgcagatcttaatgcagctactgtgatttcgattcttagggtaaatatattcttttactcattggattggcactcctcagcatctgggtttttgcaaaggtataatttttattgtctctttcgattggatttgattgatctgccgattctctgtttctcccgagctttgtgggttaagatctcgattatctatctgggaatctttagattttgtgttcatcggagctgttaatcgttggactcgctagtgttcttctcttgtaaaaactttgtggaggagaatctgattgtaggtatagtgtgaagtgagtttgagctgaattctgtagctttacatggaagtttttggttgatgataacgtcttgtactttgataccatatctgaccatagtcgccagattcttaatcggatctagttcgagttataagactcttcaatagtctctccttaggttcttatgtttttattgtgtgttgatctggtttctctgatcaaggattcagcttttagctccctttattggtcatataagaatagatctgtttgattggtttcttaactgagcaattgtgtagcagattaggtgcttatcattatctttgtttttgttctgtgtatttgaatatctcattaggatcttggcatctcctattgatcatgatatcttgttctccgaagtttgtttggttttgtaacagattttatgtttatgcagcattcttattacttccactgattcaaacatg

SEQ ID NO: 11532 - DNA, 3000 bp, Unknown
  misc_feature (1)..( 3000): cDNA_ID_2717493_gDNA_ID_2214501_Annot_ID_133661 3000 nt of promoter + ATG
ataggtgcatatccagtcaaacctcaggagctctatatgttggtgttgtgtattttctaatattatcttcttcaattcccatctcttctgctctttcaaaaatcttgtgatttgtcgaaacgcttccaaaatcacacaatttccattgtccatctgagctcaatagaagattctcagccttcaagtctctgtcacgattagcaacaccaatacagtatcaattcacatcgcttgctaatgtaaaaacgaaacgaaatctaataatacaacatgtatacctgtgagcaatgcgtggggattgacaatgcattgcaaagacagcattacacacatctctaaaaatcgtaagagcttgtttctcttcaaagtaaccagcacctctattctcaagcacatccacaagagatttaccacaaaaatccatagccaaaagagcttcttttttattcctccccatatccaagataccatgtgcgtagagcgtgacaacatttggatgtcccttgagggatttcagaaccgagatctctttcattacgagttcaagtgactcctcgtcattgcatatcatgtgcttcaaagcatattgctttgacgcgtgatttacatcttgagctaagtaaacactggagaaacctccttccgcaatgacatttctaacttgaactttcagatttcctatctcgagaaatcgaccttcgagacccgcaggttctttttgagcaaaaggtttaaacttccacatgtttgaatcagtggaagtaataagaatgctgcataaacataaaatctgttacaaaaccaaacaaacttcggagaacaagatatcatgatcaataggagatgccaagatcctaatgagatattcaaatacacagaacaaaaacaaagataatgataagcacctaatctgctacacaattgctcagttaagaaaccaatcaaacagatctattcttatatgaccaataaagggagctaaaagctgaatccttgatcagagaaaccagatcaacacacaataaaaacataagaacctaaggagagactattgaagagtcttataactcgaactagatccgattaagaatctggcgactatggtcagatatggtatcaaagtacaagacgttatcatcaaccaaaaacttccatgtaaagctacagaattcagctcaaactcacttcacactatacctacaatcagattctcctccacaaagtttttacaagagaagaacactagcgagtccaacgattaacagctccgatgaacacaaaatctaaagattcccagatagataatcgagatcttaacccacaaagctcgggagaaacagagaatcggcagatcaatcaaatccaatcgaaagagacaataaaaattatacctttgcaaaaacccagatgctgaggagtgccaatccaatgagtaaaagaatatatttaccctaagaatcgaaatcacagtagctgcattaagatctgcgttcacttttgcgtataaaggaaacaactttaaaaggggtgattttgagagagagatgatgaagaagaagaaagcggcaaatccgggaatagaaaggaaagtgagataagaacattttggttatggttttgtataataagccgtaaaattaagacgtgaacctgaacgtggaccgtgaccctcccaatacctatttttatttgattatttcacatttgttgacgcatttgtacattttatcataaagtttgtattttaaacgttatgagatacatttaggtaatttctgttgcaaatatagagatgattttacaattttacacttgttgatttgctctaattctagaatgcatgttcttatcagaattggctacaatcaaatcgcgacatgtgggttcttgaacttaataaaaagcactgaaaaatgattagagaattcggttctcggaaggagacttgagggacatttaccggtttactcaaagctataacacaaggtttttcttccaaaaaaaaagcttgaacttattgtaactttagattatcgatggcttgagcacattattgatcatcaccaaagggaccggtgtcgaaactttcacagatctacaacaccacttcaccaaaaccaaaacaaaataaaccctagacaagatacaggagacgaacggtgaaaccctagacataagccagccaaccactgctgtagaaaccgacgtacggatgctggacacaagcggacataggggtaatgttattggattggatttcagaatgtcattccttaaagaacctatcttaagagaaatgttgtgcatcaaggatttgcattcagcattaagattgactatgttcaacaattcttctctgaattttatatgaaaacagcttctaaaaaaactaaactggcgctatctattcccatgaaaatgatattaacaagcccatgtcttcttagaactcagtttttattttttgttgggtctttggactattttgggattaatgtgaagttgatgtaaactttgacgaaattgttttaaatgaatgtagtatcgtggatattcaccaggaatgccgctttgtctcttattgttgtgttaataagtagaaaatgaggtgagtaaaggaaatatatgaaaatgatggatatatgctagtaaagacgattggaatattataatatttaaagttttgagcaaggtattagaatacttttttttttattaaagtcattaaaatgcacttcgtgctttgttatggacaatgacgcttgacgaattcagaaatataaaggaagtaaatgttcataatattataaactttttttaactaatcctataactaaactaaagatgccccgcaaaatatgagtgcaacacaaggaaatcacaaattccctttcacataacacacacttgaagcttctttcctataaatagaatggattggaaatggaagaagcataaaaaaaaaaaaaactaataaaattcacaagaaaaaacactcat

SEQ ID NO: 11533 - DNA, 3000 bp, Unknown
  misc_feature (1)..( 3000): cDNA_ID_2717489_gDNA_ID_2214501_Annot_ID_133662 3000 nt of promoter + ATG
ggtaaaaatatgtttatcttatacattgcgcacatgtttcccatatatatgaaccaggaaactagtaatgtacccaagaggaaccggagatgggaaaggaaactcgttgtctttgtatttgaatgcgtctaattacgtcaccaataatggtccaaaggggagaacattcgcggtctataaattgagagtgttggaccaactccatcgcaatcatttcgaaattggtatgtatgtatacgtaattatccttttgttttctaagctttacattttctatatgcatatatcatctatataataagccgtttgctactactaatgatcacatgtttgataaagactgccaagattggtttctttatgatccggttcatccaagattatgctcatggggacgtaccaagttcttgccgctggaggaactccacaaagcttctaggggatttctggtgaatgatcagatatatatcggtgttgaattcttaattgtatccactactgagtatctctgatgcgcattcacgggtttgatcaagaccacaccaataaatagctcccgttgaacctatctacctattgttctatacttgaatattgtcatgtacgttgctaaattatcttattgagggatgcatgcttcatgcttgtgtttgtgtttaagtgctatttcttgtttgtaatatatacataaacaattaaaaacctcaccacgttgaaaaaatcaatttccataacaatatttatacatatttcttaacatttatggatactatggccaaattataggtggctttgaaatttaaatgcctatctctctacaaaatattactagaaactttagaccatccttattggtcatattcttattcgtgtcttaaaaaaaacaaagacaccatcattttgggatctaaaactgtcttcctagtaacactaatctcactaattcacacatttaaagacacccccatttcctttctttttttaatatttagagacaccctcatgggatgaccaatgagggcggtagttgaaaatttatcattaattcgtaaaattatgattgttttaatgcataaaggttcaatttatcttttaaagccatagaattctatatagttcagaagtaaatcagtgttaagtttttttatatttcgactcttagaaaaatataacttataaatgagattcttgtttataactgctaaacttcaaaagtaatgatataaaacatatgtttgcatcattttataaaaattctttcttatactttttcattaattatatacatatatgagtcacacatttctaaggtcgactgtctttggcatgtagtcctaaagttcacattagtagtttcattttaattataggttttgtaatttcggtttagatttccaaaccttttaatgaaaactctttctgttctattttactataagatttttaggtaaaagcacggtctttaaaaactggtaaaatatttgatcatttctacaattccacctaacattttggttcaaatttcttagagatagacaaaacaaattatcattaaaatgaaaaaaaaaaacaaatatgaagaattttacataaaagagtcttagttctaaatataaagtaaaaaatatagagagatttttaagttaaacagaagttaaatataaaaaaatggatgtaagaaaaaaacagaagacaagttattgatagagaagaaatatatctaggcacattgcgttgcattactaggaaagaggatattgcgttgctcgtctctagacacatatctcgccttcacaattgcactcactgttgttagattctcgataacgtgggaataaatgtaggtgcttaattggtcatacatatgtcaaaacaaatgtgcttggtggaaacaaaataaaaattagtgtgtttgaggggaccggaggatatggttcgtattagatatgatcgaatctgtctaattctatgcgggaattcagttatgctctctagggtgagattttctagactggccagaaaattaatgtggtagcaactaattattttgcaaagttggacatgatcaatgcaacgtggttggagatgtatcataattgtatcaacacttgtacgtagcatatgtacaaatgatactcccaaagtaacgtcccaggcactatagctcctctgaataggctcatatttatccgtcgattcattagcccaagaaaaaaatattgtttttgtcaggtttaatacacaaaaattcagcattagttttcaattggggtgtgtatgaagagatctaagatctttaaagtcatgaatataatcatgaactaatttaacttggtgaagttttcaagccgaaaatagtatggatcaaacacctaaaactttttcataaataaaaaagagtatttaatacaaagtaattatatatattcttcacattaaaatcaaaaaataaataattatatatgtatgttgaatgtaaaagaaataaaatgtcatgtcgtcgaatgatgtcgtgtaaatatatatacctactgcatatatacttaacggttaattatcaattggaccatatatacatattcttgtcgagtccaaacaggtctagggatatttcaaccttacatcttagcctaaacccgatcctaaacagcttggagatcgatatcaatcgaaccaaagatttaaaccatgaacaacagttttcgaaataaaattcatgaacagtcgaaagaaaatttatctgatgaccggcacaagaaatctgataggaccctaatcgtgtttaaccggaaaaccccgctctatttttatttttttgagcaagtaagatatataaccggttctatttatatcctaattgaaaccccttcgtcaaggaatctgcctatatatagtaacatatgcataccaatttcttctcaccccaatacaaactatagaccaaagaaaagaaaaaaaaaccctcctacggtatatttgacgaccattatcctcataatg

SEQ ID NO: 11534 - DNA, 3000 bp, Unknown
  misc_feature (1)..( 3000): cDNA_ID_2717485_gDNA_ID_2214501_Annot_ID_133663 3000 nt of promoter + ATG
tacttagccttaagaccagctcaaaagaaatcactctactccattaatagtaaattccatttcttatataagcacaattgtaagagaaaagcataacaaaagaacatagtaaataaaaagaacaaaagcttttaaagtaagttggattaatctatattatcatttgtttttcagacaagagaaagagagatagagagaaagtgtctgatccatggctgcatctagagaatttattatatgttgcttcttaacacttctcctatgcaatttcttcatgagagtcgagtctggtgctgctgctgacgtcagtagaggaggatgcggcggcggcgatggcagcctcggggacgataatgagcggtgtgtggaggcggtgaaagaagacgacgacgatgatgtggatgatgtttacaaagtgatcaacaagatgaggatatatgcttgatcatgcatgcatgatgcattctttatatatagggctatttatttattacttttttttcgtttccattttcttttctcaagttttttccgattcttctgtttttctcttaatctatttgctttttcttttttccccttaatgagagagattatgatccgaagaagaacctgttgccttaaatatatggtttactaactttcttggatccgacaagaatgtacttatcctagcgttacacattttacctctattataagtacattatttatttaaaaaaaacaacaaaatatattaattattttcttatataacaatacacatgaattttctacataaatatccaaaaatataacaaatgactggtaatatacaattatcttttgctaagttagacaatactagcttaccatacacgtaccagtctcagcttgctgctacttaaaaaaacattattctcatagaattagttacaaaaattttgtattttatagttttactaatttagttgaaaaattaagttttatttatgtaattttatcttttcttcttttttcaagaaaaattatatctcatagtatcaacccccacgacatctttggctagcttcgcaacctggtttatacggattagccggttgcatcttgcaaccagctgaagatccaggagcacaacctttgggtaaatcttctcgcatagctggagcgcctatactgtttgcctccgttgtgctcatgacgatagatataataattataagagcaaatgattgtacaactgttttcttggatatacccatttttccttattgataaacttttttactttttacttcttattcccaataaacatttgcgctattatatagtgaagatttgttgctaaataaagaattttctgattggtttagtcatttgtaaccgttgaatgttttgtcgggtttgcgcattgtttggtgaaccatacttattattattatttttgtaaaaataaagatatctctaatcaaagccgtttctaatattttagaggccaaaacaactaaagaaaatattaaaatatggtcgttttttgatattcaaataaaaattcgttataagttttacttcaaattaaaacaaaaattaacatagtactgttaaataagtacattataccatatcttggttcaaaatttgtagagatattgtaaacaaaacaaataatgaagaaaaaaaaaacaaaaaagccatgaagaatgtttcataaaagtaaaatttctaaatataaagtaaacaaaagagagagagaaatgttttaagttaaatagatgttaaataaaaaatggatgtaagaaaaaaaagttattgataaaagaagaaatatatctaggcacattgcattgtgttgctcgtctctggctaggcgtacatatctcgcctttataattgtcaccccactgttgttagattctagataacgtgggaatacatgtaggtgcttaattggtcgtacatgtcaaaacgaatgtgcttggtagaaacaaaataaaagctagtgtgtttgacgggaccggaggattcgtactagatatgatcgaatatttctatttctatgtggaatttagttatcttctctagcttggattttgttagaccggccagccagttcatgtggtagcattatattagcaacactagttacgtaaagttttgtgctcagatctgggacatgcaacaaatgatattataattttgtatgcatgcaacgtagtgggagatgtatcagctgtatcaactaatgatattatacaatatgtacaatttacaaatgatattcccaaagtaacgccccatgcactaggtccttctaatagggtcacatatttatcggtctattcatttacccaaggaaagataaattgctttattatgtttaaccaaaattcagcatctaatatagcttcgaagtcatgaatttgaaaccctttttttgtcaacaatattatattaatcttcgaatgcgattacaaccgaaagaaaccgggtactcgatgccgaaaagtcccggaatgatacataaatgagatagattaaataaacggttacaaccgtagataagattaaatacaaaacatgaatttgaacttaacataggaaacgaactattttaacttgttgtagttgttaacccgaaaagagtttggatattcttacatttaaaactttttggttaccaaaaaagtatttaatacaaagtaatttttatgttgaatgatgtgcaaatgaatatatcctcaaggttatcaatttggaccatacggattcctgtcaagaccaaacatgtgtaggggtgaataaattagccgaaaaaccggctctacattaaattaaacttgttttttctttttttctttctaagagcaactaagatatatataaccggttcaatttataccctaattgaaacccctttgtcaaggaacctgtctatatatacagacatatgcttactactttcttctcactccaatacaactaaaaaaatctactacggtgtattatacgacgaccatcatg

SEQ ID NO: 11535 - DNA, 3000 bp, Unknown
  misc_feature (1)..( 3000): cDNA_ID_2717478_gDNA_ID_2214501_Annot_ID_133665 3000 nt of promoter + ATG
attcaacataaaaattactttgtattaaatacttttttggtaaccaaaaagttttaaatgtaagaatatccaaactcttttcgggttaacaactacaacaagttaaaatagttcgtttcctatgttaagttcaaattcatgttttgtatttaatcttatctacggttgtaaccgtttatttaatctatctcatttatgtatcattccgggacttttcggcatcgagtacccggtttctttcggttgtaatcgcattcgaagattaatataatattgttgacaaaaaaagggtttcaaattcatgacttcgaagctatattagatgctgaattttggttaaacataataaagcaatttatctttccttgggtaaatgaatagaccgataaatatgtgaccctattagaaggacctagtgcatggggcgttactttgggaatatcatttgtaaattgtacatattgtataatatcattagttgatacagctgatacatctcccactacgttgcatgcatacaaaattataatatcatttgttgcatgtcccagatctgagcacaaaactttacgtaactagtgttgctaatataatgctaccacatgaactggctggccggtctaacaaaatccaagctagagaagataactaaattccacatagaaatagaaatattcgatcatatctagtacgaatcctccggtcccgtcaaacacactagcttttattttgtttctaccaagcacattcgttttgacatgtacgaccaattaagcacctacatgtattcccacgttatctagaatctaacaacagtggggtgacaattataaaggcgagatatgtacgcctagccagagacgagcaacacaatgcaatgtgcctagatatatttcttcttttatcaataacttttttttcttacatccattttttatttaacatctatttaacttaaaacatttctctctctcttttgtttactttatatttagaaattttacttttatgaaacattcttcatggcttttttgttttttttttcttcattatttgttttgtttacaatatctctacaaattttgaaccaagatatggtataatgtacttatttaacagtactatgttaatttttgttttaatttgaagtaaaacttataacgaatttttatttgaatatcaaaaaacgaccatattttaatattttctttagttgttttggcctctaaaatattagaaacggctttgattagagatatctttatttttacaaaaataataataataagtatggttcaccaaacaatgcgcaaacccgacaaaacattcaacggttacaaatgactaaaccaatcagaaaattctttatttagcaacaaatcttcactatataatagcgcaaatgtttattgggaataagaagtaaaaagtaaaaaagtttatcaataaggaaaaatgggtatatccaagaaaacagttgtacaatcatttgctcttataattattatatctatcgtcatgagcacaacggaggcaaacagtataggcgctccagctatgcgagaagatttacccaaaggttgtgctcctggatcttcagctggttgcaagatgcaaccggctaatccgtataaaccaggttgcgaagctagccaaagatgtcgtgggggttgatactatgagatataatttttcttgaaaaaagaagaaaagataaaattacataaataaaacttaatttttcaactaaattagtaaaactataaaatacaaaatttttgtaactaattctatgagaataatgtttttttaagtagcagcaagctgagactggtacgtgtatggtaagctagtattgtctaacttagcaaaagataattgtatattaccagtcatttgttatatttttggatatttatgtagaaaattcatgtgtattgttatataagaaaataattaatatattttgttgttttttttaaataaataatgtacttataatagaggtaaaatgtgtaacgctaggataagtacattcttgtcggatccaagaaagttagtaaaccatatatttaaggcaacaggttcttcttcggatcataatctctctcattaaggggaaaaaagaaaaagcaaatagattaagagaaaaacagaagaatcggaaaaaacttgagaaaagaaaatggaaacgaaaaaaaagtaataaataaatagccctatatataaagaatgcatcatgcatgcatgatcaagcatatatcctcatcttgttgatcactttgtaaacatcatccacatcatcgtcgtcgtcttctttcaccgcctccacacaccgctcattatcgtccccgaggctgccatcgccgccgccgcatcctcctctactgacgtcagcagcagcaccagactcgactctcatgaagaaattgcataggagaagtgttaagaagcaacatataataaattctctagatgcagccatggatcagacactttctctctatctctctttctcttgtctgaaaaacaaatgataatatagattaatccaacttactttaaaagcttttgttctttttatttactatgttcttttgttatgcttttctcttacaattgtgcttatataagaaatggaatttactattaatggagtagagtgatttcttttgagctggtcttaaggctaagtaactgttgcagtattttacttgaatattcatagcaaaaataaagaaaatcatttaaataagtggtacgttagtgacaaggaacaaaaaaatgacatgttttcgatgtcaaaaaacatacattattacaagttcccgatgaagacttgggccttgagcctaacattttatttgataggcccaatagtaaaagtaaaataaaaacgtccgtgttcaataaggtccatcgtcaccgccaaatctatcaccgccaattactctctaatcggaaaagagccccgacgacaacgaccaccgtccctccgtc

SEQ ID NO: 11536 - DNA, 3000 bp, Unknown
  misc_feature (1)..( 3000): cDNA_ID_2706773_gDNA_ID_2214501_Annot_ID_133667 3000 nt of promoter + ATG
agcaggttcagaactctactgggtcgattcgatctcccgacaaaattgaaggtagttactctcttttttttcattgaagatccaacgaaacgggttttttccgtaatgtgtttgaagatcatataatttctgttgttgtttttgatcattcaagtcttattgtgatttcgtttattttttctgagagttctgatcattcaagtcttaaaagttcgaaaatttagagttttgtctttttggagttatcttgttggattcgtcttgtcggatcattgattccgaatgcttcttctacatttatggaagttaaagatcatgttttttttcattgtgtgatattgttctgattctgattgctctttgtcggatttaaagtttgacattgtctttttgtctttggaatgtggattcttatgatttgagtttggtttttcttgttatttagatatataatgttcttggtgttatgattttgtagataccttcaggaggatgaaagttaatgaagacaatatggagcaatctagtccatatcctgatcgtcctggtgagcgagattgccagttctttctgagaactggtcagtgtggctatggaaactcttgtcgatacaatcatcctcttactaatcttccacaggtgagaaacttagtttatatggctgaatcttctcttcatctttcctgatactcgagcttacagtttgtaacattttgcagggtattatttattacagagaccaattgcctgagagagttggacagcctgactgtgaggtgcactgcttacattatgctgcaaaacataccttgtcttgagtctttccttatttggaaagtgttaatacagtagtttggatagttgatgcaccgtattgttttacttttctctgaagatgtttaacgaacattttcctcttctgtatgcattttctttgcagtattttctgaagacaggagcctgtaagtatggcccaacatgtaaatatcaccaccctaaagacaggaatggtgctggacccgtgctgttcaatgttctcggtttgcctatgcggcaggtaagattacatcgttgcatatagcctgcttttcatccaccagtttcatacttgatagaaaactttatatgtttcttctctctccagggtgagaagccatgtccatattacatgcagacaggattgtgtcgattcggagttgcctgcaaattccatcatcctcatcctcattctcagccttctaatggccactctgcatatgcaatgtccagctttccgtctgttggttttccttatgccagtggaatgacaatggtgtctttgcctcctgcaacatatggagctattccacgtcctcaagttcctcagtctcaggcctatatgccctacatggttgcaccctcccaaggccttttacctcctcaaggctgggccacttacatggtaagtcttaaatatagtttctcagtgcatagaccttgctttctctctgtgaagttacaataaatagacagagattctgcttttaacaaatttcactttcttttacaacattcctattttgcaatagattgtcttaatctgaaaattctctcttttcctttttaccgtggtgcagactgcatctaaccccatttacaatatgaaaactcaactcgactccagttctagcgcatcggtggctgtgaccgtgacatcacatcatcacagtttttctgaaagagctgaatgtaggttttttatgaacactggaacttgtaaatatggtgatgattgcaaatacagtcatccgaaagaaagattgttacaatcaccaccaactctcttgaaccctattgttcttccagcaagaccagtaagtctcttgtccttctttgttattttttgccaacttgacatttccgcaactcgttctgtttattctgttaaagccaacaagctttggtgacactaatttctctcattttgctgtgttcagggacagccagcatgtggtaacttcaaggcctacggattttgcaagtttggagcaaactgcaaatttgatcactcaatgctgctaaacccttataacaatacgggcttggccatgtcttctctgcctactccttatccttatgctccacctgtttcaactaatttgaggatctcatcgccaccaagcccctctgatatgactaccctatccaatggtaaacccgctgctgcagaagctcaaagcttggagactgagaaacaagacgatagtccaacagaaccagaaaaatcagaagtggaggactcattgccaccaaacggctctgattcaacctccctgcccaatgataaacctgatgcagagactgagaaacaagacgatgattctgcagaactggacagctcaaaagtgcaggattcatctgataaatctacatgatcacgatcatgatctcacaatctggcagagtctttccctgtcaggggtatctaacggtctcaaaatgatctctctgccctttttgttaatttttttggaaagagggcttggaaatgttctatctttttttttttttttttttcttcttctttggtttcggagacagcaatggctgaaacaaaataggaaaagaacagtgttttgaattggttaataaaacttgacatcctttagcacaattttcagattctcaacatatcaagttccatgatttttctatttctttatcaaactgtatattcgatttccttgatgcagcaactagaaaatgttgaacctaactagtttttggaacccaacacaaatagtaaccctctttctgagccagaggcttgcctagttaatgttacaaaagaaaacgaagcgacatcttatgctgatgtgtcaggatattattggttagactacgtaattccacggagcttgtgttcttaaatctgctgcttcgcaggatcgcgagagagaaaaggatacaattttacagaagaaagtgaaaagaaagagagaaaggggaagaagaaaaatg

SEQ ID NO: 11537 - DNA, 3000 bp, Unknown
  misc_feature (1)..( 3000): cDNA_ID_2706741_gDNA_ID_2214501_Annot_ID_133669 3000 nt of promoter + ATG
ttcatcctctacccacaaccactttcaatttctcgagctgtcaatccagatgaccaagagctgagtagctaggcatggtagtaactgtaacacaatcactggggcctaattgtagtaattattcttattctttaatagacaaatatcttaaactttaatgccattgtccttttaccatttcagcataaagatgttgagtagacaaggaggaacaaacctgagcatgaatccgtttctttctagccattgagacagttgactgattcaaactttgcgaatctgacccactcagcgcatccttctttggtagcccatgagagcttccttgtgccttcccctctacctttttgttttgataattgcctacaaaatttcctcctcttatgctgagagaattggagttgaaaccaatctggttcttctcatgtggccatgcatttcttgtgcttggatcatctccgagcatccgcaactttacagaatatctgtccctagctcggtataaatctattctatgtctctcaacggcatttatatcttctttaatatactggagatcagtttgcacctacattaagatagagaagacataaatgacagaattctataatattctgagatctcatctaacattcaggggttatacgtctcatgaatagttggatagatcatacatctattgatagaaacatggtttatggctttcttttacaacaactatacagtctaaacccagtgaagattttgaagcaaatggaatgaagagcaacgagaataattatcaataggtagcccaatgctactccataattcagacaaaccaacctcatttagttcatcaactttttgcttccttagacaatgcaaaaagtccaaaagtatctgcatgttcctctcagcttcttcctgttccatttttctcttcctttccgcaagaagtgtcagaagattatcaacctccttaattgacacatcacaaccctgtctaagtatgaacgcaggaagtcaatatttgatcaaaagaaatgacttagaattgctttttactccaataataattctgagaaagcaaacttaaagaggaaaaaatgaaacataaaaagcttgttaagaaccgaccctttgtagtgcttcccgaaactgatccaagggcgatgcagtttttgacacatgccgagctgaagttttcttcaatagctacacaattgatacataaacgtcatataataagctgcattccagtgataaatagtttcaatacactatcattcctataaacatgcttctatttagctgtaataagcagaatcctaccacaatactacacatcaaaaacaaaacaaaaccttcctaagaaaatctaatggcaaggttcattggaatcgattaaagactaagctagcttacttgtttccacaaaaaccacgacaaaaaccaaacttgattacaagctaagactcaaacaagcaacacccgaacttgaactgaaaagctaaggaccaaacacaaattacgagtaaaattagaaaaagaaaccttatcgagcaagaaattagggtaaagctgattattggtgaggtgttggctacaacagggacaatcactcttgttcctaagatgtgtgatgatacacatatagcagaaactatgaccacaagccgtgaggaaagcatctttaataatctgcatacaaatcggacaaagcaagtctttatccagatccggtgctccaatctcagaaccgccgcttcctccgtcgtcattttcatgacgattagcaccttcaccaactgaagatgttctcgggtcaggtttcaccgctggaacaaccggatccgtcgaaatctcttccattttgctttcaaaagatttcttcgattgtgattttggtttttgagaaaatcggaattgtgagaaaagagtggtttgggtatgacgtcggagatgaaggaggagtgaggctgaggtgtggtgggatccaccgtggttcttttctgaggtgacaaatcctacacgttctggtctacgcgcttcttttcgcgcgtgtgtctggcgtttctccaagcgctggtacggtttaattatccggcttctaatttatagtccggttcaatgaaatttcttacaattaccacgacggtctaatttaatttcttacaaccattcattttatttcttactatttgaaatgaataagttgggaatttcaatccattcaaccggagcataaccctagaaatagaataagttttgaaggattcggtttaataattttggaataaaccatttttatttcagttcttaaattttgttactgtaaaaaatgactgaaaagtgaaatatattttaattttcccatcactggaaacgttccctccattcttttgcttgtctgggaaacccaaagagactgtgacggagaagagaaatgagctaaataaattcctctctttgattcaccggaaccctagaaatcctcttcttaattctttcaaaggtgcgctgttttcactagatatcgctgttgtaattgttgttgattcggagctaggttttgtttttgtctctctttcggagaatttgcatgaagctaggatttgtctgttgatagttgtatggttttggctgcgttgtttctctcttgaaagtcttgttatgctactgtatgacacactcgaatgagtttttgtttgtgtaatgtttctcaattttgaaggcgaccaacagttaaaggtgccattttttttccagattaagtttgttcctcatctgaaatttataccatttctcgcgatttagcaggatatgcccagaaattaaaatcttagaacgacaatggtggtaaagtttttagctttttaccttttggagttgtcttcttaatttggtgtttttcttttctttcttagtctcctgagcattgtgttttggactggtttttgcacactgtaaccaacctccacttttctctcttgcagattattttcccctggaaggatg

SEQ ID NO: 11538 - DNA, 3000 bp, Unknown
  misc_feature (1)..( 3000): cDNA_ID_1807111_gDNA_ID_2214501_Annot_ID_133670 3000 nt of promoter + ATG
tacaagattacaaaactgcaagaaaagaattagaagttcaaacatacacacctccagaagtgggataagagactacaaaaaaattaacgaaggaaacactgctggagatggatacctccagtggaagatagttgggccgatctggcttgccaacatcaaggcatggaaagtacgcagaagaaataggctctgtgtaggtttgcttgaaatagtcatacacagtaatctctctaataggtacctcacgttcaccatctttaatcttcattgaaaacctggaaaacggtgaagaaagtcaagcaaaggctgaaaaagaggacaaaatatatattgatagtacaatcatggggaacctacagttgctgattgcacggtttcgaacttagacctataattttaaattccatgttacggtgtgttgccttaaccctcatatgtttaagcattttcgcagcctgccaagtttcaatgaaaacttcacaagctcaaaacaaaagcagccagtcatgttctcagttattgcatttaaaagccagaactaccttaatccagtcgatttgccgtggtgtctcaacactctgattggctttcaggaattcaataactggaccaggttctaagatcattgttgttgacacatctgcaaaccatcacaaaacgaaaacagttttgcttattaataaaactatccacaattaagacaagtttatgaaagctggagatgagaaaggtatactgaaaaataccaatgttaagcgagagtcctccatgagttggacgaaagctcgaatgtaaacctcgaatacctataacacctcctccaactttcatggggtgcccatcgctatggaaaaatgcctgtctgaccaaaaggcatcccctgcattatcaacagttttctatagtaagcatcgagcatggtcacaaaatgcaaatagttgtacattgattaaatttcaccaacaaagtgaaaatatgataataaaaattggtccattagaacgtagagtatctattttaataaaaatataaactgcacaaaagcaaacagatagaaagatttacctttcagctgcttgctgcctcagtacaatgtcaagcactctaagtgcatcctgagcactcttatctggtgtataagctcctctctgagtgccaagaacagtcttcaacggtatttctgcagcataatgtatctgaaccttgtaacttcttggcaagaaagaacgttttgatcgcttgcaagtaccggaagaactaccaccatcagagacaccacaatcactataaacttaacaagactgcgttagttagaagatcaacaagatctatcttgacaccttgaaacgattaaatatcaatccagataagagggacataccgttttgaaaatgacccttccacgatgactagaaagtcaaattcgttctgtggtagaggaccaacagtatataaagtcttctctccatcatatgccaaccttttaccatcaagatcagaagagtaagtcttgaatagttggtccataagctttctgcttattcctgtcccatcaacagcatcaccgttttctgtggtgatactaacctgcaaaaaaggtaccgatatgtcaaacatctcacacacgcacagacactgatgaaagaatgcagaaaagtgactaatgaatcttacagtgtactggtaaaatactacatccggctgtctcacagaaacattaaagtgattggtgcacaattctattgggttgcctgtggttccaaccccacgtctagttgtgatgtcataatctcgatggctgggctgttctggttctatacttatgggtgacagtggcagagatgaagatgtctccatccttccaggggaaaataatctgcaagagagaaaagtggaggttggttacagtgtgcaaaaaccagtccaaaacacaatgctcaggagactaagaaagaaaagaaaaacaccaaattaagaagacaactccaaaaggtaaaaagctaaaaactttaccaccattgtcgttctaagattttaatttctgggcatatcctgctaaatcgcgagaaatggtataaatttcagatgaggaacaaacttaatctggaaaaaaaatggcacctttaactgttggtcgccttcaaaattgagaaacattacacaaacaaaaactcattcgagtgtgtcatacagtagcataacaagactttcaagagagaaacaacgcagccaaaaccatacaactatcaacagacaaatcctagcttcatgcaaattctccgaaagagagacaaaaacaaaacctagctccgaatcaacaacaattacaacagcgatatctagtgaaaacagcgcacctttgaaagaattaagaagaggatttctagggttccggtgaatcaaagagaggaatttatttagctcatttctcttctccgtcacagtctctttgggtttcccagacaagcaaaagaatggagggaacgtttccagtgatgggaaaattaaaatatatttcacttttcagtcattttttacagtaacaaaatttaagaactgaaataaaaatggtttattccaaaattattaaaccgaatccttcaaaacttattctatttctagggttatgctccggttgaatggattgaaattcccaacttattcatttcaaatagtaagaaataaaatgaatggttgtaagaaattaaattagaccgtcgtggtaattgtaagaaatttcattgaaccggactataaattagaagccggataattaaaccgtaccagcgcttggagaaacgccagacacacgcgcgaaaagaagcgcgtagaccagaacgtgtaggatttgtcacctcagaaaagaaccacggtggatcccaccacacctcagcctcactcctccttcatctccgacgtcatacccaaaccactcttttctcacaattccgattttctcaaaaaccaaaatcacaatcgaagaaatcttttgaaagcaaa

SEQ ID NO: 11539 - DNA, 3000 bp, Unknown
  misc_feature (1)..( 3000): cDNA_ID_2706753_gDNA_ID_2214501_Annot_ID_184000 3000 nt of promoter + ATG
ttaataaagtttattcgcagctcatttggttcctttatgatattatactcaagctaagtaatgggttcgattcccatcttctcatttctttatcaaaaaacaagtaataaagttccttaaatattgtcttaaaatactatcgtagtaactagtaaggtggaatatatagtgtaactttggagcttgaggtcgtcggtgatgtgctggtacgaagagacacgtggcgctcaatcatttgaaaataatttagtttttttctttcttttggaatatgggaaccaccaacgacaacattattaattccatagattcggagttaattgagcgggttgcacgaaccacaccacacaccagatgccgaataaaattttatgcataagctaagcgaataatcaatgcatagttaaactttataagactgatatttaacgactggattatcacaactaagaggcgttttatttgttttaaacattttaattaagttattaatggtttgcgactcaagacgataggaaacgaccatctttttctactcatgaatatttgaaagaatattgttcttgcgacaactgatcaagctactatctttgaaaagaacgttcttctgccagtctactgaagaataactcaaaaaatgcacttggggctcactgatttttaacaacatttctttttatatacatcctttgaaagaaaactgaatcgtagcaaaaactagactaggaaactgaaaaaaaaaaaaaaaaaaattaagaggaagactaggaaaactgaaaaagaaagctttattaaaccagcatgcaacacaacttaatcatatgaattactttgtttttttccacattagttgccgtctgattaatttaacacatttgaaactatagtcatctttttgaagaaaaagttcactaataaaaacagagaaaatccatttaaaaaaaaaagacattttaaaagaatatcgagtaggatttttaatgtaaactttatataaattttataatataacatcaaatcgaaactaattttaaaaactaactttattttataaaagatacagtataatgaaagtgtataaacgaattttgttgtggatcaacatgaaaattaattagtttgtcaacagctattcatatagttaaatgatacaagtaatgataaacaaataaacgcatgttccccgttaacaatttttacgtctccatgcttagtggcgctaatcacctttttggttcgctcaagtcaaattattttgaccaagttgtcggtcgagctagctcgaaggtaacaaatagttaggcccactttgaaaatgtcggtgctcggaaaaaagataaaccgctaaattaaaccggtcatcatgaaactccggaaacctgaattactgccaaatttatggttgtaggcactgcacacgtgtaggtgtctcttagtccccattgtcatacccctcagtttttattggtggtgggcaaacttatattaagatgacccaggtccatctttcaaacccatttagatccatcctatatttttgaatgtttggtgtttttgctttagatatcaatagaggtgaataaattagtattcatactctgcagatttgagtttaacatttgtgatagtttttgtaaactttataatttgtaacagtgaacccagccaaaaccaaagttttgatttgagaaattagccttactattcacgattctctcgcctaacacagcagccttaacgacagaaacagaaacgaatctctgcctagcaatgacattctacggttccgaaaatttattagtattaattggaccgtttcatggaaacttgaaataattaagagaaactaattaagagacaaaatcgtccactttaactgttacactatcaacaactgacactctccttctacttttcaaaattacacaagatcgctaaatacattgaaattatcaccaccttttgaaacaaaaattgaaatcattaggaaaagtatcataaaacaccctctcacacagtacaaatgtaaaatttcaacaattgtaaatagtatgtaaaatgactttactacatgcacttttaattaattcggtctagatttagcacagtaaaagcaataactagctgcataaattacggccattaccactatatggaaaaagcaaaagtctccacattttctcatgtggaaatattttagattaaaaacaaaagttaaccataaaaacaaagtcacgtcatctctctcctccaccactccacagagctttcaaatatatccctctcctgcgagagcagagaaatagagagagactagtgagtgagagagtccatcgctttctttctttctctctctcgctctctcttcatctccaacagagacttctttctagagaaagagatcttcacaaatatgactgtgatgaatcaccgacacaagcaatgtcattttctcctcctccttctgatcactgtcttctctgccgcgttggatggtgtttcttccgagacagacgtcggagggtttgactacggtgaagcattgtctaaaagcttactctactttgaagctcagagatcaggaagacttccgtacaaccagcgcgtgacttggcgtgatcactctggtctcaccgatggtcttgaacaaggggtttgttttctgttcaaaactcttgtcattttattttttaattaattttatttttgaattcaaactaattcagtttactatcattagtttgaattttaataagagaattgaaatttattgtttgtattaatttataaataatacataaatttattgtagatttccatttaaagaaattattttctttggtttggaatgagacttgaaaaccttttgtgaattaagtattgaaattaattatttgttttattttgtgatgtgactttaattttaaaattttggtaataaaggttgatttagtgggaggatatcacgacgccggagaccatgttaaatttggacttccg

SEQ ID NO: 11540 - DNA, 3000 bp, Unknown
  misc_feature (1)..( 3000): cDNA_ID_3040280_gDNA_ID_2214501_Annot_ID_183996 3000 nt of promoter + ATG
tctatgtgtttaaactctttgcatcaagagagaaggagattgctacttttacgtaatgtgttgcataacagttgttgatttcggttttacatgctataatctcaatctctctactctttttttccccaacaaaattataggaaatgctgcgtccaatacctgtggcactagcgtcatgcacgagattctttgaggccatgtctgcgatgagagaatcattcgcgactcttcaagagcttcgagttggtaactctgcagtttctttaccaacaacaccaggaggtaacgaaatgacacatagagactcagattgtgtgactccacctcaagggaggatagagtcaagcttcgacgatttagctgttcataaaacaaggagacaaaacaatgatcaaaatgaagaagaagaagaagaagaagaagaagaagatggtaataacaatgggaaccggagactatcttggcctccttctgtaaaaaagagtagcgtttaaacagttgcttttgtctttgcttgagctttttaatatcgatcgtgttttgtttcatcagcattagtgttctttatggatttacttatttctatttgatagtctttgagtgaaacttaaaacagtgtatattttgttaacactggttttcatggtccatgtgactatcatattttagtctgttcgtttgttcgccgcttgcggctgcggcagaccgcggcaaaactaccgcaaaattaaaatatttcatagatgtgggaattgttttagtcgagaaatctaaagaggggtctataaaaaaaggattagcattcataggcacaatcgttccactaaataactcgtatggtctaaatattgtagtatgtagactgtagagagtagaccatgaatttaagacaactttaattgagaaccggtggcacctaatcatattttagccacctagttacatagcccggtctggtcttaaaagtagtttgtgtaaattggacaataaaacctcatatatcatttacatgatatttaaactgtaaaactcatcactatttaaaactataaaacgaaccacaaaagtgtttgcaataaaaaaaataccacttatatataaaattcatatcagattagattgcataggttcactgccaatccatggccaacatttctaaatgatatacagtacatgaaagactattatattcaactattcaaagttatctgatggaaaattattacatgaaatcaaataagtagttgaatctggatgatcgatctcaatattcatattaaaatggaacacacttttgttgttagagtattgatataatgcatgtaacgtgaaattgcaataatgcatcatatataggtttatatagattaactgagagacatcacttgcgttggttactcaataattacgtagctaaaattaataaagcggcgttaaggacccacccacgagctctatctatatatttccgtggtttttgtattcgaaacagaatcgatcacatacgtccaaattttgatttgttcctggcccactccttatccttacgcgcccgaacgcgtgtccttttaaattgactctttcatataaccaaaatatcagaccaacctctggtttattcggtttagcgattatactcattattacacattttccagacacacaaattgagattatttaatttctcacatttcaagtatatattaaatttcggatgcgtgcaattaaatgaaacgaataaatatgtgcaagcgattaatgtaccgacgcaggcgatgaatattcgtatttctcgcaactttaaatgtcgatgatacacttttcaaagcataactttaatgtcaaatgtcaattcattgtccatgcgtccatttcccactctcgacacctattttcatgtcttaaattcttgatttattgcttcatttttgatttttatttttattttgttgtttacaattcattatttcttgttcattttctgtaagacatttgacaaattatacaaaagaatcgaatctacaaaacatattctaatctaaacaacaaaatctaaatctaacagtctcaaaaatatttgacaatcatgcaaatatgttacagataatatcaatttttcatgatgcgagaaaataccattttagtgctcattgaataaagatgcattattagtttgcggcttttcagaagacatcaagtctcaaaggaccattatgtaatttgaagaaaataggaaactacacgcgcctgccaaagaaggaccttatcccacgcgtttatatatcttccaatccataagcagagcttctcttcaacgtgctccggtgaagattaaaaaccgacgagaccctggcgccatcacaactacgcaatctcattcctccgtcttcttcggctttcaaatttaccattttacccttctctttccctgagacgtcttctttggaaatattcttctcttcttccattccaagtaaacccaaattctctctctctctctatctctcaaatttcaaattccggatttattgattctctggtgataaacctaaacctctggttttgatttgtggttgttattgttgctacattaatggtgcttttaattttttctctgatccatttctcgccgtgtgatttcaaatttctccggctgtttttgttcgccggcgggcggtgttgattcgattctatacgatttgaatttcctttttctttaggttttagagtttccttttctattaagtaatcacacaattttacaaatttgttcctaaatttatttatgtcattttaccaactaactaccattaatttgtataaaactcgtcggcaatagcttcatgacctctttctctcaaggctaagctcttgtaatctctgttgagaatttgttgtggagtatgatgataatgacgaataatctggaattacgtctttcgatttttcagtgattttgaggttaattggaaattagagtgcaaaattgggatttagatg

SEQ ID NO: 11541 - DNA, 3000 bp, Unknown; identical to SEQ ID NO: 11538
  misc_feature (1)..( 3000): cDNA_ID_1807111_gDNA_ID_2214501_Annot_ID_183994 3000 nt of promoter + ATG

SEQ ID NO: 11542 - DNA, 3000 bp, Unknown
  misc_feature (1)..( 3000): cDNA_ID_3040292_gDNA_ID_2214501_Annot_ID_183992 3000 nt of promoter + ATG
ttaatacaactcacaagtaaacaaaattgagatacttattgcaatttgagtataaattaccaaaccatcttataagataaaacaaataaacactttatattttgtatcagaataaatataatttgacgaaggacagaaaaggattacaagcatatgtatgtaaatcttcttcgtgtttaagctcctaaaaaaaatcttaacttgtgagttcagttatataattagattgcttttaagacaataatcctagttgtaaacctgaaccctatagtctatagctaagtctacacttgtcttgtgccgaattaaaaaatgatagtatgatacaatgcagcaaaaaggtctcttggtagattctgccaaactgcattaaatgtttttattatttattcttttttaaacccaattgcttgctatatcgtgcgttaccttaaaatcgaaatttaccccaaaacaacaaaacaaattggtcgtaattctaagagattcagctaaaaacaggttttgaagagtactatcaaaccgatttaacaactaattagatgatcattaaatttatgtatttttgtttgtaattagacagtggagttgattcaacattcacattcgatttgtttttaaaattttaactcttaaacctaatttatttgtattagtttggaagcgaacttattgaactcatgatttagatatagattcgaactgatggatagaaatccaaaatattatagttcatgattatttgagttaagttcctttcacaaaaataatttaacttacaatctaatttcttgcatgttaaatttcataacgttttctaatataaacataaacttattatatgaaagtattataaaaactaaactaaaattcacgtaaaagaaaacaaactggtggcctgaattttgcaattagtgtgcattcttaatcaatcgtactgagtacaacagtattggtcattaagcagctacaaattaaggaaggattcagcgtgggccctacagcagaattaaactggtccaaaccgcagattagcgtacgaagaacattttagtatgaggctctattttattaaaaaaaaaaaagctcccttaatctttataaatcagtattttttacctttctcattaaataaaataccgtgtagctcacgctttcctttttatcctttactccacactaaatgacgaaaacacccatcaatttcttttctttctctctctttaacttaataataatatatttatatttcccctaaattctgaatttataatgtctcatagaagaaatagtttagtttctactttcaagtttcaacgtagttttttgtattgtgaataaaactatttgttgtggagtcaattgtaaaatggggtataattcaaatgctaaacaaaattagagtcgtttatcaaatagtagattcatttgtagaagaataaaatataataatgatgtaatagactacaaacttgtcttagataatttcatctctaatcaaatacatgtttcattatattctgtttgttctcataataacatcttggtaaaaaattgagcttatatgtcaatgagacataattattttcataaaaaaagttatacagtaagtcttaattaatttacagcattagttacaatttggatcaacattaagtatcttttaatgataccatcaatttgtttatagagatcaggagtcaataaatacatttattcattcagcataatatagttggaaatctgtagaattttagtgagaagatataataattaagaaaaggacccacgcaccgtcatttagatacgcgaataaactgctttcaaattaggtgtgtcatgtgtgattgcatattaaatgttaacaaaccttaatttggccaaaaaaataaacaatttacaacactaatagacttatttataaaaagatcagaatatgttgataactagagataacatttaagaaattataatcactttacattcatattaaatcataagtttatcactattttttattgaatttagtgctaaaactatgtgctagaaataaattattttagaaaagtatgttgagttattaattatgaaaaaataaatactacattaagattacattatacaattgaaaagttcagtattaactctattaagattaattaacatataatagcttttttaggcagcataatttcatttgtttaaattaaaatgcaataagagaaaaaaaattaatttttattaaataaggttcccaaacaaagaagaagaatagagggggtcccacaaggtttgtatccaacggctcagatcgaaccaacacattgaaaattaaaccacgcgcaaacgagttaaaggaacatataggggtaatatagtcatttcagatggaccggcagaatttattaatccgtacacggggggggggggcaaagactcattactcagcactgttatttttattttcattatattatataaatgcaatatttgttattatattattatttgatctcgttttcacattgaagaagaaactcttcattacattgggagaaaaaaaaagaggcaaaaaaccaaaaaggaagatccgaaaattttcccacgaaaatctcagattctggggaaaaagaaaggaaatcgccaagcagagaataaggcaaaatttcattcctattggaatatttgggctgagatttttctcttttcttttggatttgttcaaacgataaatctatctttgggacacaaaaaaaaagttaaatttaagagatcgttttttattcttttcaagttttcacattttgttcttcgtttgatctttcatcggaaaaaaggaaaaatcttattttccttttgtgtttgtttccttttcgtttgtttgatcattgtgatcatcgtctctacttacatacaactcataaacgattttttctcagaggattagagacgagttttgattttgtgtctgtgactgtgtttgtttcataacgagccatg

SEQ ID NO: 11543 - DNA, 3000 bp, Unknown; identical to SEQ ID NO: 11535
  misc_feature (1)..( 3000): cDNA_ID_3040300_gDNA_ID_2214501_Annot_ID_183990 3000 nt of promoter + ATG

SEQ ID NO: 11544 - DNA, 3000 bp, Unknown
  misc_feature (1)..( 3000): cDNA_ID_3040308_gDNA_ID_2214501_Annot_ID_183987 3000 nt of promoter + ATG
ttaagaccagctcaaaagaaatcactctactccattaatagtaaattccatttcttatataagcacaattgtaagagaaaagcataacaaaagaacatagtaaataaaaagaacaaaagcttttaaagtaagttggattaatctatattatcatttgtttttcagacaagagaaagagagatagagagaaagtgtctgatccatggctgcatctagagaatttattatatgttgcttcttaacacttctcctatgcaatttcttcatgagagtcgagtctggtgctgctgctgacgtcagtagaggaggatgcggcggcggcgatggcagcctcggggacgataatgagcggtgtgtggaggcggtgaaagaagacgacgacgatgatgtggatgatgtttacaaagtgatcaacaagatgaggatatatgcttgatcatgcatgcatgatgcattctttatatatagggctatttatttattacttttttttcgtttccattttcttttctcaagttttttccgattcttctgtttttctcttaatctatttgctttttcttttttccccttaatgagagagattatgatccgaagaagaacctgttgccttaaatatatggtttactaactttcttggatccgacaagaatgtacttatcctagcgttacacattttacctctattataagtacattatttatttaaaaaaaacaacaaaatatattaattattttcttatataacaatacacatgaattttctacataaatatccaaaaatataacaaatgactggtaatatacaattatcttttgctaagttagacaatactagcttaccatacacgtaccagtctcagcttgctgctacttaaaaaaacattattctcatagaattagttacaaaaattttgtattttatagttttactaatttagttgaaaaattaagttttatttatgtaattttatcttttcttcttttttcaagaaaaattatatctcatagtatcaacccccacgacatctttggctagcttcgcaacctggtttatacggattagccggttgcatcttgcaaccagctgaagatccaggagcacaacctttgggtaaatcttctcgcatagctggagcgcctatactgtttgcctccgttgtgctcatgacgatagatataataattataagagcaaatgattgtacaactgttttcttggatatacccatttttccttattgataaacttttttactttttacttcttattcccaataaacatttgcgctattatatagtgaagatttgttgctaaataaagaattttctgattggtttagtcatttgtaaccgttgaatgttttgtcgggtttgcgcattgtttggtgaaccatacttattattattatttttgtaaaaataaagatatctctaatcaaagccgtttctaatattttagaggccaaaacaactaaagaaaatattaaaatatggtcgttttttgatattcaaataaaaattcgttataagttttacttcaaattaaaacaaaaattaacatagtactgttaaataagtacattataccatatcttggttcaaaatttgtagagatattgtaaacaaaacaaataatgaagaaaaaaaaaacaaaaaagccatgaagaatgtttcataaaagtaaaatttctaaatataaagtaaacaaaagagagagagaaatgttttaagttaaatagatgttaaataaaaaatggatgtaagaaaaaaaagttattgataaaagaagaaatatatctaggcacattgcattgtgttgctcgtctctggctaggcgtacatatctcgcctttataattgtcaccccactgttgttagattctagataacgtgggaatacatgtaggtgcttaattggtcgtacatgtcaaaacgaatgtgcttggtagaaacaaaataaaagctagtgtgtttgacgggaccggaggattcgtactagatatgatcgaatatttctatttctatgtggaatttagttatcttctctagcttggattttgttagaccggccagccagttcatgtggtagcattatattagcaacactagttacgtaaagttttgtgctcagatctgggacatgcaacaaatgatattataattttgtatgcatgcaacgtagtgggagatgtatcagctgtatcaactaatgatattatacaatatgtacaatttacaaatgatattcccaaagtaacgccccatgcactaggtccttctaatagggtcacatatttatcggtctattcatttacccaaggaaagataaattgctttattatgtttaaccaaaattcagcatctaatatagcttcgaagtcatgaatttgaaaccctttttttgtcaacaatattatattaatcttcgaatgcgattacaaccgaaagaaaccgggtactcgatgccgaaaagtcccggaatgatacataaatgagatagattaaataaacggttacaaccgtagataagattaaatacaaaacatgaatttgaacttaacataggaaacgaactattttaacttgttgtagttgttaacccgaaaagagtttggatattcttacatttaaaactttttggttaccaaaaaagtatttaatacaaagtaatttttatgttgaatgatgtgcaaatgaatatatcctcaaggttatcaatttggaccatacggattcctgtcaagaccaaacatgtgtaggggtgaataaattagccgaaaaaccggctctacattaaattaaacttgttttttctttttttctttctaagagcaactaagatatatataaccggttcaatttataccctaattgaaacccctttgtcaaggaacctgtctatatatacagacatatgcttactactttcttctcactccaatacaactaaaaaaatctactacggtgtattatacgacgaccatcatgctcaaaatg

SEQ ID NO: 11545 - DNA, 3000 bp, Unknown; identical to SEQ ID NO: 11533
  misc_feature (1)..( 3000): cDNA_ID_3040312_gDNA_ID_2214501_Annot_ID_183986 3000 nt of promoter + ATG

SEQ ID NO: 11546 - DNA, 3000 bp, Unknown; identical to SEQ ID NO: 11532
  misc_feature (1)..( 3000): cDNA_ID_3040316_gDNA_ID_2214501_Annot_ID_183985 3000 nt of promoter + ATG

SEQ ID NO: 11547 - DNA, 3000 bp, Unknown
  misc_feature (1)..( 3000): cDNA_ID_3040320_gDNA_ID_2214501_Annot_ID_183984 3000 nt of promoter + ATG
agaggggtagagaagaatgctccatagtaatttaatccgacgaaatccaaagattttcttagtttctcagattcttctggtgtaaattcacgcagtcggatgtttacatcttctaacatttccgctggatactgtccatatgtgagagggcgaagaaacctgcccatttgtagttcagaaagcaagaatgtcacatcttatgtatgatcaatttaaacattattttaattaatcatggatacatactaagatcgatcccaaaggaaaaatagttaaaagaaggaagaaaaaatcaccagccgagttggtactcgagggatcgtctagctgctttgacgtcttcactcgaatttggatctttaggctcgaaccagtgagataccaacactatcccaattttccctccaccctcttggcactatattgtaacatagtaaagaaattattaaatgaataatgtatgtatggcatactatttttgtaattcagatatgtataggatttatgatttaagctttataatatatgtggaaattagttagtatataagcaccgacctttttacagtttcggaattcatcaacagcagcaagatgagcaagaatttggttgtgagcaactatgtatggctcctcggatgaatctcctgtgggacattttggggcttgccatttagagcaccgtcctggtgctttcttacctttcgagtaaccagcaacgctgtataccgatggctcgttaaacgtcgcccaattcttcaccctatctccaaattccttgaagcaaaagtttgcaaactcacggaaatcctctctacattaatttgttagcgacaaaaaaattatttaagaaaatcagatagttgaatagttttcttaattatactagaagaagaaatcttgagaagtttttatcaacaaaattacttacactatcctttcgtttaggaaacctccgtactccatttctagagcaagtggagattcccagtgaaagagagtaaccgaaggctgaattcctggcaattagtattacaaacgattaaaaacaaaagctggtataatatacacaagttggaaataacaattaagattgaataatataagagacattaagttataagatgtttaaccattagctaaaagttcatttataagatcgttgtagaacttcaccccctcctcgtttacaccttttttaatagttccatctgcaaattatatataaattttcatgagttataaaagtaaaaagaatcattacgtcattgcaatatagatttaagttagagataatatgtgtggtctggtaaattaactgtaaggacaatgagattgacttacaaggcaagatcctggtccatgagattgaaaatctgaagccattcgtgttcaactccttcattaattttatatcatcctataacgtcacatcccgcccaatcgtttcaatttaattataggataaaaaaaagactatcatttactatatatgaaatcatatacacccataataaataatgacgtaccttgtaacgggtatagaagtcgactccctcatctccatcgccattttgttgaaccttctctgaaagatgccacaatattggtgatacattttcttttaagaaaagcttttggtaaaataaaatacaattcataatcacttggtaatttataccaggaaacatgtgtgtaaattcgtcccatgaggtcaagcctctcccagaaccctttttagcaccttcaacctaaaagtcaaaccaatttgaaaatgataagactgatcttctatatatcatcaatgttataatgtgtttatatgtatgttgacctgatatgcggaaacagatgttccaaatatgaaatctgcggggaaatcttgcttgtggatctcaaactcgggtccaatgatggtgcccaaatcatcatcatttaggttggtctgcggtccaacggtggtgcccatgtccatgtcaatgtcttcgtcatctacggtcgcatgtggtccaatcacgatgcctatctcgtcatcgaagctagtttgatgaggtccaatgatggtaccaagatcctcatcacttggttgaggcctagcatcggcgttgaagctaagtatggtactagttaaggctaagagccctaggaaaagagtgagagtagctgtagccatatgagtgttttttcttgtgaattttattagttttttttttttttatgcttcttccatttccaatccattctatttataggaaagaagcttcaagtgtgtgttatgtgaaagggaatttgtgatttccttgtgttgcactcatattttgcggggcatctttagtttagttataggattagttaaaaaaagtttataatattatgaacatttacttcctttatatttctgaattcgtcaagcgtcattgtccataacaaagcacgaagtgcattttaatgactttaataaaaaaaaaagtattctaataccttgctcaaaactttaaatattataatattccaatcgtctttactagcatatatccatcattttcatatatttcctttactcacctcattttctacttattaacacaacaataagagacaaagcggcattcctggtgaatatccacgatactacattcatttaaaacaatttcgtcaaagtttacatcaacttcacattaatcccaaaatagtccaaagacccaacaaaaaataaaaactgagttctaagaagacatgggcttgttaatatcattttcatgggaatagatagcgccagtttagtttttttagaagctgttttcatataaaattcagagaagaattgttgaacatagtcaatcttaatgctgaatgcaaatccttgatgcacaacatttctcttaagataggttctttaaggaatgacattctgaaatccaatccaataacattacccctatgtccgcttgtgtccagcatccgtacgtcggtttctacagcagtggttggctggcttatg

SEQ ID NO: 11548 - DNA, 3000 bp, Unknown; identical to SEQ ID NO: 11530
  misc_feature (1)..( 3000): cDNA_ID_2706769_gDNA_ID_2214501_Annot_ID_183982 3000 nt of promoter + ATG

SEQ ID NO: 11549 - DNA, 3000 bp, Unknown
  misc_feature (1)..( 3000): cDNA_ID_2706745_gDNA_ID_2214501_Annot_ID_133671 3000 nt of promoter + ATG
tggagccaacacttttactacgacttttgttttgtggtataatcacaaaatcatacagtataataaagacaaccagatactctcaaaatcactaaactcggcattgctgtttagtgattatcaaaactatataaactgttcatagctaatataatgtggattttagtttgcgtgttaaaatattacttaaataatcaaataaatatattttaatcataaattgcaaaattagatgaacgttggttttcatgttaaatagaactatatttcctaataatgtacagaaaaaagccataaatacaaactttcactataaatagaaataaattcgttatcgattcacatgggcggagacaaagaatatatttagacacagaatatattttatacgatatgatttttagtctgttgtcctttaggtttgaagagaggtgggaatgattggatcggcttctcatctccacttcttccacagtgtccaacttgagaaccgaaaaataattggagagataggaatcgtttctcatcaaattcccacttacttatgttaagccacttaagtagtggaacaataattcaaaacttataataatattcttttacccaaaactcttttcatttgaccaaattagtaatcgagttggtaattactagttatgtatacattctgacattcactatccaagttgttttccaataagtagaaagtttaaagtatgcgtagctcgacattaattaattagcttctgttaattatatgattaaggacggttcataaaatagtatttaaactgctttttacaagtagtttgagttttagcaatcatgtgatgattcagataaatttatatattttaaatttatattgaagcaatcgttaaacgaagttgaaaatgcgttaataaagtatctgacatatggtaagtttaatgggtgtaagaacaatatccactatctactaataacattactcaagtgtaacgacatggtgttaacaacattacaacaaattttaagcatgtatataagaatatacatgaactcaattttccttgattaaactagtcatggaatcaagtaaagagatccaatattgaagttttaattatcaacaagacaaggcaatataaattctaatgatggtatcaaatatgaggtgggataatattgagagaacgagagatagaccgagatcaacggtacaaatgattaccaaataaggataattgttttttgacaattatatcgatcaatctttgattttaccaataaataatgttagttttcaaaatattcttagcaaggaatggtaaaattagccattagttcccaaacatttgtttagctcaagtgtcattacaaaattcatttttatttgctgagtattatatcgatgttattagtttcagttctcgttcaattctgtttgttgataaaaccttttatgctcgttcaattctgtttcgaaagagaagtatgaacctatttttaatattggttggaagttggaacagtctatagatcaaaactctaaaattgcttggtacggttaaaaaaaaatattcccaagatttgtaaaaaaaaatagtaacaatgaaacaaaattagggttttactgtacattcttaagtcttaatacggaagctctttacggtgtggagcccagctcagctcgggacccaaaacctttcctaatctgaagcatattccatagaatgtaccttttcaatttctccattagtttattttagtattttcttttcataaaatctcgttacattttcaaaaaacagttatatagacatagacggaaaaaaaaaaactaaattttttttgtcgaacactttgcagcatgtgtattggttcggagctcatgagaggcccgtacaggcatacaatcttttatatgtctcttgagtcctgactcttgtttttcacaatatatattgatggactactaaaaatagtaggagaacattagttgcttaaatggtttgaggagttatgtgaacaactgaacataacatttttgttaatcatacatgaagataagtcttttttgaaaatatatctcaattaatatatagagaatttgagaaagcgttagcgttcctaatttcatatatggagtatagcatagtttataacacgggactgctatagaacatctataataatcccattaaatttttagcgatcgatttacaaattacaaatctatagtaattgttcgatcggttgatggaattactacaacgagaaacaacaatttgattttgttgactagttaaattctaatatacatatatatatatataaaattatataccaatattagctttttgtcggtatttaccaacacaattaactataacaatagatattgtaataaatcacatatcatatagatatatcttattaacacgatatgtaagataattgctctaaaataaaaacttctatagtagtttatttttgtcaccaattgaatatttttccttttggggtggaaaatatttgtggtatctcaataagcttcttgtgtatcccaccccccaccatggcattcctacaatttaataaagccgtattttcactttcactctgagtcatttttattatattgtcattttcgacaaaatcgaatttagattgtgcattatatattctgacgaaaacaaagaaagattgttgcattaatttaatttaaaaaagttgattgaaaacgcaagtctcgttcatctcctccaaatgttctttttctttttttatgttctttctcttctaaaagtccaacagcgacaacataggtttctctctctaccatggcgtgtctatataaagcaaggtcgtcgattcataacgaccatctccattacttctccataacctttcaagaaacaaaaacaagataagatctcttcagattcctacactccaacaaatataagtttcattagattctttcttagctagagaatgaaactgattgagaagacg

SEQ ID NO: 11550 - DNA, 3000 bp, Unknown
  misc_feature (1)..( 3000): cDNA_ID_3040280_gDNA_ID_2214501_Annot_ID_133672 3000 nt of promoter + ATG
acaataaaacctcatatatcatttacatgatatttaaactgtaaaactcatcactatttaaaactataaaacgaaccacaaaagtgtttgcaataaaaaaaataccacttatatataaaattcatatcagattagattgcataggttcactgccaatccatggccaacatttctaaatgatatacagtacatgaaagactattatattcaactattcaaagttatctgatggaaaattattacatgaaatcaaataagtagttgaatctggatgatcgatctcaatattcatattaaaatggaacacacttttgttgttagagtattgatataatgcatgtaacgtgaaattgcaataatgcatcatatataggtttatatagattaactgagagacatcacttgcgttggttactcaataattacgtagctaaaattaataaagcggcgttaaggacccacccacgagctctatctatatatttccgtggtttttgtattcgaaacagaatcgatcacatacgtccaaattttgatttgttcctggcccactccttatccttacgcgcccgaacgcgtgtccttttaaattgactctttcatataaccaaaatatcagaccaacctctggtttattcggtttagcgattatactcattattacacattttccagacacacaaattgagattatttaatttctcacatttcaagtatatattaaatttcggatgcgtgcaattaaatgaaacgaataaatatgtgcaagcgattaatgtaccgacgcaggcgatgaatattcgtatttctcgcaactttaaatgtcgatgatacacttttcaaagcataactttaatgtcaaatgtcaattcattgtccatgcgtccatttcccactctcgacacctattttcatgtcttaaattcttgatttattgcttcatttttgatttttatttttattttgttgtttacaattcattatttcttgttcattttctgtaagacatttgacaaattatacaaaagaatcgaatctacaaaacatattctaatctaaacaacaaaatctaaatctaacagtctcaaaaatatttgacaatcatgcaaatatgttacagataatatcaatttttcatgatgcgagaaaataccattttagtgctcattgaataaagatgcattattagtttgcggcttttcagaagacatcaagtctcaaaggaccattatgtaatttgaagaaaataggaaactacacgcgcctgccaaagaaggaccttatcccacgcgtttatatatcttccaatccataagcagagcttctcttcaacgtgctccggtgaagattaaaaaccgacgagaccctggcgccatcacaactacgcaatctcattcctccgtcttcttcggctttcaaatttaccattttacccttctctttccctgagacgtcttctttggaaatattcttctcttcttccattccaagtaaacccaaattctctctctctctctatctctcaaatttcaaattccggatttattgattctctggtgataaacctaaacctctggttttgatttgtggttgttattgttgctacattaatggtgcttttaattttttctctgatccatttctcgccgtgtgatttcaaatttctccggctgtttttgttcgccggcgggcggtgttgattcgattctatacgatttgaatttcctttttctttaggttttagagtttccttttctattaagtaatcacacaattttacaaatttgttcctaaatttatttatgtcattttaccaactaactaccattaatttgtataaaactcgtcggcaatagcttcatgacctctttctctcaaggctaagctcttgtaatctctgttgagaatttgttgtggagtatgatgataatgacgaataatctggaattacgtctttcgatttttcagtgattttgaggttaattggaaattagagtgcaaaattgggatttagatggggattgctgatgaatctaaatgtgttttccccttgacgagtctccagatcgggtaattttatctatctatttgatctgcattgccgcttttttttttttttataagttatgattcacaggatcaatgattctgcagttaattacgtgacctgtttttgaatgaagtacaagcttgttgagcctttaattggaaaactatgttgtctttccagacaaaacaagatctgtttttgtggttttgacaatttattatctaagttctgcaattaaagctatcacttatttgtgtttctttcattatcttgattccaggcttatgttcctctcctgaatctgaactagtaatcagtttttggtgttaatgtcttaaacatttccctctgaagtgaattatatttgttctagcaattctcttgtccagtttcttgaaattttcttctacgtatgtgatattttaaagtctcactcgtgttggctactttttcttagcagagatcttaatctgatgatactttcgtgtgttttttaagagttaactacattgtcacactttatttgcttgattgttctctgcttttctggttaacctttgtttttttggttggttacagagacttgcaatcatatctttctgatctcagtattttcctgggaaataaaagtaaaaagatttacatattggtggataaccggccatggttgaatcctggcaccagatctgctcatttttggcaactaatggtcacaaaggttgtaaaagctgcttcaagtacatttctctgtggtgtgtaggtgaaaaattatggtaaagtgacacatctatctttgtttgcagtccagactctccccttttgcaaacacgaaacttcgaggggagaagaaaaatcagaatcaggacagggagaagaaaaagtcgaagcaggaggaggaagagaagcctaaagaggcttgttctcagccccagccggacgataaaaaaatg

SEQ ID NO: 11551 - DNA, 3000 bp, Unknown
  misc_feature (1)..( 3000): cDNA_ID_2706753_gDNA_ID_2214501_Annot_ID_133674 3000 nt of promoter + ATG
aagcttgaatctttcttaagattgtttttaataagattgctctgagaagcttctagcttatggcacgtttattaattgtaaagtcgaaacaatgtgagaccgtcggtgggagatttatgaaatatggaacgtctagaagcaaaaaaacatattttgatctaataaaaagttcttcactttatactaaaagactctttaatatcaaagatttgacagatctggttattaacatatttattaactaaaaacattgggatttgattgttacatttatttattttataccttgcatttaatattctgcattattatggatcgccaatttttttattctgcatggatttaagagagagagggagagaaaacaaaacccatgcatagaaatttcatcgaccgactcttgtcatatgaatctaaaataattatcaagaaaaataaacacatcaaatctgcttaaataaacaagaatttaagttttcccaaatgaaattaaaccatcctttcccaaatgaaagtttgaactcagcaccaacaacaagcaaaattcaatccttctcgtactcaccaaataagctagacatatggggttaataaagtttattcgcagctcatttggttcctttatgatattatactcaagctaagtaatgggttcgattcccatcttctcatttctttatcaaaaaacaagtaataaagttccttaaatattgtcttaaaatactatcgtagtaactagtaaggtggaatatatagtgtaactttggagcttgaggtcgtcggtgatgtgctggtacgaagagacacgtggcgctcaatcatttgaaaataatttagtttttttctttcttttggaatatgggaaccaccaacgacaacattattaattccatagattcggagttaattgagcgggttgcacgaaccacaccacacaccagatgccgaataaaattttatgcataagctaagcgaataatcaatgcatagttaaactttataagactgatatttaacgactggattatcacaactaagaggcgttttatttgttttaaacattttaattaagttattaatggtttgcgactcaagacgataggaaacgaccatctttttctactcatgaatatttgaaagaatattgttcttgcgacaactgatcaagctactatctttgaaaagaacgttcttctgccagtctactgaagaataactcaaaaaatgcacttggggctcactgatttttaacaacatttctttttatatacatcctttgaaagaaaactgaatcgtagcaaaaactagactaggaaactgaaaaaaaaaaaaaaaaaaattaagaggaagactaggaaaactgaaaaagaaagctttattaaaccagcatgcaacacaacttaatcatatgaattactttgtttttttccacattagttgccgtctgattaatttaacacatttgaaactatagtcatctttttgaagaaaaagttcactaataaaaacagagaaaatccatttaaaaaaaaaagacattttaaaagaatatcgagtaggatttttaatgtaaactttatataaattttataatataacatcaaatcgaaactaattttaaaaactaactttattttataaaagatacagtataatgaaagtgtataaacgaattttgttgtggatcaacatgaaaattaattagtttgtcaacagctattcatatagttaaatgatacaagtaatgataaacaaataaacgcatgttccccgttaacaatttttacgtctccatgcttagtggcgctaatcacctttttggttcgctcaagtcaaattattttgaccaagttgtcggtcgagctagctcgaaggtaacaaatagttaggcccactttgaaaatgtcggtgctcggaaaaaagataaaccgctaaattaaaccggtcatcatgaaactccggaaacctgaattactgccaaatttatggttgtaggcactgcacacgtgtaggtgtctcttagtccccattgtcatacccctcagtttttattggtggtgggcaaacttatattaagatgacccaggtccatctttcaaacccatttagatccatcctatatttttgaatgtttggtgtttttgctttagatatcaatagaggtgaataaattagtattcatactctgcagatttgagtttaacatttgtgatagtttttgtaaactttataatttgtaacagtgaacccagccaaaaccaaagttttgatttgagaaattagccttactattcacgattctctcgcctaacacagcagccttaacgacagaaacagaaacgaatctctgcctagcaatgacattctacggttccgaaaatttattagtattaattggaccgtttcatggaaacttgaaataattaagagaaactaattaagagacaaaatcgtccactttaactgttacactatcaacaactgacactctccttctacttttcaaaattacacaagatcgctaaatacattgaaattatcaccaccttttgaaacaaaaattgaaatcattaggaaaagtatcataaaacaccctctcacacagtacaaatgtaaaatttcaacaattgtaaatagtatgtaaaatgactttactacatgcacttttaattaattcggtctagatttagcacagtaaaagcaataactagctgcataaattacggccattaccactatatggaaaaagcaaaagtctccacattttctcatgtggaaatattttagattaaaaacaaaagttaaccataaaaacaaagtcacgtcatctctctcctccaccactccacagagctttcaaatatatccctctcctgcgagagcagagaaatagagagagactagtgagtgagagagtccatcgctttctttctttctctctctcgctctctcttcatctccaacagagacttctttctagagaaagagatcttcacaaat

SEQ ID NO: 11552 - DNA, 3000 bp, Unknown
  misc_feature (1)..( 3000): cDNA_ID_2706757_gDNA_ID_2214501_Annot_ID_133675 3000 nt of promoter + ATG
cctccaccactccacagagctttcaaatatatccctctcctgcgagagcagagaaatagagagagactagtgagtgagagagtccatcgctttctttctttctctctctcgctctctcttcatctccaacagagacttctttctagagaaagagatcttcacaaatatgactgtgatgaatcaccgacacaagcaatgtcattttctcctcctccttctgatcactgtcttctctgccgcgttggatggtgtttcttccgagacagacgtcggagggtttgactacggtgaagcattgtctaaaagcttactctactttgaagctcagagatcaggaagacttccgtacaaccagcgcgtgacttggcgtgatcactctggtctcaccgatggtcttgaacaaggggtttgttttctgttcaaaactcttgtcattttattttttaattaattttatttttgaattcaaactaattcagtttactatcattagtttgaattttaataagagaattgaaatttattgtttgtattaatttataaataatacataaatttattgtagatttccatttaaagaaattattttctttggtttggaatgagacttgaaaaccttttgtgaattaagtattgaaattaattatttgttttattttgtgatgtgactttaattttaaaattttggtaataaaggttgatttagtgggaggatatcacgacgccggagaccatgttaaatttggacttccgatggcttttacggtgacaatgttgtcatggagtgtaatagagtacggtgactcactcgcttccaccggagagttatctcacgcgcttgaagccatcaagtggggaacagactacttcatcaaggcacacacaagcccaaatgtcttatgggccgaagttggcgacggtgacactgaccactactgttggcaaagaccggaggacatgacgacttcacggagagctttcaagatcgatgagaataatccgggatcagatatcgctggagaaactgcggcggctatggcggcagcttcgatcgttttccgttcaacaaatccacattactctcaccttctcttgcaccatgcccaacaagtacatacatactcattttaaatttaatttaatgttacagttggaacagacattttaatgtttttgggtaggacatttaaataagttatggttatggttttggttgtagttgtttgagtttggagacaagtacagaggaaaatacgatgagagtctaaaagttgtgaaaagttattatgcctcggtgagtgggtacatggacgagcttttatggggtgccacttggctttatcgagccaccgacaatgagcactatatgagttatgtggttgacatggctcaccaactaggtggcctttcttgggccatgtccgagtttagctgggacgtcaagttcgccggtgttcaactcctagcttccatggttagtacttacatattgttcaattttgtgtgtggtaaaagtgaaatatttatagcactaacctcttagtagtctaatttaagatttaagtagaatcttataattgccttatgtgaagtgattatcaagtttaaatattctcacgtcgaattaccaaaagtaaggtattccccaccccacgttacatatgtacaacaactattcaaatattttctctttgtatgcaaatgaaatactttataactaaatattagtactagcatttagaaaaaagtttagttatgaagcagaaacaaaactaaaggtcacgtgcttttgttcctctaagtctaagcggatacgtctctttaaatggttctgttttatggcacgtgattctaaacctacttgataaattagctatattctgattgacaaaaaaagaagaagctatattcttatgtatgaactagtctacgaaattctacttgagttttaagcactaacaacacttgcctcatttttcagttgctaaaagaagaaaagcacaagcaacattctaaagtcctacaacaatacaaatcaaaggcggatcattacctatgctcaattctcaacaagaacatcaacggcacaaacgtccagcgaactcctgccggtttactctacgtccgacaatggaacaatatgcaatacgtatccacagcatctttcctcctaaccgtatattctgatcatctccgaaaatcaaacaccgatctcgagtgtcacgaaggaaccgtaactcctgacgagatgcttggctttgcgaaatctcaaatcgattacattttaggatcaaatccaatggaaacaagttatctagtcgggtacggtccaaaatacccgattagggttcatcatcgaggcgcgtctatcgcttcttttaaagagcacaaaggttttataggatgtactcaaggatatgataattggtatggacggtccgagccaaatccgagtgttttagtcggggctttggttggaggaccggatcaccaggatgattttgatgaccggaggggtaattacgttcaaacggaggcttgtacgtacaatactgctcctttggtcggtgtgtttgcgagacttatagagcttgaggagcaaaaacttgaagaagaagatgtgagcttggttgcaacttataagagatagtttttatttaatcaatacaaaaaaaagaaagaaaatgtggttttattttgcacccattttgccatttctatattgttagagtttttcttctcaactttttttttttgttttgtttttaaataaaaagtgtgtataaaatatcaattatcaatatagatttttgtcaattttattagttaagaagttcgaacggtctcttctttttgcctctgttttgcagtttacacttaccatttttacccctgccgtttttgtggattaattgcgttatacgacgtcctcttacactttcactccaaacgacgctgttttaagcaagaaactccatcgtcttcttggcaaaattctgg

SEQ ID NO: 11553 - DNA, 3000 bp, Unknown
  misc_feature (1)..( 3000): cDNA_ID_2717509_gDNA_ID_2214502_Annot_ID_133678 3000 nt of promoter + ATG
agattcttctctcagacaaaagcaaaggctccgactcaaactgctttgccattgttcctcagaaaaagaccggcggagttaagagcctctggagaaagctgttggggagaaataagaaaggtaagagcaagaaggtccctaatccatttgccaactaagaagatggtggcatctgtcatctagactataatctaataccttaatcctgtttctttatatggtcccaaagacccaaactatgcaaactaaactgtcattttctagatttttttggcagtatatatataatctccacgtagagtattactctataagatgatcattctgctttattccacttttagtctcagaaaggatacaatcagtaatcttgacccaatgaatctttagcagggttaatgtaaatcttcaacgtagacactaaatgcataagatcatttgatataatgtcatctcaggtctcaaaagaacaaattgtggcctttaaaagagacttctcaatctctgtacagaacaaacttggcgatgtcgttaagtccagcttccttgtagcactgagcaacccgttccagtgattcgtcccatgtcccttcaagtgacgctagattcagtaagaacgcagcctcgtccaaagatgcctgagaattacaagttttgtttcaagcctttgtatccataagcatgatatgagtatctgataatgaatacaggcaaagaacaaacctgagccattggctttcccctgtctatatcccgttgttttccttctcctgtaactctctccttatactgcgcaatttgctcttctccccactctgctatttgagcaatttcctgggaacccgtttcatatgttcaacacttttttcccttctcttttcgattaccaaaattgcttgtcgatagtcaaggaattgtacctcatatctgcatcctaaggtccaccacgaagatttcaaagcacccctagctgcgtctttcgcttctaagttacgcccaagtctacaaaatatatagaggtcttagagttttctagaaaggacgtaagcatttacctgggggtcgttcacaagggagaaagagggatgatgagaaaggatcatacgaacttcagtaaaacttttgcgttgaaagcgaatggccgggcaaatccgggaaagttccctctctttgtataaaactcggtagccaccaaagctgaaaccttgtattagcacgtgaagatagtttaaaaagagaaaacacgtcaactacaacaggatagatataattactagccttacatggtctccattctcgatatgccgaataacttttcgttcaagagaatctggaaacaatccaacctgaattacaaagctaataatcatatcccagtatccatgtgcagaaaagattctgatattaacaggctcaatatatgtacctttcttaaaagataggcatctaaatccatcagtcttgaactggcaaagtcacccttactgtaaagtttcttcccagcttcaccagcagcattgaagatttcttggctgcattcttcgggtttggaaacatcttcttccaccaatattctgtgaatgaactgatcaacctgaatgttggccaatgaagtcagatatgagaatgaacactcaacaaaaataaccctaaattaacgcatcagtaatgctataaaaagactcattacattattagctagaaaccaaaccccatgtttctgaacttccaccacaggcatctccatactgcaaacaccacaaacaatgataagctacaaaagaagagaaacatgacgatattaaaaaagcaaggaggatctaacctagaaggagctgttggccaccgtaatagagcaattgaagaacctgaaaaaggaaagtcatacaaacttaatatgaaagtgttacaacctcagataagaacttatgtacaagtccagaatcatacccgggctcattttcaccaacggaatagtaagaggtaacaagccttgcttggcaccaggagaaactatggatttacctgatccaatgtcattaccacaagcaaaagtcaccattccgcaagttaacaaacaaaaacttcgaaaatacgatcagcaagtcagtgtaagattgatttacctctagctgtgaatatattcagcagctgcatcagatgcttaggaggctgagcttttgctatatccttaatgaaacattcatgttctgcacataatcaatcgttaacttcgattcactgattgttcaaattcggcaccgtaagaatcataaaccaatctcaagccatcgcacagcttccagaagttgcaaatgaaatagcgaagatgtgaatccctctcaccagatagtgaagaagaagagcaaaaggatctggcgaagtttctgctgccatggagaagtatcagtctacgtttccgtccgaaaaccgccgcgccgcgatgcatctcagagttttccgatcgccgtactgtttctcgtccgatgagattacagagagacttcgaaaagctgttgctgaaaaaaaaaacaaaaaataaagcccaaacaaatagggtttaagagcccattaaatcagagcccagcaacgttcgtgtttgttttgttcagttgatatagaaccagtctcgaactctagtagattcgttgtctcgagctacgtgatattccggtaaaccgtcgccggagatgtacagtagataattcaaatcgagctgccacgtcgctattttcccaccaacttttttttttttaaataattggaaaaagtttctaatttacacgcttcccaattcgtaaacaatgttctttaaaagtaaaacgaaattttttttggatttgaagataaaagatccaaaataaaaacaaaattgaagataaatttttagggtttataacgacccgccaaattccttctctcctccaacatttcagatttcgcgacccggatcttaacccggacccgcatttgtttcggttccgatctggtttcttgaca

SEQ ID NO: 11554 - DNA, 3000 bp, Unknown
  misc_feature (1)..( 3000): cDNA_ID_2706847_gDNA_ID_2214502_Annot_ID_133679 3000 nt of promoter + ATG
cattgatcgagagagagcttttgacaaattgtagtgacttcccaagtcctgatttaatgattaggacaagtggagaacagaggattagtaacttcttcttgtggcaacttgcttattccgagcttttcttctcgccggtattttggcctgatttcgataaggataagcttctagaggctcttgcttcgtatcagcgtagggaaagacgatttggttgtcgggtttgatccacctttcatcctctctattatgttttgttcatctgtaatttctaccaaacttcttgcgtatcattgtaatttgtgtcggtaaaaatcgaataaaatcagtgatgcgtttatttctttctccgtgcttcgctttatacgcatgttttatgtatcagttgacagttgttactaaaaccaataacttgctaaacaagtaactttaatacctcagattcctctagttcaacaacattacaatttaaaactccaaaccatcaccccaaaactaggcaaagtttctgattttttaattaaaacatcttcaaaccaattcactttttttttgcgggaaatagattgataaagatccaaattcactcgattaaatgggtctaagtgtcaaatcaaagtatattagcccaccttttcgaccacacaaaacaactgaagtccccagagagtgacacgtcacgaagcaaaaatccatgaatcaaaacctaaagtcaccgtcgcgcacagaagggtctccttttccgatcctcttcagaagcaccagacacaagaaaccaaaaaaggcttgtttcacaagaaaccaataaaagtcttgtgacacaagaaaccaataaaagtcttgtgacacaagaaaccaatcacgtgggttctcaaagccctaatgcagctggaaaaagatagataaaccgttacaaacatcgattaacttaatataaatgattctccacggaagagtttaatacgtaagacctgtctttgcgtagtttgattgatcaaagcgacgtctttgaattcttagtatatatatgtgtatgacaaagcttcaataactcgaacaaattaacattaaagcaaagccaaattaagcattagcaaggacaagaatgttgtctcttctctctactctagtagccctcccctttctgtttctcatcccttgtctctttatcacaagctatatatgtttccctgtgttcttgacaaaactccttggactcatcaaattcaaagccgctcgagacgatgatgacaacgagaaacggtagtttacggttttttaatcatacttttagtttttagtaagttatgtttgtggaatgttttgtaaatctataatttgtaaaatgttttgtacaagagtgacatcatataaatggtatttttgaaagtctcccgagaagagaatcataatttaatttcaattttataatcactagttaatatctagttatcaacagaaattatactacacaagtacacatagagagagccttttgttagaattatcccacatcggaagaatttttggacaatatatatgtgttttagcaataattttttggttgtatagtgatgaggcaacttgtgttgtccgagaggaggagctacaaagagagctgatgccgagacacgtgtcattcatactagatgggaaccggagatgggccaaacgagacggattgacgacggcacaaggccacgaggctggaactaaacgaattatagagatagccgaggtctgcttcgagttgggtattcatacagtctcagcttttgctttctccacagagaattggggaagagacaaggtgtgacattttacattgtagatctcacaagtagattatattctcatacaattatagacactaacaaattttgttgttattatataagtttgaggttaagtgcttaatgtctttgttcaaccactacctcaagtccaacattcaatactttcaaaggtatatatacaaattcgattgtgattcttttgttttgacatattctctctggttattcattaccaagaattatcttgttgttacagaaaggaagttcgcgtttctgttatcgggaataaaacgaagatccctgaatctctcctcaaagaaatccatgagatagaggaagctaccaaggctacaagaataagcatctcatcatggcagtagattacagcgggaaatttgatatcatgcatgcttgcaagagtcttgtgaagaaatcagaaaaagggttgatccgagaggaagatgtagacgaggcattgatcgagagagagcttctaacgaattgtagtgacttcccaagtcctgatttaatgattaggacaagtggagaacaaaggattagtaacttcttcttgtggcaacttgcttataccgagcttttctactcgccggtattgtggcctgatttcgataaggataagcttctagaggccctcgcttcgtatcagggcagggaaagacgatttggttgtcgcgtgtgatccacctttcatcctctttattcatctataatttctatcaaactacttgctctttgtttcacgtttcattgtaatatatgtctttaaatcggataaaatcagtgatgtctttgcttctccttctacgcatgtatcagtttgttactaaaaatcaatatcttgctatacaagaaaatatctcagaaacctagttctacagcactaaaattgaaaatcagtctttgcgggaaatagtttgggctttaaaggtccatgtccactcgatttaatgggcctagctgtcaaatcaatagcccaccttatcgacaacgcaaaaaaataactgaagaccccaaaattgacacgtcacgaagcaaataaaccaaattcccatgaatcaaaaaaatcatcagcgaccactgtgactccacttgagcgccggagccgccgccgtcgccgtcgcgtcggaactccattttcacgttcctcttcaaacacaccgacgcgtaaccagtttcgtccatg

SEQ ID NO: 11555 - DNA, 3000 bp, Unknown
  misc_feature (1)..( 3000): cDNA_ID_1957064_gDNA_ID_2214502_Annot_ID_133682 3000 nt of promoter + ATG
attaaacttgatcctaaaaaaaaatcttaattatttttcttttcatcttaaatactaattttgtaactcaatcttaaatgtgcatatgcttttatcaagtgtttttgatagctatattattttaattctatttatatgaaaaaaacatatacaggtggaagatttctttgttgaaatgcaagaaaaaataatttctatttgttgaataaatgtcttaaatggagaaagctccttggatatcattgcatatgttaaaattttctacatttcaacaaagaatatagaaaatttctatgtttttctttgttagtgtgacagaatctactaaaaaatacatatttttatgccaatggttaatatgtttaacgttttgtgttttagtgatatcatacaaaagtttctagctagctagatttttatgccaatggctctctccatttttttatgattaaattttcaaaaaactaacaagagaactttgtgtattatttcttggttttttatactccaatggtaggttctcttaaaggaggtctcttaaaaaaaaaatattcatataaattattttatttcatacaacttaatattacaaagcataaaatattaaaatacattttttggaaatattataaaatagatgtgaaataaatattataatgtttagttaaatatataattttgtcataaattatgagctaattaaaacaaaattagtaaaccaaaacatttagggggatgtattggattagggattttagaagatttttgtttttcttaaaaaccatatcaaatctagtgttattcaaaaattaaaaggtttttgttcctctactcatcaacaaattaaaattcttataatttttttttttttgtttggcttgaatctgcatgactcactcaaattagaagccaattactatcatcaaattagagatacatttaactatgaagcgaattactatcaccaaatcatgagctatatgtgttccatagttacagagtctatcaccaaaatacataacgccaacaaaacaaactcctagtcttgtacatctatgaagccaatgactcaaaacatacaacataaccatcatgaagccaattactaagaaaaagcaacaaaagaaagagatagatacagagaaaagagaaaatacttgagcaagttgggactgagtcagcttcttgtcttctcgggcttgcatgatggctttcttcaacttagtgggcacacgatcacctgattttaaaaccatataaaggtgttaacgataaccagcattacgaatcaatcaaacacatatgtagacttcctctcgctaataatgcaaactgaagaaaatattaataacccaagagaacagactagattactagaatgactgtacccaagcaaaagctggttcttatgggatccaaatcaacaacactgatccccatgcaacaaacaataaaacgaaacagatcaatcagataacttcttcgttttctaaagaaccaaatcatctacacaactaaatcaatcaaagcttagtcatcttcctatctgacaatgctctgattcgagggaacgaagcaagggtttggtgggagattggatttgggacaaacacatatagaattgggtcatcgatttggtgaaacgaactcggaatggtgagcagcgtcgagagagacgaccaatagagagagtgagaaaatttcccgacggaatgaaaaataaagacacaaggattttttgttggttaaatatatcaaccaaccactgactgccacgtaggaggctctctccagaattatttgttttgattatttttaatcaacaacttcaagagaaccctatcaaattgtgatactcatatcatgacactgacaaataaaagagaccatgaatatggttaggccatatgcgatatggcttcaaaaaccaagttgggacaatcttatgtttagtcttaagtttgagttcattttaattcattttagatactattgtttgatgtaaaattaaactttgataaataaatgtacctaaatttggattgattttttcataatcatgtttaaaatttttggtgttatgcaattctgttttgttttgtttttccataataagcatctgaacatttttacaatatttatatattttaagaaactgaagttttaagatgtattaatctacattaaccttttctattttaatgttaacaaatattatatattataagtacaatattcatcaaatactataacatatatgtgaaatgtaaatatttactactaatcaaatatcatactgcatatttgattgcaaaagagctaaaaatcattaatattgcacattaaaaatagtcaataaactaaaatcattaaatacacaaatatatcataacacagcaagtgtgtaccattattaatcaatagatttacgctatacaagttttccgaattatgtatgtgaaataaatcacaccaaaaaaatgtatttgaaatgaaaaaattccccgcctctgtaatttaagttttttagattaaaacagctaaactcttttcattaatttattagagatacaagatattgttatttgttaccaataccaatatgtaaatttttctgagtaattattataattagttgaatttggctaccatatgccaattttcaacacataaaattcttttaaacgtgaaaattccaataatctaagagccaacaaccacgaaaattaaacctcgttttagtctaaactctaaaatgagaaataattagaaaccaataaaggctcttaaagaaagactaggtcaagttcaaagcaagttttgctttgtgtggtggtcgtcgtctctttctttaaacacacttgtttttttctttttcctttgaccactccaatataaacaaccaagaaccagtgttcctcgtccattcactctctcgtaatcacacacacactcactcatacgaagccaattgttccacacaaattggaagcgacgaca

SEQ ID NO: 11556 - DNA, 3000 bp, Unknown
  misc_feature (1)..( 3000): cDNA_ID_3040359_gDNA_ID_2214502_Annot_ID_184026 3000 nt of promoter + ATG
tcctaattctatcgtaaattattatcaacccaaaccagtcaattctaaaatatcatccgtagtacaccatcccatattaatatcgattcaaactcgtcaattctaggatttcactcgcggtagtatttaattgtacaattatattttgattgtcattctaggatttaactcctacttctatcgcaaattcttatcaacccaaacagtcaattctaaaatttcacccgtagtataaatttaaatatatttataatgtttaaatttcttataaagaatcaaaatgtgttttaaaaaaattaaagttttaagtgttttttttaatattgttaattttgtttagtgtttaagattatataattatattatgattgttattatatgtttttttccatagcatactatcccatgttattatccactcaaactcgtcacaccatataaccccgtcccgtgaaattaaacacaaatttgtcattttattataaatttcaaatatttataaaattagaaacttcaaaaaagattaatattgactcaaatttcatcattgaattttgagtgttatatctaagatttctctcgcagtatatcgtcccgtattaatatcttttatattgtttaaatttcttgtaaaatttaatttataattttttatactttttaaagtttcaattttttaacataaataaccctagtaaacaaaccattttaattttggacacctcataaatcaagtttcatgctcattcgtaatcgaaatcattttggtcctttttatagtatggctcttgaccattgtccaatttttttaagcgatgtggaacattttaaaatcgtaattattatccacccaaacccgtcctaccatataacccagtcccgtgaaattaaacataattttgtcattttcttataaatttcaatattataaaatttgaaacttaaaaaaatacaatatcgacccaaaattcatcattgaattttgattgttatatttaagatttttcctgtaatatatcgtctcgtattaatatattttttatatatttataatgtttaaatttcttgtaaaattcaatttataatttttaaaactttataagttttaaaaatataaatatttaaagtattttttaaagataaactttatacaaagtttttaaaattataatatttaacttttgataaagttataatatttataatttcttgaaacattttaaagtttcaattctttaaaataaaaaatccgagtaaaatcggataactattttaattttggacgcctgataaatcaagcttcctgctcattcgtaatcagaatcattttggtccttttataatatgggtctgaaccattgtccaatttttctaagcgatgtgggatattgtacacatattatttcttcatacgttgaataatatatgtccgttttaaaaaatttgaattacatcatattcagaaaaaaatataatattttattaactataaatattttatataaattcaaaataaataaagtataagatcaaataaaaatgaaagaagaattatatatttatgtttaaattagatagaaatattttaggaaattagttaaggtaaataagaaatatggttagtttagaaatattgtttatattaaatttggtaattaaatcaataattttcgtttttaattattagtttttaggtaacttttccaaaaattaatgttatccaagatcagaacagaattaaacatgttatccaggatccgaacagagttaaaccgggtaaaaaccacccatttaaattaattgttgaattatggctcaaatcttcaatattatcttcaaaaatcgcctccaaaaatgtatatatagatcataatagagtcatttgtaatttgccaatttgttctgaattaaaagctacttggaaggattgttttccttgccaacttatgtaattcaagtcttgtcaggttctaatccatcaatgaaattttaattttctgtgaaaaaaaaaaaaaaaagctactaataattacacatcatagaattctataagctatgtttgaataaaaaatattctgatatatttttttcttacataaatgtggagtctaaaaaagagcaagaatcttcccactgttctcaacctaacatatttaatacatttggtctccttacccaacactcccaacatatatctaaattaaaagcttttcactttcttaaattgactttaaaaaatgtattttcagttattcacactctctaaatataatccttaagaatcctaaaggttgacagtaaaattttcccccaaattaattaccttctttacttgccgagttgactaattcttacatttttttcagggcaaaaataagacaaaattctgttttattaagtaaaaaatatcgtttctgttttgtttctctctgcttaaaataaacacaaattaattataaaatgaggttactaatcatctttcatttgaataatacaaaatcaaatgattatagaaagtgattaattaagcttctcaaaaaccctaacgccaccactactctgcttctaatggaaaaaaaagtcaatgccttttttgacccgaggattagagagagaaaccgcactgagtagagagagagtgttgtagttgtagtaaatgaaacgagagattggtggtgaaaggagtcagctttgcatttattatatcatcttctctaaaaaagcttcaatacagagcaaaaccaaaagcttaaagcttcacaaaattcatcttcttcctttcacaattttgggatctgtttgttgaaaattctgctacttcttctcttccgtgaaagtcgtttactttttttgtgggttttgtgaaagtttccgcttttagaggcttctctttgatctgctttaagatcttcactttttagggttttagttctcttatgggctagagaaacccttcttctgattaatctcttaggaaagtttcgaaatttgagattaatg

SEQ ID NO: 11557 - DNA, 3000 bp, Unknown
  misc_feature (1)..( 3000): cDNA_ID_1807662_gDNA_ID_2214502_Annot_ID_184025 3000 nt of promoter + ATG
tgatgagtatggtcacttgttggattcaaaggtatgtcttgattactgtggatttgggttgttttcttatgttcagactttgcattattgggattcttgtacgtttagtttatctgagattactgctaatttgagtaaccatgcgctttatggtggagctgagattggaactgtggaacatgatctcaagactaggataatggattatctgaatatacctgagagtgagtatggtcttgtttttactggaagtagaggctctgcgtttaggttgcttgcggaatcttatccttttcatacgaataagcggcttttgacaatgtttgatcatgagagtcagtctgtgaattggatggctcagactgcaagagagaaaggtgctaaagcttataacgcttggtttaaatggccaactttgaagctgtgttcgacggatttgaagaagcgtttgtctcataagaagaggaagaagaaggattctgcggttgggttgtttgtgtttcctgctcagtctagagttacaggttctaagtactcttaccagtggatggctcttgctcagcagaacaactggcatgtgttgcttgatgctggttctttaggtcccaaagatatggattcgctcgggttatcattgtttcgaccagagtttatcatcacctcgttctacaaggtctttgggcatgatcctacaggttttggttgcctgttgattaagaagtcggtgatgggtaatcttcagagtcagtccgggaaaacaggatcaggaattgtgaagatcacacctcagtatccgttatatctcagtgattcgatagatggtcttgacggattggttggtcttgaagatcatgacattggtacaaatggtgataaaccggctacgacagatgctgctcgtagaggcgctcagatgccggtattctctggtgcatacacttcagctcaagtgagggatgtgtttgagacagatctcttagaagataatgcctctgatagagatgggactagtagtaccatatttgaagaaaatgaaagtgtttcggttggagaattgatgaaaagtccagctttcagtgaagatgagtcatccgataattcgttttggatcgatttgggtcaaagtccgctcgggtctgacagtgcgggtcacttgaaccaccataaaatcgcctctccattgccaccgttttggtttaccagcaaaaggcaatcaccaaaaccggtggcaaagagttacagcagtcctatgtatgatggtaaagatgtcctctcgtttgatgctgcagtaatgtcagttactcaggagataaactctacgccatcacggaatctgaggaactctaataatctccaaattcaagagatacaggaagaaaactgcggtaatattgtgtatcgtgcaggatctggttttggatcaaatggctcaagctccaagatttcttcagatatgaaagataacgcaattagacgagaaacagaaggtgagtttaggttattgggaagaaggggtactggtgggaggcttttgggtttggaagatgaacaaccaagcagaggaacaagggtttcatttaacatggaccgtgtcagtcatagtctggaccaaggtgaagcttctctggccagtgtatatgacgaaagtgatggtgaaaacccgaatgaggatgattgggacagaagggagcccgagattgtttgcagccatatcgatcatgtgaatatgttaggtcttaataaaaccacaagtaggctcagatttctgattaactggctagtgatctctttgctacagcttaaagtgcctgaaccaggcagtgacggtagtagcagatacatgaatcttgtgcagatttatggcccaaagataaagtacgaaagaggagcggcagttgctttcaacgtgaaagacaaaagcaaaggatttgtaagtccagaaattgttctgaaactggctgagagagaaggtgtatctcttggtattggaatattgagtcacatacgcataatggatcttccgagaaaccaccgtggaggcgctaggatcaaggaagatagttctttgcatctgcagagagaagctggtaaacgtggtggtaaaaatgggttcgtgcgatttgaggttgtcacagcttctctaagctttttgtcgaactttgaggatgtttataagctatgggcttttgtagccaagttcctaaaccccggtttcagcagagaaggatcactaccgactgtaatagaagaagaagcagaagattcagagacgtgattgattctttgaaaactttttgaaacaggactcaaaaggcttgagccactaacatcctagaggcttctggaaatggaaggagggtaaaaagtaaaactgtgaattaagatttgctatatatagttttttcgttttggctctgtttcagtttttaggaatatgagataggaggagaattcttgtaaactggaaaacagaacatgttttggccaaagattccactttcggacaagggaacatagtttagcatttgctcttacactaaaccctcctgaaatcatacatattcgtaaaaattgaatttgtttaagactttcctttaatttcctttcactctctccctccgtggctaccacatagtatcacttgttgtaaaaccaaatgttttaacatgagaaaagttacgtacgtttgcttttaccttttcaaataatgatgaaaattcattggccgtgcggacaacaaggataacttagctttgtttggtttcaaaatgacatttaatgaaactacaatgtcaaaccgtttccattttcttaatttattggcagtgcggacaataaaggcttacttagaatataaataagagtgccatttgttacttcttacaatgtttaaggttaaacgtggccaacatgaagccaaaactttatctataaaagacaagagtgttcttagagtacttatacacttatatttgtcaaacacataaaaattaaaacatg

SEQ ID NO: 11558 - DNA, 3000 bp, Unknown; identical to SEQ ID NO: 11555
  misc_feature (1)..( 3000): cDNA_ID_3040383_gDNA_ID_2214502_Annot_ID_184013 3000 nt of promoter + ATG

SEQ ID NO: 11559 - DNA, 3000 bp, Unknown; identical to SEQ ID NO: 11554
  misc_feature (1)..( 3000): cDNA_ID_3040395_gDNA_ID_2214502_Annot_ID_184010 3000 nt of promoter + ATG

SEQ ID NO: 11560 - DNA, 3000 bp, Unknown; identical to SEQ ID NO: 11553
  misc_feature (1)..( 3000): cDNA_ID_2717509_gDNA_ID_2214502_Annot_ID_184009 3000 nt of promoter + ATG

SEQ ID NO: 11561 - DNA, 3000 bp, Unknown
  misc_feature (1)..( 3000): cDNA_ID_2706807_gDNA_ID_2214502_Annot_ID_133686 3000 nt of promoter + ATG
gttttcaactgcacacacattcaattactgaaaagattctaatttcacaattactgacaagattctaatttgaaacgaagaacaaaagacggtaaaaatactctaaaaactcaatgtaaatgcataaaaacaaaactatgaaagcgaattttaaataagctaaaaagtgaaaaccatatacatcaattaaaaataaaatataagtttagtgtgaacgtgttattcgttgtttcacgcaaaacccgtttatatgtcagttcgttggatttggatatcgactctagtcatggtccggtcacgagccttgttcgttatcgacttacttgccgtgtgagctggggtaatccatttcctaaatgacataaataccctcattacttgcacccattgacttctattcttttccttttcgagaatgataaatacgtgccttactatacacgtaaatgtttatatacggtaaacatttaatttcgctttacaatttatttttcttccatttatctataggattcgattcacatagtattacacatgtttcattttgaaactggcaatactcaattagaaggaatcactatggaatgtgactttgagtttgatgttgaccatgactttgaaagtgtatgtacgtgactcaaaattacatttagcatggaatttaaactcgtatctctttatttaatagcttaatatctctaacgaaacaactaaacgtttgatctgttattaaagattatttgtcgaccaattcattgggatctagtggtcgatcgaatgactatatttgaatcattctggtacatttttaatcatggttactgtggaatctttaaacgataaataagaatacaaaactttgatatttccgttataagacatataattaatttgttgtcatatatagttttgtcttcagcaatcacaacattattaaattatcatattgatcagtatgaaaaaggtcagataattattatcaattaatcagttttgtagacccaagctcaatgatttatcttctttcctctactttataagaaatttgtggaatgattagaataattggcaggaattccgctgatgagaggaaagacccaaactcaatgattaagactggagattttgtttttgtcccgaatgtacttttcaacacttgatttcttctcaatgttctcatgcggaaatttgggggaaattgtcaatgtatcattttttcggttgtcatctctagttatagtgttagatctcgtttttaatatgtctccgactaatgtttttgttatcatttctaaagcaatgatatttatgctcaaatgagcttattaagagaaatataaaactgaaattagatagctcattaagagctttattactcaaagaaactaaaagaggaaagattactttgttatcacaaagaacacgatgattcaattactactttcataaagatgagaaagggagttgttttgagacaactcttaaagttatcatcaaagttctcatcacataactatatatatgagtgatgagtcactatcttgttaatcctatttatatggaccactacatgagcttttaagttactcatgagacattatattgggctttatatggatcctctaatagttttgctagattaatgtgaatacgtctttaggaatgactagatcatgagcacgagataatcgtcaccgcttgcactaatatagtataagagggcaatggtgactaattttcaaaaatttagctccaaggtgattttggagttttacgctcatttacatttcagaaaaaaatcaaacaatcatgattgggtcgtgtctaaacaattttgcatacacatcaaaacaaacatttgcaaaagtttgaagaatgatactaagctaaaaagtgaaaatttccaaaacaaaaattagggactaagaaatgcgagattttaagctcacaaagagtacttaattgattgtgtttctttttttgtttatcttcccgtagatttcatgtcaatttccgaatgaacctagaaaatcaccaccatatttcctcttatcaaacaaattttccatccaatcatattgtctcattctaacttgagcgtaaaaaggtatttgaaaacaatttattttagttttctcggacactttcatgagttgaagacaaaatcagagaagtctccgaaaagacaaaaatggatcgtcagtttgtcaccaaacacctacatgaaccttacttgattcgctccaagtgttcaatcacttatcatatgatcaccaacaatccaaaaataatcgaagtttccataccataaacaaattccataatccaaaaattcgaccccttgacacacactgacacacactgacacacacacacagaaaatattcccgtagctatgcctatatgggcaacttcctgggctaatggtcccatgaaaaactgatgagctcatagtcaaatattatgcacaaatgggcttatataaatgtcaacttcaaagcttaccagaaacccaacaaatacacaagccctgaagtaaaaaacaaaaacaatatttatatcaccgtaaatttcggaccaaatcagagaattcagagtgtttttactgttcatggatcccacgtgatcagacagctcaaattccgatctcgtaacgacgtcgaataagacaatttcggttttgtccctaatcccatcttaaactgggtcccacgtttttctcttcctcccaaaaagcaaacttaaaaccaaaaaaatattatcggacaagattccagctactagtggttctttctttcttcttcatctttttctcaatcactttcttcttctccattctccttttcttttggttctctctcccacttgtgaagaagctcctcaagaagaaccctaaaaaaatgattcttctttgattttgtgtatttttacctgttcttgttggtgtttgtttgcttagttctgaagcaaaagctagggtttttcttcttcttcttgaaa

SEQ ID NO: 11562 - DNA, 3000 bp, Unknown
  misc_feature (1)..( 3000): cDNA_ID_2706842_gDNA_ID_2214502_Annot_ID_133687 3000 nt of promoter + ATG
tatcaactacaacatcgtgcttatcaacatcatcctctactcccgtgatttcagccaaaaggggtacttcttcagccttctctctaattatactctcaatgacctatggaaataataaacaatgaaatattagaaagaaataaattcatatttgctcatatttgctcaaggaattataggaaatactaacctcagttgttccgagtacatggttgatttgctcaagggtaaaccctttcatctcggttctcttgaaactcaccttgcacatccttggacaaccggcatgtgaaccctctttttcttctatgaatctttccctaagtgatggaatggcctcaaatgctaaaaactacacaaaacacatgaaatttaattgttagcttcaattacgaaaatgtaacaaggataaaacaaaagacttacctcaagcggcacacagaatccgggaacaggccatggtgactgagtgttcgggacgacaccgttaaaatgatccaatgtgtgtgagatcgattttaacatgtactcaaatgaatatctcccccatggaaatgtcttacaaaacgtaagatcacttgcagccctaacacagaaatcatcaattggactagccctttctccagtcttagtaggcacggcaatgatgcttgttagaaaatagaggaccgccatccgcaacctatcctttgatctagccggttccatctccattagcttggttttcacgtcttcacgtctaattaccccggttttgaagtacctgttggcgaagttcatattaccagcactctgataattagctggataagccttgcagttgaaaccagagatcaaagcatgctccctaataccatagcggatgggaactccattaacaacgaaccaaacctccttcttcttctcaatagatgccgttcgaagaaaaagcatccacatccccattaacttgtgggtatatccggaaggcaggtggtagatgtgcttgaaactcggatgctccataaaataattcttttcaacattcgttagaggatgttccaagtcagcgaaggtcttcaacacctccgagatataacacctcgttgctaacttcatcttcttggtatactccgacgccgggaagtacataccaagtggctgcattgccatcgcttcctccatatcctgaaagaaacaaacattcatttatatatcactcaattgtaaatagtactgccacattattactctgtatttccaaaaagtattccccgtaattaccagtattacacagatactcctattcatatatcactcaattgtaaatagtactgccacattattactttgtatttcctaaaagtattccccgtaattaccagtattacacagatactcctattttactatatagtattgctcaaagttactagtactaactactgataaatcacaattgtagtattactataaggtattacccacatccgccaatattacctaaatatcaacatagcatttcccaatgttactagtactgtccacatttcacaattgcattattacccaattagatcggtattacgaaatggaatacttaccacatttgcgatgtcctcggctatggtcctctcctccacgggtttttccacttggactatcacgtcctcgtttctctcgtcctaaatatcaacatagcatttcccaatgttactagtactgtccacatttcacaattgcattattacccaattagatcggtattacgaaatggaatacttaccacatttgcgatgtcctcgtctatggtcctctcctccacgggtttttccacttggactatcacgtcctcgtctctctcgtcctcgtctccctcatcctccacagacttttccacattgacgtcctcgtcgctcgcggagctcctctcctcctcctcctcgataacggctaggccgtcatcttgtctctccgcctcttccacgggattagcacacgcgacttctttgtttgtctccgtctcctctgaatcggaatcggagcccaaggtttggctactactccctgattcttctttttcacttccttcttctttttcattttcatcttccacctcatcagtttgcatattctcttgagtttcttcagccggaatatgcttcagagcatcataaaacgtagaatcatcaagcatcgggctctccgtcgttggagccgtcgttggagccgttgtcgttggagccgctgtcgttgccatcgccgtcgcagtcgtttgtgccgtcgcagtcgtcttcgccgtcgcctgaaccttcgctttcttcgccggcgcctgaaccttctctttcttcgccggcgcctgaaccttctctttcttcgccggcgcctgaaccttcgctttcttcgccggcaccttctccttcactttctcagccggcgccttaactttctctgtcttcgctggcgccggcgcttctatctcctttcttttcccttgacctcctccacgcgtcttaggcggcatgactgatttcgaatcggaaatagaacggaaatactggtgaaagcaagaagaacgatcgattaaatttaaagaaatagggaatgttgcagttgaaacggttactaaggagaagaagtcaaaaaatcgaaaacggttactaaggagaagaagtcaaaaaatctctcttcgaattgggaaatccctggaaatattagggtttttttatttgattttcaaataaagagtaaaggtggttcggatggtttggttcggaaacgaaccatggtttttctggtaattaataggttcggatggagatatactagtaatatccatatatttcgaattaaaaaaaaaacaaaaattatttcagttttttacaaggattttttggctttctctttacaaaaaagggactggccagacgattattctcacagaaccgagttagtagttacagagaaggaagaagaagtagaaaacgcaaaaccttccctaaaaccctaagaactctgatg

SEQ ID NO: 11563 - DNA, 3000 bp, Unknown
  misc_feature (1)..( 3000): cDNA_ID_2706838_gDNA_ID_2214502_Annot_ID_133688 3000 nt of promoter + ATG
gcatgagtgaatactctatgtatagcactgagccaagttccttctcaaattgatgtttttcacagtcaacaaaagagtctaatgtatatggtaacaactttcttgtgtatagattgccacgtagattgtattaacagagtactcaagcatcagtttacaaaccaatctcggtgtactaaaactgttacaatttaaccgattcttcttttatgttacaattggtttttgtcaaaaatgtatctaatctgctcttctgcactcaacaagacattctttacgatccaaccttgttcttgcatttgtttgttcagtgcgatattatcatctcgagcagctcgcttactctctctagtgagcaaggtccaatcttgtagcgtcaagtctgaaaacgataaatagcttctcttggttctattggctccaagggatttacgtatgtaacatgtctgaacatatcaccaaaatgtgttatcagttaactactatgaacttactaaattgatgatattcagttgagtcccttacctgtaacaaactcgtgataacgtctacactgttggctccttcgcgcagacaaataacgatgcccgactaaatattttacaagtgttgaggatcaaaccacagaatcatgaggacatattagtagcaaacatgaaactcacttttggtattcttctgaaaccttgggaggaaagttccatggttatgaagtaaccatcatcactgcagagtgattgcatggccatcatcgatagtgtaggaatctgggccttaggatctaagcatccgattctgatgggccaaacccgtttgctacctacaaagaacatatgaaggattcagcttatcaacaatgtctggaaagtgaatagcctgaagacgttttcttgtttttcacctctactccctaaaaggccaattccttcctcttcactcacttcggcaggggaaggtacttgcctaaattcaatccatctttccagaataatttcaagcctatcctgataaggaaaagaaaaacttataacaacataaagtagtctccattgttcgagtctagttaccgagataacaaaaaactaccttggtcaaagtttgcagattgatatgcttgagcccttgataaatgccaaggagatcaaacgtggagaaaatcggatatagaacaaaaggtagacatgcctgcagtctagtacataaagcaagtcagaggattcagagacaaatctcacagataaagtaactctcaacggtactagattgagctaacctttggttgtgttggaatagcatatttagaagaaccgccagtaggagaccaaggttatcaaaacaaacagtttgaatctgaaaagtcacaaataaaatcaagccatgtgtgtgatacaaatgatagaaaagctcgagtaggttcgttaatgaaacctgtgcctttgcagagacttcaccaaggttatccgctacagcaaagcttcgatgtacagctgactatacaatgtcaaaacattggctatcaaaccaaaacaccaagcataaaacaaaacacttaagtcataaggaaaaataacaaataggaaaccttacaccggttgctaagtagcacgacaggctaatctgtttagcgatgttagcgatggaagctagcaaaaggaagtactgagggaatactggagtcattaactcaactccaatgcttagactgaagagtacagacgtcgagaacctaactctcttgatttagcaaaatcctaagagtatatgagtaacaaaaaatctccaaagtttcaagaactataatttagtgaagtaaaataccttcaaattagtgtcaaaagcagaagcaagactagcagtgtatatacatctacttaaccttccaagtccatctttcaaaatccagttaaaagcagcagatgaagctagtgaccgagattgtccaattcctattgctctaaacattgcctgaagcaacaaaaacaactcaaaatttgtaacaaacaaaagtccaagttcaagtctagaactgtgtcaatgttacctgagtggcaagaacttgtaaagcagagctgaaaactctgtgcaaaaacttccatttgacataacttatataattgtcactgacttgtttcggtaaaaagaagtcttttgcagctgaagaagtaagtcttatcaatttccagaaaccatcatcgaggccaaggcaaaacgacgtcgaatcatcttcttcttcatcaacacatagcagctccaaggaatctcctttgatgaagtacctagaaactttgccagactttttgattataattggaagacgacgagctacgttactgggtactacgaggtcttcttttgaagctccttcttgcttgtaatcaatggaagttctcagagacttgacgaattttcttgacgaaaatttggggaaaatgaagattggatattgggttgatgttgatttacatgggtattgaaaaagtcgagagctttgattcgttgaatgcatcagagttcttagggttttagggaaggttttgcgttttctacttcttcttccttctctgtaactactaactcggttctgtgagaataatcgtctggccagtcccttttttgtaaagagaaagccaaaaaatccttgtaaaaaactgaaataatttttgttttttttttaattcgaaatatatggatattactagtatatctccatccgaacctattaattaccagaaaaaccatggttcgtttccgaaccaaaccatccgaaccacctttactctttatttgaaaatcaaataaaaaaaccctaatatttccagggatttcccaattcgaagagagattttttgacttcttctccttagtaaccgttttcgattttttgacttcttctccttagtaaccgtttcaactgcaacattccctatttctttaaatttaatcgatcgttcttcttgctttcaccagtatttccgttctatttccgattcgaaatcagtc

SEQ ID NO: 11564 - DNA, 3000 bp, Unknown; identical to SEQ ID NO: 11557
  misc_feature (1)..( 3000): cDNA_ID_1807662_gDNA_ID_2214502_Annot_ID_133691 3000 nt of promoter + ATG

SEQ ID NO: 11565 - DNA, 3000 bp, Unknown; identical to SEQ ID NO: 11556
  misc_feature (1)..( 3000): cDNA_ID_2706834_gDNA_ID_2214502_Annot_ID_133692 3000 nt of promoter + ATG

SEQ ID NO: 11566 - DNA, 3000 bp, Unknown
  misc_feature (1)..( 3000): cDNA_ID_2706826_gDNA_ID_2214502_Annot_ID_133694 3000 nt of promoter + ATG
ttcttcagggagatcaccattctgatcttcgttcgtgttttcaccttcttctttctgtaaggaatcatcattctcaagcattggtacgtcttcatcaccagcaatcttttcttgaaaggaaagtgatctctttgcagacgcttgacttggtgttgtgtcatcagttggcgcccgtttggtttgaatcagataatgtgccacagacttatacccaagtgcagctatctggaaacaatccaaagaaagaaagaaatcttcagctctagattctattcaagaatcaaaaacaccacaagataatacaaaagaacaactgaaaaaaacgcacccttctgtaaatcgggccagttggaacccatcctttattattccggcacaaactgcaattgcagatcccgcgacaagcgggacaaatccagtctggattctcaagagcttcaagcacatgttcaccatatctgttcatcaaaaatattaatatacattcatcatcaataacagaaaaactaatagcaaccaacctcatgaacaaacaatcaccacagaactgtccttgaaccaaattgcattcactgcactgtgtacgatgccccatcgtcttctgcctgtaagaaacacacaaacacacactaaagcattacagaaaaatcatttcagagagttgcaatatcaagttctcaacacatatgagtttggttattacctgcattggtgacaagtcttaccgttaaacggatcataaatccgtttcccattcttatcatagccatcaacaaaacaagtccagcttctttctgtattcccaagaagcttctcatgttcctctgtgtaaatctcagctcttatcccttcaccaatcacaacactctctcgtttagatgctttcttgcccttctcattgatcccatcagtgtagataactggagttgtgttctccaatctaacaatcacagaagaaaagaatcaataataaacccaaattcttactttaaaatccaaattcttaaaccctagttttgcctcaaaaacccaattcctccagaaaaatctctcctttaaactgatacaaatcgaatcataatccctaattccacaaactcatctttcaaatccaaaaccccaaaatatgatggaatgagagaaacggagacagagaaaggaagagattaccgagaagatcggcgagaaggctgaagaggaggagtcggattctgaacagaattacggttaccgtaagatcttttaacgggtcgggtcttgggtttgagtttgcgagagagatttaagagacccagattgttcatcctctgaagattctctttgatcctctcttccctgcattgttcgtaaagagagacctttggggtttctttgattagttccggattagggtttgatttaggtactgaatcttgtgcttcagttctcatggtgagcatgatgatgatgaagatgatactgggtttcagatttcagaactctctgtcactctctttatggctgctctctggagaaatgatagtaaaagtttaggtttttatattgttttgagttgatgtcctgatgttacagcaacggtcggatttattatttgaaaagtgtgcttatggaaatggggaatagtgtttggaaatgtttactagcttctgtatcataaatccctaatgatgggacttaatctttttaaatatttttgtttccttctaattgcaatacagctaagtagagatagtgggaatatggaaagttgtaatcttttaagagaaaattaataaaccattctacaaaaattgttcttggtgcactttattaagattacgaatattaacatttaaacaaatttccaatagaaatataaagtttgacttttgagtaaagtttagggactgtccataagattgagagtctcaccttgtcaaccaaattaacaccaaatcccttcacatttaggaggatgtattcaatatagcatttggaatgatttgtattaagatgaaaaatatattttattcaaacatgaattctaaaaagctttctaaaatcaagtgttattggattaataattttaaaatctagaatcaaatctgctgttattagaaatattttaaatagtggatttgaattgacttgagagattttgggtgaaatttcaatgaatttttaaaaattcaaacattccctgtctcatagtttgaggtagattttaaacagttttaataacaaattttcgaattcactaaaataatttcaaaactcaataaaactcaaatcactccaaattctttctacaatacactcccttaatttttatttttttttcttttttcctatttttttacacccctttattaattactgtgctttactaaacttaccacacatacaaaaatatgaaatttaagttactaatatagaagaatactgttggggactagaatcacatgatcgttgttgtcataaaatctatcgctagttaaagtattaaaagatcgagaaaaaaaattattagttccccaaactcataattgtatgttaacattttctacccattttcttagatttgaataaggaaaaataatattttggttgtaaattgtaataactaaattttttccggatttgattatttgttttattttcttgacagtggtaactctgctcaagtgcttgccttcatctataaaattggagagacttttcattaattactgttccaacaaatttgaactacttttaattatgagtctaattaatacagagagagttcaagcgtccaacgaattaaaggtctcgttgttattttctcactagctaaaggaaaaacttggccacgttgatgaaccaccacttgaaaaatcttgaagcctccatttacatcaaaacagtcaaaccaaattcgcaatctcacaagtttcccttccatcccaaacaacactttattatctcttgttatatataaatctcaaacaataacactaacatttctcaaaatcaagaaat

SEQ ID NO: 11567 - DNA, 606 bp, Unknown
  misc_feature (1)..( 606): cDNA_ID_2706818_gDNA_ID_2214502_Annot_ID_133701 3000 nt of promoter + ATG
ttaattgttggcatcaaatatatacttcatcaaaaatgaaattctacttctttatatgagataagacttctattatgttgtgtcattgtgaacatggcttcaactcgtgagccatgagtaaattaataaatcttaatattataacttaagaaagattccctacatttatggcgtcgtcctctttcaatcttggtttgaattttctgatgtttaaagttttcttttaacagggctttcaattcttcagttggtgtctgggatttttcttttgtttgccagcttttacttcattttcgtggacatttgtatttatctttggttccacaaccagtttaattaataaatttcaaatgacacaaccaaaaaaattcctacatttctattacagattaacaggtgtcctataacctttttattttccttttcatgtgttgtttctagaaaacaaaatccagattattataattcttgatatcacaaaaatgtagaggaaagggaccatttctaaggaaaagtaattttaaaatccctttatctatgtgttgtgtcgtgtgtcggtgaagagtaagaagtcgagagacaaagttaaaagtagagaagaaaatg

SEQ ID NO: 11568 - DNA, 3000 bp, Unknown
  misc_feature (1)..( 3000): cDNA_ID_2706873_gDNA_ID_2214503_Annot_ID_133702 3000 nt of promoter + ATG
tcatgatttgctttattttgttttgtatatttcccacaattttaacggaattaccggtcaaagcctttaataatgatattgttaatttactttttttgttgttgttgtctttatttatctaactatgcatatagtaaagaattatgacgtccaaagccgcatgggaacctgaacacgacgaagtatttgtggacttatgcgtcgagcaaaagatgttggggaatcaacctgaaatgcaacatatattggaagcttttcaagaaatgggtgtgcggttcaccatagaccagcttataaatcattgggatacaatgatcaagcagtggaagatttggtgtagacttgttcaatgcaaagatatcaaatgggattccttgacaaacacgtttggtgccactgatcaagaatgggccaactatttagaggtacaaattaacaacgttttttgtgtgttgattttgattgtttatgaaggctaatatgtaataaaaagagcttgattggaattgtcataggtgaatcctgaggctgggcagtatcggtgtaatccccccttgttcctcgagaaactagagattatctttgcaggtatgaacttagatggtgaaggtacttcttcaggtagcaaaatgaagcaaatatgtgagcatcgtgatgaagaaaatgttactggatatgtacctaggctaagcgcgtctgatatcgcgactcgtcgtcattataagtggtcaccatcctcacatgcgattgttgtggacacgtgtttccaagagtctttaaaaggaatcagaccaatcaaacgtaaccatctttttacaaaggaaagttggaaaatgattcttgagaaaatcaatcggatcacaggactaggatacacacataagcagctcgaaaaccacttcacacgtaccaggacatcttggaagcactggtgtgaaactattgcctctcccatcatgaagtgggatgccaatactcgcaagtttggtgcaaccgaagaggactgggataaatacttgatggtaaagaaaaactttatttagatttcttagatatcaatttgtaattatattattatttttttgtcgatttatagataaataaaagagctcgagtcttcaaaaggagacatattcctcatgctgataaactggcaaccatcttcaaaggacgtatcgaacctggaaaaaccaaaacccgccgttatcgcaagagagtgatcgatcatcattcagaatcaccacagctacatgatcatcaaccaactccatcatcagtagtagtcaacacaaacgagccagtcaaaggaagtgacgatagagcggaggatggcaatgtggagcctacttcactgattaggtcagactcagaggatgttgctgaaactgtaactcccgagatgatggagaagattccagtgaatgcatcggtcaagaagaaggagaagtttacctttgaggaatgcgtggagtgtttggatgccatagaagaggttgagaaaggcggtgatctatacatgtttgccttggatttgtttaagaccaaagactacagatatctcttcttgatgttgcagaaatcaagtttgaggatggcttggctgctaaagcttctatcaaacccttaaattcatcttttcaaaaaaaaaaaaagtttatttttattttatgttttgttatttttcgttcatgtttatgagtattgtgcaaaactcttttctttctttcttgatcttaactattatgccaaactctctattatgtgtatgtgtaatacttaatatactggagagtaacctagaactcaacaatgtgagatattaggttattatgatttgagagagaatgtctagttcttgttataaaattattcgttttgtgcatctatatctctctgctatatctgactgaggcgaacatttctcgcttcaagttcaatgtaagtattacagattctgagttttcttgagcaacaagtaaccttcaacttctaaatgaattatgatttaggtagtgatgaaatacaacaaccttcattttatcttctttttgaactttttttgcctaaaaaagtaacgccacgtcaccatgcttgtgccgcattactgctttagtaattttgggttatttctcaatatacccttcatctttttaaacgtcttattcatggacctaaatttattaatgtagacttttatccaatccctttagctggtcgtccgtgccgtgtaaatcactttgcaacatcgaattccgttgattataaaatttctgattagattattgtttcgaatttggtctcagttcctttgacttgctatttcgataaatgggtttgtacgaaaatgttgattctatgatgttgtatcagcagctccatcaaatgctggactaaaagtctaaattttcaaaaagatccaactttttaaggtaaatgatccttgtccattttgatgcttgtcttgcaagtctttatgtgatgtttgaattccaattcatgtgtctctttgtttattagagtgctacaatttcaaatagtctcaagaatttttcagctactgctattgttccacctgattcatgttgccatgtttgggagattgatttttgtactttgtttattgtcacttgaagtttctttatgttatccacaaactcaagtttgaaactttcattgtcagctaatcatgagaactagttctttggctttaaacaattagcccacttgaagatttgtcaactaacaaaagaccacccgaagtcgtccttgtgtacgaacacaaggacactcttagcatatatcaacttgcccttttgacttgagatttgttttttaagtatttgattacaagagatagtgcttcaccatcagccaacatggctatattatataatctttagagtcaaaagtattggagaaagaaataagttttgcttaaacattgtagaagaggctggtattgaaatttttatgagatcaagagcttttttttcagtaatg

SEQ ID NO: 11569 - DNA, 3000 bp, Unknown
  misc_feature (1)..( 3000): cDNA_ID_3040417_gDNA_ID_2214503_Annot_ID_184060 3000 nt of promoter + ATG
gacatcgctttattctacaaagaaaatcctctgtaactatttttttttgatccatgaaacttttttgtttgtttgtcaatgtacagtcataattgcagttgcagagagaagagaagacgttgagaaatctctctgtctcctttttctgcagctgtgttttttgttttgtacgtttttgttgcatctgcccagaattggcgttcatgtatttttctacggcctttttcctagtggcagtttccaaccgtttgttcccgccattggtggttacttagttattgttattagcaacatctaaataaacctatttttatattcgcatttgatcttcttcttcttcttttctgcttttgtttatacatcttgttgtggctcttattagcaaacatcaattcgattataatctcattaggaaaaaatagttcaaacaaaaacttctttgaagtttgtttgtttgaatactgtagttatttttttttatatactttagttaacttcactttgacaatgttgtcttccaatacttttcgacttaccaaattaggaaatagtaaaaagagaaaaataaaaaaacagagaaatctgaacaaaaacatagtagctaaacaaaaaaaatgcattttactgtaatagcatgtaaatagtaatatactcaaaattatgtaataacagagtcaatataacaaaaatatccaagttcaataaatttaaaaatgaaattgtgaaataactaaaaacagtgtatgatagtttttttgtttctaagtactaaaatatacattgacatttcaaaactctagaacccaatcatctaaatatttagataaccctatgagtatttgcactaaatgagctaacatctcccggtgtaaaatctttatactaacccattttatcttggtttttttttataacaactaatatcaaattctacgaggaaagtctatatatggagccaaatttataattgttaaagtatatatatggtgtcaaatttatcgatgataggaaattgaaaagagaaaaacttattttcaaagctccacaagactattctttaattttaatagatgcttaaagttttttttccctatatataaatatatatattaaatggaaataaaaccactttcttattttcaaattttatcattaattataatatcacaaaagtactatgtaagggatgaatcacatttcaaatatgtgaactatatacaactatcacctattcattatacaattattaaatttaataatggtatatttgtcccattaatagaatcgtaaaaacttccaaatcctctttatatatgaataatgtattgaataaaatactctatgaattacttggttttttttttttttaaacagaattgtaagtaacctgcttcttatgttaataatgattttagcaagtcatcaagatttagtgagatacaaaacattatttcaatttagataaattgtaaacagtataatcgccattagccagagaggcccatagcttttttctccgagccgggtcggcttgtattttactaaattacccctaatttctctgggtatgtatttctctgggattaaacatgggcaataccgtagtttcaacagtactagtttcatcgccgatcaaaaactagcaacgaaccaatgcaccttcgatcccgtcctctcatggccacgttgcttgatttcgatttcgagcttcttattttttattttcttcacgaaactcgttgaaacgatctaatcttcaacatctttgatttttggtgttggggtttgttgttatctgcggaatttttgtttcctttgccgcggtttttgattcagaggtacgaattgtttcgtttttcctttgtttcaatctttgaactttgatctggattattagggttttatttatagttacttaattgttgattaggctgcttatttgaagagtttttagttcgtttatgtttgattcagttctctcctagggtttcgtgtttaaaagtatccatggattaagaattcttgcttcaatgttgatttagtggtaatgaagttagattatggtgaaagtatcagtcttttggattggatcagttcaaattttgtagttaagcttggaagataacttgttctaagttggggaatatgttttagtgagtaatagacaatgtagattatttgtgatgaaggcaactaaggaatgatctttttcaaactttctcagggtttaattatagctgtctaattgtgtccggtgttcaacaaactaagtggaagtgaattttggaggactttcttaacacatatcacttggattctctgtaagtgaaagcatagtttctggaaggaagttttgagtaatttgaataatatctctgttcttgcttagttcattttcgaattttactatagtttttttttatctattgtacatttagctactgtgagttcttaatgcatttctttattggggttagttcttaatttgggatagattagtggaagtatttagaataagattttgctattatggaattgagcattgttctggcagtttctgtttaaagaccataatgaatatttgctttggaagccgaatatatgcaatgactgcgtgaagtaaccaaattaatctgaagctacataaagggattcctttgtttgtgtatagtctagatgttggagtttgttctttggccttttcaagtgttgggcagtgtaaatcaaatatttcacttaacgttctcgcctattttcatgtttacgttctacataaaatatctctggattttttttgttttcaagtaattttcaaatgccgttctggaaaactcttttggtgtttactaatgtattaattcccgttgttacatggcaggtgcattttaaatcaattatttgagtctgagaaatcagcatttatgtgctacagcttgtcatgctccagtgtgtattcagtgtttattataaaatataagactttcgagagctgagggaatg

SEQ ID NO: 11570 - DNA, 3000 bp, Unknown
  misc_feature (1)..( 3000): cDNA_ID_1015231_gDNA_ID_2214503_Annot_ID_184056 3000 nt of promoter + ATG
atttgtcgttttggataatactattaattgggaacatattgactaattaattttgataggatattctgtttacttttggttcagtctcaatctttgtcgtccgatccaaatgtcaatccctagtcaaatttgttataatttttccaacaaattttgatgctattttggatgtgacacagaccataccagaatcactaacagcgagactactcaacttgatagcattagatgttcactcaaatcagatcaaagctcttccaaactccattggttgtctctctaagctcaagactctcaatgtctccggcaactttcttgtatcctttcccaaatctatccaacattgcaggtttcaccccataacttccacaaagctctcacaagacaacactcccaacaaagcataattcccatttttgttctctttttttttttttcaggtcattggaagaactaaatgcaaacttcaacaaactaatcagattaccagactccattggttttgaactcaccaatctaaggaagctctctatcaactccaacaagctaattagtcttccaatctccattactcacctcacatctctccgtgtccttgacgcccgtctcaactgcctcatgattctaccggatgatctcgagaatctcatcaacctcgagatcctcaatgtcagccagaatttccagtatctttccgctcttccatcttccattggccttttaatgaacctcattgagctcgatgttagctacaacaagatcactgtcttgccagagtccattggctgcatgagacggttaaggaagctgagtgttgaaggaaacccgcttgtgtcgccacccatagaggtgatggagcagaatttgcaggtggtgagagagtatctgacacagaagatgaatggtggctcaccaaggagtcccagcaaaaagaagtcatggggattcggtaaattggtgaagtatgggacgttcaatggcggatcaagaagctggaatagagaggagagagaagggttcatcatgcctgagtaccgctccatcgacagtcttgcttcgcctaggtattctggaatgttctctccacgtcgtctcttttctccaagaacctatttcagcagataaaacagacaacagccaagagttttcacattcctataagccatgtacacctctgtagcatcaaggccaaaacaatccaattttgtctatcattttaatagtagcatcaaaaaatgtgtaaagagtatttcaatatgttcatcagattctagaattcttgtttttttcatatctatgcttgcaccaggtccctatttgactatttctatacacaccaaattttgttcacgaataaagtttgttctttcagaaaacctacccccttctctgcctgatcctttagctataagcaaaagacttaagatttatacagacaaagaaagcaatacttaaaacctaacatacaaggcctcacattctttaaccgtctagaactcactcagttacatactctgacaattgctgagaggaatcaacaatctttattcctctcttcaatttcacatatagtttgatgatcaaaattcaaaacaatgtacgtcatataactaagtatcaaaactcaattcatagccaaaggagaatattttcactttacaaactcctagttcctctactacaagttaagtctgtctgaagattgaagtccggcacacgaatccacttaaagatctcaacttttcttgacttctgactatagaatttgcacaatgaggcaaagagaactcaattgaacaataattactaggactttaattcaaatccaaagagacatgcttcaaattggtgactacggaactgagttcgaacactaaaaaagacacaacttttcaagtgatcactactcttataagtcaagttcccattacacataatctaaaagctaataaagataaccaggaatcttaatacggataaagagcatactcatgacataagcgatcacaatggaggagacaccagcaacagcataagaagctttaacactcttggctttgttcttatcaagcgctaaatcaagcataacaatcccaattccaccgagaacgaacatgaatccagaagagagaccttcaatgatatattgcccgttaacccgacccgacataaacacaacgggtcgaatagttccagtagtcggatcctgagttgatccgatacccggaggctcgacaattacgtcgtagacgaaaccggagactactaaaaagtaggtaaggagaattagagcgtatacagtcatcggagaaggaagcgtgaacgatggaatcttcagacggaggcgcggtggtcggagaaatgagaatgggacgattcggagaaggtggaatattggatccattgaggattgatctgaaccgtctgatacactggagccggtttgcgaatcggatcttggagccattttatcgaatcctccttggatctcttcctctctcaccctatcgacggaatcaggaagagtttcagaattggctttgtttggaaactaggataaagctatccattacacgaataaacaaacgtctatcaatttccttctttcgattttatccccagaagttatcaaagatgcaaaagagaccactttagttctaacttgtattaaattagaaaattcagactattttcgtaattttgttagaaatttgagactatcttcgtaattttctcacaaaatttcttagtttggacgttctgccgttttaatgtataacaaacgacacgtagttctatcttagattgaaaatccggcaagatttggttgctttaacgaaagtatctatctcccgtcatcttgcttcctcgttaaaggaagcaaaagagtttgatcccgtcgtcgagctttcgaactttcgatcttcagcttttctcaggtgacagacgtcgttgtgattcaaatctttttccggtgaacttaatttcggaggctattcg

SEQ ID NO: 11571 - DNA, 3000 bp, Unknown
  misc_feature (1)..( 3000): cDNA_ID_2706901_gDNA_ID_2214503_Annot_ID_184054 3000 nt of promoter + ATG
tcctccatccacgccgtgacctgatccgtcaaggcgttgttaggaagcttaaatctgctcatgaacttgttgtcgccagtacagatctgaagatatccttcttcatctacgaacgcaatcacttcgtcttgatccactcccggaagatacgctttgaaaacgtgagccgtcggagtctcggtccaattgagctgcgtattgacggtggatgatgaagtttgtgggaatatttctcgagaaagtgagggaaagtggtgagaaagaaagagagctggtgatgggaaatcaagaaaggtgttcatgagttcaaatggttcccagattctatcgccgggagatagtctccggcgattgctgatcggaatcatcgacatcttcttcttctctattcttagaaagtaacagaagctgagttataaatcttgatcttcttactcaagagaattctagagttttcttgagagtgacgtttgtgatgattatgaagcacagtaactgggcctagcgtggaagcataaagcccaatagaaaaggcctttttcttttttttcttcttattcccggaatccgacaatgttcaaagtgtgtagtagattgatgaagaaaaccagtgtcattttggtagataatcgtatggaggaattttttcttgcaaaagtgatatatatggtggaaaaatatatatgtaaacatagatgtttattgctcttccgcatttgtgttaaacaaatagtgtaacaatatcaaacagtttttttgtttcgtccattcgattgataaagacaaagatcattacgcattgcgaaaatcgaacattttgattaaagactacaaaacagaacacctgacattaactactactcgagggacgaatcgatctttcgtacggttcttgagaaagcaagaatgtcctctggcttgctagcgccatggtcgttgtctttgttgccatcatcgtcgttggaacctctgtcttccactatagattcacgaatgatggttcttatcgtgttgtcttcggcttttcccgcctcgttggtgacgactctctttttctggtctttctccattctctctttcgttgcctccatatctctctcgttctcttttctctagctggtgcaatattttcttgaaagacttctcgacacgagatttgagaacacgtggcacgttagagatgataacgtggtcgtgttcgatgtgaaggtgttttcttcgactgatacgtggagggatgagtcaaacgaagagaaaatgttacaagaaagcccctcagaccatccttatcaatggactcttacatacaattctaaacaattttgatatacaaaataatgtttaaatattaaaaagattcttacaaaagtaaaaaataaagaagaaaactcttaactaagagccattttccatctcttaagcacactttttaattttttaattcttattttgtttaatataatattttgatattgttaacaatctattgataaggatgctctcaaacgagtgatgtatttcgaaaatgaccttttgaacgatcgttaaaatgagtttcattcaactttcatctaaacaaatcgttttgaatctacgtgtgaaagttggtatccgtttagaaaacaaccggactgctaacgtttaactcaaaccggttttaatattttccaccaaaagaatttgttttagcttctttgtagtatttataatggagtaactcaaatgaatttgacgtttattaagcttaattagggttaatcatttagggaagcaattttgatactattttgccaatggggtggtacttaaaatggagcttgtgaaatttttggccatgaatggatgttcttttccagttcagtttttggatttggtttttattttttttaattattttaaacaaaatttagattttagttttagattttgttattagatatttgtttttttttaaaaaaaaattggttttgaagaaaataatgtagttaaagtaaaaaatagattccttaaattatagaagaactaaaaatctaaaatcttttaacgggagattatatcaaaactctttcttaaactccaaggaaacaaattttacaaacttgattggtatgacaattattttttgaagaatgaaaaccaataactctgtcaaaaattgcaaaacattcaattcgtgtattcacacttatgaaaaactccacgaacaaagctaacaaagttgctttactttttagttacgtcaatttaagttgatactatatatttttaaaaatatatattcgtatagttagttgatatattcgtatactaacttgatctcactcacctcgaacattatcggttttggtgggatttgaaagtgaatagagatgaatgagatcatgaactttattttacaaaaatcagagtaagaataacaaaatttggtaacgggtacatatgattagttaccgattaaagagattgacgtgtcaactatattatcaataggaatattcgtaatttttttactcaagttccagttcaatgctttttgatagttcttttttaataactagtgagaacaatccttttgatttggtcaaaagatgccaataaaacattaaacactgatagaaagaaaagagtaatttgcgttagtatttgactttttttataatcaggtggttaagaaactttgaccactaataaaatgccatacttctttaattacctaattttattaatggcttggatatttggattaatttaaattgattacttccttttaaaactctccaccgtacatgcatctcctatttccgtacacacacatttgttataccatattaagcttttaaactctctttcttctctgatcattctcttcttcttcaaacaacatatacataaaatcatacacacacgtatatatatatatatatatagatagtgtgaaagatgatatgcgaggaggcatatcatcagcaaccgcaaatacaaaaggaacaaatgatgacg

SEQ ID NO: 11572 - DNA, 3000 bp, Unknown
  misc_feature (1)..( 3000): cDNA_ID_3040436_gDNA_ID_2214503_Annot_ID_184049 3000 nt of promoter + ATG
agtggataagcataagtttatgttgccatagaattagctggatttcagatagctgccatccttctctctttgcaggatctcaagaaggccaagaatagtaagaaacaatgttctgcagtgaattggcttcaatgcagagaagaagatactaatggagttatctgcggaaagtggcgtaggtaagttaaacaattttgcaagttccattatttggttcatgctctcgtcttgaatgtaacttactttctatcgccttttcatcagacttcttaccaattaccaataccttcttccttgtctaaatatgcttaatttgactggatatacacagggcccctcgttcagaggtacaaaccaaagactgggaatgcttctgctgcttctcttgggatccatcacgtgctgactgtgccgtccctcaggtcagaaactctctttacaactatcttatttcccccaaagaaaaatccttccgaggatgaaaagttagcagccgtgagaggatgaaaagcattgaaaattattgaaccgtcttgcttcatctttctccatgaacatgtcatctgtattcttgaacagatatcttaatactcctaaaagagccatcgaagtttatacaatgcatcttgtgttcatttctgcaggaactggagacaagtgagatccttaaacaactcaagtacatcaagatggttcgttatttttctcattacttgtttgatctttcccgaccatattcctttctgatcaaggatctaaaactgaaacggtcggtttcctctgcagcttagacctcgatcagacgccaaaaagcgaaaactaggaccaaagggtcgaagcagatcacatatcaaaggaaaatcttgatggacacaatcaaaatgcatatgcttttggattagagagaccttagaaactagaaaggtaacatcagaaattttttgtgaagcgccaatgctttttgtactacttgaggatatcaagttgctttctaagtgactaattaggttcagatcttttgttagctcccaaaacaggagtagtgaatagaacgtttgtgttaagggacaggttctgggttaaatgtgagattcatcttgaatgcaacaaaatctataatcagcttccgggtcaaagcattctgctgagattagattcattcacggaaatgagtattacattcaaagcttggatcttggaaaatagtaaaagaaaaaaattacactctgagttacagaaaatctgttgcaaatttcacaaattgagaaaaacaatagcggcaaatcaccatccgtatttagcttgtgtctcggctttcgtgagcaatcctctagaacgtctctctgtcaactccgactccttgtgcttcatgtccatgaacaacgcagtgatttgatgcttcctcttgtgaagctttgacactttccctttagatgaagatgttaccggctgcaagacaaatttgaacaaagacatcatttaaaaagcaatacaaagcagtcaagtatattttcagtgaagaacacataataaaattggtatgataatcaaagtatctcttttcctataaatccacaaagaagtttatcagcaaaacagaaagaacttgacaacagaagccccaaacaagagataatcttcaactcatattcaactcatatgctctctaatgaaaatctcctaccagcaaagggtttagatatacagaaccagagaatgagaataataagagacattagagacaagacaacacccaagttattgcaaataaatttcgcaagaaaaaacttgacaatggcagccacaaacaggagacaaattcacaacgctctatactctatagtgttaccagttcaggcttttctaaagacaattcctaagttcttgcagccaaaaacgagtaagaagagtttagagagtaaacaaacctgatacgcaggtccaaaggcgattccagtagatttaacctgatcaactcgtggcctattcttcataagctcatcttgcttaacctcaacaatctctggcatctgattcctccctctccttcctctcctcgcaccactatccatagctacaaccgcttcaggcaatcccgtcattgcctcaaacccaccaccattccaagtattacctccatagctactaccatcatatcccacactactaccactaggaattgtttcgtatccaccatcataaccagtagcataatagttatctactccaacgatttgttccgtttcgctattactatgactaaacgattcatagctctggttttgttgatcactaatacctgaatccgtttgaggaaatgcaattgaaggtgtttctgtttcgagattcgatcttcgacctgatcctgatcccaatgaaggaagagcacctagtgtttgtgagcttttaggtgcaggcatggcggataagaacgatcttactgatgaatcgtgagatgcggaagcagattccatctgtttacgcttcttcctagctttctcttcttcttcgtcgtcttcgtcgtcaagattgctcggtctagggtttactggaagcctgatctggacgacacgtttcggaattgacgacggattgggattttttttccgtgaaattgaggatttgggaggagggagagatgagaggaaagaagaagattttcctcgagaggaagatgagcctaaatcaccatcttcggaggatttgagttctttaggttgaggaatagctgagaatagagacgaagcggaaggttctgaggattttacagtgaaagcttctcgacgtggttgaagatcttcttcttcgtccgacgaagcgtagctcgctaccagagagtccattgcagagagagagagagagagagagagagagaggaagacttagccgtcgccgagatatgtcggagtatttgtcttatttatatgggctttttcaggagagatttaagacccatttaaaagcccatttggaagtgatgtgaaaaaaaggttttgccaa

SEQ ID NO: 11573 - DNA, 3000 bp, Unknown
  misc_feature (1)..( 3000): cDNA_ID_2706348_gDNA_ID_2214503_Annot_ID_184043 3000 nt of promoter + ATG
attcagcgagaagagtgatgtttatagctttggggtggtactcctggaggtaatcacgggccaaccggtaatttcacgttcaaggactgaagagaacagacatataagcgaccgagttagcttgatgctgtctaaaggagatatcaaaagcattgtggatccgaagctaggagagaggttcaacgctggcttggcctggaagatcactgaagtagcattggcttgtgcgtctgaaagtactaagacaagactcacgatgagtcaggttgtggctgagctaaaagagagtctatgcagagcaagaaccagtggtgattctggagatatttcttttagcgagccgacggagatgaacgtgtccatgactgttgacccgggggtgcttcctcaaccgaggtaatgcatctcagtttaaaagcatttggaaaattatgtgagctatgaaataaaaatgatttgtgattaagaagagaagaaaggttgggtataattgaattgtttttttttttgccttaaatcttagtaacggtaagttcttttatacattgtttactttctgatcgacactttaattcttgagctacatatatacaaacattctttaatggacaagaagaaaaaatattgttctgatacccttcaattgagctctattgttctgataaaaacattaatacataacctgtgagtatgggactggcttagtaaggtagatataaggaagaagatggtcacaaagagagtacatatggtaaagtaaagcatggttatactgtaaagtaaagctagtttatatagaaaactaactttgatatagctttcatataagaagcaaggacaagcctgagatcataaagcttccatgcaaaaacctttagagaaaacgtacaaaattaaaatctggcgggttcagtatgttacataggtcaaattacagtggaaatgatttagattgatgtaccggttcagaaaacgataaaggtcaacaaacaagtgtaaattcacctctttctgtatctccccatacgagaaatgagtatccagtaactcagcctgatgcagtcaactctacagataaatctgtgggcattactaaggagcacaaccttttacatggaatagtccagtggttccggaagcttaaacacactttgtcaagtgaggagacttcagatagaaaagcttctgatgccacaaagaccagtgatgttgaaattaaaaagaaccaaatcggttgccattctgagtcccacccccaagctttatcttcttgcagcaatggagactcaaatcagaatctgatgaggactctgaagaaccttggccagtccatgctctaacacattcaggtaacttctcagttctcatattcatcaaactggtagaagtatttttcgtatggttctgaaggtaacaagtatgagtatgttagtttcttgcctctagtggtataggattattgtaacaaagatatttagccatttccatgacaattcttctccgccttacaagctcaaatgttctgatgattttagtctattttatattcaggcagttgagttggttttccaacaagaacctagtctggttcaggcaggattgatagggaactttgctaaaaccaatttgatcgaaaagggacaagtcactgctacaacagcacttaaggagcttcggaaactcagtaatctgttgtcagagatgtgaggttgtgttctctcatttgtttgagtcagctctgtaaatacatttgaaatgtatattgttttagagtaaaaggataaagaataaaactttctgttttcaatcgaggtgtggttaggtctaaatgtgtagaggaaaactcatgaaagaaattgacctcaatttcttaaatatttttgtacattgatttattgagatgaagccaaatacttgttttagttcttgtgttaaaagggaataatgatgactcgtttaatatatgttgtggaagccaggaaatagtggaagttatgaatccaaaaacaataatctgaatctccttcactattccccaccactgcttcaggaccaactatgttctcattctcgtttgcataagatcggttctctgcatctttacttccctaccttgtctttctacacatcatataaggaagattctgttatgttatagcaatagcttctgaataaaatataggaacatgcaatatctacataacaaatttaaaaactcataataactaatctaattaaacaacataacatataaacaaataacatgtatttttcaaatttcgtgtaataaaaaatggcagttaaattaattaaataatgtgtattataaacaaacaatgtgttgttatttttttttcaaatttcgcacgcaaacttattatcttattaaaaccaaaaaaaaaatagtaatctcgggggtaattttatggtaattaacttaattgaactctataatttgactatcttttcaattaacccttcaatcacaatatcatttagtataaatgaagattagtcaatttttattttgcaacaaattaaaatcagtcaatgccaattaaaaagtttcctaaaagagaatccactcataccggtataaatagggcccttagacacctataatctcagaaaaaaacacaagaattctccatctcaagcagtgcaaatgccaaaaaatttagccatgatgtaaaattttggaattgataagtcttaaggttagttctagattcagccatgatgtaaaaaattcccatacatatttgaatgtatattgtatatagacttggtttctgtataaaactatttggaatgacaaaatctttcgctatcttccgggttctaaccaattatatcatgatttgctttattttgttttgtatatttcccacaattttaacggaattaccggtcaaagcctttaataatgatattgttaatttactttttttgttgttgttgtctttatttatctaactatgcatatagtaaagaattatg

SEQ ID NO: 11574 - DNA, 3000 bp, Unknown; identical to SEQ ID NO: 11568
  misc_feature (1)..( 3000): cDNA_ID_2706873_gDNA_ID_2214503_Annot_ID_184042 3000 nt of promoter + ATG

SEQ ID NO: 11575 - DNA, 3000 bp, Unknown; identical to SEQ ID NO: 11573
  misc_feature (1)..( 3000): cDNA_ID_2706348_gDNA_ID_2214503_Annot_ID_133703 3000 nt of promoter + ATG

SEQ ID NO: 11576 - DNA, 3000 bp, Unknown
  misc_feature (1)..( 3000): cDNA_ID_2706344_gDNA_ID_2214503_Annot_ID_133704 3000 nt of promoter + ATG
agagttcaattgcttttgtatcatgtgctttttctcatctttttgcaggaatgcacgagcttttggcacccctcctttatgtacttcatgttgatatcatgcgtctttctgaagtgcgtaaaagctatgaagattactttaccgatagatttgatagtttatctttcatggaaagagatatcacttatacctttgatttcaataagtttatggactcagtggacaatgggattggttcccaaggacattcaaagaattttaatagtctagatgagcttgatcctgaagtccagtccctagtgatgttgactgattcttatgggacagaaagtgaacttggtattgtcttgtctgaaaaattcatggaacatgatgcttactgtatgtttgatgctttaatgagtgggattcatggttgcttcgccatggcgagcttctttagttactctccagccagcggttcccacaccgggttaactccagttcttgaagcatgtagtgcattttatcgtattttggctgttgtggattcatctctgcacagtcatctagttgaacttggagttgaaccccagtactttggtcttcgttggttgagagttttgtttggaagagaatttttgcttcaggatctcttgttagtgtgggatgagataattttggcagataatagtgcaagaacggatgaggatagtagaaatcagaacttcaggatctttgattgtcctcggggaaccttagtcttgggaatgactgtttcaatgatattatatttaagatcttccttgctttctactgaaaatgcaacatgctgtctacaaagactattaaattttccagagaacattgacctgaataagataatacagaaggccaagttgttacaagctttggttttggatactgatatgttatcagctctgtcaattaatggtgttttcgaccagagcaattttgtacctgcaagaactaaaagttgctccacttcacctagatctcctttgattatcgctcctgaaagctattgggagaagaaatggagagttctacacaaagccgaggaagaagaaaataaaatttgtttggagaaacagactcctcctacacagaagaaaaagaggtggttgaatgtgacaaaacttttccgagcagtgattgatctatcacatcataagttaggaattggggaacggaaagcaaactcatctccagtgacacaaagtttgcttgaagattcgtctgagcagctcaatgttgattgtcatgtgactgtgaacaaggagaacattcatcctcaagaaactgaggaaaacattatggaattccattctgcagatgaagagagtatagtaagtggaagttcaccaagtgaggagagttcattcgtctccttagacccaaccagtcctgtcagatgttcaaccaaaattgaaaacgattcagttagcagtgctggctcaaatttgcttcccgatgaagacgacaaaagcatagtttcaattagtgaagagaattcatctgtctcctctgatccaatcagtcctgccatagattcaaattacagtggaaaatatttagattgctgtaccggttcggaaaacgataaagatcaacaaacaagtgtaaattcacctctttctgtatctccccataggagaaatgagtatccagtaactcagtctgatgaagacgtctccaccgataaatctgtgggcataactaaagagtacaagcttttacatggaatagttcagtggtttcggaagcttaaacgcactttgtcaagtgaggagacttctcatagaaaagcttctgatgccacaaagaccaatgatgttaaaattaaaaagaaccaaataggttgctattctgaatcccacccccaagctttgtcttctggagactcaagtcagaatctgaggaagactctgaagaaccttggccagtccatgctcaaacacattgaggtaacttctcagttctcatattcatcgtgtttcagcggttaccagcatttataaaaagataagtacaaagacagtaaaatgggttatcgaactggtaaatgtatctttcgtatggtcctgaaggtaactagtaagttagtttcttgcctccagtggtaaaggattattgtaacaaagatattttgccatttccatgacaattctttaccgccttacaagctcaaatgttctgatgattttagtctattttattttcaggcaattgagttggttttccaacaagaaccttgtctggttccggcaggattgatagggaacttagctaaaaccaatttgatcgaaaagggacaagtcactgctacaacagcacttaaggagcttcggaaactcagtaatctgttgtcagagatgtgaggttgtgttctctcatttgtttgagtcagctctgtaaatacattatgaaatgtatattgttttacatttgtttgagtcagctctgtaaatacattatgaaatgtatattgttttagagtaaaaggataaagaataaaactttctgttttcaatcgaggtgtggttaggtctaaatgtgtagaggaaaactcatgaaagaaattgacctcaatttcttaaatatttttgtacattgatttattgagatgaagccaaatacttgttttagttcttgtgttaaaagggaataatgatgactcgtttaatatatgttgtggaagccaggaaatagtggaagttatgaatccaaaaacaataatctgaatctccttcactattccccaccacttttccggtttggaaattgttgtgaatacactttcgtaagtcgttgacattatattgaagaaactcttataaaatcacaaaatacccttttggcttatagtatatatatgctttcagggaaggtggttcacatgttggcaacatgcctattgaatgactgaaaataacaagcttttcatatataaggtttagtttgaatctatgagaaattgattgagaattgtgactgatg

SEQ ID NO: 11577 - DNA, 3000 bp, Unknown
  misc_feature (1)..( 3000): cDNA_ID_2706911_gDNA_ID_2214503_Annot_ID_133705 3000 nt of promoter + ATG
tgcgagactaatggcaatggtcaggaaaaatatgagagcagcgctatcacgaatttcaacttctgtttttcgcttgcatctaagagttaaacaagaaaaatatctgcggttgaaggaagaaaaagagacacttgcctgctgagtgaagcagtctcgtttgcagaatctcgaagttgattaatctcagtcttgtcctcgttgattgctatagccccagaattttcagagtgccttataatagtgaggttgttgagagagaccttatttaaatatcttagagcccaccttcttactcatcaatgtcagatgttgttgcaccatttgctgacctgacaatggaattcaggatatgattaccgacaatagattttatgaagaaccaatactgaaaaaccaatgtttattagcgacatgaatgaggatgttatagcctaacacgttctaactgtggatgctggatacctataacaattggaaacaagtactttttcacggataccttctttagttcaaaatccaaattttatgaaaacaatgccccttatggttttgcaaacatctgatgaacttacagctacataatgccagcagttagaacattttagacgcagcaatcagatatcttatataaactacagaagagattagaaaataggaagcagatgttagaccataataaccccactaggaagtctgaaaaatagaacttataccttcatcttctacggagagtctttcctactctttggttgtttctccttccgggtctctctaataccgttgcacatagttataagtttgtatctgttacttagacctcagtcttcgccttcaaaaatctgctcatctaaaagacagtcgtttctgagtaatgataaacaagaaaatcataagctataacagtttaccaatagtgttgcaaaaaaattaaactggaatcattacataacgagaaggtggttaatattgtgagcatgaaagggtgaaacaacttagcacactgcattatcagtcttgcgaaataattggaggacaaatcatatgaatcttcataccattggatactactaccaacttggttagtcaataaacaacactggcatgcttttttatgcgtaaactactgtcctatggagaatctcaaaaacggagtttcttctactttgcttttttttgagcaaatcactgtatttctcccgtaaacaaataaagggattaaaataaaaagtactcacatagtatagtccactgctctccattgtcttggcatggatacaatttcttcattgttggtttcacctaaggggaccctgtttccaagtgtacgtatgacagttcttctaaaacacggctgccgaatcctatagaagagcagctcaagctagttgaagttatgttgccatcttcatcgctagcatttcccaagccactaatgctatttccgtcttccttcgcttcaggatcataatcaccattctcagagtcatcttaaggctaatccacattgtcattgagtaacatttcagaaccagtatggagactagcttcacctttgaatatatccaagaggagagtacaaagtctcagaagtagaaggaacattacagtgttcattgctgtttgtctcttttaccattctaaaaacctcattacagtgttcttgcaactgtttagcaattccaactgctgctacgggatcttcaaaactcttaaaaagagaaagaacagagaattatcaaaaagagccaggcaatattttttatcatcgattcatacactccagcaataccttaaattaatggcaacacggttactcttggatagcaccttcttcaggttggtagattgcaactaaaagtggcttgcatgggttcctaaagctgattccttctctttcaactatattgagtattaaacatctgtagtagctctatatcagactcatatagagaaacagacacagagacgcacgtcaaattcctctttttaaaagtagtgatacacacgaagtcaagtcaatttagaaaaatataacgaaacacagacattacatatacagagtaatgtaaactgttcaaagatcatattgaaactgttgttgagcagtgtatatgataaagagcaaaaattgatgcaaagccagaagccatcaagtcttttcgcatctgaatcgaaaaattgatacagaactgcgataaattacttaccgatcatgcgtggtcggttgagtcaccggcggcgactgacgaagctgtggggtttgggttcgtcgtcaccttcaactttactttttgttcaactcttaacgtttttacatttgagcccctctatttaacaatctatattcaatttgttttatgttcatgaaatgaaaattacattccattccctatatttttgagacatatttcaaatttgtttgttggttttactttggaaaaaagaaaataactgtttcccaaaaaaataaaaataaaaataaatccataggcaattaacagatggtcaatttaattatgcaaaaagagaaaaagatggtcaattaattaattatcaaagaaaaatctgattatagggtatttcaattaagtgataatttatttttcagtgataatatattactgatatttaataccttttttctcaacattcctggaatgactcttttgtgctctaattaattttggatttttttctcaacattattttaataattaatacccattttttaggttacaattaacaaaaagaacaagacaaaattcaattttaatttaattagcatttagctacttgttcttcttcatcaatcggctcttcgcgcctggaatctctcacgcaacagacaaaattcatattttcatcatcattcatcgtaagtagtttcatgaagaattaacaatgtttatcgtttggttatagttttgcttatttatctcctcggagctgtgtgatttaacttaaaattgatagagaagcaaaagaggattaagctatatg

SEQ ID NO: 11578 - DNA, 3000 bp, Unknown
  misc_feature (1)..( 3000): cDNA_ID_2706866_gDNA_ID_2214503_Annot_ID_133707 3000 nt of promoter + ATG
actttttattttaatccctttatttgtttacgggagaaatacagtgatttgctcaaaaaaaagcaaagtagaagaaactccgtttttgagattctccataggacagtagtttacgcataaaaaagcatgccagtgttgtttattgactaaccaagttggtagtagtatccaatggtatgaagattcatatgatttgtcctccaattatttcgcaagactgataatgcagtgtgctaagttgtttcaccctttcatgctcacaatattaaccaccttctcgttatgtaatgattccagtttaatttttttgcaacactattggtaaactgttatagcttatgattttcttgtttatcattactcagaaacgactgtcttttagatgagcagatttttgaaggcgaagactgaggtctaagtaacagatacaaacttataactatgtgcaacggtattagagagacccggaaggagaaacaaccaaagagtaggaaagactctccgtagaagatgaaggtataagttctatttttcagacttcctagtggggttattatggtctaacatctgcttcctattttctaatctcttctgtagtttatataagatatctgattgctgcgtctaaaatgttctaactgctggcattatgtagctgtaagttcatcagatgtttgcaaaaccataaggggcattgttttcataaaatttggattttgaactaaagaaggtatccgtgaaaaagtacttgtttccaattgttataggtatccagcatccacagttagaacgtgttaggctataacatcctcattcatgtcgctaataaacattggtttttcagtattggttcttcataaaatctattgtcggtaatcatatcctgaattccattgtcaggtcagcaaatggtgcaacaacatctgacattgatgagtaagaaggtgggctctaagatatttaaataaggtctctctcaacaacctcactattataaggcactctgaaaattctggggctatagcaatcaacgaggacaagactgagattaatcaacttcgagattctgcaaacgagactgcttcactcagcaggcaagtgtctctttttcttccttcaaccgcagatatttttcttgtttaactcttagatgcaagcgaaaaacagaagttgaaattcgtgatagcgctgctctcatatttttcctgaccattgccattagtctcgcacatgcttttcgcaacttctaagatgtcacatctttgtcattgtctgagttttgatgagcttaaagcaacttctagaagacaaagagacaagaagaggacgagtttgaagcactaatggagaagctttgtttacacctgaggcactagccattgagttttaggcaagtcttcttgttttactcccaagaggactcaatagcagaggcttttgagcttctaggagaaatgttgttatgttgcagaatcatatgtatagttttgtattgtttgatcctcttggaataaacaagtctaagtcttgacacatgtagctttgaactttctgcaacagtgtaacacctatgtatgtaatatataataaaaatgccaaatattttgtggttcttcattgtgatttggttaacaaatattgaatctgtgaatcttctctactgatacagttcagattcagggatcagaatgcaagaaactaaaaaaagagacccattttacacaagaacaaaaaatctgagcggtttaattataaattagattttgaagttatatatataaatttttccacaggaaaatcaaagaaagttgttttgccagtgagttagagagagagagagcgatagagcgagagagagagagagcttgcgtcagtggaggagtcggaaacttgagaaacttgtttagaagaaacgccataacttggagaagcccaaacgaggattttgctcttgtgtatcttcgtagtccatctggtaaatgcgagattgttcttcttgttacgaaattgtttgtttgtgtatcgctgttcattgtattgtttgttgttttgtactggatttggctgtgctttgtgaggtatatgaaggtttctgcaattactggaattggattttggtgtttagtctccgatggtttgattgtgttctagggttttcataagaacggaagtctgttttgttgtgaatttctcagaaaggtaaaatttgttcagagattgttgagattaagacttgaattttagcataggaagagaaatttatgtctagcttgaatctaggttgaagggtgcatggtgctttaaacgactgaaagattaagatttctcagagattgagacttgaattttagaataggaagagaaatttgcttacttcacaaacgttttgtgcaacctggatttaagatgatatagatatgtagcttgaatctaggttgaagggcgcatgggtttccagattcgagtcactttagatccgaatttttgtagttttctaaacttgggtgctgaatttggatctgaatagcatccaagaacatcctggattactaacttactgaggattaaaggtttttctgaatggaaagtttgcattttatcactagttaggaatccgatttgtttttctcagtgagacttggagatgatgagaacagtatgtgtccgcttaatgcagtaccacaaaattattcaatcacgaatcaggagagcaaccttttgagcgcctgataagttactggagttagtttaaaacaatgggtgaaattgatccaaattagtgatcagaagataacttactgtttcttcgttatggtactcatggacttggttttcttgcattttgactctgttccatgttttgctttcgacatttaggtgatcagaaggatatgagcattaccattccagagggactacatgaagaagtcgaccaacagattcattggtacttagagaagtaatgtgctttcagatacttttttggtttctcaggaaaac

SEQ ID NO: 11579 - DNA, 3000 bp, Unknown
  misc_feature (1)..( 3000): cDNA_ID_2706901_gDNA_ID_2214503_Annot_ID_133714 3000 nt of promoter + ATG
tccggcagctgtggcggcgacgaagaagcatctttctcaacgaacacgacaagaaactcgtcctccatccacgccgtgacctgatccgtcaaggcgttgttaggaagcttaaatctgctcatgaacttgttgtcgccagtacagatctgaagatatccttcttcatctacgaacgcaatcacttcgtcttgatccactcccggaagatacgctttgaaaacgtgagccgtcggagtctcggtccaattgagctgcgtattgacggtggatgatgaagtttgtgggaatatttctcgagaaagtgagggaaagtggtgagaaagaaagagagctggtgatgggaaatcaagaaaggtgttcatgagttcaaatggttcccagattctatcgccgggagatagtctccggcgattgctgatcggaatcatcgacatcttcttcttctctattcttagaaagtaacagaagctgagttataaatcttgatcttcttactcaagagaattctagagttttcttgagagtgacgtttgtgatgattatgaagcacagtaactgggcctagcgtggaagcataaagcccaatagaaaaggcctttttcttttttttcttcttattcccggaatccgacaatgttcaaagtgtgtagtagattgatgaagaaaaccagtgtcattttggtagataatcgtatggaggaattttttcttgcaaaagtgatatatatggtggaaaaatatatatgtaaacatagatgtttattgctcttccgcatttgtgttaaacaaatagtgtaacaatatcaaacagtttttttgtttcgtccattcgattgataaagacaaagatcattacgcattgcgaaaatcgaacattttgattaaagactacaaaacagaacacctgacattaactactactcgagggacgaatcgatctttcgtacggttcttgagaaagcaagaatgtcctctggcttgctagcgccatggtcgttgtctttgttgccatcatcgtcgttggaacctctgtcttccactatagattcacgaatgatggttcttatcgtgttgtcttcggcttttcccgcctcgttggtgacgactctctttttctggtctttctccattctctctttcgttgcctccatatctctctcgttctcttttctctagctggtgcaatattttcttgaaagacttctcgacacgagatttgagaacacgtggcacgttagagatgataacgtggtcgtgttcgatgtgaaggtgttttcttcgactgatacgtggagggatgagtcaaacgaagagaaaatgttacaagaaagcccctcagaccatccttatcaatggactcttacatacaattctaaacaattttgatatacaaaataatgtttaaatattaaaaagattcttacaaaagtaaaaaataaagaagaaaactcttaactaagagccattttccatctcttaagcacactttttaattttttaattcttattttgtttaatataatattttgatattgttaacaatctattgataaggatgctctcaaacgagtgatgtatttcgaaaatgaccttttgaacgatcgttaaaatgagtttcattcaactttcatctaaacaaatcgttttgaatctacgtgtgaaagttggtatccgtttagaaaacaaccggactgctaacgtttaactcaaaccggttttaatattttccaccaaaagaatttgttttagcttctttgtagtatttataatggagtaactcaaatgaatttgacgtttattaagcttaattagggttaatcatttagggaagcaattttgatactattttgccaatggggtggtacttaaaatggagcttgtgaaatttttggccatgaatggatgttcttttccagttcagtttttggatttggtttttattttttttaattattttaaacaaaatttagattttagttttagattttgttattagatatttgtttttttttaaaaaaaaattggttttgaagaaaataatgtagttaaagtaaaaaatagattccttaaattatagaagaactaaaaatctaaaatcttttaacgggagattatatcaaaactctttcttaaactccaaggaaacaaattttacaaacttgattggtatgacaattattttttgaagaatgaaaaccaataactctgtcaaaaattgcaaaacattcaattcgtgtattcacacttatgaaaaactccacgaacaaagctaacaaagttgctttactttttagttacgtcaatttaagttgatactatatatttttaaaaatatatattcgtatagttagttgatatattcgtatactaacttgatctcactcacctcgaacattatcggttttggtgggatttgaaagtgaatagagatgaatgagatcatgaactttattttacaaaaatcagagtaagaataacaaaatttggtaacgggtacatatgattagttaccgattaaagagattgacgtgtcaactatattatcaataggaatattcgtaatttttttactcaagttccagttcaatgctttttgatagttcttttttaataactagtgagaacaatccttttgatttggtcaaaagatgccaataaaacattaaacactgatagaaagaaaagagtaatttgcgttagtatttgactttttttataatcaggtggttaagaaactttgaccactaataaaatgccatacttctttaattacctaattttattaatggcttggatatttggattaatttaaattgattacttccttttaaaactctccaccgtacatgcatctcctatttccgtacacacacatttgttataccatattaagcttttaaactctctttcttctctgatcattctcttcttcttcaaacaacatatacataaaatcatacacacacgtatatatatatatatatatagatagtgtgaaag

SEQ ID NO: 11580 - DNA, 3000 bp, Unknown; identical to SEQ ID NO: 11570
  misc_feature (1)..( 3000): cDNA_ID_1015231_gDNA_ID_2214503_Annot_ID_133716 3000 nt of promoter + ATG

SEQ ID NO: 11581 - DNA, 3000 bp, Unknown
  misc_feature (1)..( 3000): cDNA_ID_2706889_gDNA_ID_2214503_Annot_ID_133719 3000 nt of promoter + ATG
cattgacattctgattcctaatatttcctttaagcttctcctcaattcttagttcaaggtagaaacgagtttgctcatcattccacgcaagattcttagttgatcatgtgtttttgtacaaaatcagtctaaattacagaaaatattacagtaaatctaagtttagaggagaatatactcacatcggtaccattgatagttgtcatctgtagcacacaatgaaaacaaacgttttgtagttgtgtttgaacaagatcaaagataccaaacaaataaaacaaagatcagagataacaaagcaaacaatacacaacttatgataacaaagcaaagcaaataaaacgtgtacaaagatcagagataacaaagcaaagcaaagaaaaactatttgatattgaacaatcatgagatattattcttgactatttctacagtatttgaactcaaaccttagacgaactcatgctactactacagaaagccaaatgcaaccactaattaatactatttaatatcgaaagcaatatatttacagaggacgtactcgagaaaccaaagctttcttacttggagacaaaacttgctgaaacaaggactgaagagaaaaaatcttttataagatgaaattctcccttataaataagcagttataagctataaacacaaaaacaattccactttggatgcaattgaacacgtcaaggaggcagctgaggtttgtaactatggatggtcaatctaaagagggctaaagtgcagatgctaaagtggcagcaccaaatggttatgttgctcctaatgtagagacaacaaagcctcttaagagcaaatcgaagactcaaaagcaacacaaagcaagcaaagcaacacaaagcaatataaggaacacaagccgtaaactaaagctaatcgaagaatcaaaagcaacacaaagcaaagtaaagcaaacccacaattaaacaatgtaaccatggtggatcaaacccaagaacaagtgattgcaacaaggatacaaagagaaacaacgtgagagacatggagcgagagagaggaagcgagagagagagagagagagagagagagagagagagagagagagagagagagagagagagagagagagagagagagagagagagagagagagagagagagagagagagagagagagagagagagagagagagagagagagagagagagagagagagagagagagagagagagaaacacaaacctgctacactggcgaagaatcggcgacggcgatttgtgaagaatcggcgacggcgagatcaccggcgaagaatcagcatcattgacggctatgaatctcaattttgagtgttttgtgtcgaggagagggtgaagaagagatgtgattttgggtgtaattccatatattagattagggtattatttttgttataattttggctgaatcagcttcagcagaatgaacaaatcaaactcagtcagattttttttattttttggatgaatttagaaaaaagcattcaactgaatcattcgaatgatctattaaaacatgaaaaacaaacaacaattttcatcttcattgagatggttcatccaaatggacaaacaaacaggaccatagtactcaacttgaaaccattgaagctggttggcaggttttagtctttcttgcaatatttgcatgtttatatataaatatattctaattttcttatattttattcattgttttgttattgattaggtgtgcactgtactttataatgatactaaccctcgatactttgtctactggactgtgagttaacttccaaagtattgttaaattttctttgttttttttgttgacaaaaaatctcctaactattttttgttatgtgtgttgtttgattacgtgaaaacagaatgattcatatacacaacatggttgctataacaatctttgctccggctttgttgttgtcaaccaagcatttgctctaggcgcggccgttcctgaagtttctatccgtgatggtctacaatacgaaattttcacaagtatatggaaggtaaaaataagggctctttttcatcatataatttcaagaaatactcttttatatatagaaactgaaactaaatatgttctattgttataggatcgtagttcaggaaattggtggttgaaatttggtactcatttaattgttggatattggccttcttcattgttcaatcgcttaggagatgctgcgagccaagttcattggggaggcgaaatagtaaacgtaaaggagaacaaccaacacacgtcaacacaaatgggaagtgggtcgtttgcaataaatggatttagaaaggctagttattttaggaatattttagtacttgatgaaaacaatactacgaagcaacctgtaggtgcttctacatctgagacggaaggaagttgttatgacatcaggtatcgcactgatcaagcatggggaagtttcttttactatggtggtcctggtcgaagtcctttttgtgcttgattagatatgcatcttatatatgtaaaatattgtgtatcaatctatctatgtcagttatcaccagcatatagtattatatgtggtggtgaaaataaagtttaagatatcattatagttttgagactataactagtgtaagctagtgtaaaaaaaaaaaaaaaaaaagaaaaaaaaaaaaaaaaaaaaaaaactagtgtaagccaaattcatcaatagggttaaaaagatagtttaatggattgagtattgagttctcgaggaagttatattcttgtctaaagtgttatcacatttaacaaagtgaaacggcaacgttttggttgccacaagataaacaaaccatgtcgttttcgaattgtgaaaacagcacgtagttagaaaattcatcaatctgaaaaggaaaagggtttcaaactctctctaggcggtctccgaattagcaaattgaaattggcaaattgcaagagttttcgattcaaca

SEQ ID NO: 11582 - DNA, 3000 bp, Unknown; identical to SEQ ID NO: 11569
  misc_feature (1)..( 3000): cDNA_ID_2706885_gDNA_ID_2214503_Annot_ID_133720 3000 nt of promoter + ATG

SEQ ID NO: 11583 - DNA, 3000 bp, Unknown
  misc_feature (1)..( 3000): cDNA_ID_2706915_gDNA_ID_2214504_Annot_ID_133722 3000 nt of promoter + ATG
agcgctatcagccaataaaagacgacagctgtaataagactcgagacgagggaatcgggacttcaatatccgtaacggccgtacgggttcactctcgcagacaccttagcatgtggcaccgtcggaggtcgggcacatcatcgaccgatcgaccgacgtcggagttgtgctcggtctaaacaacattggtgctatgtaatctctctatgttgtgcatttgtgctcggccttaaatgtctacaaaatgattcaaatcatgacatgattaccatggttaatggtttatacggtgaattaaatcttgacttggtttaactgttgttataccatttttcagtttaaaatgttctattatatgttgactactacgttagggccggccaaacagtcaagaatgcagtcagatgaagccaccgtttgtgactctttaagtttaacaatcaaatgcatttgaatagagaaaaatataaaacaagaccaattagctcgtagttttaaaattaaccgctggattatttttaccagctctgagatggtcaaaacaagggtagacagtgtcaatggaaacaaagaatgaaataataaacaaaaatataaagcatttgatattaaaatgtatctatcaagaaaaagtactagttagacatgaatatgtcaatagtttgtcaacttttcgcatagataaatctcattttctttttgttgtggagaagttcacaatgatgtggttggttccgaacccaagatatcttcacatctgtatgtggatggaaaagcatatagaggaacggtggctgtatgtgaaaagggcactctagttactttattcttctgatggtcaatatgtcccctaccgtgccatagaatataaattgaaattgagttgcaactagcaatgaggcactatatattatcctggattcaaaaatccgattggatttgtttttaaagtttaatgtttgaaatgttcagatccaatttaattaaaaagacaatgacattggtgtggagatggtgaaggcaaacaacaaacaaaaattggaaatagaactaaaagactagaggtgagctaaactaaaggttttcgtggtaaatttgggatggagttaatctaatttgtgatatgttttttttagcatgttaccatgcattatgtacattcttttagttaaaaaatgttgagttgaagttaattatttttttatagcttaatatttttttttggtttaacaattagcttaattttgttatttgataaagactaaaacacccctggatgctcacccaccacatgcccacaaacggagattgccaacccccgggggagatgacgacagacgagaggagagaacagatttggagcttttatagcttttatagctatattgttaaaaaaaaatcaataatataaattaaactgcatgcaaaatcaaactcttgtacatctagagtcttactagattaacgtgtaagaacttagaacttggaaaaatctatatggacaaaatagatcagtcttttttcgaacatcatcaaccacacgaaatacgctagctaacttttaaacctcttctgtatcaactatcaagagacaaacgatataaaaaaaaaacaattggtgtatttttgaattttcattgcacgcacgtgaacagcataattgcttgattggaaacaaacctttttagaattcattaatcagttttaggtgttttggaaaattaacgaactatagtggagattaattaattttatattagtcttttttagtacacaaatcgaagtttcctagattttttcaaagttgaaaataatattgataatatttatcaacaatgaatctacaaaaacataatttttttgccaaacaaataacaccgaaacaagattcattcactatttttggtttaaaaaaaaaaatcaaaattacactattatgaagccaatttttgtatgcaaaaaacctgtatgtatcaatttgtttgtattaaaaagtaagcatttatgtcttttttttataaataatagaaacacttactagatgaatagattttttggttttagaacagaatactataattgtatttatatagcttttttatattattcgatatagaaaagtgttataataggaaaaatgtaccatatactgtcaataacatatttgattctaaatataaatagaattgttttaaagaaatatgatcgtttataattaaatggtttttaatgtcttttcttggggcaaaaaacaaagcttctctttcgtccatatatttgcatcgtaaggggtgacgtatcactctctctttctctcaaatattattcttcaatctctttttggggaatcttcgagcaaattagtgagagaacccacccactttctttctcatatgagtacataagatcccttttgagttttcgtgttttgccaaaatctccaggtaaagcttctccctttttctctgttttctctgttttgttattctcccttttctccattgtagctttttcctgtaaagtgggattgatagttttgtttcatggatttcaaatttgtgttatttgactcgataccatcttaaatgcagagtcttttcgtgataataaaattatggattcgtttcaaagttttttttttttcgtatggaaaacacttgagctctctcaatcttgtagtcttgactcttgatgattcttctatgttctcgttgtgattgcttgtcactgttctatcttttatatatgattaaatgcaattttgcccctttttacgcgcgaatgtatttattatctttcgcactctgggtccatttcttgtcacttgagcacataatgattgatttatgactttttaaagttatgaaaatttattatttttgttgctatggttttttggaattagaagctcatttcaaagttgttgattttctttgcagggtagggaattggtgtggtagcttgtgatgcactgtgtttgagggaaaggaaaggataacg

SEQ ID NO: 11584 - DNA, 3000 bp, Unknown
  misc_feature (1)..( 3000): cDNA_ID_2706923_gDNA_ID_2214504_Annot_ID_133724 3000 nt of promoter + ATG
gaaacagctttccgtatagcccatccatggtggggagcaaacacttgagcataagacttagttgctggatccttcaaggagttatctcctctgcaaaagatatcaaactacatttcaatcttctaatcttgaccaaaaataaaagaaaactacaacaggactccattttttcatttacttcagtgtccatatttaaatcacacatcctacaaactggcacggctaatgcatttgatcaaaattttcacaagaactcaaataagagagagttcagaagaatcacttactcggaagctatgatctgttcaaagagaactttgaccatgtcaagaccacgcttaaccctcaaaaggtttctcgtatgactaccagctttccttacacaatctgcctcaatatctttgtccatcattaccactaatgtcgatatcgaactcgacgccctcacaagatcatcaacctatagtcacattcacaagttttaacatttcattttccaaaacattcatcctccagataaacaaacacaacatccatttccatcaaattagcaaaattcagtctgagtactacagaaactaaatcaattccaacatctcacaatatactcaatagtacatgaaagtgaacacaactagaaaaagattcggactttgattcaaatctactacataaacaaaccttggcaacatagtccatttccgcaaacttaaaagctattccaaggcaaccaaagagaggcgagaccagagagcaagcgtgagagaattgcgttacaggaacttccggattcggtgaattcacgatgattgctagttttttgaaagcggctgagatttttctcagtggcttatctgcttccgaatccgccatggaagatctctctccttctctctctctgtcgtcttctcctgattaacaagttttgttcttgtgtgattattccgattggtgttctgtgatttgccgcggaatctactttgctgcaagacgactcaaaaaggcggcgattcgctgatcactaattgtctttgtttggcgttcagatcattcctatccttcatctggatagtattatcctcaccgtgtgaatgaataaccgaatccaaccgaaataacctgtaggaataccgaaataatagaattgaatccgaaccaaattcggttttgtgcaattgaaccgaagaaacataaatacgtatgcttaaactatagatagtagttgggcaatagacttgtgttgaagctacttgaagaaaagatgatgatgatgatgaattatgaataatgttcaagaattaagatatgaagctttcattgggatactttagttaaaaagattatcatcatcaacaaatgtgatttttttcaaactttcatttatgttccactctggctatacatatttttgtttttcgattcttttcattgattaaaacaaggtaccaaaattataggtaggggataataatatttagtgggttatactaataattattgggtagaaggaatggcggatgcaattattttgattacttataaaagatagtgacattaattgattcttaggtggagcttattttaaaattaattgaagatttttatgagtaataatttaggataagtagaacacaaaaaatttaaatttttttaaaaaggaatctgttttcttgactttttgagcacatcattttatcgttggttaaataaataaaaacaatttcatcagttttcgaaaaacgtccacttgccatttaactctgcctttacggtttccgccaatttaaaattctctaaattttcaaacttttctctctcaccatcaaattctctaatttattctctttttataatgttcctctcttttcttctggataattacttttcattatagtccctatactactataattatccacaactgtctcatacttttataaccgttttatcattttcaccgggtaaacttagaaacaaaattgagtttccgacatcgcatgataattttaaatgtaaggtacttgcatggaactttaaaaaataagagggtgaaaaacataaattaaagtataatataggggtgtatattttgggttaaacatattacacaacacactcttccgctacacactgtttacactgttccttacttttttttctttttctttcgccaacatctctctctccagctattttccctcaatttttaatcgtcgttttcacttttgttcgattccattcaaaaaagcttcaatcagtgagctgcgttttttattctctgcttcatccagatctacatttctctgtttcagcctctattgctctgtttaacaagttctcaacggccggaatcgtcgccgggattctcgccaccggagttattgtgaaacggtgaaaatgggtttttgattttactggttacttcattgttcagtgcagtaagtatttattttccttgtcctgtcttactattggtttatttccttaaatgaagaaactttattttccccgaatttcttcattgctaaaaactctcactttctgcaatttcgtctgcttgtttcactcacaagaatttcacatttttttcaaaaataaacactgcttaatgcggattggttgttcacaaaaggaccaaaaaatcgtagaaggtaaccgacagtgttagctgaaagaagccagaaactctgtttgtctgtgttcttgaatttagacaatctactaaagtccgtactttttttattagtaaatcctgttatgaccggacccaataaagtagagtaattgttacatgcgcgttccattccaaacaatgtgcgtgggccacttggtcatttgattctgtatttttacttcggagaaatttggatacaacaaataaagtagagagattgtgtataatgaataaagtttccttttttttgttaatgatttgatcatgcgtctcttctgatttgagtttcttttgtatctgcataagtttggattgatttcactatg

SEQ ID NO: 11585 - DNA, 3000 bp, Unknown
  misc_feature (1)..( 3000): cDNA_ID_1807078_gDNA_ID_2214504_Annot_ID_133726 3000 nt of promoter + ATG
tgtctattttaatgaaaattttaaatgttatcgtattctactgagaaagccaccattttggtaaaagactgtagcagaaaaaaatggttaaaaaaagtttttagaaaaacggtggaagtgaccattttggtaaaacggtcgcaataacatttccataattgtaggaaataagtttatcaagttgctgcgcgcctctcctttagctttagtaaagatgaataaataattcataggatatcgaaaaaacgatactgctttaataattaatattattgtactaaacatttaatcataattttgtttcttctcataattttgtttcttcccgtgtatatgcatcgggaacaatacatttccttcccatttcactagaacttttgaaggcaccaccaagtttctggattttggaaaaaccactgatgatggtatattacataaggcaacatcaactttgtagcctcttccctccatggctctatcaccataagaaaactttaaggtcatgtctttggcttgcacaatccattgacaatagattactatatatgaaggagcattattaagcaatagtatgttattgacttgaatagtttgtttatctataaaatatataataacaaaaatcagaagtgaaaactataatatctaaactactcttccgttccattttaaatgatattttaatagtattatgatatatcatatattaatggtattaaataaaaataataattatgatatatcatatattaatggtattcttccgttgagggaacataagttatgataaaaaaaaattagttatcgtgtaatctcctagatccataacatcataatttaccgtaatttttatttattaattccatgaaatttagtcttgatatcaactcatgtagcaagttacattttgattcttgaattaatttcggtgtttaaagcatgtatgcatgcattatacggtctcgcagaagatattagatgtgttctatctgctatgcctttaggttactaatctaaaccaaaaataccaaataagcaaataaaccacaaagcagaatacaagcaaccaattgtataactaaattgaacacatcttttgacgacattccctctccgccacaacatttgacatgtcgtttggcccataagaaactcgccactagagccaagatgaggaggacaccaacaaccacggtggctataataaagtaaccaatattcttcatattgctcttcgaattcactgcaccaaaaatttcttctttttaactttgttttgtgtcttcttcttctccggtataggtgatgtttatatacacgtcttgtcaacagaaaagtttaacatttttggaaaatatatatttacattttttcactaaggaacattggaagttttacattttacggcactttcttgatcctcataccatcatatatgtacacatgtatttagtgaatcaaaactattaaactattttaacatttttcttctaaaattaataattaatttctaaatttccttaattattgtacaaaaaattaaaagcaataattttttaaaaattttaaatttcattaattatatgatgaagtttataatttgttttatttttttttttaattacaagatatatatagtttctttatgtttaactttttttatatttaatattttcttaattcaaaacaaaaaaaaatatattttaatttttagtttatttatttatttataagatactaatagtttctttatatttatcgtctttacttttcaatcctttttaatttttatttttcaaattataagagacataactttttaatatttatcttctttactttttaatcataaatattttatgataaattaattaaattatgtattggttgttttatgaagtctaggtggcaagctattagatgctaacgtatcaagctgtgagaaagagttaagctcctttcatatatataatacaactaaaaatttgaatcgtcaaagaaaaatacctttaaaacagaaattttctgattttaaaagtgcaaaaaggttagtaatgccgaattttaacggaggctattttgtccaaaaaagattgttaactagcgatgactatgaggcttgagattcttcaccaataaatgccgactcgcttggattagggatatatttcatcaagatacgtgattactggtgcccatgcatttacatagtaactttacattgttaaatttaacattttgtcactaggtaatcttacctaagaaaattaaaaattaaaaatattatatttttttgttgaataagtaacacaacttgtcatgatgggactatatcattaacacaacttgaagcaccaactactttaattaatttatagcctcttccctccatggctctatcaccataagaaaactttaaggtcatgtctttggcttgcacaatccattgacaatagtattactatatatgaaggagcattattaagcaatagtatgttattgagttgttttttttttattttaatgaatgacttgaatagtttgtttatctgtacaaaatatcataacaaaaatcagaagtcgaaactataatatctaaactactcttccgttccattttaaatgatgttttaagaaaataataattatgatatatcatatattaatggtattctttcgttaagagggaacataagttataatacatatatcatgtgatattgatgccttgatggtattgtagagttagatatatatatatatatatataatatttccacagaataatacacaaacaaaacaaactaattaaactcttttaaaaactaaaaaggagcataaatctattttcttataattatgtgagaaacggatattattatttatcacttatttttttttggtgagaactatgccttggctttggctagtgctttaaatatggcctttaatgagacaatctcatttgtctatctttttcactaacaaagaacaaaaatg

SEQ ID NO: 11586 - DNA, 3000 bp, Unknown
  misc_feature (1)..( 3000): cDNA_ID_2706931_gDNA_ID_2214504_Annot_ID_133727 3000 nt of promoter + ATG
atggcggaaaatgacaccaacaagaagaaagaaaaagaaaaaagcattgtaaattttgggaaatcaagcaatgtacaatgtagtgtgtgacatgggaacaagagtaagtggacttggcccagtggggtactctcttgctccatgcctcttgctaaaataaaaagttggcacacaaataaaaatggaatatataattgataaagccaattattattttgtaaagattgatattgtcaaatttaaaggtttgacattcttttttctccagcaaccaaactattcactctatttgtagtttttttttccttatcataaaagcatccaaagcgttttaaaaaaatcattgcataatgtataatgtgttatgggtgaacagtcaaaatgcaaattgctaaacaatttagtacctaggctttatatttgaatgagtaaatgctgtgtgtttaatgtttatcaatgcattagtggtagattaaacatgggttgagacttgagagcatatatctccaccataaatattcagtcgtaagtccaaatattttcttgaaaacaacatttgaaatgtcataataacaagtaccatttggaattctattacaaaagagttaatccatataagtcatatagattttgattggtaaattggtaacacgataaaaaaaatgaatgaaaacctactttcacaatcttttacttgtcagataattttgaaaacttttttctacaacttcttttttcatttgctttgattatgcgatgatattaacaaatgaaggatgcgactaaaccttcacaacaatgaaaaccaaaaaaaaatccatttaccatagttcaaacttcaaacacggtatataaatggtgaacatgcaggagttaataatccctcgtgatgaggaaaacaaaactcaaaactcaaaagaaaaatgttttgagtggcgcgagaagaaacctcgtaatattgtgtagttaaataatgttaagtggtgttttatgaaaagaatacaacttgaaaagcatttattttgcgtgtattcgatggagaaaagtatttagtagttgtagccttttattgaaataaaaatggttaattgggtgtcgaagaaaaggatatagggagctacgtgtggtggtatctgccatgtagaaaatcgaagcgcatgcacaaagttggactcatgatgagacttcacatgaccaccttcatttattcctcctactcctctctctctctatgtacagtattagtattaaattacgtatataaaaaaaaaaaaaaaatattacgtatatataaaaaaaaaaaaatattacgtatttattttttgtcctagcgtatagacacgtagaccgtagttataagaagttagtcgtttgtccgagcattgattttgtacaactcttacagaacctaaaacagactgtacttaccaatgccaaacttgtctgtcttctctttctatttatttcttgactcaaatttgaatcgaatatattcataatctgaccagaaaaaaccaaaactctaataaacaaaaaagctttgaaactaacaaagcgaagccaaatttcataaaagaaagtttaaacacacaaaaagtcctaatttgaggcattttttgacaggactaataactttatatttcaaaaaaataaagtccctttcacgcttctcacgcgctcggtgagtgacattcccacaccattttcctcatgcatgcaacatttatcatcatcattatcataaacctaatgcatacaaagatgtacgtagatatacacatgatgatatattgtacatgcaacatacatcagcatcagcatatgatgaacatcagaaagaaggaaagagaaagaaacttatgtgatgtccttctcacagagctaaagacaacagcatttttttttccctaagttagcaaaatacccatttcgtcaaatatccgtttcttctgacaacaatttcttcgaataaaacataacaatattaaaaagaaaaggtaaagaaaaaaacaaagattggcctgtcttctctgcctccatattaagttagttattttatatgtatttttatcattactgttgtgggtagagtaaaaaaaacagatgggttttgcagagactgttttgcgtgtgttggcttttctcctttattgtctttccccttttttatcctgcaccttattttaattatttcttagctaattttttattgctacaaatactagaataattttattttatttttgcatcacaagttataaccagaagaaacttatgtagtaattagtacacataaaactcaattgcattttctttttacatttttttttttttttttttggacaaatcattttctttttactaaagtaaatgtttttagtgaacacattgagtacaaatatggacacaaagtataaattattatgagattttgcagtagatattaatttattttagctatgtaaataaaaccgtaaaagtaaaaagcttttatcaaattcaacccacctggcgtttcagttttcattttttttttacctttatgctgtttttatgttcttgcaagtctttctcgcgccacacaaaagaaaagtaatttcttttagagttatgttttattttttttggaccatgtcttaaaaggatctcgagattggcgtctgagataaagacctctactttgcttcctttatcttgctcctcttatctcttcgcttctccttcctctcctctctcgccattgccctctggcgttttctgtcttgagctaaagaaataacaaataaaccgaaaaaaataaaaatagaaacttttttttttgtttatttgttctttctccaaaactccttttttttctcaccattatctcatgaacgtgagtggaggctctctgagtagagagagcctacccttgaaaataacctagggatttctccaattttcaagctttacccattcaaaagaatcgtccttttttcctatttctgactttgagctatg

SEQ ID NO: 11587 - DNA, 3000 bp, Unknown
  misc_feature (1)..( 3000): cDNA_ID_2706935_gDNA_ID_2214504_Annot_ID_133728 3000 nt of promoter + ATG
caatgtacatgtgtatgtatattatgtgtttggctctatcttaaactatatcattatttcggctaacatttgttgacgagacttattttttcatgcaaagatgttcacatttatatataatataagtagcctgttcaaatgggtcaagctcaatccaacaaattcagtttttcatggatttatttattgttttctgggttggaaagagcttattcattcgttaattttagttcaatacttcaattcattagggttattcatacttatatgactaaaataagggaattataatatttcttttatggatatactagaatgtgttgctaagacaataataattggaaagaattcattgagttgatctcataatcattaaggtttctacctaattcaaaatcattgtttagtccaatccaactaatccgatgattaaattaatccggattctttttaaagaactaataaaagatcggagcctctgttttagaagtcttaactttttggtctattacttttcatagctttattcttcggtcaagatgtcattcttggaacaagaaaaatgtttatatgactaatatggttgtgacattcgattaattaattatagatttcggatgacattttaattttttagtatttctattctagatatatttttggtaataaagctagatttgacaatatgattgatgttaaatttaagatttatatgacaactataacaagaggtatttctaaatctaagttttacttaatttttctctataatctatttgaatcaatatacttttgaacaccccttcgataaaaattagtatatttatcttcacaattataaaagaatctcatccttatctttctatcaaatttatgaatttggtctcatctctatctttttcttttgcttttactttgtgtaagtggtattttttttttttttttgtatcatggattaaactagattatgacggtttgatcttgatggttggggtttaagtcttattaactaaaatcgttcttttgaggcgatctttgtaggaaaaaccaaactaggatagatttgtgctcaaatgaactaacatagaaatctaaaactgaaaataagagacctcattaagcttattgcacaaaacaaaagtatgaggggaaaagatttagattgtccccaagaatagaatgactttagttttgatttcaaagaaggggatagactatggagttaagtgacaactctctacgttagtctcactgttctcactacatgattatatataagagactacttgctcatctacttaacctaattacatgaacttgtgttgggtttttccaatatcatgaacttataatctttggttttgttaggaatgctcttttaatctcagtgctaaattatgcttgatatttataactttttttttttttttttatatttataactttatacgtgctgacatgcacttgaggactttgaggtgtcgaatcaagaatcatgatgataaggagtttagggatgaaagcagactatataatcgtataggtgattaagtaagcatggttatttaatgactgctcagtcacttcatttacttgtgtattaatcatgtttactagttagttttcgtccatttccaaacgctaatttgttgttcaatgactgctcactcacttcatttacgttaaacgtttcttacttgtcgaatgcatacttacttgattttgacctatagttacttgtcgaatactgtgacctcgtataagtgatcaaaggcgttacaacttttggtggtcttttacacataagtgatagttttcaattatttttcgagtcaaagcaattagcaaatacttttttaggaaagttttttttttctttttttttttttgggcaaaatttttaggaaacttataaataataagttacttattatggaatcatgtactgtttttttctgaagtcactcatcactcgttcgtttaagtaggttttgttttgtcactgaaccgaagtcaaaccaatctaaataccaaagctggtttaatgtctctgaaattcgaacaaaaccaaaagcgaacggaatcttcggtttcgataccgacgcttctttgatgactcacaacgaaagatatatttgagggcaacgggcacaagtagggtcaggcaaaactagtggagttgaacaatcgataacatattcgggcagcttttcagatctgcccgtcttttcctacaatctcgatcgttgtttcgacacttgtcctcattgtattagcctccttttcactgttgcacatcgtgtcgtttaccactcctacacattttcgtggttctgagttgacctatcactacagtgtgagtggaaaacatgaaaacggcacgatgttaatgaatattagagaaggacggaggctatgaactgaaaaaacgacatggtgtgtccctcttgggtctagccgtttaggcctctgttagtcatttcgtctcttccttagttagaacaaaaaaggagagacctttaacaattttctgagggtaagatccagagattgattgaatcagcttactattttatataattcaggtaaattcttatgtttctttccctccagattttgaaagtttctagcttttgttgttctgtatctactcgtttccgggaaaatgcttttgctatgtatgttgagatgtgatagtagaggttaagattggtttttctctgttctgggtttgctttagattctagggttgtgattgaattctgattttggggttttggtttagtgaattccgattctcaaactcttggctttggtactgacttttgtgctttgttgttgtttcagtttgttgttcctcagacttgtaactaggacagtcttctcatgaatcatgacttcttcagtacatgagctctctggttttgtctctctttctgaccattttcattatgctctcgttttattgttgtatcttcctaactgattcttggtggtatg

SEQ ID NO: 11588 - DNA, 3000 bp, Unknown
  misc_feature (1)..( 3000): cDNA_ID_2706939_gDNA_ID_2214504_Annot_ID_133729 3000 nt of promoter + ATG
accctcagaaaattgttaaaggtctctccttttttgttctaactaaggaagagacgaaatgactaacagaggcctaaacggctagacccaagagggacacaccatgtcgttttttcagttcatagcctccgtccttctctaatattcattaacatcgtgccgttttcatgttttccactcacactgtagtgataggtcaactcagaaccacgaaaatgtgtaggagtggtaaacgacacgatgtgcaacagtgaaaaggaggctaatacaatgaggacaagtgtcgaaacaacgatcgagattgtaggaaaagacgggcagatctgaaaagctgcccgaatatgttatcgattgttcaactccactagttttgcctgaccctacttgtgcccgttgccctcaaatatatctttcgttgtgagtcatcaaagaagcgtcggtatcgaaaccgaagattccgttcgcttttggttttgttcgaatttcagagacattaaaccagctttggtatttagattggtttgacttcggttcagtgacaaaacaaaacctacttaaacgaacgagtgatgagtgacttcagaaaaaaacagtacatgattccataataagtaacttattatttataagtttcctaaaaattttgcccaaaaaaaaaaaaagaaaaaaaaaactttcctaaaaaagtatttgctaattgctttgactcgaaaaataattgaaaactatcacttatgtgtaaaagaccaccaaaagttgtaacgcctttgatcacttatacgaggtcacagtattcgacaagtaactataggtcaaaatcaagtaagtatgcattcgacaagtaagaaacgtttaacgtaaatgaagtgagtgagcagtcattgaacaacaaattagcgtttggaaatggacgaaaactaactagtaaacatgattaatacacaagtaaatgaagtgactgagcagtcattaaataaccatgcttacttaatcacctatacgattatatagtctgctttcatccctaaactccttatcatcatgattcttgattcgacacctcaaagtcctcaagtgcatgtcagcacgtataaagttataaatataaaaaaaaaaaaaaaaagttataaatatcaagcataatttagcactgagattaaaagagcattcctaacaaaaccaaagattataagttcatgatattggaaaaacccaacacaagttcatgtaattaggttaagtagatgagcaagtagtctcttatatataatcatgtagtgagaacagtgagactaacgtagagagttgtcacttaactccatagtctatccccttctttgaaatcaaaactaaagtcattctattcttggggacaatctaaatcttttcccctcatacttttgttttgtgcaataagcttaatgaggtctcttattttcagttttagatttctatgttagttcatttgagcacaaatctatcctagtttggtttttcctacaaagatcgcctcaaaagaacgattttagttaataagacttaaaccccaaccatcaagatcaaaccgtcataatctagtttaatccatgatacaaaaaaaaaaaaaaaataccacttacacaaagtaaaagcaaaagaaaaagatagagatgagaccaaattcataaatttgatagaaagataaggatgagattcttttataattgtgaagataaatatactaatttttatcgaaggggtgttcaaaagtatattgattcaaatagattatagagaaaaattaagtaaaacttagatttagaaatacctcttgttatagttgtcatataaatcttaaatttaacatcaatcatattgtcaaatctagctttattaccaaaaatatatctagaatagaaatactaaaaaattaaaatgtcatccgaaatctataattaattaatcgaatgtcacaaccatattagtcatataaacatttttcttgttccaagaatgacatcttgaccgaagaataaagctatgaaaagtaatagaccaaaaagttaagacttctaaaacagaggctccgatcttttattagttctttaaaaagaatccggattaatttaatcatcggattagttggattggactaaacaatgattttgaattaggtagaaaccttaatgattatgagatcaactcaatgaattctttccaattattattgtcttagcaacacattctagtatatccataaaagaaatattataattcccttattttagtcatataagtatgaataaccctaatgaattgaagtattgaactaaaattaacgaatgaataagctctttccaacccagaaaacaataaataaatccatgaaaaactgaatttgttggattgagcttgacccatttgaacaggctacttatattatatataaatgtgaacatctttgcatgaaaaaataagtctcgtcaacaaatgttagccgaaataatgatatagtttaagatagagccaaacacataatatacatacacatgtacattgtattttctcaaaaaggtataatgacaaaagacaaaattaataggggtaatatcgtaaattcaagggtaaaggagctgggcataagctttgttctcgagtctcccgctccgctcaggtgtagcgtagcgcctcttaaactttctctccctttactatgcgttttctttggaaaccctaaaactctgcaagaacaagaagaaagtctcatccttgaaatcgacgctgtgattagctcttcttaaggtcaattcgtcactttacctcgacttgtaagtttgcttctccttttatttggtcatggtcgttagagttttcttataggatttgtaatctcaattcattagctgggatagcttaattaaggagtaaattttgttgtaaagttttgatttttattgaacactgttgtttctctcacagggttattgtgagaaaagagtggtggaattagttaataacctt

SEQ ID NO: 11589 - DNA, 3000 bp, Unknown
  misc_feature (1)..( 3000): cDNA_ID_2706945_gDNA_ID_2214504_Annot_ID_133731 3000 nt of promoter + ATG
ccctgagcaaccattttgcagaccttttactgattttgaaaaaaaatgaaacagacgatcaagagaagaatatgatccaactatgtctatattgatcagaaacgcatagtaacaaacaccagaggtccttttcaacaggtcgtataggtaaatttacagatcctcttcactatcataaccagattagaggcctgaatcttaagcattacttcttaaatgactaagaaaacgacaggggtctactgtttggcaagataaccaacctaattgctcttaatattaataccaaactcacttatccaattatatatactcgataaattagtcccaaaaatcgaaattcctagcacaaaaagcaagtattagatgaaagaaaaatactaatcatttaaaaacatagaatgtatgaacagagctccctctcactcatttccctccaggacccaccaccaaatatatatacaagtaaactacccaaataaatcaactcacaagttaacatcaaggaaacaaaaaaacacacagttcctaattgagttgagacacataatctattaaagagaaaaatggcttaaccaaaagttcttttcaattgaatcattcactattgttgcagtgagaaacaatgaggctcaaaaaataaattcacatgttttcgagacaccttcctttctagcaacaattgagcattttttatttagccttcaataacaatgcgtaaacaaagttttaagatagttatgattcgttttttgagagtcaataacaaaaattatccgatctaaaccactaaacatcaaatcaatggaaatctcaatgtttccagaaaaatgaaatctatctagagaggaaaggaaacaaatacggattcaagagaatagattcgaatagaaacgaacctgatggatctcagcgactcgagacggaagagagaatcgccgagattgtgaatgaatcgccccggccctgttttggaggtttgcgttggtgtgtgtgtgagaattagatagagaaaacaaggtcggtgtaatatatcttctagatggaatctggaccgttgattgtgagagatgccttagatctcggaggccaacgaatcgtcaatatattcaaaaaaaacaacggctgtgccaggttgttgctcttttggctctcttcatacattagctgttcatagcctcgtcttgtcacttgtcgtcgcacttataggattcccaattttgtacgttgccacaaataaacaacattacactatatatattacaaattcaacttatatggaaaagaaaaaaaatactaggatactcatacactgtgtggacgattacattttagacttcgaattattggtcttctgccaacaatgtcaaaagattttattgactgctttaatcattttccatagagcaatgagaaagtcaaggattaaagtcggtctcttcttgagtaaatattaaattcgaagattgtggcagctagataataatcatactttcgattttcttattgagtaaaataaaatttgtaaatgattaattcattatgcttatttttaggattttgatgcggcctcttatgatgtagaatcattcactaccagtacacgtgaccagtgtcaagcatagtgtttgattataattattttatttgctttagtactatagaatgtttctttaatgcttaaaatccacgattaatatagctcactcgacgacgctggtgtgatgacaattgattagtctttgtcttttatgtctaacttagagatttgacaacggagcttaaatagtcagcataatgaaacagaagatagaaatgaaagtagtagtgatacggttaatcaaatgtttggttagcactttttccagaaaaatgggttggttccatttcacaaatgtaaaagaagtaagatattggttatatcagcctgatgttgagataagctttcttgcattggtacacagaagaaggaatggacgagatggagtttaatgaagcagagagtaacatgaacgatcttgtggctgagtatcagcaatatcaagatgctacagctgatgaagaggagtataaagaggagatggatgaagatgctgacctcgatgcttgagatttttagatctttaaatggagttgttttcttttcgtatccgctggctttgattgctcttttgtctgttgttttgggtgtaaaaattgtaatgagaaactaatttgtatgtgtgttggccctaatcttttctcgttttggtttatatatatctggtttggtcttatttagttatggttatgtgagcaatcaaagtagaccaattaaccaaaaataatgtctatagttcacttacttaaattaagtaaaaatttgtgtttgtcacacgacagaaacatagaaaacaaaatttgatgtaatgacgacaatagtgaagaaaaaaaaagatggaattaaagaaataggaaaaagtaagtgtgaaccctaaacgtctcctattatttatcgattatcgccgtctttcatcagaatctgctccttctctatttttcttctccaagaaaaaaccatagcgaaggagtaaaaaacgaaggccggaattatcagaacgggacagtgacaagggtttccctgagctgacggaccctttcaattattcatcctcgtgagttctctcaccgtcgtattttgtgtctttatactagttttctcttgtaaaatctgtaatcaatggagattttacttggttacatcgattcttatagctctcctttccctattttcgcagctgatagtctatatagcttcaatacttaacatttagtctaaattcagagacttttccagatattgtttctagtgagtttaaattgagtgtttatggtgtcttgagtataagttaatgttgaaagttttgagatttcttaatacttctcttgtccatcaggaaagttccacactttcggcaacttgaagtagcagcacgatttacattaagtccagagaggatg

SEQ ID NO: 11590 - DNA, 3000 bp, Unknown
  misc_feature (1)..( 3000): cDNA_ID_3023131_gDNA_ID_2214504_Annot_ID_184080 3000 nt of promoter + ATG
aacctggcacagccgttgttttttttgaatatattgacgattcgttggcctccgagatctaaggcatctctcacaatcaacggtccagattccatctagaagatatattacaccgaccttgttttctctatctaattctcacacacacaccaacgcaaacctccaaaacagggccggggcgattcattcacaatctcggcgattctctcttccgtctcgagtcgctgagatccatcaggttcgtttctattcgaatctattctcttgaatccgtatttgtttcctttcctctctagatagatttcatttttctggaaacattgagatttccattgatttgatgtttagtggtttagatcggataatttttgttattgactctcaaaaaacgaatcataactatcttaaaactttgtttacgcattgttattgaaggctaaataaaaaatgctcaattgttgctagaaaggaaggtgtctcgaaaacatgtgaatttattttttgagcctcattgtttctcactgcaacaatagtgaatgattcaattgaaaagaacttttggttaagccatttttctctttaatagattatgtgtctcaactcaattaggaactgtgtgtttttttgtttccttgatgttaacttgtgagttgatttatttgggtagtttacttgtatatatatttggtggtgggtcctggagggaaatgagtgagagggagctctgttcatacattctatgtttttaaatgattagtatttttctttcatctaatacttgctttttgtgctaggaatttcgatttttgggactaatttatcgagtatatataattggataagtgagtttggtattaatattaagagcaattaggttggttatcttgccaaacagtagacccctgtcgttttcttagtcatttaagaagtaatgcttaagattcaggcctctaatctggttatgatagtgaagaggatctgtaaatttacctatacgacctgttgaaaaggacctctggtgtttgttactatgcgtttctgatcaatatagacatagttggatcatattcttctcttgatcgtctgtttcattttttttcaaaatcagtaaaaggtctgcaaaatggttgctcagggattcactgtggatcttaaaaagccccttgtatttcaggtaattactgtttcccagggttttaaatagtttatgtcaacattttccttgagaccatagtcacccaagattgtcttcgtttctttcttagagctaatcaaagtaacgctctctctttaacccctcctgccattgctttggatgttttacaggttggtcatcttggagaagattatgaggaatgggttcaccaacctatcgcgaccaaggaaggccctcggttttttcagagtgacttttgggaggtatatattttattttcatcttttctcattctcaatttccaatatcaataataagcaatgtcaatgagactctgatctccattctctgacgtatttgcaatgaaacagttcttgacacttacagtttggtgggcagttcctgtcatttggttgccagttgtagtctggtgcatatcaaggtcagtaagtatgggatgttcacttccagaaatcgtcccaattgttgtcatgggaatattcatctggacattttttgaatacgttcttcaccggttcgttttccacataaaaacgaagagttactggttagtcactttctccctctctctgtgttacatttcatagagacagtactctcctatgaatcctcctcaaacagacaaattcctggaaacatgacttcggtcagatgctaatgattttgtgaaaccactccaggggaaacactgcacactatcttattcacggatgccatcataagcacccgatggaccaccttcggctcgtctttcctcctactgcaacagcgattttatgctttccggtatttatctacattaacccaccattctacatgttttcagcgccaaccctaaaccgttttcttttcttgtgtcctagttctggaacattgcgaaggctatctcaactccttcaaccgcacctgcattgtttggtggaggcatgctcggatatgtgatgtacgatgtcactcattattaccttcaccatgcccaacctactagaccagtgaccaaaaatctcaaggtaaaacaatgtcaagtctcaaaacctgggactttcttttcttttgtatccggattgcataaagagagcttatttgttatgttttttcttatgattctgcagaagtaccatttgaatcatcacttcaggattcaggacaaaggatttggtataacttcgtcgttatgggacatagtctttgggacacttcccaccacaaaagcccccagaaaagagcaatagtagtaaaaggcaaaaactaaaaagatgtttgtaatacatttaatttaatcttaagttattaatcatccttctgaattttgagatgtttaatctgaggtttcatttggatcactgtcttttgtagtttgtaaatcaatacttcacaatcctaatataatatttttctgcgaaagcaataaaaaatctactaacatgaacatctgtgtcttgactttggccatatatatatttcttgaattgacagacattttgcaataaatatccgaagtttaaaaaagacaaccaaatatgggaagagaaactaaaaattaaaaaaaatcgttattgggctgggcctgggtaaagaaataaaatcaacactcactcaccgacccgcccggaaatccaaatcgctcgaggtctaatctgactcctcctcgattccttcttctcaaactgactgcactcttccttctttcttctgctcactgaaaattagggtttagggtttttgattttcgttctctattagtttctccccctcactctcatggcgatgaattttcaatttatgtgagattttattccacaatcggaataattttcctggca

SEQ ID NO: 11591 - DNA, 3000 bp, Unknown
  misc_feature (1)..( 3000): cDNA_ID_3040459_gDNA_ID_2214504_Annot_ID_184078 3000 nt of promoter + ATG
aaataagctctctttatgcaatccggatacaaaagaaaagaaagtcccaggttttgagacttgacattgttttaccttgagatttttggtcactggtctagtaggttgggcatggtgaaggtaataatgagtgacatcgtacatcacatatccgagcatgcctccaccaaacaatgcaggtgcggttgaaggagttgagatagccttcgcaatgttccagaactaggacacaagaaaagaaaacggtttagggttggcgctgaaaacatgtagaatggtgggttaatgtagataaataccggaaagcataaaatcgctgttgcagtaggaggaaagacgagccgaaggtggtccatcgggtgcttatgatggcatccgtgaataagatagtgtgcagtgtttcccctggagtggtttcacaaaatcattagcatctgaccgaagtcatgtttccaggaatttgtctgtttgaggaggattcataggagagtactgtctctatgaaatgtaacacagagagagggagaaagtgactaaccagtaactcttcgtttttatgtggaaaacgaaccggtgaagaacgtattcaaaaaatgtccagatgaatattcccatgacaacaattgggacgatttctggaagtgaacatcccatacttactgaccttgatatgcaccagactacaactggcaaccaaatgacaggaactgcccaccaaactgtaagtgtcaagaactgtttcattgcaaatacgtcagagaatggagatcagagtctcattgacattgcttattattgatattggaaattgagaatgagaaaagatgaaaataaaatatatacctcccaaaagtcactctgaaaaaaccgagggccttccttggtcgcgataggttggtgaacccattcctcataatcttctccaagatgaccaacctgtaaaacatccaaagcaatggcaggaggggttaaagagagagcgttactttgattagctctaagaaagaaacgaagacaatcttgggtgactatggtctcaaggaaaatgttgacataaactatttaaaaccctgggaaacagtaattacctgaaatacaaggggctttttaagatccacagtgaatccctgagcaaccattttgcagaccttttactgattttgaaaaaaaatgaaacagacgatcaagagaagaatatgatccaactatgtctatattgatcagaaacgcatagtaacaaacaccagaggtccttttcaacaggtcgtataggtaaatttacagatcctcttcactatcataaccagattagaggcctgaatcttaagcattacttcttaaatgactaagaaaacgacaggggtctactgtttggcaagataaccaacctaattgctcttaatattaataccaaactcacttatccaattatatatactcgataaattagtcccaaaaatcgaaattcctagcacaaaaagcaagtattagatgaaagaaaaatactaatcatttaaaaacatagaatgtatgaacagagctccctctcactcatttccctccaggacccaccaccaaatatatatacaagtaaactacccaaataaatcaactcacaagttaacatcaaggaaacaaaaaaacacacagttcctaattgagttgagacacataatctattaaagagaaaaatggcttaaccaaaagttcttttcaattgaatcattcactattgttgcagtgagaaacaatgaggctcaaaaaataaattcacatgttttcgagacaccttcctttctagcaacaattgagcattttttatttagccttcaataacaatgcgtaaacaaagttttaagatagttatgattcgttttttgagagtcaataacaaaaattatccgatctaaaccactaaacatcaaatcaatggaaatctcaatgtttccagaaaaatgaaatctatctagagaggaaaggaaacaaatacggattcaagagaatagattcgaatagaaacgaacctgatggatctcagcgactcgagacggaagagagaatcgccgagattgtgaatgaatcgccccggccctgttttggaggtttgcgttggtgtgtgtgtgagaattagatagagaaaacaaggtcggtgtaatatatcttctagatggaatctggaccgttgattgtgagagatgccttagatctcggaggccaacgaatcgtcaatatattcaaaaaaaacaacggctgtgccaggttgttgctcttttggctctcttcatacattagctgttcatagcctcgtcttgtcacttgtcgtcgcacttataggattcccaattttgtacgttgccacaaataaacaacattacactatatatattacaaattcaacttatatggaaaagaaaaaaaatactaggatactcatacactgtgtggacgattacattttagacttcgaattattggtcttctgccaacaatgtcaaaagattttattgactgctttaatcattttccatagagcaatgagaaagtcaaggattaaagtcggtctcttcttgagtaaatattaaattcgaagattgtggcagctagataataatcatactttcgattttcttattgagtaaaataaaatttgtaaatgattaattcattatgcttatttttaggattttgatgcggcctcttatgatgtagaatcattcactaccagtacacgtgaccagtgtcaagcatagtgtttgattataattattttatttgctttagtactatagaatgtttctttaatgcttaaaatccacgattaatatagctcactcgacgacgctggtgtgatgacaattgattagtctttgtcttttatgtctaacttagagatttgacaacggagcttaaatagtcagcataatgaaacagaagatagaaatgaaagtagtagtgatacggttaatcaaatgtttggttagcactttttccagaaaaatg

SEQ ID NO: 11592 - DNA, 3000 bp, Unknown
  misc_feature (1)..( 3000): cDNA_ID_3040475_gDNA_ID_2214504_Annot_ID_184074 3000 nt of promoter + ATG
gggagactcgagaacaaagcttatgcccagctcctttacccttgaatttacgatattacccctattaattttgtcttttgtcattatacctttttgagaaaatacaatgtacatgtgtatgtatattatgtgtttggctctatcttaaactatatcattatttcggctaacatttgttgacgagacttattttttcatgcaaagatgttcacatttatatataatataagtagcctgttcaaatgggtcaagctcaatccaacaaattcagtttttcatggatttatttattgttttctgggttggaaagagcttattcattcgttaattttagttcaatacttcaattcattagggttattcatacttatatgactaaaataagggaattataatatttcttttatggatatactagaatgtgttgctaagacaataataattggaaagaattcattgagttgatctcataatcattaaggtttctacctaattcaaaatcattgtttagtccaatccaactaatccgatgattaaattaatccggattctttttaaagaactaataaaagatcggagcctctgttttagaagtcttaactttttggtctattacttttcatagctttattcttcggtcaagatgtcattcttggaacaagaaaaatgtttatatgactaatatggttgtgacattcgattaattaattatagatttcggatgacattttaattttttagtatttctattctagatatatttttggtaataaagctagatttgacaatatgattgatgttaaatttaagatttatatgacaactataacaagaggtatttctaaatctaagttttacttaatttttctctataatctatttgaatcaatatacttttgaacaccccttcgataaaaattagtatatttatcttcacaattataaaagaatctcatccttatctttctatcaaatttatgaatttggtctcatctctatctttttcttttgcttttactttgtgtaagtggtattttttttttttttttgtatcatggattaaactagattatgacggtttgatcttgatggttggggtttaagtcttattaactaaaatcgttcttttgaggcgatctttgtaggaaaaaccaaactaggatagatttgtgctcaaatgaactaacatagaaatctaaaactgaaaataagagacctcattaagcttattgcacaaaacaaaagtatgaggggaaaagatttagattgtccccaagaatagaatgactttagttttgatttcaaagaaggggatagactatggagttaagtgacaactctctacgttagtctcactgttctcactacatgattatatataagagactacttgctcatctacttaacctaattacatgaacttgtgttgggtttttccaatatcatgaacttataatctttggttttgttaggaatgctcttttaatctcagtgctaaattatgcttgatatttataactttttttttttttttttatatttataactttatacgtgctgacatgcacttgaggactttgaggtgtcgaatcaagaatcatgatgataaggagtttagggatgaaagcagactatataatcgtataggtgattaagtaagcatggttatttaatgactgctcagtcacttcatttacttgtgtattaatcatgtttactagttagttttcgtccatttccaaacgctaatttgttgttcaatgactgctcactcacttcatttacgttaaacgtttcttacttgtcgaatgcatacttacttgattttgacctatagttacttgtcgaatactgtgacctcgtataagtgatcaaaggcgttacaacttttggtggtcttttacacataagtgatagttttcaattatttttcgagtcaaagcaattagcaaatacttttttaggaaagttttttttttctttttttttttttgggcaaaatttttaggaaacttataaataataagttacttattatggaatcatgtactgtttttttctgaagtcactcatcactcgttcgtttaagtaggttttgttttgtcactgaaccgaagtcaaaccaatctaaataccaaagctggtttaatgtctctgaaattcgaacaaaaccaaaagcgaacggaatcttcggtttcgataccgacgcttctttgatgactcacaacgaaagatatatttgagggcaacgggcacaagtagggtcaggcaaaactagtggagttgaacaatcgataacatattcgggcagcttttcagatctgcccgtcttttcctacaatctcgatcgttgtttcgacacttgtcctcattgtattagcctccttttcactgttgcacatcgtgtcgtttaccactcctacacattttcgtggttctgagttgacctatcactacagtgtgagtggaaaacatgaaaacggcacgatgttaatgaatattagagaaggacggaggctatgaactgaaaaaacgacatggtgtgtccctcttgggtctagccgtttaggcctctgttagtcatttcgtctcttccttagttagaacaaaaaaggagagacctttaacaattttctgagggtaagatccagagattgattgaatcagcttactattttatataattcaggtaaattcttatgtttctttccctccagattttgaaagtttctagcttttgttgttctgtatctactcgtttccgggaaaatgcttttgctatgtatgttgagatgtgatagtagaggttaagattggtttttctctgttctgggtttgctttagattctagggttgtgattgaattctgattttggggttttggtttagtgaattccgattctcaaactcttggctttggtactgacttttgtgctttgttgttgtttcagtttgttgttcctcagacttgtaactaggacagtcttctcatgaatcatg

SEQ ID NO: 11593 - DNA, 3000 bp, Unknown; identical to SEQ ID NO: 11586
  misc_feature (1)..( 3000): cDNA_ID_2706931_gDNA_ID_2214504_Annot_ID_184072 3000 nt of promoter + ATG

SEQ ID NO: 11594 - DNA, 3000 bp, Unknown; identical to SEQ ID NO: 11585
  misc_feature (1)..( 3000): cDNA_ID_1807078_gDNA_ID_2214504_Annot_ID_184070 3000 nt of promoter + ATG

SEQ ID NO: 11595 - DNA, 3000 bp, Unknown; identical to SEQ ID NO: 11584
  misc_feature (1)..( 3000): cDNA_ID_3040483_gDNA_ID_2214504_Annot_ID_184068 3000 nt of promoter + ATG

SEQ ID NO: 11596 - DNA, 3000 bp, Unknown
  misc_feature (1)..( 3000): cDNA_ID_2717553_gDNA_ID_2214505_Annot_ID_133734 3000 nt of promoter + ATG
ccggtgacggacttcaccggaaatttggccggagtcattcgtcataatagtaattccaacaacatctacttatgaaaaatcttagaatcctatgaattggaatcaacaatcagtaaatgcaatcaaaactaacaaattgatcccaaatcatcaaacctaacaattctacatcaaaacctaagtttttgcatcgttccacataaatttttgaggatttaccttcaatctaatgatatactcttcctcttgctcaacgaagaaggaattgaatttctcaagctcatcttcaagaagactaatgaaatcaagctcttccttggtcataccaaccgttggatctgtgtcgacagaattggaatcggatctcgaacgtttatttggacgattctcgacgcttcgtggctccataagcttgagcttcttcttgagttctttgtatgagaggaatttgtcgcgccattcaggtaaagtttcttcgatctggttgcttaggctcttgccgaacttcatggttagctgagaataaggaagaacaatcaaaagtgaaaattggttacaggattgatggtggtttgataatattaatattagtgttttattttattaaatgaagaatattcgtggttttgtttttggaatatccaattttaaattttttttgttgaagcatatcttttttagaaataatatttattctttgtttattttacgtattggataatttacaaaggcacgagttttgggatacgaaggaattggagttaattgatcataactgtttgatcaccggtcaaaagagttgggcttagtacatgatgatagcccgattggatgaatgtatatgggccagtgtggcccatgtagttacaattgtgagtggaaacaaaggaggtaaagtggagacgctaatggtcgacgaaaaaggacccaaaaaagagtcaaagacccatacaatgatacaaaaggaaaaaaggaatgaagttttatatgcaacacacttgtaaattagagaaataccagctcataaaaaaaaagagagaaatactctaaaatactattaaactaaatttgtgtttcatatatatttggtccaactggtcagagcgcgagtcatgtaattaataattatcttaatttaatgttttctataaaaaaaggtcttagaacctgttacaataaaataaaatataaactcttgctctataattaacatgttttcaatttatctagcataaatattttccaaacaagaaaaaatgataaagtgtgttatatagtgaaaagttaaaacttgaaaaaacaaagaaacataatccattttagaacaactaaacataaattaaatcaattaagtttttagaatattatatatatatatatatatatatatatatatatactagttgtatttgtcacaatcaggacttagggaacccctccagtttctatttggaaataccaacttgtcccatattgagaatacattcctatataagataggaatttggaaacacccgaacagttatgggatggaacaagaagtgtgctaacctctaactgaaatattagtaaataaagaaaattctaaaagtaaaagaaaattggttgttacgcatctaacattctctataggaaatagccatctctatgatgatttcatacttttgccagttccttggcttatctaggattagctccatcatttggcaatccgatttacgaattcttcctatcaaactcacaacactcttttcactagagcaatattgaagtagatcaaatatatttaaaaggtcatcttcctcccctagcgacatagcaatcaaacctttatgatttatctatagcagtagacatcttgtaaattaaaactttaactatatgaaatttgagaaatccagaacttgaaggaaaaaatagcaacaaatatttgtagtaataagaccactttaatgaggtaactgttataaatgtgatgattatccatcacattacttctctttcaagaaaatggatagttatccaaagttcattattatccctcatcattttacattatctacttaaatcctaagtagcttcctccccaaacaatggtagttatcatatcctaaaggctaaatgtctagcttatcttaaattccctatatatacgatgatggacaagaagtgagtaagatagacgaggaaaaggtgaacaaaagggcttacgatctagggatgatgaaccaaaatatttttcttttatgcccaaacaaagaaaaactatttttttacgatttgcttttcctttactcgttaaaataaaagtatgacagtttaacatttattgctctttatgcaagtatgcaaccaatcataccataagttgcaatcaatatctcacttcaaatctccataccacaaatgagcccaagaatgttatatgatcgatcacctaaaatattttaaaacaagttttaagtcgtgtcctacatctatatgtgttttttttttcctttagttagaagtcaaacaaacaataaaatagtaagtataatgattgaaaaacttgagatcatgctctgatgtataaatttttggtcaactcttcctcttcggtctaatttttcttcttctgttaatacaattatttatgagcaagaatgatattttattttatcttgaaatggagaagccaccattaatgctacagtaagggttaagacgtgaaagtggggccaaccactgtgttgccgagagaaaacttaattccttgaaagtgaagggatccaaagtcagaaatgacacacacacccgtaataaagccaactagccaagagtttttttttgttataaagaaaaaaaaaaggtctcactcatcaacaacgagtgaaaaaaaaatgtgaaaccaataaagccaagagttaagctgcttattttgcctcttttgccgaaaccaaaagaacaaaaaaaaggaaccatcaaagaggaagccaagaaaaaaaaacgtcggtgatg

SEQ ID NO: 11597 - DNA, 3000 bp, Unknown
  misc_feature (1)..( 3000): cDNA_ID_2717549_gDNA_ID_2214505_Annot_ID_133735 3000 nt of promoter + ATG
aacttgtaacctaaccaaatagttattcacctaactcatagaaaataaggttagttaatctagtgcatatacttaatagtatttacccacaataaattacaaaagttgatcaccaaccattaaaaagaatacaatttttttttatattcagtattcatttaataaaatacaaatttgttaactatgatcctaaagtaaagttaatttcttgtttccgatcctcataaatgaaagaatcagaagttatatagttgaaatatatatcaagttaaaatggtaatcgtcttcttagcttgacatggaagagaaacaagaaaaacaaaaaacaaaagagtgaaacctgtatttgtgatcataaggagatacaacgaatctcctaagcttaactcgtcgattacttcttgcaccaagtgaaggtaaaattccagtagaaagactaaaatgactactctctctcgaaagctgttcaatctcatcttggacttgtccgcataacaaagcccctcctctcatcaccgacgtttttttttcttggcttcctctttgatggttccttttttttgttcttttggtttcggcaaaagaggcaaaataagcagcttaactcttggctttattggtttcacatttttttttcactcgttgttgatgagtgagaccttttttttttctttataacaaaaaaaaactcttggctagttggctttattacgggtgtgtgtgtcatttctgactttggatcccttcactttcaaggaattaagttttctctcggcaacacagtggttggccccactttcacgtcttaacccttactgtagcattaatggtggcttctccatttcaagataaaataaaatatcattcttgctcataaataattgtattaacagaagaagaaaaattagaccgaagaggaagagttgaccaaaaatttatacatcagagcatgatctcaagtttttcaatcattatacttactattttattgtttgtttgacttctaactaaaggaaaaaaaaaacacatatagatgtaggacacgacttaaaacttgttttaaaatattttaggtgatcgatcatataacattcttgggctcatttgtggtatggagatttgaagtgagatattgattgcaacttatggtatgattggttgcatacttgcataaagagcaataaatgttaaactgtcatacttttattttaacgagtaaaggaaaagcaaatcgtaaaaaaatagtttttctttgtttgggcataaaagaaaaatattttggttcatcatccctagatcgtaagcccttttgttcaccttttcctcgtctatcttactcacttcttgtccatcatcgtatatatagggaatttaagataagctagacatttagcctttaggatatgataactaccattgtttggggaggaagctacttaggatttaagtagataatgtaaaatgatgagggataataatgaactttggataactatccattttcttgaaagagaagtaatgtgatggataatcatcacatttataacagttacctcattaaagtggtcttattactacaaatatttgttgctattttttccttcaagttctggatttctcaaatttcatatagttaaagttttaatttacaagatgtctactgctatagataaatcataaaggtttgattgctatgtcgctaggggaggaagatgaccttttaaatatatttgatctacttcaatattgctctagtgaaaagagtgttgtgagtttgataggaagaattcgtaaatcggattgccaaatgatggagctaatcctagataagccaaggaactggcaaaagtatgaaatcatcatagagatggctatttcctatagagaatgttagatgcgtaacaaccaattttcttttacttttagaattttctttatttactaatatttcagttagaggttagcacacttcttgttccatcccataactgttcgggtgtttccaaattcctatcttatataggaatgtattctcaatatgggacaagttggtatttccaaatagaaactggaggggttccctaagtcctgattgtgacaaatacaactagtatatatatatatatatatatatatatatatataatattctaaaaacttaattgatttaatttatgtttagttgttctaaaatggattatgtttctttgttttttcaagttttaacttttcactatataacacactttatcattttttcttgtttggaaaatatttatgctagataaattgaaaacatgttaattatagagcaagagtttatattttattttattgtaacaggttctaagacctttttttatagaaaacattaaattaagataattattaattacatgactcgcgctctgaccagttggaccaaatatatatgaaacacaaatttagtttaatagtattttagagtatttctctctttttttttatgagctggtatttctctaatttacaagtgtgttgcatataaaacttcattccttttttccttttgtatcattgtatgggtctttgactcttttttgggtcctttttcgtcgaccattagcgtctccactttacctcctttgtttccactcacaattgtaactacatgggccacactggcccatatacattcatccaatcgggctatcatcatgtactaagcccaactcttttgaccggtgatcaaacagttatgatcaattaactccaattccttcgtatcccaaaactcgtgcctttgtaaattatccaatacgtaaaataaacaaagaataaatattatttctaaaaaagatatgcttcaacaaaaaaaatttaaaattggatattccaaaaacaaaaccacgaatattcttcatttaataaaataaaacactaatattaatattatcaaaccaccatcaatcctgtaaccaattttcacttttgattgttcttccttattctcagctaacc

SEQ ID NO: 11598 - DNA, 3000 bp, Unknown
  misc_feature (1)..( 3000): cDNA_ID_1394502_gDNA_ID_2214505_Annot_ID_133736 3000 nt of promoter + ATG
aaccacgaatattcttcatttaataaaataaaacactaatattaatattatcaaaccaccatcaatcctgtaaccaattttcacttttgattgttcttccttattctcagctaaccatgaagttcggcaagagcctaagcaaccagatcgaagaaactttacctgaatggcgcgacaaattcctctcatacaaagaactcaagaagaagctcaagcttatggagccacgaagcgtcgagaatcgtccaaataaacgttcgagatccgattccaattctgtcgacacagatccaacggttggtatgaccaaggaagagcttgatttcattagtcttcttgaagatgagcttgagaaattcaattccttcttcgttgagcaagaggaagagtatatcattagattgaaggtaaatcctcaaaaatttatgtggaacgatgcaaaaacttaggttttgatgtagaattgttaggtttgatgatttgggatcaatttgttagttttgattgcatttactgattgttgattccaattcataggattctaagatttttcataagtagatgttgttggaattactattatgacgaatgactccggccaaatttccggtgaagtccgtcaccggaatgaccggagcttggattcctcgtaaatcatctgaattagtagtttcgattcgtttggaaacgtagttgaatgagaaatgagcatagttagttaaaaatttaggtccatgttacttattttgtagcctaaggctagaattattgcgtggagcatttttagtttacatagtgtattcaactctatttcttggtgggaattggtatcgtaggaattgaaggaccaagtggcgaaagcgaagaattctaatgaagagatgataaatataaagaaagagattgttgattttcatggagaaatggttttgttgatgaattatagtgctcttaactatacaggtaaacttttctttctcatgtcatctccatggttattgtttttcgttcttttctcatatgttctaatcattcgtagcccgaaagccgacgttgagtaaacagaacaagctcacatgttggacaattgatagtttttagatgttaaaactcgtttacaaggtcaagctctagtttttagcatttcctagtaagtgaaaccgtgtcaatgggcaatatttttagaagttttgtgaaagattgattagtagggaacttgagttagtattaacattacgtctatgttaagagtcatattctccacgatctttgtgttacttgttaaatagaaatgtgcccacatgaaggaatatgctgtaatttgtttaactggccactcatcgcagatgctttctttatacttttttcttataaataacttgaggtttatgcctttattcttattcgctaaatgtgtagaattgtgttctattggtttacaggattggcaaagattctcaaaaagtatgacaaaagaaccggtgctttaatccgtttaccatttatccaaaaggttttgcaagaacctttcttcacaactgacctactcaacacatttgtgaaagagtgcgaggctatgctggaccgcctctttccgtctaacaaaagtcggaatctggatgaagaaggagagccgacaacttctggaatggtcaagacaggaacggacgattctgaacttcttagagtaccaaaagaactgtctgagattgagtacatggagagcttgtatatgaagagcactgtgtcggcattaaaagtattaaaggaaatccgcagtggtagctcaacagttagcgtcttctcgttgccaccgttaccggcaagtggattagaagatgattcatggaagaagaaagttggtgtccttgaacaagtagcgaaatgaattatgagtattattatttttaaatctctctttttttttgtactttctttaaatagtacaagtaattgtatacgcttacagctgtaaaagatgaatcaaataaaacatagaagtgtgatcatctttcaacatttaaacttggttgcgtgtactttttcttttgctgcatatcatgtatgaaaaatcttctgtaagactgtaacaccactttcaagcagagagaacaatgaaatacatacgccatttcgaaatcttatgtattgcattttagcatctgtgggtcaatcggtctctgtactcctaactaggtgatatttggtccaatttaagggcagctcattcaatcacaaagaatcaaatatgttgcagaggaaactgttctgacttctgtgaatgttgcaagattgtatagctgcttcttgttcggcccttttatatgggctttgtaatatatgggccttttttatgtgggcttagataaggcttcgacaaattttagactacgctttgcgtccctaagtgcggccactcagtaaatcatctacgtcacttattgatcaaactatggctgggcagtgggcaaaacaaacgaaccagaaatcctaattttgtgtacttcaaaaatcaccattttttttttttttttttttactattataacaatactttttgagatcaccaattttcttattttataactaattaattctttcaagaaatatttaattcacttttttatatattttaactaaaaaagactagaagttattactttttctttttgacccatactattaaaaatataactgtcactgaatcggctctaaatctcctcgactttcaactcctacagacattcagacatgtgcaacactcaacgcactgtcgatattacatagacccgaaataaaagctccttgtccaaaaacttcattcaccctctcatcgttatcttcatttggaaacaactaaacaatattctgttttattaatattttcgcctatttaaaaattcaattagaatagtgtatccctcttctctattccttcaagccaactaaaactacattgcgtgacttcttctgtaaccatttttctattccgatcaaacc

SEQ ID NO: 11599 - DNA, 3000 bp, Unknown
  misc_feature (1)..( 3000): cDNA_ID_3040525_gDNA_ID_2214505_Annot_ID_133737 3000 nt of promoter + ATG
cggccatagttgcagaaggagattttgaacaaacccttgatggagttgcaatcccaaacccttggaagctaagctcagtgaccaaagttgaggaagtaaaaatgatggttaggcttttgcctatttgggcaacaactataattttttggacaacatatgcccaaatgattacattctctgttgagcaagcttcaactatgagacgtaacattggaagctttaagatcccagctggttccctcaccgtgtttttcgttgcggctattctcataactctagctgtctacgaccgtgccataatgcctttttggaagaaatggaaaggaaaaccaggtgacataagattcatagattcatatatctattcttttttcatatatgtctctcagctatatattcacatgcattaacatttcaggtttctctagcctacaaagaatagctattggattggtcttatcaaccgctggaatggcagctgcagctctagtagagcaaaagcgtttatccgttgcgaaatctagttcacaaaaaacattgcctataagtgtgtttttacttgttccacaattcttcttagtaggagctggggaagcctttatctacactggccaacttgatttcttcataacacaatcgcctaagggaatgaaaactatgagcactggactcttcttgaccactttatcactaggtttctttgtcagcagtttcttggtctcaatcgtcaagagggtcacttcaacttctactgatgtaggatggctggctgataacattaaccacggccgactcgattacttttattggcttttagtcattctcagtggaattaacttcgttgtctatatcatatgtgccttgtggtttaagccaacgaagggtaaagactcagtagagaaggaaaatggcaagggattttcagttgaagactgctgaattttgttttgcaataattgtcttgtgtacaatattatcttgcaacaatgtcgctttccaattatgtttcttgtatattaagcaattggcttgtttttagattcctcccggtctcaaatattgtgtctttaccgtttatgttattcactctttttttttgcatcgtgaaaaataattatttaacgaagtatacttttaattttctggttacgtcctgtcgcgatccgattaatctcctttttttttcgattaatcttttaggttttatgctttagtaggtcgagaagatgagatccacatttaggcctttagctatttcatatctctttacctttgtgatctagtgtccggaacattgtagaactgtggagaacatcttgcaaaattaaagatggtcttaaaagttgtagaaaagtgttgaaagatctagattaattttgaccggaataaatccatctttatcgttgatttggaaggtaaacttgcattttaaagagtaggatctttcattagaagcgagttatgaagacgatgtgtaccaaaattctatttaatagcttaatgaacattatatttgttttagagtttccctgcaagctcactaggtaggatcgtgcatttgattcaccaaaaaactgtaaaactcatgagccggttctttaatatatttatggtcgaaaatcgtttatcgtcaaaaaatgttataagtagcaggcccagcccgtgcataagacagttgaaacagttactttagatcaccgatatacaaataattgaaaagctacaattctaaggttatctgtttggtttgcaactttaccctctatctccaaaaaaatataaatttaaaactaatacgtaatataacttatatatatatattataacgtttttacattcaaattcaatatatttttaaaattctagaagtatagttgaatttctcgtgagggttttaatataacacattattgtcaaaattttacaaatttgacgataacaaaaaatgttttattgcatattattttaaaatttgtataattaatggtaaaaactaattgtagaaattagctagttagaaaattttcttttgtacaaaacctatacagtattttattcttacaaaaatattttagatataaaaaaaaactcaatttacccttaaattttgttaaacggactctagtaagtaaatacttgatttgagttaattctagtaccgtccctttgtagacacagcgtgtgattgtgtctctctattggacttgtgtaaagctcttgtcttcactgaaattgcaaacctctctagtgtgttgagtgttgcacatgtatgaatatatactatactggttgaaagtagaggagatttagagctcatttagtgacaattatacttttaatagtatgagtcaaaaaataataaagtttaatcttttcaagtatatgtgttcaatcaaatatataaaaagtgaattaaatatttcttaaaaaaattaattatttataaaagaagaaaattgacggtctcaaaaaatattgttataatagtaaaaaataaaaaaaaaatcgattcactagatctcaaaaaatattgttataacagtaaaaggaatattataatagttttgatagtcaaattcactagatttttaaaattctcttcggcgaggtttcaatttaacaaaagatttgtcaaaatttataaatctgatgatagcaaaaataaattatattacatgttatttttgaattcgtataattaatttttagttttaaaagtataaataaaattgtagaaatgaattttgtgagaataaatagttttacttaattggtgtcattaattctagtaatgacacacttttgtcagtttgtgtctctctgctcactgaaattgctaacctcggatcttctttctccttgtttttctttaacaagtcggtacgaatccatcttttcccacccaagatctctccttcttgtttccccagatctgaaatttcaaaagctacccaattttaactcaagactctgaacaacacatctagatccatttccatg

SEQ ID NO: 11600 - DNA, 3000 bp, Unknown
  misc_feature (1)..( 3000): cDNA_ID_2717541_gDNA_ID_2214505_Annot_ID_133739 3000 nt of promoter + ATG
tcttccaagaaacatatagaattgttgacacaggaaacatcaaatataaaaaagagcagaacaactgagtgaagaaaacacacacacagcgtcctctcgccgcaacccaatttgctttagttacaaacattccttcctcctaaaagcaacctttcttggttacattacgatctaatactttggttttgaaaaaaagtgatttaaaagaattccttttccaattgatttgactatcgacgacacatagtgtagttatcgagttcttacagccaattataaaaatgaaattagatccaaaatagccatatgaaccatttgaccaaataggaagaggaaaataccgtcattaattttttttttttttcaaccactcgtgtttccgttttctttttcctgttctttttgaacttatacaaagtaaaatttctactcatatgacttagaaaaccaaactaccataaaaatgagaattaggtaagtaaaaattactccatctgttcctttttgtttgatcttttagaaaaaaacacaaatattaagaaaatatattaaatattacttttaaatatattgttttttgtgttttacaattttcaataactataaaccaatgatattcactaatttgtattgaagtttacaatttatcaattataactaataactattgtattgaaaatctaaaaaattaatttttttaaaataatttttttttctaaacaattaaacaaaaaggaacagaggcagtattagaaaccctctaacccaacaaaaaatgtaatgtataatgtgttcataaacagcaccaactacccattataattatttcatgaacacaattgtggcagaataataatgatatgtcaaactgattaatgcttaatctttccgatttcagcctgtaaatattgaagtagccgacaacaagaattgaaaatcgcacaaattaggataacgtagaaaaatcatgttcgaaatggtaaaagttatgtaaacttaatttgaaccgagttatgtagaggaagaagaatgaacgtagacatgcctaagtgaatcttggtatgatggcttttgaattattgaagaaaagaagaataaaagtgttagaaagaataaattggcattataataaggaataaattctaagtgaatttagtattatatagtttttttgtaacactttaatactgtccgcgttatggccgccccatatggcccttaagacattaactagaagagaacatacccgggggagtttcatctattttttttggatactaggctatatgtttttttgttttttttttcctttgcgaaaagcctctttatttttactttggtgttaaccaaattccatttgtatatcatctttggttaacaattgtgttttcttgttgctaaataacttttaacatttctataaaaagaaaagaaaattaaagtgttaaagtattgccttacgccaatgtacaatgccgatgtaattatagaaaaatgacaaactgtgtttatatagaaaaataagagaggaaacttattatttacgatattttcactcatgctattttttttttcaaagaaaccaatttttttcttctcaccagataatagctctcgaaaaagagatagtatttagaacactactaatcttttttctatttgttttcactagaaaaatgattgcttagtaacagtctaaaactgtgtatggtaacttttttaatgtcaaatttgttggtccataagaaaaaaattatttccaaaatttaggagaaatgaaggcgctattatacaaaaaatacaagcaacgcatagtagataaggtggtgaagcttatcaaatttggtttaattttgattcttttcacttaattatgttctcattatatggaaagatggtgatgaaatatatgtgtgaaactctaaaatcggtgaatttttcttgttgctcaatttaatctacaagaggttatatgtagactaaattaaaatttcaaaatatatggtttattactttttagataagaaatgtcttaattttatagtttgagttgtactacattgtttttttaacatctataaaagaatgaacatatgttttaatatgattggtaagttgttttgacattttcccatatccacatataactttattaaaagtgatatagtgtacactttgaattcattataagatataatagaaactaaacggataatatgagagatttcgaaatccaacaaggagctaagtgtgaaggaacacgaatgaaggacagaattggaacaaatggttattggggggcaacagaagagaataatacccttcatcatcctcttctcttttatacctacaataatgcaatcgagaatcactttaagccctcaaggacgctctcgttatttccctcctaatgatccttgacgacttttttctccttcacatgaaacagtttcaactttacgttaatcgatatcgaacgtctatttccccgtaatgtttgaacgttgatattaaaactatttttgtaaaaccgtgcatcttaagacaaaacatggtgtccaaaccaaaaatatgtcttacctgatccaaataaattattttcaccctcagaaaattataatgcacaccatccaaattaatgatcatgtcttgaagtcttctagcaccaaggctatttcgtcggaattcatttctttggttttaatttcttttactatatcctcatgttgcaaagaaagttgatggaatcagaatctatctacatatacattctgatcattaatgcctataaaatgacatgtttctcaaacaaccaagttcaccaattcctttcgcttaccagtctcttgtcttctcaggttcgatcatttttttccttcaattttagctccttcttcatcataaggcttttccacaactaaatcattactagatcttgagtaagttggctgagtgctactagttaacttttcaggttgttagagatacatagatagaaat

SEQ ID NO: 11601 - DNA, 3000 bp, Unknown
  misc_feature (1)..( 3000): cDNA_ID_2717537_gDNA_ID_2214505_Annot_ID_133740 3000 nt of promoter + ATG
tgtatatcatgtatacttatcaacactgtctattttctatataattttcaagggacagattgtccccaacattaattttcttctgtttatattaattctttagtttctaagaaaacattacaacgagggggtatagtgtatgtccccattttcatgacaaaaacgaaagaaaaataacttttagagaaatgtggatttgattgtgaactatacgtggaaaattatttgcatatgactattcgtttttcttacagcatcagtgtttgtttattatctttacattataaatatatagatatacatattacatatcggttgaaaaagaatatatatctgtatacatatatggttacatgcatgtatagaccacattgtgaaagtagtaataaaaatatataattacttcttttgtattggcgggatcagagatctaactaaaataagttagaaacattctattatggagaagccaaaaccccacatgggtagttgaaatttataagtatttaattacgtaatattttatttgtttattttttcaatgtctctttatcctcgactaataaaattaagttttttaatctcatatgtatcctgcaattatgccttaaaatcttggtttacaaaaccgtccatagtagcaaataatatctattctcatctcacttcgtatctctttttatgatcttgatagttttcttactaagtaatttttataacgttacaagacaaagaattatttggtctatacaatcacacttgcatagaagtttcaataagattgcataaagaaatcaaaataattaaaacagaaataaaactttcgtatatatttttacagaaaatatgtttcaataagaatgcataaaaaaattaaaagaagaatagagtttagaaaatatcttccattttatatgattttgaaatctttgatgaaatttagaaaataaagtttcaaaaaatgtataaaagttataaatgttaagtttaaacaatgaccttaaaaatctatatataagttttaaaaaacgtgtattgactaataatgcaatcaaggaaatcttccgtggtaacttctggaaacttcaaaacttcaaactattagacttcttgttgggcagtgaacggtgttgatcgacactaagagagttacggtcgacactcttgccttggttagaatccgaatttgtccttcaaacttgatttcttcgatttagcttcagaatattccataaactttcaatgtatccctaaagtgcaaaaacctgaaaaaaactagaaaaaactctagaaaaaaaaaaaaactctaaaacctatatctaaatcatacctaaaatcgaagaaaatcgaggtatatcagaatagacgaacaactataaattgagagtcggttttaatttcatctactacctcaagtgtggaatatgaaagaggttcctcatttgattttgaagaattaggggcactttagatggtttaaggatgaactattttgttcacctccttttatttcagctaatcataatctaccatctaataaataaataaataacaaaataactcatttaattatcaaatctaagttctaaccactattttatccattcaaaacaatatataatctcgtctaattataaaatctaaattctaattcttttttgtgaatccaaaccgtcatttaatctcgtataattgtaaaatttaaactctaaaatgtattccaaacgaaaatatatttagaagtaaattgatatttggagtgtatatagaagtttcgttttctggtaagaagctggtaattagggaatgaattcgattaaactatttgtgtgatttgttgtattatcatttatcataaatatttgattgtcactattttgtcaaaaatattaaattgtcattattgtgttcaggttcttagtacctcaaatcaaacagatcaagggtttaagtgtttaaccaaaccaatcgaattattcaaaaatctttataattaaatgactgttttaatacgctaaaccacttaattgtttatatcaatacaggatctcattatggcacaattattaaaataacagattttatcatattatttctaaatgagcgttacgttttaaactttcaattttgtatatacactataggttttgtgacaggtcgattattattgataaaagcattgggtttactgtatattttctttttctttttcaatttcttttttgctaaaatgttcattttttcttttcttatttgattctgatatgcatgattatttcagggaaaatatctacatatcatattaacaaaaaaaaatacaaatccattctataccatatacgttacattgtgaaaattataataaactcaagatatatatatacatatacatcatggtagtagtagtagtagtacacatttaatttcagcagttgcaccaacaactgagtaaaggacaaaaaactataaaattttgccatctgctatttaaatcattacgtattactagaaaatgatgtggaattcgacaagaatgaataataaaaattaaactcactagagacaactttcattaaaaaaaaaaaaaaagacttgtatcacaatcatatgaaagatgaaacaaatttgcattattatcatttttataattgaaaaaaaaacctcaattcgttgacccttcactgtcctccaatggcggcccctacgccgttggccttgcctctctctctctctctctatatctctttcttgatctctctctataaaagctcaaatagtccagcaagcaaaataatccaaaaagaaacaagataagaagaaaccaaactcgcaaagaaacaaaaaggaaaaaaaaaaaaaaaacgaattaaaaaaagaagaaataaatcctcctttttaacacctcattccctctttctccggcactcaaaagagaccaaagaagaaaactttagctctcctttttgtgttttctctcttttctttgttggtgttccgaca

SEQ ID NO: 11602 - DNA, 3000 bp, Unknown
  misc_feature (1)..( 3000): cDNA_ID_2717530_gDNA_ID_2214505_Annot_ID_133742 3000 nt of promoter + ATG
tctagcagcaacatagatgaagaaactaaattataaatccttaaattaacataatatttcattcctcattttaaaaacttggtcttgaaccccaaattcaataactactcacacatatcgttagaaagaaagataatgtaacatgtttaaatcaataaatatagagataggggttcatgaaaaaaaacaatgtagagttaaaagattagactcgtcaatttttatatagcaaaaacaaagttttggataggaaaaatatgtgaaagaggtctttaaaattcgagcatattggaaacaatatatatccaaatgggccatgtccggagtcaaatcgaatttgggcctaaaatttatatgtggaagtggtctggcattctggtatatcctttggttcggcattaaagattagactcgtcaatttttatagcaaaaattaaacgaagttttggatacgaaaaaagatgtgaactaggtctttacaaatccaacatatggtcctaaaacaatataaatccaaatgggccatgtatgggccagagtcaaatcaaatttgggtctaaaattaatgtagaagtggtctgacattatggtgtagccattggttcggctagccttggacaaaaaaacaaaactgaaccaaaccgaaccaaaccaaaccaaactaaaaaaagggtccggttgggttatggatacaactaagtatccgaatggatctcagtcacactatcagttaataaccgaactgaaccgatagataattatataattatagattgtttggaagtagaatctaaatacctttgtaaatcttgatgctagcaaatctcgccaaacaaataaccatctcatcactagcttgttcagaggcattgaaaatatgctcggtagtaattgatcccacaaagtaaaaggtaacctttcatcactacagaaaagaagaataatcaaccaaaatgaattgaaaacatcaaacataatttatttatgaatgagaatacaaacatctcatatctgtgttcaaaatcaatctttttgttcgctaattgttgacataaagagtctccatttcacaaacgtttatgatcaacaatttcttgtacaagtaaaagatcataataataagtaacctacgggtaggcaaactgttttttggtttagggttggttcagattttatggttttttggttttacaaaaactgaaaccatatagtaaaaggtatagagactaccacaacacaaagagctgtttaaaagacttattcttattgataataaacttttgttacaagtattatctcagttcttacttgatctaatctacccaaaagatcaaccccgactaagaataactaagctctaattctcttctctgttttttatcactaacccgtgaagacgaagagaactacacactcaccttcaagcttttgcacggctttgaagtttttacttagtatcgaaaaatatcccagagtgctcaaagcggctcaccctctgctctagaatatttatatcaattccccagaaccctaaccttaggatctccgagaatctcttgatatggaatcttccttgtttccaagcctattcctttctttattcttcgatataatatcttctatattttctcgatgaaccttgtctttgacacctctccaagttaacttccatccttggctcttcacatcattcgccttagcttgccacgtttgctctcgcatccatgtctgcacatcaagcgtctgatgaaacctgatgcagcgtcctgaaatccatcaacgatctgatcaccatcagctgattgattcactctgcatcttcatatagaaatcgtatgtaatttagtttggtcaaactttcggtatcatgaatcatatccctagttgtaactaatggcatggttctcaaaaaattcttatacccaacaagaaacatagtgcattatgtcccaattgatgtatttgttcaattggtttcatgaaacaatacaacgattgtctaaaattgggtagggaagagtttaggcctgacctgaatatttgctgaataaggcttgggtcaaaacttttgtaactgggctttgaacaccttattgggcggaagtttgcaaagcccaccagataaatatttgcttgatgagtctctaaaagtcttgtaaagattgatatttaatctatgtttatggttaaggttatttcagaatattgtggagagcaagtaaaaaaaacaaagataggaaattatgatataacaaatgtggatgatttaggtttaggaaatagcattttgttcaaatatgtggagaatacaccataaatgtttattttcttatagttatccaagaggttaaatggtttaggtaatcgtaattaaagatcaatacgctaaacatatgtaattattttttgcgtcagctggattttattatgtcaatttcaattacttaaatcctaatgccataattcagtagcaatttaaataataaaataaattaatttggatatctattcaaatgtactgtctcttcgaagataataatcaaactttaaattcaacaaatatcatcaaagcatgaaaattcaattgtttccagctacgtattaatagctttaatgtggaaaaagaaatattaatagcttttttcatggaaaaaagaaaaaaagaaagaaactttacttttaatagtatatttttgtctgagccaataaaagaaaaataatattttggtttaacatatttgtccctcgtgatagatttgattcgttcgttctccttctccttcattaaagacttcacgatcccacacctccacacacattgactcacacacacacacttctctctccaagttcagaaaaaccaaaaatgggttcttgtcggaaaaccacttctggttttcagcaaacccacttcttgtaataaaacagacaaaactagaaagaagcaaaaaagcttcgttttttttttctctttctccaaaaaaaaaaacccccccaaat

SEQ ID NO: 11603 - DNA, 1291 bp, Unknown
  misc_feature (1)..( 1291): cDNA_ID_2706949_gDNA_ID_2214505_Annot_ID_184100 3000 nt of promoter + ATG
aagaagtggagtttctgctttgttggatctcttatttttttaagattttgtcttgttaatatggatcttagtttgtactatcgtcctttttcgagattggtttgatattttctgcattataatttgagtttacttcatcttctttatttaggatctagattccgaagaattctctttttccgccagcttatgtttttttgggaacttatagtttatccgccaatttacgttttttttgtttgggcattatattttacgtctttcacaacaagattctataatttctttatgacaaaaaaaaaaataaaaagtaaaaaaaaataaatccccatgaccaaaaaaagttttggctttaccaaatttgtgtaagaaaggtctaagtttcacaccaaaccactcttattagtgtcatcattttgattactttcccttttaaaaaacaattaaaaagaatatcgtggcagttaaacacgaaacagaacccgtgaccgctctgtgatttttaagtttcagacaacaacagtccgacagcgacacacatcaaccggagttgaaaattatgcaacaatttattacctaaaccagaaaaacttttaaacaaaactaaattaaaaaaaaaagaaaaaaagaaaaaagacagtgtttccaccaaagccacaattttttcacggtctttgctttttagtaaagctaatgcttacgactctctcaaacttcactttttgccttctcctcagaccaaatcttcttcttcttccttctctgttctcgacgaccttctcaaattcgatctcaactcaaaacatttgtctgatccattaatcggattcaggtgagaagtgtttagctttgttctcttgaaaatctccgacgttgttcgtgattattgcagtattttgtgttctgattttcgatttcaagttcttaaaatttgactttcaatttctatcttctttgaaatttgttactaaattggtatatgggtagttgttgttagctcttttgtttggtaatctagggttttgacatccatcaattctttatctctgtagctataaaatgtttttaaatgtgtgttgaatccattgttatttccaacattggcgtaggtactgaaaaaaacaatgttttgtttttgttgttttagatttttgtgaagattcaacaacagatctgtgagtccattggagtatattactattcatagtggttagacatctactagcattttctgtcttttattttgtttttgtctaagcatttttggttttgtttataaacagatacaatg

SEQ ID NO: 11604 - DNA, 3000 bp, Unknown; identical to SEQ ID NO: 11602
  misc_feature (1)..( 3000): cDNA_ID_2717530_gDNA_ID_2214505_Annot_ID_184096 3000 nt of promoter + ATG

SEQ ID NO: 11605 - DNA, 3000 bp, Unknown; identical to SEQ ID NO: 11601
  misc_feature (1)..( 3000): cDNA_ID_2717537_gDNA_ID_2214505_Annot_ID_184094 3000 nt of promoter + ATG

SEQ ID NO: 11606 - DNA, 3000 bp, Unknown
  misc_feature (1)..( 3000): cDNA_ID_3040509_gDNA_ID_2214505_Annot_ID_184093 3000 nt of promoter + ATG
gggatgtggggttcataactacgcaagcagggcagaatgcttcaaatgcaagacaacaagagattatggtgcgtaaatatatatatcctctctttcttcttttaaaatgttattctattgatttcgaacttttgaattgatatattttcctctttttgatctctaggtggcgtctaaatggacgagaaagagctaatgaagaatctcttgttttaattatacctttcaacaagtgtttctactttctaacatgcatgacgctttcttacgttgacttgaaatcaattgaaagtttagactcgtgcaaattaacgtaagtacaaatagttgcaaacaaaattttgaaacaattaaggcatcaatgagaccttattgcaaaaacaatcgagatacatagattattgacgatattttattttttagtacaaatatacgatctttagaggaagaattcactagaaatttaaagcaaatacaaggtatttgcaaatacgaaagttaaattctactctttcgatataccattttgcagaagcaattttaaagtacgctgtaaaaaataaagtaagttttgtatttgatctaacacttgtagctccagcactaacaactattgtgcttctacagtcacaatattaaaaagtatgggcgtaacttacatccgaaatatagttcgaaaatagaaatttgtcacacatttacaaggagcacattgctcaaatataataaagaggaagggacattctccaaagaatttcatgaaaccattctcagatgttttcaagataacacgtgtcttttttattttattttataacatggcatacctacactagataaaaacgaagttagatggcgtttctagtctcctgaggctggtatacatattcccaactactgcaagatgcactatctattcttctctctctctctccctctttcaaattatgaattaagaaatctaaaagaaataaaaaagagaattgaagatagtgttgtaacctgcttagaccatctccaatagtatttcatttttcactttttccttcattttgaaataaaaaatgaaaaaatcttctccaatagtacttcatttttatcttcaaaatgaagatttgaatagtgtatcttcatatttgaaggtatactattcacaattttgaagatgtgaacttttctatttacaaaataatccttaaaattctaacaaaattttattttgcaccaaacaaattatttatttttattttaatccaatcaaactaaaatgcaaaaataaattatttatttttatcttccttttccttatagattatttgtgggagaattatatgtctacaattgtatcataaatatatattttaattaatgttatgtaatgtgattttctttataataatgtattttacataacattaattaaaaagatatatttatgatacaattgtaaaagaagtgggttaaagttataaaagaaatggattaactaatgtataattgtatttgcttattattataaaagaaattggttaaaattcataagtttacaaagtaaagggtattattcataattaataataaaatagagatagaatatatttaagaatattccttttgaagtagaaaatgaaagaaaccattggaaaagtcttgtttcatttttgtcttcaaatttgaagaaattctaattttgaagaaaaatttgaagctaaccattgaagatgcccttaaagagagacgatcgcctttaaccaccactacctggcccaaaccaaggtcactgtaggttcatcgaatcaagctatttttacaaaacttttaagtttcagtctatactatgttcaagaattattattcttacatttttttgttaccatatatagctacgtacatatcaaaaattgtactgtacatagagcatcagcaacatatgaaatatttcacttattgacggatcaatccacgaatgacatcggtcatataaatatcaaacctaatatatatgatccattatatgatttacatgttctgttgattagaatttagaacctatggacttttgagtttttttttctctcttcgacttcattaaagaaaagaaattcatatgtacagatagatttaatataataatagtgtgtgtaatcctataaaatgtaatttaagtaaaaaccaacaaaattgaatatatcaaaattaaaaaaatattgaaaattgagggctattacgtaccatcagactaacataattgacatgtatcagaaactagttttcaattagaagattatttttgtataatcgaattacaaaaatttcagttttcttaaaatgcatgcgagatttgaatttttttatatataaataataagttgatagcccttaattttaaataagttttagaatactataggacaagttttagaactttgtactttttgcaaaaaaaaatccaattcaataaggagatttctccaaaagaaacaaatctaactaatttactaaatccaagatgcttctaaaatgttttttatatagtcatgcaattacatttcattattttctatttagcttttctttgtcatctcgtattataggggactttcttgagttattcattgtaatttctcataaataaatactaaatagggatttgaccatctttgggtcatcggattattctgatactaaggtaaagctggcataggattttattgttcaaacatttataacttttgagtaaacaaaggatagtggtggtgtcagcttggcggagcatgcctgacatgtgcatctcatcaattctcctttatgtttatatccacacttggatctatattgtttatcttcacgcatggttttaactttactacaataatttttaaaaaaatatgtacaaaaataaataaataaaaagacaaaagtgaaaaagagatgtatgtgaagaatatggataaatagtgaagacaagacagttattgtcttgcccttgagacgtatcta

SEQ ID NO: 11607 - DNA, 3000 bp, Unknown
  misc_feature (1)..( 3000): cDNA_ID_3040525_gDNA_ID_2214505_Annot_ID_184088 3000 nt of promoter + ATG
ctacaaagaatagctattggattggtcttatcaaccgctggaatggcagctgcagctctagtagagcaaaagcgtttatccgttgcgaaatctagttcacaaaaaacattgcctataagtgtgtttttacttgttccacaattcttcttagtaggagctggggaagcctttatctacactggccaacttgatttcttcataacacaatcgcctaagggaatgaaaactatgagcactggactcttcttgaccactttatcactaggtttctttgtcagcagtttcttggtctcaatcgtcaagagggtcacttcaacttctactgatgtaggatggctggctgataacattaaccacggccgactcgattacttttattggcttttagtcattctcagtggaattaacttcgttgtctatatcatatgtgccttgtggtttaagccaacgaagggtaaagactcagtagagaaggaaaatggcaagggattttcagttgaagactgctgaattttgttttgcaataattgtcttgtgtacaatattatcttgcaacaatgtcgctttccaattatgtttcttgtatattaagcaattggcttgtttttagattcctcccggtctcaaatattgtgtctttaccgtttatgttattcactctttttttttgcatcgtgaaaaataattatttaacgaagtatacttttaattttctggttacgtcctgtcgcgatccgattaatctcctttttttttcgattaatcttttaggttttatgctttagtaggtcgagaagatgagatccacatttaggcctttagctatttcatatctctttacctttgtgatctagtgtccggaacattgtagaactgtggagaacatcttgcaaaattaaagatggtcttaaaagttgtagaaaagtgttgaaagatctagattaattttgaccggaataaatccatctttatcgttgatttggaaggtaaacttgcattttaaagagtaggatctttcattagaagcgagttatgaagacgatgtgtaccaaaattctatttaatagcttaatgaacattatatttgttttagagtttccctgcaagctcactaggtaggatcgtgcatttgattcaccaaaaaactgtaaaactcatgagccggttctttaatatatttatggtcgaaaatcgtttatcgtcaaaaaatgttataagtagcaggcccagcccgtgcataagacagttgaaacagttactttagatcaccgatatacaaataattgaaaagctacaattctaaggttatctgtttggtttgcaactttaccctctatctccaaaaaaatataaatttaaaactaatacgtaatataacttatatatatatattataacgtttttacattcaaattcaatatatttttaaaattctagaagtatagttgaatttctcgtgagggttttaatataacacattattgtcaaaattttacaaatttgacgataacaaaaaatgttttattgcatattattttaaaatttgtataattaatggtaaaaactaattgtagaaattagctagttagaaaattttcttttgtacaaaacctatacagtattttattcttacaaaaatattttagatataaaaaaaaactcaatttacccttaaattttgttaaacggactctagtaagtaaatacttgatttgagttaattctagtaccgtccctttgtagacacagcgtgtgattgtgtctctctattggacttgtgtaaagctcttgtcttcactgaaattgcaaacctctctagtgtgttgagtgttgcacatgtatgaatatatactatactggttgaaagtagaggagatttagagctcatttagtgacaattatacttttaatagtatgagtcaaaaaataataaagtttaatcttttcaagtatatgtgttcaatcaaatatataaaaagtgaattaaatatttcttaaaaaaattaattatttataaaagaagaaaattgacggtctcaaaaaatattgttataatagtaaaaaataaaaaaaaaatcgattcactagatctcaaaaaatattgttataacagtaaaaggaatattataatagttttgatagtcaaattcactagatttttaaaattctcttcggcgaggtttcaatttaacaaaagatttgtcaaaatttataaatctgatgatagcaaaaataaattatattacatgttatttttgaattcgtataattaatttttagttttaaaagtataaataaaattgtagaaatgaattttgtgagaataaatagttttacttaattggtgtcattaattctagtaatgacacacttttgtcagtttgtgtctctctgctcactgaaattgctaacctcggatcttctttctccttgtttttctttaacaagtcggtacgaatccatcttttcccacccaagatctctccttcttgtttccccagatctgaaatttcaaaagctacccaattttaactcaagactctgaacaacacatctagatccatttccatggcgagcgcctggaaaaaagacaagaaccaaaaacttttatcaccaaagacactaatctcacttcttgtcctttccattatcttcctctcttctctcttcttcttcttctctaactcctctctccaatactccaatccaaatctctccatcaattccccataccctatccctccttttgattgcttcaaatgtccacaatcaaaacccataatcgcaaacgtcgtcgaaaatctcaagtacccttttgtttactctctcgctgatctcggtaatctcccggagaaaccacataagaacattgttaggctacttaaaggtaagccctttaggaaaccagatatctccgcaacgattcaggaggtattggatagtatgagagctagtggtaaaaatgggattgttgttgatgttggagctaatgttggtatg

SEQ ID NO: 11608 - DNA, 3000 bp, Unknown; identical to SEQ ID NO: 11598
  misc_feature (1)..( 3000): cDNA_ID_1394502_gDNA_ID_2214505_Annot_ID_184087 3000 nt of promoter + ATG

SEQ ID NO: 11609 - DNA, 3000 bp, Unknown; identical to SEQ ID NO: 11597
  misc_feature (1)..( 3000): cDNA_ID_2717549_gDNA_ID_2214505_Annot_ID_184086 3000 nt of promoter + ATG

SEQ ID NO: 11610 - DNA, 3000 bp, Unknown; identical to SEQ ID NO: 11596
  misc_feature (1)..( 3000): cDNA_ID_2717553_gDNA_ID_2214505_Annot_ID_184084 3000 nt of promoter + ATG

SEQ ID NO: 11611 - DNA, 3000 bp, Unknown
  misc_feature (1)..( 3000): cDNA_ID_1807304_gDNA_ID_2214505_Annot_ID_133745 3000 nt of promoter + ATG
caagaaattttgaaaggttttaagtttttgataggtatgtatgtgagaaggtatatgatattattttatttgattttaaatgtatgatattattttatttgattttaaatgtatagtcaactgcgatttgtatatgttttgttgatattatttatgttgttaagtgtttaaaattatacacttgtattttgattgttaattttagagtttcacctgtagtataccatcttgtattattatcgatctaaacccgtcaattctacgattttcaagcttgtattaaaaattgaatcacatcatacacattaaaaaatctaatatgttattaattattatagtatataagattataaattttcaaaacaatatgtatgactcagtactcagtagaaagttttcttaaatctatttttgacccattataatatttttcatgtattgaacagtttatattcgtttttaaaaattcaaattagggcatatgcgaaaaaactctaattattttttataacgatgatattattttttcgcaaaaatagaatcatataaagatgagaagtgaactataataattaataaaaattaatatgataatttagatatcaaatctaatttgttgattttaattggttacttttttggaaattaataatgcatttcgttttttaattaaatttaattaattaaatttgtatttgactttttaattcttaaagagatgaattaatttactttttaaaattttatttctaatgacatacctatgtaattacttacaaaaaataaggttacatttaaaatgtacttcccaaataatatagtaggatctaatattgtggtttagactacgtacagttataaattaaaactaatttaaaataataagtcaataatttgtttaaataagttttgttttctttctcattttatatcgtactctcatttttttttatcttgcaagtattaaagacgagaaatatagatctagatcgttactacaaaaacgaaaataacaccttaaacttaaaacacaatacaattctcataataataagtacacgacactactaataaaacacataactttgttaaatagactcaactccaaaacaataaaaatcttaaaattaaacatagaaatttagaaatttatttaatcagggaaacatttcgaaatgtgcaaatatctgtgtttgctaaatatacttataatttataattgatgtacatttgaatcacgcaactcagattagcatatatacaatttgcaaatacatgtaattttttggtcgagagtagttacggactacggagtattagatccatttgcattagattgatcattatcggttcatattagacatatgtgttcatcatcaaaaagtcatatgatacaatatgatatatgacttgatgatgatagccaactcgattatattccacatgcgatctggttcacgaatgattttaaagcgaacatacaacacttcagatgcaggttcgatatttttatgttcaacatcatcaaacaatagtaaacggtgtagaacatttatatcgtttgacgtgctcgaatatctaataaggtatgtcaattcatatatcatgagatgcaattgcttcaagaataacaatgatgattcttttatcttttcgagtgagttgacgtaattaataggtaagggttctcaattaaagccaaaaatcacattatattgatgaaaaagtcatgagaattactgataaaaatattattaaaacataaagagaaaaaaaaacatattaataaagctgaaagagacatacacacattattaaagcggaaagagaccgaatacaaacacacacttgacaactattaatttccaaataagtcgtgactcaaacttctctaaaagctctttactccgatcatcgagattctctttttcacttactctctcataaacatcttcagcttcttagattcaatcatttctttcattaattggtttgccttattttgcgccatgcttattttgtctcgtttcaattcttggtccttagattgtttaaattcattacactcttcgttaatcactactaaatttacgtgatctttctagatgtattttctcttgctttgatgtgcatagtcttcctttatcttggttcgacgatctttaaactggttcacgatatacctcttttcaatttcaaactgctttttgtaagttttgatatcaagaaaatattcagatggattcattgatatttttttagtaagttgaaatttgtgatattgatataacaatggaagtatgagtcccattttataaagaacaaaaaaatcaagaatctacacagccaataagaatacaacatgtatccattccatattttaatctaaaagaaatttctttgcccaatcaataaacaccacatggcatgttactaattattatttaaaacctgtaaattctatttaattttttttgttcttttttctgtattaaactgaaaatagaaaagagactactttaactttaacaaatttattaatgtctttagtcttataaacctccgctccgtttattaggctcctcttcgtccccaacggctagtaataaaaaataacatttttataactaacactcaatttaaacccttagatctcaattaaaagcaaaatcaacggtcacgattcgattcgattcgaacaaaaaaggaccgttagagagagctcaaacttttccttttcaaaataaaacagtgccctttcctcaaccacaaatcttcaccattcgcaatttcacagtcgagaaaaaaaagttagggttttatttgttgttcctgagagaagcgaaagagatttttgattcagagagagtggcgtctggttgggttgaagccgggacgggaaagagtcgtctccgggatttcttttcttctttgttaacgagtcttggaggagcgttacttcagatcaccgaagaagaccaacaacaaggttcagatatt

SEQ ID NO: 11612 - DNA, 1291 bp, Unknown; identical to SEQ ID NO: 11603
  misc_feature (1)..( 1291): cDNA_ID_2706949_gDNA_ID_2214505_Annot_ID_133746 3000 nt of promoter + ATG

SEQ ID NO: 11613 - DNA, 471 bp, Unknown
  misc_feature (1)..( 471): cDNA_ID_2707010_gDNA_ID_2214506_Annot_ID_133747 3000 nt of promoter + ATG
ttcagcttaataccttttgaacaaatgtgtacaaaaccagtttaattttgacgagaaccggtcgaatatttaaccgatttggcttgattttcaaaaccatgaaaactttacaattaaaatttgagcggtctaaaccattagaccgtttagagatccctccaacccaaaatagtcgattttcacgtcttgaacatatattgggccttaatctgtgtggttagtaaagacttttattggtcaaagaaaaacaaccatggcccaacatgttgatacttttatttaattatacaagtacccctgaattctctgaaatatatttgattgacccagatattaattttaattatcatttcctgtaaaagtgaaggagtcaccgtgactcgtcgtaatctgaaaccaatctgttcatatgatgaagaagtttctctcgttctcctccaacgcgtagaaaattctgacggcttaacgatg

SEQ ID NO: 11614 - DNA, 3000 bp, Unknown
  misc_feature (1)..( 3000): cDNA_ID_2708068_gDNA_ID_2214506_Annot_ID_133749 3000 nt of promoter + ATG
atggacaagtatttgcattgtgttaatagtaatgtcgatggctcgtgaagctgtctctacaaattatgcagaagctctcaaaaacagtcttttgtatttcgaagctcaacgttctggaaaattgcctccgaaccaaagagttacttggagaggagattctgctcttagagacggttctgatgctcatgtaatttaacactcaaatccttttttttttttttttttgtaatgtatgtttatcaagttcaactaaaatatttgctatttgtaaaaatgtatagattgatctcaccggagggtactatgatgcgggagacaacatgaagtttggatttccgttggcgttcacgacaacaatgctagcttggagcaatatagagatggcatcacagcttagggcccaccacgagaagggaaacgctctcagggctctcaagtgggccaccgattatctcattaaagcccatcctcagcctaatgtcctgtacggacaagtgggtgaaggaaactcggaccacaaatgctggatgagacctgaggatatgaccactccgcgtacttcataccgcatcgatgctcaacatccaggttctgacctagcaggtgagacagctgcagcaatggcggcagcgtctatcgcctttgcaccatctgataaagcctatgccaatatactcattggtcatgcaaaagatttatttgcattcgctaaggctcaccgtggactttaccaaaactccattcctaacgcgggtggcttctacgcgagcagtggatatgaagatgagttgctgtgggctgcagcttggctccaccgtgccaccaacgaccagatttatcttgattacctaacagaagcagaaacaggaggtccaaggactgtttttgcctgggatgataagttcgtgggtgcacaagtcttggtcgccaaggtagtttatgactatttcactaaagaaacatatcactgacttatttgacaagaaacaaacataatacaaaaatttgcaaatgcagctagcacttgaagggaaagtagagagcagtgaacagatcgtagagtacaagagtatggcggagcagtttatctgcaactgtgctcaaaaaggtgacaacaacgttaagaaaacccctggcggtttgctctacttcttgccgtggaacaacctccaatacaccacagccgctactttcgtcctctcagcatattctaaatatcttgaagccgcaaaagcctccatcgactgtcccgatggtgctcttcaagcttctgatcttctccaagtcgctcgttcccaggtagttaataaaacctaatatagtaccaactataagacatgttgttgaaaagatatcaagactttttcagtataatatttactaatttgcgatttcctcatgtgatataggttgactatatacttgggtcgaacccccagaaaatgagctacatggttggagttgggaccaattatcccaaaaaaccacaccatagagcagcctccatagtatcgatcagacaggacaaaacaccagtgacgtgtagtggagggtatgataaatggtataacaatcctgcaccaaaccctaacgttttagcgggagcagttgtcggaggacccgacgataacgatgtttatggagatgagaggagtaatttccagcaagctgagcctgcgacggtcactactgctccgcttgttggtgtcttggccctcgttttttaattttgtctctcctcgttttgcaaatttgagtatgtttgctttagaccttgttatcttatataagtcctaggctgttcattgatttaggtctaaatgtaatttggcttgaaaatataatataattgatagttaaaagttaaaaaccaatatatttcagaaataattgatcttgaactggaaactattttctacatgattggatcataattgaccaagaaaaaatgtatttttgctactgagagaactgtaagctgaggaaaatagttctgcttctttctctgtttataattccacattttaatcactaatttatcatcaatgtccatatatactacacaacgcaattttgagtacctcacttttccctgactttcaagcttggactttactgtgaagtacaacaatcctctgtcaaagctgtaattaaaatccttcctttattattggatcaggcttaattcccaaagacaactaacacaaaatgtaaactaaaccaacgtcgacatctcatcaattttccggggaatgtttttcaacttcaaatttcccaaatccaacccctttttaactattgttttttaagaaaaatgaggaaaaaatatcttcaaattagtaaccctaatttttaaggcttattggattgtcactgtccagatgagttagtcccattggtttgtagggtaaatgagtttctagcctatatgactccttcgactttgggtttgatcatagcctaaccattataatttggactgttctatgacatgatcatcagcccatttgacatccctatcaagaatgtgatttttctctattttcaactaaaattgtgattaaaaatatcttaaaaccctttccgaaactctttcttaagaaatttaagaaattttgaataacattggatttcatatgacttttataaatgattatttgaataacaagaaagtgtaaatgattttacctaagtttcatgttcagtactaaactaggatttggaaagatatttagaactcaatatttgaataacatgagatattaaagaaaaaccaaagtcttctaaaattcttaattcttagttgaataacagattacaacatttttagctaattttttttttgagcaagtcctttactagccatggactccatcatttatagattctctataaatagtgaatacatacatagacatagacatccaaaacacaagcaaaaagtaaaatctattgtacaattggtcttgagatcgtctaaagatttatcaaaaaaagatg

SEQ ID NO: 11615 - DNA, 3000 bp, Unknown
  misc_feature (1)..( 3000): cDNA_ID_2708064_gDNA_ID_2214506_Annot_ID_133750 3000 nt of promoter + ATG
aaatggttaaaaatgatgcaaaaaaaaataaaataaaaattaagacaaaatctgtaaattttatacaaaagattgaaagaatattgaccaaaaactgtaaatttctacatggatagtaagaaactttcaaaaaatgcataagattattaatagatatatacataagaaaaatagaaggaatatatttttaagaagatagcctaactaattatagttcgcaatcttattggtcttgtctatatcttttaggataaatgagaagatgtctaatattatgagatctaggtacaacatttttagctaatttatttttgagtaagaactacgaatgttaatgatccttaattagccatggattccatcttatatagattctctataaatagttgaacacggacatatacatagatatgccaaacacaagagaaaatcaaatcaattctacaattggtcttgagatcgtctaaagattatttaaaaaaacgatgtctcaactgaaaattggatcttcacaatgcttatggacaagtatttgcattgtgttatttgtattgtcgatggctcgtggagctgtctctagaaattatggagacgctctcacaaagagtcttttgtatttcgaagctcaacgttctggaaaattgccttcgaaccaaagagttacttggagaggagattctgcgcttagagacggttctgatgctcatgtaatctaaatctcaatccctttttttttgtattgtaatatatgtttatcaagttcaactaaaatatttgcttattgtaaaaatgcataggttgatctaaccggagggtactatgatgccggagacaacatgaagtttggatttccgttggccttctttacaacaatgctagcttggagcaatatagagatggcaacacagcttaaggcccatcaagagcaagaaaacgccctcgcggctctcaagtgggccaccgattttctcattaaagcccatcctgagcccaatgtcttgtacggacaggtgggcgatggaaactcggaccacgagtgctggatgaggcctgaggatatgacaactccacgtccttcatttcgcattgatgctcaacatccaggttctgacctagcaggtgagacagcagcagcaatggctgctgcgtctatcgcctttgcaccatctgatgaagcctatgcccaaatactcattggtcatgcgaaagaattatttgaattcgctaaggcgtaccctggcatttaccaaaactccattactaacgcgggtggcttctacgcgagcagtggatacgaagatgagttgttatgggctgcagcttggctccaccgtgccaccaacgaccagatttatcttgattatctaacacaagcatctggtacaggaggtccgaggactgctttttcctgggatgataagttcgtgggtgcacaagtcttggtcgccaaggtactatttcactaaagacaacatatcagtaacttatgtgacaagaaataaacatatataacacaaagtttttgcaaatgcagcttgcacttgaagggaaagtagagagcaatggaaagatcgcagagtacaagagtatggcagagcagtttatctgcaactgtgctcaaaaaggttccaacaacgttaagaaaacccctggcggtttgctctacttcttgccgtggaacaacctccaatacaccacagccgctactttcgtcctctcagcatattctaaatatcttacagacgcaaaagcctccatccaatgtcccaatggtgctcttcaagcttctgatcttctcgacctcgctcgttcccaggtagttaactaaccctaatatagtacataccataagacatgttctgatgttcatacaatattaatgtgtgatttctacaacatgttatataggtagactatatacttgggtcgaacccccagaacatgagctacatggttggagttgggaccaattatcccaaaaaaccacaccatagagcagcctctattgtatcgatcaccaaggacaaaacaccagtgacgtgtagtgaaggattcgatgcatggtttaacaatcctgcaccaaatcctaacgttttaatgggagcagttgtcggaggacccaacgataacgatgtttatggagatgagaggactgattaccagcatgctgagcctgctccggccactgctgctccatttgttggtgtcttggcggccgttgcttaatctttctctttgttttgcaaatttgagtatattgctttagaccttgttatcttatataagtcctaggctgttctttaatctaggtgtgaggtctaaatgtaatttggcttgaaaataaaatatatttgatagttaaaaccaataattaatcttaaactgaaattattttctacatgattagatcataaattgaccaagatgtccaatattgaccgattcgattttgggcgtgacaagcaccaaaccattataacttggactggtttatcatatggtcattaggcccatttgacatccctatctagaggtgcgatttttcttatcactattttcaactaaaactgtaaataaagtctttaaaatcctttccaaagctctttcttaacaaatttatgaaattgtgaataacaatggatttcatatgactttataaatgattaattgaataacaagaaattctaaatgatttgaatgattttacataagtttcatgttcagtaaactaggatttggaaagatatttagaactcaatatttgaataacatgagattttaaagaaaacccaaagtcatctaaaactcttaattcttagttgaatacaacatatttagctaaaatttttttgagcaagtccttaactagccatggactccatcttatatagattctctataaatagttgaatacatagacatatgccaaacacaagaaaaagtaaaatcaattgtacaattggtcttgagattgtctaaagattaattgaaaaaacaatg

SEQ ID NO: 11616 - DNA, 3000 bp, Unknown
  misc_feature (1)..( 3000): cDNA_ID_2707006_gDNA_ID_2214506_Annot_ID_133751 3000 nt of promoter + ATG
cctattccatgaagatttagtacgttgatcgttaaagtaatcctattattcagaatataatcaggaaaatatttatttccgctcatggtcatggatcacgatattttctggcaccgtcattgattattacttactaagatagatacatcctctatatagcgaataagaggatcacaattattttttctggtaccgctcattgattatatgcatggtctttatactgaaaaagggatcacgtaccaattatatagatacgtaaatataaggaagtatatatatatatatatattgattacatatgtagatacgaatatgctatatatatatatatatacatatatgtacgtctaatattttgtcagtaaaaatagcttacaaccatgtcttgtatatcatcacaatgcttcatcacaatcaaaagcatttgcattgtgttattattatcgattacttgtggagcagtttctgcaaattcaaattatggagaagctcttacgaagagtcttttgtatttcgaagctcaacgctccggaaaattgcctttggaccaaagagttatatggagaggagattctgcactcagagatggttctgatgctcatgtaagtttaatatccaaatctattttatttcattattctttttctgtaatgaatatttattacttgaaataaaatatttgccaattgtaaaaataggttgatctcaccggagggtattacgatgctggagataatatgaagttcggatttcctttagcgttcacaacaacaatgctagcttggagtagtgtagagatggaatcacagcttaaggcccatcaggagcacggaaacaccctcgcggctctcaggtgggccaccgattatctcattaaagcccatcctgagcccaatgtcttgtacggacaggtgggtgatgccaacttggaccatgcctgctggatgagacccgaggatatgaccactccgcgcccttcataccgcattgaccctcagcatcctggtgcggatctcgcgggtgagacagcagcagcgatggctgcggcttctttggcatttgcgccatctgattcagcctacgccaaaacacttattagtcacgcaaaagaactatttgaattcgctaaggattaccctggagtctatcataactccattcctaacgcgggtggcttttaccctagcagcggttacgaagatgagttactttgggccgcggcttggcttcaccgtgccactggagaccagacttatctcgatcatctaacacaagcttctaatagtggaggtgcaaggtccgtttttgcgtgggacgataagttcttgggagcgcaagtcttggtagccaaggtaggttatatgactttcctaaaagagaccatacccttacttacgccacaattcactcactcttttgcaaatgatagcttgtgtttgaagggaaagtgaagaacgaagggaagatgattgagtacaagagtatggcagagcaattcatctgcaactgtgctcaaaagggtttcaacaatgttaaaaagaccccaggaggtttgctctggttcttgccgtgggacaacctccagtacactgccaccgcttctttcgcattagccacttatgcaaaatacctcgaagctgcacaaacatcgattcaatgccccaatggtgatgtccttcaagcttctgatcttcttaaccttgctcgtgcccaggttaggcaggcattcgtgtttttcccttttaaattaaattacgttttgagaatcctcaagacttaattcttataaagatatgcaaagtgttcgtaatcttcatagttcttaggattttctgtgatgattacatggtttatgactaaaatgattaacataagaagaaaacaatttacatggtttatgtaataggtagactacatacttgggtcaaaccccaagaaaatgagctacatggttggatacgggaccaattatcctaaaagaccacaccatagaggagcctctatagtgtcaatcaaaaatgatcctaaaccggtgacatgtaatggagggtttgaagcttggtacaacaatccaaaaccgaatcctaatcttttggttggagcaattgtaggtggaccggacgagtacgatgcatacggagatgaacgatctgattttcagcacggcgagcctgataccgtcacggttgctcctttgcttggtgttctggctgccattgcatgaccttaagtattattttctttggactacatttcccaaggacgctctagcaactaacgttttaggtctaagggtagagaaacaaaatttgatttgttaaaatatcttgatttagtgagacattttgaagactgatgaggtttttcctctgtttcaagactaaagtgatttcggctcggttaagttattttggtttgtagcattgattctcttgaaaaattttaacaaaaaaaaaaaaaaaaaatctaagatatctgtacttgtactatcattcaataagaaatcaacaaatggttaaaaatgatgcaaaaaaaaataaaataaaaattaagacaaaatctgtaaattttatacaaaagattgaaagaatattgaccaaaaactgtaaatttctacatggatagtaagaaactttcaaaaaatgcataagattattaatagatatatacataagaaaaatagaaggaatatatttttaagaagatagcctaactaattatagttcgcaatcttattggtcttgtctatatcttttaggataaatgagaagatgtctaatattatgagatctaggtacaacatttttagctaatttatttttgagtaagaactacgaatgttaatgatccttaattagccatggattccatcttatatagattctctataaatagttgaacacggacatatacatagatatgccaaacacaagagaaaatcaaatcaattctacaattggtcttgagatcgtctaaagattatttaaaaaaacgatg

SEQ ID NO: 11617 - DNA, 3000 bp, Unknown
  misc_feature (1)..( 3000): cDNA_ID_2707002_gDNA_ID_2214506_Annot_ID_133752 3000 nt of promoter + ATG
tccagacaaagcgaataatgtcgacaattagtgttgtttcatatactagcatacgtgtagtctcgagaattcgaatctagaccaacattttggaaataattaatgactagtagtatacaaagtcaaatttaaaaaaatgtttttaaattttttaaaaaattgaaaaaataaaataaaatgttatttagtgcttttaggaggaagatccaatatctttcatgtctctgcaaaaacattttcctacttttaaagacatcacacttaactaataaataattcaaaattaaaataatattaacttttataataaactattgtaaagacatctctaaaaaggtcataaatgaagatgctcttagagcaaccccaaccttgtatcttagctaattcttagctagttcttagatataaaagtgattaaatttaataaaaccaacaaaccttagctaagataaacatcttaactaagatgttttcttaaaactaagaaaagtataggtgttgtgttttaattgggtagaaaaaaaagaataaaaagaggacataatttgaatgttgttttttaagaaaccaatagttcttaaccattggagtaaaaattagttaaactttttctaacttttcttaacttagtaaaagcaacattttaatttataataaggttaaaattcaaaattaagaaccaattggttctaaaccagtggggtcgctcttagtatatgttaatatatgtgtttccaaactacaaacaaatattaaccagcttcgttagttctgccataataatctccaaacattttctcgataaaatagattattaattttctcgagaatgtttgttgaaactgtgattcaactctctcagttcattgccgaatccgtcattatcgtctctgtagccgtcttcactctccgtctcttctatagattcgcttgtttcctcgcgagccgttcttggcgtcgttaccgtacattcacggtccatcatcgccggagatggagaaaaaccacagccgaggaaaaacattcatcaccgtattgtacgatttgtctcgaaaatgcgacggagggagaaaagatgaggcggatagcagcatgcagtcactgtttccacgtcgattgcattgatccgtggttggagaagaagtccatgtgtcctttgtgtagagctgagatcccgccggtcccgccgggaaatcctctgcgcgcgctttttattcctcccggcgtgattgagatgttcaccaaaggaatcgactccgacgcgtaggagtactgcttctctttcgtcatctcaaactttttagacaaaatattaatccgttgaattaatatttgtttatcaaaaataatatttactgtacgtataattcgccgaatgataaagagtttacacaacataaaaattagataaaactctaatatgttggtgaccagaaaaatattcgacatgacgacatagttatgcattaatggagaatcatatactgtatattcgacattatacgtcacctacaaactttcgttagtgttagaaaatgacagtattaattagtgtttataaaactttttatgagatgcaagtacactcctaggatttgttttttcttcactaatttagaaaatttcttacccactctaccacccaataaaattgttctgtgtcgaacaagtggttttagtctataaaatgacggatggtttgaccaaaataatataacaaagcaaaaaaaataaagctagattaaaaaataatttatgacttaacggccaacgaatccgtcaaagtattggcactacgtgtggcggaataaaagaattataactataagaaaacaaatttctgatcctaaatattcttgatttgtcatccgtagaggagagtagcgattagcactagtcagatcagtcagactctacgtgaatgaaacgataccttttgtttgatcattattgcagtcattgcttcttcacctatttgcatagaagcgaaaaaatatttggtccgcgattcttgtaatatggtcaaaacaattttaaaagatctccggatttaattttctcatcaagatatatacgtatccactatgcaacgggtgtgaccagaagctgagaagacacatgggttacgttaaaacgaaatactaaatgaacaaaaccatgatgggcccattcatgatgaggttgatccatttgagaattggttctctcttggaacttgaatcaagtaacacttccatacttgtgagtctatgaatatttagatcttttgacattgggattgtatttattgattatgcaattgcaaggaaatgtacgctctcgcactcaaattttttttaactggggcaataattaatttaagacccaacattacagttagattggaaattaaataaaaactatatgggtttgagtcaacgacttcttaacacaaatcactaaactaattagagaaagctacactatatgcattacgattcttattagttattaatcagtctctttgccataaaataaggagaacaaaccagaaagttaattaataaataatatataagttgtagtaactgtacttttttcggggaattcattgaaactttcaaatgtgttgcctattccatgaagatttagtacgttgatcgttaaagtaatcctattattcagaatataatcaggaaaatatttatttccgctcatggtcatggatcacgatattttctggcaccgtcattgattattacttactaagatagatacatcctctatatagcgaataagaggatcacaattattttttctggtaccgctcattgattatatgcatggtctttatactgaaaaagggatcacgtaccaattatatagatacgtaaatataaggaagtatatatatatatatatattgattacatatgtagatacgaatatgctatatatatatatatatacatatatgtacgtctaatattttgtcagtaaaaatagcttacaaccatg

SEQ ID NO: 11618 - DNA, 3000 bp, Unknown
  misc_feature (1)..( 3000): cDNA_ID_1013645_gDNA_ID_2214506_Annot_ID_133756 3000 nt of promoter + ATG
cattgttctcactcccggtggacatcgtattgaacatcttagccttggtaccaaaacgatattacccaatcctctgttgcgtctccaagtccttgcggagtctaattcgctcgccggagattcacaagacgcgatctttacacggaaaggactctctttatctatgcttctcgaccagaactacatacccgaaccggaaccggacgacttttcactggttcactctccggaggaatgataacaagatgaatacgactgagaatgtcttcgtctccatcgatgttccttatcgtcccgggcatgcttcttaccctctttccaatatcgcaattgatacagagatttactgcattcccggatataattttccctcatcatcaatcgtatggatctttgacacccaatctggacagtggcgtcaaggacctagtatgcaagtggagcgattatcagctaccgtaggactagtcggtggtaagatctatgtgatcggaggcaacagaggcgaagagatcctagcggaagtatttgacttaaagacacaaacttgggaagcagcgccgattcctaaggcaaaggatagaaacgaatggttcacgcatgcaagtgtttcacttgataggaaggtttatgctttaaattcgagggaatacatgaattcttacgatactagagatggttcttatcaaagatatacgatacctgaagataattggtggaagacaggaaaatgcgtgattgacaatgtgctcttcgtttacttccttagatttgggttaatgtggtatgactctgagctgatgttgtggagagtggtttatggtttagatcttgacaaagctcgatgcattgggatcggggaatactacggaaagttggcgtttatatggggaaaaccaagtaatgttagtgaaagcaaagagatttggtgtagaatgattggcttgcttaggagtgaagtaggaattcatggaactgaagaaccgtctcaacttctcagaatcgttcctaacaactatagtttgcgccattgtctgtctctttcgggttaaacttaatcaagagatatattgttgacgttagatgtttatttagtctttctttagtcattatgatcaatatcactacaatgtgtttacaagattcattgctgttgcggtttcagcatcttgctttgttccttccaccctatccattttgcataattagcttagcaagtttttaatattgtaagttcacccattttgtcccatttactaaaaaatcgattcaaacgaaacctgaaatgtatctcctaattaaaacatctaacttgtggatagagatattggtgtattttggtacaaatgctgtagttgagatgaagcagaaaacttgtccaaatgaaaactactgtctgtattcgatccaaaagatggctgacaaacaattctagttaatagcacgttatgatgtaatgtagtatataagatccaatttcttggtcttgcatatgtatccaagagagacgatcagttttttaaaacaagtatgtttttcaaagattcgtcttcaatgtatgatcaagaccatgctaagaatcaagtgtattatatacaaatcgtattaaagtattaactcaagaaaaagtgtcaactttcacaagattcaagcaaaaaggttttctttttaagaaactggaaccgttaaaagagtcaataacaatgctctccaaataaaagtgatttttttgcaaatcccattatggcattatcaaagagagaagaacctcatacaagaaaaaggaaggagaaaccatgagagagcacacagcgattagctagacattggatgattgtaaacgtattcaatggcgagagagcaagaatcgatcttgtcagcttctttgtctggaatttccagcttgaattcctcttcaatagccatcactatctccactgtgtccaaactatctaatcccaaatcgttttggaaatgaacctcaggagtcacctgtcgatatttatcacaaagccatcaacaaaaataaccctaaccaaacaacccttattagagagagttgatgaaggattcataaatgcaaaatccataagaatgaccatatcaaatcaaatccataggaacaacaacacgataagctacacttactaaaccacattgagatcaataaccttcaatttactaacaacactaatgcaacatcgtttcagatacatttggtctctatttccactagatcaatacgaaatcaaccaaaagctcctacattgacaaatattcaaggcaaaataatcattttgttcccaataatgaggaaaacaaaagataagaatcacgatttggccaaattttatgaagatcgagctgaccttagagggatcgactttggggaagctcttgacaacatcgagtactctatcgacgacagcttctctgctaagatgatcatcgtgcgaagaaaatgaccggatcgtaccaaggaacccaattttagactgattcaatcctagggtttgcaccggaaccctcaggtgacgaagaattgcatttctcagtgccattttcgtctctttcttcgagctcgagaattagggatttgatttgatgagagagacacagaagagtcaagtagccaaaaggggcaaaaatagttcaggtcatacgagatgacacgtgccccctactataaggctagcccaaatccttacgtgggcttataaatgctgcccataatgtagtaaattccttaatcagcttctaagtttttatatattttgtaacttatctcaaatagtttctaatttaacataaatgacccaattgggtcactcgaggaataaactgcaatttacgaataacaaactctcactaatacagtatttgcaattccagagcgacgggatctctctccggtaaatatcggaaacttttattctcagcaaagcgagatctcgacgtttctcagatccgtccggcgagttagatccttgagaaatcatg

SEQ ID NO: 11619 - DNA, 3000 bp, Unknown; identical to SEQ ID NO: 11614
  misc_feature (1)..( 3000): cDNA_ID_2708068_gDNA_ID_2214506_Annot_ID_184111 3000 nt of promoter + ATG

SEQ ID NO: 11620 - DNA, 3000 bp, Unknown
  misc_feature (1)..( 3000): cDNA_ID_1399068_gDNA_ID_2214506_Annot_ID_133757 3000 nt of promoter + ATG
atttaagtgatctgaactaacgacatgtgtacgaaattaattatctgtttctttatgggtcaaagattaaaaatgctgtgcttctttctctatcagactatcacatggaaagacgaaacgaaatgagagtttttattacctagcagctcacagttatacataattaaattcatagaccgacaaatcacagttttgagaaataagtaaacaaaagtactgaagcagcgagcatttgaaactccaaagaccacaaaagatcacagttagggacaaaccatagctaaaacagagtcttctttaaaaacaatccgatgaagaaaaaaagttgaaaaacaggcaaaaattttacagatggaagacgataactgatcgaatcatgcaaaggggcttgaggacattttttagtagtgtgttttgttgttctctatcgatttgttgttgtgttgttgttgccaaatctaacaagagcatcctcctgattgctgctgagcgagagatgcatttgcattggaagacttgagattgacatcaaccatatcctcttgctttgttgaagacaatgtctccattcccggcaaagctgctgctatcttgcggaagagcgcctagcaatacaaaaaggtttgaaatcataagaaaacaagatttgcacggagtgatagcgttatggatttgcggtaattgtttagagagtatcagtgaaagatccatacaaatgaggaggatgtaataatcagcaggttgggttaaaaatttataagtctaggttaattaactattgaatattgatggaactaaacaaagttagggcttagttgaactaagcagcaagtttttgttgtgcaagaaaccctcagaaatgtgtcaagccaagatctttgttaccttaatgttgaagcccgctttggcactggtttcgatgaacattacattaagttcgcgtgccttagcttctgcttcctctattgacacttgcctgagaaacaaaatatttaatacaaaggcccaattggcagtaacaaatgtagtaggcaccatcaagtgtcaaagcgtgttgactataaagaaaccctgtaaagatatgcagttgagcagcaaatgattttccatttattatcttgtagggtcgtttggcaacatactcaataccaccagaaaagtaagacgtggtttaacaacagtttgtacttgagtaaaacaaaaaagacacccattcgtcttgtcaacatacttacgaaatcagagcgtgtttaaacaaggaggactaccaaatttcagtctcaattgctattgaacagtaatttgcacatcatggtttaacaagaaacaagtagaggaagagatggtagatcattattaccttttgtccactagatcagttttgtttcccacaagcacgactatgacatcactaccacgttctgtcctaacctcatcgatccacttagtagtgtttaggaaggactgcctgcctatatgtcagtggaaaacaaaataaatctcgagtttcacaacgcacaatggatcaacataaagaagaaatcgaaacgcataaattcataagattactgaaaaccacatccccaagatctcagatatgggaaaatattcatgtgtttgagagaacgagtgaaggtacacatacttgcaacatcatacacaataacagcaacggaggaatccctgatatagctcggaattagactcctgaatcgctcttgcccagctgtatccctgtcatatgatttcggctctcgatgttaatcatcaaaaaatgatctgcaatgttattcttcagtattcgaaaattgaaagaggctcaagatcttaccacaactgaagtctgaccgttcgatcttcaaggtacattgtctttgatagaaaatcaataccaattgtggcctgatgattatgaaacaacataaaaactacttagaaaaggaagaacattctgtaaaatgacgataagcaagcatggttcacatattattaggagcttaaacgtaattctcataatcacagaacaagatcagatgctttcattcatcaattgagaactaattcgattagataaacaatgataacatgatcaaagaaacatcctcatattagtgttactgcgatcttctattggactgaattctcgactttgtacaataaacgagagtgagcgattacgatgccaaaatctcattcagctgattgttacgtcctatacattgactaaaacacgatctacaaatcagatcacacataattacgcaaaaccaaacgcccgatcacgtaaacgagtaagaacttcgaactgaaaaacacgattcccgtccatgaaaacggatctcaaaatcaatcaaaccctgggattttcccgactataatccctcaaaatagaagcaaacgtcgtgcatcgtcgagataatacctagatttgaacaatggaaatttacctggtaagtgttgtcgaatttgtcgtacatgaatcgagtaatgatactggttttgccgacggattgatctcccagaaacaccagcttatacttagcgagtgccgagaccggagccatgatttctcaaggatctaactcgccggacggatctgagaaacgtcgagatctcgctttgctgagaataaaagtttccgatatttaccggagagagatcccgtcgctctggaattgcaaatactgtattagtgagagtttgttattcgtaaattgcagtttattcctcgagtgacccaattgggtcatttatgttaaattagaaactatttgagataagttacaaaatatataaaaacttagaagctgattaaggaatttactacattatgggcagcatttataagcccacgtaaggatttgggctagccttatagtagggggcacgtgtcatctcgtatgacctgaactatttttgccccttttggctacttgactcttctgtgtctctctcatcaaatcaaatccctaattctcgagctcgaagaaagagacgaaa

SEQ ID NO: 11621 - DNA, 3000 bp, Unknown
  misc_feature (1)..( 3000): cDNA_ID_2706991_gDNA_ID_2214506_Annot_ID_133759 3000 nt of promoter + ATG
tccctaattctcgagctcgaagaaagagacgaaaatggcactgagaaatgcaattcttcgtcacctgagggttccggtgcaaaccctaggattgaatcagtctaaaattgggttccttggtacgatccggtcattttcttcgcacgatgatcatcttagcagagaagctgtcgtcgatagagtactcgatgttgtcaagagcttccccaaagtcgatccctctaaggtcagctcgatcttcataaaatttggccaaatcgtgattcttatcttttgttttcctcattattgggaacaaaatgattattttgccttgaatatttgtcaatgtaggagcttttggttgatttcgtattgatctagtggaaatagagaccaaatgtatctgaaacgatgttgcattagtgttgttagtaaattgaaggttattgatctcaatgtggtttagtaagtgtagcttatcgtgttgttgttcctatggatttgatttgatatggtcattcttatggattttgcatttatgaatccttcatcaactctctctaataagggttgtttggttagggttatttttgttgatggctttgtgataaatatcgacaggtgactcctgaggttcatttccaaaacgatttgggattagatagtttggacacagtggagatagtgatggctattgaagaggaattcaagctggaaattccagacaaagaagctgacaagatcgattcttgctctctcgccattgaatacgtttacaatcatccaatgtctagctaatcgctgtgtgctctctcatggtttctccttcctttttcttgtatgaggttcttctctctttgataatgccataatgggatttgcaaaaaaatcacttttatttggagagcattgttattgactcttttaacggttccagtttcttaaaaagaaaacctttttgcttgaatcttgtgaaagttgacactttttcttgagttaatactttaatacgatttgtatataatacacttgattcttagcatggtcttgatcatacattgaagacgaatctttgaaaaacatacttgttttaaaaaactgatcgtctctcttggatacatatgcaagaccaagaaattggatcttatatactacattacatcataacgtgctattaactagaattgtttgtcagccatcttttggatcgaatacagacagtagttttcatttggacaagttttctgcttcatctcaactacagcatttgtaccaaaatacaccaatatctctatccacaagttagatgttttaattaggagatacatttcaggtttcgtttgaatcgattttttagtaaatgggacaaaatgggtgaacttacaatattaaaaacttgctaagctaattatgcaaaatggatagggtggaaggaacaaagcaagatgctgaaaccgcaacagcaatgaatcttgtaaacacattgtagtgatattgatcataatgactaaagaaagactaaataaacatctaacgtcaacaatatatctcttgattaagtttaacccgaaagagacagacaatggcgcaaactatagttgttaggaacgattctgagaagttgagacggttcttcagttccatgaattcctacttcactcctaagcaagccaatcattctacaccaaatctctttgctttcactaacattacttggttttccccatataaacgccaactttccgtagtattccccgatcccaatgcatcgagctttgtcaagatctaaaccataaaccactctccacaacatcagctcagagtcataccacattaacccaaatctaaggaagtaaacgaagagcacattgtcaatcacgcattttcctgtcttccaccaattatcttcaggtatcgtatatctttgataagaaccatctctagtatcgtaagaattcatgtattccctcgaatttaaagcataaaccttcctatcaagtgaaacacttgcatgcgtgaaccattcgtttctatcctttgccttaggaatcggcgctgcttcccaagtttgtgtctttaagtcaaatacttccgctaggatctcttcgcctctgttgcctccgatcacatagatcttaccaccgactagtcctacggtagctgataatcgctccacttgcatactaggtccttgacgccactgtccagattgggtgtcaaagatccatacgattgatgatgagggaaaattatatccgggaatgcagtaaatctctgtatcaattgcgatattggaaagagggtaagaagcatgcccgggacgataaggaacatcgatggagacgaagacattctcagtcgtattcatcttgttatcattcctccggagagtgaaccagtgaaaagtcgtccggttccggttcgggtatgtagttctggtcgagaagcatagataaagagagtcctttccgtgtaaagatcgcgtcttgtgaatctccggcgagcgaattagactccgcaaggacttggagacgcaacagaggattgggtaatatcgttttggtaccaaggctaagatgttcaatacgatgtccaccgggagtgagaacaatgacggcggcgtcaatgaagacgacggtggttggttggttttctgcggtggttcgtcggcgttagacatcgagagctattaggaggaggagactagagaacaactgagtgaatcaatcaaattgagggctttagccaaaaaccaaaagccggttaaattcttctctgattctgctttaatcggttaaaaccggtttatatttcttgtcttgatcagggaaacacacagagttttagaataaggcccaggaataagcccggtgagtgaatctttctaaggaatcgattttaaaacaaggcccattaaagggtgaagaaaaggcccatgaaaatgcttaaaccccctttgtctcccagcttcgtacacaggagagactgagataaggaaagaagaagaggaagaagaaa

SEQ ID NO: 11622 - DNA, 3000 bp, Unknown
  misc_feature (1)..( 3000): cDNA_ID_1808635_gDNA_ID_2214506_Annot_ID_133760 3000 nt of promoter + ATG
gtcgatacaacaaggcgtcgagctgactcagattaatgagttaatgggacccacaatcacctctcttttgaaaggcccaattatcaacgtccttgtctcccgggcccacgacagctgcccttgtaccccgtttgccctacttttttcttttttttttaaactcacctgcagttgacacgtgcggtgatcctcgctcgtgcgccagctaagatccgagttcgtgctacgtggctgttaggtaaaggtcttaaggtttgcatgggaattaaaatctgttgttttgagtctacggttactatttgatcttttagggtcgtcgtgtatgacacgtggccttagttactgaagaatgatctcaaccgctgattaattcgaatggtctagctctacgctatagccaatagctactttccttttgggcggttgtaataggtaggtacgacttatacacacaacgaaatattcatagctaaaccggtttaatccgatataaaaaccaatttgaacagttccacgtaatgccatgtcatatatttttaaccaattatgtactgccatatctacaactccacgtaaacttctgtagttactaagtgggccggttcgtgtcccaaattaggcccatatcaatgggttttgtaaatcaacggtcgctaatgttcccagtctatcggtgccgagatggatcaccgggaaaagagtgaccggcgactactgctatggttcttcgccgtagccaccgccgtaaaactccttctcattccgtcgtccagaagcaccgatttcgaggtccaccgtaactggctcgctatcacaaactctcttcctcttaccaaatggtacttcgacgagactagccaatggacactcgactatcctcctttcttcgcctacttcgaacgcttcctctcaattttcgcgcgtctcgtcgatcccaggatcgtagatcttcaatcaggactcgattacaatgccgaatctgtaatttacttccaacgaatcagcgtaatcgtctcagatctatgtcttctctacggtgtttatcgattgactcgaaaattagaaccgttgaaacgaaatctgatctgcgcattggtgatttggtctccggggctattgatcgtagatcacattcattttcagtataatggatttctactgggttggttattgctttcgatttcgtttcttcaagaagggagagatcttttgggtgggtttttattcgcagttcttctatgctttaagcatttgttcgccgtcactgctccggtttactttgtttatctacttaggcattattgctggtctggtttagttactggtttccgacggcttgtaactattggtgcggtggttgtggcggtttttgctgctgcctatggaccttttatctatcatggacaggttagtgtagttctttcctattcaatgttgaagaatatagccaaattcttttgagttcaagttgaagattctaatgttgttgatgtgtttaggagattgtgaatcatttttgttgttgtttgatttggcaaagagttagaatttgttagaaattttggtgctagagagctatttcactacttttatcaatggaaattatcctagacgaatcagtgaatctctatacatcaatcaagtcaaaccttgtcctaaatagatttattgagaaaacatcttatggtggtagttttcgtgttctctcgttgtgttgcagatacagcaagtcatcagtagaatgtttcctttcgggagaggattgtgtcatgcatactgggcacctaatttttgggttttctacataatactcgacaaagggcttgcggttttgctgcggaagctaggatatgaaattcaaattccttccgcatctttcactggaggattagttggagattcttcgccttttgcagttcttcctcaggtactactcttcatgagtatctgtcatatctcatgaattgtttcactcaatcttattctgttggactggtgcaatgacagatcacgccattgacaacatttgcaatggtattactagctatatctccatgtctcatcaaagcctggaaaaaaccacactcggggctcgttgctagatgggtagcttatgcatatacatgcggttttctgtttggatggcacgtccatgagaaagcatcgcttcactttaccatcccacttgcaatcgttgcagttcagagtctagaagatgctaaacattactttctggtttccataggtatatactattctctaaccagaatcaacttttacgcataatcattcattccttgtacttaatctctgtatttttcctgcagtctcttgctattcgctctatccactcttatatgaaccgcggagtacccgatcaaggttctgttgctgttattgcattccgtggtaatgtggctcggctttgcagctcaatacacagattataaggcgcagaagaaggagactagtgaaatcaagagcaagtttaggattggatgttttgagaagagctatctaatgggtttgattatagtagagatagtgtctcaattcttgcatccgtattttctaggtgataagttgccatttttgcctttaatgttgatctcaacatattgtaccgttggtattatgtactcttggatttggcagctccggaagatcctgacatgacatatagatagattcatgtaatagttaacttgattttagtactacgtgagtttttccctccgtagtatatgacttttcagtataccccacgatactgcattactgcttcggtgactctcaataaagtgcaattgagatttctcggttcaataaaacatacatcggttaggcttaatagaataaagatattgggtcttaatagttaaatgggctgtaatattggcccaatgtaaaacataagaagcactgacgagaaagctggagccaaagtcgtaacggaggaagaagaagatctgcttctgcaaaaaaccttatcctgctatg

SEQ ID NO: 11623 - DNA, 3000 bp, Unknown
  misc_feature (1)..( 3000): cDNA_ID_2711238_gDNA_ID_2214506_Annot_ID_133761 3000 nt of promoter + ATG
gatccatagaaagatcaatagaaacagagcaaatcttttagaggctttggagatataagtggttttaggagggtttatagattttagacaaaaaggtatttatatagaagaaaaaaagactatttgcttgattatgtaactgaagcttctactaagccacgacgagagttcctgtccgtacggtgtttccggcggcggattctttagtttcagaagaatttttccggagagatcttgaagattttttccactttctctccttagcttcatcagattcaatctgttcttctctacactcgttgctacaaaaagccttgtctcctctgtaaatcacaaaaaccataaacaatcagaccaaataaatgaattatagaaaaaaaccagatctagaaactcaattgaaagtttaatgctttagtttgaatcgaatcaatacctgtacatgaagatatcggagttaagaccaaggtgtttccggcaaagagaacacgattccaaaaagtgtggctcttcacaacccaaaaaaccagagtaatacgaagccatttgcttaattaaatacgaaagcttccgaatttacgatgacgaaatagactgcgaaaagcagattcgagaggaagaagaagaagcgagaggaggaggaggaagaaggaggttgatttggtgttcatttataaagccggctttaggactttctgcttgacttgagctgatcacctgtgtcacgtaccactttagttacagtactctacaatacatcctcaccgttcatcgtgaccgaatcttcatctcgaaagatctatacgttaaagttcaataattcattacttttattatattttattattgtctttttgtgttgtggtaaattctttttttttttctgattattttacctcatcgataaagttaaagtgcaatgaatcaaactctttgtccgttacgagtactattttctttgtttttatttttgcaattacattacgaatgtcgagtaaattttaaaattattttatttcttttgtaagagcaataaagaacatatattagtattattttgggaatacaataatttgggtggatctcgttcgacgagagaatcaaacaagtcttgcgttttgtaagattcgttggccacaataacatgcatagcgcatgatggtggacttttcccaaatattcaattaacattaaatgaaagtttctaaattttcgttaacaaaaaaacaaaaaagagaaagtttctaattttttatatgaatattactactaaaataatttctattttattaatctgttctcgtgtgtactttctctgcttttccttaggattcatttcgcctggacaatgtttcattgcatgtgtgtaatttataatcgcctctcgttttgtttaatgctttgcttgtacttatttgtatttcattaacttcttcaatggacatatcgacagtaacgtcttttttttattgttactatagtagagtgaattaatttattcgtgtttatagtgagacaaaaacattttggtacacatgtacatgtccaagtaaaaaatattccaaagacattggatgaatttaaatctctttcgaaatagtactattctattctatattttatatcgatatgaatactatagctaagaatcctctagttgaaaatgtgtaaaagagtctttggcaaaatctttgttcaaacaataatatttaaaaatacgatctaaatagtcataaagtttttttttaaaaaggttctagaacatgtaattcgaatacgtttacacatttactactactagtaatgtgtacatacatactccatacgctaatacttgtaataaaacgaataagagggtgaccgacctattttattcatttactatagtagtattaagttcttagtccgagttcaattatagttttaatactaaaaccacataacgtgtcacataggtgaaattctgtatactattataaatatcagataccgactagaaatatcacatttttatgctcttgattcatattataatcctccaacatgagacttttgactttttaaatcaaaggtaagaaaacactatcatgatttattaaattaaataagatcacgtcaagaaaactcaatgaatctgagtaagcaatgactcacattacgaacggcaaaccaataataaaacattaaaaatgtatatatttaaagtgtattaatacatacaaaaataaaaggtgttttcgtgatcaattataataaagttccaaaaaaagaaaggaggttttacataattggttaggaccacacaacttgtcatctgtcgatacaacaaggcgtcgagctgactcagattaatgagttaatgggacccacaatcacctctcttttgaaaggcccaattatcaacgtccttgtctcccgggcccacgacagctgcccttgtaccccgtttgccctacttttttcttttttttttaaactcacctgcagttgacacgtgcggtgatcctcgctcgtgcgccagctaagatccgagttcgtgctacgtggctgttaggtaaaggtcttaaggtttgcatgggaattaaaatctgttgttttgagtctacggttactatttgatcttttagggtcgtcgtgtatgacacgtggccttagttactgaagaatgatctcaaccgctgattaattcgaatggtctagctctacgctatagccaatagctactttccttttgggcggttgtaataggtaggtacgacttatacacacaacgaaatattcatagctaaaccggtttaatccgatataaaaaccaatttgaacagttccacgtaatgccatgtcatatatttttaaccaattatgtactgccatatctacaactccacgtaaacttctgtagttactaagtgggccggttcgtgtcccaaattaggcccatatcaatgggttttgtaaatcaacggtcgctaatgttcccagtctatcggtgccgagatg

SEQ ID NO: 11624 - DNA, 3000 bp, Unknown
  misc_feature (1)..( 3000): cDNA_ID_1396391_gDNA_ID_2214506_Annot_ID_133762 3000 nt of promoter + ATG
tgcgaataaaaacccacccaaaagatctctcccttcttgaagaaacgaaatcgaaagcaataaccaacccagtagaaatccattatactgaaaatgaatgtgatctacgatcaatagccccggagaccaaatcaccaatgcgcagatcagatttcgtttcaacggttctaattttcgagtcaatcgataaacaccgtagagaagacatagatctgagacgattacgctgattcgttggaagtaaattacagattcggcattgtaatcgagtcctgattgaagatctacgatcctgggatcgacgagacgcgcgaaaattgagaggaagcgttcgaagtaggcgaagaaaggaggatagtcgagtgtccattggctagtctcgtcgaagtaccatttggtaagaggaagagagtttgtgatagcgagccagttacggtggacctcgaaatcggtgcttctggacgacggaatgagaaggagttttacggcggtggctacggcgaagaaccatagcagtagtcgccggtcactcttttcccggtgatccatctcggcaccgatagactgggaacattagcgaccgttgatttacaaaacccattgatatgggcctaatttgggacacgaaccggcccacttagtaactacagaagtttacgtggagttgtagatatggcagtacataattggttaaaaatatatgacatggcattacgtggaactgttcaaattggtttttatatcggattaaaccggtttagctatgaatatttcgttgtgtgtataagtcgtacctacctattacaaccgcccaaaaggaaagtagctattggctatagcgtagagctagaccattcgaattaatcagcggttgagatcattcttcagtaactaaggccacgtgtcatacacgacgaccctaaaagatcaaatagtaaccgtagactcaaaacaacagattttaattcccatgcaaaccttaagacctttacctaacagccacgtagcacgaactcggatcttagctggcgcacgagcgaggatcaccgcacgtgtcaactgcaggtgagtttaaaaaaaaaagaaaaaagtagggcaaacggggtacaagggcagctgtcgtgggcccgggagacaaggacgttgataattgggcctttcaaaagagaggtgattgtgggtcccattaactcattaatctgagtcagctcgacgccttgttgtatcgacagatgacaagttgtgtggtcctaaccaattatgtaaaacctcctttctttttttggaactttattataattgatcacgaaaacaccttttatttttgtatgtattaatacactttaaatatatacatttttaatgttttattattggtttgccgttcgtaatgtgagtcattgcttactcagattcattgagttttcttgacgtgatcttatttaatttaataaatcatgatagtgttttcttacctttgatttaaaaagtcaaaagtctcatgttggaggattataatatgaatcaagagcataaaaatgtgatatttctagtcggtatctgatatttataatagtatacagaatttcacctatgtgacacgttatgtggttttagtattaaaactataattgaactcggactaagaacttaatactactatagtaaatgaataaaataggtcggtcaccctcttattcgttttattacaagtattagcgtatggagtatgtatgtacacattactagtagtagtaaatgtgtaaacgtattcgaattacatgttctagaacctttttaaaaaaaaactttatgactatttagatcgtatttttaaatattattgtttgaacaaagattttgccaaagactcttttacacattttcaactagaggattcttagctatagtattcatatcgatataaaatatagaatagaatagtactatttcgaaagagatttaaattcatccaatgtctttggaatattttttacttggacatgtacatgtgtaccaaaatgtttttgtctcactataaacacgaataaattaattcactctactatagtaacaataaaaaaaagacgttactgtcgatatgtccattgaagaagttaatgaaatacaaataagtacaagcaaagcattaaacaaaacgagaggcgattataaattacacacatgcaatgaaacattgtccaggcgaaatgaatcctaaggaaaagcagagaaagtacacacgagaacagattaataaaatagaaattattttagtagtaatattcatataaaaaattagaaactttctcttttttgtttttttgttaacgaaaatttagaaactttcatttaatgttaattgaatatttgggaaaagtccaccatcatgcgctatgcatgttattgtggccaacgaatcttacaaaacgcaagacttgtttgattctctcgtcgaacgagatccacccaaattattgtattcccaaaataatactaatatatgttctttattgctcttacaaaagaaataaaataattttaaaatttactcgacattcgtaatgtaattgcaaaaataaaaacaaagaaaatagtactcgtaacggacaaagagtttgattcattgcactttaactttatcgatgaggtaaaataatcagaaaaaaaaaaagaatttaccacaacacaaaaagacaataataaaatataataaaagtaatgaattattgaactttaacgtatagatctttcgagatgaagattcggtcacgatgaacggtgaggatgtattgtagagtactgtaactaaagtggtacgtgacacaggtgatcagctcaagtcaagcagaaagtcctaaagccggctttataaatgaacaccaaatcaacctccttcttcctcctcctcctctcgcttcttcttcttcctctcgaatctgcttttcgcagtctatttcgtcatcgtaaattcggaagctttcgtatttaattaagcaa

SEQ ID NO: 11625 - DNA, 3000 bp, Unknown
  misc_feature (1)..( 3000): cDNA_ID_2706988_gDNA_ID_2214506_Annot_ID_133763 3000 nt of promoter + ATG
attgggtaatatcgttttgggacgcgggctaagatcatcgaaatgatttccagtggcagtgacaaaaacaatgacggcgatgccgatgccgatgccgatgacgacgatggttggtcggtttttcgcggtggttcgttggagctagacatcgactctagtttaaaggagaagactagagaattgagattttattgatttattctatttcggtttcggttattagccaaaaaacaaaacccggtttatttattcttcgattctgtttcaatcggtttattttgtttctttttgcgctaaaacggttctttgttgttgtctcttgaactcaaagaagacaaacattgttcttttacatagactgatagacgagaattcgcttataattctgttacaagaatctctactacaagatcaaacttttataacgaagatagctaatcatactaaaatctgcaagagtccttcatagaagaaacacactaaaaaagatgtaaaacaaaccaaagccagagacttgagtacactagtcaaagaacatggcataaaccgatctttctctttcgcttcttagtctttgaaggaggatgtaaaactactttgatcgcttcatcaaacacggcttttacgttctgcaaatttagcatcatcataagtctttctttatcagattgaggtccaaaatatttggtctaattgtaaaatgtaactcaagcattaatggttactttaccatttgtgcttttgagctgcactctatgtatgctaatgctcctatttcctttcttagttcttgaccctataaaagaagcaatctttgagttataaaagagtttgattcttaacatggttcttgatcatatacattgaagaagaatctttaaaaaaacatacctgttctgggaagattgtgcaagcacctggataattctttgggaactgcatgttgtctcttagatctgcaatatcaagaaattcatcttatatactacataacatcacttacacattgatgttagattcctaacattcaagacataacagagtggttcattatcttcaacctgatttggttcccacaagaacaataggcacagtcggggcataatgtctcagctcgggtacccactgcgaaagaaaaccgatccatatgcacatgagatcagtgttgtaaagttaaattacagtgaaattaaaagtaaaaggaaagataatctcaagtctcaacctttttagcaatgttctcaaagctaggcctgctaataagtgagaaggcaagaatgaaaacatctgctcctctgtaactcaatggtctaaccctattgtagtcttcttgacctgtaatataatgtgaatcacccaaaagatatataacacaagaatcataattggtctcatttaagttttgaagaaacatgagcaaaatctgatagtgaattcaagaaccaaaacaatgttgcatcaaagattcaaatttttcaactgacttcttttaaaaggaccaaaagattagaccttgacatattgttgtagatataaagctaaagacaagaacaactttgacattaggtaaaagcatttaccagcagtatcccagagacccagattgacagttttaccatcgactaaaacattagcattgaaattgtcgaacactgttggaacataatcctgtaataacaagatctcaacagtcaccaaaagctatcaagaaaagcaatccaaaagagagagagggagagatggatttatatacagtggggaacgtgttgctggtgtaggaaataagaagacaagttttgcccacagctccatcgccaacagtgacacactttataaacgttgtagctgttgctgatgatgttgatgttgcagccattgaagctgacattgattgagaaaattctctgattttacttaccctgttctctctctttctgtggttttattctggttcaagtgaagaatgagaatgagacttgagtggtaaaaaaggagtcaactttaatttgagctgtcagagagccaaaacgccttaaaaataattttttattcggtgggtttgatttctttcctattttttgaatttagatagattttgccatattttacttctttccaaaaaaactctaattggtaacacatagctgtacataacttttatctgttaactttttttgaaatagtataaaattactaaaaaacagttatattaaaaaaaatgtataaaaaagctgagagaaaaatcttttagtaacgcttttgataaaaaaaattataattggtagaaatgaaagttgtacaaattatagtgctttgtttttttcaccaatcaatgcaaatgcaaaggtccaaatgtttcagcaaaatgaaaataagtggtggttatatcaaatcaaattttgtaaattcagttacatttacatgactaattttacaagatgtgtaattttaattatctctagatcatttgttttttttttcgatttaagtttggacaatggatcgaccaccaaacacatcatcattaacaaagatggaaaggcaagtccattattactaccgtgttgatacaaaaaaaaatgaattttatgatttctttcttcctaagatataatttggaatcatagtttaagtacaaaaaaatgtttccttctacgtgaatctttgtattacaactgtcagtgtcataaggcccatccgaaaagcccatttctaaatactagaattttaaaaaattaaacaatgattaaaaaaaaaaaaaaaaacaaagagaagaaaacaaaacagtagagaatgagaaaaaaccacagggaaaagcagagcactctttatctcttcttctctctttcttctactctgtgatcaaactatcgaagaaaaaacaaaccctagatttatccgcccctcttcttcctctgatgataagaaagtcgaagactttgagaatctaaagctgaaaaattttgttttttttcattgagggaatcgaatcgagttatg

SEQ ID NO: 11626 - DNA, 3000 bp, Unknown
  misc_feature (1)..( 3000): cDNA_ID_2711232_gDNA_ID_2214506_Annot_ID_133767 3000 nt of promoter + ATG
gtcaaccaacacacttgaaactccatacgagtaaaggcccattggggatgaggatatttgggccaatccttcttaccgtttttcgtttgttaacaattaccgaattaaaagcttgatcgccacgtctttttcttaatagaatatattgattttatttatcttttatttttagaccaagctcaggctatcatctctccgttaattagggttttcttctctatctcgatttcaataccattgttgatccgctgagctagggttgttcgatcccgataattgtgtcgcttagctctgatctctgttcatcgaatttggttaatttgttttgattggttaagatacattggaaagcgatgccaccgaaggttgtgaagaggggaggcgccgcgagaagaggtgggaggcttacgagatcggcgctcaaggcgcagaatcctcacgtggaatcttcccatgacgaatctgttaatatcggtgagctctcaggctccgatgcactggaagccaaggaggtgactccggaggttgataaaactgttgaggaagagaatccattagatgtgccgaagtcatcggattcaattgatgattctgaagctgcagcgaatccgcatgttgatgttccgtcgaaaagtaagattcttttagcctggttattaattttgtttcgtttttgggattctctacgttttcgttgttttgatggatctaagtttcgctttgacgaaagtttgtgacttagagttccaacatatctgaccatagagattaaatgaatgtctgaccattgaatgtatgaatctaatttggaggatggatgtttagctgtttttaattctgtggaagatagacgtatcttctgagattgttatctctgaacaaactttaggctacctggaatagtgtagatgttttactcgcttttactcgcagaggagactgaggtagaggaatctgtggatgattttggaaaagatgaaagattggatttagatgacaatgaacctgagtatgaggctgaggaatatggcggggaggagtttgaagagagggaattgggacaggaggaccatgagttggtaaatgaggagggggaagaactggaggaagagattgaggtcgaggaggaagctggtgagtttgcagacgagattggagatggtgcggaggaccttgatagtgaggatgatgatgatgatcatgctattgaagaggtcaagcatggagaaactgttgatgtggaagaagaagagcatcatgatgttctccatgagaggcgtaagcgtaaggagttcgaaatatttgttgggagtttggacaaaggtgcttcggaggaggacttaaagaaagtgtttggtcatgtgggcgaggtgactgaagttaggattttgaagaatcctcagacaaagaagagcaagggttctgctttcttgcgttttgcaactgtggaacaggcaaaacgagctgttaaagagcttaaaagcccaatggtaattgtctacactttagtatttgatggagagtttgtgtagctttacattttgtatcatgctcttggtcattgggactgcagataaatggtaaaaagtgtggtgtaactgcaagccaagataatgataccctcttcgttggtaacatatgcaagatatggaccccagaagctgtaagtatttgggtgtccgtagatatgtcaattaaacccaactccacagttcgtggtgatcctgacaatcaggtatttgttgttgttccagttgagggagaagcttaaacactatggagttgagaatatggatgatataacgttggtagaggacagcaacaatgtcaacatgaatcgagggtatgcctttttggaattctcatctcgctcagatgccatggatgctcacaagcgtctcgtcaagaaagatgtgatgtttggagttgagaagcctgcaaaggtctcttttactgattctttcttagacctggaagatgagataatggcgcaggtactcacattgcaggatcaattatttctagcaactttcatcctaccatgtcttctttagagcgttggaggagtttataggggcatgtgtgggtgccacctattctgtatggtgacttagaatacttgctaaacccatcatgaaaacagagtcagaatacatattccttttggccctctaacaacatgctagatactgaattattgattgttggtgaatctattatatctaacttatctatcttgctcatagtaattagttttatgatatttctggtgttacaggttaagacaatcttcattgacggtctgttaccttcatggaatgaagaacgtgttagagaccttctgaaaccatatggtaaacttgaaaaagttgagcttgctcgcaatatgccatcagcaaggaggaaagattttggctttgtaacttttgatactcatgaagctgctgtgagttgtgccaaattcatcaacaactcagagctaggcgaaggggaggacaaggtatgcataatttaaatgcattatccttatccacgaagtattttcttgctttctaattctctttttttttccaggcaaaagtgagagcacgcctgtctagaccacttcagaaagcaggtaaaggccgacaatctagtcgctcagaccagcggtctaggcatggggctggacggtctggaaggagttcatttgctcgtcttccacctcgtagccttgcttcctctcggagtgctagaggcgctggatctcgggccccatcttctagtgcaaagagagcttctggatcaagaggaagacgtcctcgcccacctctacctccgcctgcaagagctaggcccttgcctccacctgcaagagccaggcccatgccaccacctgcaagagccaggcccttgccaccacctgctaggtcatatgatagaagacctccaggtaccactggaattattacatgtttagttatcttttttagttgaatctcttttgtgttcatgtatcta

SEQ ID NO: 11627 - DNA, 3000 bp, Unknown
  misc_feature (1)..( 3000): cDNA_ID_2706977_gDNA_ID_2214506_Annot_ID_184136 3000 nt of promoter + ATG
agtgactcgcaagatggcgttgaaacatagaatgataactaaatgggccgttaatacaatcttaggcccataattatcaatatttaagaagtatatagtagaccgttaatacaggcttaggcccataacattcaatattttgggctcaactgtctaaatgtatgaattatgatcctagatgggaaatatgagtttgttcaaaaaagaatcagtatagcatcttctttacttttctttttcgtagtttttttgggaagtgaacttgtgattggtaggaaggttactggtgatcgacgtttcctttaaggccgacaaagttaatggaccacggggagttttataaaggaggttttctttctttctttctttagcttaaaaaggtgtaatgatgactttttcaatctcaattttaaaaactttttggtgtattaatattgattcatatacgtgcaatctggagatcaagacattgaatactaacaccaagacgaatttttcggattgatggtttttgagttttcaaaataagtatgttggaatggtgcattggcgaatgaagcattgaccagacaaaggtcattggaaagtagtttttttttttttttttgcgtaaagctaaaggaaggtaataaaatacagtacatgaaaacgaaataagtagtgatattaaatactttagttgacaaaattgacagcggaaaaaacattacatgaaggccataaactaagagctttgaccaaatctgaaggtaaatcaggtttcagaatcagaagaggatatctattccaactggtgcaacggtagttgtacctgttgtgtcactattgcttcatagtttcgtatttatttattgtttctatgatgctgatatttgataatatatagagatatattgtgtttgcgttaattggtttggtcagtcgacaacccaagatttacttgtttgttattcgttcatcaacaatcttatagttttctctgtcaaatattctctttaagtaattttttaattaggaagtttagggattttttataggtcataggtgtaggttaaattaggtttgacaatgtataaggtgactctataaaatattataagtttttctaaatgaatatatcattagttggattaccaatttgaatatttttatgagattttgattaagtacttgaagtgttacgtgaaaatatatatagttcatgttttatcatggcaatttttttaattatgactaaccattatatgaatgttttaaagaataattctcgtttctattataaattttggtatgaaatctctatttataaaaataatgtgtatgtttatcaacaaaaaagaagaagatatgtatatgttttcttgataatacccgtacatagaaaggctattactttgacttcaagtaaaggtgtagcaattatctatgttcttgcttttttccaagcatataaggataatcgttggaatctaggaaaacttttaacgcaactcaacttcagataacaaacgtaaattttaacatggttaaatattcgatctaatttgtatatatacttagcgacaccagctttcacttatataaaattcacgaataaaatagttcatatgatggtagctaaattttcagtactttagaaaatatgaaatgcaagtgaagtagaattcagataaccggccaattgaatagaaaatttgatttagttggatagaggaaaagaatgttctgaaaaagagtaatgatgtgcatgtgctcgcgaaagtttccatagtgttgatggtagcgaccagtcttgagttccattcacgctaaatcacgtggactataaagattacacgtaccataaccataaagctctataaagattgcaattcaaaaaaaaaaaaaaaaaaaaaagaattgtaataggggctagtttctgattttgcttgctgtaaatgtaacatttcctcaagttttgacatagtttttaaaaaacctccttatagggacatgtcacatgtgttggatgattgattaacaatccggtggaccagaaaacaatgagtaattatacggaggccggctttagttaaacttcacacatcaaaatatatggcccatccctcgccttttgcaattgtcgccgaccggcgcgtgacgatctacaaaatttcgattttaaactcagaaaaatacataatacaatatacgtcaaaattgcatctacttattctaatggtagttgaaggaaaaaaatcagaactctatgacttgtgttataccatatattacgacaaaaaaaaagggattaaaaagtcgttgacgtttgacttaagtgccaaattaattaaccaatgcttaatgacctaaccaaagtcactttttattttagtccggtatgacttgtgacggcgacgctgaaaacgattgaagtacacgcgcggggtcctccagcctaattgccacctgtacaccagccctgtccgtcgtaactataaaaatctcattttccttttttattttatttccaaacctccaaacaattaaagaaacggcaaaaatttatgctgaaatctttttttcttccttattctcctctttcgcttgatttcgccgtccgattatctctatcgccgataaatatccggcgtcactcagtagatcttgaagctgttgctttcttgctttgctcttcgcgcaagattctctttctctgttttcattgaggattcgaagttgatcgctatttgattcgattggttttgagttttcgatcctcgacggtgattgaattctcctctttactttatttttggtttttgaagctcgctgtatcaatcgtgacgttttttgtgattcgcattgtgtctgtagtagttgatcaggtttccgattggtttcttattgatttgattttaaaaattcgattgctgatgaaattatctggttctgcatttgattgttcgcaggatggagattttgaagtgaatcggaggagcgaataagagaaagtgagag

SEQ ID NO: 11628 - DNA, 3000 bp, Unknown
  misc_feature (1)..( 3000): cDNA_ID_3022692_gDNA_ID_2214506_Annot_ID_184135 3000 nt of promoter + ATG
cgaacaatcaaatgcagaaccagataatttcatcagcaatcgaatttttaaaatcaaatcaataagaaaccaatcggaaacctgatcaactactacagacacaatgcgaatcacaaaaaacgtcacgattgatacagcgagcttcaaaaaccaaaaataaagtaaagaggagaattcaatcaccgtcgaggatcgaaaactcaaaaccaatcgaatcaaatagcgatcaacttcgaatcctcaatgaaaacagagaaagagaatcttgcgcgaagagcaaagcaagaaagcaacagcttcaagatctactgagtgacgccggatatttatcggcgatagagataatcggacggcgaaatcaagcgaaagaggagaataaggaagaaaaaaagatttcagcataaatttttgccgtttctttaattgtttggaggtttggaaataaaataaaaaaggaaaatgagatttttatagttacgacggacagggctggtgtacaggtggcaattaggctggaggaccccgcgcgtgtacttcaatcgttttcagcgtcgccgtcacaagtcataccggactaaaataaaaagtgactttggttaggtcattaagcattggttaattaatttggcacttaagtcaaacgtcaacgactttttaatccctttttttttgtcgtaatatatggtataacacaagtcatagagttctgatttttttccttcaactaccattagaataagtagatgcaattttgacgtatattgtattatgtatttttctgagtttaaaatcgaaattttgtagatcgtcacgcgccggtcggcgacaattgcaaaaggcgagggatgggccatatattttgatgtgtgaagtttaactaaagccggcctccgtataattactcattgttttctggtccaccggattgttaatcaatcatccaacacatgtgacatgtccctataaggaggttttttaaaaactatgtcaaaacttgaggaaatgttacatttacagcaagcaaaatcagaaactagcccctattacaattcttttttttttttttttttttttgaattgcaatctttatagagctttatggttatggtacgtgtaatctttatagtccacgtgatttagcgtgaatggaactcaagactggtcgctaccatcaacactatggaaactttcgcgagcacatgcacatcattactctttttcagaacattcttttcctctatccaactaaatcaaattttctattcaattggccggttatctgaattctacttcacttgcatttcatattttctaaagtactgaaaatttagctaccatcatatgaactattttattcgtgaattttatataagtgaaagctggtgtcgctaagtatatatacaaattagatcgaatatttaaccatgttaaaatttacgtttgttatctgaagttgagttgcgttaaaagttttcctagattccaacgattatccttatatgcttggaaaaaagcaagaacatagataattgctacacctttacttgaagtcaaagtaatagcctttctatgtacgggtattatcaagaaaacatatacatatcttcttcttttttgttgataaacatacacattatttttataaatagagatttcataccaaaatttataatagaaacgagaattattctttaaaacattcatataatggttagtcataattaaaaaaattgccatgataaaacatgaactatatatattttcacgtaacacttcaagtacttaatcaaaatctcataaaaatattcaaattggtaatccaactaatgatatattcatttagaaaaacttataatattttatagagtcaccttatacattgtcaaacctaatttaacctacacctatgacctataaaaaatccctaaacttcctaattaaaaaattacttaaagagaatatttgacagagaaaactataagattgttgatgaacgaataacaaacaagtaaatcttgggttgtcgactgaccaaaccaattaacgcaaacacaatatatctctatatattatcaaatatcagcatcatagaaacaataaataaatacgaaactatgaagcaatagtgacacaacaggtacaactaccgttgcaccagttggaatagatatcctcttctgattctgaaacctgatttaccttcagatttggtcaaagctcttagtttatggccttcatgtaatgttttttccgctgtcaattttgtcaactaaagtatttaatatcactacttatttcgttttcatgtactgtattttattaccttcctttagctttacgcaaaaaaaaaaaaaaaaactactttccaatgacctttgtctggtcaatgcttcattcgccaatgcaccattccaacatacttattttgaaaactcaaaaaccatcaatccgaaaaattcgtcttggtgttagtattcaatgtcttgatctccagattgcacgtatatgaatcaatattaatacaccaaaaagtttttaaaattgagattgaaaaagtcatcattacacctttttaagctaaagaaagaaagaaagaaaacctcctttataaaactccccgtggtccattaactttgtcggccttaaaggaaacgtcgatcaccagtaaccttcctaccaatcacaagttcacttcccaaaaaaactacgaaaaagaaaagtaaagaagatgctatactgattcttttttgaacaaactcatatttcccatctaggatcataattcatacatttagacagttgagcccaaaatattgaatgttatgggcctaagcctgtattaacggtctactatatacttcttaaatattgataattatgggcctaagattgtattaacggcccatttagttatcattctatgtttcaacgccatcttgcgagtcactttgcttagttcttctcatcatcatcttctctatgattcttcagaaaacgatg

SEQ ID NO: 11629 - DNA, 3000 bp, Unknown
  misc_feature (1)..( 3000): cDNA_ID_2711228_gDNA_ID_2214506_Annot_ID_184134 3000 nt of promoter + ATG
catgaacaagaagaagaaatggattcatcttttaatccaacgatgtaaattaccaagaattagaatgagcatcattgttagttccacctccaaaattctcctgatcatcattaaccacctttgatcccaagggtcctccaccctacaaaaaatcatattagaccttccaaatcaagatcaataaatacttcaaataaaattaaacaagatctttttatatatgtatataaagaaagagagatcaaagacctgaagattattagaaaaccctagaggtgcatgagtagtagtagtggaggaagagttgtgaatggggaaagaaggagaagaaagagaagaggaagaagaagaagagaaaaaggttaagacattggtttcttcaaaaggaacgaggaagttcatattctcttgaatcgtcgtcgacgacgatgtcacttgttgtagatcgtaattactgaatactcttctccctcctccttccattgtttttaatctcaatctctccttgttcctttttgttgactattttgtaccaatttaaaatagtgtatgacactaatttatttctatataaattaataatgttttaaatgttactttgacggtttatcttctcttgctttcgtatagaaagggtagggcttcgtgtgtatgtccccacacgtgtcaaagaccctccaaacatattatttgtaccattcgtgtctttggcagtcaacttcatgtgaagtgttttaatgtttataaatcatatcgctaacaaaacaaaattcgattccattatatactcgaatatatatatttcttcgcataattcaaaacatcgtaaatccttgatatttatgcgtattgtggtcgaccaaaggcggcgatttttaaattcagtttaacaaaaaacaaattgcattttatgaatatatataggttattccacaacattctaatatcgtataaagaaatatatatgtacgaagaaatgtaaatacgaatatacaataagtacttttctgacgtactaattaatgatcagtataatactaacaacaaaataatcataccaataacgtttacaatacatcaattttattagataattaacgaattttactttcatttgtttaagcaagtaacctgaatcattaattaaacctaaccattccataatgaggccaaaagaaggtttggagtttggactgattattatgatcagctttctgaagcaacctaagaaattaaatgaaggacattgttcatttcacatgacaattttgatagagagagaaaaagatgggagagaaagaagttgtcaaggaggtaatcgagtgtggtggaggtacatcaaagcttccatccatctcaagatgtgtcctaaagctgatgatggaaacgacacccacaaaagttacctcttctcaaatcatgtcgaatccaccttcataatttttgttttgtaaatttaatcccaataattttatttgaataatttcattagactatatgtttatatcgtttattgaaaatcacaatttttttaaaaaaatttatgcatatgcaataatttataaaagtcgttagacatcaatcagaatatcaaacaaaactcatccatgtttttatttggcttttaacattcctcggtcgatgttacagtaatggctggtttgaaaaaaaagtgtatttcttacagtattgagaatttgatagttacacacaacaacacaaacaccccaagaaaagagccggccaacttcctccacaatagcaacacaaagcaacaatgactaatataacatttttttaatcttctttttgacaaaaccataaaacatgattgaggtggattttaattttatttttaatttaccggtccaatctactccataattaactatcatcataaggttcagaacacttgcttaaatagccattaaaggaattatactaccattagtttgttgatcttattcttaccgagttactgacaccaagagtactgttggtttttcaggtagaaacatatggctacggtagtttcaaaagctaaggtcttcttgtttgtttatgtatgaaaattatcggttttactctaaaagaatcatatataacgctttagttttcttttccgaacacattttattaagttgtaaatacaaacacaagatatagtcgaaacgtttagagttggaaaaatgatttgatcaaataaaactttatattaggttaaatgcaaacataatcaaaagatgcaaatgaaaagaggagaataattaattataagatcataggttaagacaaagagagaaagagaggcataataaaggttatatataataggggatgaattccatgcaacaatgattacacgtttcaatcaaatccgtaaggaattttccaaatttaatgatggtgagatttctaaggcatatttttctctcttgtaggtgcccactttgtctcctccttcattctcctttcgttttcttttcttagtttgttttcatactttgatgtctttgaaaattcatgtggagatgcatacacgagctcgtcacgtaccgttggctataacctaaacctaactacatagttctatatatatccactattttcatacaagttcaatatcaattttcattgaaatgagtttgaggataaaacaagaacaaaaaatataagttgggttcgtaaatacgtaagttatcaaaaaaaaaattgaaactctaaaatcaatactatttgtggatctatatccagcaaacaaaggaaaaggaatgtattactgaattccaaaataagatccagtgggcgacaaacccaagcccaattgtaattcaggcccaatgggcctacaaagcagaacaagataccaaattaaggcacaagttagttcgaaaaactttctccggcggaaacttacgccggcggcacaaactttgtgtcttgctcaagatgattgcgtcgaattttatgtaaacaattggctctccgatgttgtcagcc

SEQ ID NO: 11630 - DNA, 3000 bp, Unknown
  misc_feature (1)..( 3000): cDNA_ID_4254303_gDNA_ID_2214506_Annot_ID_184132 3000 nt of promoter + ATG
gggcatgtgactcgctgcttatcatgtgtgccagacacaagtggagtgtgagtaaactgagtaagccacctattttgtgccctgacacatccttcgctttttgtacatatattggtccacctcttattacacgatttaacaacatttctcattacattaggacataattttctgaatggaataataaactttattcaagtaaagaggagaaacataaagttttctttttcttttggattttagtatgaaatatatatataatagggtattgattccctcaacctacagcaacatcatggcatcatgcatggaaccttgagggacaaaaagaaagatttatgatctgatgtctagatttgtttgggttttatcttcatttcaacattattatgatcattatttgttttttcttggatcaacattacaatagtttctctataattagattttggggaaagtaaaagagatatgtccttagatttgtttgggtttatctttcatttttctggtaaaaaatgttttttttaatcaacatttctatacttttttcgaccactggggttttcggaaactaaagaaatactaaattaacgggccatgttaggcccattatcggctcaaaagatagttatgaagcgattgttgaagagatgagagactaaatgatcttcttttagttttactacaaacattgtacttttagtttgtcatatgagtcgagctgcttaaatgatgttctttttttatttatttttaaaattgataaaaaaaattgatgttctttctttgatcgtgacgtggcatcaaataattggttcttgggcccgtttgtgtaagccaacaacaacgacaattggtttcttttatattttcatgaacgattgttgtatgtatcatctcgatcttcttagaagatatctgtaacaaaaatgtcgtatgcaacttaagatgaaatggataatagctaggcccaccaaattaaaatggattggtctgataaaatcttcaacaacaaaaacatttgatatggtctgatttaaataaatatcttgaaaagagaattggcttatatagagaacataaaaactgaacttacgaattcggaattttaaaactgtacatgcaaccaagaaatgtggtcctccatctttatataatttcaagacaaaattatcgactagactaggcctattctataaatcaatattaaatgtattctaaaacgtaaatgttgtgaattatatgaattaaactaaaggaaaaaaggcgtatttgaaggatgggggatggtcacatggagtagcacatggaaattgggtatgaaaaagatacgagaagcgagagacacgttaagcagttattgacgatccccaaatactccaaaaacactatatactattatatctacactaaaaaatcatatcgtctgtgtaaaatcatattcttagttctgtcacgagacatgctttactttttcatcactccaatcccaatctaacctggctgtcatgtttgattaacttcaggtactaatcaagtatacgatcagtactatcatcatacaaaacccaaaataaataaaatatggtaccaagacgttgtgttccttgtaactttcgtttgcatgcaatagatctcaacgtcgataatttgaattaatttcggttgttaacaataaaaaagatttctaacgtataacacgatatagtttaaggactaaattttatatacacttcttacaattttcagtccacatgcttccattttaaattcagttattatgttttatacagtttcataaatatattcttactttaatatattatcaaatgaagcaaataaactcgagtaaattttaaacgttccaaagggatgatgataaatcagtaacagttgatcacacaagttgacatatcgtcctgtaaagttaaaatctttgtttctttttttccttaaacgtgaaatctcttcttttgtttcacttttttctttggttgctctttagcttttgcgtttgctgttcttaattagaatttgcctaaatgcgtccaaattagctgtccctcttggcatcttagatttagatcgatctattatttattcatatctatatttctgctaacaatcaatatatttttggggttataaagaaaggattaaatttgatgttaccagatgggaattgattcacattattagaaacacatgcatttcgtgagatcactattcgtgactttgtaattcaaataaaaaatttccccacatgtcatgtaacatggtgagtatgggatcccatctccatacactacaaaccaaaaattaagacacataatggttaatcgtttaattttcttgtaattcaaatatatataattgtaaataaaacttcgcgttatcatccgcagttacttctgatagtttctaaatttgtagatatataacgtgtatatttcatgaatcatgacgtagataaactatggattacctaaaatcagattacataattttataaatattgattaggatacgatattacgtttatctgtgtcgatttgatatgttgtgtttaacgcattaattgtgtttccctcttgttagaacttaagttttcaaattcaataatcattaacttgtgaaatataaaccccacatttcgcatatactaatgttttcattttcaaaaatactactatagtttggtcttttcggttccaccgccgacggtgatagaagagttaatgactactaatgaataacacaatttaaaatccaaaagagacacattcctaaaattgaatttggataaaataaaaacattattacttatttacaaaaataaaataaaataaaataataaataataactgcccaatataacgaccaacttaacacacacgccattaacaacagagcagaacaaagagaagactcttcttcattagatcacacaaaaaagtaacttttttttctttctctctctgtcatacacacaaaaaaatg

SEQ ID NO: 11631 - DNA, 3000 bp, Unknown
  misc_feature (1)..( 3000): cDNA_ID_3022706_gDNA_ID_2214506_Annot_ID_184129 3000 nt of promoter + ATG
gtgaaaaccctagatgtagaaggtgaagatttcttaagatgtttgtctaaagcatcattgattcgtttccgatcaatagctccaccaaggatctccgatctcgatgatccaccaccacccattattcctcctccactccgatccttgtacataactcgattcgattccctcaatgaaaaaaaacaaaatttttcagctttagattctcaaagtcttcgactttcttatcatcagaggaagaagaggggcggataaatctagggtttgttttttcttcgatagtttgatcacagagtagaagaaagagagaagaagagataaagagtgctctgcttttccctgtggttttttctcattctctactgttttgttttcttctctttgtttttttttttttttttaatcattgtttaattttttaaaattctagtatttagaaatgggcttttcggatgggccttatgacactgacagttgtaatacaaagattcacgtagaaggaaacatttttttgtacttaaactatgattccaaattatatcttaggaagaaagaaatcataaaattcatttttttttgtatcaacacggtagtaataatggacttgcctttccatctttgttaatgatgatgtgtttggtggtcgatccattgtccaaacttaaatcgaaaaaaaaaacaaatgatctagagataattaaaattacacatcttgtaaaattagtcatgtaaatgtaactgaatttacaaaatttgatttgatataaccaccacttattttcattttgctgaaacatttggacctttgcatttgcattgattggtgaaaaaaacaaagcactataatttgtacaactttcatttctaccaattataattttttttatcaaaagcgttactaaaagatttttctctcagcttttttatacattttttttaatataactgttttttagtaattttatactatttcaaaaaaagttaacagataaaagttatgtacagctatgtgttaccaattagagtttttttggaaagaagtaaaatatggcaaaatctatctaaattcaaaaaataggaaagaaatcaaacccaccgaataaaaaattatttttaaggcgttttggctctctgacagctcaaattaaagttgactccttttttaccactcaagtctcattctcattcttcacttgaaccagaataaaaccacagaaagagagagaacagggtaagtaaaatcagagaattttctcaatcaatgtcagcttcaatggctgcaacatcaacatcatcagcaacagctacaacgtttataaagtgtgtcactgttggcgatggagctgtgggcaaaacttgtcttcttatttcctacaccagcaacacgttccccactgtatataaatccatctctccctctctctcttttggattgcttttcttgatagcttttggtgactgttgagatcttgttattacaggattatgttccaacagtgttcgacaatttcaatgctaatgttttagtcgatggtaaaactgtcaatctgggtctctgggatactgctggtaaatgcttttacctaatgtcaaagttgttcttgtctttagctttatatctacaacaatatgtcaaggtctaatcttttggtccttttaaaagaagtcagttgaaaaatttgaatctttgatgcaacattgttttggttcttgaattcactatcagattttgctcatgtttcttcaaaacttaaatgagaccaattatgattcttgtgttatatatcttttgggtgattcacattatattacaggtcaagaagactacaatagggttagaccattgagttacagaggagcagatgttttcattcttgccttctcacttattagcaggcctagctttgagaacattgctaaaaaggttgagacttgagattatctttccttttacttttaatttcactgtaatttaactttacaacactgatctcatgtgcatatggatcggttttctttcgcagtgggtacccgagctgagacattatgccccgactgtgcctattgttcttgtgggaaccaaatcaggttgaagataatgaaccactctgttatgtcttgaatgttaggaatctaacatcaatgtgtaagtgatgttatgtagtatataagatgaatttcttgatattgcagatctaagagacaacatgcagttcccaaagaattatccaggtgcttgcacaatcttcccagaacaggtatgtttttttaaagattcttcttcaatgtatatgatcaagaaccatgttaagaatcaaactcttttataactcaaagattgcttcttttatagggtcaagaactaagaaaggaaataggagcattagcatacatagagtgcagctcaaaagcacaaatggtaaagtaaccattaatgcttgagttacattttacaattagaccaaatattttggacctcaatctgataaagaaagacttatgatgatgctaaatttgcagaacgtaaaagccgtgtttgatgaagcgatcaaagtagttttacatcctccttcaaagactaagaagcgaaagagaaagatcggtttatgccatgttctttgactagtgtactcaagtctctggctttggtttgttttacatcttttttagtgtgtttcttctatgaaggactcttgcagattttagtatgattagctatcttcgttataaaagtttgatcttgtagtagagattcttgtaacagaattataagcgaattctcgtctatcagtctatgtaaaagaacaatgtttgtcttctttgagttcaagagacaacaacaaagaaccgttttagcgcaaaaagaaacaaaataaaccgattgaaacagaatcgaagaataaataaaccgggttttgttttttggctaataaccgaaaccgaaatagaataaatcaataaaatctcaattctctagtcttctcctttaaactagagtcg

SEQ ID NO: 11632 - DNA, 3000 bp, Unknown; identical to SEQ ID NO: 11625
  misc_feature (1)..( 3000): cDNA_ID_2706988_gDNA_ID_2214506_Annot_ID_184127 3000 nt of promoter + ATG

SEQ ID NO: 11633 - DNA, 3000 bp, Unknown; identical to SEQ ID NO: 11624
  misc_feature (1)..( 3000): cDNA_ID_1396391_gDNA_ID_2214506_Annot_ID_184126 3000 nt of promoter + ATG

SEQ ID NO: 11634 - DNA, 3000 bp, Unknown; identical to SEQ ID NO: 11622
  misc_feature (1)..( 3000): cDNA_ID_3022714_gDNA_ID_2214506_Annot_ID_184124 3000 nt of promoter + ATG

SEQ ID NO: 11635 - DNA, 3000 bp, Unknown; identical to SEQ ID NO: 11621
  misc_feature (1)..( 3000): cDNA_ID_2992387_gDNA_ID_2214506_Annot_ID_184123 3000 nt of promoter + ATG

SEQ ID NO: 11636 - DNA, 3000 bp, Unknown; identical to SEQ ID NO: 11620
  misc_feature (1)..( 3000): cDNA_ID_1399068_gDNA_ID_2214506_Annot_ID_184121 3000 nt of promoter + ATG

SEQ ID NO: 11637 - DNA, 3000 bp, Unknown; identical to SEQ ID NO: 11618
  misc_feature (1)..( 3000): cDNA_ID_1013645_gDNA_ID_2214506_Annot_ID_184120 3000 nt of promoter + ATG

SEQ ID NO: 11638 - DNA, 3000 bp, Unknown
  misc_feature (1)..( 3000): cDNA_ID_3022725_gDNA_ID_2214506_Annot_ID_184116 3000 nt of promoter + ATG
agaaagccaaaacatgtctctttcttcaccaacatcagcaatagaccaatacggtgatgggcatttcagaaagatagcttcaaatgtagctgcttatatcaagatggttgcagagacacttgttaacactattcctaaggctgttgttcattgccaagtcagacaagcgaaactctctttgcttaattacttctatgcacagattagtcagagtcaggtttgttgtctcttacattcgtttatccagttcggttaactagctaagtttggttttagttccggtttaaggatttgggtttggttctttttagcaggggaaacgattgggacagttgctagatgagaacccggcattgatggaaaggagaatgcaatgtgcaaagaggctcgagctatacaagaaggctagagatgagattgatgcagcggtttgggttcgatgaacgaagccggtttgattttattggttgacatattaaaccttttaagttgataaacagacaactattgtagtacttgtggttatctccggtataatcgttgctatttcttgcacacacaaaattaacttaagttttttacttggtaataaaatttccttttctttgacccattaacttgggcctttgtgcccagataagagaattaaaacttacgcgcctaaaatggctaaaataaggcgcgaaacctgaagagccctagctcgaaggttccttctcttatcctcaacctcgcgattcgttattcggaccctacccagacgattcgttattcgcatcaggtttgattcatttgtctttgtctaattgatttgaattttcggaaacatttcttgacttctctgcttaatcgtcgcttacttacccgtgacatttgatttctagtaatggaagaaattggaggagctgaagcagtgataaatctcaaatctggatattcgctaccaatttcttatcacccatgttttgggcctcacgaggatctacttcttcttgaagctgatgacaaactcgtctctgatatctttcatcaaaggtacgattttgaagcttttgggtttgttttgatttttcatttgtgtcttagggtttcttaatttagtatccattctctttagggtaacattgagaggacttcctgatgaagatgctgttctttgcaccaagtctaagacttatgctatcaaatttgttggtaattctaattccatgttccttattcctccttcaatttttcctggagatgcacaagtttctgataccaacaacaatgtatcggttctcaaaatcgctcctggtaatatggaacttgttgaggcttctcctaggcttgataaacttaagcagattctcttggcaaatccttttggtgctggtgaagttgaagctatgatggatgttgataatgatgacttagaccatagtgggaagaaagatctagcgttgtacacttggagcgatttggttaacacggttcaagcgagtgatgaggagttacgcaatggcttgcagagtctttctgctattgagattgatggtttctggagggttatagatgagaattacctagacgtgattctgagaatgcttcttcataactgtgtattgaaagattggtcatttgatgatcttgatgaagatgaagttgtgaatgctttggtagctgatgagtttcctagtcaactagcgagtcactgcttgcgtgtgtttggctctaaagttaatgaaactgataagtggaagttggaaccgaggcttgtgtgtttgcactttgctagacagatactgagagaagaaaagatgagactagagagtttcatggaagagtggaagaagaagataccagatgggatggaagaaagattcgagatgcttgaaggagaggttttaacagagaaaatcgggatcgagacacgggtctatacgtttagtgtgcgctctctgccttcaactccagaagaaaggttttcagtactctttaaacatagatcaaaatgggaatggaaagacttagagccttacctaaggtaattgaacaaatcttgtgttgacagattccataagaagttgtgttattccatttatgaattgatttgggtttttgtgttatttgcagggatcttcatgttcctagactatctatggaagggttacttctgaaatacacacgcagagcacaacctaaagctgatgcaccacctgtctttagtgcaagataagatagtttctctatttctaaaaccttcggtttctttgttttgtgttatttgatattttagaagtgaaattacaggtcacagatcatccagtttcttaactaattggttaaaactatatttattggctgggcccaaaattgaagagaataggccctggatctggttgtcttgttaggcctagtctttgtcatgtctagtaattatacagtacaacgttaaataaatgaaaaacatgttacttgttttgtgcagagcaagagactttggttttgttactttgtttgattgagtgtagtcgaaaattggattacgttaactctatttgttttattttggttcgcaccaactcttaattaataaactaagttaattttgactaatcccaaaaattcaaagtagccaatctcaaattttctctctattttaacattgtttaatatactacttactagcatacatgtagtctcgagaattcgaatgtagaccactagtggaaattgttaatgattactatatactagcaaagtcaaattttaggaagaattttgatcaaaattgacggttaataagtcggaagttggattagttattagtagtaagttgcttcgaaactacaaacaaactactgtacatctaatcatcaccgttcaattaatccaaattctcccacgtgattaaatcatgaccgtcgatgtcatcaagataaaaccttatatatagacactacacaaagcagagcattgttacttgtgccatagtctccaaacattttctcgagaatg

SEQ ID NO: 11639 - DNA, 3000 bp, Unknown; identical to SEQ ID NO: 11617
  misc_feature (1)..( 3000): cDNA_ID_2707002_gDNA_ID_2214506_Annot_ID_184114 3000 nt of promoter + ATG

SEQ ID NO: 11640 - DNA, 3000 bp, Unknown
  misc_feature (1)..( 3000): cDNA_ID_2707006_gDNA_ID_2214506_Annot_ID_184113 3000 nt of promoter + ATG
ttatttccgctcatggtcatggatcacgatattttctggcaccgtcattgattattacttactaagatagatacatcctctatatagcgaataagaggatcacaattattttttctggtaccgctcattgattatatgcatggtctttatactgaaaaagggatcacgtaccaattatatagatacgtaaatataaggaagtatatatatatatatatattgattacatatgtagatacgaatatgctatatatatatatatatacatatatgtacgtctaatattttgtcagtaaaaatagcttacaaccatgtcttgtatatcatcacaatgcttcatcacaatcaaaagcatttgcattgtgttattattatcgattacttgtggagcagtttctgcaaattcaaattatggagaagctcttacgaagagtcttttgtatttcgaagctcaacgctccggaaaattgcctttggaccaaagagttatatggagaggagattctgcactcagagatggttctgatgctcatgtaagtttaatatccaaatctattttatttcattattctttttctgtaatgaatatttattacttgaaataaaatatttgccaattgtaaaaataggttgatctcaccggagggtattacgatgctggagataatatgaagttcggatttcctttagcgttcacaacaacaatgctagcttggagtagtgtagagatggaatcacagcttaaggcccatcaggagcacggaaacaccctcgcggctctcaggtgggccaccgattatctcattaaagcccatcctgagcccaatgtcttgtacggacaggtgggtgatgccaacttggaccatgcctgctggatgagacccgaggatatgaccactccgcgcccttcataccgcattgaccctcagcatcctggtgcggatctcgcgggtgagacagcagcagcgatggctgcggcttctttggcatttgcgccatctgattcagcctacgccaaaacacttattagtcacgcaaaagaactatttgaattcgctaaggattaccctggagtctatcataactccattcctaacgcgggtggcttttaccctagcagcggttacgaagatgagttactttgggccgcggcttggcttcaccgtgccactggagaccagacttatctcgatcatctaacacaagcttctaatagtggaggtgcaaggtccgtttttgcgtgggacgataagttcttgggagcgcaagtcttggtagccaaggtaggttatatgactttcctaaaagagaccatacccttacttacgccacaattcactcactcttttgcaaatgatagcttgtgtttgaagggaaagtgaagaacgaagggaagatgattgagtacaagagtatggcagagcaattcatctgcaactgtgctcaaaagggtttcaacaatgttaaaaagaccccaggaggtttgctctggttcttgccgtgggacaacctccagtacactgccaccgcttctttcgcattagccacttatgcaaaatacctcgaagctgcacaaacatcgattcaatgccccaatggtgatgtccttcaagcttctgatcttcttaaccttgctcgtgcccaggttaggcaggcattcgtgtttttcccttttaaattaaattacgttttgagaatcctcaagacttaattcttataaagatatgcaaagtgttcgtaatcttcatagttcttaggattttctgtgatgattacatggtttatgactaaaatgattaacataagaagaaaacaatttacatggtttatgtaataggtagactacatacttgggtcaaaccccaagaaaatgagctacatggttggatacgggaccaattatcctaaaagaccacaccatagaggagcctctatagtgtcaatcaaaaatgatcctaaaccggtgacatgtaatggagggtttgaagcttggtacaacaatccaaaaccgaatcctaatcttttggttggagcaattgtaggtggaccggacgagtacgatgcatacggagatgaacgatctgattttcagcacggcgagcctgataccgtcacggttgctcctttgcttggtgttctggctgccattgcatgaccttaagtattattttctttggactacatttcccaaggacgctctagcaactaacgttttaggtctaagggtagagaaacaaaatttgatttgttaaaatatcttgatttagtgagacattttgaagactgatgaggtttttcctctgtttcaagactaaagtgatttcggctcggttaagttattttggtttgtagcattgattctcttgaaaaattttaacaaaaaaaaaaaaaaaaaatctaagatatctgtacttgtactatcattcaataagaaatcaacaaatggttaaaaatgatgcaaaaaaaaataaaataaaaattaagacaaaatctgtaaattttatacaaaagattgaaagaatattgaccaaaaactgtaaatttctacatggatagtaagaaactttcaaaaaatgcataagattattaatagatatatacataagaaaaatagaaggaatatatttttaagaagatagcctaactaattatagttcgcaatcttattggtcttgtctatatcttttaggataaatgagaagatgtctaatattatgagatctaggtacaacatttttagctaatttatttttgagtaagaactacgaatgttaatgatccttaattagccatggattccatcttatatagattctctataaatagttgaacacggacatatacatagatatgccaaacacaagagaaaatcaaatcaattctacaattggtcttgagatcgtctaaagattatttaaaaaaacgatgtctcaactgaaaattggatcttcacaatgcttatggacaagtatttgcattgtgttatttgtattgtcgatg

SEQ ID NO: 11641 - DNA, 3000 bp, Unknown; identical to SEQ ID NO: 11615
  misc_feature (1)..( 3000): cDNA_ID_2708064_gDNA_ID_2214506_Annot_ID_184112 3000 nt of promoter + ATG

SEQ ID NO: 11642 - DNA, 3000 bp, Unknown; identical to SEQ ID NO: 11630
  misc_feature (1)..( 3000): cDNA_ID_4254303_gDNA_ID_2214506_Annot_ID_133769 3000 nt of promoter + ATG

SEQ ID NO: 11643 - DNA, 3000 bp, Unknown; identical to SEQ ID NO: 11629
  misc_feature (1)..( 3000): cDNA_ID_2711228_gDNA_ID_2214506_Annot_ID_133770 3000 nt of promoter + ATG

SEQ ID NO: 11644 - DNA, 3000 bp, Unknown
  misc_feature (1)..( 3000): cDNA_ID_2711224_gDNA_ID_2214506_Annot_ID_133771 3000 nt of promoter + ATG
ttcaaaatctccatcctgcgaacaatcaaatgcagaaccagataatttcatcagcaatcgaatttttaaaatcaaatcaataagaaaccaatcggaaacctgatcaactactacagacacaatgcgaatcacaaaaaacgtcacgattgatacagcgagcttcaaaaaccaaaaataaagtaaagaggagaattcaatcaccgtcgaggatcgaaaactcaaaaccaatcgaatcaaatagcgatcaacttcgaatcctcaatgaaaacagagaaagagaatcttgcgcgaagagcaaagcaagaaagcaacagcttcaagatctactgagtgacgccggatatttatcggcgatagagataatcggacggcgaaatcaagcgaaagaggagaataaggaagaaaaaaagatttcagcataaatttttgccgtttctttaattgtttggaggtttggaaataaaataaaaaaggaaaatgagatttttatagttacgacggacagggctggtgtacaggtggcaattaggctggaggaccccgcgcgtgtacttcaatcgttttcagcgtcgccgtcacaagtcataccggactaaaataaaaagtgactttggttaggtcattaagcattggttaattaatttggcacttaagtcaaacgtcaacgactttttaatccctttttttttgtcgtaatatatggtataacacaagtcatagagttctgatttttttccttcaactaccattagaataagtagatgcaattttgacgtatattgtattatgtatttttctgagtttaaaatcgaaattttgtagatcgtcacgcgccggtcggcgacaattgcaaaaggcgagggatgggccatatattttgatgtgtgaagtttaactaaagccggcctccgtataattactcattgttttctggtccaccggattgttaatcaatcatccaacacatgtgacatgtccctataaggaggttttttaaaaactatgtcaaaacttgaggaaatgttacatttacagcaagcaaaatcagaaactagcccctattacaattcttttttttttttttttttttttgaattgcaatctttatagagctttatggttatggtacgtgtaatctttatagtccacgtgatttagcgtgaatggaactcaagactggtcgctaccatcaacactatggaaactttcgcgagcacatgcacatcattactctttttcagaacattcttttcctctatccaactaaatcaaattttctattcaattggccggttatctgaattctacttcacttgcatttcatattttctaaagtactgaaaatttagctaccatcatatgaactattttattcgtgaattttatataagtgaaagctggtgtcgctaagtatatatacaaattagatcgaatatttaaccatgttaaaatttacgtttgttatctgaagttgagttgcgttaaaagttttcctagattccaacgattatccttatatgcttggaaaaaagcaagaacatagataattgctacacctttacttgaagtcaaagtaatagcctttctatgtacgggtattatcaagaaaacatatacatatcttcttcttttttgttgataaacatacacattatttttataaatagagatttcataccaaaatttataatagaaacgagaattattctttaaaacattcatataatggttagtcataattaaaaaaattgccatgataaaacatgaactatatatattttcacgtaacacttcaagtacttaatcaaaatctcataaaaatattcaaattggtaatccaactaatgatatattcatttagaaaaacttataatattttatagagtcaccttatacattgtcaaacctaatttaacctacacctatgacctataaaaaatccctaaacttcctaattaaaaaattacttaaagagaatatttgacagagaaaactataagattgttgatgaacgaataacaaacaagtaaatcttgggttgtcgactgaccaaaccaattaacgcaaacacaatatatctctatatattatcaaatatcagcatcatagaaacaataaataaatacgaaactatgaagcaatagtgacacaacaggtacaactaccgttgcaccagttggaatagatatcctcttctgattctgaaacctgatttaccttcagatttggtcaaagctcttagtttatggccttcatgtaatgttttttccgctgtcaattttgtcaactaaagtatttaatatcactacttatttcgttttcatgtactgtattttattaccttcctttagctttacgcaaaaaaaaaaaaaaaaactactttccaatgacctttgtctggtcaatgcttcattcgccaatgcaccattccaacatacttattttgaaaactcaaaaaccatcaatccgaaaaattcgtcttggtgttagtattcaatgtcttgatctccagattgcacgtatatgaatcaatattaatacaccaaaaagtttttaaaattgagattgaaaaagtcatcattacacctttttaagctaaagaaagaaagaaagaaaacctcctttataaaactccccgtggtccattaactttgtcggccttaaaggaaacgtcgatcaccagtaaccttcctaccaatcacaagttcacttcccaaaaaaactacgaaaaagaaaagtaaagaagatgctatactgattcttttttgaacaaactcatatttcccatctaggatcataattcatacatttagacagttgagcccaaaatattgaatgttatgggcctaagcctgtattaacggtctactatatacttcttaaatattgataattatgggcctaagattgtattaacggcccatttagttatcattctatgtttcaacgccatcttgcgagtcactttgcttagttcttctcatcatcatcttctctatg

SEQ ID NO: 11645 - DNA, 3000 bp, Unknown; identical to SEQ ID NO: 11627
  misc_feature (1)..( 3000): cDNA_ID_2706977_gDNA_ID_2214506_Annot_ID_133772 3000 nt of promoter + ATG

SEQ ID NO: 11646 - DNA, 3000 bp, Unknown
  misc_feature (1)..( 3000): cDNA_ID_2707044_gDNA_ID_2214507_Annot_ID_133775 3000 nt of promoter + ATG
caaatctatgtaaaataacatacttaatcatgatataaacatttttatacttggattatccacacgaaagaaagagttttgcttgagcaacaaaatgtgttcagaaggtacccccaccggtatttcttacaaaattaagggtacattttagtaatacttattaagttacatttcagtttctgaatttttttaaagatcatgagagtaatcgttgaatacaaatccaaaaatccttcaataagacttaacaattgtagttcttttgtttaaacttttacttcttttttttatcattcttaaggaaaaattacaaaattatcaaaaacaaatcagagataaattatttctagataaccactaatatggattatattctagagtttcatgtaaattatgtaatacaaatatttttggatgatctagataaccactaaaatggattatattctagagttttgaggatacaccttttttgtaatatatatatagtctggattcaaatatacttatatagacaggtgcaaacaaaaaaaaaaatctattcatggtcaataagtgaaagactacaaatctaaaacttattaagaaaagaaatctacattttgatatcatactgaatttgattatatttcatttaattaaaaaaagtttttaatagtgtatgattaagaagtaaagttaaaattaattataatttaggggtcacattttaaaaaattgttttagaccaccaattattgagaggtcccgcttaaatgttgaaactaaatctcatatatctagagttttgaggatacacatttttataatatatacagtctggactcaaatatacttacttatatagacatgcacaaacgaaaagaaaatatctatccatggccacaccaaccgaatagctaaaagtttaaaacttattaaggaaagaaatctacattttgatatcatactgaatttgattatatttcaattaattaaaaaagctttcaacaatgtataattaagaaataaagttcaaattaataaaaaaattaagggccacattttaaaaaattgttttagaccgccaactatttcagaggccgcgcttgaaactaaaatctcgtatcttctagggttttgaggtgcacctaattttcctatataaagaatttttacatacattttcgaaatcgccgaaaaataggagagagcgagagttcatggtttacatcaaccgaaactcgaattcttattaaggagaaattcattgtagttttgttgatctatatcttgtttcgcatacggatagatcttctgcggaccacaccattttttccgctcatcaacttcaaggggataattttacaccatttcaatctcataaggtatcttcacatccctatttgatttgtttcactacatagcgagcataatacttttgaataagttgtaaattttcatgtaataattgtttttaaagtgttagagacaaagggcatgaacttgttaatgttccagatttgattttcgtatgaaaactattttacataaccatcatgtgtagtgaatcttttatgtattcaattcaacgagatcttcatattaagattttgaagaaaagaagaataaatctatacatcataatttaaatatctacatctaatatatactaacaatttggtcacttggagttcattgccaaaagttatgtttttcaaagaaagttcactgccatcctagtgattctaaactcttaggatatgaatggtagacaataggaggaaaaggataaggtaaaaacttttaatgaaattgttttgactaatattttgggggtgaaaaaatatcactactctaggacactatttcgattaagacaactattaaaagaaaatcattttcatttttaaatgaatagttaacttacaatattcttagcaacaacaagtttcactaacataaaacaaagctcaatctcgtctttaagtcaagtaaaactttgatttattttattcatcaacctaaattaccattcaacaaattttcataacctaatgtaaaatgtaattctaaaaaaaaatacgaatgacatgcaaagtatcatgtgtccctacatttataaaaactctcttgtttcgtcttcttcttctccagtctctccgttcaacaaaaattgaatctttttgacatagtttgtataagaatcattgtatttggtattcttcttcttctttttcgcgaacgattactctagtcacaatcttattttctctgtttgagttcatatatacccacaagttttcttttcaaagtctcagttttttttttgctttttctatttcattgcaggttttcaagattccgagtatatactttgggtttgatcaagctctctactactttctttcatggcttcttttcataaaggtaacgtttttatttggattctgcatttcatagttttagaaagttttagacttttttctgactcgtgaagatgaacgtagcgtaacgattgttttaatcttgattttacatcctagagttgttttatttggaaagttacatgattgtgagtgctaattatattggttgatgtgttgtaccataaaagaggaaactttctttgtctaagatgttcttggaacttatagtaatgaatgtggattcactacttgctttgtctttgtgaatgaatgtggaaacatgtatcttgttctcttctgggttttgtgagcttttgtattgttgtttctagttctctggctcgttgatgtctcagcaacatgtagaatttgagttgttttgttctgcggttgtagttgaggtttctttgtgttactgtacaaggtaccaaattagattttctagttgcataaattttgatctgaaatgaagtttggtaaacaagctcatgtagcttttatttttgttgatacattgttattttaggacacaataagcttgttttttcttcttcatccaggagctgcaggtgactcaatgggaagcagtaaa

SEQ ID NO: 11647 - DNA, 3000 bp, Unknown
  misc_feature (1)..( 3000): cDNA_ID_2707024_gDNA_ID_2214507_Annot_ID_133777 3000 nt of promoter + ATG
ggcactaagctgattgtatctggtggttgtgctgattcaggagctctactcagcgatacattcctgcttgacctatcgatggatatacctgcttggagggagataccggttccatggactcccccatctcgcctcgggcatactctaactgtctatggtgaccgcaagattcttatgtttggcggtctagctaaaaacggtactttgagattccgctctaacgatgtatacacgatggatcttagcgaggatgaaccgagttggagacctgtgattgggtatggatctagcctccccggaggcatggcagctccaccaccaaggctggaccatgtggcaatcagccttcccggtggtagaatcttgatctttggtggttcggttgcagggcttgactcggcttctcagctttatcttcttgatccaaatgaggagaaaccggcatggagaatactgaatgttcagggaggtccgccgaggtttgcatggggacacacaacatgtgtggtcggaggaactcgattggtcgtattaggtggtcagaccggtgaagagtggatgttaaatgaagcacatgaactgttactagcaacttctaccactgcaagtacttgatcaagtgatgaagttaaaaaggcatttagatgtgttggacaaaagatctatacattgatcaaaaacatgttcatattgtctgtacatggtgagtttgatacgtccatgttttgttcatctgttgacttaatgttttttttttgtatatgcaatattacgaattggattgtacataacgtcttttgtagtgcaagtggccaaatgatctaaatccaaacctttttttttgtcctcccaaaatgtttcatgtctgattgaaatcaaaattattgtgtttagggtttagatcttttctccacggatcatataataattgtttttttttttgaagaattattaagaaaaaaaaggaccaaaaaaaagaaaagaaagattcgtcggaaaaagcaggaaaaaaaaaagaatgcaagaaatgtgaagtgtgtttgactctttcattggtcagtgtgaaaagtaaagtacatttacacttgcaagaaaaaaaacacagagacgaaccaaaacctcactctctcccctgaaactaatcttccactttttcactgtctgcaacttgcaactacaactagcaagcaagaacctttcttcttcttcttcttaatctcagattcttgtctgaaaactttctctttcattttctctcaatttaacactttcaagatgccgatcaacaaagacccatcaacacctcctcctgttatcggaaaaatcggtccttacactgtctttatgactcctcctgcgactcctaaaccacctgaatctccctccgctgtgtctcagaagcctgtgatggcaccaccggttcttcctccgccgcagcagtttaaatcggtggcttcttctgaccaggacggctcagttttggggttctttaaaaacgccgtcacaaaggttcaaaatggtgagaaatctgataaacaattaactgattttcagctcaaagtttcctcatttttagatcttgaatttgagattgatttttccgataccctttgattgattgattaggaaattgaactcaaaaatgatataaatcgttgtaaagtttctatctttgtgaagtgattggaaagtactaatgttacatgaattctagcttttcatactgtttatgtgatttggtcctaaaagcaattagattgtgaatttgacattcatgttgtgtgtgtgtgttctaatccatttgactacagcacattcaagtgtggatgatcatttggtgaggtggtttgggttaaaccaatctaagtatcagtgggctttggatgagtactacgaaagcaaagaatcagtaagtttttttttgagtctctatatgtttcctttgagtctctatatgtttagtttcttgttcttgcgggtcctgtatcgttctttgtactagtttctatcgataatcgattcctttagtccgattgattcatcagctttttgtttcatgtacattttgcgtaagcttagaagtaaagctagtttaagtgtttttttgctctttgcttctaggctaatgaacataacaatatacaaccaatgaaattgatacaacatatttgaagcttgatattcactcaatatcagttgtaaaaattgttcattggtatttggtagtcaaaaatgtcattgattggttttagagttactactctctttagtcattgatttgcttatgttcctcaagtaaatcttgtagttaacacatatcttttgaatcgaacgcaggatatgaagaccgtgaaagcaaaggagatgccggggaaagtacagagtgtataagcaaccatgtataaactcatttcccctttggccaattctaaaatctgtttttctgagagagttcaaaaaagcttgagtcttgaggaaagttctcttcagatgatatttaatcttagagatttcttttggtatatttcaaaacctatgtagtagctctttctagtttcatctaacaatggtgaaatctccaaagcaaaatggagagatgtcattggtcatttggtttgttgtaagtttaatcacattatttactttttaattgtatcgttataatctatatattgtctcaattcaaaaaagtttgctcagtgtttttcttttgattgttgtcatacatgaaaacttttgctagatacctctcaaaacttcaataattatcttcatcaaacctaacaaggcccattacaaaggcccaaaaacattattgtttaatattttccgattaaataaatagataaaaactgaaatgtaattgagcagaaaaaaaaacaaaagagacgaagaagggtttaagttagggcttttgaagtaaaccaattttgtgcgtctcccttttcttcttctcttcccaatttcaccgcctctctctatcgccggaaattaaccatg

SEQ ID NO: 11648 - DNA, 3000 bp, Unknown
  misc_feature (1)..( 3000): cDNA_ID_2707040_gDNA_ID_2214507_Annot_ID_133778 3000 nt of promoter + ATG
gcaatttactgtcttttaacaaccatctccatccagtttttctttaatggttgagtgggcaaaggtatataaaccgtataccaaaaattgtgccaaagggagtgtgggacactatcaagagattcttctaaacatgaaggaagatgaggtacctaacaaaatctcatctctgtcattatgcatttgttttatattaaatatttagattatattttttcagattaaatggcagccttatagcaaagttgaatttctcgaggaatacacctctcaattgagtatggtatttgcacatgttccatgcatctgttttaacaccatcgcatacaaccgaactatttggaaaagccaccaaatagttctccgattaggaatgacgagaccttggaatgagagagcctccaaacaagtggcatgaaagcagtaggtgggttgaccattcacatgtcactgagctggtcgagaccttgccagaagaaaccagtagatcggttgatgcaaatgtgattttttttttttttctaacacaaatgaatttggttctcactttacttgatttaacagttggagtcctcggatgaaaatcacaaggaagcaaatgaagaggagggagcgaatgaaacggtgggagcgaatgaagaagagggagcgaatgaatcagtatgtcattctcaataatgcaaatgaatttggttttgtaacatatactctaagatattaggaaactaaatattaataactggcaggaaagaagcgatctttgacttcttaaaagaggaagagataaaatactaacagatagatttactccatcttctcgcaccagaaacatggaggggaacaagaaacaaaaattacgcttgatagcctcgtttcctccaaaatcgaggagatgatagattttggaggctatcaagaaacaagcgtggcctatcgattttggaggaaacgaggctatcaagcggaatttttgtttcttgttcccctgcatgtttctggtgcgaaaaagatggagtacatctatcggttggttttaattttccttcacttctaagtagttcgtctcttcctcttttaagaagtcgaagatcacttctttcctgccagttattaatatttagttttctaatatcctagagtatatgttacaaaaccaaattcatttgtattattgagaatgactaactgtttcattcgctccctcttgttcattcactcccatcgtttcattcgctccctcctcttcattcgcttccttgtgattttcatccaaggactccagctgttaaatcaagtaaagtgagaaccaaattcatttgtattagaaaaaaaaaaaaaagacaattcacatttgcatcagccgatttactggttttctccggcaaagtctcgaccacctcagtgacatgtgaatggtcaacccatctattgctttcattccacttgtttggtggctctcccatctccaaggtctcgtcattcctaatcggaaaactatttagtggctctcccaaatagttcggttgtatgcgatggtgttaaagcagatgcatggaacatgtgcaaataccatactcaattgagaggtgtattccttgggcaatataactttgctatatggctgccacttaatctgaaaaaatataatctaagtatttaatatagaacaaatgcatatgacaaagagatgaaattttgttaggtacctcatcttccttcatgtctacaagcatctcttgatagtgtcccccacttctgttggcacaatttttggtatacggtttatatatctttgcccactcaaccattaaaggaaaactggatggaaatagttgttgaaagatagtaaatcgctctaatgcaaatacctacacgaaaaaataaaaaacaattaacattatacaaataatcaacatcaacataattagtttttgtttcacataaaaactttacttgcagagcaaagacaaaaccgcagaaaaatgtggtttgacctttagtaaaagccttcttccatttgcataaagcgtcttttaggatagttgaagatgatgtctaccctctaaacacacaagattatatggcagacaccacccaaaaccaaggcgtaacacaaacacgtaacagtgtacaaacttcttctagacgtgcaaggcaacctcgaagaaggtctatcattgaaagcgtgatcgaaaatagtggaaactttattacggagtatcgtgaaagacggggtgttgtacttttgtatcaagatgttattaacgctcttagacgtcttgatgtcccgaagcgtacaccattctggcgggctgcagtacgatgtcttgctcaagccaactatgcatcggcttttgttgctctagaagaagaggaaaatattgattggcttgaagctattactggattcagcaaagacggagaacgtttcgatgagcaagaattgggttttggatgcaatggtttcatgataaattcaagtttctaatgtttttaaatcaataaaactgattctaatacactcatttggtaaaaccaaaaaaatctcataagaaacttacaggatattttgtgtaaaccggatagataaactaaaccggtaaggtaaaattaagaaaccggtctggttaaagatggaaaaggagaggcactgagaagagccgagtcatcgaccgaccgaatcatctctcttcttcttcttctcctcctcttagaagtgggcggtggagacttccattacctacaaatatcagattcctcttttcttcgctcgattccatttcaaaatctgttcttctatctcctgttcctgaagaagacgatttctgggtttgtctaaagtttggaacttttttcctgtggagacttcgattacctacagatatcagattcctcgattcaaaatcaaactttgttcttctgggtctcttctcctgttgctgaggaagaagattagtgggcttaagctttattttgtgggtgtgtatgcaaaatcaaatg

SEQ ID NO: 11649 - DNA, 3000 bp, Unknown
  misc_feature (1)..( 3000): cDNA_ID_2707036_gDNA_ID_2214507_Annot_ID_133782 3000 nt of promoter + ATG
tctctctgatcctgctagtgctcggcatttaaagtttgcgaggagtaatgttctcaaaagcatccagctcgggaatatttggccctcctttatcctattctcgattctctctatccctagatagttccctcctttagcataacactgaagcatcaaggaataagatgtttcagtaggtttgaaacctttacttttcatgtcggaaatcacattttcgcctgatctccaatctccttttcttgccaaggcattaagtaacgcgttgtaagtcgtaacgcaagcgttgaaccctgctcttgtcatctcaccatacattttcgatgcatcaacctctgaaccacatcgcccataggcactgatcagcgtgttgaatgtgtccctatcaggttcaaatccgcagctcttcatttcacggaacacccggttcacaaacttatccatacccttattcccacacagagcaagcattgtgttccaagtggcacgattaggggaacatccattagacttcatatcacataacatctttatcatttcgttggatctcgacttcttccccaacagactaagcactgcattgtaggtgcaagtattcggaacacaaccagcttctttcatactataaaacagcttcaaagcctcgtcctcctttcccgcctttccatatgcatctatcactgtagtataagtgattgcgttcggcattacaccctttttcgtcatcatctcaatgacaccagcagcttccttgctaaaaccagctctaacataagcagcaacaagctcattatatgtcacagaatctgctgggcagctattttcctccatctctttcaaaacactcaacgcttctgtataaactcctgctttaccaaaaacttgcaacaaagcattgtacgtaacagtaccaggttcatagccgcatgacttaagttcagcgaaaaactccttggcctctcttaacaaaccttctcttgcacaagcagagagcacagtactacaagtaaactcatcaaacttcaatcctttgcttctcatttcatctaaaacccctagaattttccgccaagatcgacccattttcccgaaaacatcgagaatcacattgtaagtcaccaaagtaggtgaaggacccatctctttcatcctctcaaacaaatcgatagccttttcatacttcccagtccgtgaatacgcatgtaagatcgtcgtgtaagcccgaacatcgaggagatattcttgtagaggaattttatcgagcaacttagctgcaacagagtactgagattctctacctaaaatcctaacaaagatttcgataacttgatgatctagcttcaaagctccagaatttgaagacaaaactaaccattcaaacaaaaaaacagctctttcccaatgcccagaatcatctagacccttaaccaaactaaccaaatcagttctaagcaattccgatttcacagaatcaaaaaacctactcaaaccagtcaaaggctgttcaacaatggaattaaccaagacaacttctttcttacacaagagtttcaaagacccatttctctcgttctcaatttcaatacccagaatgggtttcgacgatgatgaatcagtcgagacttcgagagaagggaaacgagcggcggcggagttggagtgtctaggaggcggggaagagaggtgaacgagatggtgaagaagagaatcgagagggaaagaaggaggagaaggaggaggtaagtgaagagtagcggaactgaatttgatagattggttagaggattgagatggtggaggtctcttggattgaattgggtatggaggtttgtgagggaagagtgctccgtccattgaaagacgttatccgaaattgggattgaaggagaagaagagtgagtgaaagttagcgcctttgggttgaagttgagattttgaatggccgtaaaagggactcgtccctatcggcacaagattggcctttccagatgatgcgttacgaacatttttgttctaatccgtatgactgaatatcttaactaaaccgaaccgaaccgaatttgaactaaccggaatgtatacacgaagtaaaaacaatagataaaatgtgaaaaaaaaattaaaatccccaaactgtaaaaaatacaaaaaaccataatcagattttgaaatttgaaatatttttgcgattttattgagttcatgtgtattttaaacgaaaaaaattacttgattagaccaaattggttcagacaaccttaaatctataaattggtttgttagattttacaccaatttgatcacttaactaaattaattaaattagatgattatcccaccatatttttgagcattaaaccataaaaccatagttataagtaactgttttaatcgaatatgactcgattaagattaggaaaaatttataaccggtaattaagaaaacattaaccgtagtaaccgtaaatgccgattcctcccttgtctaaaagacagaaaacatatattttattttgccccatatgtttcactctatttaatttcaggcacaatacttttggttggtaacaaaactaaaaaggacaacacgtgatacttttcctcgtccgtcagtcagattttttttaaactagaaacaagtggcaaatctacaccacattttttgcttaatctattaacttgtaagttttaaattcctaaaaaagtctaactaattcttctaatataagtacattccctaaatttcccaaaaagtcaaattaataattttcaaaatctaatctaaatatctaataattcaaaatcattaaaaagacacgcaacaatgacaccaattaatcatcctcgacccacacaattctacagttctcatgctaaaccatattttttgctctctgttccttcaaaatcatttctttctcttctttgattcccaaagatcacttctttgtctttgatttttgattttttttctctctggcgtgaaggaagaagctttatttc

SEQ ID NO: 11650 - DNA, 1878 bp, Unknown
  misc_feature (1)..( 1878): cDNA_ID_2711125_gDNA_ID_2214507_Annot_ID_184166 3000 nt of promoter + ATG
atataacaataatatatgatattctgaaaaaattatgagcaactatgttacttgtgtgatttaaaatttgcctaactcaattttaaactaaatcttattttatgtacttcaacaacattgtgataggctcatgattaaaatttggattgacatcaactgaacaagatttgaaaagtattcgtatgaaaaaataaaaagataacaaaaattaaatgtcatttaagtcaatattttttgatcttctgtcattgcatatatcaatattagagaaatgatcatgtcttgaatgatttgaaatttgtctaacttgattataaataaactatttctagtttgatgtgttcacttgatataatactccaacaacagtgttatcgactcatgattaaatatatagaattgatataaactgaacaagatttcaaaagtattcatatgaaaagaatttaaaaaaaaacaaaaattaaagcagcatttaagtcaatacttttagatcttctctcattgcatatatccatataacagaaatgatcgtgtattaaattatttgataggtctaatgttttaaaggtttattatttaaaaaaacttgaatgtcaatgttatcaaagactcaaaataaaattactaaactaataagaggtttggtaacgaacaagtacaacacaaaaaaatagtataataaaaagagtatagtaaaagtagtgcttaatttattatcattaattttttttatttttttttattttaaagaaatcaattaagagtaggattgatgatatatttaatttgcttatttaatttgattaatattttaatttaaaaaatatagaatgacacatgtcatttttttttgtgatgatgtgtcattcatttggagagagttggccaactttcatatatatgatttatattagtcaattggagaaatttacacataaagactaatcaacttgattactgcctatatctcatccctcgtgatgatctccaatttcataaggttttttcaagtgatcattcacttaattgcacagaaatatagtaatgtttgatctttttatactttagtatggtccacgttcattattttgcaaacttgcatgacttgtcaacttatattgtatatcatcaaaaataatgtattccacatacacaaaaacttactttccatcactagagtcaactttaaatcctatcctcgttgtaaacttagatcttgagaaggatgtaatctggtaagatggatcaaatcacatgagttcttcttcttagtccctcttgttcaagtagttgctaagaagtggtaacatggctttgagttggcaaagataagattaagatcaatttaaacttgacaccgagactggtttagattttgcctttgattaagaaaatctgattaatgacacaaaatatacatttgtttttataactgtaactaatttcttcataattataatttcagtcaatactagtatactactctttaatgcatcataaaaaaaaacagccatatattgagggttgaattatattgtacccaaaatacatggttgaataacactctcaaagaaacatacataatcaaaagtcctcaattaagcaattatagcctatatataacaacagtataataaaataaaatattatacaaatcactatgtgagcctcaacctagcctcacatcaaactcgcaaaatatatgattggacattacagagtgtaacaaagtcattatcataattgtattcttcaaattataaaataaactaaattgcatgtaccatacgtaacccgtaattgtaaatttgatcaactctataaatggagacaaaaacacacacaatgatcaaaaccttaacattctaagccatg

SEQ ID NO: 11651 - DNA, 3000 bp, Unknown
  misc_feature (1)..( 3000): cDNA_ID_2687599_gDNA_ID_2214507_Annot_ID_184164 3000 nt of promoter + ATG
aaattgtttttaacagacctctgtaaaaatttaattagcgaccttttctatgctaaaatatttttcaagtgtttatatataatcaattgatatatcaaacagaatcaaaagcaagggttaatttgcaaaatggctaattttttttatagttgctaaaaatataattttaaataactaactaaaagcaaatgaaaaagtactttaatagttgaccttcaaaaatatttcatttaatattcacgtagagctactcgttttattcattggtaaaatttaagaaaacgtggtaacaaatgattttcttttttggaggctaatataataatgaatactattaagtacgagagaaaaaaaagattaggctaagaactaataataatggaatgatggaatataaaaattctattttgtttggatgatctaacctttcatttaacctaaatgggtgattttcttttctgtaatatatcacttttatattatatgattttaatgttaacagattttattaaatagagttgaagctatatgatttcaggatgccatatcatactaatattctacgtacaaaacaatttagcacagaaatagttttaccgaaaactaattgatggcaagaaatcacatgattattattttttgtaatttgttttgtatattttccattaatattttgctaattaactcagctaaaaatgtttcaaaaaatagatctgattatttggatgttggttttatatttccttgttataaaaacaaagaatatgacgaataaatttaactttttgaaatcctaaaaaaaaaagcatacacatttaaataaatacttttatgtatttacctatgaaagttaaattgattttgtctatcagatacataaatgatcaaataataaatgagaaaaacctgcccatatgtgccgatatatatccagttgaattaaaccatcatcttcttgtttctttgtttttaaaattctcttatgaaatcgatcttttagataaaatacaatcgaatttatggaagcaagaaaaaaaaattacgtaggggaggtgtattattgggggacccagcacgatcaaaaagtcaatattcatcagccaatttgctgaataaataaataaataaccttgaaaacaatttttggttaaattacaaaaataatgatatccacaaacatgtgaattgttccagcaattgctgaccttgccatgaggcaccttggaagagccattgcttcattacaatcctttaaagccataaatatgagattaggattaccaaaatttcacatataacaaattgttttatatcattactagcttaatatgtgttttattatagttttagatcgacgtcatctgaatattttcccccaaactcctaaattttataatctgtgtctaaacctaattttatatttcaaaacatccctttttctggaagaaacttgtcttttaattttttttttttttttcacacttgtcttttaatttccttaagagaccaaatcaagttaatttagtgtactcaccacctttaaaacaggtcaagttaatttatttgaacatcagtaataaatttatgaacatctcttttcaacatcggtattcttaaatagtgttttagaatcgtcattttaactttatgtttcactaaacttagaaaatatttagttttttttatctcaattagtaattatcatttaaatttttattttctcggtttctacttcgccactattatttaacatattattaaacaaattagtattatacgggttgattttaattttccaattacaaattaattaaaattcaactttttgattggttgtataatccgaaggaaaaatgtttacatacgaattgttttaaaaacactttgatttaaaagtccgacctaaacaatcaacatgaaaattaaacttatgagcaaattaggttgatctagaaaataacttttgcatttgtctcatagggaattataaagttagtatctacacacatatatcaaatatacatgttatatctatattactctctctctctctctctctctctctctatatatatatatatatatatatatgtatattcacaaatccatgtatgtattttaaattttgtttgttttttttttccttcaaaatgagtaacttatatagaagtcattaagattagctttgcacaactctttgggaacaaaaaagaacccaaattttaagcattattcaatgttcatataattattatgtatattatttttccttattgattatcaattttatatacacaaaaagatatcagtgaagaacttatgattgtgcatattttctgtccatacataaccacaatattaatcaaaaatttaaatttatcttagatatttttcttatgataattcaatactgtataattttttaaaatctatacattacagttttgtcttttaaatcatattctaatatgcataaatatctagaaaaatactaactccatagaattaaatttcttatgtaagtttagtatattatcctaaatttgtgttaatgttaagatttctactaaatttgatactcaaaagtaaaaagtttctcttaatagaaaaaaataaatatagattctcttacattacaggatcagagtataaaaccagtttaagtaaacaatgtttcaaaaaacagtatgatatctgaaattttaattataaaaccaaaaatccaaagtcaaatatacgttttccaagtgagaaaggacccataaacaattaacaaccattgatgatcaccaaatcataatcaacggtcgaaatgaatgaaaaataaaagtctgaaacggtggagagtttcgtcgttttgagtggttataaaaagagaaggcgtatatctcctctgcaacagaagctcgctttctctctctctctctcgtgtgtgtgtgtgtgatcgagtggtgaaacgacagagaggggcgtcgttttgttgatttcttctgggtgaag

SEQ ID NO: 11652 - DNA, 3000 bp, Unknown; identical to SEQ ID NO: 11649
  misc_feature (1)..( 3000): cDNA_ID_3022338_gDNA_ID_2214507_Annot_ID_184163 3000 nt of promoter + ATG

SEQ ID NO: 11653 - DNA, 3000 bp, Unknown; identical to SEQ ID NO: 11647
  misc_feature (1)..( 3000): cDNA_ID_2707024_gDNA_ID_2214507_Annot_ID_184158 3000 nt of promoter + ATG

SEQ ID NO: 11654 - DNA, 876 bp, Unknown
  misc_feature (1)..( 876): cDNA_ID_3022366_gDNA_ID_2214507_Annot_ID_184153 3000 nt of promoter + ATG
aacataataataatgtataaaacataataacaccaaaagttttaatacagtaaaatatgaaaattatagtcaaacaaagaacaaatatgaatttaagcaaaaaattattataaatctattttaaagaatttttatacataatatatatatatatataattgatacatttatataattattaacttatgatattgatgggaccatatatttacatagaactttcaaaaaaattattatcttattgatttatcgatttgtgtcactttttacattagtcctaactcgtgactggaaaaatttattaattttttgaggttctactgtatataatacttaaactgattaatgagatatatccatttaataaatttataaataaatttaaattaaaaataaaatggaatgataaagattttttttaacagagttttctagcacttaatcttctttgcttccctttatttaccataaccacaattctcatctaattgtcaaaccttgatcttcaactcaaattgaagctaaaccatgttcttaaacttgacatgtgttttaaataaataccactttgttaacacagtttttaatcaacactatattctgccagactgccatcatatcatttttgcaaggaaattttctcaatatgattatctacctaaatgatactatattttaacatataaggttacgttttgattctgtagtttatggaagaatccttataatattattcctaaactaccttccctgttttatttctactcaaaaaccctttttttttttttttttttttgtaaatctcactttcttcttctctcttcaggctgtgaatattctgatttctgactaagctctctacaattctctctcatg

SEQ ID NO: 11655 - DNA, 3000 bp, Unknown; identical to SEQ ID NO: 11651
  misc_feature (1)..( 3000): cDNA_ID_2687599_gDNA_ID_2214507_Annot_ID_133783 3000 nt of promoter + ATG

SEQ ID NO: 11656 - DNA, 1878 bp, Unknown; identical to SEQ ID NO: 11650
  misc_feature (1)..( 1878): cDNA_ID_2711125_gDNA_ID_2214507_Annot_ID_133785 3000 nt of promoter + ATG

SEQ ID NO: 11657 - DNA, 3000 bp, Unknown
  misc_feature (1)..( 3000): cDNA_ID_3022386_gDNA_ID_2214508_Annot_ID_133789 3000 nt of promoter + ATG
caacaaaccacaaacgctaccattctaacaaatccatgataatctctaaaattctctaatcgcgagtggaaaacaccgatgaatctaagctaataggataaatcaaaatggtgcgatggtggtggtacctgaatcttatcggaaaggtaagaaggatctgggaatccagaatcgctgtcgctgctgcaccaggaaccagcaccaccgctaccacctcccgtttccagaaaatctgtaaccattaggcctaggtcatgttcaccgtcgtgactcgaatctatccctcgattcaaccattcctccgccggaacaactctcaagtccatacccatcgttcccaaatctcggtcaattgttcaaatttcaaacccagaacttatgaataaaattgaattgaattgaatttgagtctgtacaaaataaaaaacgcgtatcgtcccctttcacgagtcttgtgtgtgattgattttattatattatatagcgatgagagagacagagcttgaaggttctttttagcgaaagagaaaaatccaggaagataggcgaaaaggaagatgaagcgaagatgaggttaatataatactcatgttaaatgacaaaaatgcccttatatgattaatgatattaccatttgagcttgctgtggaagctgtaacgaaccgaaaattaaaaacagaataacgaacatagacggagaatatgatattattcgttttaccaaagaaactaacaaatagttttaactttatctaacaaaggggtaaaacgggtaatttgtttgggatgaggtggagcgtagcggacaatcgagaaattaaaagtttggcttggggacgaagttaaaggtgggctttaacgttttaaattggctgactcggacgatatttcttgtatttaataccaaaaatgaatgactttataattcatttgtagattgaaagttacgtattgattcgaaaatcaacacattgtgttttcaagtgggcataaactataacaccttgttgattgattaatagattacctaaagacattatggtttattactggtctttcaatatatttttatcgcattgtcaatgatattgtttttgtatcccaagtccactgttttggtctctacattcattttgattgggatttatctttttaaaatttcttctaatgttttttcgatatggttattacttgctttgattttcttttcagtatgtgtattgctttgcaaattgtttttttcttaagatgaaaaacaactcattaaattgtttgagaaatactactaaaacaaataaacaatgaggagaattatggaaaacaaagtgtaataggctttaattcattgctagtgggctttttgggcctatgggcatattacttaccactatccaacccaaaatgccaaataaccgacatgtctcacacaatccaattttgggccatacggccgaaattatttaaacctgtgctcataatttactttacaaattattacttttccataaattgtggaaaagttatctgtaacatccgattcaactggagtctagactactatagacattgatacgttttgagtttttagatacttggaagatatatgcatttatgaatacagattacagacacatactagtactactgtatgtctgtatatggatacaaaaaaaatcatgtatgaatactaaaattttattagaaatctatttttcaattgttgcaacaatcaagttgtcaaatttatttttgtaaccgttaaacaaacaaatatcgatttaggtttctaatctgaattgacatctcaaacaaaaaaggctgaatactttctgaaaatagtgtatggaatgaaggtggcttttagagccattataaccggaagaaaattcaggtgacttttagaaccattataaccggaagaaaaggtgaattttaatttttagctgtgtggaagacacggcaagtccaagtagtaccttcgtacgtcaatattgtccaaccggccgtgtcgaaaatcttcttgagaaaaattggattttcatctataaaaaaaaaaagtccaagtaataccaaacaaagacagcgacgtgtaaaacaatacaagactcataatcacaaacctaccacccaagtcaaacctatattccatttagtgaattcttgattatgacttcttgaaatcatttgtattcatatgtataattatttaagtcatttttctgtaagtaaaatttttatatatctagaataacgagttccctacgacaagatacagttgaacgtaaatgtgacatctcaattttcattggtgtctagtactctagtgattaggttttcgacatttattgtactgattaagtaaaaattcatggtacaaacatcgaatatatatttttctgcttacacacaccaattaacgtggatagaccaattgaaatattttgttacgacaaagcaaaacaaaacaaacgtcatgtttcgctgtttgtttgtcgtcccgttaatggtaatctttcagacacatacagtacccaaacaagtaatttgactaaaattttctctctgtctaaatttcagaagaaaaaaaaactttaggatatattgccaaaagatcttaaaaatgggtcatatcattttgatcatatagaatccaacgacctttatcttttcgccgaactatacttttttgtgtccatttgtttgactttctttcacacacacatccacaaagaaaaaaggaccattcttctccttcttctagtcacccctcgtgcctctctttaacaccaaacccaaaactcccttctctttcttccttcctctccgatctccgttcacatctctctctcatctttatcttcttctttttttgccttgtgggttgaaagtttctatattttctctttctcttctgtttacataatccattttcagctcaagcagctgaagaataacgatcaagaaccaaaaaagaagaaaacgaatctgttcttagctttg

SEQ ID NO: 11658 - DNA, 3000 bp, Unknown
  misc_feature (1)..( 3000): cDNA_ID_1808049_gDNA_ID_2214508_Annot_ID_133790 3000 nt of promoter + ATG
aattcatggtacaaacatcgaatatatatttttctgcttacacacaccaattaacgtggatagaccaattgaaatattttgttacgacaaagcaaaacaaaacaaacgtcatgtttcgctgtttgtttgtcgtcccgttaatggtaatctttcagacacatacagtacccaaacaagtaatttgactaaaattttctctctgtctaaatttcagaagaaaaaaaaactttaggatatattgccaaaagatcttaaaaatgggtcatatcattttgatcatatagaatccaacgacctttatcttttcgccgaactatacttttttgtgtccatttgtttgactttctttcacacacacatccacaaagaaaaaaggaccattcttctccttcttctagtcacccctcgtgcctctctttaacaccaaacccaaaactcccttctctttcttccttcctctccgatctccgttcacatctctctctcatctttatcttcttctttttttgccttgtgggttgaaagtttctatattttctctttctcttctgtttacataatccattttcagctcaagcagctgaagaataacgatcaagaaccaaaaaagaagaaaacgaatctgttcttagctttgatgggttcttgcttcagttctcgagtcaaagcagacatcttccacaatggtaccatctctctccaactatcaattttcttgcaatctggaattatgcatctctctgtttttaattcatggagatttccgattttgattattgtaaatggtcaacatgtgtgtctgtgtaggtaagagcagcgatctttatggtctaagtctctcaagtcggaaatcgtcttcgactgtagcggcggctcagaagacggaaggggagatattgagttcgacccctgtcaaaagcttcacctttaacgaactcaaactcgccacaagaaacttcagaccagatagtgtgatcggagaaggtggctttggttgtgtctttaaaggctggttagatgagtccactctcactccgactaaacctggaaccggtttggtcatcgccgttaaaaagcttaaccaagaaggttttcaaggtcaccgtgaatggctggtactgtgttttcatttccccaaacttaagagtcatgtgttatatatgtgtgaatgcgtgtctgatctgttgtgttgtgttgtgctattcagacagagatcaattacttggggcaactgagtcacccaaatctagttaaactgatcggttattgcttagaagatgaacaccgtcttctagtctacgagtttatgcaaaaaggaagtcttgagaatcatctattcagaagtgagtcccatggatcatctttatctttgattaaatctgttttcttttgtttttggttctgatggaaaatggttttaatataggaggtgcatattttaagccactcccatggtttctacgggtcaatgttgcgcttgatgcagcaaaggggcttgcttttcttcacagcgatcccgtcaaagtgatataccgagacattaaagcctcgaacatcttacttgatgcggtatgtagagaaatatacacattcaaagaattagatgtcttcatagtactttcctgatgactttgattcccttaaacaggactacaacgcaaaactttctgactttggactagctagagacggtccaatgggtgatttgagttatgttagtacaagggtcatgggtacttatgggtacgccgcgcctgagtacatgtcatcaggtaaaaatctatcaccttaaatatgaattatgactaggttgatcaaatgttttagagcataaggataattgtttttaaatcctcgtatcatttcaggtcacttgaatgcaagaagcgatgtgtacagtttcggagttttgcttctagagattttatctggtaagcgagcgttggatcataacagaccggctaaagaagaaaaccttgtggattgggctcgaccgtacctcacaagcaaacgtaaggttctcctaatcgtggacaatcggctagacacacagtacctacctgaagaagccgtgagaatggcaagcgtggcggtgcagtgtctctcatttgaacccaagtcgcgcccgaccatggaccaagtggtccgtgccttacaacaacttcaggacaacttgggaaaaccgagtcagaccaatccggttaaggataccaagaaacttggttttaaaactggtactactaagtcatccgaaaaacggtttacacaaaaaccttttggcaggcaccttgtgtaggtcaagttgataactgaattccaggatggacatttttccggcggtttacttgaaactgccgatatccgttttcgacggattgaatgcggttctggacaaaccgtgcaggtcaagactaataaaggatacattaaattttccggttacatgtcccatacccaaccttagagaacatgtgtagcctttagcttaggcttccttgtgtgctgttatattgagtatatatgaggtaatttttgcctcttgtgttgtaacacttgtatttttgttcctttaacatttgatgtagagatttttcctatatcttcagttttgaaacccaaatttattgcaagtcaaaatatgaaaattctaatcaatgtgcaatgaataacacaaatccgaattgtgctttgttggctgcagacctgcagttaacacaaatcttataaatttgaaatgtcgttcaaactccaaaccacaaaaaggggaagcaaaacgcaaccgtttcacgatttttgtctagtttggtccaatttctcaattacggttttgtgaaatgcgtgtcggtctttggttctgcattcgaactgtgtggcgttttgtgtaacttatccacttagtgagcaaaactactcgactcgtagtagttgcagagaggttttagccgcagaagaaaagggtttactctgtcttcttcagacttctcagtgatcgaagctatg

SEQ ID NO: 11659 - DNA, 3000 bp, Unknown
  misc_feature (1)..( 3000): cDNA_ID_3022386_gDNA_ID_2214508_Annot_ID_184174 3000 nt of promoter + ATG
ctagcgatctcaaaatgacttctgaaatcaatatcaacaatcaaacgatcatcttgaccaacttcagtatcactcaatatgatatctatatactcattatctcctgcaaacaaacaaaacatatcattctctcagaattctatgtccagaaacacttgtataagacggttcttagaagcgaaaacataccaccaggaactttgccaccaccttgccatctagctgaacatacagctgcatcatatccagaaagtctcaaaagcttagcgagataaaacctgatgcaactagcgttacatgtaccggatttcacagagtgtagatctttctccttaatagtaagcatcaatgtacgaaccaccgagagaacctcggtttcgtgttgagccatagagtacttgagatactgcagatacaaacacatactcttaattcaacaaaatgttcttcaccattcctagaaacctatgtactaaaacatgccttccttcaaattacaacaaaccacaaacgctaccattctaacaaatccatgataatctctaaaattctctaatcgcgagtggaaaacaccgatgaatctaagctaataggataaatcaaaatggtgcgatggtggtggtacctgaatcttatcggaaaggtaagaaggatctgggaatccagaatcgctgtcgctgctgcaccaggaaccagcaccaccgctaccacctcccgtttccagaaaatctgtaaccattaggcctaggtcatgttcaccgtcgtgactcgaatctatccctcgattcaaccattcctccgccggaacaactctcaagtccatacccatcgttcccaaatctcggtcaattgttcaaatttcaaacccagaacttatgaataaaattgaattgaattgaatttgagtctgtacaaaataaaaaacgcgtatcgtcccctttcacgagtcttgtgtgtgattgattttattatattatatagcgatgagagagacagagcttgaaggttctttttagcgaaagagaaaaatccaggaagataggcgaaaaggaagatgaagcgaagatgaggttaatataatactcatgttaaatgacaaaaatgcccttatatgattaatgatattaccatttgagcttgctgtggaagctgtaacgaaccgaaaattaaaaacagaataacgaacatagacggagaatatgatattattcgttttaccaaagaaactaacaaatagttttaactttatctaacaaaggggtaaaacgggtaatttgtttgggatgaggtggagcgtagcggacaatcgagaaattaaaagtttggcttggggacgaagttaaaggtgggctttaacgttttaaattggctgactcggacgatatttcttgtatttaataccaaaaatgaatgactttataattcatttgtagattgaaagttacgtattgattcgaaaatcaacacattgtgttttcaagtgggcataaactataacaccttgttgattgattaatagattacctaaagacattatggtttattactggtctttcaatatatttttatcgcattgtcaatgatattgtttttgtatcccaagtccactgttttggtctctacattcattttgattgggatttatctttttaaaatttcttctaatgttttttcgatatggttattacttgctttgattttcttttcagtatgtgtattgctttgcaaattgtttttttcttaagatgaaaaacaactcattaaattgtttgagaaatactactaaaacaaataaacaatgaggagaattatggaaaacaaagtgtaataggctttaattcattgctagtgggctttttgggcctatgggcatattacttaccactatccaacccaaaatgccaaataaccgacatgtctcacacaatccaattttgggccatacggccgaaattatttaaacctgtgctcataatttactttacaaattattacttttccataaattgtggaaaagttatctgtaacatccgattcaactggagtctagactactatagacattgatacgttttgagtttttagatacttggaagatatatgcatttatgaatacagattacagacacatactagtactactgtatgtctgtatatggatacaaaaaaaatcatgtatgaatactaaaattttattagaaatctatttttcaattgttgcaacaatcaagttgtcaaatttatttttgtaaccgttaaacaaacaaatatcgatttaggtttctaatctgaattgacatctcaaacaaaaaaggctgaatactttctgaaaatagtgtatggaatgaaggtggcttttagagccattataaccggaagaaaattcaggtgacttttagaaccattataaccggaagaaaaggtgaattttaatttttagctgtgtggaagacacggcaagtccaagtagtaccttcgtacgtcaatattgtccaaccggccgtgtcgaaaatcttcttgagaaaaattggattttcatctataaaaaaaaaaagtccaagtaataccaaacaaagacagcgacgtgtaaaacaatacaagactcataatcacaaacctaccacccaagtcaaacctatattccatttagtgaattcttgattatgacttcttgaaatcatttgtattcatatgtataattatttaagtcatttttctgtaagtaaaatttttatatatctagaataacgagttccctacgacaagatacagttgaacgtaaatgtgacatctcaattttcattggtgtctagtactctagtgattaggttttcgacatttattgtactgattaagtaaaaattcatggtacaaacatcgaatatatatttttctgcttacacacaccaattaacgtggatagaccaattgaaatattttgttacgacaaagcaaaacaaaacaaacgtcatgtttcgctgtttgtttgtcgtcccgtta

SEQ ID NO: 11660 - DNA, 3000 bp, Unknown
  misc_feature (1)..( 3000): cDNA_ID_1808049_gDNA_ID_2214508_Annot_ID_184175 3000 nt of promoter + ATG
atatatatttttctgcttacacacaccaattaacgtggatagaccaattgaaatattttgttacgacaaagcaaaacaaaacaaacgtcatgtttcgctgtttgtttgtcgtcccgttaatggtaatctttcagacacatacagtacccaaacaagtaatttgactaaaattttctctctgtctaaatttcagaagaaaaaaaaactttaggatatattgccaaaagatcttaaaaatgggtcatatcattttgatcatatagaatccaacgacctttatcttttcgccgaactatacttttttgtgtccatttgtttgactttctttcacacacacatccacaaagaaaaaaggaccattcttctccttcttctagtcacccctcgtgcctctctttaacaccaaacccaaaactcccttctctttcttccttcctctccgatctccgttcacatctctctctcatctttatcttcttctttttttgccttgtgggttgaaagtttctatattttctctttctcttctgtttacataatccattttcagctcaagcagctgaagaataacgatcaagaaccaaaaaagaagaaaacgaatctgttcttagctttgatgggttcttgcttcagttctcgagtcaaagcagacatcttccacaatggtaccatctctctccaactatcaattttcttgcaatctggaattatgcatctctctgtttttaattcatggagatttccgattttgattattgtaaatggtcaacatgtgtgtctgtgtaggtaagagcagcgatctttatggtctaagtctctcaagtcggaaatcgtcttcgactgtagcggcggctcagaagacggaaggggagatattgagttcgacccctgtcaaaagcttcacctttaacgaactcaaactcgccacaagaaacttcagaccagatagtgtgatcggagaaggtggctttggttgtgtctttaaaggctggttagatgagtccactctcactccgactaaacctggaaccggtttggtcatcgccgttaaaaagcttaaccaagaaggttttcaaggtcaccgtgaatggctggtactgtgttttcatttccccaaacttaagagtcatgtgttatatatgtgtgaatgcgtgtctgatctgttgtgttgtgttgtgctattcagacagagatcaattacttggggcaactgagtcacccaaatctagttaaactgatcggttattgcttagaagatgaacaccgtcttctagtctacgagtttatgcaaaaaggaagtcttgagaatcatctattcagaagtgagtcccatggatcatctttatctttgattaaatctgttttcttttgtttttggttctgatggaaaatggttttaatataggaggtgcatattttaagccactcccatggtttctacgggtcaatgttgcgcttgatgcagcaaaggggcttgcttttcttcacagcgatcccgtcaaagtgatataccgagacattaaagcctcgaacatcttacttgatgcggtatgtagagaaatatacacattcaaagaattagatgtcttcatagtactttcctgatgactttgattcccttaaacaggactacaacgcaaaactttctgactttggactagctagagacggtccaatgggtgatttgagttatgttagtacaagggtcatgggtacttatgggtacgccgcgcctgagtacatgtcatcaggtaaaaatctatcaccttaaatatgaattatgactaggttgatcaaatgttttagagcataaggataattgtttttaaatcctcgtatcatttcaggtcacttgaatgcaagaagcgatgtgtacagtttcggagttttgcttctagagattttatctggtaagcgagcgttggatcataacagaccggctaaagaagaaaaccttgtggattgggctcgaccgtacctcacaagcaaacgtaaggttctcctaatcgtggacaatcggctagacacacagtacctacctgaagaagccgtgagaatggcaagcgtggcggtgcagtgtctctcatttgaacccaagtcgcgcccgaccatggaccaagtggtccgtgccttacaacaacttcaggacaacttgggaaaaccgagtcagaccaatccggttaaggataccaagaaacttggttttaaaactggtactactaagtcatccgaaaaacggtttacacaaaaaccttttggcaggcaccttgtgtaggtcaagttgataactgaattccaggatggacatttttccggcggtttacttgaaactgccgatatccgttttcgacggattgaatgcggttctggacaaaccgtgcaggtcaagactaataaaggatacattaaattttccggttacatgtcccatacccaaccttagagaacatgtgtagcctttagcttaggcttccttgtgtgctgttatattgagtatatatgaggtaatttttgcctcttgtgttgtaacacttgtatttttgttcctttaacatttgatgtagagatttttcctatatcttcagttttgaaacccaaatttattgcaagtcaaaatatgaaaattctaatcaatgtgcaatgaataacacaaatccgaattgtgctttgttggctgcagacctgcagttaacacaaatcttataaatttgaaatgtcgttcaaactccaaaccacaaaaaggggaagcaaaacgcaaccgtttcacgatttttgtctagtttggtccaatttctcaattacggttttgtgaaatgcgtgtcggtctttggttctgcattcgaactgtgtggcgttttgtgtaacttatccacttagtgagcaaaactactcgactcgtagtagttgcagagaggttttagccgcagaagaaaagggtttactctgtcttcttcagacttctcagtgatcgaagctatgatgacgacaacaaccaatact

SEQ ID NO: 11661 - DNA, 3000 bp, Unknown
  misc_feature (1)..( 3000): cDNA_ID_2991401_gDNA_ID_2214508_Annot_ID_184179 3000 nt of promoter + ATG
ctacgactacactcattcgaaatatatattagtccggtttgtgtccgaattgcatatatatatattttttttatttattttattattattaaatgatgctgaatattataaatgttatatgctgacacgaaataaatgtaaagacgtgaatttgttgggagaggagtggtagatacttaattcacatgcaagagcatttgtgttctcatgataaaggcttcttaggctactatacgtgcatgtgtattttggatgtacataagaaaataaattgcatacaataattccgaaaattgtaatttcactaactcgttgccaggattaattcgacaaatgtgacatatcacatatcaagtatgtatgattaggtatatatagtacactgggtgtatggccaaaaataaaacttgtaatgcacaacacatgtatatggacagaaataacaaacatatatactcactcaaacatacacctatcattttttaatattttcatccacctataatttgctattcacatttcttaacttgtaaccatataccgatatacgggatatgtccccctatcatctcgaggaagagaaggaacaaaaatcgtcggtaaccaaacaaatccatctagaatttcaatctaaaaaaaccagacagaaaaacagatgttagaagctggcacagattggactgacgtggcagatatatgaagatctggttggtgcatagatatgccttgtcatcgccatactcgacacaacctcttctcacgttcaccgcctctttaactgttttttcttcttttttccaattatcacttctcttattcttatttttattttcattttctaaatttcaccattcaatatttttttattagggaaactaacgacatttatgatgcttaaattttaaaaaagttttaaaactataataggtttttgatgtctttgatggtggtggcgcgccgatgcataaagattaaagtgagttagtgtgcatgttctttttttttcagcaagaagaaaaaaaaagaaagaaatatgatcaattaatttacacaaaaaatcagtaatagtttagatatgtaacttaattataattgagctggaatgtgaaaataaatagaaacgctaaagtcgtccattacttctaaagttttcaaactaactagttatgtttataattcaacacacaaaaaactagttatgagaattgtagtttatatctggattccaatattctattggatgtttaatttcttggatccatcttcataatactttttttatcatattgctaaagtaaagaaatgttgaatagtgggagtggagggagatatgaagctttgacttttctcacgtgagtgagaactgggaagtggagaaagctttgtctttaaacgtatatctttgacagtttcgtgacataaaacattgaccgaataggtccatgagatatcgggtcgggtcgggcgtatcactttacgtacggctaatgcacggcgcaatacgtggtccgatgaatgcggcaatatgggtccttaattttttttgctttttttttttctgaaacttgttgaatttgtttctaattaaaaattcactttcttctatgtaagtgggagtctttctctacctcctaaagcgaaatctcttaaaatttagggggtaaatacattggcggcaatcggtaaaacatttttgaatggaaacatatatctataaagtgcatctacttatcatatatacttaatgattaataattgaggttagtattgagtttttagcaaaattaaagatgtgaaagaagtcgcaaatgacaatggcaatgacatgcatgaaaatagtaaaagtgtttaggaccaaaaaagggtaaagaagtaatgatggcgatactgttgagcttagcaaattccgttcgtgattgatgctagctacaacttgttttttaagcaaaccaaatttattctccctttcacttaacccgattagaaatagactcacaccttttttttttagattaaccaataaaactcatatatctggatgctctgtaattttcttatatctcaatatcgcagaccagatttcatatatttttggcggatttaaaaagtttaaatttggagtagatgactgaataacatttgagctaaccacatttgggtattgtttaaaatttgtatgcacagtttcttatatgacatgacttactcatgaacgcatatttctgatagaaatgtactagtttttttctttctcatcaatgtattgctttagaaaatatttacttttttcaaaagaagagagaatctgtacgtagattcatggaatttgcataagacaattcacctttgaactagactacgcgcgcaagttaaaaaaaaagtgaaaaacgagcagagtcaaaagacatattaaaggcttataaatgtttacattttatttggtcagcaaaacaaacatacatttgtataaaataaaatataaagtaagataacctctcttcataagtatgaaacgcctcaaataaggtcaactcgatattctttgtcgaactttttttagcatcaaaatttccaagtcttaccaattttaaaatccaggattcaacgagataatatatttgtaagtatcattatatcatctaagaaaattagattacattaaaaaaatgacaaaacggttacaaacctacctccaccttacgtagaaatagtaatcttattttaaaagttttaactttgacaaaaggaaattaaaatttagccaattatctctcgatctctctctctcactctaactttggagtttccttccctccataaataccgaacctcactccttcttcctccaccatcctcatctctcaatcaacaaacctaactctttctctatacaagagcgcaagctcgaaggcgctcttgttctttcttcattttctccttaacaatcaccctcatagtaactttaaaactctctgtttctagtaattcacacacaaaatg

SEQ ID NO: 11662 - DNA, 3000 bp, Unknown; identical to SEQ ID NO: 11661
  misc_feature (1)..( 3000): cDNA_ID_2991401_gDNA_ID_2214508_Annot_ID_133793 3000 nt of promoter + ATG

SEQ ID NO: 11663 - DNA, 3000 bp, Unknown
  misc_feature (1)..( 3000): cDNA_ID_2707121_gDNA_ID_2214509_Annot_ID_133797 3000 nt of promoter + ATG
cttacctgttacatggacacatctgttgatcaaaccttttaaactcaaacacacttcaacattaatttgagagactgagaaatttagtactttatttgcttggatcgttagaatatttgcaccgagttctctgattggcatcattgcagcttcttcacacaatgcttggagatcgcttcctgagtatcctgtaacatagggatagcttacgcttatcagttacttgacttatgaatctgtgtttttttatacaaagtctatagagcttgccttcggtttctttgacgattttatcaatgtcgccatcggataacgagtgaggctggcactttaatttagttttaaaaagtagttttctgacgttggaatccggcaatggtacatatattctcttcacctaacaaagtgataaaatcaaatcatataaccagatactttcctagcaattggtggacaagaaaaattctgatgacaataatgttcttaccaatctcctaagcactgcatcatccaactcctgtggcttgttagtagctcctgcaaaacattacatcaaagtaaatttttaggaaaggaaaacagactatatgtaaactgatactccgagatgttaaacagaatgaagattgagtttgatgtggactgatttagcagaaatcataccaatgataatcaccaaatcatcaggattagaagtcacaccatcaaactggataagaaattctgatttcagccttctgcttgcttcattctcactggttgaccttgttgacattatactatctatctgataaccagagcaaaaacatattcagatctccaagtgacaatatgttgatatgaaaaagatcctttttcagggatctttaggtcttcagtcaaatacaacttatatggtattatctagaactctggtaagagtagttcttcccatataagacagaaaaaggaaaaagtgtgcatacttcatccataaatataacagacggttgtctggatattgcaacttgaaacagcgttttaactagcttttcagcctcacccacctgaatcaatacagtaaagtcagtttgtctattcgaattgacaaataaattcaacaagccttgttagttattacaaaagacagtacagtgacagaataagcacacacccattttgatgtcaaagaagatgctgagacattgaaaaatgttgcctgtgactcagaagcgactgccttggcaagcattgttttcccattgccaggtggcccaaagagaagcagacctaacaaagaagttactttaccaaggacggcaatggagaagataaagaagaaaccaagcttgaaatgttacctctcgctggtcttcggagaccagtgaacaaatctcttcgttttgccggtaaaattaccatctccaacaaagcttgtttagctccattaagtccagctgcaataattaagcataagcttgtttccacatactgcgccgaaaaggaaaaacaagaagaagagcataacattgacactcaccgacatcatcccatttcacagatgggcttctatccactattgttgtatttatcatctcaaccaacttatcatcatagacatttccagattctttcacaggttttgggcttgcagcagcatctttagggttccttggcgttgcaacgccacctctggcaaccggagtcttttgcgataaagttttcctataccttgacgctgtagaggaaactgaagctgaagaaggatatgccaccgtcctctacataacaaagaatcaaaaaaagaattgaagtatacaattaatgccttaaaaatgaattatgttaagcaatcaataccaatacagaaacatatcactaataatctacaaacatcacattctccttccaacatttatgaacaaaaaagaagcaatacattaccttattctcagacattccaacacctaaaatatgaacaccattgatgacagaaacaagtaaaacaaacaaccattagtgtgaattcacttgtgcttcttcatattaatatgcaaaaaaggtcaaaaatttaaaactttatcacctgtacgcttacccaaagcttgcaatctctcagatacttgattttgccaatttgaaatcttctctcggtacgatctcaccttctccttttcactaccatatcattcaacaaatcatcatcactacaactttatttttcaacataacatatataagtcaaaacaaacttatcaaaacctggaactaatatacgaaggagaaggagtagaagtagcttcattcatgatcctttgagcatttctataatgaagaagagcatcatcatgtaaaccccactcttctgctctaacccctttagcgatttcctctttcgctaaatcgaagtatcctttaagcttatacgcaattcgttcgttagtaaccggaactccatcgataccattcatggactcagaagaagttgatgatgatgaaacactaggatctttcttagattcttcgttgagaatagagctaaacgaatcaattatacctctgaggaaactcatatctaagcaataaacaataaaatcgatcatcacttccgagtttaatcaaacaaaaaacaaaaaaacatcaagaaggcaaaattggtttcacgcaccatgttgtgctcgtatatataactcatgtcgagaagattcgaatcaaaatcgaaatcaaatccagcgaattgaagaaatttgatgaaatcttatgaactgggaaatacgcaaacgatgaacaaaccaaacaacacacggtcaagtctttaaccctctacgtagaaagaaggttctaatgggctttacaaggcctatacatatataatcttaggcccaatgatattttatcggtggcccagttttgttttgttttcgatcatcttcttcgccgttaaatattttattctctacggtaccttttgtctctttgtactttcagatactatcgttgacttcgaagtaagaaaagaaa

SEQ ID NO: 11664 - DNA, 3000 bp, Unknown
  misc_feature (1)..( 3000): cDNA_ID_2707117_gDNA_ID_2214509_Annot_ID_133800 3000 nt of promoter + ATG
tcgtatttagtttaacaattttcaaatgcttgtttaaactaaaattttgtatttgtacgtaaacataattaataattttattacggtttgtcggtttctaataaattcaactgtttttggatacaatcttagtcgaaattacggtttattgacgcttgtaacgagtaaaaactttagagtgttgtcttgaggtgttccaattgttaatcttcaaacataaacgcaaacgtaacaaagacaccaattagagtataatggatcgctgttatgatttgtctcaggatgttgagaaaactgtcagtgactctcatgttctcaccgcagcgtaccgaagccactaaagctctgcggatgaagaaagtgcaagagcttgtaagcttcatgaatgaaagcagcgagagaaaagaagcagttgatatttctcgtgcatcctacaccacagttcttaatatcatatccaacattctgttttcggttgatctcggtagctatgactcgaaaaaatccaacgaatttcaggacacggtgattggtgccatggaagctgctgggaaaccagacgctgctaactactttccatttatggggtttcttgacctacaaggtaataggaaggcaatgaggggtctgacggagaggttgtttagggttttccgtgggttcatggatgctaaaatagcagaaaaatcattagggaattactctaaagatgtttccaacagagatttcttggattcgcttctcatcctcaacgaaggagatgaagcagagctcgacaataacgatattgaacacctactcttggtaagttctaccagcttgcagataatcaagattgtagtcaattttctgttcattcgttttgagatgaaatttcattactcgcaatcttccaacaaatcttgagacggaaatgtcaaaaatatgacttgatcatataaagacatcttgaatacggtttcgcaatgttatgttctttttatcaatgtcttgagatgaaaccacatgaatctttatatacggttccacaatgtcaagctcacttatttatatatgattgtatttcaggatatgtttacagctggcacagatacaagctctagtactctagagtgggcaatggcagagttacttagaaaccctaaaacgatggtaaaagctcaggcagagatggatcgtgtgttaggtcaaaacagtgttgtgcaagagtcagatatctcaggattgccatatttacaagcggttgtgaaggaaacttttaggttacatccggctgctccgctactagtcccacgaaaagcggaatcagatgtggaggttcttgggttcatggtgcctaaagatactcaggttctagtgaatgtgtgggccataggacgagacccaagcgtatgggagaatccgagccagttcgagccagagaggtttatggggaaagatattgatgtgaaaggtagagattatgagcttacaccgtttggaggaggacggagaatatgtccgggattgcctttggctgtgaaaacagtgtctcttatgcttgcttctcttctttattcctttgactggaagcttcctaacggtgtcgtttcagaggacttggatatggacgagacctttggtatcacattacacaggaccaacacgttatatgccattcccgtaaagaaacagaccattaattagccattgtaatactttcctctgtttgtttaaattgctcaaacccttgtgataaaaataaaacaaaatcatctaaaacgctgtgttctctcggttaaaagttttcttcttatgaaatgggtaaggcctgaagaagtcaaggtatccagtatccagatttgtattgggcctatgtatatcttttaggtaaatttaaagcccataagttattacaaattttcaattaaaaaattactatgactagttatcaatctaaattgatggttgtgctaaagaaaaaatagaaagatgatttgttgtttggtttagactttagtgtaaaaaaatattattattaatttttaggttaagaaaatattaatttctttttctttttttcttaaacacttgtgtatggtagacctttgttttttttgcatccttgtctaatgtctaagataaagatttatactgtaaatgaaattgttggaaaaaaaaagatttataaatgaatcactttactgttgggaaaaaattgaagtaaataaatgaatcactttactgagagtagtaaaaagaaataaatttgtgttgacatgaatagcaaaatacttaaaaaggaattaaatgaaaactttagtgttaattgacttttatgtgttgctaaaatcccaaatcagtaaaaaaccacaatctctcttctcttctttctctctctcccgcgcgcccaagtcgcctcctttcgctagtctctctccgatcgtcgtctcacctctctttactttcgtcgtcctctggaatcttacgcattctccgtcttccaagctctcgttgcgccgtcggcggatagagattccgtccagatttgtttgagcttccgattcgcttccattcattggttcatcatctccgaacatttctccggtccgatccgtgcgtactctctcccggcattgatttctataagcattttatcctttcatagttctagatgatacactcggaatgtaattttcttatgattttcaaaatcgatcctctctgagatctgacagagaatcttctaattgattgttttctgaagatttttgagctccttttgcagatttttgatgctgtatatgttaaatttagtagatccaagtgagtatatatatggatcattggttcagatgcatttttgcaggtttatttggttcaatcacagtgtcgactttagttctcatcttcatcagtgtcagatgcatttttctcagaagctcaacttttgctctgtgtaacaggtggagggtgagaaaacgctgtgaatgtctgtactctccataagtttatagaatg

SEQ ID NO: 11665 - DNA, 3000 bp, Unknown
  misc_feature (1)..( 3000): cDNA_ID_2711142_gDNA_ID_2214509_Annot_ID_184203 3000 nt of promoter + ATG
tttcaattcttcttgttacaggttaatatggtgcgttattacataaatcctttttaattaattattagtcgtcctaagtatgtgaaagtggcaccaacaaatgagatatttgttgttgaagaaattaaatataaatatcgtcatatatttgatggaacaaaatgataactctgtcttcatcgttatagctagattcctaaaaatggaaatctacttgtaacagtcggaccattgaaaattccttttattttctctttttaattattaggactcttttcttttcttttttgctttttttacatagagcgcgatgtttcaaattcaaactaactcattttgtttccaaatgttatggctcatgttcttctataactagttattgtacccttttcaagctatcctagcgtgttcttttatttgatgctgcgccagcggcaatagcggactgaaacgacgtgtcatgagaagtagtaggtaagtaaaacgacattaaagcttgaaaataacaatttcggatgagtcgccgatgatagccgatgaattgcaattgcatcaaatgaatcgctgaaattaagcagcgtcacgtcaatcttcatcatcgtacatcttttgcggcagttcttctctaatcaatgtattttttctcgccgcagatctgtttttcttctttgttgtcgctgacgctgcgttcattaaaagaacacgctaaattaaatagaaaatttggttttctaatgcggtgaaggattgatatattatactcgcaaccatgtatcttgattgaaccgtgattcaatatgtttggttaaaatgtctacttgatctaaaatcggacgaagtaaactacgtgcgaaattaatgctgattggttttacaaatttgtgaacttttatttggtcaatgaaaaggggcagaaaattcatcattgttttgaagctctcgcagagctggttaaatatagtaagatgttgggttaggtaaaattgtctttaaaaatgtttacctctgaaaatgattgaaaaatgagatattttcctatatatatatatatatatgtatgtattatttacttacagtttgatacatatatatgtattcattcatatatatatatgcaatcatttacttacagtttaattgctaatatctgaatgattatttttaatcaattttttgatgtttttgtcccttgttgtatctgcatcatttgatatgttgacgattctttcaacgttattcatcaaaacggtaactaattaattttaggttttaaacttggaagttaaataggggacatttcactttttctacaaattttttcgacagttcaatggaaaacgtcaagttaattttcggctaatgagatattgaagctcaatggagttaattaacagatcataaatgaaacacgtgtaagggaatctgctactcttttgtattgtaggccttaactttttttatcgatcagtcggcgtgtcagtgtcttgtggtcttaaggaaaaatatccgaacctcatcatctccacgagttaaatagtatatatccttcttcttcgtacgaggttaagacaactaaaatcttaaaaaataaattaaatacttaaaatcaatgaatcgtttcatatatatacatatatatatatataatatttatgtgcttcgattaattagtacatgtaactattttacgaacgtttagttatcgcccatttgcacataagtttacaaacaaacatagaatcatcacattatatattgtgcaaaattcaaatacaagatgataaatctttacatcttcaactacaaacacgatatatgatatcaagttatcaaccaatcaagagctgtaatctagtagttttttattttttgttaaaaagttgtaatctagtagtttcattttcatctatctttttacattatagaaaaatgaaagtatagaaaaatgaaagcttatcaaaagttagtgggctacatctacattatattaaaaaaatatatatatatatatatatatatatatatatatatatatatatcaataactagatcggacagtgaccaaaccaatctcgttgtgtccaatccaagaaaataacaaaggaaagtcgtacgtttgatgatataaaaacctttttatgtttggacgagtttcatagaacatggtggacaaaattatagtactatatactatttagtatctccttttgaaaaacagtaagccatgtaaatgaatttgtacaattaacagctatttaaaaagcaaaaaaaaaaacagtgaatgtttatttacaaagttccgaagggaagaggttgtggtagtggttaggggcatgccaaatacggaaagggaggcaaagaagatcgggtagtcttcataatttcatacttttcactttgtagtaatctttccttttcttttttaatttcatcaccaatgtttctttgttcaaattcatatccacacactcttttggaaatggcactgcagcttcatgtgaggtgtggggtcattgcgccttatcgtctgaaaatgttaccctcttgacattcaatgaccccattttcttattttccataatttcttttaccattttactataacaagaatgatgcaaaaggaataggcaaaaaacagcatattattttttagtgggatcctagtaggtcacttgaagtctctatgcattgattatggattgctatatttgtctctctttttatttttgaatttcgagttagtgatcttcaatgtgtgtttcaaatatagatattcaaaggttataaaccaagaaaagaaaaagtagaaaaaaaatatatatatttcaaatcttttaaacggaccattggcaacaaaatctataaacgagttaggcccaaattgttgtacaaaaggcccattaggttaaataagtatgggcctaaagcggtccgatcaatctctgtgccattaccttcttcttcgtcgtagtgatttctctcgagagaaaaagagagatg

SEQ ID NO: 11666 - DNA, 3000 bp, Unknown
  misc_feature (1)..( 3000): cDNA_ID_2707091_gDNA_ID_2214509_Annot_ID_184202 3000 nt of promoter + ATG
ccgtcgtcacaaggtcctcagcatcatcagtcattcgctctcgatccagccatcgcagccattggtcctaccgtcaataatccttttcctccgtcgaattggcaatctaacggtcatcgacccagtaatcataaccctccttcttggccactcgccttttcacctcctcataatctttcccccaatttcttagggtttcctcaatttccgcctagccctttcacgacgaaccaattcgacggtaatcaaagagtatctccagaagatgcttatagattagggtttcctggaactacaaatcctgctattcagtccatggtacagcaacagcagcagcagcagctaccgccgccgcaatcagagactcggaagcttgtttttggttctttctcgggagatgctactcaaagccttaatgggttacataacgggaacttgaagtatgattctaatcaacacgaacagctcatgaggcatccccaatctactctctcgaattctaacatggatccaaacttgtctcatcatcggaatcatgatctccatgaacagaggggaggtcacagcggaagaggaaactggggtcatattgggaataacggcaggggtttaaagtctactcctcctcctcctcctcctggattttcgagtaaccaaagaggatgggatatgagtttaggaagtaaggatgacgatagagggatgggtaggaatcatgatcaagcaatgggcgagcattctaaagtttggaatcaaagtgttgatttttctgctgaggctaatagattaaggggattgtctatccagaacgagagcaagttcaatcttagtcaacaaatagatcatcctggaccacctaagggtgcaagtctacattctgtatcagcagctgatgctgcggattccttttcgatgttgaacaaggaagctcgtcgtggaggtgaacgtagagaggaattggggcagctcagtaaggcaaagagggaaggcaatgcaaactctgacgagattgaggattttggagaagatattgttaagtctttattgcttgaagatgaaactggtgagaaggatgccaatgatgggaagaaggatagcaagacttctcgcgagaaggtacgtttcagtttttgtgtaagcttgtgatataggatatacctaatgacttgttgggaacattcagtgatggtgtttagctcgtgtaatcaattcttgaactagaaaggatgtttttttagattggaaagattgtttaaatcagggttttgttatcaggagtcgagagtggacaatcggggtcaacggctgcttggccaaaaggcaagaatggttaaaatgtatatggcatgtcgaaatgacatccacaggtatgatgctacattcattgcaatctacaagtccctgattcccgcagaagaggagctggagaagcagagacaactaatggcacatctagagaatctagttgccaaagaatggcctcatgcaaagttgtatctttacgggtcctgtgctaactcttttggtttcccgaagagcgacatcgacgtttgccttgcaatcgaaggtgatgatatcaacaaatctgagatgttgttaaagctggcagagatcttggaatcagataatctccaaaatgttcaggtaaagtaaatgagtttacttatagaaacacattgctttggtacttgatacgcttttcttgctttgaatctggtgcctatattttctgaaacattgttttttgtgtaggctctaacacgagctagggttccaattgtaaaacttatggatccggttactgggatatcttgtgatatctgcatcaacaatgtattggctgttgtgaacacaaagctcttgcgagattatgctcagatagatgttcgtttaaggcagttggctttcattgtgaaacattgggcaaagtcaagaagggttaatgaaacttatcaaggaacactttccagctacgcgtaagttctcctccacactttgaaatgaagttactttggattgcaaattacaatcattacttatatttgatacttttgcaggtacgttctgatgtgtatccatttcttgcagcagcgtaggccgccaattcttccttgcttacaggtgtgtataatcatatcctcctaaaatagtgtactgattactgaatgctcttcatttattgaagttattacttgatgcaggaaatggagccgacttactcagttcgggtagataatatccggtgcacatactttgataatgttgatagactccgtaacttcggatcaaacaacagggagaccatagctgagctggtctggggattcttcaactactgggcttacgctcatgactatgcgtataatgttgtatccgtccgcaccggttccatacttgggtaaactagaaactcaattatacttactgcaacatctgtgaagcaacaatctcagagatgaaacatgaatatgtgtgtgttgcaggaagcgagagaaggactggacgagaagggtggggaacgataggcacttgatatgcatagaggatccgtttgagacgagccatgatctgggtagggtggtcgacaagtttagtatcagagtgttgagggaggagttcgaaagagctgcaaggattatgcatcaagatcctaacccatgtgccaagcttttggaaccatatattcctgaagataataatggacaaggccacaactgaacttttaaaacatttgaatggcggattcgtgtggcttgtatatatttatgggtagaagattcatgctctgttctttttgcttttttggttgtgatttgaaatcttgcttgtgacccaacaaaaagaaaggtcttagttttgaagatttttgtatgatggtgatgtgggtggatttcttaaacgtgtcgtgttatttgcgtgacttgaaaaaagaagtgagataattttgaaaacaattttttaataataatgcaaaacagatcaatctcgcaagtcgcaacg

SEQ ID NO: 11667 - DNA, 3000 bp, Unknown
  misc_feature (1)..( 3000): cDNA_ID_3022412_gDNA_ID_2214509_Annot_ID_184201 3000 nt of promoter + ATG
aataccttcatccgaatcttcaagccacggaatattccgccggaatccaaacttccgatcctcgtttactttcacggcggtggatttatcctctacagcgccgcttcagctcctttccatgaatcttgcaccaaaatggctgatcgtcttcaaactataatcctctccgtcgaataccgtctagctcccgaacaccgtctcccggcggcgtacgaagacgccgtcgaagctatcttatggctccgtgatcaagctcgtgggccaatcaacggtggtgattgcgacacgtggttaaaagacggtgtcgatttctcgaaatgctacgtcatgggttcaagctctggaggaaatattgtctacaacgtggcgttgcgtgtagttgacacagatctttctcctgttaagatccaagggctgataatgaaccaagctttcttcggtggcgttgagccgtcggattctgagtcacggcttaaagacgataagatctgtccgttaccagctactcacttgttgtggtcactttgtttaccggacggtgtagatcgtgaccacgtgtacagtaatccaattaagagcagtgggcctcaggaaaaagataagatgggacgttttccgtcgactcttatcaacggttacggtggggatcctttagtggatcgtcagagacacgtggcggagatgttaaagggacgtggagttcacgtggagacgaggtttgataaagatgggtttcatgcttgtgagttgtttgatgggaacaaagctaaggccctgtacgaaaccgttgaggcctttatgaagagttgttcatcaactggcccatcgtccaactccaacatgtagtagtctgatctaatcatgttttacgaactatatatatatctagctaataattaaattcctacaactattacgcaatttttgttgttttaagtcacatatgatatgtgtggtgcaatggaaaaatgtataccctttcaataaatatagtggatgcaatttaatctatttactaatactaattttaacgatgtccaaagagaattggatgttctgtgagctacgttttattaacattttaaattatgaattccaccaacaaaaaaagatagattttaataggtgaacatactatcattatcatattatgattagctatttacagaattgttttgaataattcattaagaacattgttagattctttttgtatatatacaacaataaaatgctaataattccatctagtttagtttgtagaacatgattcctcatttagacaaaatataaaaacatttcttaatttggtcaataatcaatatagctaaactgcgtaaaatcatgaccacaaataatccgtatattcatcctaatcacaacttaagctccattaaacgtaaaacagttacacacaacaacaacaacaaaaaagtaagaaaagaaacgaaaaaaatcctaaacatttcttcttaggtcaaagttaacttcctcttaatcacgcaattaatcataaaaccatgtcacgtgactctcctcccgcatttgatccatacaaacacctcaacataacaatcaaccccaacggctcttgcacgcgccatttcgtttggccgagggttgaacccgacccggatccatgccccggcaagctcgccgcttccaaagacgtaaccattaaccacgaaaccggcgtgtccgtacgtattttccgaccaactaatctaccatccaatgataacgccgtggctcgtctcccaatcatcatccatctccacggctccggttggatcctttacccggccaattctgccgcaaatgaccgttgttgctctcaaatggccagtgagttaacagtgattgttgtctccgtacactatcgtttgcctccggagcatagactcccagctcaatacgacgacgcattagatgctctgctttgggtcaaacaacaagtcgttgactcaaccaacggcgagccgtggcttaaggactacgccgatttctcacggtgttacatatgcggttcgagtaacggcgctaacatcgctttccaattggcactgagatcgttagaccacgatttaacgccgttacaaatcgacggttgcgtgttttaccaaccgctttttggcggtaaaacgaggacaaaatcggagcttaagaatttcgccgacccggtaatgccggttcctgcggttgacgccatgtgggaactatctttgccggtaggtgttgatcgggatcataggtactgtaatccattgggttacttgccgcaaaaggagaaagttggacggcttggacggtgtttggtgatcggttacggcggagacacgtcgttggatcgacaacaagatttcgtgaatttgttggttgcagctggagttagggttgaagcaaggtttgacgacgccggtttccatagcatcgagctggtcgatccacgacgagccgtcgctcttcttaatatgattagagattttataagttgattattcttttcaagttttcatctaagcattctataaccgttaattttctcattttctattttgtatacatatgacattttacattgaacgttgttacatagcacaaatgttacttcttttgtgttttttgataaaatgttaacattgttacttcttattgtattcatttttacaattccacaattccgtaatttcacaaatttactaattgaaatccatttcattctcaatcatacttaagtaacctactgtagttgaattttaagtccaacttgtgatcagctttaaaaacaaaagtcataacatcggacggtcaggatatcatgtgtgaggctgtatcctttaaataataaaatagaggacacacacgagatccgttaaaggttaaaccttgaagaaagaaagatctctcggtggtggtcattcaacattgtaagatcttcgacttggcaaaattgtttcactttcgctctaaaaacttcatcttcactttctctcctcctcc

SEQ ID NO: 11668 - DNA, 3000 bp, Unknown
  misc_feature (1)..( 3000): cDNA_ID_3022416_gDNA_ID_2214509_Annot_ID_184197 3000 nt of promoter + ATG
tgcgatccaaaagcgcgtcttgtaaactacgattagccataagttcgtagacgaggataagcttccgaccacgacgatcggaggagaatccaaggagagagacgacatgaggagagccaattaagtgagaagagagagaaagctcgttgtgaaactcacgttcgccttgtaaagaaccagcggaggtatccatgactttgacggcgagtgaatcgccgccactcgggaaatcagctttgtaaacagagccgaatccgccgtgaccgaggtgagtcgactcggagaaagagtttgtagcgcggcggagctgagagtaagagaagcgtcgacattggtagtgttgaggagacttggagttggagataagatctgaaggagccgtacggtttcggtagagtcttcggtaaataagtaaagtgacgaggatgagtaaaactccggttaaagtcagagaaccggctatgataagtggaagagtctggaaacgatgatggccgtcactaaccgtaggcgtcggttgcagcggcggaatatctggcggagagaggcgagatggcattttagtaaatataggaagttacagaagtgtcatttaatccggagtttccattgaagaagaagatggtgagatgttaaaagattttcttcagctacttggaacactcgcgtagtaaaaataaagagatatacttgtgtgacaggcgagcgataatggtaatggtgacgtgtcggagaataaatgggggatggtgactgtgatttgtgacagtcatgtgagcggatattattgctcacgtcgtttagcggaagaccggtgagggatagatttgagtcaccgagtcgtgagattttaatgagggagcgtgatttgcacgcggcgcgttgaggtgagattcacgagggttttgttttgaaaccttcttctccttctgaagaggtccacggtgggacctacgaaatttaactggggaagtgatggtgaagtcaacctcactcgccttttaagaagcgcgtggatgcatgtgtggttcgagcttaaccaatttcttggctagaccatcggttaaacagcaattagtcgtctgattaatttggatttgttcgatcgactagccatgtgcataactggtcggcaatgttatattagatgttcaatcttgttataacattagtagtaattagtaaaatggtgtattgattgtctaggttctaattatatcgtttaagatggttgataatttagttaggcgcacaattttaatatcaaacttaatcattttttagcttcttaaaaagaagcaaaaagcgtacagctatttttgtaaaatcatatgtataatttgtaaaatacaatgtttgtgttaaacacaaaaagatttgtttttgttgtaataatcaaacgtgttagtaacgtcagcgaaaaggaggcatttttcaggtcgctttttcgggtgatgggattttgaccttttcaattttgcccttaatcgctttggtctgactcttattgtggtttttgtttggtttgttttggttttacttttacccaatttttagacgcacgagtaacgtatacttgcaaaacaaaagagtgagatcacgtcactaacgttcaaaatcatttcactcgctggcaccatctcttatttattttaatttattcgagggagaaaaaaaatggttcaaagctaatgacctaatgttatcattatcattagagaactatccaagtgagaaacattcgtgaatccacttgatgttagtgggtgatttgttagttttaatagaacaacaaggtttgtttactttttatttttggctaataaagaagtggttagttgcacttaggggtttgactttggtaacatcgttggaatcttgataagggaatctatggaaaaatatataaacaaagaagtaaagcgtcaaacacaaagccttttgcaggtttaaagcagattcagatgtacttttaatgtattttttccaaaaataaaatggagattggagaagaagaagaagaagaagaagcgacgactactactcaaattgctcatgtgacttccactacttaacctcctttagaaaactacaaaaaatagttatcattaaataatactgtttgctagccggaacgttatagccaacacttgtcgggacccgtgaccgtggtccctaactttccactaccgttacatgaataaaagttctttatgtttcatagtttttatacctaggagattttattagtgttccatgaccatccaagatgtagtaacagttgatagtaagaagataaaatttgagtgttgtcactcgttaattagcaaatatcaagagatgcacattaaaggagcaaaccaggtcgagcaacttaacctaacatcagaacaaatacagctaacagtagataaagagagtaacgtacacctaaacacatggttaagctgcctaatagtataattaatgaaattaatgtgaggtttaacagatgaacagtaatggctacatacaagtttggcaggcggttgtcttgatctcccatgtgtcattatagttttagaatcatatattttttcttgcatgttttgaatccaattaatgacactaatacaactcactattttacatattatgttctcattgtttatataattagtctgtaccaaaaagaaatcccatgtttgtaagaaatttaggcaagtatgtaaggttcaaactttccataagtgggcatgacaaaaacaaatttttagaaactcagatagtttgtaggtgttataagcagcaataaacatatacattatgcaaccgattgacagtttttgagaacttgtttctccattttagataatatctttaaacttgtgaataaattcattagaaaaaaaacttaaattcatggatataaaatgcatgattgagttatattttctaggcactctccaatttcattaaacaaggagagtagaacctaaagaaaaaagtggtcgtccaatg

SEQ ID NO: 11669 - DNA, 3000 bp, Unknown
  misc_feature (1)..( 3000): cDNA_ID_2707105_gDNA_ID_2214509_Annot_ID_184196 3000 nt of promoter + ATG
gtcgagcaacttaacctaacatcagaacaaatacagctaacagtagataaagagagtaacgtacacctaaacacatggttaagctgcctaatagtataattaatgaaattaatgtgaggtttaacagatgaacagtaatggctacatacaagtttggcaggcggttgtcttgatctcccatgtgtcattatagttttagaatcatatattttttcttgcatgttttgaatccaattaatgacactaatacaactcactattttacatattatgttctcattgtttatataattagtctgtaccaaaaagaaatcccatgtttgtaagaaatttaggcaagtatgtaaggttcaaactttccataagtgggcatgacaaaaacaaatttttagaaactcagatagtttgtaggtgttataagcagcaataaacatatacattatgcaaccgattgacagtttttgagaacttgtttctccattttagataatatctttaaacttgtgaataaattcattagaaaaaaaacttaaattcatggatataaaatgcatgattgagttatattttctaggcactctccaatttcattaaacaaggagagtagaacctaaagaaaaaagtggtcgtccaatggacctctcactaattcaaggcatgtctctgcctctctattttctcttaacattattctttttcttctttgctaccgcaaaaacgcggagaagctctagcaccggcacgcttccaccgggtcctccgatactgccattggtcggaaacatattccaactcggattcaatcctcaccgttcacttgctgccttttcgaaaacgtacggacctataatgagtttgaagcttggaaggttaaccgcagtggttatatcttcaccagaagcagctaaagaggcacttagaacacacgaccatgtcatgtccgctcgaacctttaacgacgctcttcgagcctttgatcaccataaacattctattgtctggattcccccctctgctcgttggaggtactaactctatctaagatcaacatttcatttctttttaactctctttgtgttgatatcatccgtgtactaaacttcaatttaaaactttaaatctatacacacgtgaagtgattagctacgtacaactccattaaagttctgtatgtatgcattgtcaggtttctgaagaaaacaataacaaaatatttgttatcaccgcaaaacttagatgctattcaatctttaagaatgagaaaggtggaggaactagtgagtttagtaaatgaatttcgcgagagaggagaagctattgacctggctcgtgcttccttcgtcacatctttcaatatcatctcaaatgctctgttttcagtagatttagcgacgtatgactctaactcctcgtcttacgaatttcacaacacagtggttcacctgacggatatcgccggtatacccaacgtaggagactatttccagtatatgaggtttcttgatttgcaaggtacccggaaaaaagcggtgctctgcatagagaaattgtttagggtttttcaagaattcattgatgctcgattagccaaaagattttctcggacagagaaagagcctaaagaggcttcaagcatcgatatgctagactcccttctggatctcacacagcaaaacgaagcagaattaacaatgaatgatctcaaacacttgcttctcgtaagtctttcacacacaccaatggtaagattaagatattgtttggatgcaaatatcatcagtttacctattttgtgacaggatgtgtttgttgcgggcacagacacaaactctagtacaatggaatgggcaatgacggagttattccgtagcacggagaagatggtcaaagcacagagtgagatacggcaagtgattggtcaaaacggtttcgttcaagaatctgatatcccgagtctgccttacttacaagcaattgtgaaagagactcttcgtttgcatcctgcagctcctttgatccctagaaaatcagaatccgatgttcagattatgggtttccttgttcctaaaaacacccaggtttttctcatacttatctttattacaccaacattcattacttgagatattacaccaataaaaaagtttggtttggttaaaatcttccacctctgtttctcgagattaggttgttgtgaacgtatgggcgataggacgagacgcgagcgtgtgggaaaatccaatgaagttcgagccagagaggttcttgttacgagaaaccgatgtaaaaggcagagatttcgagttgataccgtttggatcaggaagaaggatgtgtccgggaatctcgatggctcttaagacaatgcatatggtgcttgcctctcttctctattcctttgactggaagcttcaaaacggtgtcgtccccggaaacattgacatgagcgagactttcggtcttaccttacacaaggccaaatctctttgtgccgtacccgtcaagaaacctacaatatcgtcttcttattaataatcgtatcaatataaagttcgtgtacggatcaatattaataattgaagagaatgaaattataaaagatactgctttttatgtttcaagtaaaaatgttaatattagaaagtcaagaaagaggaaacacaatgcaatttgataaggtgttttatcgtctccgggattgaattgcgtaggtcaaaaaaagacatttgccatttgatatcgacatataatcactcattcacggatacgtatctcttgtgaatggtcgtcggtcaattacaactttactgctcggctttaactgacaagtggcgcctcctggtttcattcagaccctaccggtaggatgtaatttggaccataagtaagaaatatttgtgaaatatttactacacgaatatctttacgtatttaagttggcttttgaagctttgataattcactcatttgaaagaaaatatcacttgagaaaaaattatg

SEQ ID NO: 11670 - DNA, 3000 bp, Unknown
  misc_feature (1)..( 3000): cDNA_ID_2707109_gDNA_ID_2214509_Annot_ID_184195 3000 nt of promoter + ATG
aatttcatgaccaaaataagaaaaattaaatattattccgctttttcttggttgaacatgttggttcttagtcaaattaaatcccgtgattccaatattcgacatgttagtttgttcatattaattaggcttgttgagtaatggtttgtgttttgttttatttagacttttgagaaaactgtcggcgactcagctcttctcgcctcagcgtatcgaagccacgaaaacgttgagggagaacaaggtgaaggaactcgtgagcttcatgagtgaaagcagcgagagagaagaagctgttgatatatctcgtgctaccttcatcactgctcttaatatcatatcaaacattctgttttctgtcgatctcggtaactacgactcgaataaatccggtgtgtttcaagacacggtgattggtgtcatggaagctgtcgggaatccagacgctgctaacttctttccatttctggggttccttgatctgcaaggtaatagaaagactctgaaggcttgttccgagagattgtttaaggttttccgtgggttcattgatgctaaattagcggaaaaatcattgcgggatactaactctaaagatgtccgggagagagattttgtggatgtgcttctcgatcttaccgaaggagatgaagcagagctcaacactaacgatattgtacaccttctcttggtaagtctacttactatatattttgtaggatattagaatcttatgaattaacttttaaaataaatcaaatatcatcaagactttaaaagatacgtatatatatatcaggacctgtttggagcgggcacagacacaaactctagtaccgtggaatgggcaatggcagagttacttcgaaaccctgaaacaatggtgaaagctcaggctgagatcgactgtgtgattggtcagaaaggtgttgttgaagagtctgatatctcggcacttccctatctacaagcagtggtgaaggaaactttccggttacatccggctgctccgctactagtcccccgaaaagctgaatcagatgtggaggttcttgggttcatggtgcctaaagacactcaggtatttgtgaacgtgtgggccataggaagagacccgaacgtgtgggagaattcgtcccggtttaagccagagaggtttttagggaaagatatcgacctgagaggtagagattatgagcttacaccattcggagccggacgtagaatatgcccgggattgcctttggctgtgaaaacagtgcctcttatgcttgcttctcttctttattcatttgactggaagcttccaaacggtgtcggttcagaggatttggacatggacgagactttcggtctcacattgcacaagaccaacccgttacatgccgtacccgtcaagaaacgtggccgtaattagccatttagtataagttttctttaaagtacaaatatgcttttcttatcggttgacataagatgcaatttcatgctctgattttacgattctattcttcagattctatagttcgtttacctatattctctcttcgatttcatcttcgaatttcatgagttgttgatccatctttggctccaaattgttcgacgttttgatttgttgctttgtcgttgctcttcgacaaattgagcgatggaagttaatgttgactcttcttcgaccaagatgtatcctgagaacgacgacggagatggctagagagagagagagtgacagaataaaaaatatcgattaggttagagacgaactacatgttgccggaatttcaggcctcggagtcatgatgttggagcttctctccgataaggaccagcaatcaattggcgatagagagagagagagagagagattgaggaggtggcttttgcgtttccggtgaagagtgtggcttttgcatttacagagaggtggcgcctggcggcgttggattgatgacatcatcaaagcccttttgcacaacaaagcccaacaaaaggaacagaattttcagcccatacgaactgttaatcctatcccattttattttattttcattcaaaaaattttagcagattttcaaatattatacttaaaatcaaatttgggttttgaagttttttttttttttaatattacggattttaagaaacttgatttttgcaatatgatatgaaattaaccggattttgtatctgcattagtcgttagaaatttcaaatattcaatttgtttttatatcgttatgtagattttagtattcaagtttttaattcaaaattttaaaataggttttttaattttgatatttccatggcatttactaaataaaattcattttattattttaaaaaatcaaattatttgctacgctgggttttgagaaattttggttttgttaattagaaaagagtccaaaccaaatataaaagccatttaatataagttttttttttttaaagtacaaatatcaagagatgcacatgaaaggagcaaaccaggtcgagcaacttaacctaacatcagaacaaatacagctaaacagtaaataaagagagtaacgtacacctatacacatggttaagctgcctaatagtataattaatgaaattaatgtgaggtttaacagatgaacagtaatgtggttttgttaattagaaaagagtccaaaccaaatagtataaaataattagttggttagattttgctattttgttgtatataaaaaaatatcttcatatttgtttgatttcttctgccaaaactaaagtagcgccactggtaggaatttcggaaccgatcactgacattatttattgtatatgccgggggagtcgacaaacaaagtaaatggaccaaatttgtggctactactctcctcaattataaaaatgaaatatttatatatcttccctgaaccaggaagatattttgtttgtcttctacaaatattatatatatgtaatttctttggataattttctaccgcttaagaagcacagatg

SEQ ID NO: 11671 - DNA, 3000 bp, Unknown
  misc_feature (1)..( 3000): cDNA_ID_2707113_gDNA_ID_2214509_Annot_ID_184194 3000 nt of promoter + ATG
tgctattttgttgtatataaaaaaatatcttcatatttgtttgatttcttctgccaaaactaaagtagcgccactggtaggaatttcggaaccgatcactgacattatttattgtatatgccgggggagtcgacaaacaaagtaaatggaccaaatttgtggctactactctcctcaattataaaaatgaaatatttatatatcttccctgaaccaggaagatattttgtttgtcttctacaaatattatatatatgtaatttctttggataattttctaccgcttaagaagcacagatggacataatctcagggcaagctctgttactcctcttttgctttatcttatcatgttttcttatcttcaccaccacaagatctggacgaatctcccgcggggccaccgcgctgcctccaggacctccacggttaccgatcatcggaaatattcacctcgtcggaaaacatccacatcgctcattcgccgagctctcaaaaacttatggaccagtcatgagtcttaagcttggaagtttaaatacagtggttatagcttcaccagaagctgcgagagaggttttacgaacacatgaccagattttgtctgcccgtagtcccactaacgcggtacggtccatcaatcaccaagacgcttcccttgtctggcttccttcgtcgtccgctcgttggaggtataacttcaatatcgactttctattttcctaggattttgtttcttacgagatttgctacaagagcgtttttctttttgttaaaaggcaataaagaccctaaaacagtaatgttcttgatggatcgttgttatgctctgttttaggctgttgagaaggctgtcggtgactcagctcttgtcaccacagcgtatcgaagccacgaaagccttgaggatgaacaaggtgaaggaacttgtgagcttcataagtgaaagcagcgatagggaagaatctgttgatatttctcgtgtagccttcatcacaactcttaatatcatatcgaacattctgttttccgtcgatctcggtagctacaacgcgaaagcttctattaatggggttcaagacacggtgattagtgttatggatgctgccgggactccagacgctgctaattactttccatttctgaggtttcttgatctgcaaggtaatgtgaagacttttaaggtttgcacggagaggctggtaagggttttccgtgggttcattgatgctaagattgcggaaaaatcatcgcagaataaccctaaagatgtttcaaaaaacgatttcgttgacaaccttctcgattacaaaggagatgaatcagaactctccattagcgatattgaacaccttctcttggtaagtctgaccttactgcagataatcatgatttataagataatggaataatcaattttgtggatgaaaatctttaaatttattagtattccaacaaatgttagatgagtgaaaacatgtttcgatcatagaaagacatttttaaaactttaatatcacatcatttttatacaacaggatcatgttgtactcgaatgttatgagttgaaatcgcatgaatatttatatacggaaccgaaatgtcgagctgctcactgacatgtgatttatatgtgtcaggatatgtttacagcaggcacggatacaagctctagtaccctggagtgggcaatgacagagttacttaaaaaccctaaaacgatggcgaaagctcaggccgagatcgattgtgtgataggtcaaaacggtatcgttgaagagtcagatatctccaaactgccgtatttacaagcagtcgtgaaggaaactttccggttacatacgcctgttccgcttcttatcccgcgaaaagccgaatccgatgcggagattcttggtttcatggtgcttaaagatactcaggttctagtgaacgtctgggccataggacgagacccgagcgtgtgggataatccgtcccagtttgagccagagaggtttttggggaaagatatggacgtgagaggtagagattatgagcttacaccattcggagccggacgtagaatttgcccgggaatgcctttggctatgaaaacagtgtctcttatgcttgcttctcttctttattcctttgactggaagcttccgaagggtgtcctttcggaggatttggacatggacgagacctttggtctaactttgcataagaccaacccgttacatgccgtacccgtcaagaaacgcgccaatattaattagtcgtggttttataattaaaaataaacagagaaataatctccaaagctttgtttattaccaaaaactatctgttttcggttctagagtttgtttgtttctctctcttgaggtggctagagcttgaagaagtcaaaagtatccatattgatgcctagcttcggtcctcggtttaggctaggaaggaaacgaagaagtttctgcaaaccgatgcagatcatcaatggaataatgaaatgttaattttatcatttactcatataggtttccgcctcattatcatttacttgatgtttctcctaaatcttgtcatttaattgactaaggaaataacgaagaaattatcatttacttatttatatatgttcattggatacaattatatatatatacgcacttaaaataattgtttagtgtatacaacaaatgagagttgcaaatgtttacaccttcaaaacacaaactcaaattgtttccatttcttaatcgtttggctcatctcactcagcatagcgactgtttaacagaaaaccggatctttgacttttgttactgtttaacacaattctttttgataaaatttggaaaacttacgattgctatgtaagcgaaagttttgatacacaattcttttttatcaacaacatatatggaaatctatgttatgatatatttcagatgacaaaaaaagaagaagatatgtttagatgattttgcttagtcatttgagcaaacacagatg

SEQ ID NO: 11672 - DNA, 3000 bp, Unknown; identical to SEQ ID NO: 11663
  misc_feature (1)..( 3000): cDNA_ID_2707121_gDNA_ID_2214509_Annot_ID_184190 3000 nt of promoter + ATG

SEQ ID NO: 11673 - DNA, 3000 bp, Unknown
  misc_feature (1)..( 3000): cDNA_ID_2996267_gDNA_ID_2214509_Annot_ID_184207 3000 nt of promoter + ATG
gccatcgccatgtcggttaacggaaccttaaaaatcccgacgacgacgaacgctgattctgatatgggtgaaaatctgatgaagaagaaacgtaaacgaccttctaacagtgagtatatagacataagcgacgccgtttcagcttcctccggtttagctccaattgccacgacgacaacgatccaacctccgcaagctctggcatcatccactgtggctcagcaacttctgccgcaaggaatgtatccgatgtgggctattccatcaaacgcaatgattccgacggtcggagctttcttcttgattccacaaatcgctggtccgtcgaatcagcctcagttattagcttttcccgccgccgctgcttcgccgtcgtcttacgtcgccgctgttcaacaggcttccacgatggctagaccacctcctttacaagttgttccaagcagcggctttgtatccgtttcagacgttagcggttcgaatttatcaagagcgacgtcggttatggctccgagctcaagctcaggcgtaacaaccggtagttcatcgtcaattgcaacaacaacgacgcacacgctgagagacttctccctagagatatacgagaaacaagagcttcaccagttcatgagcaccacaacagcacggtcatcgaaccactgaagaaaagaaaggaaacggcggcgtattagtgatcggaaaaaaagcacgtgtgcacatgaagaagtgcacgtgttaagaagtgggcctcgattttaggcagaagtgggtcaacacgcaccaaaaagagagtggagggaggaggagaggggccacacggctcccaccttacgcatagcttccgaggcagccaggttgggtgtggtccccaaatggttagagctacgtggtccgtatgagtaggaccagcttaagcttaagcataattcgaaacgtttcgtttttttggtgggggctcaccactttgtcttgacttttttggtctttgtaattttacaaaataagatttattgaagccctctctaagtcatggtccactcaacaacaattgtgatattgatgttttgattttattaaaatctgtaacaaaataaatatttctatctaaaatgaaaatactaatgttgttttcctaaaattgttgtagcattacttttcaaatgattccattttcttacaagtgttacaaaagctttttgcgaaaaaagtctcgtccgtgttattggcggggcctagtaagcttgattgtaccactaatacggcgttgtttcgtggggcctgaaagcttcccactcaagggacgcctagttgggtcagcaccaccagtttaacgctaaggaaataaaggaacagcctggcgtgggtcatacttgtgtctatctaatctttaccgttcaattccatcgtcttgtcctaaccgttgattctatttcgttcgttgtttaattagtactagtagtagtagatattttcttcttgtctacggtctcaacgccagacaggatttactataagataactttgtttatgtttgatttataattcaagtgtggttggttaaagttaaaccatggttctccgtttcacaccgttgattatatatttttttaagatatgtaggaagtaaaactttaaaaggttaaacacaaggtaaaatgtattattggaggcctaaaccaacttggtggccgtggatggggaaaaaaggtccagaagtgttggctataggattcctcgtggacttagagaaatgacttgtcgttctcttcttttatttcagtggacctcattaatttttatatatagttggcctataaatttataaatgttcctttatttttcttaaaaaacaaaaaggttttaaatcaaacagcgggaaaccagcccaatgcttttttaatttcttgattaagcccaaaaaagggaaaaagttgtatgggcttacataacatttaggactaaggcccattattttgcgaacaacacaaaattgcttacataacaattgctacgattcatgttgcagaagaacaccgtttttgtttttgtttcttagccttaatttaattgtttgtattcaattgtttttatcatttagaattttgcttcgtccttgtcgaaatcctctcttatgttcttgggttcttatgtacttattcttttctttcttgttcgttcttttttcaagttatgtgaagtaatatttgtcaatgatttcaaagtaagttgttaaaggctcaagaaaccaaatcgttatctattatgtcactaataaaattctactaaatatatataattcttctcctttttttacttgccgataattgtatcctatttacaatgaaataacgcaaaagacttggcgtattatcttttgacacacgtttcaagtcaacgatttcgacatctgctttattctattggtatgtcgaccaagatgtcaatgaaggggtggacaacgatttactgttttcaaatatctggattattaacctctggatgttatctatattttagaaaatctggatacctccacaagaacaacatccatgttccgaactaaaaaatggaatcatataatttctgtttttagtaaattaataactttacatagttaagtttttttaaagtatgttatgacaaggccatgccgaatccatgtgcaatcataatccttatacaaattacctgtccgcgttgacgaaacctttatcgtgccctcttgtcatttgtatactctagtaaacagttgttctcgttatgttaattaacttctataatgtttcatattctaacagaataaacaaaactccaacatgtaatgaataataaatactaatactattttattttattttttaacagtaagaaagaaaaagaaaggagattggaaagaaacaaataacattccaccacaagcgtgtaccaatctctcccgctctgtctctctctctctctttcctccatctctctgtgttcttcttacagacaccgagaatg

SEQ ID NO: 11674 - DNA, 3000 bp, Unknown
  misc_feature (1)..( 3000): cDNA_ID_2711138_gDNA_ID_2214509_Annot_ID_184205 3000 nt of promoter + ATG
aaaaaaaacacctaaagaagtgaatataataggcatatacatatgaggaaaatgaaaacaaaaggagcgaaaaatagatttaacctaaaagaggaagtaaagaggttataagaggtaagaaaagtaggaccatataatagctatattgtagaattttattatttggagatatggcaatttttgtgagggtcccatgaagactaaagtgtggagcacgatttatctttgtaattaataaaataataaatatattattattgtctcgggatttttcgattgatgagaaaaagtaagaggtgcgttttcgaattatcattggctaacgtttgtacgtgactgtacggacgacgttgatgtatttctaatattgtactcttttttcccacccttatttctctaattcttgtacattaaccccaaactaattttacaaacacattggtgtttaatcattgtgaaattttgatttatctaaaatacactttatatgttatgattttgcatgagcttatgactggtaaactcatgagatttccatatcaccatgttggaagttactaaccatacatcttttaaatgcaaattcacatcattcctagactgctagacagacatgtacttacttatacaaggtttttctaatctaatggcaacaaagaaacttgtgactaaacgcatacgtatctctcatatagtgtagactagaactctacgtatctctcatatagtcatatttttaaaaaaattatactttgggatctcgaagcgaaaattagattagtttatatgattatgtacaaaaaaaatcggatattactaccacttaaaaataattgtagtggtcaatcatatctaaaattaatcgcagtgaacaaaaacctgaagcatagcctggttctatcttactttcgatgtgacacattactaacacgattgttttaatctataggacgaatcctttaagtaatgtatagttggttcagttacgttagatactttttgttttggatttgtctcaaccagttaagaagtgatcgtatttactagtggtatacgatgatgtttctttaaatctgaattgggtctacaaaatacataactaaacttcaaaccgggtttatactttatacaaacacgaaaatataaagatagagacaattcaccagagaagatgtgtatttatataaaaattatccatacagattttcggacctatctgtttgatatttaatatatataaatacgttaacatatttcaccagagaagatgtgtatttttcgaaataattagtttgtgtggtcctcctcccgatatagataaaagatcattagatatcgattaacaattttatctccaaaaaaggatatttttttggtgccactagctagacaagacgttcgataagctgaattattattggatttctaagttacgttttctttagtaatccgagggaccaaaaatagcaaatgcctctttagacacgtcgctacttaacgccattgccccattgtctctgtactagcctccaaatatttggattaatggtcacttaggtaatgaggaaattgtagtattttgtaatgtggttttgtccaacttataaaaacttacaattgcaagtaattaattattcacatggagatgtaagattatgtcatataactaaaaacacaatttaagaacaacaataagaaacaatggacaaacaagcatagaaaatatacaaatcaaatgaattttatctgttgggatggaaagatattataaaaattgattaaaaccaatatagttgtattactcacaggtaagaaaaaacgatattcttatttttcatatcaattacaagtgggggcatataggtacgagagagtgtttgtgtccacattaaaaacaaaaaaagatttttgttagaagaaatttaataaaaataatttgacaggcatttccatccaactagatatttatgggagggaaaaagatgtgtatgtaaaaatgtccatatgtatcaaaatatgctatttttggtctttcttaaggcttttttccaaaataagtaaaggatgaggtttcaagcgtccatcatatttgcgacacatatgactgactatttagctcctccctctttctttctcttattttattatctttctccaagaaataaaatagaaaagaaaatatatatggtttcacaaacaccattaccataactacaacgagaagaggatcttttttaaggagaaaagcagagagagaagagacgagtgtgtgaagtttttttgtcttttgtttcttttattacacacaaatagatgaaacgaggaaagctacttcttttgctacttccataaaaaggttcttcctttcgcagagaatcaactttgatcatcttcttccttctctttctttcttcttctccctccagtaatgcttatatagtctcctcctatatctctacctatacatacacaaaccctttatcctcgaaagcttcctcctggttaggtttttatcaaacccttttagccaatcggtaagatctcttcgtcatgatcttttcttttttcttttgctttgtactctgatggatctataaacttatatgggtttggtttcatttggttcgatttgatgtgtttggtttctttgtcctaaatctcatgaaaggaggttgcatccttcaattaaaccgataacaaaagtttccattacagacttatagatcagatactttagattgttttgctttttgggtacttaatctttcgttgacttcatcagtcttctcccacccaaacaaaaaagtcatatttcgatcatatcttcatttttttaacctactctctttgattcatatatgaaatgggttgttttatgtgtgtgactaatcttgttattgaggtggttgcaccattgatctaccgttttcttcaatttttgaaaaaataattttattttttttctgtgtgcaagggaaattaactaaagaagaagatatg

SEQ ID NO: 11675 - DNA, 3000 bp, Unknown
  misc_feature (1)..( 3000): cDNA_ID_1807963_gDNA_ID_2214509_Annot_ID_184204 3000 nt of promoter + ATG
cgtttatagattttgttgccaatggtccgtttaaaagatttgaaatatatatattttttttctactttttcttttcttggtttataacctttgaatatctatatttgaaacacacattgaagatcactaactcgaaattcaaaaataaaaagagagacaaatatagcaatccataatcaatgcatagagacttcaagtgacctactaggatcccactaaaaaataatatgctgttttttgcctattccttttgcatcattcttgttatagtaaaatggtaaaagaaattatggaaaataagaaaatggggtcattgaatgtcaagagggtaacattttcagacgataaggcgcaatgaccccacacctcacatgaagctgcagtgccatttccaaaagagtgtgtggatatgaatttgaacaaagaaacattggtgatgaaattaaaaaagaaaaggaaagattactacaaagtgaaaagtatgaaattatgaagactacccgatcttctttgcctccctttccgtatttggcatgcccctaaccactaccacaacctcttcccttcggaactttgtaaataaacattcactgtttttttttttgctttttaaatagctgttaattgtacaaattcatttacatggcttactgtttttcaaaaggagatactaaatagtatatagtactataattttgtccaccatgttctatgaaactcgtccaaacataaaaaggtttttatatcatcaaacgtacgactttcctttgttattttcttggattggacacaacgagattggtttggtcactgtccgatctagttattgatatatatatatatatatatatatatatatatatatatatatatttttttaatataatgtagatgtagcccactaacttttgataagctttcatttttctatactttcatttttctataatgtaaaaagatagatgaaaatgaaactactagattacaactttttaacaaaaaataaaaaactactagattacagctcttgattggttgataacttgatatcatatatcgtgtttgtagttgaagatgtaaagatttatcatcttgtatttgaattttgcacaatatataatgtgatgattctatgtttgtttgtaaacttatgtgcaaatgggcgataactaaacgttcgtaaaatagttacatgtactaattaatcgaagcacataaatattatatatatatatatgtatatatatgaaacgattcattgattttaagtatttaatttattttttaagattttagttgtcttaacctcgtacgaagaagaaggatatatactatttaactcgtggagatgatgaggttcggatatttttccttaagaccacaagacactgacacgccgactgatcgataaaaaaagttaaggcctacaatacaaaagagtagcagattcccttacacgtgtttcatttatgatctgttaattaactccattgagcttcaatatctcattagccgaaaattaacttgacgttttccattgaactgtcgaaaaaatttgtagaaaaagtgaaatgtcccctatttaacttccaagtttaaaacctaaaattaattagttaccgttttgatgaataacgttgaaagaatcgtcaacatatcaaatgatgcagatacaacaagggacaaaaacatcaaaaaattgattaaaaataatcattcagatattagcaattaaactgtaagtaaatgattgcatatatatatatgaatgaatacatatatatgtatcaaactgtaagtaaataatacatacatatatatatatatatataggaaaatatctcatttttcaatcattttcagaggtaaacatttttaaagacaattttacctaacccaacatcttactatatttaaccagctctgcgagagcttcaaaacaatgatgaattttctgccccttttcattgaccaaataaaagttcacaaatttgtaaaaccaatcagcattaatttcgcacgtagtttacttcgtccgattttagatcaagtagacattttaaccaaacatattgaatcacggttcaatcaagatacatggttgcgagtataatatatcaatccttcaccgcattagaaaaccaaattttctatttaatttagcgtgttcttttaatgaacgcagcgtcagcgacaacaaagaagaaaaacagatctgcggcgagaaaaaatacattgattagagaagaactgccgcaaaagatgtacgatgatgaagattgacgtgacgctgcttaatttcagcgattcatttgatgcaattgcaattcatcggctatcatcggcgactcatccgaaattgttattttcaagctttaatgtcgttttacttacctactacttctcatgacacgtcgtttcagtccgctattgccgctggcgcagcatcaaataaaagaacacgctaggatagcttgaaaagggtacaataactagttatagaagaacatgagccataacatttggaaacaaaatgagttagtttgaatttgaaacatcgcgctctatgtaaaaaaagcaaaaaagaaaagaaaagagtcctaataattaaaaagagaaaataaaaggaattttcaatggtccgactgttacaagtagatttccatttttaggaatctagctataacgatgaagacagagttatcattttgttccatcaaatatatgacgatatttatatttaatttcttcaacaacaaatatctcatttgttggtgccactttcacatacttaggacgactaataattaattaaaaaggatttatgtaataacgcaccatattaacctgtaacaagaagaattgaaagtaatacaagtttatatatatagcaacacatttatcgtgtacgatactttattccttttatctattcttgaaaaaaagttaccaattcttgagaagaagaagaaatcagaatcaagagaaggagagagaaag

SEQ ID NO: 11676 - DNA, 3000 bp, Unknown; identical to SEQ ID NO: 11671
  misc_feature (1)..( 3000): cDNA_ID_2707113_gDNA_ID_2214509_Annot_ID_133801 3000 nt of promoter + ATG

SEQ ID NO: 11677 - DNA, 3000 bp, Unknown; identical to SEQ ID NO: 11670
  misc_feature (1)..( 3000): cDNA_ID_2707109_gDNA_ID_2214509_Annot_ID_133802 3000 nt of promoter + ATG

SEQ ID NO: 11678 - DNA, 3000 bp, Unknown; identical to SEQ ID NO: 11669
  misc_feature (1)..( 3000): cDNA_ID_2707105_gDNA_ID_2214509_Annot_ID_133803 3000 nt of promoter + ATG

SEQ ID NO: 11679 - DNA, 3000 bp, Unknown
  misc_feature (1)..( 3000): cDNA_ID_3022416_gDNA_ID_2214509_Annot_ID_133804 3000 nt of promoter + ATG
aactacgattagccataagttcgtagacgaggataagcttccgaccacgacgatcggaggagaatccaaggagagagacgacatgaggagagccaattaagtgagaagagagagaaagctcgttgtgaaactcacgttcgccttgtaaagaaccagcggaggtatccatgactttgacggcgagtgaatcgccgccactcgggaaatcagctttgtaaacagagccgaatccgccgtgaccgaggtgagtcgactcggagaaagagtttgtagcgcggcggagctgagagtaagagaagcgtcgacattggtagtgttgaggagacttggagttggagataagatctgaaggagccgtacggtttcggtagagtcttcggtaaataagtaaagtgacgaggatgagtaaaactccggttaaagtcagagaaccggctatgataagtggaagagtctggaaacgatgatggccgtcactaaccgtaggcgtcggttgcagcggcggaatatctggcggagagaggcgagatggcattttagtaaatataggaagttacagaagtgtcatttaatccggagtttccattgaagaagaagatggtgagatgttaaaagattttcttcagctacttggaacactcgcgtagtaaaaataaagagatatacttgtgtgacaggcgagcgataatggtaatggtgacgtgtcggagaataaatgggggatggtgactgtgatttgtgacagtcatgtgagcggatattattgctcacgtcgtttagcggaagaccggtgagggatagatttgagtcaccgagtcgtgagattttaatgagggagcgtgatttgcacgcggcgcgttgaggtgagattcacgagggttttgttttgaaaccttcttctccttctgaagaggtccacggtgggacctacgaaatttaactggggaagtgatggtgaagtcaacctcactcgccttttaagaagcgcgtggatgcatgtgtggttcgagcttaaccaatttcttggctagaccatcggttaaacagcaattagtcgtctgattaatttggatttgttcgatcgactagccatgtgcataactggtcggcaatgttatattagatgttcaatcttgttataacattagtagtaattagtaaaatggtgtattgattgtctaggttctaattatatcgtttaagatggttgataatttagttaggcgcacaattttaatatcaaacttaatcattttttagcttcttaaaaagaagcaaaaagcgtacagctatttttgtaaaatcatatgtataatttgtaaaatacaatgtttgtgttaaacacaaaaagatttgtttttgttgtaataatcaaacgtgttagtaacgtcagcgaaaaggaggcatttttcaggtcgctttttcgggtgatgggattttgaccttttcaattttgcccttaatcgctttggtctgactcttattgtggtttttgtttggtttgttttggttttacttttacccaatttttagacgcacgagtaacgtatacttgcaaaacaaaagagtgagatcacgtcactaacgttcaaaatcatttcactcgctggcaccatctcttatttattttaatttattcgagggagaaaaaaaatggttcaaagctaatgacctaatgttatcattatcattagagaactatccaagtgagaaacattcgtgaatccacttgatgttagtgggtgatttgttagttttaatagaacaacaaggtttgtttactttttatttttggctaataaagaagtggttagttgcacttaggggtttgactttggtaacatcgttggaatcttgataagggaatctatggaaaaatatataaacaaagaagtaaagcgtcaaacacaaagccttttgcaggtttaaagcagattcagatgtacttttaatgtattttttccaaaaataaaatggagattggagaagaagaagaagaagaagaagcgacgactactactcaaattgctcatgtgacttccactacttaacctcctttagaaaactacaaaaaatagttatcattaaataatactgtttgctagccggaacgttatagccaacacttgtcgggacccgtgaccgtggtccctaactttccactaccgttacatgaataaaagttctttatgtttcatagtttttatacctaggagattttattagtgttccatgaccatccaagatgtagtaacagttgatagtaagaagataaaatttgagtgttgtcactcgttaattagcaaatatcaagagatgcacattaaaggagcaaaccaggtcgagcaacttaacctaacatcagaacaaatacagctaacagtagataaagagagtaacgtacacctaaacacatggttaagctgcctaatagtataattaatgaaattaatgtgaggtttaacagatgaacagtaatggctacatacaagtttggcaggcggttgtcttgatctcccatgtgtcattatagttttagaatcatatattttttcttgcatgttttgaatccaattaatgacactaatacaactcactattttacatattatgttctcattgtttatataattagtctgtaccaaaaagaaatcccatgtttgtaagaaatttaggcaagtatgtaaggttcaaactttccataagtgggcatgacaaaaacaaatttttagaaactcagatagtttgtaggtgttataagcagcaataaacatatacattatgcaaccgattgacagtttttgagaacttgtttctccattttagataatatctttaaacttgtgaataaattcattagaaaaaaaacttaaattcatggatataaaatgcatgattgagttatattttctaggcactctccaatttcattaaacaaggagagtagaacctaaagaaaaaagtggtcgtccaatggacctctcactaattcaaggcatg

SEQ ID NO: 11680 - DNA, 3000 bp, Unknown; identical to SEQ ID NO: 11667
  misc_feature (1)..( 3000): cDNA_ID_2707094_gDNA_ID_2214509_Annot_ID_133808 3000 nt of promoter + ATG

SEQ ID NO: 11681 - DNA, 3000 bp, Unknown; identical to SEQ ID NO: 11666
  misc_feature (1)..( 3000): cDNA_ID_2707091_gDNA_ID_2214509_Annot_ID_133809 3000 nt of promoter + ATG

SEQ ID NO: 11682 - DNA, 3000 bp, Unknown; identical to SEQ ID NO: 11665
  misc_feature (1)..( 3000): cDNA_ID_2711142_gDNA_ID_2214509_Annot_ID_133810 3000 nt of promoter + ATG

SEQ ID NO: 11683 - DNA, 3000 bp, Unknown; identical to SEQ ID NO: 11675
  misc_feature (1)..( 3000): cDNA_ID_1807963_gDNA_ID_2214509_Annot_ID_133811 3000 nt of promoter + ATG

SEQ ID NO: 11684 - DNA, 3000 bp, Unknown; identical to SEQ ID NO: 11674
  misc_feature (1)..( 3000): cDNA_ID_2711138_gDNA_ID_2214509_Annot_ID_133812 3000 nt of promoter + ATG

SEQ ID NO: 11685 - DNA, 3000 bp, Unknown
  misc_feature (1)..( 3000): cDNA_ID_3022468_gDNA_ID_2214510_Annot_ID_133815 3000 nt of promoter + ATG
agtggaatgcttatgagactttgaagattcaaaaggcttacaaatttctctaaccagtaaccatgcatgcacatttcttttttaagcacacatcattaccattcaccttaagtcttctaaatagatccttttgagattttgtctagattttccaatctttttctttaaattgtgatctcatttgttgttgatttgatgctaaagctagatttgaatcttgctttaaacacaaacaaaacgaaaaatttaattagttgaatatatatatttaattatgattaatgtgataacctttgaatgtttgattctatatgaatcaaaatttaaaataaagtaattacttccagtgatgagataaatttatccacactacaatcttgtcaatcaatttttttgtttataacgaatatatgtattccattggattgaagatcaatccttttcaataccatgcagaatcgaatttaagatatcgagaagaatggtaatatattgactaagttgagtcagccaaattttatccaaaaccggttaatattaatacaacacacaaataaaaatcaaatatgtcaaatgaaaatacctttaaatcaaccttaaatatattgtacttattaaagagaactacgaataaatttgtaactttattttaccaaattcacgggttgttaataccaccgactatatatgctttatagatttgttacttgatcttgaagctcccaaagattcttactaaagtttggtcaaaattaattatcaccatgaaatgatgaaagtaatttttttttcattcccatcactggcactggcagtttaaccgtttttttcccgttaatcagtgacaaattttttttgtgaaccaataaccttaaaagtataattaaaaaagttaaagacatgactaaggtttctgaaatccatggtgaacaaacaaaaatatttgggtaaaatgtcattgcaagcagacaacagttaaacagtacctccgggtcttgactgttaatcgcagtctatacagtcatctatgcgttatggaacgaccaaaacaatatggtcttcaacaatcttctcatcatcgtagaagtttctcttcaaaattgttgttttgattggcgaatcaatattatttgtattgcaagacgagaaattaccaaaggatagttaatctagacttcgaaacgaattatgtgaagttcatcaaattgataacaatttatattgcttaagagcctattatgtctcgcgttttatttgttaagattgattttttagctagttcttttttttttgtgcaaccgtttagctagttcaatttgtagtatatacaaggtttattatatgttttgccctactgttttaatgtattggccaatgaaaaaattataaaatatattaataaaaggtaaaacagaaaatttaatagttttcttaatttgtgtggaaaaacattaaacgacatgtaattcaaatggatggagtatataagagaaacaaatatatttgacaaatgatattagagtatcggtaaaattgacttcgtagacgtacataacgacctttaccatacccgaaaagtcaagtgtacagtttaaacaattaatgcaccgaatggagtttcatgctaacttaatattttattttgattcatattatattatttatagttataatgtgattcatatatattaaaaagtgataaatgaatatatacatatatatagtgatattttcatattattacaaacatattcctctctatataactatattttgtaatttgttttcaattttacatacattagataaaaaatagacactaaataaattcgcgatccttcattttttttttgttcacttaaagattaactttcttaaaataagattgcaaaatattgagatgaacgacgtttctggtacatgaagccggcatgacctaattctccggaaattaagttgacgtaaagatatatgaaaacaaagccttaacaaggaaagcaaagaagatgaaatgagagagtcagagaaattcacaagactcacacatgggaacgggtgacatgggagatctagtgataaatgtattttggacgttttgtggatattttcaacccacttttttttttttttttttttttttcttcaatattttcaacccacttaatactacagttttgctacaagccatatctctttttaactatttttaaaatctctggtatattctgtgattactctacagtttttagttacctaatattttttttttgaagtaaaagcagaacccaaaaacaccatcacaaagcacaaatctttgaaaacttctgagatagagacaaaacaaaagttgggtcctataaattttcattcatttttcatctttaaaattcatttatttcttcttttaaattattaattaaaactttaaaagttggaaaattcttcaaaaccgtacaactatatttgtgtggacctgaagccaaatgtctctctccattggccattttaccttctacacattcccactggccaaattcgaagttcattctctctcaaatcactttgcccaaatcttcctttttcccatatttgatttcttctttaaataaagcaaaaaagatttcatctttctatttattctctttataaattggaacctactttgcttcttcttcagtctccacacttatcttatttttgccagtcttctctgtggatgaagcagagtttttagtcaatcaaaagtttgaagctttccttcatgggtttctgatttgtctactaaagttttgatttttttaatttgggtattaataaaaaaagtggggagtgacacaagaagcagtatagtcattagttttccactaagcaaagcacccaaaagttcaccaacaacaaaggcctaatatgtgtctttgtttatgatttgggatcatctgaaacaagatgcgaggagatagcttctcaatgagtattgagaatcttcctgattctccaatg

SEQ ID NO: 11686 - DNA, 3000 bp, Unknown
  misc_feature (1)..( 3000): cDNA_ID_2711149_gDNA_ID_2214510_Annot_ID_133817 3000 nt of promoter + ATG
gcaacaaaatggattctttacacgttcttagatcctttcttcttcttttcattgtttttaatcatcttcctcgcacaactacatcaatgtcagaaccaaaagtcattaccatcgatgtaaaccaagctcagaaacttcttgattctggctacacgtttcttgatgtcaggttaatcttaaaacctttcagattcagtcatgcctttattgttgttcgatattactgtctggtgatttctgaaattttaagagctgttaaacacagaactgttgaagagttcaagaaaggccatgttgattcagaaaatgtcttcaatgttccttactggttatatactccacaaggtcaagagattaaccctaatttcttgaaacatgtttcatctctctgtaaccaaaccgatcatctcatcctggtaataacatagtcttgtcctgatcatgtgaaagtatatttcaattcactagatcttttttttttttatgttcactggatctgaatctagaaactgttgttatgatcttgttttgtagggatgtaaatctggagttagatcattacatgctaccaaatttcttgtttcttccgtaagtaccaaaagattcaagatttgaaaaccctgttttcttctttaatctatgagtttattggtgagatataatgcgattgtttaatcatgtgatagggcttcaagactgtaagaaacatggacggtggttacattgcttgggtcaacaagagattcccagttaaagtggaacacaaggaactcaagtatgatgagctttgattcaaattcttcaaatacaagcatgttaatgtaaatttttgctttaaatatatgttaagaatgtgtaaatgtaatcatattattgcaaatttgcaataacacataaagtataaagttcaaggtttagagagatgaaaaaatgggcagaccgaccaatgaagctccagcatcgacaatgtatgtattcccggagatatatttagacgagtcgtgaacgaggtagcgtaggagagaagtaagccccggatccactgtctgttgtacctttaatgggactgtcctctcgataacggtcttgagccactctttttgcataagaccttgtgtgatctctgactttaaaagccctggtgcgatcgaattcactctgatcttgtaaacacctaactcaagtgccatcatccttgtcatggtgtcaacaccgcctttagaacaagcgtatgcgactccaccaggcacctgaccgcggtggagccaggatactgatgaaatgtttatcaccgagccaccaccacgtttagcatcgcgcattaaaatgcatacgtatttggagactaaccaggttccggttaagttggtcttgaagactttgtcccactcgtcttctgacaaatccaaactcgacttgacattgcctctaaatcccgcattgttgatcaacgcatcgatctttccgaagatttcccaagctttcttaaccgctttttgaacggtggctgcgtctgatgaaacgtctagctcaagagcttcagcttgaattccagctgaatattcgaagcgatttatttcagagcagagagatttgagacgatcgacacgacgagctgctgcgataatcttacagccagctttggctagatcaagacatacctctcttcctataccagaggaagctcctgtcacaagaaccactttgtctttaagttcacactatggctccagttgcttcaatacctgctttgttagagtcatattaaagatgattaaaaagcatatatgataaattttcatataattgagctaacacagtgagatataagagaagaagtatctcacgcacagtttgatgattactcatgttgtttctctttgtgtgttctttggtggagaaggatatgcccataacatataaagacttgtctctaaaccaaaacgacattttaacgtggcaatctaaatctgtaagtctgtaactgatttgtctatcaaccaaactttaaaaccttttagaggcaggggagtctttattgttagttagatactgtctggtgatttctggaatttgagagctattaatacagaactgtttgatgaagttgagaaagggcatgttatcagagaaactctttaatgttcgttactagttttgtgtgtgtgttttttaaaaccttaataaaaacagaggatattggtcttaatgttttttccttgaaccaatctaagttttttaatgagaattaatgggattttgtcttttcttttttttatcatgtaaagagaacttcaagactgctagaacttagaaacatcaaacatgtttggtggttatattgctgattaagattatccaaatataagcatgtttaaaatttattttgttaactaaatctaaaatcgttttttttttttttaatcgttaattattgtatgcaaaacaatttaagttataagttaagcaatgacatgttaatagttcaaactaaatactgttttacaaatgtaatagcatgttatgtagagtaaataattagtaccttttatcagaaaagaaaaaacgttactaccttctttttttttttactcaaaaacaaacaaaagaaactatcatttctttatttcagttaaataatataaagttttagtgatacgcaactgcataataaattatctttaagtacactctttttttgagtttaatgcaatttccgagacgaaaaaagcgaccgaccgacatgagaacaattaaccgtgtaacagcgcgggaaagatgtcgacaaggtgagttataaccgaaccggtttataccgttttacacgcgtcatttacgcgtaacatccacgtcttcccaaatctgacagatacagagatacttaacttggtccctttccttcttcttcttcaaatataaatatctttaatcaattcagaaccaaaccaagtcaatcattcttcattgatcttctccgatttgaaatcgccggcgaaaatg

SEQ ID NO: 11687 - DNA, 3000 bp, Unknown
  misc_feature (1)..( 3000): cDNA_ID_3022468_gDNA_ID_2214510_Annot_ID_184218 3000 nt of promoter + ATG
taaaaagatatatagaattatgatctatacatatccgtaagtatataattaagtggaatgcttatgagactttgaagattcaaaaggcttacaaatttctctaaccagtaaccatgcatgcacatttcttttttaagcacacatcattaccattcaccttaagtcttctaaatagatccttttgagattttgtctagattttccaatctttttctttaaattgtgatctcatttgttgttgatttgatgctaaagctagatttgaatcttgctttaaacacaaacaaaacgaaaaatttaattagttgaatatatatatttaattatgattaatgtgataacctttgaatgtttgattctatatgaatcaaaatttaaaataaagtaattacttccagtgatgagataaatttatccacactacaatcttgtcaatcaatttttttgtttataacgaatatatgtattccattggattgaagatcaatccttttcaataccatgcagaatcgaatttaagatatcgagaagaatggtaatatattgactaagttgagtcagccaaattttatccaaaaccggttaatattaatacaacacacaaataaaaatcaaatatgtcaaatgaaaatacctttaaatcaaccttaaatatattgtacttattaaagagaactacgaataaatttgtaactttattttaccaaattcacgggttgttaataccaccgactatatatgctttatagatttgttacttgatcttgaagctcccaaagattcttactaaagtttggtcaaaattaattatcaccatgaaatgatgaaagtaatttttttttcattcccatcactggcactggcagtttaaccgtttttttcccgttaatcagtgacaaattttttttgtgaaccaataaccttaaaagtataattaaaaaagttaaagacatgactaaggtttctgaaatccatggtgaacaaacaaaaatatttgggtaaaatgtcattgcaagcagacaacagttaaacagtacctccgggtcttgactgttaatcgcagtctatacagtcatctatgcgttatggaacgaccaaaacaatatggtcttcaacaatcttctcatcatcgtagaagtttctcttcaaaattgttgttttgattggcgaatcaatattatttgtattgcaagacgagaaattaccaaaggatagttaatctagacttcgaaacgaattatgtgaagttcatcaaattgataacaatttatattgcttaagagcctattatgtctcgcgttttatttgttaagattgattttttagctagttcttttttttttgtgcaaccgtttagctagttcaatttgtagtatatacaaggtttattatatgttttgccctactgttttaatgtattggccaatgaaaaaattataaaatatattaataaaaggtaaaacagaaaatttaatagttttcttaatttgtgtggaaaaacattaaacgacatgtaattcaaatggatggagtatataagagaaacaaatatatttgacaaatgatattagagtatcggtaaaattgacttcgtagacgtacataacgacctttaccatacccgaaaagtcaagtgtacagtttaaacaattaatgcaccgaatggagtttcatgctaacttaatattttattttgattcatattatattatttatagttataatgtgattcatatatattaaaaagtgataaatgaatatatacatatatatagtgatattttcatattattacaaacatattcctctctatataactatattttgtaatttgttttcaattttacatacattagataaaaaatagacactaaataaattcgcgatccttcattttttttttgttcacttaaagattaactttcttaaaataagattgcaaaatattgagatgaacgacgtttctggtacatgaagccggcatgacctaattctccggaaattaagttgacgtaaagatatatgaaaacaaagccttaacaaggaaagcaaagaagatgaaatgagagagtcagagaaattcacaagactcacacatgggaacgggtgacatgggagatctagtgataaatgtattttggacgttttgtggatattttcaacccacttttttttttttttttttttttttcttcaatattttcaacccacttaatactacagttttgctacaagccatatctctttttaactatttttaaaatctctggtatattctgtgattactctacagtttttagttacctaatattttttttttgaagtaaaagcagaacccaaaaacaccatcacaaagcacaaatctttgaaaacttctgagatagagacaaaacaaaagttgggtcctataaattttcattcatttttcatctttaaaattcatttatttcttcttttaaattattaattaaaactttaaaagttggaaaattcttcaaaaccgtacaactatatttgtgtggacctgaagccaaatgtctctctccattggccattttaccttctacacattcccactggccaaattcgaagttcattctctctcaaatcactttgcccaaatcttcctttttcccatatttgatttcttctttaaataaagcaaaaaagatttcatctttctatttattctctttataaattggaacctactttgcttcttcttcagtctccacacttatcttatttttgccagtcttctctgtggatgaagcagagtttttagtcaatcaaaagtttgaagctttccttcatgggtttctgatttgtctactaaagttttgatttttttaatttgggtattaataaaaaaagtggggagtgacacaagaagcagtatagtcattagttttccactaagcaaagcacccaaaagttcaccaacaacaaaggcctaatatgtgtctttgtttatgatttgggatcatctgaaacaagatg

SEQ ID NO: 11688 - DNA, 3000 bp, Unknown
  misc_feature (1)..( 3000): cDNA_ID_3022460_gDNA_ID_2214510_Annot_ID_184221 3000 nt of promoter + ATG
cttatttatcaaaagacaacaagacgatacaaacaaacaggaccaatgagtctgttttgcttcatcaggcagccttactaggcttttttttgtgaagctgcagatctaatggcggtttttgcaagcgtcgaaggcttgagtacactcttcgggttaatagcctttcttattttgaaagcaacccaggctgtgccaagcgcatatcctgctgcatcgagcccttcgtttgtcgcctcagccgctttaccaccatacctatattcatcaaaccaaaatttacatccttctcttaaaacactttccatatccaaataaccaggagtttcaattccaaatactcgattttacttacttgtgatcaacgagttcggttgtaacagtggaagaggttgacattacattcctcccagctacttcaacagcgtcacagaccttatctatcaaaacaggaatcaacagtttcaatgatcatgattacctaaagatagccgcatgaagtcgagttaagtatattgtagacttactgaatccgtcaagagatgcaaggatgacttctccaggaagaaggctgaagaatttctttcctactttggtgtttgccactgaacttgtgaagaatccagaaactttaaggactccagacagtatgctgtttgctacactctctgtcattttggtcatcctcttcactctgcataggcaacaacacaattagacaccaatacacgtaactatatgtcattttgctagagacgatgaacacatatcgtctcagctctcaaattacactcttcaggacacaccagaacaaatcaagatcatcaatcaaaacttatgtctcacaaaaaggattatcaaagacgttcacacaagtttctgtccagacaatttcctaaaatataaaccatattccaccaatttactgcaaacattccatgacacagctataacaaacacaaagatttcacctttcgagaaacatcacaaacctctaaatcaaaatcaaaatcaaattcattcataccttctgattcttttcaaggtgtcagggtgaacttcactctccttctcagcctttgacaacctccttttcatgaaaccatttccccaaataagcctatccatagtcacatctccacaccaaagaatcccttttatcaaatgtcctgagccagttgcaatcagcttcgccgccttcccgctataatcctccacattcggagccaaagtagtccaataagcagaacattgcctctccacaatctctttcctttccccagtaagctccaccggagacgtctctctcgccaccgtcacatccaaaaccttttcacctgcttccttcgcttcctctgacacctcctgcacagagaaactactataatcctccaagatcttctcaagctccaccagtaaatgctcttgacctttagaagcaattgtaagtccgtagttcaacatctcgttagtgtttttccctccatctccgtcttcttcgtcgcttgaatcatgtgagatctctttggtaggacgaagcgtgaagaagtaatgagactcatcgaccttgacagagttctcatccttagtcaacggccattgaatctcatcggagacactagcgagaacagcgacaacattctctccttgaacaatacggatgatctcaagatcaccgcaagcgagctcgacgctgtaagatttgtcgattaaatgaagaatcgcgccggagattttcaaaattacttcctccgtcgcagcgggaggagctgaaaccggaatagaactcgtctctggttgttcagggaagagattacgagcgagatcattcatatcgagagaaggatagagattgttagtagaagatgatgagctagggtttataggagcttcgggattggatgtgtcaacagtagggtaaagagaagaagtttgcttgtcgccggaggattccattttcgccggcgatttcaaatcggagaagatcaatgaagaatgattgacttggtttggttctgaattgattaaagatatttatatttgaagaagaagaaggaaagggaccaagttaagtatctctgtatctgtcagatttgggaagacgtggatgttacgcgtaaatgacgcgtgtaaaacggtataaaccggttcggttataactcaccttgtcgacatctttcccgcgctgttacacggttaattgttctcatgtcggtcggtcgcttttttcgtctcggaaattgcattaaactcaaaaaaagagtgtacttaaagataatttattatgcagttgcgtatcactaaaactttatattatttaactgaaataaagaaatgatagtttcttttgtttgtttttgagtaaaaaaaaaaagaaggtagtaacgttttttcttttctgataaaaggtactaattatttactctacataacatgctattacatttgtaaaacagtatttagtttgaactattaacatgtcattgcttaacttataacttaaattgttttgcatacaataattaacgattaaaaaaaaaaaaaacgattttagatttagttaacaaaataaattttaaacatgcttatatttggataatcttaatcagcaatataaccaccaaacatgtttgatgtttctaagttctagcagtcttgaagttctctttacatgataaaaaaaagaaaagacaaaatcccattaattctcattaaaaaacttagattggttcaaggaaaaaacattaagaccaatatcctctgtttttattaaggttttaaaaaacacacacacaaaactagtaacgaacattaaagagtttctctgataacatgccctttctcaacttcatcaaacagttctgtattaatagctctcaaattccagaaatcaccagacagtatctaactaacaataaagactcccctgcctctaaaaggttttaaagtttggttgatagacaaatcagttacagacttacagatttagattgccacgttaaa

SEQ ID NO: 11689 - DNA, 3000 bp, Unknown
  misc_feature (1)..( 3000): cDNA_ID_2994339_gDNA_ID_2214510_Annot_ID_184224 3000 nt of promoter + ATG
aagttaatagtgtttcaaataaaaagtttgttaaaattttgttttgtagtcatttgtagctagatgtagacttaaatactagtaagattctgattattatgacgtggaaatgaagaaattcgttattatctatcaatagaaaaacgcattgcattaggcttgtattaaatagttgtgacaagactaaatagcgcgttttatataataggaagttaggataagaggagatagcacacacaaccacgtttatatactatttttggtgtttagaaattttaattattaatagaaaagtgcattacaattatacatttaacaaaagaaacgaagaaattagaattatcaatagaaaagtgcattgcatttggcttgttttattatagtgtggaaagagtgcttttaggtattagggtgagacttgagagagatggtacacgtaaaggcctaaaccatgtttgtatgtactttttttggtgtttagaagtttgaatgatcaagttaggtttaagtggactatcaaaagagagatagccaaatgatagtaaactacattttccgtcttaaaaaaaaaaaaactaaaaacacactaattaatgttacaaagtttagatatttgtttagattttttttgctatgagatatttgtatgttctataatgtatattagtatatacatatgtaaacataaacctatacttaataatatatctctaaaatgcatagaaaagaataagataaatataataagaatatataaatttaaatatatgtatatatagcgctagaaaattaaagttttaaataaaatatctggttttcattatttaacacgatatgaaacaaatttatatatagattttagaccgatgtccctaaattgtaaagtccatatattttagttgatggttgaggggatccttctcccttttgattactaatcagactaattgtttggtggttagtgtaattatttgtaacactaaacttctaaaagctaattatgcaaggcctcttgttgtaacaataaacaacctttaacaataaaaatctcagaagacacaaaagaaaaaaagaagtccatatatttatttagtccatatatttcatacatattgtatcatgattctatagtgtctgtttacattttatgtatctttaaattacactgaatggttaaaaagataccgaatggaaaatgaatgtatctttttggtatcaaaatatgaaacatcgttgtccttttaacttttcatatttttattgatctttccaacagtatgggtgatatttcatattagttaataatagttacaactttagttaataagtaactatccgattgaaacaaagtagatcagtaatacaactatatttaccgatttcttccggatattcgcttagggataacatttaatcgaatgttttaagtttcatgagtaccaaaacaagaaaacaaataataacaatgtgaataataatgttatcaagttttgttatatgataccaaaaatagaaaaatttggtagatgacaataataacttcattgccactctcaagttcgttcgttcgttgaatcttatctcacttctcccattatttacaactgtggataagccttttagtctgactcagctttctcaagatccgaaaacacactgacccaacccggttcgattttgcttaaccggacaagatacattaatctgcctaatcttcaattatttaaaagctaactaaacgttatacgtactaatcacttcttcccctataaataaacctttctaatttctcatctcaaatcacactgcatcacaaaacccaaatcggaacttaaaccaaaagacaaacaaaaacgccgtcgtttcacgatgctttcttcttccccaaccttcttcgctactccatttctctcttcttcttcttcttcttctccgtcgttctcttctacttcaccaccgtcacgcatttcccggatctcgccgtcgctttctacaaccaccgcgtcctacacctgcgccgaagatctaccgagattacgccaaatcccgcagcgattttcagcaaccgcgtctctctacgagatccttgaaattcccgtcggctcgacgagtcaagagatcaaatcagcttaccggcgactagccaggatctgtcatcccgatgtagcgagaaatagtcgggataactcgtcggcggacgatttcatgaagatccacgcagcgtattgcacgctttcggatcccgagaaacgcgccgtttatgatcggaggactcttcttcggagccggccgttaacggctggatacggcagttacggtggacggaattgggaaaccgatcagtgctggtagcgagttgactcgatgtgtcgagttggtccaaaaccattgaattggttgtaattagagcaaacccagagattctgggtggttgtgccacgtaggatcaacacggtttatcgtgccacgtaggatctgtcgcgtttttagcctttgtatccataagtagtaagtagtctgtatttagtatttaccatctaataaagaaaataaaaatttatgtataacttaaagtgttccaacttagcaatcaatagtatgtagccttggagaaacagattttttttgttacaggtaagatttacatactgaaatcatatagcattcttagaaaattttagttgtattatgttgtagtcacctaatttaaaaagctgggagtgttttttttctagtcgcacaatcagccgacatcgacaataaaagaaaagaagatctatgtcaaatagtaacaaaaatacataaatacatatatatgtaaagattttaatactgttgcggtgcggttttgggtgtggtctatgttaccattcatggtcttagtctatcgaaagttcgataacgttgtttgccttggtggcagtgaattttttcctgtcacgcgactgtgaaaagagtaatttttagagacgttacaatcgcatatcgtgaattccgatg

SEQ ID NO: 11690 - DNA, 3000 bp, Unknown; identical to SEQ ID NO: 11686
  misc_feature (1)..( 3000): cDNA_ID_2711149_gDNA_ID_2214510_Annot_ID_184220 3000 nt of promoter + ATG

SEQ ID NO: 11691 - DNA, 3000 bp, Unknown
  misc_feature (1)..( 3000): cDNA_ID_1977311_gDNA_ID_2214510_Annot_ID_133818 3000 nt of promoter + ATG
tgcgtgatcttgtagtgcctatgcctgttcgtcagttcgtggtttctttttctctacttaccgtgatgttttaagaagatgatgaagttaatcccgttagttttttttaacctaattacacttgtgattagctgaatctttcggatataaacatttggatcccacgtgttctgttattggaagtgacttgatctttcttaacatatacaaagacaagcttctaatgtccaacacctcctttatttccgttaatacaaaatcccaccaattccagtacaattaacttactacacaacaccatacatgtctctttcctatcaaagtctttaaactaaataactttttccttaacaaacaaaagagagctttttcctcctctaacctttatctaaatttctagttttgaatttaggaagagatcctcaacaaatagttataaaaaaaaaatgtataattttcgaaaaggataacaagtatactagcttgattcgtaatttccatttcacaagtattaatgagaatattgaaataaaggaaatgatgagtgaacatgtatcggattctgtaatggcaaaactcatatagggaaaattgatattatgaaactttccataacacaaatccccgattctcttatataaacacgatccctaacttctcctgaatcatacaacatcaaacggtaacaatggatttggctaaagtctcttgctttctcttagcgattatgtttttcatcaatggtggttcctccaccacgttcaccatcgttaaccagtgtaactacaccgtctggccgggacttctctccggcgccggcaccgctccattacccaccactggtttctccctcaactcctttgagtcacgactcatctccatacccgccgcttggtccggccgcatatggggacgcacgctctgcaaccaaaacgaaatcaccggaatattcacttgcgtcaccggcgactgcggctcatcccaaatcgaatgctctggcgcaggagcaatccctccagctacactagccgaattcacactcaacggcgccgaaaatctagatttctacgacgttagcctcgtcgatggttacaacatcccaatgacgatcgttccttacggcggagctatcggagtcggtaagtgtaacgcaacgggttgcgcggcggatctcaacggcttatgtccggagcagctgaaagtaacggttgaagcggctggaacgggtgctgtggcgtgcaagagcgcttgtgaggcgtttggaacgccggagttttgttgtaacggcgcgtttggaacgccggacacgtgtcagccgagtgagtactctgttttctttaagaaaacttgtccgacggcttatagttacgcttatgacgacggcacaagcacttttacttgctccggtgctgattacgtcatcactttctgtccttctccttcaaggtaatatttttgctactgaatttactaaataaggaaagtaatattcgaaaaatgttaattttagtgttttttggtaattttaatgaatcttagattattcaaaattcatattttggaagttttgttaactgttttatatatttttgttgttgttgttgtgttttgaattagtgaagactttgagaagagtgtgtctccgcctctgcaaccggaagcagttagcgtctctgacgcgtcaagtagaatctcagttgcgttatcattggtcgttttggctgttgcggtttcttgggtgtggagtggactttggtgatattcaatacggcaccgaccttttttttttctttttcttttgtctttttgttcattctgttttttcaaactaaaattgttaaacagattttccaattaatttatgtgattgattttgttgcgactcaagaaaacgagttttttttgggctgaagtaaacattgactagttaatatcatactccctctgtttctaaatatttgtaatttaaggtttttgtacacaaattaaaaaaacatacaaatttcatttaatttattttttttctataaaatattattaattataactaatgcaaccaataaaaaaatatgatctaaaatataattggtttcttttttttccgacaatctaaaatataattggttaaaaactgttaaatacatttaatatttgcatagaaaaataaaaacaacacttatattgaaaaaaataaaaaaaatttaaactatatataattaaaaacagagggagtaatagattttaaaagattttatataatagtattgtcaaaaataataaagattatataacacacaaaaaaaaacaagagctgaaagcctcaaactacaataagtgacacaatatcactacaaaaacaaagtgtgtggattactatttagaagttcaaatattttcaatagaaaaaaaatttaaaactcaattttagatttttacgataaaataaatagctaaattatatagtaaaaatgaaatgtgtaagattaaaatttaatttaaaataaaaactactaaaagtagtttattaacaaagtgtatagattactatttaaaagtatttagaatttaaatatcagctaaatgtaccttagctaattaattatacattgatataatattaaattagttttcgcattacaagcaaaacaatcggcatttgagttcaatcagcgtaaaaacctaaagtttaaacaaaacaatgaaaaaaataaaatacaacagggtaagcgaatccgacggcggatacgccacgtatacaccactgccgccaaaatgaaaacagagtgctcaaatccaacggcggattaatacgaataaatttggctactactagtctactagtatatatatatatatactagtatatatatatatactgattcttgttcagagactctagaaaactaattcagcaacaaaatggattctttacacgttcttagatcctttcttcttcttttcattgtttttaatcatcttcctcgcacaactacatcaatg

SEQ ID NO: 11692 - DNA, 3000 bp, Unknown
  misc_feature (1)..( 3000): cDNA_ID_2707186_gDNA_ID_2214511_Annot_ID_133833 3000 nt of promoter + ATG
ccgcctcctagaccaccaccgccgcctaaacctccaccaccgcctaaacctccaccgcctcctaggccaccaccgcctcctagaccacctccgccgcctagaccgcctccaccgcccaaacccttaccgaaacctttcttgtaaatgccatgcttgtggaggaatggacgaggtttgtgtaaaaatggacgaggtttgtggaaaaagtgtttgtcgtcgttaacctcaacatttccgaacgaaaattcagcgactagagcgaatacaaagataaacacacacaccttcccggaaattaaacccataattaactggttcgttttatatggtgtatatgaaagagagatcgaagacagtagttgtgtcagtgaagcttagtcttgacctctatatatagacatatcgtccactcgtgagtacgttacatacataaccggttttgcttcttctttttctaggtttcttatcaattccggtttagtttagtttgttgatttgttcatatatactcaaattattctatttcagaggttgaaatgcttggttaaggcgtaaccgtgaggaaaagtgggaaaccggaattgattaaaccggacgtattaacttgtaagaaggcgaaaaaaataaattggttgagtaaactaaattaaatgaggttcacctgtcataggacaatttatttatgtctgccaactgcccagttgatctcatccaacataacaataaaaatgaaatcaatgtacatttgatgaattcaataaataaataatatcgatgtatatatatatgcacatgaaatgaaatgtatatcttatttccgattaagaaaatgagcaaacgattctagtgggcgccgatggtgaaaaaacctgaaattgatgaaaatatatactacaattggttcatgtactttgtcaaataataataattggttcatgttctaaaaaccagactgatcatattcgtagaatgcaatcatcagttcaccatatgtatatgattcctcataaatcaaccttccatggatttatagcaaaaagaacagtgtgtttctcttttagtgtattttcataaaagacgtaccataaatgaataaattgtgtcgttatcaaaaaaacaaaagtttataatcgtggctgttttatttttccttttatagttgaaggacatgtctactacaaagccattaataatatgagggctcttttgcattattcaagccctaaatgtgatctcatttagtgaaaaaaaagtgatctcatttattatgtcattaatggctcaaaccaaacacatattaaacctttcattttccaaactaacaaataaagaaaaacagataggcttatacattatacatgcatcacccacatagatttagattattaaaaatttgaggttgactggtttgagctgtgaatgtaatcttttatttaatttggactgtttgttgttagaataatggttgggacttaaattttaaagtcaactagtgatttgaaaaaaaaacgaggcttaacaagaatatttaactagttaatctagggctaacttgttagtaagaaatttaagaaatacgtttaatacttcataacactacaagtgtggattgttcatttcacatcataaagtactaaaacttcaaattaagtgccaaatgaatatcctatgcattttttttttgtaaaaaaattagattggttctattgagaatatgcatgcaatcttttggttacagacctctagttaaaggattttaattagttcttattttctatttagaatttgaattagtttcataaaacatatgcagtgatcagtttataaggtcaaatctcaccctcaaaatacaaacatatttcacgagtttgcccaaaaagaaagaactagtatttgacgcaagttttcattttgaaccattcgtaagctataactagaagattaaatacggtagaataatgaatgtattatgggaaaaatgttaaaaaaatcgccaacttttaaaaatgggacaaaaaaatcgccaactcctgaaatgtcatttaaatcatatacttttggttgacttttccagaaagataataaagcaaagattcgtaatcaacaaaactttgctctgttatctttctaaagaactcaatcaaaagtatgtgattaaaacgacatttcaggagttggtgatttttcatcccatttttcaaagttggcaatttttttgacattttttccaatgtattattgagtgtagctacatgaagtatgaaccatttatcttgacatagcattgcgtactttgaaaataatttctttactaataaaaaaacctacacttttttttataataaattttttcactctgtttagaaaccatgaattggctgctctaacgattcaagagaaatttcggcctaccttcgagttgactttagattaaaagtcaatcacaggcccaaaagtaagcccataactaggtccaaatatcgaagcccatgaataaactttttcatcgaatcctaaagctaagcatcaaaccaaacatccgatgatctctccaaactcatcaatctgatctatctctctcttccagctgtttcatgatcgatttactcttaacttacagctgattacaattcactgtaatctctcaagaaccctagattcttttttttccttttcaattgtgatccgtcaggtatgtgaattcgattactttctatatcaattcaacgaattccaaaagtcatgttcgcgtataagcaatttaaccttgtcgatttctttatattttctctgtatgtgtagcagcaatgcttgatctttaaatttactgatatctgaagatcgaattagggttctgatctacttgatatttatttgtttgggcttttattcaggttagtgtctgtttattaaaacaatcgaattattctgagttcatatcatttctttggattgaagatttgaattccttttatagcagctcgatcttgggctgaagct

SEQ ID NO: 11693 - DNA, 3000 bp, Unknown
  misc_feature (1)..( 3000): cDNA_ID_1832112_gDNA_ID_2214511_Annot_ID_133836 3000 nt of promoter + ATG
cgtagtactgctccatcatttctcttgcactctcgctgtgacccacgtcctcaaaatcatccgttgcatccttacctgaaaagagaataagaatcaaaaaccgatggattgatctccactaagccgggagcatggtgatagttgtgtttatacagacctgttgaagacaagagaacatcgtccccacctggatggtcttcaagaaacttggtcacattgtacacctgcatttttttgcaaatgtgtgaagttaggagaggcaaatgaaacccaattacagaacttctgaactttgaagatttcttgtcaaatcaagaagtttaaaacatgggaagatccacttctgaggcttatgattaaaatgtaagaaacaatggagcaacaaaaagaaaagttcttaggttatcgctttctttggactaaacaagatatggtgcatataactctaaaaatcaaacaataggaatagaaagatgaatacttgaaacaaattactgtaccaacaaccaagtccagagatacatttgggatcttctgaacttgataaaaaggattgttctgtgtacatagcaaacttgttgcacagaggtaaactcccaaaaaaaatgaacttaagtgacaatattaataagaaacataaactactgatggaacaacagaccaaaacatttaatgtttcctactttcttgtgataatctactgatttcacaaaccaatcaatgaagaaaacaaaaatcaagttcactatgaagggaggctcaaggatgtatctacagattccttcacaagttaataatcacaatacaaaaacgatcgatcttcagggcaaacaactaatcgacaagtgtcagtagtccatcccaagaaaggttgatgtcgatcaaacaaactctaaagacaataagaactatttctacatttctccatcttcaatcaaaattagaaaattttcagctgataaatagatcaaaagagctaaatcttcagcataagcttaataactacaccattttctactctctctacccatctaaagatttgatctgataattttagacttagaaatctgagacttcaaaagcttaatctcatgcaaacaccaaaaggggaaactttgaagcacgagatctctaatttcagaggtgagaataaggagaaagaagaatgaaacctttccattgatgacaatccaacagtcatgagcttgattatgctctgaaacttctgaaagagtgaagatctttgcttcgtctcccattgtttgtttgattcttgtctaccagaattaacccaccaaaacctgactctgagacttaaagctcaaaactttatacaagagtgtgagagagagttgttgagttaaagaccatttgacgaatcagttaaattccggtttaatttggttcgttctcaaagtaatcggttggtgagttttggaagctttgaaaaccggtttaatgaaaattgattttgagtttgttctcacatagtctgtacctaattgctgctctactgttttggccttatggtattcatctgtacgattttgaaaacatatgtgccaatgttgaaccgatgggttaagtggtttggtagtagttgttatttccggttgagtggatggggtaggtaggtaggcagtgcaaatgttgcggttgtgcgctctaattctgcctttttcattcaagatcggtaggtgaatgatgtgcaataaattttattatggtacatatgaattcttttctcataagtaatatttatgtagttttatattagtagatacaactacataagaaaaataaattgccgctgcttcataccaactgaccttatttattagggacacaaatctttttctttctaaagcttatataaaatgtacatattattcaaaatcaatagattgaccggtgaatttctgaccttgtaaacgaaaagaggtctgagaagtttcaaatttgaaccatcgacaatgaaaaaaatacattagccatgttctctagagaaaaacaagcaggttaaccaaaagattagaaccatcattttctttatgttttttagtaccaaataatgttattaaaagaaaaagttatacttttaggaccaccaaatctttttcaatactaaaaattgttgctttgaaaatattaaatacaatttacacattaaaaaaaactaatatatatataattttaaaatgaacaataaatataaataactaaaatcgtgtttgtttgttcatacactattttcattgaacttctgatacgataaacagataactaaaaaaaaaattgaatgcatatgtttttgaattacatcttgaaatgatttataagctaaataactagatgactttgttacataatcgagctaatggtcgaccacaccatcatcatagtttacgcttaccatttcgtgtaatgagctgaatcgatttatgataattttgtttataaaatttgattaaccgactgtaagtttattaatttctctatgatgccttgcatatctctataaagctttgtattatgttctgaattgcaacacattttattgatatgatatgatgataatttagcaattagggtatcctaaaagctcctaaaacttaaaattgtatgaccaaccaattttgtaaaagcaataaggagtttttgtaaatcttcaaaatatattggatccataactcaataacacaaaacttgagactaaaatcataataaagctatacattcggggcagtttttaatatcctgacttgttgggtaagtctctaaatattcgtagtttgcatccaagtccctgacttactatcttctcccaaatctccttttatttttactttcgtcctataaactaaaataaataaggaaaacactcttcttcaaatccagtagagagattcaagacgagtctcatcgaaagttcgaatctttcgtcatctgattagctttctcttagggtttatttcgatttcgatttagtgttctccatca

SEQ ID NO: 11694 - DNA, 3000 bp, Unknown
  misc_feature (1)..( 3000): cDNA_ID_2707198_gDNA_ID_2214511_Annot_ID_133839 3000 nt of promoter + ATG
tgatgaaaccagttccaaagctttgggttgtcatctcaagtgcctttgtgttctgtcttttagttctgtttcaaatcaataaatcagatttgatcgaagcaaatctccaaatcactcatcaagttaacaacttcctcatctccttcgttgcttcttcaaataatcaaatcctaaatcacaccaaacatgcgaatgagagtgatggaatcagagcgaaacagcttgaggaagaagaaacggatacttgcgccggaagatacatctacatgtacaatcttccaagcacattcaacgacgacatcatcaaagaatgtcgtccactcatcaaatggttcgatatgtgtccattcatggtcaattccgggctcggtccacagattttggtctccgataaaaccacagctcgagtcttaaccgtgaaaaccggttcttggtactcaacgaaccaattcttgctttcggttatcttccgagagaggatgaaacactacgagtgtttgaccaacaactcttctctagcctcagcgatctatgtcccatactacgcaggatttgatgtgagccgtcacctctggggatacaacgtgacggttagagacgaattggcgataaagctggcacaatggctgagagagagacctgaatgggggaagatgtacggccgagatcacttctttgtgaccggacggattggttgggatttcaggaggtttcacgatgaagattcagattggggaagcaaactgatgctattacctgaattctcgaatctgacaatgttaggtatcgaaacgactgcttgggctaacgaatttgcgattccttatcctacttatttccatccaaagagcttaacagagatttggagatggcagaagaaagtgaagagtgtgaagaggaagtatttgttttcgtttgttggaggtccaagacctaaattggatggatctattaggggagagattataaagcagtgccttgcatctcacggtaaatgcaactttcttaactgctttgttaatgactgcgataatccggttaagataatgaaggtgtttgaaaattctgtcttctgtttacaaccttcgggagattcgtacactcggagatcgatattcgattcgattctggcgggttgtataccggttttcttcagcccaggttcgggttacaaccaatatatttggtattttccaaaggattataccaagtactcggtttacataccagagaatgaaatgagaaatggaacggttagtctcaagaatattttgggtatgatcgctaaggagaggattttgaggatgagaaaagaggttgtgaagattataccaaaaatcatatataataaaccagggtttggaccggagaagattgaagatgcgtttgacattgcagtggataggatgcttgagagggtagcaatggttaagaggatgatggaagaagggaaagatgttcaaagtcagtattattcacagacaaaggatttgaaaaaacttgagattatacatgaaaaaactgcttaagccttaagacattgttaatgaatgcacattcagtatttatagcatgttgaatcacatttcagatacattttggaattgtaagtaaatcaatcgattttgttttacaaggatgcataaattacaaatttctctctttctcgttccttaagatgtggagcaaccaaaaactatatgaatatgatctctcgaaagaaacttaatttcgaatactatataataaatggattttgatgtatgaatgagaatgttttgaaactatgacaagagaatttgacttttcgttagcaagaatttggatggctaaattagatatggaagttaacatacacataaaaagttagctgaatgttaaactgtagtctattcgaaatatgaagtttaaagtagaatgtgaatggtaaatgttaaagttaaattaagatacataataattggttcaaacttgagataaccaggacgaaataattggtttggtacaaagtacaaaacaactttggttaaaggaatcatactttccacgaggaatcgccagttcgccaccagttggccggatcgaacggtgcctactgcttaacccggtctttagataatacccacctgttaagtcattcgggtcatctctgacccggaagtttctaatctctctctctttcctaaagtaacaaactttaaattttctgcaaaatcgaacaacgaatcatcagcccgagaagcttcttcaatcctgtaaatttttcattctacgtaccaatctctcatttcccagattcgtttcttgcttccattgctcttcctttgtaccaatcatcatctccaggtgatcggtttattaaaaattagggtttttgattgttctaatccgatctctcggttcctttaagattgatgatgaatttcgaagcgtgatatgaaaagatctgaagacttgatgtcagaacttgcgttgcgtgggttccgagataattgttgatggaaagagtatcagagcgaagtttgtcagaaaatttgagaagaagcgatcgagaagatgggaagattatagaatgggaagaattcgaccatgagcttacgaggttatggagtctttcttctgctatgaaattagccacagagaggaaacaaatcctgcaaccgaaacttgagtctcttattcaggtttttctcttactcatgtgttttcttttgggcatgtctgaatttgattcatttctgagtgtaaagcatagatttttattagtggcattgtcttaagggtggatgaagatagctagaagaagaaactctattcaaagaaaatttatgctttcttattgtgttggttaggaatgtgttgtttagtcttattattcttgcttatctcttactttatctactcgatgagctttaattgattagcccgcggattagcgggcggcaaaatttcgggcaggttagtactgaatcattgagacgcactaatgaacttgaagaa

SEQ ID NO: 11695 - DNA, 330 bp, Unknown
  misc_feature (1)..( 330): cDNA_ID_3022482_gDNA_ID_2214511_Annot_ID_184259 3000 nt of promoter + ATG
tagagaaaaggaaatagaaggaagtttacttttgagccaaggaaactttatccaaaacaaaatcataatctgaccaggatattgcaataaggatacacacatagatcttgttgttgcttcattaattgcgttattctcaagttacagctgtgaaattaatttattatttgctgttgttaagtttaattttatttttgggctatgttgcacttttataaacgtttggggatattttaacatttagtagaaatagatatgggtatcgtcttcgagttcgagatacacgctaaaaggaaaatctgtggactttgatgagcttttacttcaatg

SEQ ID NO: 11696 - DNA, 3000 bp, Unknown; identical to SEQ ID NO: 11693
  misc_feature (1)..( 3000): cDNA_ID_1832112_gDNA_ID_2214511_Annot_ID_184248 3000 nt of promoter + ATG

SEQ ID NO: 11697 - DNA, 3000 bp, Unknown
  misc_feature (1)..( 3000): cDNA_ID_1013306_gDNA_ID_2214511_Annot_ID_184246 3000 nt of promoter + ATG
cttgtgatatttccaatctttgtctaatgatcctacttctttacttcgttgttttgatctctagtgtttagagtgaaagagagatgtaagtaatttctctagaccaactacattgttgaataataatttcttataatcagccaaacgcttgtttttaaggtctctttacgaatatcttataatgacactgcatacattaagttggtttaagatgaatacaaaactctaagcatgcacattgaaagtactcgtacgttaaaacttaggattaaggatgagtttattatctgcttaggcttaaattgtctttgttctgggttacttattgaacttctaatataaccgcatctttcttgaatgactctgcctctctttcaaaattatttgtttcagcatcactgtaacatttattgtaaaaatagtttttttgggtttgaataaatttaactttcaactcaaaaaaaaagaaaaactcgatattatatatagaaaacggaaatgtgaaacataaggagaagtaaaaagcacggttacgtttgtgtttgtttacaatttacaaacacgtctaacttggaaaaactaaaataaatgtacttttttttttttggtctaaaataaatgtacttttttcttaaacatgaacttattttttgtaacagttgagtggttgaatgaatcattaatttaagttatctttagtttctcaatcgataatatatacctactcaaacctttatacaatactataagatataaaatactcctactccttcccaattctcaaaactgcttaaactttcataatcatctaactcttgtaatttatataatctagtcattagattcatcagtatattctcaatattacaaaggctaaatatcttatgctacattatccaagcaattcgcagaaaacaataaaaataaaattgtcaaacatcataagcctagtagagaagtagaagttgacattccaaattcgtccaatctctacctcaactagatttaaaactttttatcctaaggtaagtaaaatacacaaaagtagagcaaaatacgatccttgaattaattcaggttgtgtaaccgttcaatcttttctaacgctgtgacacatatttgaacccaactaactcaaatttttttattttaaatataatttataaatgtggaaaaaaataataaatttataaataaaaatatatgtcatcatttctatttataaatatcgaaattattacactcaagttctaaaatattttttttttttaaaaactaaagtgaaaaaatagcaaagtacattactcacagtagtgaagaagcagccacctgaaaaaaaaaataacacacacaaaaaaagagagagagagagagagagagagagagagagagagagaccccacaaagagcactaatcttcacaaccctaactccgatttttctcacacctcccaatctctctttctttctctctgatgaaaagctaacggaaaatggggaaatacataagaaagagcaaaatcgacggagctggagctggagctggtggtggaggtggaggcggaggtggaggtgaatcctctattgctttaatggatgttgtttcaccttcttcctcttcttcacttggtgttttaactcgagctaaatctctagctcttcaacaacaacaacaacgctgtcttcttcaaaaaccctcttctccttcttcgttaccaccgacttctgcttctcctaatccaccgtcaaagcagaagatgaagaagaagcagcagcagatgaacgattgtggttcgtatcttcagctacggagtcgtcggcttcagaagaaaccaccaattgttgtgattcgttctactaaacggaggaaacagcaacggaggaatgagacatgcggaagaaaccctaaccctaggagtaatttggattcgattcgtggtgatgggtctaggtctgattctgtttctgaaagtgttgtctttggtaaagacaaggatttgatttctgaaatcaataaagatccaacctttggccaaaatttcttcgaccttgaagaagaacacactcaaaggtatcatctttcttcatcaatttcaacctaattttttgggggatttcttatttttatgaatctgtgtgaatttgttctgtttcttgagaaaactttggtattggatttgaaaatttccgttgttaatttgaaaaaaggatcaattttttgtcttgtatttggttaaaattgaaactggcgttttcgattttgaaatttaatgatatttttaccatgtgtatgatatgatgccatcttttctttatctgacaacaccagactcttctctctgtttccgggaaagaaaatatatataattaatcaaaaatgtgtttcttttttcttgagaaagtttttattttttcttcaattactttgaagaaggtgatagtgactattgttttttcttcagactttttatctgctttcatgtaaagaatgttggatttgtgtttgaaatgtctctgtaagtaactctttaaagtttggttcgtttttgggattctgcaaagtatatgatgtgtctctgtaacatcttaagttctagtttctctgtcttttaatttttcttgctgtttggttgttttttgatgttatgatttcagtctaaagtcgtgatcttgttgaacattgtatgagtcattaacttttcaagcattgctgaagtaatcttcattggaagtttcttctttggttttatgctttgtgaactttgaaccacaaatcaacaaggagtttctccttgtccttttttcagttaaacatgacttgcttagttttagttatctatatgcaataaagtttgcttgcttttgctgctaattaaggaaacacggttatgtgctttttccttgagagcattgtatgaaagtaacatattacttactctcagcttcaacaggaccacaagggaatccacaccatgcagtttgataagaaggcctgaaatc

SEQ ID NO: 11698 - DNA, 3000 bp, Unknown; identical to SEQ ID NO: 11692
  misc_feature (1)..( 3000): cDNA_ID_3022512_gDNA_ID_2214511_Annot_ID_184244 3000 nt of promoter + ATG

SEQ ID NO: 11699 - DNA, 330 bp, Unknown; identical to SEQ ID NO: 11695
  misc_feature (1)..( 330): cDNA_ID_2707214_gDNA_ID_2214511_Annot_ID_133844 3000 nt of promoter + ATG

SEQ ID NO: 11700 - DNA, 3000 bp, Unknown
  misc_feature (1)..( 3000): cDNA_ID_2711220_gDNA_ID_2214512_Annot_ID_133845 3000 nt of promoter + ATG
atttattatttaatccaattttgttcaggcctaaaaaaaattacgatcatgcatgcatgtttggatgagccatccacatatgtaagattttacgaccaaagtttcattgtcaaatcagaatttttatcaaatcattctgaagtatgttatttaaatattcaaaagatgacaaagaagattatggaacaagtataaatggaaaataatatttggatgattggagcaacatggttacggaacgtgacaattggagaagaatacggatcgaaattggaacaatgatcacaccgaaaggttctttaaatttctccaaaattaaatttctttcgtatacttgaatgttttcttaagtcaaacatttgattactcacatttttcaagttcatgcatttaaattaacgtgctaatggcgagactaagaaagataagatttttaactactcgaatatacttttccggtaattacttaattaatattcaaggtcaattggaggatcatgatgccgaatgagtactaattgcattcatgttcaagggatcgaagttgatttgtgactcaaccctttgcttaaacctagaagagtggtgctatatgaaaatttgagtatgtgctataggataagcttttagcccaagttatgtatgtttttaaaaaacatttcgttgctttctttaactagaaaatatatgtatattataatatatctagtataccaaccaatcccaagtaaagtaaagcttattgaaactaaaccaaatcaacttatgaatcaacatatttttttctaatataatgtaacttcaaacgaaacaaaaaacaatcagaatttattttaaattaattgtttagataaaaatacaatgaaaagagtattatttaattgttcggatagtaataatactagtgattattcatttctcggcttagttttgaaaactgatcaaaaccaaaccagaaaaaaactataaaaccgtatgaaatactgaaaatcccaataggtatgtacataatgatgtatgatatatctgatcaagtataaggattcgagtatgcgaccatatagtcatataccaatcatcaaactatatatagattttcaaatattatttattttacagactcataattatgttgtctatggctgatcacatgcattgcaagatctcaaaaatatcatgtataaattcacgtaacacatttattacgcatgcatatatgctttgccgcatttatgtagaaggacatcatgttgagttcatgtttctctttgattgttacgtattttgtctaaatactgaccaaatattagttgtttcgttacgtaattatgttagttgaggttggagactgattttcagaagcaatttacaccttaattagtaaatatcattaaccgcagtaacatactgatatttactggcactggtccttcaatcttctaattatagttaaactaaatttgaaaatttgatcatgtcataagagcaagaaaaaaaattcgtgaataattctttcatttttatgggcttttagtattttagaagatagagtgaccattttatttaatgtagtcgttgacatttacacactatattaaaactcgatatagccatgtgatcatgatggatataaactcaaatcgatttgttaattgagaagccaatctaatttaattattcaacataaaaaataaacagtctatttttgtgtcttcagatggcaattgttattagttttcatcgaattgatccagccatctacatacataacataaaggcgcggggaaattaaacatacatcatatttgtagacttgtagttgtgaattttgaaaaagtaatacaaagtatgtaatggaaaaaatgtatcgtttctagacttggaaaacgttgggctttgaaccagaagaaggaaacatattgggtttctgaaaggtaaacgagacctacaaatacagtccttcataaataatgggcccataacatccatacttgtgtgagacagacgtttgttatgtcttcaatcatgaacatataattcctttttttcatttttttcagcaagaacaaataattcttaatcaacttacaactttaaattttttatgcttgttatatgatattatgttaaggcatggctcaatgtttttagattttcaaccaaggcctatattgagaatttgagagcttataactttttcttttcttttcaactgtacgataaattaaaataatgtatagagaggtttgcaggagccatgccttgcatatattcccgcccaattatcctgcagaattttctccacgtgacattacagtaaattccaacagtgcatgatagataatttttgtttctaagtttcttctccacttgattgatatattctgctgttttatttaccgcattatacatcagattcaccttctttaccgaagtttgattacaaatttacaaagtatcgtgaaatcgtcatgggtaataaaatcatgacaccaacatactaaacttgaaatcttaaaaagcataaacagaaaaaataatattattatctgaatcaattgattaagttcaaaagaatatcaaactgtttatgtaaagagacaaaaaaaatattttctgattcagtgaattaagttgataaggaaactgatcaataagcatttgcatatagataacgtggaaactgagagtacaactttgttttgcaataattcatgcatgcgtcgctttatcgactaatattcgtacataacaagttgtactcacacaagtcataagtacattatcattaaataacatagactatggaatcaagtaacatttaggtcacttatattttaatgcaccgcatctaacgcgattagtcattaatacacggatcgtccgatctaaaataaaatttgtttttattttatatatacagtatataacctttctcattatttcttcttaaatcattacaatcatcacaaagccatcgcaaattagaagagatttaag

SEQ ID NO: 11701 - DNA, 3000 bp, Unknown
  misc_feature (1)..( 3000): cDNA_ID_2707257_gDNA_ID_2214512_Annot_ID_133847 3000 nt of promoter + ATG
accattaacggggatttaggtttttggtccatatatataaacagagctcgtgattatgtatagcgccttgtcacactaaccaaaatcaagtgctttccgatcattaaagttatattttgttaagtttaacgaatcttctacttaaaattaagattgactcatatatcactaatgtgattttaatcatctatggacccaaaaattctgaaaattttaaattttggaagctaaacaaaaggaaaattaaataagaaatgtaactaaataaaattataaacaggtggatgggaaaaatgttgggaagaagagataacaccatgggaccaagggagagccacacctctcattgttcatcttgtcgacacttcctcactcccacttggccgtgctctggtccccggctgtggtggagtcagtcttcttctagcttacctctctctctatctttccatttggttatatatatatggtttgaattctatttttaaaatgaaaattttaatatagaaaaatatattcttaacaatttcagatttttgtgataaaaaccgaatctagtttgaattagtatgatacggttttggactcaacatcttttttttttatgaagacgcaatataacttcatttacatttcttaaaggaagtttaattttggtgtagtttttcttcatttattttggttgctcttcagttttgttattggttttttaagatgtgaatgtaaaaatattatttgtaattagaaaaaaaaaactatttaaactgaattaaaatcatccagttggccttttatgaatttcactacttaattaagattgaaccaattttacttaattaagattgaaccaatattatttggttagcctccctagtgaaacattttcataatgaaatgattgttacttaacattgtgaataaatatgttatgaatgtgagtagggacacgacgtcgttgcgatggcaagtcctgaacgcttcgttgttggattggatatttccgaaagcgcactcgcgaaagctaatgaggttaattggttaatcatctcactttcttacgtattcgtctttagatactgaaaattaataatattttatgttgactacatatagacttacggctcctcaccaaaggcagagtacttttcgttcgtgaaggaagatgttttcacgtggcgtcctactgaattattcgacctcatcttcgattatgtgtgagtttattaacttataattgaaaacataattaaggtttgcattacgtaactaaacaaaaaatttggttagaaacattaatgtgaaggaccaggctaaggtgttttatttattaaaaaggtaacgaaaattcaattaactagtaattattaacaggttcttctgtgccattgaaccggagatgagacctgcatgggctaaatctatgtatgaactcttaaaacctgacggcgaactcataactctcatgtatccggtaataattttaatttttgggtaaatattccataatttagctatatataatcaaagactaagtggattaatacttttgcctttatattaattagattaccgaccacgttggtggacctccctacaaagtagatgtctctacgtatgtaatcaatccctcagtttctcttatacataattatagacttatatatatgaataattggatatagctaaacttaaatgttaattattgtgtgttttatgtggatcagcttcgaagaggtgttggtgcctataggatttaaggcagtgtctgtcgaggagaatcctcacgccattccaactcgtaaggtacaatagaagtatactcacatcgtgcgatattatacttatattcaacgtactagacattctttcatttttagataattttatacattcaattaatatactacttaattaattaaaccgtttaaccaaaaaaattctttcagttttttttataataaatttatttgtttattaataggttttctaaactgaattgtgtcataaatattgacttttttggggctacatgaaacactaaaaagaaatggacatggcaaataggtatctctgtgtagttgtgctatcttatgtggatctgataaataaaaaccaaatggacagggcaaagagaagctgggaaggtggaagaagatcaattgatccctaagaaagagatcttactgtttggtaagagtgttatatgtgtgatctacaaagagtaaaatgattatcttcctttatttgctctatgtatgtttcaatgttgatgattattatgagtaacaataatgtttattatcaaacaatctcttttatcatacttaaaactaaaataatacaaacaaaaaacataataaacggagttataggtgaatgtatagtagatatgcaagcaaaatgatataaacccacaaaaaaagtgctccttaacgttgcaatttaagttatttaacccaaagcatgtagaaccaaaatgaacagagtcattatccgttgcatgactaacaaggaagaagcaaaacatcaaccaaaaccgtaagactcaaggggtcactggcttcttgcttcgacgtgacgttagacatctttggaaccctaaattccacaagaaggaacacacactgattacaggggcagcggaatcaacgtccgacaatattattgggccttttctcaactcaaaagcccaatacattggtagcccatatgattaaaatgaatctcttttgttattacattcacacttagacataaacactcaaataatacaaaaacgaaagaagaagatgataaattaaggcaaagagagatggagcgtattgcagagaaatcttccatgaaaaatggagaagaagctagagaagcaacaaactctcttcttctcgccatgtttctcccgaacacttcgctccatctctctctttcttctcttacattttcttctccccatttctctcattctctcttcctcttctctttcctcaatctttcgccatg

SEQ ID NO: 11702 - DNA, 3000 bp, Unknown
  misc_feature (1)..( 3000): cDNA_ID_1448051_gDNA_ID_2214512_Annot_ID_133848 3000 nt of promoter + ATG
ttgaaccggagatgagacctgcatggggtaaatccatgcatgaactcctcaaacctgacggagaacttataactcttatgtatccggtaattatttcatatttttgtcgtgagaatgttccatatacaaattcaatgatatataaatatatgaattaatactttgcctttctattaattagatgaccgaccacgagggtggagctccctacaaagtagctttgtcttcgtacgtagttaacccctcaatatgtcatatatatacaaaatcatttaagattattaatgactaattaaaatccataattgtactatactttcttaactaaatgtgtgtgtgtgtgtgttttcttttgagagtttagctacgaagatgtgttggttccggtaggatttaaagcggtgtccgttgaggagaacccagactccattcccactcgtaaggtactgtgcgagatgacatatatgttatatcaaaatataagtcgatattttattttggtatataaacatgcttgtgagttgtgttttattattagttgcatgttcaaatcgcattataatgataattccttcggatgtattataacagggcaaagagaagcttgcgaggtggaagaagattaactgattcaagggagagtcagagagatcatatcttactgtttagtaagatcagtgttatatatgtgtgtaaaatcctaatctattaagaataaactgagtatcatatactctatgtaagatatatgtgtttaaaggtgaatgcttatcaggccgtgaccagcgtctacgtacgccacgacggtggcgatctctccccttgttgttatgtcacatgttccttatctgtatctgtgttatattgtgtttcagtttaataaagtttctcctttccaattagagttttttactctattgattggtgtggagttttgtttctaaagaattgtctttgccagctttcgagtttcttttccttatccacgtgatatggctacaattctgatcattctcgcagcttcttcaatgacttttataaagaaacataaaataatatgccctggtggagagcttatcataacatgcattgatatgatgcttcctgtaagaaaaaacataaaaacatgtctctcatcagaacaaatatcttgggactctgaaatgtatctttattattttatgttatgcagttcgatgatcgcttggaacctccataccaagtatcagtttcatcttctcttaatcttttcacgactctataactctcttaacgtctctcagttttggttaaatatcaaacttgtttaactgttttgtagctatgaagagcttttgattccctcaggatatttgaggtcatctctattgtggataacgaacttgctccagatacaagaccgggaaaaaaataatttccacttcagatcactttatattcatagcgaaacaagcaagataaaaaaaaaaagaaggacgtttaattaaagtttgaagttcacttttagggaatgtaaaaagttggccgatggaagaagaagaagaagtcaatgtgataatacctcattaccatcacatcacactctcatggctctaaagtattgtaataaaatttacattgttggttctcctaatagagtcataacctacacgtctaaatacataaatatatcaaaagtttcaatttgtaataaataaagtgtctattgaatgagacgcaatgtctaattttctcatccacaatattccttgttggttaaatcggtacaccttacagagaaagagatatgttacacacagtcagatttggaaacagttgtcgttttgtgttttaaaaacgatgccgtgcttactttcaatccagtgtaaatgggagttaggtcgtatcttggattattgcttctattaaattttgaggtggtcccttgtaatcactctcactcgtgcgtgagtccgtgatctcagaaagagtcgtttttggaggtaagaccattttcaatgtacaattctatttttcttctaaaattttttattttttatttttagaaataagtttattttaaaagaaagaaagttgattttgttcaaatgtatgactttaaaataaaattatctctaaaatagagaaaaaaatatagtagttttactttttactctatatactgagttatccctatttttttctctgttttataggtaactctatttgagagtcaatacattagagtaaaatcaattttatttcctattaaataaaattatttttaaaataggaaaataaaataaaaataggcattagaaatgatctaaatcatccaactatttattggaaattggtgaataattgagtgaaactagggccactatttccacttgcttctgattttcataccatggataagatgcgtcataagtcatggtcttttttatatattataataatggaatcaaattgatactatagagtatatatagtcttctgaattctgatgaaatgtaaaacgggaatattaaaataatgtttcgtactaaaaattattttataaatacatcaatatacttaattttaaattttcgaatgtcagatatattaaaaatgctataatgatcattttaattgttttttctctatatgaaacaccaaaggtataagtctaccaaaatgctataatgtatgtagttaaattgtccaatatatgattggggactaaaattctaacgtagctacgtgttccaatgagagaacacacaaaatgagcacaaagtatagaggttgaaacacacaataatatagctttatacaaagtcactttattcaattattgtattttaattcacaattcaattattgttttataaattgaatatagtaattcaatttgctatcctctatatagatagatatcatgtgcttatagctttccacaacttcaagacccccaaaaaatatcaaagtgtcattaatagaaagacgagaaagaaagaccaaccctgaaacatg

SEQ ID NO: 11703 - DNA, 3000 bp, Unknown
  misc_feature (1)..( 3000): cDNA_ID_2711210_gDNA_ID_2214512_Annot_ID_133851 3000 nt of promoter + ATG
tttattcgatttttcactattgtatagtatagtttcacattcttgaacaaaaaaatcgtgctaaccataactaattaaacgaaaaaattgaggaatatttacctaagtaacgttaataaaatgctttcatagcaaaataaagtaataaacgatccctaatttactgaattttagaataaacgaaatgtaaagaattaaaagaaaataaagagagacaagtgatgttatcaaaaagtaagaaaaacaagaaccgtccgtttcatacttgtgtcttgttgtacttgttaaacttgaatcccgtgttcgcgactttgcgatagattctctcaaatccaattccaatggcggatccatcttctcaaaaccctaacctcgccactccccctcctccttcttctccttcaccaacccatcaaattcaatctggaacctcggaattatcgccaccgtctcgaccgccttgctctaccttgtcctttctcaagactgctaaccgaccaaaactccgtgtgacatctgaattcgacagcgatagtctccttttcttaaacaaagtgtcttgtaagctcttcgataaccttgccaagcttaaactctcgtttcagaacaattcccagcgcgagatttcacagcctcaggtctcttttacttccaaacacgtttctgttctctatgatgtcgaagagaagaatactttcattaagagcactctcgatgttcacccgcgtcttcagctccgagctcttcataatgttaaggtacatatctctacttcttcctaattatcaccgtttgttacaataaaggattgattttttcctggaacactttgtcaatttgatgaactgtgcgcagagaaaccttcttgtcaactaaatgatcaaattgggcgtaatttgtcatctatggaacagaacaatttatgtgattgattgttgaatggtggtcatattgataggatttgtggtaccttatatcattggttttggtttccttttctgttgagcatctcacaatgatagaatctgattgtttctgagtgggacattgctgtgcaactaactaccactagctattgaaacttaacattttcttttatagttttggatttcggttgtatgctagtgattatgttgggttttttctaatgtatttatcggtttaactgtgtgttgttacaggcacaacaaggagaagttgctatggaggcaaatctgactgaacctggctactctctggagctttcatcacctgtgcctattggttacgtgagtggccatctcttacattgtctatttggttttgcaactgcagtagtatcaattaccggtaaattgttttcttgcttggttgggagttttctttaaatgctaattataatcccatatggtttactcttcctgcagccaagagcaactcttaaattcccacttggcgaaatttcgttacaagaaaaagatgaggaggaggaggagaagcagaaaagaactttatctgttaatgggatcctcaaacgtcaagttatgaatggtgtttgtaccgctctatacacagatgaagagttgaggctgagatatgcttataaggttcctgacttttacaaaatcccttctctgctttttatgtgttactacaattcaataacttatacaaggttgcacatgcatgaacatatccttcgtcccccaacttctggttctgacatcaaaatattttcctttctcatacaggatgatgcattgtctttcatcccaagtatttcccttccttccaatgctgcatcatttgcattcaaacggcggtttagcccttcagataagttgaggttagtggcctcattgtgttctctcttactctctctctcttctggtagaaacatctcatctgctacaatcagtttcatataatattatgatgattactatatatgcagctattggtacaactttgattcaaacatgtggagtgctgtgtacaaacgcacatatggtaaagactacaaattaaaagctggctatgattctgatgttcgccttggctgggcatctctctgggtaaatcatcaacctttagttttcttttctctcttctctcatcagcgtaatctttttactcgcttaagcccgaatccgagtcatacgagtaagatgctatagcatatagaacattcattcaccacacaattgtacctaatgatgcatctaccatctaataatatctaagggacaccatcactcttgagcaagcttttgtttgagtgagttgtgaccatgcatgagtctcattttttaaccgtggcaggttggtgatgaagctggaaaagtgaaaacgacaccaatgaagatgaaagtccagttcatgcttcaagttccacaagatgacatcaaatcatcagtcttgatgttccgagtcaagaaaagatgggacatttgatgaaatctttgaataaatcatctcttagtttcactttctttaatctctctataaaacccataaaagttgtttgtttctccttatatatcaaatcttttgcaaagtagatacaaaagcttagagtgaataattgcaattgtatttctgtagcttttttttaaatgatctttttcacacgtgtgagactagtataaatgttgctaattttcgtttccagtataaaaaggtacattgcttttaccttcactttttaacccaaatcaattttaaccactaatattaaaattatgctaaaatagaatatttttctcacaacgaaaaattaataaaaaagtattgttggcttatttcctccgttattgtttttgtatgcatttggtctgtgtgttgtgttgtttatcttcttcttcttcaacccgaccaaatacacatccgacggggaaaaagagttccgacaagaatcgagaactgaaagatttgtcatttgtctctcaaatatctgtggagagaagagaaattggaataaagaagacagtgttgtgagagagagagagagagagagagatg

SEQ ID NO: 11704 - DNA, 3000 bp, Unknown
  misc_feature (1)..( 3000): cDNA_ID_2711203_gDNA_ID_2214512_Annot_ID_133854 3000 nt of promoter + ATG
gcctttagagacgtctcttacgagtgttacctttggtgatactctcaaagcatggtatagtgacggtagtattctgtatgttgcttcaagcagaaaggaagagatactgcgtgaacttagtcccagtcagctagttgttttactcggttagtgatgaagataatctctagtcctataagagataacttattcaataattccagcttctgcatttattgtctaaatagtttgctctttgaatgtttaaacatgcttcctgattcgaattatggatcttttcgatttatgaactctcactaataggaaaaagataggcattaaagtttgctacattaaagttctgagtttccttttgtactgataacttttatgaggcacctaactttgttggattttttgggtttctagatgttgaaggcgattcacttgaggatcctaacataattcatatccatagtcttgaggagctgccaatgactatttgctgcataaacaaaaaggtatgtcatgactgcagttctggcttatactagaatacgctcatagttgagaaataagctggtctgtttgaagaaagtactaattgtaggccagaactaaacagtgtaaaaatgtagttcgagatgcttgatattacaccttcattaccattttttggtttgtatatcttgccgattagtattttgaccacccttttgatatcgcctcccaaaacaggcaatgggtgatggtgctgcaatagttgcttacatcatgaagccatctcgggtagaggactttgccaaggttagatccttatttgcaatctgactctgaagtattatatatatggtgatcattgcttagtttttggctctctgtgtgctggtcgtatatatgctttaccctctaggtcattactgattcatgaaagtaatatggatatatatgtaatgttcaccgatgttaaattttctgattttcttagaggggtgctttacccatgtatcctacttcatgtgggttgatatttctgcccctcatgtttgagttccctcttgcatctcaactcaaacacgctgatatcattttccacaaagcaactgatgaaatcttgtccattgaactgaactgctccgactcaaaatcatctgttgcagttacattctctaccggcatggagaaactgaaaaagtaagcttctcaattctttgttttcaatctagcactcagttatatctgcaagtggcgtatagataccatcatacacaaatatgagaaaccttgttaaaaattctccattcaggtttgcataatgatataaggtatttgcaggtatatggaagatcaaaatgcttgtgccatagtcgaccctattcgaaatatatatccagtcgtagaccgactcaagatgcaacatattcttcttggattagagggccttggtgcagcaggacgaaagataagaggtgcctgctttctcaaggtcgtaaaagtcctctcattttgatcaactcgtcaatcttctttatgcttataatcttacatagttatctcttgagacctttagtctggcctcttaacttctccagtttcgcattgatgcttttcttttttactttagcaaattaatatcagagttccttatctgcagattgacagctatgatgaaccagatctggctcagaacttgtcaagagctggactctctcttccatgtattgtgaaaccacaggttgcctgtggtgttgctgatgctcacagcatggtgaatatctcatactttccatctagatttgatatctcgcaatatctgttgctcttttcacagcagaacaaaaaaattcctcgttttcatgtgtttctcacaggccattgtcttccgagtcgaggattttaagaatctgaacactcctgttcctgccattatccaagtaagtcataatgtaatatggatacccaaatctaggggcacactcctaaatcaagatgtcaagcatagaaaaacttctcaaccgatgttttgcaggagtatgtggaccattcatctaggatttttaagttttacgtcttgggggaaacgatctttcacgcggtcaagaaatcgatccctagttcttctagtctgaggaaatcagcggaggaaaatggtctcaaaccaattctctttgacaggcaagatttcataacagttccatgaacacatagccttcagttactaaaaagattgtaactttggtagttccattacctccacagcttaaaatcgttacctgttgattccgcaaaccagaacccggtaagcgagattgatctagagctagttacagaagcagctacctggctaagaaagaagcttgatctcacaatcttcggctttgacgtagttgtaagtatcatcctcatcacacaagaccctttatatataactcatttacttacacattgtctctttattaatctccacagattcaagaaggaacaggagatcacgtgatagtagacttgaactacttaccatcctttaaagaagttccggataacatcgcagttcctgcattctgggaagccatcagaaacagattcgaccaacatgtccaagagaagcattgaatccaacattgtgggaagcgaaactcttctgtctgtttattttaggaatgacctgaagctgctttatgcttcatactctgagactaataataattgagaaacatcttttatggaattttgtaattttaagaccaaacaagtgaagttttttttcttttgtcgataagaacaaaagtcacattctataaatatacgacaagagacgacctttgagactcgagaagctctctccaaaaacaaacgaaaagaagcgacttttgcctcttttggtctctccccttctccggagagatctgctctctctatctatctctcaatctgtaagaagaagattcccacttcagtaaaagccctaactttacttgggaaagttcttcatctatcatccttcaatcgtcatcatccatg

SEQ ID NO: 11705 - DNA, 3000 bp, Unknown
  misc_feature (1)..( 3000): cDNA_ID_1808045_gDNA_ID_2214512_Annot_ID_133855 3000 nt of promoter + ATG
taacttttcagtattgtcaagaggaacttagatgataacaaaaagatatatactcagcaaagccaaatcccaacagaaaaagctgagaatatgtggaaagtagaaagtatgaatgggttcttgatcaacattacattaaaagatgatgagtgttttacgaaataagtaagagatgcttaaaagaaccctttttagctttgtttctccttttgtatactttgcttttttccaagacctggaacaaaggaaaggtatcatgaagcatcaaacttttattggaagatactgagaaacaacaatgtcctttgcaagaagaaaccaaaatacaagaatatagcgatccgataatcgtgtgaatccttctctagtattttgaaggctgaacaataaaatagtatagctatttaccgaaaggctgtatagagactaaaactgaagcaaagggaaggtatcagaaaaagtttagtagcaaactttcattgaaagatgctgaagtaactgagtgatcctgataatctcattctcttgtactgtatgaattgagcagagaagtcaatggttaaagaatctcaaatattctgatgcgctcataaaaaaatgctgtttacagtggaaatgtggagacaacaagagataaaacacaataacagaaggaaaattctttaggtatcttgctaacgtggacctacttacaaagaaacagaagctaaaactattctttctaggaagttaattcttgtaacatgccatccaatttgaatcctcagaacaaatcagaccacctccatcagtgcttattgactctgcagcagagcatggaagcaattctcttccttttcccagagaagcagcactttctttgtgattttgaatatcaaattcagtatctgtaatctgttgggatttcatttcaggcatgtggctatttgtttgctctactctcaaatgtgtccttgacactttatccagtgttacatgaggatgacaagaactcctgtcaactaaacctctctgaaactgtgagagatcaatagaatcagaagatgtggccaaatagtcgaagttgaaacttgaacggctcggctcccatgatgaagcctggatccttggtgacaaaccggctgactgaaacttcattgtcagtgattccaaatctgaaccaacatcatgtttcttttggatttcagcttgagaacatgagagtccaaaataattgtcgaagcttgagttggattcaggtgtttgaataacattctcacttcccagcgtatcaacagataagggagacgatttgtctcctttcaaatgctcagaaggatctagctcacatgtaggggaagtgtcgaatgctgaagcttcaccatcacatgatgaaaggtgaatgaatcttctgaaccgaaaaagttcatttggagaaagagaagaactgatccttctcgttgtctctttatatatatccatgggcgaaagacttctaccactactaatgttgcatagatccgaagaagcactacgatctgatagtggcgaaggagtctcatggccaacacactcaacaatttgctgaaactgagagaaaccatcatcagatatttccttctcatgttctttctcctcatcacaaggagataaaagccagtgcactgacgcatccgcaggcaaaggcataacagaaatatcatcataactcccgtcattaccaaaatctccttcatcaaattcatcagaatcattcagtatcttgcctttaccaacctcaaaaccattttcacccacagtgagtatccccttaggcttgcatttcctcttatcactaacacctgagagtaaatgtccagcagcataacaagcttgtgattgagctgatgcagacagattcatagacgatccacactgtatctctggagacaccgaagcttgaacaggtggtgtcctatcttgataactactactgttgctacttagtctaccatcatcagtagcttcactcttccttctataaatcaaatcagatccagtttctaatttagaaacaggagtactctgagcaatactgtcatctactctaatcgtagtttggctatctttaagcttaacatttctagaaacagaagattgtttcttcaaaaccgaaactttctccggtttcatggtaatcttacaagttggtctctttccagatacaggatttgtcttgcatctctgagacttcagcaaattaggtttctcagtaagagtagatttcaacttaacctcctcaagagagcttggtttctttctaattaagggtttactaactaccggagcagatttggggtttttagctactgatctcactggtctacgaggaaaaactcccaacgaagaagaagatgatgaagaagacgatgagaaagaatgagagagcaagaacctgtgacaaccgttggatgcttcaccggaagttgaaccagaagcactcacattgctacaactgctgcttccagagcttcttgtactgaaatctctcaaagggttcaccggaaatctctcccttttcagttttttctcatttttctccggcggctgtggctgagactgaggaaatttcttcgtttgcgcatttgaagaagaagttattcgattcatcctatgagcattcgaccaaaaagcctaaagtatctctctttcttcgtgtctcagtgttctctcactgtttccgatctgcttgatctgatatttcaaaacgactttttttttttggcggaggcgcagagacgaacaacaacaaacattaaaatgagaaaaagatcgaaactttgacggagaggcttttgcttttgtctttttctctttaattaccgacttaaccctcaacttttatttcgtgctccaacaaaaacaagggtacatcggtcatttaccgaaagaacaacactttttccgatgtttaacggctaaatcgccaccgtgtattgatttattcttttgttcctcagctgagagagaagaagaacgatg

SEQ ID NO: 11706 - DNA, 3000 bp, Unknown
  misc_feature (1)..( 3000): cDNA_ID_2711183_gDNA_ID_2214512_Annot_ID_133866 3000 nt of promoter + ATG
cggtcacagccattaccttgttggttaggtaagaaggatcgcagacaactttcttgcatttggcagtctctccctcagatgtaacaccagaaaccttaccctcctcgtcaaactctacctgttataaaagcaatattaggttatcagatctagcatccatatagttaacgacagaaaaagttgcagaaacgaccgaaacaaaaaagccacaaagataaggaagtcaaagacgcaccttgcactcaggtttgttcaacatatacgtcccaccatagacagcactaagtcgtgcaaatgcctgagccaaggaagataagagagaatttagaaactatagtccaaaacgccagaatagttgcaccaaccaaataaagcaatgtacaaaagaagaaaaaaacctgaggcaattctcccaacccatagagaggatagatatatggtgaacctccttgaaaacgtgcaagggactctgcgtagagctgataaaacatttaaagcaacagagtcaaacatgaaatactgagagcaaaaaagaagacttcgaaaacaaggggatccacactttaaagtcccatgagagcaattcaccttcattctcattacagtatcataggcaggttgatggagatgattgtcattacagtgaagtgccactgcatgaccaataaagtcaatagtatcttctttaagaccgaatttcctgccaaagtgttaaattgatagttagcagcagatagtctaaaacaaatattgacaacaccataatgcaaaagacaagagaacatcagcttacgcaatcaaatccttagttgtaactctcctcaaatccattccatcatgtgtttttgggtccttctcgtcgtattcttgaacatagctgaaaaactttccagctcgacgtttctcaaaaatacccataagaggagatttgagggcctccatgggagttgctggcactttttggacctgtagcatataaacagttaatataactagaaaaaaattacttaagctgcaaagctagaatgatcagtgaaaagcttttgaccaagatcaaacatgggagaaaaaaagatgcacaaacagacttgaaatctatggaaaaaaaagagaatgaggcacaagataaaaatgaaaatgagtaatcaatgtaccttgccttggacaaaaacatagcttccatcaacagctttaaaagacaagtacttggtcacatccgtatgaataaggacacgaacaagctttccgttagccatcataaactggtgcgccacattgacagagaacagttagtaattcatattggtaacaaggaagctagataagctggaaagtagctaatattgataacctttggcatcatgtcaacattgtagtctctgctagaacctaaatgagcaggagccttctcttctcccctgaacttcttccacagctgtttaaaacaaagcaacattcaataactctcgctgattataacttaccacaaaaagtcttcatatatatttaacaaaaatattgacctgattgagattaagagaagttgactctccaccgtagtagtcattcctgtccatgtgaagtacctaattggaatatagatgaaattagtagaccattagattacttataaaaagaagtaaacttggcgacaaagtcagctaatcaatcacatagaagatataggagtggagatgatgaaaatttagtctttttacgcaatctcaataactaactaaatgcattaaattcagatcattgtcaaaatcgcgaagccaattgattctcatgttgaagctcacaaagcaaccagctttaaatcacacaatcggagataataatctcaactagatccgttgttcatcatgtaagtaacgaattaagagtattgaaaatctccagatcaagcatggattcaaaaagagagagagagaccttaagaccatcgacggagagaagaccactaaggatgcactccttgagaccagtacccagaactatgacttcgtactcttcatccatagttgctgatcctccaaagagaagaaagaaatggacttttgatatgcgaccgtcgagagactcgagagagagagagagagaatcggcggtgattgcgtctatagagaaaatcagacaagtccaaagatgctttctttcttatatgctttttctcttttttttttcttatttggctattgaaatttggataaatctaaatattattaccaagtaaaacttaaaagtaattttgtgtgtgtaataaatagatttacaataatgtttttgctgtctgaagcaatctaataattcaattagcattttctaaaacaattccgtttttttttagggtaataaataaataaccagtcgattaaaccaaaaagacaaatatgaaaatagagaaaatgtcatcttctgttctgttctgtgagtgcaaagcaaatttatttaattaattttgtcaattattatttttacaataaaaaaataaaaaaaaattctctcattgttctcttgacctctcaatgaaaatctcgtccaggttcgctcatcttcccatctcctctacgaatgttcttctttggtaatttgcaaattcacatctttcttcttctttccgatgcaattttcatggccgaattcacaattgctgtgctcggccatggattctgattgggatcagtttctgtttttattttattttaaggtttggatgcttctgttgactacgttttgctaaaattcagacccttttcgctctcgtgaatcgattctaccgcattttctgaacgaaatctctagtctcttttttcttttcttcctgggtttgatttcttggagtggttgattgcgcaagtctggattttgattttggtacaagacatttgcttgtacaaggaggaagggatttgttggtatacagtattgttattgcaaaggtttttcgaatgtcaaaacaagtttttggattattgattttggaaatctgagtggatg

SEQ ID NO: 11707 - DNA, 3000 bp, Unknown
  misc_feature (1)..( 3000): cDNA_ID_2707226_gDNA_ID_2214512_Annot_ID_184308 3000 nt of promoter + ATG
atacaaatatttgagcacaagacttaaaaagccttccaaaactattatacaaactcaagaagaacaactgcttcaagttctgtgaaaatcactatttcaataatcgtctcctttggaaataatctctttgcaagttggtcgcaacaggattgtatgctcaaactgagaaatatagcttcctttgacatcacacactggaggacatggctacaaaagttaacccaaagaaacttactttcatcaaaatgttcttgaacataagtcatcagagtatatatatagttttaaggagtttacctcaattatgccagaatcacaaagattctttaaagccatcaagtattttgtttcaccaaggcggtccaaataacgtctgcagaaggctagcgtggagaagttcttgttaatagtggcaaggagttgttttgcccttggtaacctcaaaggtacatgacccacatcatagtttttcatgtaatggctacattctaagtcttctcttacatatcctttccctgcaaaatgacacaagtgaaaaaccaattttactctgaattcgtaaaaatccacatttcttgtatagtttcatgtgagaaatgttgttgttacctgttgatccaaaagtttcaatggcatataattcaccctcttccattttcgtctgctcgcctcctctaacattaggaactgatttttcagcgtgtatctgatagcgtccaatgctgtgcccattcaggtttctgatacttttgactgcccccaaaagacacaacattgttttagttttctaataatccaaatagaaaccaccaaaaaatgctgccacaaacgtaatcaattaccttggtagacttttccattgatttcaacctcataagactccatgacctcctgaactgcagcaccaacatcacagagccggacatctaccccggcttcctaaaccaacaaaattaataacacaatggacttattcagttggattgaacgataaagatccaaaaaagaagctcaatatggttataagaaaacaatgcaaacttcaaagaagaagtcactacagaatgaatggctgcattcaccatatccaagaacagaagaatcccacaagtagcaacagaaacagaatgagcaccttgataccagtatatgttgcgtcacgcgaggctgctaaaagaggatcaaacataggattgaacgcaactgtaaaagcagaatcaacaatgtgccctgccaaaacaacataataattgttcttatgagacatctacgttgagaaaatacaacaaacagatgataagtttttgtttttaccataccatcaatatgtgttccaaaatccagcttcatcacatcatcatactgaaggacagtcttatctccagagtttggtgtccaatgagcagcaacactgaaggttcaagtaaatttgagacgcattgatagagccaaagatcaaagaaatgcagaaagaatgaaaaaggttgaactaacttattcagtgaacatcctgtaggaaaggcgataccagcttgaagaccattctctgatatcaacttacgaacagtgttctctaaagtctcacagagatcaatcatcaacattccaggcttcaatatacttctcatatacttcctaacttgacgatgaacttccgctgcttggcgaagagagttatatatcggcttttgcagcctctccatctctctcttctcttcagatgttgttctccacaaattactacatcacaacatagacttagctagcaaaacaaaatgtccttatagaaaatctagtctagacttactcatcattgtactgttggatttcaccttgaggaaaatctccagaagggaagagctcaagaacaggaattgaaggaggatcagtctgttgaagagaactcttcttcttcctaaaaacaatcatcagatttttgagcaagatcatcaaagcaaacactgaagattaacagaaaaaagaaacaacttctcacttgcttttacttttcttcttcttcttcttcgttgaagcctcagctaaaatgaaaagactaaaagtctcaacaacaataaagctagagaaactctaaaccaacttcacatacactagttcctagaaagttacaatctctgatgacataaccagattgattaatctaaactagtaataaacaagaacacacgaaagagaccaaagttccatctttttcccgtcataattacatacttcaactacaagatctatcaaaaacacgaaatgatttacctttcagtccatcttcttcttcttggttattatccttttcgtcttccttcacttcagccagatcaagactcttcgttaagtcagaacttaactgagactcgtttccattagaggactcggcttcagtgttctccttccccatagttgctacttctgggtttcctatcgccatctcaaattattttaacaaggaggcttaatgagaagaagtgcagaagaaagttcatcagaagaagtcaaagtctcctcttttcacctctttttcactcccaacttttttcttcagtctatccaggaaaatgtcggaaggttaaaacaattgcaaaatgatccaacaaaactttcatttatacatttataacccattactttaaagaacacaaacgctccttattgggcccaatattaataggcccaccaacattaatcctgcttatcttttttttcaaaacattaatcttgcttatcttatctgattaatttaatttaatcgagaaagcaagacaaaaaaaaaacctatcgtttcacggacaagaagagaaccgttgcgctttgtgaagcatttactcaacggctagtttccttcttcttccccttttctcttcctcttcgcctagggtttcgaaaatttcaatccgatttgaataatttctgttttcttatcggaacaaaaaaatctccggcatctggaatctccggtgattttgtcaatttcgaagaaatttgattgaa

SEQ ID NO: 11708 - DNA, 3000 bp, Unknown
  misc_feature (1)..( 3000): cDNA_ID_1975979_gDNA_ID_2214512_Annot_ID_184307 3000 nt of promoter + ATG
ttcctcctcttcgttcaaaaactcgtcaagggtttttataataagaaagtttcaccttcttataatctcagcgccgccttaatggacatctgggcttaataatggccattaacgggcctgttttggatatctcgcggtagagtcccggtttactttggtttaacccagtgaagtggtcgatgaattcaacatccaacacttgaaaaggagtcttctttgttctcttactaaaagatacggtaatacaatgctcagacaaaagctaatggatcattgaatagactcagatattacaagacaactgatagtatttacaaattcttttgttatttgaggtatgtaagaagatagattatgccaaaccgaagagcttcagtgttgctgcactagcgagtatgccatgtatggctggctgtttttactgtgtggtaaagtaaccttaaaaaatcatcaaacagaagttgtgcactcttgctgatggcacttcttctggtgttgaataagctgacttctaagatagcattcttccatctgcagaatagaagaaaaaacactttaggatttcagaaactgaaaagaaacaaatggttatgtcccccaaacagtacaagttttaatacctgtgatgaatgtgtcttaagcagtgcaactctgcaatcttctactgatgctttctctatgccgcttactctagctaattccgacatcaaagtctccatctcttgtgtctgcaaaaggaaccaaggaagatgtttcagtttcaacataggcgtgtgtaggaactttgtttttgttcatgtttaatgtgaagcacattgactgtattttgctaaccttaggcacaagatttccaatgttttgcacaatgccttccatagattttgaagcgacaacaagtgcttctgctaactctttagtctcaacctggttttgagaagcaaaatctaaatgttttagtacaaaaggtataaaggagcagaatttttcctagttgattcgaccaacacaacatataccttgatttttgaatcgagaggcaaccgcaatgaagcattcaacaaagcttcagttgtttccaatagtgaagttgagaattcatcttcaagaacagcccattgctccaaagaaggagtctgcatagagttaaaagtagtttaacaccaatttttacaaggaaactacacaattgctctaaacgttcataaatgtaaaaatagtgtgaaatctacgatatttaagatctttacttacttgtgactctacaatctccgtaacagctttaactctctgtaaatgttggagttctatgcgtttcctctgtacagaatcagacaactccgacattttcaaaccaagtgaataaaacattctctgcaagaaaaacaatttacagcatccataagatcaccatcatcaaacagaatctaacctaaacaacattcatcactaatactgaagttatgtgtcaaacattgatctatatgtaaaagctatcaaatttctgattctcagagctatagaaactgacctcagcttgtgctttctgagattgtgttttgacctcagcatttgcatttgcaaatcgccattgcaagtaacggttatggagcagtttcagagaatgcacatccgcttgttgtcctaaagctttcttctgcttctttgtatcggcttgaatcttcgaattaggagccaccggaggcaatgacaaaccaacaccatttttaagcgacaatgaagctctaacatctcgaaacatcgacgcatcatcggaactcagggatcgagaaagtggtgaggcggtgggagtgttaaaggcctttgcttgggttctaattgttggcaacagatctgggccgttggatttgaaaatctctctattgttgttatcttcttcaccgtctgtagaagatgataacgagatcccgcttgatcggagaagcctagtcgcagcggaggcagtgagtaaacgctgttggttcagccgcgatctagacggtggcggcaacatagccgtcgttggtgtgtcgagacggtgaccgttctctttcaacggcttagatcgaatatgctgcttagggtttttacctccgtcgacttgttgaagaggaaaaggcgagtctaagctacgcgccgtctcggaaggacgattctcgtctccctcttgcattttcaattgccgtctcatcctctgagccgaagtcgatctctgattctgatgttggtgatgatgtctaggagaatttgaagtcaattgatggagatctccggcggaagaagaggaagacgacgatgacgaagaagaaatgggagacatgaatctcgagctcacttctcttactctcggccgcctcgtagaaggaggaggaaccggcgccggagcattaatcgcaggtgtagatgggtgttccatggatcggccgattctcgcctccatttcaatcaaatttcttcgaaattgacaaaatcaccggagattccagatgccggagatttttttgttccgataagaaaacagaaattattcaaatcggattgaaattttcgaaaccctaggcgaagaggaagagaaaaggggaagaagaaggaaactagccgttgagtaaatgcttcacaaagcgcaacggttctcttcttgtccgtgaaacgataggttttttttttgtcttgctttctcgattaaattaaattaatcagataagataagcaagattaatgttttgaaaaaaaagataagcaggattaatgttggtgggcctattaatattgggcccaataaggagcgtttgtgttctttaaagtaatgggttataaatgtataaatgaaagttttgttggatcattttgcaattgttttaaccttccgacattttcctggatagactgaagaaaaaagttgggagtgaaaaagaggtgaaaagaggagactttgacttcttctgatgaactttcttctgcacttcttctcattaagcctccttgttaaaataatttgagatg

SEQ ID NO: 11709 - DNA, 3000 bp, Unknown
  misc_feature (1)..( 3000): cDNA_ID_3022587_gDNA_ID_2214512_Annot_ID_184303 3000 nt of promoter + ATG
atgcctctgtttttatttcacttttcttgatctatctatttcagcatttcattgatataagaccataattatctgcttgtttaagtacattgaactggaaaaaaccttatcttttgtgttaggatgctattctcaagctgttcctcaagttgcaagtgtgggagtgagtgtaacaataagccgttccaacaacgacatgtcaagaagatgaagttaattcaggtaatgtgtgattggttttggttggatagagtggatttttgttgttgtcggtttgttattttagttgtgtcttgtagacagaaaaatgcggatcagggattgtggcagaagaagaaatcgaagctggagagtttatcattgaatatgttggagaaggtgatgtgactatttgatattttgtctccctactgaatatactgcgaccatggtctaatttgttttcttttttcgtacctttgctcaatgtagttattgatgataagacttgtgaagagaggctttggaagatgaaacaccgtggcgagacaaacttttatttatgtgagataaccagagatatggttattgatgctactcataagggaaacaaatcaagatatattaatcatagctgcaaccctaatacgcagatgcagaaatggtttgttgttaactgtcaacccttagtgcttgtttcctagtttagaatacttgagagagaaaagtcatcatttggtttacttttgcttgcaattaggataattgacggcgagaccagaatcggcattttcgccacccgtggtatcaaaaagggagagcatttgacctatgattatcagtaagtttatatcctccttctccagtttactttgtaacatatctgtttttatgttgagttgtgacactaagaaatagagcaggtttgttcagtttggtgcagatcaagactgccattgtggggctgtaggttgcagaaggaagcttggtgtaaaacctagcaaacctaagatagcctcggatgaagcttttaatctagtggcacatgaattggcccagacactgcccaaggtattttcaaattttatctgaaaagaagaatcaaatatatatctcgtctttgccctggcatagtttcacagtcactgaaaaatttgtgtgatgaggtctaagtgactctttttctttccccacttttggttaggtgcatcaaaatggacttgtaaatagacacatagatgcaggtaagtttggattttttctgctcaatttgcgagagtagcttattgtgttttggttgtaagaaagtaatttggattcccatgtttctccaggaaaatcatggaacaatcttagtcaaagggatacatgttcgcgtaattgcattggtgtggtgatcaggttatctcgccccacgagtgataggtatttattgagttttgaactcgtggattagttttatgactcattctatgcttttctcatccaatgttttatcttttgagattttcaggtgttttggcctcgttagacattttgatgagtattcaagaaagcactcggtattacaattagccaatacttgttcctcaccatcgaacttggcaaaatcattctcaattaagacctctctgttaacatctttaaacttggtccaggtgatgttcgaggatggtgttaccgagtttgtcgacatgtcgagagaagactgggagattgtctaatattgttttcaggtgatttatactcttcactctcttaatgaaacattaaaactcccagaagcatagagtattaaattaccctggctgctatgtttctgcagattgctttgaagttgagaaaccaaaataacctgtcttggtaaactaaaggtatcccaaaaaacccgggtctgactgactgggattggtgcagtgacattgtttgttgcgtctaacttgtgacctgtgtttgtacaaccattataagagatatcatatatctacttgtgtaaccacatctgtactttcttctccttccttcttttttcatggggatctcaaatgatgatgtcttgcaagaaccttcgtggtgtgtaattgactttgtaagaaccggtaatctcatatccggtttagcttttaaaaatttgtatccaaagaccggtttgttcttgtttgcatgtgctgttcttattcgtgcatctgtgtgagtgtgactgtgtcggtgtcgccgacaaaagccggtgtttgcaaaatctgaccagttttgttttagcgattaacgtttcaaattccttcaaatgcaaaatgagttaaacaagtgaaaaattactaaaacaacataacagttttaaattggaaaaagttttgtaaagtttaaagatacactgtaagtgaaaaacggaaaattttaattagattttttttttttttttttttttttggtaaaagtagattatttttgttaaacaaaagtgatggatcattggttttttggtagtaggtgggtgatgtgggtgtgtggttctggttcaccaactcaaaaagcatagactgcaggggttggggattgataacgacaaatctaattgtggttggtaaatcttttactaatcacattcctttaaaataattatgtaactcatcttgtttactaatatcaactcgactatcttaatatcaaataactcggattcttcatttttttcactttagaatggtttggtaaatctcttgaataataaacactttaataaaaatgtttttttttgtcaagcataaaaatgtaactcatgttgtctaactacatggattttcgcacaaaacaatgattaaatgtaaattatgtaattatactttatttaaagtatgattttgtcttaaaaatgaaaataatataaggaagtggacgggtaaggtaaagtctaaaattcaccaaacattttggaatctctctgtttactataaagcagtgagtagaagaacctgaaagaactcgcctttgtctctcattcttcttctccatttcgaaaagaag

SEQ ID NO: 11710 - DNA, 3000 bp, Unknown
  misc_feature (1)..( 3000): cDNA_ID_3022599_gDNA_ID_2214512_Annot_ID_184300 3000 nt of promoter + ATG
atatgttacaaagtaaactggagaaggaggatataaacttactgataatcataggtcaaatgctctccctttttgataccacgggtggcgaaaatgccgattctggtctcgccgtcaattatcctaattgcaagcaaaagtaaaccaaatgatgacttttctctctcaagtattctaaactaggaaacaagcactaagggttgacagttaacaacaaaccatttctgcatctgcgtattagggttgcagctatgattaatatatcttgatttgtttcccttatgagtagcatcaataaccatatctctggttatctcacataaataaaagtttgtctcgccacggtgtttcatcttccaaagcctctcttcacaagtcttatcatcaataactacattgagcaaaggtacgaaaaaagaaaacaaattagaccatggtcgcagtatattcagtagggagacaaaatatcaaatagtcacatcaccttctccaacatattcaatgataaactctccagcttcgatttcttcttctgccacaatccctgatccgcatttttctgtctacaagacacaactaaaataacaaaccgacaacaacaaaaatccactctatccaaccaaaaccaatcacacattacctgaattaacttcatcttcttgacatgtcgttgttggaacggcttattgttacactcactcccacacttgcaacttgaggaacagcttgagaatagcatcctaacacaaaagataaggttttttccagttcaatgtacttaaacaagcagataattatggtcttatatcaatgaaatgctgaaatagatagatcaagaaaagtgaaataaaaacagaggcatacccacaatggcaattactcccacagacagttgaagaagaaccaggagacgaggaggagcaagaacagaagattccatcatcttcaaccctccttttgactttcttcgtcaagtatatatctttaacaagtcaaggccaaaacaaatcttgatcaaagctaaatctgcaaaatgaaacaaaaccaaaactgcaattgcaaaaaaggatactgcgcctgatgaagatataaggagtaggttttcctttattcaaccactccggtaactcgaattcttcagattctccaatctgattcaatagcttgtcgaacacttgccctaagtgattccggtccgaaatctgagaaaaatatctggaaatttcagatatcaagaataaagttaaaatttccatgaagcggagattgtttttgaacagacctttttgctggctggcatgtcgaaagaatctaaaagaagctctaaaaaccagagaataagcaagatttgagcgtcgacctattgaggtaacaccaagttcgatgaaactaagaaaagaagatggctaaaactagtacgtctctctgttgtttcggaattcgaagtttctcaaccctaattattacttcttgttgttgttgaagaagaagaactgaagaagtaacaatggcggatctgagacagtaagaaagaagaaagagcggcagttgctttttttttaatctttttttctctttgataattacgcttcagaaataaatggcttcagggtaaaaccgtaacttgactcgatatgatatgttggcccagtgtcaatatgggcttttttatccgatccaatttttttaactagcccaaattagctgagcttaattaacccaaactaatattgttgctttatgtcgtttatatgtcatagccttttagccgtaatcactaatcacattaatagcaagcagcagcaacattttaattttgtgtactgttaacatgttgatggatgtgttaacaaaaaaattaggaacctggagaaaagtaaagtaaaatactatcaatgtcattgttaatataatattcgaacgttttatccgaagtaaacaggtaaatcggagagtatttatttttttccacgtaaaaaaatggtaaacaagtgtaatcataattcataaccctgattatgtgaagtttaattaataattaaacgatatagattgtcattagttgaaagcgaaagatttgaagaaggtaaaaagaagaatcgccattgagattgtcccaaaacctccaaaggaaacacacgtttgtctttgctctgaggtatcttcgacgggacgttgaagcgagcaagatacgacacgaaatcgatctcccccttgcgttttccatctccgtcgtctgctgaaaccatttgatcgatctctcaggtgatccttctgtttcttttcctattgttttctctctgctagaaaaattcggagttgtgagaattcctgggctaaattggatgatgaaattctgctacacgaagaggagttgtcaaaatttaagttgattaattgatcattttcgattactgtagatccgtgagttgaaatttcgtcaagctcaagtctgtttcttgattttgtcatttgctagaaacattcttcaattaagagaatatgcatgtggaatccaaatgctttgatctctaaaattttggtttatatttctctgttgactccctaaaccttcctaatatcatgcggaaaattctatgttgtgatgtttcaagaggtcaagaagctatggattgggtttattttctcatcaaaatctgcttagtgtttgtaattgtagaatcgttattgtgttacatgcttacttgtttttggggtgttaagctgaacttcagtggtcacaaaactatagttatggtctcagagagttaattgattaaacttttctgaaccttgaagtcacacacacccaatcttgtgtagtgtttgaagttaattgtggaagtttttagtcaatcttggctttctgatactacttaaaagtatgttggatgttaattcagtgtcttttgtgcttattatttcagataaggttctcaggatttaggttgcttctatgagaaggacacgttgcagttggtgcttcatgtctaggtaatg

SEQ ID NO: 11711 - DNA, 3000 bp, Unknown
  misc_feature (1)..( 3000): cDNA_ID_1807771_gDNA_ID_2214512_Annot_ID_184298 3000 nt of promoter + ATG
cctttcaatctcaccaaacaggcaagagtcaacacatgggttactttgatgcgatttccttaataaggaataaaactttgaaatggaatctataacaactggtttagttcatgaagacggtgcttttgttaaaacaatcttttcataaaacaggaaaagtagaaagcttctagaagactttcataaggacaaaatgaacaactaacagtggagtaaatcatatactccataagaatttgattatttgaatatcaaccaaaaattcaagaaatgtccatgttgtttcatgatgtaaattgtaaaggcaaatagttgaagttaggtcagtggttacttggttaagtgaagttaggtaacaatattgtatattataatcacaaattaaattgacagtatactgcgccgcactttttgtttaacgcttttaccactgtatagcgtctatagtttaaaaacagtttgaactaataactttttaaactagtttatcaactagatatctagattactattccatttcagtgtcaattgaaaccgaatctatgacatcttgataataaagttcacgaagaccagtagtgagctttttagtctttaccatcactttttatttgaaataacaaaaagcttctagaagctatgcaaagacaaataatatggagtaataaggaatgagtcgtattcactgacgcaaccgtcaaccgataagtaaacatctcgtgaactgtttctccctaatttactacaatttaaaacaggtatattaatatgtatgatggacattttcatttcatattggcatgtgcacgcactatcaaacaaattctttcacgaatagtccatatgtatagattctttatgttttgccaaaaaatttgtgcttagttgttataagttgtaagatatcatcatgtgtttttaattttgtaatacgtattattttacgtagaaaattgcgagggcagtttcgtttgaatataagattcatcaataatattatgattgattataactttataaaggtttctactttattatagtcttctagaagaagttctcatggatatacattggcattaactatccttgggtcttactcttcgattattcaacatattatattaaaacgttgacacgtctattctgcgatgcaccgacgtaaaggtatgtctcgcggacttccagcctcacacaagtcatctcgtctccaccggataattaatgatgctttctgttgttttactttggggttatttatgaatctacgcttactatttgtgccgttatttaaaacatgtttcaagggaagaagattaatttgggtgttagcgcacgatatgaacatagatagacaagaagaaaaatgaaagtcggggataagaaggaaaataataagaatggggtcgaacattaatagggggctggtccattacactctatcccattttccccacattgtctgttcttgtttcgtcaattgtcctttctttgattactctctacttatgtattttctctctatcagcttttctagctttattcatcaccaattattgtcgtgtgtcaagaaaaagtaacgtagagtttctttgaatagtagtagtagtttcgcatataaacgagtactttcgattcattttcattcctaaatggtaatattggctatcaataggtcgcgttagtcaaagaaacaatggatacatcttttgaaactttttgctcgacaagaaaaaagcaactataatgtcatttagttttgttttatttcccttaaatggattatggatcaatggatgatgtagtactgttaacagattctattgatgaatttcacgactatcgcaagacgaatttgaaatcatcacgaaactgaagttgttgttttttttttcttttcaacgaaggttgattgatttacgactacgatgaagtggattggtttctaattaattattcctgaaaatgaaaccaaagatataatacaactattactaaatgaaaagaagaaaaatagagataagggttctagaagataggcattgatatttgttttcccttttggggagtttgtcatctttatgggggaggaaacaagtgggccgaaactggcaagcacttatcctcttggctttagtcttcttctttacggttactaaagtttttctctttcttttcttctagaagaccatattgacatttttttttgtatctctagagtaatagcactaaatataaacctaacttttgatgttagtctaagacaataagacatacgaagctttaaaactctattgttttgaatgatcacaatgtcacatatcaatacttatattcgatctagaagatttggaagagtatagatttaatttgttggtttatgaaaagaaaaacagtattggtggaagaaagtattcagaagggcaaaatcgatgacatgtagatgtagatggacaaggcctgagtatgtatatgtcatttaaaaccaagcccaatttaagttaaataaataggcccactttggaaaaatgactgctgactaaaaaattagggttacgaaataaaccctaaacccagtttcgactttgtttgttttgtcctccttctacgccgcacactatctcttcctctctctcagacgagatttcctcttcatctcaagtaagcttctctctttgatcttcttcgtttagtttagtttttaatcgtaagttttcttttgattcattataatttgtttgttctgatgtttgtgagatcgataaacccagttgttctagttctattgtagagaaattcactttgattttagatttagaatcgttgcattgagttttccgatcttctataattgctccttttcattttgctgtttggttttaaacattgtcgttgatgttcctgccttgcttctctgtgattaacaatctgttcaatttctcaaaggtgtcttttttatttgattagtatagcttatttttggtttgtttatggcatgctatg

SEQ ID NO: 11712 - DNA, 3000 bp, Unknown
  misc_feature (1)..( 3000): cDNA_ID_2707265_gDNA_ID_2214512_Annot_ID_184296 3000 nt of promoter + ATG
cttccacgagctgtcctcttagcttttgtgagagcagccggccacccgcatccacacactctctgtacagtggcatgtaggcgattgccactctcaatggtgctgggagatcctttagacttattgcagactctccgagtttcaaaactctcatgaaattcatgtaattttcccggctttccttcaatccttggttgaatgcagcttctgaccactgttcttggagaaacgatttgaggtcggaaggaacagactcgtcttctgactttgcaatggtgtctgcaactgaatatgtggctgctggatccccgaggaaatctgatttaaggagaaactctactccgtggagggaaccaccacttctttcaccggctgctttgaggatttcaatgctgagagcagtaaggacgggtcttggaacatgaggaaggagataagcagcaacctcaacctggctgcttgaagtggcggctgtgagagctaagcatagctccatttcacgacagcctcgtttcacaaaccattgaacaacttgcatgcaacctctctccgctgctctcatcaagggacccaagaaagcaattgcatgaccttcttctacaaggcaatccatcgtttcgattttactataatgcgaggcaaaaccaagggctaagtcaacatccacgtctaagctattcctttgagcaatctgcaccaggaaaaagttcagttagattgcacaaagtaacttgcaagcagtcattaagaattagatttacctgcaacaagatgcgcacaagttctgtgctcccaaaacgagaagcttcaaggaagcactgatttacattatctgcgcctccttccaccagcataccgagcaatccatgtatgacagtagctgaaattccagaagcccagccaggattaaacgaggtagagaacagcgtaagcgggaagcaagctgcatcaaaggcttctgtgaaatcctttcctgatagatggtttcctgcaagatctaagaacatcttgaaagcagaaagctggagttggatctcagcagctgagtcttggttagctttatctctagggccctggcatcgggagtgaaaacctatacatttgagtgcccattcagtaaacttttgaactttagcaccagcttctgctttgaggacctcatcaccgttacactcttggagacgctcgtgcaacctggaaacgccgagatgggaaaaaatggatttatatagaaagggtatctcacccttcccagctaaccaaagataaaccaggaggaataagaacataagagatactatagatttaacaaaaagcgatttctaagaaaagttaacaacactaaaacacttgcagatgtaaccaaccaatgtaacatgtaagacacaatgtagtgatcatataaagcaaaaacaaggtatcataacagaaaccaacttctccaataatccaaaagtgttttaccataattatactgagaaaaaggggaaacatcttataagagaaagtatcaaatgtgtacctttgagccataacagttacagtatcagcaagactcacagtccggctatggcaagatgaaacacaagaagcaagaaaggaagtcctaagtgtagctctagtatagtcctgagcaccatgacatatgatcttagcaatcaattcagtgattccccgtaactcatgctctgtgctcaagaaccaaatagaatctaaactaatacacaacagatcattcaaagtttgtggatcagccagctgaataaatctctctgaaagttgccaatcctgtgagctaacagcaccttggaaaagccgtcccaattcgattctatcctgtctattaagcttcttctgttgctcaagacccctgcatttcagtatctttgcagtagatccagagcatttggtcggttgagtgatgatacctacaagaggtgactctcttgcaaaaacaacatcactctcttgaggttccaagtcagaacctacaggctcatcaggatacatgtcatcgttctccatccactcagatttccaaaatcaataatccaaaaacttgttttgacattcgaaaaacctttgcaataacaatactgtataccaacaaatcccttcctccttgtacaagcaaatgtcttgtaccaaaatcaaaatccagacttgcgcaatcaaccactccaagaaatcaaacccaggaagaaaagaaaaaagagactagagatttcgttcagaaaatgcggtagaatcgattcacgagagcgaaaagggtctgaattttagcaaaacgtagtcaacagaagcatccaaaccttaaaataaaataaaaacagaaactgatcccaatcagaatccatggccgagcacagcaattgtgaattcggccatgaaaattgcatcggaaagaagaagaaagatgtgaatttgcaaattaccaaagaagaacattcgtagaggagatgggaagatgagcgaacctggacgagattttcattgagaggtcaagagaacaatgagagaatttttttttatttttttattgtaaaaataataattgacaaaattaattaaataaatttgctttgcactcacagaacagaacagaagatgacattttctctattttcatatttgtctttttggtttaatcgactggttatttatttattaccctaaaaaaaaacggaattgttttagaaaatgctaattgaattattagattgcttcagacagcaaaaacattattgtaaatctatttattacacacacaaaattacttttaagttttacttggtaataatatttagatttatccaaatttcaatagccaaataagaaaaaaaaaagagaaaaagcatataagaaagaaagcatctttggacttgtctgattttctctatagacgcaatcaccgccgattctctctctctctctctcgagtctctcgacggtcgcatatcaaaagtccatttctttcttctctttggaggatcagcaact

SEQ ID NO: 11713 - DNA, 3000 bp, Unknown; identical to SEQ ID NO: 11706
  misc_feature (1)..( 3000): cDNA_ID_2711183_gDNA_ID_2214512_Annot_ID_184295 3000 nt of promoter + ATG

SEQ ID NO: 11714 - DNA, 3000 bp, Unknown; identical to SEQ ID NO: 11704
  misc_feature (1)..( 3000): cDNA_ID_3022631_gDNA_ID_2214512_Annot_ID_184282 3000 nt of promoter + ATG

SEQ ID NO: 11715 - DNA, 3000 bp, Unknown; identical to SEQ ID NO: 11702
  misc_feature (1)..( 3000): cDNA_ID_3022651_gDNA_ID_2214512_Annot_ID_184273 3000 nt of promoter + ATG

SEQ ID NO: 11716 - DNA, 3000 bp, Unknown; identical to SEQ ID NO: 11701
  misc_feature (1)..( 3000): cDNA_ID_2707257_gDNA_ID_2214512_Annot_ID_184272 3000 nt of promoter + ATG

SEQ ID NO: 11717 - DNA, 3000 bp, Unknown
  misc_feature (1)..( 3000): cDNA_ID_2711220_gDNA_ID_2214512_Annot_ID_184270 3000 nt of promoter + ATG
gtaagattttacgaccaaagtttcattgtcaaatcagaatttttatcaaatcattctgaagtatgttatttaaatattcaaaagatgacaaagaagattatggaacaagtataaatggaaaataatatttggatgattggagcaacatggttacggaacgtgacaattggagaagaatacggatcgaaattggaacaatgatcacaccgaaaggttctttaaatttctccaaaattaaatttctttcgtatacttgaatgttttcttaagtcaaacatttgattactcacatttttcaagttcatgcatttaaattaacgtgctaatggcgagactaagaaagataagatttttaactactcgaatatacttttccggtaattacttaattaatattcaaggtcaattggaggatcatgatgccgaatgagtactaattgcattcatgttcaagggatcgaagttgatttgtgactcaaccctttgcttaaacctagaagagtggtgctatatgaaaatttgagtatgtgctataggataagcttttagcccaagttatgtatgtttttaaaaaacatttcgttgctttctttaactagaaaatatatgtatattataatatatctagtataccaaccaatcccaagtaaagtaaagcttattgaaactaaaccaaatcaacttatgaatcaacatatttttttctaatataatgtaacttcaaacgaaacaaaaaacaatcagaatttattttaaattaattgtttagataaaaatacaatgaaaagagtattatttaattgttcggatagtaataatactagtgattattcatttctcggcttagttttgaaaactgatcaaaaccaaaccagaaaaaaactataaaaccgtatgaaatactgaaaatcccaataggtatgtacataatgatgtatgatatatctgatcaagtataaggattcgagtatgcgaccatatagtcatataccaatcatcaaactatatatagattttcaaatattatttattttacagactcataattatgttgtctatggctgatcacatgcattgcaagatctcaaaaatatcatgtataaattcacgtaacacatttattacgcatgcatatatgctttgccgcatttatgtagaaggacatcatgttgagttcatgtttctctttgattgttacgtattttgtctaaatactgaccaaatattagttgtttcgttacgtaattatgttagttgaggttggagactgattttcagaagcaatttacaccttaattagtaaatatcattaaccgcagtaacatactgatatttactggcactggtccttcaatcttctaattatagttaaactaaatttgaaaatttgatcatgtcataagagcaagaaaaaaaattcgtgaataattctttcatttttatgggcttttagtattttagaagatagagtgaccattttatttaatgtagtcgttgacatttacacactatattaaaactcgatatagccatgtgatcatgatggatataaactcaaatcgatttgttaattgagaagccaatctaatttaattattcaacataaaaaataaacagtctatttttgtgtcttcagatggcaattgttattagttttcatcgaattgatccagccatctacatacataacataaaggcgcggggaaattaaacatacatcatatttgtagacttgtagttgtgaattttgaaaaagtaatacaaagtatgtaatggaaaaaatgtatcgtttctagacttggaaaacgttgggctttgaaccagaagaaggaaacatattgggtttctgaaaggtaaacgagacctacaaatacagtccttcataaataatgggcccataacatccatacttgtgtgagacagacgtttgttatgtcttcaatcatgaacatataattcctttttttcatttttttcagcaagaacaaataattcttaatcaacttacaactttaaattttttatgcttgttatatgatattatgttaaggcatggctcaatgtttttagattttcaaccaaggcctatattgagaatttgagagcttataactttttcttttcttttcaactgtacgataaattaaaataatgtatagagaggtttgcaggagccatgccttgcatatattcccgcccaattatcctgcagaattttctccacgtgacattacagtaaattccaacagtgcatgatagataatttttgtttctaagtttcttctccacttgattgatatattctgctgttttatttaccgcattatacatcagattcaccttctttaccgaagtttgattacaaatttacaaagtatcgtgaaatcgtcatgggtaataaaatcatgacaccaacatactaaacttgaaatcttaaaaagcataaacagaaaaaataatattattatctgaatcaattgattaagttcaaaagaatatcaaactgtttatgtaaagagacaaaaaaaatattttctgattcagtgaattaagttgataaggaaactgatcaataagcatttgcatatagataacgtggaaactgagagtacaactttgttttgcaataattcatgcatgcgtcgctttatcgactaatattcgtacataacaagttgtactcacacaagtcataagtacattatcattaaataacatagactatggaatcaagtaacatttaggtcacttatattttaatgcaccgcatctaacgcgattagtcattaatacacggatcgtccgatctaaaataaaatttgtttttattttatatatacagtatataacctttctcattatttcttcttaaatcattacaatcatcacaaagccatcgcaaattagaagagatttaagatggccaacaacatctcctttccttgcgccatcatatttttctctatcaatattttcttcttaatcaagtcatcacacgca

SEQ ID NO: 11718 - DNA, 3000 bp, Unknown; identical to SEQ ID NO: 11712
  misc_feature (1)..( 3000): cDNA_ID_2707265_gDNA_ID_2214512_Annot_ID_133867 3000 nt of promoter + ATG

SEQ ID NO: 11719 - DNA, 3000 bp, Unknown
  misc_feature (1)..( 3000): cDNA_ID_2707234_gDNA_ID_2214512_Annot_ID_133868 3000 nt of promoter + ATG
gaaactggcaagcacttatcctcttggctttagtcttcttctttacggttactaaagtttttctctttcttttcttctagaagaccatattgacatttttttttgtatctctagagtaatagcactaaatataaacctaacttttgatgttagtctaagacaataagacatacgaagctttaaaactctattgttttgaatgatcacaatgtcacatatcaatacttatattcgatctagaagatttggaagagtatagatttaatttgttggtttatgaaaagaaaaacagtattggtggaagaaagtattcagaagggcaaaatcgatgacatgtagatgtagatggacaaggcctgagtatgtatatgtcatttaaaaccaagcccaatttaagttaaataaataggcccactttggaaaaatgactgctgactaaaaaattagggttacgaaataaaccctaaacccagtttcgactttgtttgttttgtcctccttctacgccgcacactatctcttcctctctctcagacgagatttcctcttcatctcaagtaagcttctctctttgatcttcttcgtttagtttagtttttaatcgtaagttttcttttgattcattataatttgtttgttctgatgtttgtgagatcgataaacccagttgttctagttctattgtagagaaattcactttgattttagatttagaatcgttgcattgagttttccgatcttctataattgctccttttcattttgctgtttggttttaaacattgtcgttgatgttcctgccttgcttctctgtgattaacaatctgttcaatttctcaaaggtgtcttttttatttgattagtatagcttatttttggtttgtttatggcatgctatgtatgtaggagaaatggctgaatccaaggtagtggttccagagtctgtgctaaagaagatcaagaggcaagaggaatgggcattggccaagaaagatgaagctgtagctgctaagaagaagagtgttgaggcccgcaagcttatcttcaagagagctgagcagtatgccaaagaatacgctgagaaggtaataaagcaacactcttttgttcatctttgctgactaagatgactgttctgttcatggttgttgtaatgaatcatgatatattatttgcatgcttgtttaggataacgagttgatccgattgaagcgggaggctaagttgaaaggaggtttctacgttgaccctgaggctaagttgctctttatcattcgtatccgtgggtatgtgcctattatttgtgtgttacataagttgttgcatatagattctgttttttatttacgtgattgtttgtcatttgcagtatcaatgccattgacccaaaaaccaagaagattctgcagctcctgcgtttgagacaggtaggtttcacagtttgttattttcatccagctatattagcctaacatatgattattgattaatatttgttatatgttcaaactaatatgtgatagttgcctgttcatcatttttaaaagagagtagaagactattgcgttgtcaagaagtttactttcgtatacatttgtgcagatcttcaatggtgtgtttcttaaggtgaacaaggcaacagtaaacatgctgcgccgagttgaaccatacgtgacttacgggtatgcaatctgattctctctctttcaataggattatgtaaactaaactatatgctgctctaaaccgaatgatatatctggtgcagatacccaaacttgaagagcgttaaggaactgatctacaaaagaggttatggaaagctgaaccaccagaggatagcacttactgacaactccattgtggatcaggctctcggaaagcatgggatcatctgcgttgaggatctcatccacgagatcatgactgttggacctcacttcaaggaagccaacaacttcctgtggccattccaattgaaggcaccactcggtggccttaagaagaagagaaaccactacgtcgaaggtggtgatgctggaaacagggagaatttcatcaacgagcttgtcaggagaatgaattgatgaaagcttccttctttatctttgcaaatttcaaagattttgggaccgagtttttttttttttgttcaagttatcagagacttgtgatcttttatccgagataggctttttatgactaatcatgttattttccaatggcgggcttttaaattgatcttgaatttttattggctgttagattgttccttcgaagcccaccaatccattagaaatatctggttttgaccggttgattaaataattccggtcgagctgtatcaaagatagaatgctcttaaccggaatcgttgacttcaagagtacaagctgttctccatttttttaaagagattatatcggttgtgcgaaattgtccaaattttgtttttatagattgaccgatcaaatattgtagcggttaattcgttaaaataaaacgtttgatcagttacatttgattaattcaatatcaagtcaaaattttatcttgttaaaggaaaaagaaaaaatattgggtttagacctttgacaaaggaaaaaaatggggacttaaagagtctaattagacctcaattaacaactcttggtggctctataacattagtaatttctatttaggttgtacattgtaactatccaaaactctaaataaagaaaattacaaaacatagaggggacaaacacacactgacaccgcatacattacacattatataatgtgcatgaatacaacctacactttctagtaaagaaatgaaaatgaatataacctacaaattttaatatttaaagacacgttctaaagaataagatcgccggtttaaaacaattacctggtcatcattttggattaaactcattaggcattcattatataattgcaccaaacaagaaggggatcaagaaaatcacgaatcaccggagcaaaaaaatg

SEQ ID NO: 11720 - DNA, 3000 bp, Unknown; identical to SEQ ID NO: 11711
  misc_feature (1)..( 3000): cDNA_ID_1807771_gDNA_ID_2214512_Annot_ID_133869 3000 nt of promoter + ATG

SEQ ID NO: 11721 - DNA, 3000 bp, Unknown; identical to SEQ ID NO: 11710
  misc_feature (1)..( 3000): cDNA_ID_2711179_gDNA_ID_2214512_Annot_ID_133871 3000 nt of promoter + ATG

SEQ ID NO: 11722 - DNA, 3000 bp, Unknown
  misc_feature (1)..( 3000): cDNA_ID_2711175_gDNA_ID_2214512_Annot_ID_133872 3000 nt of promoter + ATG
agattatagcaatacgtcagaaaggtcaagtacaaatacgagtcgagcataacagagataatggaatcaatttcacagttgcaaacctgggattcacactgtcaagcccaagaaccagtggaaccaaaaggataatcggtgtccactcagactgtccttttgagaattctagacaagatttggtagcatcttctatacagagaattggagccccacctctctctccatcttcgctgccagaaacgatatgaacagccataggaagcgtctggtttttagaatcagtttgttttctcttcttgcacgctaatgactcccacgctcgacaaatggcatacggtcctacccatgacccagcagcgagaccataggacgctccagctattataagattgtggatggagaaagctgaaggctcggaatcaccaaaaggttccaaggtctctaagtattcctgttcaggaagctgcatttttaaatcaaacaagcatgaggtttccactatctcaatgcaagaaaccgggtttctgttcctagtgttgctacattgagcttacctcagatttcttagtccaagccctccccagcctatggaaaagcaacgcctgataatatttggtttgtcagaatatgttataaacttcaaaatctcatgccaaaagaaatactcttcctcacacctgagcaaaaagcatctggctacttcgaatcatgcaaccccagttcacatcgctggtataagttgtgtctctaaagggttcaaaacctgtaaaatacaattcgtaaatggtaaattttatgtaaaaaactttattttggctttaatctgtagttgagtttacaaacctttacgatatgtcatcagtattttggatgaaaaatctagttgcaatgcagccaatacagtgccagtatcggtttcccctgagttctcatccgcagatattttatagcagacacccaagagccatacgtcactagttgtgctcggaagaccggtcctattaggccctaaaacacgctcctggaatctcctaattgctccactagccatagagactctttttacaaatgctgtccaaccattacgagtggtgcaaacttgcttatgcccagaagttgaagactccctatacggttgagaaactgaggaagaagacgtaaacacgtttgaccataaggtaaacttggacttattatcactaggtccagaatctgaaactaaaggggatttatcatgcgtatcactcttgcttgatgaagaacattgttgaggaacaaatctatcacataaagccttcattacctagacatgaagcaccaactgcaacgtgtccttctcatagaagcaacctaaatcctgagaaccttatctgaaataataagcacaaaagacactgaattaacatccaacatacttttaagtagtatcagaaagccaagattgactaaaaacttccacaattaacttcaaacactacacaagattgggtgtgtgtgacttcaaggttcagaaaagtttaatcaattaactctctgagaccataactatagttttgtgaccactgaagttcagcttaacaccccaaaaacaagtaagcatgtaacacaataacgattctacaattacaaacactaagcagattttgatgagaaaataaacccaatccatagcttcttgacctcttgaaacatcacaacatagaattttccgcatgatattaggaaggtttagggagtcaacagagaaatataaaccaaaattttagagatcaaagcatttggattccacatgcatattctcttaattgaagaatgtttctagcaaatgacaaaatcaagaaacagacttgagcttgacgaaatttcaactcacggatctacagtaatcgaaaatgatcaattaatcaacttaaattttgacaactcctcttcgtgtagcagaatttcatcatccaatttagcccaggaattctcacaactccgaatttttctagcagagagaaaacaataggaaaagaaacagaaggatcacctgagagatcgatcaaatggtttcagcagacgacggagatggaaaacgcaagggggagatcgatttcgtgtcgtatcttgctcgcttcaacgtcccgtcgaagatacctcagagcaaagacaaacgtgtgtttcctttggaggttttgggacaatctcaatggcgattcttctttttaccttcttcaaatctttcgctttcaactaatgacaatctatatcgtttaattattaattaaacttcacataatcagggttatgaattatgattacacttgtttaccatttttttacgtggaaaaaaataaatactctccgatttacctgtttacttcggataaaacgttcgaatattatattaacaatgacattgatagtattttactttacttttctccaggttcctaatttttttgttaacacatccatcaacatgttaacagtacacaaaattaaaatgttgctgctgcttgctattaatgtgattagtgattacggctaaaaggctatgacatataaacgacataaagcaacaatattagtttgggttaattaagctcagctaatttgggctagttaaaaaaattggatcggataaaaaagcccatattgacactgggccaacatatcatatcgagtcaagttacggttttaccctgaagccatttatttctgaagcgtaattatcaaagagaaaaaaagattaaaaaaaaagcaactgccgctctttcttctttcttactgtctcagatccgccattgttacttcttcagttcttcttcttcaacaacaacaagaagtaataattagggttgagaaacttcgaattccgaaacaacagagagacgtactagttttagccatcttcttttcttagtttcatcgaacttggtgttacctcaataggtcgacgctcaaatcttgcttattctctggtttttagagcttcttttagattctttcgac

SEQ ID NO: 11723 - DNA, 3000 bp, Unknown; identical to SEQ ID NO: 11709
  misc_feature (1)..( 3000): cDNA_ID_2707261_gDNA_ID_2214512_Annot_ID_133873 3000 nt of promoter + ATG

SEQ ID NO: 11724 - DNA, 3000 bp, Unknown
  misc_feature (1)..( 3000): cDNA_ID_1975979_gDNA_ID_2214512_Annot_ID_133875 3000 nt of promoter + ATG
ggtttttataataagaaagtttcaccttcttataatctcagcgccgccttaatggacatctgggcttaataatggccattaacgggcctgttttggatatctcgcggtagagtcccggtttactttggtttaacccagtgaagtggtcgatgaattcaacatccaacacttgaaaaggagtcttctttgttctcttactaaaagatacggtaatacaatgctcagacaaaagctaatggatcattgaatagactcagatattacaagacaactgatagtatttacaaattcttttgttatttgaggtatgtaagaagatagattatgccaaaccgaagagcttcagtgttgctgcactagcgagtatgccatgtatggctggctgtttttactgtgtggtaaagtaaccttaaaaaatcatcaaacagaagttgtgcactcttgctgatggcacttcttctggtgttgaataagctgacttctaagatagcattcttccatctgcagaatagaagaaaaaacactttaggatttcagaaactgaaaagaaacaaatggttatgtcccccaaacagtacaagttttaatacctgtgatgaatgtgtcttaagcagtgcaactctgcaatcttctactgatgctttctctatgccgcttactctagctaattccgacatcaaagtctccatctcttgtgtctgcaaaaggaaccaaggaagatgtttcagtttcaacataggcgtgtgtaggaactttgtttttgttcatgtttaatgtgaagcacattgactgtattttgctaaccttaggcacaagatttccaatgttttgcacaatgccttccatagattttgaagcgacaacaagtgcttctgctaactctttagtctcaacctggttttgagaagcaaaatctaaatgttttagtacaaaaggtataaaggagcagaatttttcctagttgattcgaccaacacaacatataccttgatttttgaatcgagaggcaaccgcaatgaagcattcaacaaagcttcagttgtttccaatagtgaagttgagaattcatcttcaagaacagcccattgctccaaagaaggagtctgcatagagttaaaagtagtttaacaccaatttttacaaggaaactacacaattgctctaaacgttcataaatgtaaaaatagtgtgaaatctacgatatttaagatctttacttacttgtgactctacaatctccgtaacagctttaactctctgtaaatgttggagttctatgcgtttcctctgtacagaatcagacaactccgacattttcaaaccaagtgaataaaacattctctgcaagaaaaacaatttacagcatccataagatcaccatcatcaaacagaatctaacctaaacaacattcatcactaatactgaagttatgtgtcaaacattgatctatatgtaaaagctatcaaatttctgattctcagagctatagaaactgacctcagcttgtgctttctgagattgtgttttgacctcagcatttgcatttgcaaatcgccattgcaagtaacggttatggagcagtttcagagaatgcacatccgcttgttgtcctaaagctttcttctgcttctttgtatcggcttgaatcttcgaattaggagccaccggaggcaatgacaaaccaacaccatttttaagcgacaatgaagctctaacatctcgaaacatcgacgcatcatcggaactcagggatcgagaaagtggtgaggcggtgggagtgttaaaggcctttgcttgggttctaattgttggcaacagatctgggccgttggatttgaaaatctctctattgttgttatcttcttcaccgtctgtagaagatgataacgagatcccgcttgatcggagaagcctagtcgcagcggaggcagtgagtaaacgctgttggttcagccgcgatctagacggtggcggcaacatagccgtcgttggtgtgtcgagacggtgaccgttctctttcaacggcttagatcgaatatgctgcttagggtttttacctccgtcgacttgttgaagaggaaaaggcgagtctaagctacgcgccgtctcggaaggacgattctcgtctccctcttgcattttcaattgccgtctcatcctctgagccgaagtcgatctctgattctgatgttggtgatgatgtctaggagaatttgaagtcaattgatggagatctccggcggaagaagaggaagacgacgatgacgaagaagaaatgggagacatgaatctcgagctcacttctcttactctcggccgcctcgtagaaggaggaggaaccggcgccggagcattaatcgcaggtgtagatgggtgttccatggatcggccgattctcgcctccatttcaatcaaatttcttcgaaattgacaaaatcaccggagattccagatgccggagatttttttgttccgataagaaaacagaaattattcaaatcggattgaaattttcgaaaccctaggcgaagaggaagagaaaaggggaagaagaaggaaactagccgttgagtaaatgcttcacaaagcgcaacggttctcttcttgtccgtgaaacgataggttttttttttgtcttgctttctcgattaaattaaattaatcagataagataagcaagattaatgttttgaaaaaaaagataagcaggattaatgttggtgggcctattaatattgggcccaataaggagcgtttgtgttctttaaagtaatgggttataaatgtataaatgaaagttttgttggatcattttgcaattgttttaaccttccgacattttcctggatagactgaagaaaaaagttgggagtgaaaaagaggtgaaaagaggagactttgacttcttctgatgaactttcttctgcacttcttctcattaagcctccttgttaaaataatttgagatggcgataggaaacccagaagtagcaactatg

SEQ ID NO: 11725 - DNA, 3000 bp, Unknown; identical to SEQ ID NO: 11707
  misc_feature (1)..( 3000): cDNA_ID_2707226_gDNA_ID_2214512_Annot_ID_133876 3000 nt of promoter + ATG

SEQ ID NO: 11726 - DNA, 3000 bp, Unknown
  misc_feature (1)..( 3000): cDNA_ID_2711267_gDNA_ID_2214513_Annot_ID_133881 3000 nt of promoter + ATG
gaggaaggatttgaaccagatgagaggacgttggtgagtatgttgggtgcttgctcacatttgggtgatttgagaactggtagattgctggaggagatggccatcaccaagaagatcgggttaagcacgtttctggggtctaagttgatcagtatgtatggaaaatgtggtgatttggattctgccagaagggttttcaatcaaatgattaagaaggatcgtgttgcttggactgctatgatcactgtgtaagtcattgttcgacactgtattcagataaaagtatgattcttaaacccgttaatgaagctaaatttggactgttttggttgttctttatcagatactcacaaaatgggaagtcaagtgaggcttttaaactgttttttgagatggaaaaaaccggagtttcaccagacgcgggcacattgtctacagttctgtctgcttgtggttcagttggagctcttgaattaggcaaacaaattgagacccatgcatcagaactttccttgcaacataatatctatgtggccacaggactagtcgacatgtatggaaagtgcggacgggtagaggaagctctgagagtatttgaagctatgccagtgaaaaacgaagccacttggaacgctatgataaccgcttatgcgcatcaaggacacgctaaagaagctcttttgctgtttgatcgaatgtcagttcctccaagtgatataacattcataggagtgctctctgcttgtgtgcacgcgggtttggtccatcagggctgtcgatatttccatgagatgagttctatgttcgggttggtcccaaaaatcgagcattacacaaacataatcgatctcctgtctcgtgcggggatgttagacgaggcttgggagttcatggagaggtttcctgggaagcctgatgagatcatgttagcagcgatccttggagcatgtcataagagaaaagatgttgcgatcagagagaaggcgatgaggatgttgatggagatgaaagaggcgaagaacgcaggaaactatgtaatctcttctaatgttttagctgatatgaagatgtgggatgagtctgcgaagatgagggcgttgatgagagacagaggcgtcgttaagacaccaggatgcagctggattgagatcgagggtgagctaatggaatttcttgccggaagcgattatttacagtgtggcagggaagattccggttcgttatttgatttgttggtggaggagatgaagagggaaaggtatgaatttggttacattcacctgtgactttctcggagagtgcaagtctagtaaaatttgttgtaaaataaatttgaagttttattttgaatgtatatgaaacttaacactaacaattaaaattactttgaatctataatagttacgtctctctctagttattatttaatcattcagtaatcaatttttttctgttggtattgtaatcaccgattcttaaaattagtagagaaaggcaaaaaaaccgaacggaccagaaaagagaacattcgccaaaccaaccaacaaccgtttgggtgagcttgacgagaacgacgtcgcacccgccattttctccatccttgaagcaacaccttcttcacttcagatctcttcttcttcttcttcttcttcttcttcttcttctttgctcgcaccttccgtgctattgtatttctagggtttcggatcctgtgccttaccttagatccgacggtggagtagaaatcactctccctgtctcttcccttcttttttgtttccagtttttgattgaagatcccttcgtggatccactataatggcggattctcagccaatcacgcctggtcaggtacggtatctcctaactttgtttttttttgaagcttcagcgtcttcttaaatttcatttttttgctacggtttcaaggatttgaaatgaatagtttctgttgaacgagatttctactataatcgataggttgtggagtaattgaatttacaatttggattagtttactagagggatcaaattttgctagtgtcttcaaatgtagtagctttcaactttgaattttgaaaatgtttctcaccagagatttggtttggatgacctttcatatttctttaatgcaggtttcgtttctactcggagtcattcctgtcttcatagcatggatttactcagagtttctagagtataagaggtcttcattgcactctaaagtgtatgtatcaggactctaatttaaatggctctcttgttatatgtatctaacctcttagtaacctatacttcttacttgcagtcattcagataataatttggttgaacttggtgaggtaaaaaacaaggaagatgaaggagtagttttacttgaaggaggtcttccaagatcagtctctacaaagttttataactcacctatcaaaacaaacttgattaggtagttttactgatttcttcctttgtgtttttttgtttcttagagtggagtgttctttcaacaaacataaaccatttacgtttgtctacttgtagatttctgacgctggaagactctttcttgattgaaaatcgagcaaccttgagagcgatgtaagttccttaattttatcagaatggattcatactgttcttcattccctctcatgaccgtattacttcctttcagggctgagtttggggctattcttttttacttttatattagtgatcgaacaagcttgcttggagagtctaaaaaggtgcctcctttaaatctatgtgatggattcttttctcagtttcaactggtcatcaaaattctaaaaccatttatgtgttatatatagtgttatagcacagatgtcgttaatagtttagagatagaaatctaacatctgagtctaaaaatggttctgcaatttgtgacacttttttcgtatactttccattttgcagaattacaacagagatcttttcctctttctctactgtcttctcatcatagtttcagcc

SEQ ID NO: 11727 - DNA, 3000 bp, Unknown
  misc_feature (1)..( 3000): cDNA_ID_1807534_gDNA_ID_2214513_Annot_ID_133886 3000 nt of promoter + ATG
ttcaatagaaaaaagaaaaatgaaaatttaaatattcatggatgtttgaatacacacaattagaaactattcaacgcccatataaggcaattcaagattttcaattaaaaacttgctaaatctgcacccttgtgattctccacctccattactatatatgaccctcgttaggttcaatgaaaattctctacctccatctccattactaaaaacagagacatacaacaccaaaatcttcttcttcaccaacatattcactttcacagcaaaaaaaaacgagaggttctctcttattcgtaccgttttagcaaacaaatgggtcggagaaagatcaagatggagatggttcaggacatgaacacacgacaggttaccttttcaaaacggaggactggtttgttcaagaaggcgagcgagttagccacgctctgcaacgctgagttgggcatcgttgtcttttcaccaggaggcaagcctttctcctacgggaaaccgaatcttgattctgttgcagagcgattcatgagagaatatgatgattcagacagtggcgatgaagaaaaaagtggtaattacaggcctaaactgaagaggctgagtgaacgtctcgatttgctcaaccaagaggttgaagctgagaaggaacgaggcgagaagagtcaggagaagcttgaatctgctggggatgagagattcaaggagtccattgagacgcttaccctcgatgaactcaatgaatacaaagataggcttcagacagtccatggtaggattgaaggtcaagtcaatcacttgcaggcttcgtcttgcctcatgcttctctccagaaaatagctagaccgacttgttagagttacattctattttttgtatcagcctacagaacttaccaacacatgaaagttattgctggtgtagaattttctgtcatctatggggtgtgactttctatttgacatcaaatgaaaatgtacctggaaatttgtctgtattaatctcaagtgtacttgctaaacttgatcagctttttcgtcactctgcagtctggaatttttgtttcaaacagaatcgagacaataaaaagaaacagtaaaaccctttggcaaccactcaagaaactggttagtattcattgatctccaaatgcaatccacagaaacatgagtatcagtgaaagaatgatctcaaaaacgaaacagaaactcttaaatatcaccgatatacaaacccatcctagaaggcttagaacaatgtttctaatgtggtagaaactaaaaagtaatctattcagaatagtctgagtcggtctctgattcatcgtgggcacctgattcctgcaaaatagtaaaatgaaaagctcagactaatgttttatcaccgcatcagtgggacactgatgtgaataaatattaagcaaaaacaaggaaaaatgaagaacccactgatgtgaataaatattaagcaaaaacaaggaaaaatgaagaaaacggtggtaccattctcttggtatattctgtcattgctcggtgaaattcttccctcttctcagtagctatatcataatactttaccttttcctacaaaacagttgaggaacaaacaatctaggagtaagaaacttccgtcaaggtctcaaccaaagatatctaggtaagaagaataaaatgagatattgttcgccaaaaagaacaagactggcaacacctgactcattttagaacatatctatccaaccactatatatgctaacatgaaacctatttcattgcttttgtgagtcatcccaatgtcagatatcatacatttgactatgatttgaataacattatagaggagacttttagaagatagagacaatagactaactgggacagaaaagcgaaacccaaatgttacctcgtaagtcattgttttccatttctctccacatgtcttcccaatctgtacagaatgaagaacaaaacaactttagcaaaagaatcaaagtgaacataatagccaccatgttttactttgacatacaaaaccaacaaagtaatattctacaacctcgcgcatggacttgacatctggattctcctcttgatattgcttccggaaatcatccctttggagccaaaaagataagacaatatgaggcaagaggaaaatgaatacaacaagtgtttcttcgtatgttttctaaagtaaccagaacacataacaacataaataatcgcatcctaaagaccaatggcaaaatgcacacaaatttctacttaagagaagacttaaggaagtccagctgagcttaaatatttagataacaatttggaatcatatgagagagagtacctacaggaaaaagaagaaagcagtggcaggtttcttgggcatcttcgtttggagtttaacgggtttcttcttggggcttgtctttggctttctcaaaggctgaagtctcagtcttgtagacctccttgcaccttcacttgacttcacagccaactctaagttcctgccaagattttacaacacaattaacaaaaatctaactaacatcctctttccttgctcttcttctcacccatttgccattggatagcataaagttcacaactttcatatccaattccctatctaaccacttaatcagtaataaccagagagactaagcagaacccttaaaccctaaacagagaaatcaaagcaaaaccaggtgtaaaaagccaaacttgttctgtaacctatcaaagccagacacaaaacttaccgactagagcctccgctgcacgacggagacaaaggccctgacttgggagctctcttcgtcattttctctcactttctcggaatcgaactttcgttcgctgcctctttggggtttttccgtaattgcgtactgaaacagattgtcggagacctttgccacgtggcgtaatctaatcaacaaaaaaggcaaagatcaaaaatttacaatttaacaaaagttaacgtttgtggcagagaggttacacatcg

SEQ ID NO: 11728 - DNA, 3000 bp, Unknown
  misc_feature (1)..( 3000): cDNA_ID_1808663_gDNA_ID_2214513_Annot_ID_133887 3000 nt of promoter + ATG
taacactgtgacgataggtgtagtaaagtgttgatgtcgcaaagtaaacaattccgaaatttgatggcactatggttgccatgaagtcacccatgttttctcttagaaaaaatttgattcctagttttttattctctttttgtgtcaactgtcaaggtttcacactttcaattatataggttctagctactaaccaaagtttaagacctgattatttattttaatgatatttacaatttagccataaaagcaaagtacgtaaaaactgagaagatttactattattgtatatagttatcttatagtatagagagtatgtacagattgatatttctataaattaatcttagttttggtttaagttttggtttatggcttatggtttaagcctttggttaagttgtatataaacccccaattgtattattttctaaattaatgagaatgagatttaattgctaatatttacaatgcgaagaaaaatatatctgaagatgctgacatatgattttgacatatgtattgatttcttgtcaaacaattatgtttggataggagttgctgagcatcttgattaaacagtacaatttaatcatatacaagtccttttgtcatcgtcgagagtcttcatcaatggcgttggcgtgtcacaattatgcaatgaatgtgtgagatacacagtatgcaataacgaccttgattaccttttttttttttttttctttcttgcgctcgtgtttgcgtgtcctcatcacccactaatttacttcgttggatctcacaatgctactatagagtggattggacctatatatgtgtgtttgggctttgtcgtaacccacatctgtcttctgtcgttttgctttaaacagataaagtttggtagtttttcactttcatattttttggttaatgattttcactttcacccctcttcaaataaaatggttttttttttttttttttttttttcccgtatgtgtgtgtgcactatttggcctggtaaggatataatattgaaacttgctacaaaaatttgactagagagaaataataaaatgaggaggaggaaataaccaaatttcgggtgggctaagacttgattacaattaacagcccattgggcttttatgatatcagttttagaattagggtttttgggcagatgctcatttataaagaagaagaaccctagccgcttatatttggttgaggtttccaccgcattgtctctctccagacgaaaaatgggtgctttcagggtaagctctttgattccttgttgatttcaatgacactatttgctgctgattcaagtttcggactcgaagaaagaatctgatctaagctttgtctggtttcatttgcagtttcaccagtaccaggttgtgggaagagctctcccgacagagaaggatgtgcagcctaagatttacaggatgaagctctgggctacgaacgaggttcgtgccaagtccaagttctggttagtaatcatattctttctctctctcttttccatttttgttgctgctgagaatgatatgagcttgatctttaattagagtgtgttatttggattaggtatttcttgaggaagctcaagaaggtgaagaagagtaatggacagatgctcgccatcaacgaggtacttgttcatttgtgaaatgacgcaatctcgtttgacttcttatatcttattgagttaggcacttagattcatttatctggaaagtgaatgtatttgcttgactagaacactagggttttgattgatcacgtttgcgtctttgtttaacctataaatgcagagtcttttgtttgcctgactattatacaatacttttatgtaactttcaaatagcctgatcatgcaaatctctcatggctttgaatctatttgtatcatacttctaattttgctgattctgataatttctttgtctgttagtctaggttaatacttttcatttgctgtctgtcatcaaatgagaaaacttagattcaccaaagtctcttacttgattctctcgacttgctattgaatcgaaattgaaaccatatcacgtttttatcatgagtttatattgtttgattgctccttggcccctctcttgactaatgtaatctattaccaaattgtttgcacagatctatgagaagaacccaacaacgatcaagaacttcggtatttggttgaggtaccagagtagaactgggtaccacaacatgtacaaggagtaccgtgacaccactcttaacggagctgttgagcagatgtacactgagatggcatcccgtcaccgtgtcagattcccttgcattcagatcatcaagacagccactgtcccagccaagctgtgcaagagagagagcactaaacagttccacaacagcaagatcaagttcccattggtgttccgcaaggttagaccaccaagcaggaagctgaagacgacttacaaggccaacaagcccaacttgttcatgtaaaacgtctctgattgactcttttttggggtggaatcgatgttgaagctgtgctctctcccgttttggattttatcggttatttttgtttttcaatatgttaggcgtactcatgaatgtgaactcgactttgtctggattttatgcttcttgtttcctacttatgaaaaaacctttcccttaattcctatattttgtgctctttattgtgttaacaaccatcgcttctttaaagtgaaagattttaagtcttggactgtgataccaacttggtgtcagttaaaatacgtttcctctactgtaattttgccttcaaacacttaacatatgacaggggtattacagtcattttatgctcccgacagagaaagcatctcctttcacttaggatagaaaaatatagaaagattcttacattaaaaactgtgcttaatgatcccagaatcccagtagtagctctactcaaagtcaacacagctaccggaagaagattcgagtctctcggaaatg

SEQ ID NO: 11729 - DNA, 3000 bp, Unknown
  misc_feature (1)..( 3000): cDNA_ID_2685989_gDNA_ID_2214513_Annot_ID_133888 3000 nt of promoter + ATG
tggcctcgctgctaactacctcatcggcaaattcatcatctacatcagagacacagagctttctcatcaaatattctccaacgttcgtcttgaagcttttcaccctctaggacatccttttggcaaacaactattcggtgatcatagcctaatctacttgtttggtgaggatcacaaaactgttcgccgtcaccttgctcctaacttcacccccaaggcactctccacttactctgatctccaacaaatagttatgctccgtcatctacgacagtgggaggaaagtttctccggcggaactaagccggtttctatgcgagaccttgtccgtgaactcaatcttgagacttctcaaacggttttcgttggaccctaccttgacaaggaagctaggaacacgttctgtactgattacaatctgttcaatctcggatctatggcgctcccgatcaacctgcccggctttgcgttcaacaaggctcgccgggcggtaatgaacctggagaagacgctctccgtctgtgcgggaaaatccaaaaagaggatggctacaggagaggagccaacatgcttaatcgatttttggatgcatgcattcgtcacggagatagaatccggtaatccaccgccgcttcactccgaagacgaagccatcggcggtttgctcttcgattttctctttgccgcacaagacgcgtcgacgtcatcactcctttgggcggtgacgtttctagaatctcatccgaaagtgctgagcaaagtgagggaggaagtggccaagatttggtcacctcagtctggccatctgatcacggccgatcagctcgcggagatgaagtatactcgcgctgtggcacgtgaggtggtgagatatcgaccaccggcaactatggtcccacacattgctactaatgatttccctcttacagaatcgtacactatcccaaaaggtacaatagtgtttccctcggttttcgacgcctcgtttcaagggtttactgaaccgaaccggttcgatccggaccggtttagtgagacaaggcaagaggatcaagtgttcaaacgaaactacctagcttttggatggggtgcacaccaatgcgtaggccagcgttacgcattgaaccacctcgtgctcttcatcgctatgttctcatcgttgtttgatttcaagagacttcaatcggacggttgcgatgacatcatatactgtcccacgatatcgccaaaggacgggtgcacggtgttcttgtctaagcgcatcgtaacgtatccgaacctctgatttggatttttgttacaaattattggtgatcaaagtcaatactcatgagtgtgattactattattgttgttcgtgatcgtgatgtgtctcgtgaggtgagttccactagagcgttatgtcttgttgaatttgagaagtcattgttttgccattaatctgtactgtcttattttgtttggaccccagtgattctataacgtgtttcatgtattttatgtcattttctctatttttcgattcaaatagagataacaatatcgcctcgtggtatataacgacagaaagccaaaaccgtaaaagaattcacacattctcggtattattgtacatttggatcgttaagatatactaatatacatatacaaccctatagttcctgttagatttttacatttcattttcttatttacatttttgtaagataattaatattaatattttatctatacgattagcaagataaaataacactgtgacgataggtgtagtaaagtgttgatgtcgcaaagtaaacaattccgaaatttgatggcactatggttgccatgaagtcacccatgttttctcttagaaaaaatttgattcctagttttttattctctttttgtgtcaactgtcaaggtttcacactttcaattatataggttctagctactaaccaaagtttaagacctgattatttattttaatgatatttacaatttagccataaaagcaaagtacgtaaaaactgagaagatttactattattgtatatagttatcttatagtatagagagtatgtacagattgatatttctataaattaatcttagttttggtttaagttttggtttatggcttatggtttaagcctttggttaagttgtatataaacccccaattgtattattttctaaattaatgagaatgagatttaattgctaatatttacaatgcgaagaaaaatatatctgaagatgctgacatatgattttgacatatgtattgatttcttgtcaaacaattatgtttggataggagttgctgagcatcttgattaaacagtacaatttaatcatatacaagtccttttgtcatcgtcgagagtcttcatcaatggcgttggcgtgtcacaattatgcaatgaatgtgtgagatacacagtatgcaataacgaccttgattaccttttttttttttttttctttcttgcgctcgtgtttgcgtgtcctcatcacccactaatttacttcgttggatctcacaatgctactatagagtggattggacctatatatgtgtgtttgggctttgtcgtaacccacatctgtcttctgtcgttttgctttaaacagataaagtttggtagtttttcactttcatattttttggttaatgattttcactttcacccctcttcaaataaaatggttttttttttttttttttttttttcccgtatgtgtgtgtgcactatttggcctggtaaggatataatattgaaacttgctacaaaaatttgactagagagaaataataaaatgaggaggaggaaataaccaaatttcgggtgggctaagacttgattacaattaacagcccattgggcttttatgatatcagttttagaattagggtttttgggcagatgctcatttataaagaagaagaaccctagccgcttatatttggttgaggtttccaccgcattgtctctctccagacgaaaaatg

SEQ ID NO: 11730 - DNA, 3000 bp, Unknown
  misc_feature (1)..( 3000): cDNA_ID_2994343_gDNA_ID_2214513_Annot_ID_133891 3000 nt of promoter + ATG
aaagaagcaaaaggagctgagctattgaaaaaggcattggagaaagcaagaaaagaagggaaaggtcatgaggcttatgagattgagatgttgcttgtggagatgttgatctacttggtttgctttctgaatttcctttctcatatatatgaatttttttcaccatctttataataaatttatttctttgtaatagggaaacatggaagaggcttcaaaatgtaagtgtttagaggatgaagtcataacagatgcaagacgtcctctatatcaggcaagtcatatacatagtaatccttaattccatttttttacttattgttgtgaccaatgtcgttttatctctcagactataatccattaccttcaaggtcatcctatgaagcaagtcgaggagacattcaacaggttcagagagattcaaattggtctacaatggcctggaagctcagaagaatgtgaaattgaccaagtcacatttgatgagttcaagaaagttatggaatctctcaagcatgaaatcgaagacggcaacaaaagaaagttgaagttagtcaaagataaaactatgagagatagtcttcattaatttcaagcaatattagtgtgttattattcaagaatgatcataagatttggtacataaataatgatactcttgacaaaatacatcaaactagacccaaaaaaacatttaatatacttatatacatgtatcattttcatgatgaaacaaatttgaatgtatgctgaaaaatgttatcaagtaaggatgtaatcttttgccaaaaatagtaaggatataaaatgtatcactgaaatgaatcaaaacgatattggcacaatggtttaagaaaaataaaagtcttattaaagtagacgagctcttagtgggccgattagaattggaaaaaggcccaatcattgtctcgagtagaagtgattgtgaatctgaaatttgctttcttctcacagagaaccctaaaaccatttccgcggcggcgtttctcggaatcaatggcgagtctccgaagagtcctgctcaacgtaacttcctattgccaacgttctctcactcaatcgtcgtattctacgtcggggatgttatcccgatcggtggtcaagcatgcgaacaatctcggtcaaattcaagctagacatttcacgacaacgcttatgaaatcgggaccaaagcatagtggtacagagcaaggcgtgaagcgaaacagtgcagatcacagacgtagattgctcgcggctagatttgaactgagaagaaagctatacaaagcgttttgcaaagatccagatcttcccagcgaaatgcgagacaagaatcgttataagctctcgaaattgccgagaaacagtgcctttgcgagaatcaggaacagatgtgtgttcactggtcgatctcgttctgtgactgagctgttccgtgtttctcgaatcgttttccgtggattagcatctaaaggtgctttgatggggataacgaaatcgtcttggtagctgcattatgtgactgatctatgtaagtgtttttgattctccttatttttctgtgtttgcttagttacttagatgatgatgatgatgatgaatgaatgatggtttgtttcagggaagaagctgattctgaagaaatgggagcaaggaatacaaagaacgtttgtggtaaatacagttaccaaagtagctgtttgtatgatggtggtggaaacattttgacaccatcacaaaacttagtttgcttttcactagtgatgctctctctttgttttacgatcttgctcagctattctagcaattctcgttgaataagttatacaaagtcacaaatcttgcttcttttttatgatctcgattttgtagtttattgtagcaattgtggttgaattaagtatgttatagacaactcatagagtcatagacttggtgtctgatgcattgttaagtagacggttataagcaagcagcttaggagcaatttagatgggacttttatgctgaggaagtaggtggtaactctgtgaaaaggagggaaaactcactaaactaaaacatcaaaacgtagtagtttcatatgaaatcaacccccatattatatgctaatgtgccatttgggatggtcaaccaaaatctaactagaagtaagcaacactttagattgacaaggtattgtatagtaaggtgaaagcattcagcatctaagcttgagaaagcggacatcatctatgatcaaccatcgtttaaggttagtgacagaatccatgtcagacttttaacatatctttacatatgcatccatgttagggttgacggctttgactgaaaacatttatgcaaagaaataatggcaacaatcataatgtttgtgtaacataatacaatagtagcacttaggtacttgtgctttgtttttcacattgttgaaattcttgattgcttcttgaaacacttattcacattgccattgagtgtctctgaatctaaaaccagcccatttcttcaaaaatctaaaagatgtctttttcctcgatctccaaaagatattgcaacaatccctccccacttgttcttttcgtctacacagctctacccttggactgatataaagagtaaaaacaagttggctatttcttacaaataaaaagaaagaaaagaaaagtggttattggtccatattagataaatgagtaagagagaacctagtaaaccactgccgtagagaccaatgactacgaccaccacgcggtttgtgatgaagagggtcccaaaatggatacacttctctacctattttttaacatatcctacaaaatctcaatggtttttatttagttcgataaagtattattccgaatgtaaatagtggaacaaaaagaacagctgggaggattttgtttaaaaggacactacacttcccagctttccctcactgcccgaaaagaacactgcagaaacactttcctctgttcacagagaaagagagagatg

SEQ ID NO: 11731 - DNA, 3000 bp, Unknown
  misc_feature (1)..( 3000): cDNA_ID_2707298_gDNA_ID_2214513_Annot_ID_133902 3000 nt of promoter + ATG
ataaaaaatcaattgcatgcttgttatcttcttcaattaggttgcataaaatggtaaatagcctaaatgttagaccactatacacgatctttttttaatgaaagatacactctacacactaatctctaactttgaataacaaataaatttatggggaaaaaaaaagcgcgatgatgcaagaatagtcgagaaattagccaaattaagataatcataacacttgtacgatgaattctagaccagccgccaatgtgtgagctcatatgaatttcgctaatgccacgttatacaaaacttaaccaacaagctgatagtcaatccaaattttctatgattacaatatgatgtataaacatattttggcttcttatgatgatagaaaaaaattaattaaatgtctggcttagtaatgaattttatttgctgacgacccaaaaatttgacggatttgtcgagaactgcaacaattcatggaaaaatgactgtaataatagaggtttgaaagattaaaataaaaacccattcgagttttactttcactccggataaagaaacagataaactcacatcaatgatcaatccttttgattgaatcttcaaattttatttttatatatgtaaaatttgaatcattaggtgatgcaacaaaataaacttcacttttttatagatacgtggaagcaaatctatcatatatatgttgttttgattttactttgttgtgctgtcaaagcgtggtacattatttttcttatattgtacatatcaaaggtacctaatgtaatgtataaatataagaaaaataaaaatttacggattcctgttgttgtcacaaggttacgtgttgacgttatgcggtactaagcctctgtaccttgacctaaaataattttccgatttgcttatatcacccgatatcgacaataattttaattttgtaattatcttaatacaaacattaaatgtaatgtacattttccaggtaaacaaaaagaaaatcattgaataatacttgcagaagacgattggtatttccacgtaactcaacatgaaacgacaaataccgaatcgtggcaggatccgcaagtaagatatagtagttgaaacaagggtaaaatgggaaattcacacactcaataattcaaacttacgatcacaatataaatagctccaaccatgaccaatccaaagatcatacacacgagacctcaagtcctcaaggttcaatttttcaaatccaatgcccaacttatcaggagctatccctgaaaatgacagaaatgccctcgtacgttgtcgaaacccccctcttcgagccttacaagcccaagaaacaatacaaattgtactcttcgttgctcccgatcatcttatctatcttcacctacattttgatcttccacgttctcgacgtgtctcctttgtcgatcttcaacgacacgaagatcttgttcgtcatctccaacgcacttatcatcatcattgccgccgattacggtgcattcactgacaaagagaacctcgatttttacggagaatacacagccgcgatgagaagggatgcacaagaaaaccctagaccggaaaagtcggtctatggggtgagtatggcggaagaaaccaagaaccgtgagaaacaagaaggaccagtgggagcgagagacttacaagatcagtatttgcctaacaagaaagcgaaagttactgagagaatcatacaagccgtgagcaagaaccaaccgagaaacaaagccattgaaaagtgtgagccagtgactgagcaaaatgttcatataatagctgcaaaagaagaaacttgcaacgcaagcaatctgatgaactctaaagcctacgggcgaagcaaatcggataaggctcgtgggtcagtgatatccaaggaacgtcgtcgtcaagagatcaaacatagacataaaagttacgatcggagtcaatcggatagctcgaaatggatggttgttcacaaggggaagaaggctgacgaggagatggaggaggcgacgaagaagtgggagaatgtaaaagaagagtcggaggagttctcgaagatgtcgaacgaggagttgaacagacgagtcgaagatttcatccaacggttcaatcgagatatcaaacgacaaatttagtttaatgtaatttgttgttgtaccaatacggcaaatttagtcaacctttttgtgtcgtttccttccctttttttcttttgtcattcttgcatcttgtttattagagttggtaatgagatcatggagatattaatcgttagtttaatttcaagggttaaaataaataaaaatttaaaagtaaaaattgttgcgacttttttaaatcgatggaaactgattcaaaaacaaatttactttacagaatctctcggtatttcagacagatcacactagtacattagataaagcgttggatcgaatcctcgtatatgttcaaagaacagttaaaatgagttacatgagtctttgttgttgttgttgactaaatttgccgtataggtacacctcaatttcggcactcttctctcggatccttccatggtatgattctgttttttctcgtgacttgcgtgtttagatgctcaccattggagctcgctaactgcaattcctatatgttgattttgaaacttgtatcatccacttttgatttgattctagaatgttattagcttgagcaaagcaaaatcaattctgaggaagagactcatcagacgaacaactatctagagaagatcaaacattagaacactgatgacgaattgtaacctcaaatgagccaatcattgcacaagaggagtgccacgtgtttggatgtgtgttttggattatccaaactacaaaaaagggaaacactatctaatctcaccaatcacaaaagagaatagtgccacgtggaaaacaaccaccttaccttcacacttcttcttcttctccttcggcagaccatccaaaggccacatcatctctttccacc

SEQ ID NO: 11732 - DNA, 3000 bp, Unknown
  misc_feature (1)..( 3000): cDNA_ID_1832288_gDNA_ID_2214513_Annot_ID_133904 3000 nt of promoter + ATG
tcatacacttactaaacacaaatatcaattgtcactcacagcgtacgtgatgatatgaagaagagttttctcaaggtagctatttatgtttgtaatgtcaactaacatgatgctattatgaccgaagctcttcctcaagatattttcattctctattcagtcgaatttcgtcagtttcatcaccctcaagacatttcgattgaatagcttgtaatgacgtgttataagcaagagtacacatagttgctcgaggttggtagagcaacttagaacattgttagctacacttgttcagtgactagcacggaattgtatatagaaaactgcccacacgttactaaattaatgaaaaatatcctttcacacaaatgcttgttgatatctatctctggtctagctttaaacttgatatttgtctcattaccacacaaaaacaagggaacatagtaggtgatcgggtatatctatatatatgtacattaaataacaattttttgtatcatcggaccaagcttgtgacggtgaacaattgaaatgaatggagtatagaataattgtgattaataattgaaaacacataaaataacatgatttgttagatcttgattaatactataatagaaagaagagaagtgtgacaacacatgggatgtacccaacaacacaagggacagcttcaccagtctgatttatgccactgtcccgttcttgtcctccctctgccccaccactcctttgttttatttcatcagtaataatactactaattttagttagtgtttagattaatcataatgcaataaacaaagaaaaatatctgatttttggtagaaaaacataccagcagctcatatactattagttcatatttttaaccgatagttgattgttaaaaagaatgttgattcaagaattttgtaagaattgcaacattgttgaacaacagtggcaaaacataccataaactaatagatactagtaactatgatcactgatcaaataatgtataaatcggagattattctatgtaacatttaacaaaagtgtattacaagtaaataaagaataaactttttaagttacgaatggtaaaaaactaaagaaatttgttagttctctgtttgtatgcatgcattgtctctctgctaaaatgttcatgacaagtccacatctactcaaatactcatcgaggtgattatcctcgtcgtcgcttttatacacatgtaatattacacacatctatacatggagtatatttttagcgaacggataggtgccatgtggaggtaagtacacgtcgccacttgtgagattctgttccaattacttgtggaagtgaattatgtcgcagaaaaagtttgacgagatttccaattagccactcatttattaacggtcaccaaaagcatcaaattacagttttttttagtgctttgagattcttttccctgacatattgttttatgtaaaatagcaaactcgaaaagatagtaatagtatccaaattattattattacagtattatttttgataaaaggttgttattctttttttatttttttatttattgtatctattatataattcgaaactgctatattgtttgtctttagtttgcatctctagctttatatatgcttatgaagtttcaaatgttgctattatatgctgctgattctttttttcttatgtaggagtataggtttgaccgtttgacaatacgagaggaagaggaagttgggaaaaaacgacgccgcatggatagtctcgctcgttgcacgaatagttcaaaaggtgacgttaggcgcgtgcgggtcagcgaaacttgtgcctagtcagacctttgtggtatagtcttacgtggtctacgtctgccaaatttcagaaaaccaaaaaaacaattatatgtttggtccctagaaataaatattatcgtcgtttagcaagtttgaagtaagcaatagtagtattaatgtataaaaagtgtaggatattaggttaaaataggcctgtgatagataccgtaatgtctatgatgtgtctggtcagacccatttaatattggttcagaccatattagcacattagccaattgccattcacgttgggtccaaaccttcttccttctatagtgtcttagacaagtacgtacacacgctgaagtacaaatcatatacaagtatttattcacttaaaggtacaatgattgatgttttttgtgtaacatgttcctctagtccactatattaatccattacggagagaactatctaaaaattgtataatcgcaattgtaaattgcaaatctattaacaaaactaagatgtgttcacatgcatacttcgataaacattcttccatatatcttttgtgttaaggcatgttttaaatgatcaaatcacatattgattttatttgaaagtatatcaatataataaactgtttagaagatgttttgccaaaaaagaaaaagatgttttgttcttcttggaagtgtttgttaaagcccaagagagacttcaagctcacaatttctcaaagatccattaatactgggccttagttagatataccaagcccatatactttctcttcacaaattcccgttctaataccggcgcgtcgtgaaatctagagattttgccgtcaccagaatatgttaataaacgcaggaggagataaatggataaacccaaaaactgacaagtgaaaaccttttgaagccaaaacccccttcaaaatcaagctccatgatagaaaaccctcttcctacataatctcctggtaaaacaaaaaggttagtctttttctcctcaacttcgagtgtgaagcgtttgtaaaaatgcccaaaaaaatcgtaccttgttatggacaatttgttgtatcaggttcttcttatctgggttttatgttttgtactagtttgaaactgattctgagcataattgaatcggttgtttttgtaaatgatacagtgagaagtagaaagagtgtaaatg

SEQ ID NO: 11733 - DNA, 3000 bp, Unknown
  misc_feature (1)..( 3000): cDNA_ID_1832291_gDNA_ID_2214513_Annot_ID_184355 3000 nt of promoter + ATG
caaatcctaaccataacaacagctaatgttgaaaacaaatatcaattcatctttgatgagtggagtggagccacgtaaatcttactgcatgattcagccaacttctagagtaaaattatatggaagacatcaaattggatcatatagcatcacatggaaacaagcattagaacatagccaggccgacttaaaacagagatttcttataattggtgtcgtttatataaaaaaaaaaatcaatgaacatttacattttcatggagttatttgcatttgtctttgaagtataaaccaaacaaaattcattaattagttttccaatttatgtttggacccaaaagctgtcgcgtcagaaaaaaggacccacagttcctaaatgttgccgcctgtcctcctcacatcctatgcttttatttattacactgttttagttaatctcttcatatctttcttactctctatatgattcattgattctatctttaatattctgtttttttaatcacaagttaaggtttttgtgaccaatacacatcatcctctgtctaatcgttacgattataaaactaaaacggattgaatcatcatttagcttattgttaaaaaaaagattcgagggagaaataataattggagtaaggtgggaactagtccgtacaaaacatggaccccacgaaatatatagtacgtacaagacacagaagtaagtcattccgatgtagttttagtaattggtacaagattgggatatagttaaactagttaccaaacacttggctaagagagagtttgagaagatacagaagtaacgggaacagttattgtctttaggaaccaacgaggaagggaatatctctctgggtttatttaaccataagtccagaggtcagttctgttttgtctctttgccaatttagctggcacaattacgactttgtccctcttccaccaaacatctcatgcatttttctccttatttccttcttttttctccaaacttctttctcttaagtttccaaaatacttaagagaataactgaatatagtcacagtcaaatatgttaatgtttgattcagattctttaatttaaaactaaacctagggacacttatcttaacctagggacacattaattttgaaaaacgtgttctaaggttagctaaggagagggccatgcagatatatatgcgccaaatgaatcataagcggtgggcatatttatgtctgtcctttttatggcttatgaaacaaagttaaagctatatattgtgcatgaaacttaggctacgtttcccctctattttccattcattttgaactcaacatttgcaagtgttaaccacacttcttctaactgttgtgattcgtttattctagccatttcacagattgaggctagtataagtattctagagtacattatatgaatacgtctcaaacttttactgtataaacaaaacagttttccaaccgcgaacagaggttggattagagcaactcatggaaaagataaatcggagatgaaaaaagttgtcacagtggtcaatccacaatgatatgagagtaggacaagtaggttcattcccgtataattatataatacaatatgttatagtagcccaaacattataggaggtggagctaaaacaaaacaaaaattagcgagaggagatctccaattgacaataattgaatcaaccaaaacctaacctaacataaaaacaatatcttggattcaaatccaaagcttggaacgtaacgtaacatgaagccacagaaagccaacaacatcctagtatataggttgggtcccttccagcatttgtatcatctttattaatgatcattaggtatgttcatagtcggtataaatatatagggtccgcacaaactggtacacttttttaatggcaaacatagtggtacgaattgatagtaattaagtgtgttttggtcaatagctagtttttttggggttttcaaagattatatatccgtgaccatgagttctctagttcaactctcactcacgagaaagacaaatgaaagaacatactgtactagtttttgtctaaaagtactctttgattaacctttagaaaattgatgttatcattaaacaaaaaaaatagtttcactatctcttcctataaccttttttacgggctcattgaataattacatatcttttagtacattttgtaccaagacgatataacattaccaatcatcttgaattagccagaaacaacaaactaaaactgtttaagtttcagaaactaatccatatataatgttgagattagttagtattcataacctatggagtattaatcttcaaaattttcctcatgaaatctgtatttagtcatcacttttttaacacagatgaatcactagtccaatatttctccaaaaaaagacacaagagtctcgaaattgtaatccatatctgtaattttgcacccctataatatgcctagaggaaataagaagaaaaaataatggggaaaaagagaagctactgctacactttcaggcacgtgacaacgtctcacacgtgtcatatatcttacgtcatcaagtcctctttttctctctttcacttttctgtttacctctctcacgcgttgaaaagtgcaatcaatcttacataattaaccacagtaagaaaaaaaaaaaatggtctctgtaacgtctttttactgttataaccttacacgcataaatacccctcaccaactctctctgtctcgcctctctctaaaactccaacacttctccttcttccatctctctcaaacttctgaaaatcttcttcttcttctcaatcataaaccctaaatcttcatctcttcagatcagaaactaatgtccattcaaagacaccctgtcctgtttcatctctgtcattagtcttctgttttcagattccaattttttttcttgaattatcctcttagccatttcttgatttaacttcgattttcccggcgatg

SEQ ID NO: 11734 - DNA, 3000 bp, Unknown; identical to SEQ ID NO: 11731
  misc_feature (1)..( 3000): cDNA_ID_2707298_gDNA_ID_2214513_Annot_ID_184352 3000 nt of promoter + ATG

SEQ ID NO: 11735 - DNA, 3000 bp, Unknown
  misc_feature (1)..( 3000): cDNA_ID_3022740_gDNA_ID_2214513_Annot_ID_184342 3000 nt of promoter + ATG
taaaataccagcaatattaaaatttcaacaagagccatctgcacgttgaagttggcctcaggctcgtttctgtatcgcatgtttgcgtcacgaaggagctgcaccgcctcttcacattttccttccttcatcttccgtaccgcctccatctatatttcccacaattttaatttcattgagttttttttttcatttaaactgatttgaatatatgtatatatgaaggtaaataccgaatttaaataagaggaagtaacatatataagaaaagcaaaaccgaataatccagctgtttgtagtggttcaacaatactcctagctagtcttaaaggatcaagatctcacgtgacactaaactatttgaacaaatatttatatgtttgcagattgtaccttgatggagtcaatatcgtcctttgaaggcaaagaagggagcttgtgaagattgaatggtttttgagaaggaatgggtttagccgaagcaagcattgagctaacttcaaagagagaccgcaatgcgaatttagctgggaaaggatagataccggaagtagcggatgcggctgaagtcggcttcccggatatgatcatgtcggcagagcttggataggcagctgccgcggcagtgtagctcatattatttatcttaaagccaaagatacttatggcgcaagctagtgctagggatgctcccgccgccattttcaatggccttaattgctttttatcatcgtgagaatcattcttgctgtttgatttggcgaccgtgattggtgatctgatgatcaaacggcggctttgacctccattggaggggaaaccaatatatatgttttggaatctaagagttggtttatgtgtggaagtgaaatgagataaaggaagggtgagtttttgagtatggccttgaagaaatgtagaagccatttttcttcctatgagttaataaaattggatttttattgcattggttgatctttgtgttagggattggttcttaaatttttagtttccccatagacaatttgagagttttagacttttaggtgtgtgaaggaaagcatcaatttgttacttcagacaaaagaaacttcaatttgaaaaaggcatcaaatgttttgcataaacaaacagtactgttttggtatcctttctttttcgaattacatgacaaatgctttctctattggaaatattctttgttcaatgtgtctcctctattaaagtatattaacttctttacctatgatgcaagactaacattagaataacttgaatgctttcatcttccatttgcaatccaattattgtgtataaaagaaagtttcgagaaggattaaaaaaaaaaatcattccaatagataatttaggtaagtatatggtgaatcagtccaagaacaagtttagcatgaaaaccaagtatggagcagcagttgcacctgtattcctccttgctgctgcatatgtcgcttggaactacataaatcgtggtttatggagaaagaaagacgatgaaaatggtcgagatacaagaaaaagcatcggtaaaaacatttcagaacaaagaagagatggtaatgttaaaaacatgggtaaggaggcttcttcaggaagagatgaaagaaccctctcaaaatctgtttcaatgggagctattcgaggaggaaaattagcactacagagattgcttgatttgcactcataccgcggtgacacttcttcccttgcgaatgctgaactcgaatttgaagcattgctttccaaggaaaagccggacttcgggttgcttcaggttgttcatatatagaaacttttttgctctttcggatcaaattgcatttagttaatttcttctccctcatgcagagagacattgtaaaaatggaaatgagtggaaaagaagcaaaaggagctgagctattgaaaaaggcattggagaaagcaagaaaagaagggaaaggtcatgaggcttatgagattgagatgttgcttgtggagatgttgatctacttggtttgctttctgaatttcctttctcatatatatgaatttttttcaccatctttataataaatttatttctttgtaatagggaaacatggaagaggcttcaaaatgtaagtgtttagaggatgaagtcataacagatgcaagacgtcctctatatcaggcaagtcatatacatagtaatccttaattccatttttttacttattgttgtgaccaatgtcgttttatctctcagactataatccattaccttcaaggtcatcctatgaagcaagtcgaggagacattcaacaggttcagagagattcaaattggtctacaatggcctggaagctcagaagaatgtgaaattgaccaagtcacatttgatgagttcaagaaagttatggaatctctcaagcatgaaatcgaagacggcaacaaaagaaagttgaagttagtcaaagataaaactatgagagatagtcttcattaatttcaagcaatattagtgtgttattattcaagaatgatcataagatttggtacataaataatgatactcttgacaaaatacatcaaactagacccaaaaaaacatttaatatacttatatacatgtatcattttcatgatgaaacaaatttgaatgtatgctgaaaaatgttatcaagtaaggatgtaatcttttgccaaaaatagtaaggatataaaatgtatcactgaaatgaatcaaaacgatattggcacaatggtttaagaaaaataaaagtcttattaaagtagacgagctcttagtgggccgattagaattggaaaaaggcccaatcattgtctcgagtagaagtgattgtgaatctgaaatttgctttcttctcacagagaaccctaaaaccatttccgcggcggcgtttctcggaatcaatggcgagtctccgaagagtcctgctcaacgtaacttcctattgccaacgttctctcactcaatcgtcgtattctacgtcggggatg

SEQ ID NO: 11736 - DNA, 3000 bp, Unknown
  misc_feature (1)..( 3000): cDNA_ID_3022748_gDNA_ID_2214513_Annot_ID_184339 3000 nt of promoter + ATG
tttggattccaatcttcctaaatctttttcttatatagtagccttgtttgttttttttacttcgctacacttgtgtatgtattacttcttgtaaagcatattttcattattaataatatttacatgtttagaaaaaaaaaacatcaagttggttacaccaaccatatatattttcacgtatgtatcagacaaattactaattacagtggaaactgtattaacaatcatagcttttatatatatagcctttatgtaatttttggttttcatgttaaaataagccaggccctaagagagtgtcatacccttatatattgtttactgcatattcacaaaactcaaatacagagcagaaacctttaagagaagatctaataagaaagaagaggaaaaaaaaggatggttttctcagtttccatttttgcctctctcgctccgtacttagtctctgcgttactactcttctttctcatcgagcagctctcttacctcgtcaagaaacgtaacctccctggtcctctctttgtccctccgatcatcggaaacgccatttcactcgtccgtgatcctacttccttctggttcaagcaatccgacacggcaggcacttcccctggcctcgctgctaactacctcatcggcaaattcatcatctacatcagagacacagagctttctcatcaaatattctccaacgttcgtcttgaagcttttcaccctctaggacatccttttggcaaacaactattcggtgatcatagcctaatctacttgtttggtgaggatcacaaaactgttcgccgtcaccttgctcctaacttcacccccaaggcactctccacttactctgatctccaacaaatagttatgctccgtcatctacgacagtgggaggaaagtttctccggcggaactaagccggtttctatgcgagaccttgtccgtgaactcaatcttgagacttctcaaacggttttcgttggaccctaccttgacaaggaagctaggaacacgttctgtactgattacaatctgttcaatctcggatctatggcgctcccgatcaacctgcccggctttgcgttcaacaaggctcgccgggcggtaatgaacctggagaagacgctctccgtctgtgcgggaaaatccaaaaagaggatggctacaggagaggagccaacatgcttaatcgatttttggatgcatgcattcgtcacggagatagaatccggtaatccaccgccgcttcactccgaagacgaagccatcggcggtttgctcttcgattttctctttgccgcacaagacgcgtcgacgtcatcactcctttgggcggtgacgtttctagaatctcatccgaaagtgctgagcaaagtgagggaggaagtggccaagatttggtcacctcagtctggccatctgatcacggccgatcagctcgcggagatgaagtatactcgcgctgtggcacgtgaggtggtgagatatcgaccaccggcaactatggtcccacacattgctactaatgatttccctcttacagaatcgtacactatcccaaaaggtacaatagtgtttccctcggttttcgacgcctcgtttcaagggtttactgaaccgaaccggttcgatccggaccggtttagtgagacaaggcaagaggatcaagtgttcaaacgaaactacctagcttttggatggggtgcacaccaatgcgtaggccagcgttacgcattgaaccacctcgtgctcttcatcgctatgttctcatcgttgtttgatttcaagagacttcaatcggacggttgcgatgacatcatatactgtcccacgatatcgccaaaggacgggtgcacggtgttcttgtctaagcgcatcgtaacgtatccgaacctctgatttggatttttgttacaaattattggtgatcaaagtcaatactcatgagtgtgattactattattgttgttcgtgatcgtgatgtgtctcgtgaggtgagttccactagagcgttatgtcttgttgaatttgagaagtcattgttttgccattaatctgtactgtcttattttgtttggaccccagtgattctataacgtgtttcatgtattttatgtcattttctctatttttcgattcaaatagagataacaatatcgcctcgtggtatataacgacagaaagccaaaaccgtaaaagaattcacacattctcggtattattgtacatttggatcgttaagatatactaatatacatatacaaccctatagttcctgttagatttttacatttcattttcttatttacatttttgtaagataattaatattaatattttatctatacgattagcaagataaaataacactgtgacgataggtgtagtaaagtgttgatgtcgcaaagtaaacaattccgaaatttgatggcactatggttgccatgaagtcacccatgttttctcttagaaaaaatttgattcctagttttttattctctttttgtgtcaactgtcaaggtttcacactttcaattatataggttctagctactaaccaaagtttaagacctgattatttattttaatgatatttacaatttagccataaaagcaaagtacgtaaaaactgagaagatttactattattgtatatagttatcttatagtatagagagtatgtacagattgatatttctataaattaatcttagttttggtttaagttttggtttatggcttatggtttaagcctttggttaagttgtatataaacccccaattgtattattttctaaattaatgagaatgagatttaattgctaatatttacaatgcgaagaaaaatatatctgaagatgctgacatatgattttgacatatgtattgatttcttgtcaaacaattatgtttggataggagttgctgagcatcttgattaaacagtacaatttaatcatatacaagtccttttgtcatcgtcgagagtcttcatcaatg

SEQ ID NO: 11737 - DNA, 3000 bp, Unknown; identical to SEQ ID NO: 11728
  misc_feature (1)..( 3000): cDNA_ID_1808663_gDNA_ID_2214513_Annot_ID_184338 3000 nt of promoter + ATG

SEQ ID NO: 11738 - DNA, 3000 bp, Unknown
  misc_feature (1)..( 3000): cDNA_ID_4262158_gDNA_ID_2214513_Annot_ID_184334 3000 nt of promoter + ATG
attgtagaatccatgaagaaatcctgtattcacgatacgttctattattgtaatatgttcttttgatttattttcttcaggtgtcccaccgacttttcgagcttacaaacacgttaaagtctgttttcataccaacaaaagacgacaagaggctgctccacaatgttctcgctggagctgccatctcgttctgtttatatttaacatctctcattcttctccagatcccacactaaccatgtaaggccttttactttgcatggtccattgcagccattgttgatcttggtgtgtactcgcttaggaagagatacaattctcgattaacacgctataaccattttattttgacaggagggactagaaacatgttgaaaaacatgaatctaaagctgcacagaggtttctatgtgaaacttgctaaaatagatacaacacacatctcatatcgacaataaaaatttgttttcaaagatcagtattttttgaagcttgccaagtgaagcatcttttgggtaattagaaccagagaagcttcaaaaaatggcttagagtgaagcatcttgtggcatttcgacggcatcatcttaggacgacttatcttgttcgttttctttctcgtctctgttgtaattttgctataagtttctcatatatagtttcattttgtcttttgttcgtccgtatttggtagtttgtccaaatacagaacatatgaattttacaagagtggatatttcaattcaattgagtcttcagataaaacgccaacacagttagagaaaaagaggttcgatttctatacaaagataccacaaaggaaagttcacaaatttacatagaatagaccacaaacaaactctctttctctgctctcattcacataataagcagccgctcactttccggggacgaagttggtggcgaaggcccaagcgttgttgttgactgggtcggccaaatggtcggcgaggttctccaaaggtccctttccggtgacgatggcttgaacgaagaatccaaacatagagaacatagccaaccttccgttcttgagctccttcaccttcaactctgcgaaagcctcggggtcagtagcgaggcccaatgggtcgaagctgccacctgggtaaagcaagtcctctgcttctcccaatggaccatctccggcgactctgtagccttcaacagctcccatgaggataacttgagtagcccaaatggctaagatgctctgagcgtggaccaagctcgggttgcccaagtagtccaatcctccgtcgctgaagatctgtgaaccggccttgaaccaaaccgcttctccgaacttcactccgttcctagccaatagctcagggaaaacgcagcctagggctccgagcatggcccatctgctgtggataacttctagctcacggttcctggcgaaggtctctgggtcggcggatagaccagcggtgtcccatccgtagtcaccggggaactcaccggtaaggtagctcgggggctcgccggagaatggacccaagtacttgactcggtcagatccgtaccatgggctgcctgatggaccctttggcttggcgacagtcttcctcatggtcacacggccgcttccgaggacatctgatgcggcaggcttcacagcctttccggcgaaggcaggggaggacaaagccatggttgaggaagccattataatctttgtttttgtgttttcttttttttggttgtgactggtgagagtgattgaaaatggttggggtatacgtccactttatagcaatgttaagagtaaggtttgttatctgtgaagtatctgtatctgtttagtgattggcttatgagattttgggattgtcgttatcttgtcctatgtgtcactctctagtccataagcttttgctagattctttagctgcaacgaaaacacttgtcatttgtacacaaagaaactttggggaaattttcaaagataaatgcttgaattattggaaagaaatatttgaaattattccaatctatttttttctttttccttgttttctttaattccaatccacttcatgctctcaataatattttcttttttttcttatcaagtttgtttcgaacgccaaactacaaagtttttaagtgaaactagaaacacttaccaaacaaatatatatcaatgttatgtaaaacaatgcagttagatgaaacaaaaagtgatacgaagttcttacgatcataagttaataatataaaaccgtcgacaatgatattaactgatacctttgattgattttgttgaatgttttcggcaacaaatatgactggtaagtttttcttgccaatacgaattagaaaacatgtctttgaagatgaactgtattttttttttttactttgttgtcattttaatgtactttcttatcaggattaaatcttctgtaatttagagtagtttttttaacaagataattaacaaacttagagtaatgaaaattgagatgttcagttttcactcatatttcacattttggtgaaagagtgggtagtatgcaacgttctaagtatgtttggactttgtatcatgttgttttgattctttgacgacatgtctatttgggaaacaccaatgacgtgtaccttgagactgatacgattcaaagggatagaaacacgtcagatttacaagtggcacgtcttcaatggacaatgggtattccaatatgctaagatgctacgagatatctaatttatctaacacaactcaattccaaaccaaaaatctgatgccagctcgacaagacaaaaaatctaagctcaaaaatgtcaacaaccaatagaaatcaaggcattgacgatatcacgagataagcaaattaaatcttcaagttttgcaattcatatgtacgttataaatacccaaaaacctcaccgtaacctagctatccaatttcatcacatcttattaactaaagagccttttacttgcgccacactctcaccgca

SEQ ID NO: 11739 - DNA, 2610 bp, Unknown
  misc_feature (1)..( 2610): cDNA_ID_3022765_gDNA_ID_2214513_Annot_ID_184330 3000 nt of promoter + ATG
gagctaagtcttcttcagaagtaaaggaatttgcagtagacaacgggtcaattcttgtttgagattctgagaggcggaaccgacgacccatatatgaagcctaaaacctttaaaaacggttgccacttatttgtagctaagaaaaataaactttgtgtacgtggattttcaaaaatataatcctaaatgttctagaagcttcctacatcattagggcttttctattgttacaaacaccgtcgttttttgttcgtagttttttttttaataagcgtaatcagccactgttgttgaacgaaaccaaaaaaagttatggtgagactagtttgcagccgaattctcaaatttccaaaaccgtacttatggagtgcgacgcagactacaagccgttgcttcaattcacgagcccagtctcataatctcatcacaaagacgatcacttcgtctcttcaagacgttttaacacgtcccatttggcaaaatcgaagctttgttcaatgcagaagagtctcttcctatgctcagatggttaataatcatcaatctgtgacgattgagacatttgatgctttgtgtaaacaagtgaagataagagaagccttggaagttattgatatcttggaggataagggatatatagtggattttcccaggcttttagggttagcgaaactatgtggtgaagtagaggctttggaagaagctagggttgttcatgactgcatcactcctttagatgctagatcttaccacacggtaatcgaaatgtattctggttgtcgatccactgatgacgctttgaatgtgttcaacgaaatgcctaagagaaactcagagacttggggtacaatgataaggtgcttagcgaagaatggagaaggtgaacgcgcaattgatatgttcacgcgtttcatagaggaagggaataaacccgacaaggagatattcaaagctgttttctttgcgtgtgtttcgataggagacattaacgagggattgttgcattttgagtctatgtacagagattatggtatggttctttcaatggaagactatgtgaatgtaattgagatgttggcagcttgtggtcatttggatgaggcgttggattttgttgagagaatgactgtggaaccgagtgttgaaatgtgggaaacactgatgaatctttgttgggttcagggatatttagagcttggggataggtttgctgagttaataaagaagctagatgcctcaagaatgagcaaagagtcaaatgcaggtcttgtagcagcaaaagcatcagactctgcaatggagaaactaaaggagttgcgatattgtcagatgatcagagacgacccaaaaaagcgtatgcatgaatttagagcaggagatacttcacatctggggaccgtttctgcattcaggagtttgaaagtgcaaatgttagatataggttttgtccctgcgactcgggtttgttttgtaacagtggaagaagaggaaaaagaggaacaacttctttttagaagcaacaagcttgcctttgctcacgcgatcattaattcagaggctcggagaccattaactgttttacaaaatatgcgaacctgtattgatggccacaacacatttaagatgatctcactgatcaccggcagagcactgatacagcgagataaaaaaaaataccacttttacaaaaacggggtctgctcctgcaaagattactggtaagctctatggtgaagaacctatcatctcctcaacctcaaatcgtgattttactcagcttggtagagattttgtttccttttaagtcctttagcatatttctagaatatgactgaatgtttctttcccagttcatcgcgttggtatatattggtttcttaacgtttcaatgctcgaatcatttcacattgtgacttgccattttactagagtttttttttttcagttttagattcgatgtatggttgaatgtcaacatcgttgtcctctgatataacttatctgagatggggttgttcgaataaatttcaaagaaattgcaggaaaggagatgaaactaggctgctatctaaaagagtagactcagaaataactggatacataacgtaagcagatgaaaaagacgatggaacagacatgacctgaagaaaacgttgaggtctctctgacgttgccttgacgtgcaagtcatatccgtatacattattagtgtctgacttctgagatgctctgttctatctcagtatctccttgaagcatcttcccaactttgatcattctctctgcctcagctatttctactttccttctagctttgggtctctaatcactgcaaaattccctttcgtataaagcaagaaatcctggaaagtaaaagagaaaaacaaacaaaccatgaagcagaaaagaaaatcaattttagaccgaaactttggagtctcatgtgaggagcctctaaaagatcaggcccagttaaagcccaccaactgaagaggcaacaaccgtcgtttaagccgacaacatgacggtatcaagctgtttttgggagactgtgtttgcgttgtctttgttttaagctatatgaagaagcttttctttatttgatcaatg

SEQ ID NO: 11740 - DNA, 3000 bp, Unknown; identical to SEQ ID NO: 11733
  misc_feature (1)..( 3000): cDNA_ID_1832291_gDNA_ID_2214513_Annot_ID_133905 3000 nt of promoter + ATG

SEQ ID NO: 11741 - DNA, 3000 bp, Unknown
  misc_feature (1)..( 3000): cDNA_ID_2707326_gDNA_ID_2214514_Annot_ID_133907 3000 nt of promoter + ATG
taataataagggaccgtaataataataaaatactaataatagcaacaaatagtcatgtgatgttatacattttcgtcggcgtatccaacggaccaaacattaaaacagctaacacatacgattttattttacagtaaagacatttgtcaggacaaagattcggcctttcattgctcataaaacactggtgagatacataattatcgaattttatcaatccatgtcgtacttatggacatttgtatgtacaagaattgaagtatatagccaactagttttgttggaattgaatgtgctaattaacatgagaaactaagtttagtgatctctagagctcttgaatcatgaacaaaataaaatgatcataaaagtgttgttaaagttataacaagctaatttttcaactttcaagatatgtttttgatttagtttctttttctatttgctgcaaattgttgttgttgttctttttttttttcttgcaaattgtttttacatatatttactaagtaggagaataagatttagggtttatgagaaaccctctcatctttgcataagttattcggtgtctgttaacaacaagagagaattttatcgatgatggtattatagtattgatcacattaatggaaaaagctatataacactatatactgatgttttaaggcttaaaaatatggccaaattattattattatatatatatatatatatatttattattttttttgaacggaaaaaagccagaactgtagtcatatacatatatctgaatatagcgtttaaaaaataattgtgttatcattgtatgacactcaaaattttcattttttgccaattttctttttagggtacattgataacataagatcaataaaaatatattatggcatcagttaggtaacatacagtatataaacaaaagccacatgttgaaaatacgtaaataagtatgcaacaacactatatcgtgataagaactaatattcaacaacactactttattatcgtagcaaagtatgataatcataaacatttattttcacacagtaactatttttttaaagataacatcataaaagtcaacattatattaaatatagttataacataatgtatattcttttttatttattgtactgtaaatttattcaacaaccaaaaaacttccttttatgaatatgaaaagaatttgagaagctttgaaatggtaatctttatattctacaataaatctttatattctactataaaaaaatattttcactgatgatcagatgatgcatcaaacttttttttttttttttccttttgcagaactcaatatactgatatttcaaatctgaaaaatacgaccaatttttttttattttttttaaacgaaaaagtgagaattgtagaattgtagtgatatagtgaagatcggattttaaaataattatatcattatacgatatttagacaaatcacttttttttttgcaaatgttcttttaagtttacatctaaatttgaagatataaactcgataaaaatatattatggcattaataaagtaacatatttaaacataacgcacatgttgaaaacacgaatgtaagtattcaccaacacaatataatatcctccaaaatgcgattcaacatttttctgccaaatacgatttcacatttgttttaataaaacatgatttcatatttttccacgaaaacatgattccgtggtttttccactaaaaatatgatattaatcataactatttatgtcactaaatattattcaatggtaataattattgattaattattctatttaattaattaattattttattttcaggaatcaactcatttaaccattaaaccatcaaataattggattaatgaattgactcaatccgttcaacaaatgaattgaatcaactcataaaccatttcagcctaaacttggattatggattggtttgaatgagtttatccattttgacatctctaacaatacatatctacatatgaactaatattcaacaacactatttattctcatagtaatgataatcttaaatgttcatttccataccaaactattaagaaaagaaaaacagtataaaattcaacattattcctataataaagatagttatatttttttttttgcaaaataagaaatatagttattttgttttgtgaaattaataaatatagttatcacataatgtctgtccttttttctttattcctgataatgtaaaatttgttcaacaaaaaaaatacacttccttacgaaatagagatgtaacgtctataagtctgcaaagaattaccttaatgtatagttcttttcattaaggtaagcattctattctaccatatacaaatattcccattgataattcactaatcttttctctattagtattcatcatgatgtttattttatttttttgactaaatttgttagtatttttttgagaaaaaaagaaagaaaaaactaagtgtgacgagacacgaaaacactagacaaggaggggctttgacgagacccgaacaaacaaatgtgaatttaaaaaaacccattaaaataattaaaaataatggaaatttaaaaatagaaaataatagtgtctctcgctttccttcatgcgttctctcgcagtcgcaggcgactatcaagtttcagaactcgagattcatcattctctgttccacttccggcgatgtattataatccctagaccttagttccggcgaactctcgaagaacaaacaagtatatattattattttcttcttagtgtttcgtgctgtttccacgattccttcgttttatcttggatctacagttttacattcttctgtttttcttcactttcattgtttccactgcgttgttctgattaggtattgcacaggttttgaaatgtcagtgaaaacgcgaagctgagagaggagaaggaagaaatcgaaggaagctgattcaaatttaggaagaagaaaaa

SEQ ID NO: 11742 - DNA, 3000 bp, Unknown
  misc_feature (1)..( 3000): cDNA_ID_2707354_gDNA_ID_2214514_Annot_ID_133915 3000 nt of promoter + ATG
tattgcttcaaaaagaaaaaaaaagaataattgtaagctatgggcttcacaagtttgtactctctctatggaaaatccaaggttctgaaatcaattagtttttccgctctcaacagtaaaactctcgcaattgacgcttcaatgtggttatacagaggtgctttaaataatgcccggaaattcttggaggaaccaactacacccaactctgaacatataatgtttgtcatcaaaaaagtcaaacaattcatcgaccgtaatgtgaatcctattcttgttttcgatggacatcgtttacctattaagtcaccgcggaacccaataaaaactctagaatacgcaaaggatcttgacgcatcagcacaacttatggctcccgatgaccctaagagaaaggacaaagagaagaatgctactaagatctttcaaagtcatatacacatcacgccttatgtgatacatgttttcattgaggtaacatttacggtaaataattatttttaagaattttcacttctttctaattttttattaacctttcttttttctcccattgaaggtttaaaaaaaaaaagtatccgaatattgagtttatcgttgctgctcacagcttgtatatttggctaataataaagataaaagcgtttatgcggttctcactattaacactgacctcataccatttagatgttgaagagtaagttctttaatacacttatcaattattattattttaaaggtttttctcatgtagacataacattaatttttactaccactttaaacttttgtgtgatcacaaattattttcgccagtaaagactttgaattgcttgaactcgaaatgatagacttattgaagcggtttcatagtagcaagaaaaataaagacaacgaaaaagaaactaaagaagaagcaaaatcttacgatttttcagaattcacagacgataattttctggagatgtgcattctttgcgattgtgactattttaaatggccattaacggagggatccgaaagagcatatgaaataattggtactaaaactatacgtggtagagaggtactttttacttggtttagttcaaaatagtagtatactatacatttagattttgtatttgcatgtatgatgacatgatgtgtgttattcattttctttcaggtaatagaggaactactagaggacagcactgacctaacttctcatctgaaaaaattcataattttgttgcttttcaaatattagtatgtctataatcaagtaattgaagagcttcaacacttgaatgtgcctgaggtgtctaaccttccattcttgcgtgaccgtgagtctggcgatgaatttgtcattcgaaagtatgaagattctacgggcacatatttgtcaacaactaagactaaggaaatagcataaggaagacttaatcctgaaacccacgaaaaatttacacacgtggaagtggaagaaacagatgacgaagaaactacttagacaaaagtatctaataatttgaatttcgaagttctagttcaaaataaaggaagtctaatttcgacaaaaaatctcacatctataccatattttacggttttagttttttttagtcgttagcaacaatgacaatcagttatattttgttaactttataatcgttagcgatgactatcgacaatgaaatcatgtttatttggtagtcgttgggtcgggaacatttaacaaatgattttgattcaattttttttttttcttataaaccttatcggctgatctggttagccctagtaaaaacacaccgaaatgttttcgagtggacttcttcccgaaaaaccaccatactgtctgtctgtcacgagtttgaaatgctttctgactaatgccagggggtagtcaggcggccgcctacatttctaattaccaagtaaaccaattaaaccaagacccaacttatacacttaccaactttcaaggagaatcgaactcgggtctaagagtttcatccttcccaaagcttcccctaccactaaaccacatatacttggcctaggttgaaaactttcagtgatacaattttttacttgctaatcgttcaaaaatattgaccataaattgtcgatgaaccaatggctaacactatttagttggttggtcgcaatcgcatagcatgtccctgacacaaaaaaagcaaacaaaaaaagaactacttggatcaaacaaagaaacccatgcttgggctcagactgaaaacaaagtaattgggccaaacccatttagtattaaccgactaatcaagtccaacaatgtacagcatgaaataaacgctacccattaaccgactcaaatcgcaccaagtcaggcccaattaatcctacacaggcccatttagaagaaagttaacttcctccttaagaagagagaagggctaaaaatcaagctttcacgagtacggaaatttacagtatctcctccatctttttttactttcctcagagctctctcctctccgcaacttccaccaccaccaaatcggaactctcggcgttctactccgtctccggcgttacctccgtcgatttcatcttctcaggttacttagggttacctcttttttgctttttgatcgataaagtgtgatgatgtctagcgttaactcttttcgtcttcgtagtcgtagtcttagggttttggtggcgacgatactttgatttatcaaaccgaacttcttctttgtgatcttcgatgaatcaaaagttttctaagggatattaattaggttttgttaccggcgataattaatccatcttcgatgcttcttctttacacttctgactttgtttctgatgttttaacctctgtggagagcttgatagagtgacattgctctgactaagcgttttagttcaacgcatggttgattctctttttactaagtaatgaattttgagatccttgtttgattgcagttggaaggagtgaattgagaaggtcgggccaat

SEQ ID NO: 11743 - DNA, 3000 bp, Unknown
  misc_feature (1)..( 3000): cDNA_ID_1022691_gDNA_ID_2214514_Annot_ID_133918 3000 nt of promoter + ATG
acggaaaaatggctacgatttggtttctttcacttctctttctctgttgtattctcctcgccgcctttaaacacaagaagcgtcggacaaatcagcagcaaccaccgtcccctcctggctttccgatcatcggaaacttgcatcagcttggagaattaccacatcaatctctatggagtctttccaaaacgtatggtccggtgatgcttttgaagcttggaagtgtcccaacggtcgtagtttcttcttctgagacggcaaaacaagttctgaaaatcaatgatctacattgttgtagccgtcctagcttagcaggtactataactctaacttaacacatacaattttctttctttctatttgttcctttgttcatagaactcaacaaaaaccatgattttgatcattcgttaggggcaaaagagctctcttacaattacttggacattgctttctctccttttgatgattattggaaagaattaaggaggatttgtgtccaagaactctttagtgctaagcgagttcactctattcaacccatcaaggaagaagaagtgaggaaactgatcgtttcagccacggaatcagcctctcagaaatcaccagttaacttgagcgagaagtttcttgatttaactgtaagcgtgatatgcaaggcagcattcagtctagacttccatacttcagttctcaataatgatggatttgacaagttaatccacgatgcgtttttgtttttggggagcttctcggcctcaaacttcttcccaaatggtggctggatcatcgactggctcacgggtctacaaaggcggagagaaaaaagcgtcaaggatcttgatgtgttctatcaacaaatgtttgatctgcataaacaagaaaacaaacaaggagtcgaagatttcgtggacttgctcttgaagttagagaaagaagaaactgttcttggatatggcaagctcacaagaaaccatgtcaaagccatcttaatggttagtactatacaaatatgtgcaacacattagataccttatgattctaaactttgttttctcatcttatcacagaacgttcttcttggggccatcaatacttctgcaatgacaatgacatgggccatggcagaactaataagaaacccgcgagtgatgaagaaagtacaatccgaaatcagaaaccaaatgataaacaaatcagtgatcaccttagatgatatagatcatctaccttacttgaagatggtgatcaaagaaacatggaggctacatcctccagtacctcttctacttccaagagaagttatgtctgaatttgagatcaatggctacaagatacaacccaagacattgctttacgtgaatgtttgggctatagggcgtgatcctgattcctggaaagatgcagatatgttttatccagaaaggtttatggataataacattgatgctaaaggacagaactttgagctgttaccgtttggaagtggccggagaatctgtcctggaatgtacatggggacaacaatggtggagtttggtctagcgaatatgttgtatcagtttgattgggaagtaccagatggtatggtggtcgaagatattgacatggaagaatctcctggactcgccgtgggcaaaaaaaatgagcttctacttgttcctgtcaagtatttaggtcattgatgatcacttaaagtactaattttcttcctttgagtacaaaactaaatgtgttccctaaataaaactaaatcttgtattccattgtctctcggagtggatcaatccaacgatgttctttgttgccttcaatatttcatatagataatctatttattttgactaaaatatgaaccacctttcaagtaaggcatgttcgtttgtacatgagaatgatgcatatagatgacctatttggatgttgcacatttttgaatttggtagtacatctggatagagcatttgaatgaagttttgttcgtttggtttaggttttaacaatttgttatatttattcaaacatatataaggaatatgccggaaaaaccaagtatctgaaattccaaattccgaattaaacatttgattatttaaagttctagtatgattgaaaatccctaaaatttatcaaaattttctcataatttttagatatttctcaaattatccgaataccactatctaaattaaacttatattgaaattagcaagtgttttttaccaaaatttttcgaacatggccaattacgcgaattttccatgcggtattttatacgaaatagtagtggtagatttttttaatactcaaaactatttgcaaaggggggtgcaaccaaatcttatattgtcagtgatttgatttattttgagagtttttatatgatttgaagaatttgggtaaatttacggaagttgttaggatttattgtaaaatcctttcaaatttcacgtaaaggctaaaaccatgagatttaaaattctatatttttaactaagtaaatctactaaattcacttaaatatcttaaagtcactaaaaatccaatccttaaaatgttttttaagaagattttgaagtagattttaaagtagattttaaaatcactagtccaataacattagatttcatgagacttttaaaaatccatgattgaataacatatgatttactattttaacacaaatcacttcaaacgtttgattgaatatacccccttaagtgagcctaaggttttttcggttttatttcataacatgagatttttatcttgaattatataatctttgatttagattttaggaaaccatgaatatattcaaacatgttttatcaattaaatgttaaaccaagtattacagagagtttcatagtctttactctaaaaccacgtatgagcaaaccaaattgaacgaccaaacaatttcaggcatttttgctgcttctggaaataatatatctattgagtcaacaaagatcagatcaaagctgaactataaaa

SEQ ID NO: 11744 - DNA, 3000 bp, Unknown
  misc_feature (1)..( 3000): cDNA_ID_2707314_gDNA_ID_2214514_Annot_ID_133920 3000 nt of promoter + ATG
agtacttaaacaaatatgctttaccaatatttagatcttggtgtcacaaaaagaacaaacaaacattatactctatgttagaatcgatcacactaacgatgttggattttacgaacgaccaataagaagtcaagttaatcaactatccatccaattcagtatagcactactttccattatattgttgtttattgataatgagaaatgttatatcgtgctagagctttacttctcattgtctcaagtcaactctcacacgatttaacacatccttgagttaaaaaaagtataaacaaattttggttcatttattagtctaattggcctcatcgctcaatgaagctatactatcgcaatccaaaatgtctcaatgaagatatcctactatcaatgaagctatactctctataaactataccgaaagttttttactagagatttcttaatgaaatctctatcccttcgattcatatatgtaggatatcatgtaaattataatacaaaaagaccgttgagctaaatattaatactcaatctgtatcattttaaatgatgtttacaagagagaaaaattgtttcatttaaataatgtaatacagtaaaaaccttaaacattccttgaaatgaagagagtatattattatgggctatattaatgtatatgcctgaaagacttgaaaattagatatttactataaatagtttaatattaggtaagaataaaagagaaaaaaattaaaactataaatatcttttctatttatttaatttaccaaatttgccattgtctcacaacattatttattaccggatactttaggcatgatactgttcatcatatacctgacaactctattcatccaaaatttacaacactattcatcattggattgcataaaatatttatggtttatgtagataactatttgattaacatgttaactagtatgatatcgtgctagatacagataaatgtttgattaacatgttaactagtatagtatcacgataaatttatatataacgtattaaaccatttaccatattatacaaattaatatgaaagaatcaaattcggttgacaaaaaaaaaaaaaaaaatcaaattcaaattagaataacatattatactgaatataacgtgctaacatattaaatatttgaataatatttttatataaatgtggtaaaatatttgatatatagtgaaattataacaatagtttatacacgacatatttggtaaattaaacaaagtaaaaaagacagttatgactttaattttttttctcttacatacttacccaatattgaattatcaatggtaaaatctagttttcacattttctgggcatatccattaatactagatgagtacccacgctacgcgtggatttattttgaaaattgttaaaaaaaatatttacattgattgttatttttgctaatttttgtttattctttgtttattcttgtattgttaataaaattagatccataatatgtacttataatttttatggttagattcatttgtgactaatttatttataaagctgattatttataaaattttaatattttcacttcatgaatacatataacaacaatatctgatattctgatagaattatgtataattatgttacttgtgtggtttaaaatttgcttaactcgattataaataaatcaattccttgttttatgtacttcaacgatattgtgataggttcatgattaaagtttggattgacatcaactgaataagatctgaaaaatattcatatgtaaaaataagaagatggcaaaaattgaatatcatttaagtcaacaattttagattttctatcattgcatatatcaatattagaaaaatgatcatgtcttggatgatttgaaaattgtctaacttgattacaaataaactatttctggtcttatatattctcttgatataataatcaacaacattgttataagctcatgattaaatatataaaattgatataaactaaacaagatttcaagcgtattcatatgaaaaaataaaaagaaagcaaaaattaaaatatcatttaagtcaatacttttagatcttctctcattgcatatatccatataagagaaataatcatgtattaaattatttggtaggtctaatgtttcaaaggtttattatttgaaaaaatttgaatgttaatgttatcaaagactcaaaataaaattactaaactaataagaggttaggtagcaaacatcttcaatgcaaaacattttagtcattaaaatagtgattattgataataaaaaattagtaaaataaaaataatataatgtaagtagtgcttaatttattaacataatttttattttttatttttattttgaagaaatcaattaaaattagtattgatgatacatttaatttacttattaaattttattaaattttaatttaaaaaatataaaatgacacatgtcatttcttgtgtaatgacgtgtcattcatatggagagagttggtcaacttttatatatatgatttttctattatatattacattaaatactttttgaaacagagtcaaaactattacagtaaatattataaactaacgttagttggatttaattatttttaatttcagcttagctgtattttttgtcaaccaacgtcaacgtggtaacgtagctgtaatatataacaaaaatgacttctacattaatataacttaattcgtaataataatgtgaaaattagctagcatttagcgcccatagtttatttgctactatatgagtcattaaacaattacgactagatcatatcattctaaaataatatcaaacaaattgcaaactggagttgtttaatccttgggaagctaaaagtgaaatcttaacgaggacaacacctttcagtctttatatatacacatatgtaggggcaagaaggataacaacatcccaaaaccctaaaaaatactctaatcgagcaacc

SEQ ID NO: 11745 - DNA, 3000 bp, Unknown
  misc_feature (1)..( 3000): cDNA_ID_2711279_gDNA_ID_2214514_Annot_ID_133921 3000 nt of promoter + ATG
actgataaagaagtcaacttaatcatccaaccaaggccagccaagtcggtatcgctaccactacttttcattatttctatatactataaaaaaaaattaatctggtggcgtcacgattaattgcaacatttttgtttgacttttacattttcgattaatctggtggcgtcacgattaaggattggccccattagctaggtggatactaattgcttagttcattcgaagtctaccattttccagtttcctttatatatgttattgaactaattaaatttaattaaatattcgagcttatgaatgaaattcttatgagaaacgatttttttttaaactagagattagaaacgttttggaaacgtatacaaatatatatatatatatatataacattaacataaaattagattgaagaaaaaatggtttaaaccatacaaatctaaactatcaatattaaataagttaactaaaactctaaagataaagattaaaaggtttaagttcaaatatttaatttagaccaacatttttattcttattttcattactttcatcaaagataatttaaatctctcttcaaatctggtttatcaaaagaaatatcttaaaactgagagtcttccaaaattagttatatgtattaataattttaagatttctattttttttgtttttgtaatccgaaaattaattagggctcaaacgagccaaacctgagaaatgttgtttacaaatttaatataaagcggttgggtacgaactcatatttccagttttagttattaaattttttaagtcaataaaaaatatttgtcgtatgtctattttagaaatataagtttctattttggaaacttgagtttctatcgtgtttccaaaaataaatttttaaaaaatatgttttcgtgacgattttcgtatttccgaaaagtttctgtttccgaaatgtttcgaaatataaaacagatctaagagcgaattttcatgcaacctagatatacactgcccttttaatttgctaagttgtaaatttcctcaaccgatatatggaacaaaattaaaattagatttctgttattttaggtataatctccgggtatacgtgatgagttagtacttttacgcagtagtgatatacaacaaagatctctgataccgaacgtgaaaagtaaaagtccttttacatcatcgttttatatcttgaattaatataacacacaatgactattttttttttagaaacacaaaaagactgttgagaaaattaaataactaaagtctatcaaccatcttagctgtacttaatcgtatatatgaaagttggccaactctcttcatatggatgacacatcatcacacaagaaaatgacatgtgtcctttaacattaattaaattaaaaatcagcaaaattaattgagagaaaatcaaaagtttcatattctgttaaatcgtccattaattcatttctttaactattttttcaaaataaaaataaaattataaaattatttatttaaataaatcaattactacttttattttacttttattatttctatttttttttaaattaatggtcaatggtcatcactctataatgactaaatagttatttgtgttgtagtttagttgtttgctaccttatattagtttagttattttaccttgatttttttatttttacgttatggttcatatcttatcatatgaaattctgtcttttcatttttgtatctttaggtaagttcgtaacattgacattcaacattttcaagtaatagacttttgagacttttggtaagtttataaattcaccttagttgtatatcaggctactatagttaattaattatgtaccacattaagatgattagtttgtttccgtctttattgtacattgtgatttgtgaagatagcatttaatcatttagttagctagctaacccataagttatttatttgccactgaagctatatgccccaattaacaatcacgattagatcatttcataaaattattacagaacatgaattatatataatgtcctatgacacatattttatttattaaagaacttaatcatctatgtgtaacactacctttcattgtttcaagtaaaacttttggtgtatattttcgtttttctttggcaatgttaattgaaacatttgcgattaatcgggtggcgtcacgaaatccgattgtgaaccgggtaatagccggataagacgttaatttggtgacgctatcacacgtaaaaagccaacaaacagtcgaattttaaccggtccaactagttctacttgattagatcatttgaagtccaccttttgcaagattttcttcgtgtaatttacttatctttaaatcgaacatatatatatatatatatatattatatatttttgagtactaatatattgcctttataatttgataaatatacttgtatgtaattaaatcttcctcctcactatataaattcatgacttttaaaactgtttctgtttatatatatatatatactaggatttaacccgtggtataccacgggacaaatattttatttatatataataatattaaattttacggttttaaatttagtattaaaattatataattttatattaatattgtaaataaaaaaattggtgatgataaaataataaataaggatttaactcgtgttatatcaatcaaatccgtcccgctatacaactcgtctcatgatagttttaatatttttttataaggataaatattaataaattgtaggtatgtaacctagctgtaggtatgtaaagagttagtttaatgaatttgtacgttaagattagactatttattaaagaaatttaaaaacacaaattgcaaagaaagctggaaaaattaaaacgtcatctctgtgaacgtgtatatatcggaaagaaggagaagaccagtatcaatcctaaaccaaccaaaaaaaaacaccaaaatctccgattgagcagtc

SEQ ID NO: 11746 - DNA, 3000 bp, Unknown
  misc_feature (1)..( 3000): cDNA_ID_2707318_gDNA_ID_2214514_Annot_ID_133923 3000 nt of promoter + ATG
taaagtggaatttaatgggaaaccatttcttgtataccgcaacgttataaaaccattaccacaaacacaaacctcaaactcctttgataaacaatccattgattccgtctacgatctccctcctcaacctcttttcttatgccctagactccgaacccgtatattattgaattctcttgatgatgaggtggaagatgaggtaactaatcatatcctttccaagtacagttcttcccctctctttgatgagaccagcaacaatcatcatgtactccctctgttttggtgcaacaacaaagaagttgatccggaagcagaagaaggcgatgagtgctattcctgctctatccaaaccatcggtacagactattatttttgtgccacgtgtgataaaaggttccacaaagaatgcgtcgagtgtccacttgagattagttatcctacccacaccaaacattctctccaactcttctattctaaatatagatttgaccattgcatctactgtagaaaaagagcaacctatatgatttatttttgtgctctttgcgacagttatatgcatgtcctttgtgctcagtcaaaaatacccttttttatagaccagccaaaaagacatgaccatactctcacccttttccctagacaagcttccttaacctgcaatatttgtggtttgataaataaactccatttcacctacgtttgccctatatgcgatttcgtagcccatagtgattgtatttatatcccacaaaccataagaatatcccgtcaccaccatcgtgtctcttttatttcttcccttccttttgaagaaaagtcttgtggagtttgccgtcaaatggttgatagtgattatggtgcatacacttgcaatgtgtgtagtggctatgtcgttcacgtaagatgtgcattacgtaaggatatatgggatggtaaagaactcgcggaagtaccagaagaattagaagacgttgagtccttcaggaggttagctgatggagaaatattccatttttatcatcaccatcatctgaaatttgacataagtggagtttacgttggaaacaaattttgtcaagcgtgtgtccttccaatcaacgaaggaaatatttatgtttgtgtggaatgtgatttcatcctacacgaaacatgtgcatatgctccacgtaaaaaggtccatccattacatccccatccccttacacaaaagggtgatcatgtaaacgctttcttcaaatgcagtgcttgtatgcgtaagagtaatggtttcggatattcgtgttataaccgaaattgttactttaaactagatgcagtgtgtgcctcgactgctgagccgttcaattatcaaggccatcgacatcccttattcctatcgttagacccaaaagataagccaatgtgccacatttgcaagtcaacgaaagataagaaggtacttaactgcattgaatgtgactttattatatgttttgaatgcgcaaccttaccatacatggtaaggtacaagcatgacgaacattacctcacattttgtcatggagatgaggtgagtgactcagattggtgtgaattatgtgagggaaagttatcaattggaggaaaagaagggttctataattgcaaagattgctgcaccacgcttcatattaattgcttacttggcccagatcaatattataaggctggtcaaacttacaaaattggtgaggttgatattagtttgcaacacaacaattctgcttctcggcctatttgctgtatgtgcaatatccgttgtccgtatccaatatttttggtagccacagtggataggattgcttatattctatgttctagtaaacatttgaagtaagggaaaccctacaatacacgtcgacaacctttgagttatccgttttcttttaaaatgttagttgtacctgtaagtctgcaccactttttctttatgtatatatttttgtgttgttgttgttgtatatatatatatatatatacatatattttttgtttggttttcttgaaaacattgttcatgtgcgtttgatgtaatatctatacattattatatattaaagcgaacactttttatcaaaaaaaattcatctggtttattagactaaatcattaatgttttataagagatgtcatgaaattcctctataggtgaaaaatatggaacttattaagtgaaaaaccgagatatatagagacgatgtaacgtcaaaaagacttggaattttcaaaatttgaaacatttcattagaaagtcaaaagtagatatttttaaatttgaaacttagttcttgttatctatccagtatcaccattcaatgaatgacatttcaatacgcggagtcatgtcctctcaaacccacaaactcactatagcaaatctcacaaactactaattttttctccacaatttcacttaatctaactataatctttctacttgataatgaagcaaaagcaattacttcaccataaaatttctgatttaagaaaataattcttttgattttaggataaaattaaaatcaatttcattcctgaattatttcggtttttcttcttaaatttctgattttttaaatattttatacatatttaaggaaaaaaaatatatttttttcatgtagtttggttgtagaaaagttaagacacgtaacaaaaaaaaagaaaagtagtttgttaatggtattttggtctgaaataacataattagctaatttgtgaaacctccatttcactttgtcaaaacatgagaacaaaactcgtaatatgggttaatgtgatttttttttataaaattatcatgctactttgttattcataattgagtgagtttcactttgctatacttttggcaagattattttcaaaagagacactttcatcttttttttcactattcaacattctttaatacaattttgcccttttttctttatttctctttttcatttttattatctttttactatcattttt

SEQ ID NO: 11747 - DNA, 3000 bp, Unknown; identical to SEQ ID NO: 11746
  misc_feature (1)..( 3000): cDNA_ID_2707318_gDNA_ID_2214514_Annot_ID_184394 3000 nt of promoter + ATG

SEQ ID NO: 11748 - DNA, 3000 bp, Unknown; identical to SEQ ID NO: 11743
  misc_feature (1)..( 3000): cDNA_ID_1022691_gDNA_ID_2214514_Annot_ID_184387 3000 nt of promoter + ATG

SEQ ID NO: 11749 - DNA, 3000 bp, Unknown; identical to SEQ ID NO: 11742
  misc_feature (1)..( 3000): cDNA_ID_3022851_gDNA_ID_2214514_Annot_ID_184384 3000 nt of promoter + ATG

SEQ ID NO: 11750 - DNA, 3000 bp, Unknown
  misc_feature (1)..( 3000): cDNA_ID_1441000_gDNA_ID_2214515_Annot_ID_133927 3000 nt of promoter + ATG
cacttaacagaacagaatttctattcaaactctagaatcagattgaatatgctgtgcttctaatgagatgtctcttgctgtccctaggtcctgatcagcggaatactgcaaatgctgtgttctgcttgtggatggctattgggaacatccttgggttttctgccggtgctagcggaaaatggcaagagtaatctttgagatccttattctcaaaatcttgtattctttttcctcatttgcaattttgcattttccgccagctgttaaatgatcaggcaattttactgcgcagatggttcccttttttaactagtagagcatgttgtgctgcatgtggaaatctcaaagcagcgtttcttcttgcagtggtaagcagtatgtttaattttctgacacatgcatcttactaagctttctaaattgcaatggaatgggctggtctttacgaaacactctcacgtttgtacattgtgacttgtgattcatatatgtcgcaaatcaatgcgttctgtttgtatgtctatattatttttgaggtgattttgaaagtgaaattatattattgcacccagtggcttttgttcttgtttcatagtctaaaatctgaatatattgttctatatgttttaagagtttaaatcattttttcaggtctttctcactatatgtactcttgtcacaatctattttgctaaagagattccttttacaagcaacaagcccacccgcatacaagattctgcacctttgttggatgatctccagtccaaaggccttgagcattcaaaattaaataatggtactgccaatggaatcaagtatgagagagtggaacgtgatacggatgaacagtttggcaattcagagaatgagcatcaagatgagacctacgttgatggccctggatctgttttagtgaatttgctaactagtttaaggcatttgccaccggctatgcactcagttcttatcgtcatggctcttacatgggtgagtgccaaagaaaaattatgatcagttattacatatttcacactgtttcttttcttaaactctttaatgatctttaaaattatttgcttctgttatatttttgattgtggtcttgttctttgcagttatcctggttccccttctttctgttcgatacagattggatgggaagagaagtttaccatggggatccaacaggagatagtttgcatatggaactctatgatcaaggtgtacgtgaaggtgcacttggtttgctactaaactctgtaagaatcgttataataacctgttttttaactgcactgctcttcaaaattcaattactcgcccgttattgaatattcttcttccctgtttccgtaggttgttcttgggatcagctcatttctcattgaaccaatgtgtcagcggatgggtgctcgggttgtatgggctttgagcaattttactgtatttgcctgcatggcgggaacagctgtaatcagcttgatgtctctcagtgatgacaaaaatggaattgaatacataatgcgtggaaacgaaacaacaagaaccgcagccgtaatcgtttttgcactccttggttttcccctagctgtatgtgctttctttcaaccgtaattctctttattcttttcgtgttgcaacatttctctaaaatatgtgataaaaccattctttaatgcagatcacatacagtgtccctttctctgtcacagcagaagtcactgctgattccggtggcggtcaaggtctgtgaaaagattcatatcttcactatattcatagtttttgtacttaaatcttagatttcagtaatccctaatggtttcatttcctcactccaggtttggctataggagtgttgaatctcgcaatcgttattccccaggcaatctctcaaatctaattacactgataaatttcattctcttgtataatgccactcacttcgagtgtagtcttgacccgtaaatagtgtctgaatatggttttggctctaaacagatgatagtatcacttggagcgggtccatgggatcaattgtttggaggaggaaacttaccggcgtttgttttggcgtctgttgctgctttcgctgctggagttattgcattgcaaaggcttcccacgctatcgagttctttcaagtccaccggtttccacatcggctaaaatctttataccacagacataaaattcacagttagatctacccgattctttttgaccacgttctcctctcggcgtatatgtaagtaggttttgtacatctagttttcttatatgttatacacagcaatgtgactctaaatttacagtacctctcttctcacgtagaatatatcttcgttattttgaatcactttatatttgtgtgttcctttcctcacaaatagaaacttgaagcaacatattccaaactcaatagtccaatctaataacacaatactgttggttctttaacctatgatgtgtacgttttcccaacattaccatactaatataacaaagcatttcaataagaacacaaattcaaacctattttcgcctataaactatgtactaaaatcataaccaaactatatctccaatagaaacaatgtgtccataaataataaatgctcatatatcgtgggttgttgatgacatagtctttgtccacaagttccttatttagttgatataagcattttcaaaacaaagaaacaaaattcaacttagtgtaacaatgtcaaaaccaaactcttatcttcaataatgagacaaaagaaaccgaagttaagtctataatcaatttctacatagacaatgtggccaaaaataataaatgaacatatatcatgggttgttgagacacccaatttaataaaataaaaacattgaatgtcttattttcttcttctttaaaaaccctttgtacatttactcttcaattcatcctcatttactctctatagtttctctctctttctctaaactttcacctaagatcgatcaatg

SEQ ID NO: 11751 - DNA, 3000 bp, Unknown
  misc_feature (1)..( 3000): cDNA_ID_2707398_gDNA_ID_2214515_Annot_ID_133928 3000 nt of promoter + ATG
ataaacaactatagtactctttttttcttcatatatttcaaaaaacaaagctaatgtttcatctaccattaacctaaaaacgtattgtcatctattaatatgtctcttgaatttgatcacatgttgtttgcgatagcacatagtctcgatgtccggtcaacgagacgatgttcaggggatgatgcatttttgactcaactttgttataattggacgtagcttccgaacttaattagtcgagttaaggtttcgcatatactccgttctatatgaacactctatatatgcacaaatcggacccaaaaaaaagcaagatgatgtattggttttgttgggacaattaaatgacacaaagattttagaaaaaaaaccattacaaatatatgcacaaaccattgttgcttttttaaaaaatagtccactttttaaatgatttaatgaagtgagtggatataagagttcgtaaaagagctgtctccacgtgacgtgattcttttttatttcttcacgttctttccacatttctatctttcaatatcgatggttacattctcaataatgattaatgaccattataatttttctttatcaactttaatggagttattatgtgaaacagtgtaagccccattcttatgtatatatgtaaatatcacattataaattatgatctatcgacagagaacgacaaaattgccaaccaatcactaagttagaaaattaaatttattgtaataacgcatctctttttttttttttaaacatatagtttttatattattaatatttgaatttgtcgtttgagaaatgacgaaggagttattttcaggcgtaagcatttgacgtgctcgacgttaaggagatgacgtgttaagttatggtacatatgtttttttctcttttatttgggtcatagccgcgttcaacacgtgctttttgtcaaatgtaattacatgattaaactaaaaaaacttattactgtttttcaatcaacttattaaccttgatcttttttataacaaaataaaaataaaaattggcacatgatcaaatcatcaatctcaaataagataaaaccaaaggtgtaataaggttcatttttttgtggagaaaccgagtcaatgctaccaaattgcctatataggcttgaattttatgtaaatgcttttttgaatggaataatccgattttttattttattttttcttatgtaaaattataacatggtatagataaaaaatttgttttgtaataagtgatatttggtctaacggcgcgtatgtatagttcttttacaaaagtgagtaatagtggttttctggttcaaatactattgagaatggtatcagttttgatggacaacaagtgtatgagactcggctataacttctcaattaaccattaaccattaaagaatacaaaatttggattttcgactatactttggttcggatacatcatacatgcatgcacaccataacaactaaactcaaaaggatttgtttttgaacttttgatgataagaaaaagaaaaaaaagatgggacataagagtcatgtacacgtggataaggaaaggagaagagagggacaagggaagagatggagaaagagagacgtaagtattaattcaattgtgtgccctattagctttcattttccacaagcaagaataatattaataattatgtatcatctttgcatttttgtaccaatacatgatacatttgttaggcacacgtctttttcctttttcctcctttttatttctaactttcttccttttattcgtttaatccggctctatcacgttaacacacatatatgttatatcatctttttacaaacatgtttacattagttattagaaaatacatatacttgtaatagtgacattggtaagaagaactctatcaccttcacaatcacacacatatatgttatataatctttttacaaacatgtttacattagttattagaaaatacatatacttgtaaatagtgacattggtaagaagaaaaaaacactattaaatagtgaaaaaatgtttataactctcttaattaacattacttattattgctagcacctaaaatctcccacaaaatatttgttgtaaaacacaaatttacaaaatgattttgtttttaaattagtaacacatgttcatatatacgttaataagaacataccctatatgattttatataaaaaaatttctttgagacgtcttatccttttttctttaataatatgcaattgtgagagtttggatttgaatggtagcattagaagcaaacttgaaccaaacatatttcatgaagtcaaacttgaaccaatgtaatcactaatcacagtgttcgcagtgtaaggcatcagaaaatagaagaagggacatagctatgaatcatataatcttgacacatgttttataggttttaggtgtgtatgctaacaaaaaatgagacagctttcttctaatagacttaatatttgggctaaatgtaccacagttgtgaatttcttacaaaaatgggccgagctacaaaaaactacaggcccactctcaactcttatcaaacgacaccgttttacttttttaaaagcacacactttttgtttggtgtcggtgacggtgagtttcgtccgctcttcctttaaattgaagcaacggttttgatccgatcaaatccaacggtgctgattacacaaagcccgagacgaaaacgttgactattaagttaggttttaatctcatccgttaatctacaaatcaacggttccctgtaaaacgaatcttccttccttcttcacttccgcgtcttctctctcaatcacctcaaaaaaatcgatttcatcaaaatattcacccgcccgaatttgactctccgatcatcgtctccgaatctagatcgacgagatcaaaaccctagaaatctaaatcggaatgagaaattgattttgatacgaattagggatctgtgtgttgaggacgatg

SEQ ID NO: 11752 - DNA, 3000 bp, Unknown
  misc_feature (1)..( 3000): cDNA_ID_2707394_gDNA_ID_2214515_Annot_ID_133930 3000 nt of promoter + ATG
attcggaaatttgaagacttgttaatttgggtttgggattgggattgatctgaaaatttgtagtttttggaagatatgttggaagatcgatcaccagattcgtgtttgagtacaagggttttctcaagctctcgtctttctgaatcaaactggtctaactcttacatgtatccagaggatgatgataagctcctcggtaatggtaaaagagctttggaggttgttggtgaggttagacagaccaaatcacttaaattaatgggtttttcgattatctatgatagcgattcttctgactattcattgagtggtggggaggagcaagctgatgctgctattggtgatggctcatcatcaaggcaggagcaagaacagcaatctgattttaatgacaatggtggtgattcttcggattctcactctcttatcaatgagattgggagggacaattcgatcgactgtttgatccgttgctcgaggtctgattatggttctattgcttccttgaaccggaatttccgttctttggtaaagagtggagagatttatagattaaggcgacaaaacgggtttgttgaacattgggtttacttctcttgccagctcttggaatgggttgcgtttgatcctgttgagagaaggtggatgcagttgccaactatgccttccagtgttaccttcatgtgtgcagataaggagtctctggccgttgggacggacctgcttgtcttaggaaaagatgatttttcttctcatgtaatatacagatacagtctactcactaattcttggtcttctggtatgaagatgaactctccgaggtgtttgtttggatccgcgagccttggagagattgctatattcgctggtggatgtgattcccagggaaagattcttgattttgcggaaatgtataattctgagcttcaaacttggataactcttccaaggatgaacaaaccgaggaagatgtgttcgggagtttttatggacgggaagttctatgtaattggaggaatcggtggtgctgattctaaaggcttgacctgcggtgaagaatatgatttggagaccaagaaatggactcaaatccctgacttgtcgcctccaagaagccgtgctgatcaagctgatatgtcaccagcagcggaagcaccgcctcttgttgcggttgtgaataaccaattatacgctgctgatcacgccgatatggaagtgaggaagtacgataaggagaataagaagtggttaactgttggaagattgcctgaaagagctggctcggtaaacggatggggacttgcttttagagcttgtggagagcggttaattgttattggtggaccgaagtgctcaggaggtggtttcatagagctaaattcttggataccgagcgacggtggtccacctcagtggacactacttgacaggaaacattctcctactttcgtatacaattgtgcagtgatgggttgctaaaagaacacacattcataatactacgactatccatttgaagaccctccagattcttgttgatgggttttagcttacaagtcaaaagacaccattgaaggtcccacgctccaacctttatgcttcttcttcttcttccttatttgtttcccttacaaaattttcaatttgaatacaatcatctctgtattgttagaaaccagacaaaagtcccaaggagattccaaaaaaaaaaaggaaaaaaaaaaactgaaacaggtttataataagttcgttaaaagttgaagctttttagagtttgccagatctggttaacattgttgtatgtgtttttaatcaaatttgttttctaataatcttgccatctttttggtctttgttcacggttttgcttttgagtttaattctttttctatttttgttttgctttacctttctttaattttacaggtcactttacaacgttgagtttgaagtgtttgtcaattttatgacgacaaacaaaaaagtgtcacttttgtttttttgttggggtaaggaggggcaaatgttatgtctttatagatgtgtcctttaagatatctcaatctgttgcttgcaagttatacaattttttgttaagaatgtttttggactcttgttttagttccttcagcttttagggtctttagattttttggtgaagataacaacatattacaatctaagttagtattttaccaatcggaacaactcatagtataagtaacattaaccaaagtaaatttttttcaaagagtagttaaaatttcttaattacaagataaccaaagtaatatgtttttagtgtttctaattttctgatgatatatttttttttgttatttagatattttttcttatatacgattatctaatgtcttttaactttatcgtctacaactcacacacgtgtactgcttgatttcaatcgaagttcggacacaatgacatcactagcatatgttatgcttgaaattttagacatgtaaaaatctcatagacatagatataaatactagaaatcaaaaattgaaactgaaatataaaatatttagaaaaatataaaatatttagaatagaaaaatataaaaaatttagcagaattctctaaattttctttatctttattttttcgtagcgtaaatgtaaaagtagacacattagtatgaaatatttgtatcgaacagcatcatgtcacatatataaacaatattctcatgattttgagttctaattaatattggttgacaaaaaagagaaagagttaaagatgcctctttcttcaacatatcagtatcaccctctcaattcgattttttctacaaagaaatatgttatgttctaagcaaagcccaactacaataaatttgggcctcataatgttaaggcccatttactctaaatctcgcagggttttaagttttgatttattctctactcagcaaacgccattatcgctctgtagaaaagcttccattttcgtagaccactctcactgagaag

SEQ ID NO: 11753 - DNA, 3000 bp, Unknown
  misc_feature (1)..( 3000): cDNA_ID_2707440_gDNA_ID_2214515_Annot_ID_133931 3000 nt of promoter + ATG
ataaaggaataaatacagttctaaatcgccaccaggtaggtttcatggtgagctagagatcttcgcttcaggtaaagagtttttgttatttcctttctctaatctggtgttttctgggtttgtgtgagagattcttccaaatctgcatcttggattttgtctatgtttgattagcttaagcttctctcagacatagaaatcttgatttggtctgattttttgcagtgtttaaggattagataatgttaccggagagaagaagcacggtgttttcttcttcttcttcatatctgaatccatctggtcacaatgataattcttttttacttcttcggagaggcaaaaagtttggtcgtattgtgaaattgaagctttcacatttctttttgttctttgtgtcactctttttcttctcttgcatgttctctggccataaactactctttcatggtaagctttgagaactaaagaaaatgtctttctttttgttttctctcagttttggagattattaattcaacacttttgaatttggtgtaggttctgagttcttacctcattttgagcaaaaccgtaagcttttactttgtcttaatgattgaatttgtgtaaaaacctactacaaaagcttattgtattaagtggatttggtttcaaatgcagcttacatgaacagtcatatgttggtttcatcggagattgatataggattaaacaaatccaacatcgaaagaccacctggaagcaagaagagaaccaagcgtatggatttttgtatctctagaggttttcaattaatgtgttagtgttggtttctcaactctaaggctagattgtttacatataatgcagatttaccttgtgaagttccacttgctgaatctgctgatcgcatacttgagcctcaggattatttgaatttcactcggttttcgttaggctttgtagagactgagacatatgataaccctaggtttggagggcatcaaacactcagtgaaagagagagatcttactctgcagtaaatcagacaattcactgtggttttgtcaaaggaactggatttgatttgagcgaaaaggatagggcctatatgaagaactgtgtagtctctgtgtcttcttgcatttttggaagctctgattttctaaggagacctgcaaccaaaaaggttaaaactttatcattttagtagatattagcttatgctttagactgtgtgagactcatcagtcatgtggagctttattttgctttgtttctttcttcagattagtgagttttcgaagcgaaatgtttgctttgtgatgtttgttgatgagcaaacgctatcgaaactggctagtgaagggcatgttcctgacaagcaaggatttgttggtttgtggaaaactgtagtagtgagcaatttgccttataatgatatgcgaaagactggcaaggttccgaaatttctgtcacaccgcctttttccttcttctaggtgaggtcagttggctagtactcaagctctgagacttgaatcagtgacttaaatgtcttatacctatcctcatttcttgtttcaggtattcaatttggctagatagtaagatgagactcactacagatcctatgctgatcattgacttcttcttatggagaacaaaatcagaattcgctatctccaaccattatgaccggcattgtgtgtgggatgaagtgttacagaacaaacggctgaataagtacaaccattcggccattgatgaacagtttatgttttaccgatcagatggtctcaagaaatttgatccttcagatcctaattctcctcttccaagttgtaagtaatcaatcaacccttaacttctctcacaccatacacatttactagttttgtttgtttaatgtttattgagtgttatgtcttgttgttgttagatgtaccggaaggttcttttattgtaagggctcatacaccaatgtcaaacctcttcacttgcctttggttcaatgaagttgatcggtttacctcacgagatcagttgagttttgcatacacataccttaaacttcagagactgaattcggatagacccttgcgcctaaacatgttcaaggtaaaatagaaagaaaaaaaaaagtatataagagagtgatcattggtctcagttctttcatgagtacataaaaatcataatcaacttggttttcatttcaggattgtgagcgtcgagcattaactaagctcttccaccatcgcgtagattcatcgcctccttcacctcctacttgattgattaagtatagatagtgttcttatgtttctacaatttttgtacttttctcctctttatacttttagtctaactttgaaggagatgaaacatggaagaggaacctaattgacattgtgtatgagccattatagtaactttacagcaaaattcactgcagatatataccaaaaaaaacagcactgaaccagttactgcttaaggttagtggaaaacacaactacagtagggattttgactggaaaaaactggaaaaaaagaagtaccaattctgaagacctctaattgagaatatggtgaatttttttctaaataaaagtagatttcagctgggaaaaaaacacacttttttcaattttgttgatcatataaatataataaatatacaaaacatgttgatatgaatggggatgtagctcagatggtagagcgctcgcttagcatgcgagaggtacggggatcgataccccgcatctccatttcttttttgcatttgttttaacattatgtggcttagggtgtgagtaagagacgtaacttgtcggagaagttacaacttttaccaacggttacgtagagtaagctatgtaaacatatagataagtgtgtatgttgtcttaagtaaaaattgtcgagaataataaagaagtggaaataaaaattgtcgagaataataaaagaagtttttccactttttcatcctttgttttctctaccatg

SEQ ID NO: 11754 - DNA, 3000 bp, Unknown
  misc_feature (1)..( 3000): cDNA_ID_2707372_gDNA_ID_2214515_Annot_ID_133933 3000 nt of promoter + ATG
tatctataatttctactgagtgagaaagatatgtaaacttataataatgtcttgttgagtccatgatcaaatcaatttaaaagggtttcttagagaccttttgcacctaagaaaaagttactcaaagagtgacaaatgattggagagtgaaaacaaaacattatggtcagttaaaaacacagatctcaaattcagcaaaataagcagagagacattccaaaaattggctccaccaagttttaccttttttggatttagtctcaagactcaagagagagagatatgagttttgtcttagcttgaaagggttaaatcaaacgtacactagattgacagaaagagctattaatgaggaaacttaaatcaatgaaagtgtcatattacctaacatatctaagatctggtcctgaaactcatctaaaggccatgtatatgtctgaaataaaagtaaggtagacaaaaccttaattgctagttgacaatatgagagaaaagaaccaaagtgccttactaagacaataaatgcaaagaaagatcaaagatgtttgtctctgtagcctactcataagggaaatgatcgaatttaccccaaatgatcttatccagttcactgatatttctctgtaagatatttcaaaaagggctaattagatttcaagaaaagacataaatgaaaccaagatgatgacatcaaagctagtatagctagtatgggcttaaaaccaagaaacatacagatcttgaagataagtattgtacccttctcaaaagatatgagaaaataattgaccacactatatataaaaatctaatcatctaactacttagttttcatatgtggatgagagaagaacaacaaaagcaagaagacattttgtgttaagaaagcaaaacaagattactcatctttgaattctttggttggacattgcctcaaagcatccgcttgctctctttcgtcaagtgaataaaggcaagttggtaatgagatgagactctgatcccacatgacaaaaaatggctgagagaagtttctatttaattccatagagtttgtggtgaaacattcactgtcttgatgtgaaaggggttcgttcctcaggagcccaccaagagaaggagaagagtcttgtgtggtcgtttgctgcatctccattacttcatgttaccaaaagaatacaaaaaaaccccaaacataggttcaggaacagatgatgattatagaaataacaatcttatattatctgacaacaaagtggtaacagtacatcaaaactaggattcttgactgtctctagctatgtgtcagttcctaatatcttccacagagagaaggaaataatgatcatatgccaacataaagaaaatcaaatctttttaaagcacccctaagtgtatcataacatgagaaaaataaacctttaaaggaaagatcactcgattttcacaaagataacaatcacagtgctctgcctctgattaccaagtaacgtttaatgttcaattgccccgagtgaaaccattaccagttatttcaagaagatcataaactctacactcttttttgaagaacccattgtttagatgtcgtaagtagtccagtttcgtctgaaatctctgtctctctaaagtatccaattcaatgaaatcaacaggaatgtggcaatgtgcccataaatcaacattcaaaacatcgaaaacaaagtctcttctttggaaaaaaaaaaaaaaaaaaaaagcctcttctttgtgtctctttcctaaacacaaaacgaacaagcgccacataaacataacaaaagcaaatcaattcatcatctaaaaccgctccaagagaatcactaaattgtgatcaatgacgacggtccacggcgagatcaaggagacggcgccgtgtaaaaatttcacctttgaatttgattgaggagggacatattccacacgtggcacctaaagagtggttaatgataagtatcgacgcaaagtaagtatttaacaatgattaaataaaaatatgaaacaaagaacaatattgggctttcaaattggcgggttgagccaggcccatgcagtagtgcaacgcatgggcgactcgtgaaagcccagatagcaagctatcttaacgggctttctcccttaaaaaatagagttaatatcgtgtgggccgatggcccacatatcagatattaaactgataagaacagatactacacttgatcttagccaaaaggccgagaaaggtatgaatggtttagtccatcaagcttcttttatatacaccaactccaagagtgagcgattaattatttagcgatgtgggacaataccaaaacattttcttagccttcggacaaaagaacaatttggacattattgaattaggttcggttatcttaaccaaatgttttaatcttgatcagcataatccgaattgatccggtctgaaccaattcaatagatctgactaaaaagaataaactgcatacctttctagtttggttaagatgcgaatttcacatcaagagaaagctttaaaaccgtcatcacaaaagggagaaagttactagatgaagctagtaggtggaagtttgagtcatttggccgttactactacgacttgtttaatttttttctctgattcattgaatgctttattaaaaactttatctcataaccagtgtaaaaacaaatattcaaacgttaatcaatccaatttagctttgaaaaatccaccaagaagaagactagtcaatattggttgcgacggtcttgtagaggcgttattatctgttagataatattactataaacagtgagggataaagcagaaatgcttctgtataaatactatcactacttttgatcaaaacaaaaaataccatcactattttacttgtgtgttatttcatcaccttcaccttcaacatcaaacatcacatctctttctcttttatctctttttctcggtcttcaaagagtttcttagttaccaaatcaatg

SEQ ID NO: 11755 - DNA, 3000 bp, Unknown
  misc_feature (1)..( 3000): cDNA_ID_2707432_gDNA_ID_2214515_Annot_ID_133936 3000 nt of promoter + ATG
gaatggttgttgtgtactcgacctacttgcctcaaattgatcataatccgtccaatgttgagcatatgtctctcgttcatcctcaacaatcatattatgcaatatgatacacgatctcatgatgatagccaacacggttttttattttttgtattcaaatcaaatgaaaatagtatctatttatagagaatgaaaattataaattttgatatttttatgtataaatattataaaataattgaagttatataattgaaatgaaacaaaaaaaaatagaaatcaaagcaatcaatcaaaatataacacttgtcacacttattttctatcttctactttcagggatgttgatatttatcaacactaaatttgccatatcacctaacttttaattacaacaaatcaatgtagtgaaaatatttttttcaccagttgtaaaatggtttgttacaacaaatcattgtaactagtctgaggttaaatcagcttattagattttattttattttattttattagttctaacacttatgaaaattattgaacaggtgacaccatatcgattaccatgttaaatcatattttgaatcaatttataaaactataagaaacaatacacagttatatgatttttagctacggaaaattatgttgttggtctggagatgacgtcaccaaaaatccccacaagaacattttccatcttcaaaatgatgaaacctttgaacatctctaagaacaactttcctaccaaatataagagatatcaactttgctgcattgtgacaatctctacacaccctaagattcttcacaacccgaatcgttgttcccggaggagtattcaataatccaaacgttatcgcaagcttttcgctgtgatacctaagcgtaatttccttctcttggtcattcatattggcgtgaactaccattgatgtatcaggaacataacctgaaagctttagctctttcaccatttcatctaatgctctgtgaagctttgtggttgcagacttcacaccatcccctgagaaaaactcatgaaccacattgtttacctcaatcgagctgcaaccgggaactttaaccgcctttcgatctttcatcacctttcttaaagaatctacatattcccatttcttgtttctcgcgtataggtttgataaaatcacgtaatcgccaccgtgtgaatcatctagctcaaagatcctctcgctaaccttttcagctaggtccaaattgttatggctgctacaagcagctaaaagaatcctccatagcattggtgttgggctaattgggagcttatcaatgaattcatatgcatcttctaaatttccagctctactaagaagatctaccatagaaccataatgcttaatactcggaacaatcccaaatttgctaaccatctgtgagaaatactttctcccttcttccactcgaccagtgtggctgcaagcgtttaacagaccgagaaatgtgatctcatcaggctgaacattttcagacctcattctctcaaacatcaacatggatttctcagctttcccatgattcgcataagctacaatcattgctgaccaagcttgtgtatccttatacctcattttttcgaatatagacactgcatcatccaagctaccacatttcgcaaacatatcgatcaaagctgtgtttactttcacatacttacagaaactatgtttcttagcatacttatgtatccatttccctaaatctaacgatcccaacagagcacaagatgacagaacactcaaaagggtaatctcattcggcttcaagtacttaccttgcatttcacggaacaaagataaagcctcgttcggtctgtttcttctcgcataacccgtgatcatagcattataacaaacaacacacggctcaacaatccgatcaaacacacaacgagcagaatccacatcttcacactcagtgtacatattaataagcgttggacaaacatagacattatcatcaagccctagtttcatcgacaaacaatgcaattgtctaccttcttctaacgcctttgctactgcacaagctttgagaagagacgggaaagtgtagttgtcaggtaaaataccatcttctaagatctcaacgaagagactaaaaacctcaagaggattcgtgaagcgagaatacccacgagccatagaattaaaaatgacaatatctggttcagacattgcctcgaacaagtggcgtgcatatgacattgaagactccgttggagactcagtgcagaaatttatcagcttagcgacgaaggaaacatcttcaatatgagatttgatcgcgtaagcttgaatttgcatcagctctcttagagaattgcatttggaaatcagaagaatcgggttttgtgtattcacagtgtcgattttcgaatgcttagtgaacgtttctgcgtgtgagaatgatgatattagtgaagctgaagatatcgccattaaagctctgattttgagcttctcattattcaaactgacaaatcttgaggataacgataagcctgttatgtgatcatgacccgattgcaaaattaataatcaaataacccgacccgacccgaattgtaatttaataattaggtataaaaatcgtaaaaggcgctacaacgaccaatttattttccaatttaattttgctttttaatctcttttatttttatttttatttctatcaccgagaacgacatcggagacttgagagcggcggcgagcttcaccggcgctggttaacggcggccctctcaatctccagtattctcggttcaataaaagcttcaaaaaaagaagaaaaaatcgaaaattcacgaaaatatatattaatttcaattttccatatttgaattcttccagatcttatggttccttgttcttcgttctcgtggcggtttttgaattgttgatgcgacgatctcatgcccgttctagggtgaagaatagtagtagtagtaaatccgatatg

SEQ ID NO: 11756 - DNA, 3000 bp, Unknown
  misc_feature (1)..( 3000): cDNA_ID_2707424_gDNA_ID_2214515_Annot_ID_133939 3000 nt of promoter + ATG
aaatttggcgggaaaaatatttttggaaaaaaaaaattggcgggaaattgttttttcaaaattatttggtgggaaatttattttggaatattttaggcgaaaaatattaatatttcattttgtttacctaaaacaatttccaaataacggtaaatggtcattaaaatttaaagaaggtaaaaataaaaatgacaaataggaaagagtagaattgaaaaagggtaatgtgaaaagggtattctcaacaattattcaagataaaaattgtataggtgttaaataataatgtgtaaaagagaagacgatgtgaagtattaaaagaaaaaaaaaatggatgttgtatataagtaaccattgtagatagtttaagcaagaaaaattgatgttgcattggaaattaaaaaatttcaataaaattagaaaagcaactctaaatcattacttattttattattttcaagaagttataaagtattaaacaattcgttgacaaataagtttgatcgacattgtgtgacaaatttaaaacacatcattaataacaacgaggacaaatacagttcagatatcgtctactattaaaacacttcttctataggagcaaagaaaaattgtcggcaacgaactggggaccaataatattccgagtttgagttcaaactgagtaattttattttgagaaaatttgccaagttaacttataattctggtttacgtgtagtaatttattaagttgttataggaaaatgagaaaatactaagacacatccaagaaagtttcacacgaaatttacttacaaaaagattgtttatttaatacttccgtatatagatatataaatatttaacacattaattataaagttcaagataattgattatctatctttttttgtcatctgaaattattatcgctcaaacgaagtaattctgaggaaagttgtttacaaactagttatttcattattgtctacttatataatagaattaaaaaaaattattgcttaatgcaatttagttttagataaaatcattaaacttaatagattatataagttagatatcaataattgggcttgcttaaaaacataaatataaaatattattgggccgttacgtgcatacaaaacgaaccttctaacaaacaagtgtgaacgttacgacttcaaaattaaaaaaaaacacaacaactatgtccacacgtaatctcatatgattcagattccaaggagaacaaaattaaaaacaaatctcgtaaacatacatacacttcacataaaacaaaaggtacagtatataccataaatctccgagattcttttgatgtatctgtccatttcattattacacaaactaggaaactgatatctctctattcacattcctctgattctatttctctttatatatattcacccattaaccatctcaatcttataaccctcaaaatcacaatcttctcttacaaaaaactttgaaagatgaagattcttctagcatcattgtgtttgatcagtcttctcgtaatcttgccttctgtcttctctgcttcttcttcctctgaagattttgatttcttctacttcgtccaacaagtaataaaatcattctaagaatgtttctgatgattttttataatcatctaatattgttttgtgttttattgtatagtggccaggatcatactgtgacacacagaagaagtgttgttatccaaattcaggcaaaccagctgctgattttggcattcatggtctttggcctaactacaaagatggaacttatccatctaactgtgatgcctctaaaccattcgatagctcaacggtaataagatcaaacatttctgttttaaggtcaaaaatatggtttaaggtaaaaaatatggaaagttttgtacataaccggttggtttgatttggtttggtacagatatcagatcttctcacttcaatgaagaagagctggccaacactggcttgcccaagcggttcaggtgaagcgttttgggagcacgaatgggagaagcatggtacttgctctgaatcggttatcgatcaacatgaatatttccaaaccgctcttaaccttaaacagaaaaccaatctccttggagctctaaccaaagccggtacgttttgatgtcaaagtacctttttattttcccggtttggatctcattggtctaactattggtttattatgtaatagggattaatccggatggaaaatcttactctttggagagcataagagattcgataaaagagtcaattggtttcactccttgggttgagtgtaacagagatggttctggtaatagccaattgtaccaagtctatctttgtgttgaccggtctggttccggtttaatcgaatgtccggttttcccacatgggaaatgtggagctgagatcgaattcccttctttttagtttccaatttctaaattcagtctcttgaaccggcatcgatcttttgttcatggagattggtttggtcaaaaagaagatttaatgtaataaaaatttatgggatattggataatgatatagttcaatttcaataatattctacgtatccgcatggtttaactctaaaatatatagtgaaaatagttcaatttttctctaaaactagaaaacaaatctttcacaaaaaattgctaacacttttgtaaatcagttttgatatgataaatttattttttatgataaagttaaatattcaaaaaaaaatctagagcattaacgaaactgtaactcaaaagtcgaatctaaacaacaaaaagagtatgtcaaaaaaacaatcaaccataaagagtttaataacaagcgccgagaaaatcttatctataaggttttcgttctccataatttagaactctcgatctgttttatttcttcttaataacaagagatgacgacatacaaaaaaacctttgatctcttaatataatctctatttcgtttttttttgtcctttaggttttgagttgca

SEQ ID NO: 11757 - DNA, 3000 bp, Unknown
  misc_feature (1)..( 3000): cDNA_ID_2707420_gDNA_ID_2214515_Annot_ID_133940 3000 nt of promoter + ATG
ttggcaccaggaaccgtatcatcgtcaatgtcaacagtagagattatgcctacatcggcaagaaatatgataacaatgagtgaagaagtagcaaattcattcactcaaacttcttacatacaatttgggagcttgtgggagacgtttaaaactgtaacaaagttgtcgcgtgtagcgatggtggagaatggagagtgtgtgatatgtctggaggaatggcgcaaaggtgatatggagacggagctaccatgtaaacacaagtatcacttggaatgtgtgaagaagtggttgaagattcacgccacgtgtcctcagtgtagatacaaaatgcctcttgaagctgaagactagtgattatgatttctgaatcttctgactcagcatgagggttttgacgtcaacttttgtttttttaggagaaggtaatgaattcaattggaatcatgttttgtagaagcatgattaggatctattgttgaattcgtatgtgaagatcatattcccttcgaattttgtcaatattggtttacattaccaaaattaaaaatttgaaacataaccagttggtaaagtatgatcacttcatcgatcagaaacgtacgtaacatcatcgacatcgaacatgcggacatcgagtttgatgacactaacgaggttcatcgatgagcaaatatctttacgagcaaccgtttcgtcgacgaggacgaccgcacggttgttgactaatgaatcgccggcaacgatacgggcggtagcgatgttaccacgtgtagcgatggtggagaaaggagagtgtgtgatatgtttcgaggaatggagcaaaagtgatatggaaacagagctgccatgtaaacacaagtatcacttggagtgtgtggagaagtggttgaagattcacacctcgtgtcctcaatgtagatacaagctttcttgtgtatataaaagctttttgatgttgtgatttgagagattacaaatttataattgcaaaagttgtgtaattggaaatgttttgttgctttcaaggttacatcagaagaaagaggcttattgacttggttatcacaatcacctaaaattactctactggtttgaattatccatccacttgtgttgattgatttgaatcttcctcattggttgtgttatccctctgtgcttcattaaagacttgagtactatatgattccactatattcacctattcaataagcccctttatgatgtaacccaaatttttctttttgtctcaatatcgtttctactatatgacttgagtactacttgtaaatttttcttttttggtaggccctggtaaagaatgtcactcacaatttattcataaactaaaagaaaaaatatcatatgtgaatgcttctcggtctcgtggacccacgcgtatcatttacaaagagcaaagtaacaatatctggaacataagtagaagaatgaaatcttggcgacaaactaaacgcataattagctaacccatatgctagatagttaattagcttctcgatatacgtgaaaaaaatgaactatccagtctctcgaaagaaagtcatgacacaagcataccagaaaaacattgaattatactcgcttattcctgtcttaattgttattttatcatattctttcaacagatataagacgaaattctaaaaaccaattgttaaattgaccaacacaaaagagctttagtaatagtagagacaaagtgaatatattagttttttgcatgaaaaaaaaaagaaaaagaaaaagaaagttaaaaaaataaacattggggaaagaaaaatattcgtttaggttgaggcatggcgatatgaagacgatttgaccgggaggcttgtgattggtggatttttttcctactgtccgatttctttcttcctgtaggtatgtctatttcgttcgtgttggtccaccggattcccagaaacaagagtagctatcaaactgtcatgatgatgctaaatgtggggaaatatttccaatttagtggagcaaaagtcaatattaaaatgctaacaagagaaacagtgagaagcaagattttgattcacatgaggctaccaagagaccatggtacaaatagtcatagtcttggctgaaaaagtatctatatatacatttttaataaagtttttggttgaaaaatctctcaaatatttactattttcaatattaatcctaacaaaatctatttgacaaaatattgtctttaaaaaaatttacaaatcgactttatcaactaacaatttataattaattatttgtcttaatcttgcacatattaattacgtattatttgagaaaatctaaacaattagaaaagatctatactaaccatatatatgttgttctttgatcacaatattcatttacttgattctaaagcaaattagttattgacttttccgattttgttgctaaattctcgattttatgatacaaatttatctaatcacaactaattaatactaaatattattgttttaatattaaccattcattttatttgtatgtaattaaaagctaatcaaaggcatattctctcttttattcaattatatcctatacgattttcatatatttcttaaacaaaatagcatattcgaatcattaaattattttcccaaaataagattatgttaatcatgcattaattttcggaattgagaaaattgcttgctcacaaagctatttttttattcgaaatcaaaactaaccctaattgtgtatgagctctatctatatcctcactagcaaacaaatatcacaccttcattgtgtcttatgataacctttataacctctcattagcaaagccaacaaaaactcaattgggtgatacattgctaagagagaaaccaaacctcaattaaagtcataaggtataataatgtagatgaagacaaatatagattaggatatggtgttgctggtaaaggtgtgaagcgtctttgcctccttggtaccttgagaaatgtaatg

SEQ ID NO: 11758 - DNA, 3000 bp, Unknown
  misc_feature (1)..( 3000): cDNA_ID_3022908_gDNA_ID_2214515_Annot_ID_184429 3000 nt of promoter + ATG
cattgtcaccgaggaacacaattcaatcccgcagaggttagtgaaaactctcaccgagagaacttttctttcttttaatattgaatcatatcttaaaaccaaatctttgtctatcctcaaaagggaagtcgagtgctcagcgagttcttcattcgggagctatccaggctactttggaacagggaaatctcctgaaatgacaattccgggtcaagaaacaagctttcttgatgaactaaacaccggacagctgaaacaggacacaagctcgcagcagcagttcactaataataataatatcacagcatacaatcccaatcttcacaatgatatgaatcatcaccaaacgttgcctcctcctcctcttcctcttactcttccgcatgctcaggtgtatattccaatgaatcagagagagtatcatatgaatggattctttgaagcaccaccacctgattcttctgcttacaacgacaacaccaaccaaaccaggtttggttctagcagcagctccttgccttgctcaatctcaatgttcgacgaatacttgttttcccaggtaaccaaaacaaaactttctcagagattctaaatgggtttttgttttgtagactgatttgacaatttgttcttctttcttatagatgcagcagccgaactgagagagatttgatgaatgatgataaaacatctcactgaagaaactcaaaccaatattttttttcagaaacagcaagaaagctaaaactctgccgatttctgaattggttccaagaagaaaaaaaccagtggtaatccctggtagattgtgcaaccaaaccacacacaatacgtgttcatttattttttctatatcttcaatagatgtcacttaattcttttctatacataatttctcagtcagatgagattttttgaggttttccatatttctccggcgataaaagttagtagtgtctttggagggctgtcaaagtaacgccatgacagccaaaagatgagaaactctctcttccttcccttcccacaaactctagcctctgtatctattctttttcattctttcaatgtaaaacaaacaaacaaaacaatgtttactacatttttgtttttgtttttgtcttcaaagtactcttgtttattaagtgatttatacaaaagtttacaagttatgtaggatgaactaaggaagcttatgtttatgggttagagagactacattggatgattcttctaggattttgaatcaccaagaaccatcaacaaagccaacagtatctttcacacaagttactaatatcttcttaaatagttttactttgtaagaaccatttccttgagtgggtttacaatgggacggactaacttgcgtacaaagaccgttttttattcactattcataattttggtccgcagtttagtaaataggaaaaaatataaaaactctaggggaattggaaaactaaccaaaaaaaaatataattaagaaactagcataaaaaaaaaagcaatgatatcctctatattttatatattaattccaagtttaccccctctatctctttccgtctacctctctcttcccttctctctcccctctatctttttctctctctctctttctctctctttctttttttctccccctctctctttctcctcccaataaagttcctacacctacctcgttacttgttttttatttcaaattagagtctcttaattactttagggtgatatttgatttgggggtttcgaattacagagcgaggaacacaagttaggttcagggaattgactttcgttgttgcacttgatgatgaaatagggttccgttgttgcgcttggtgtattggtgatgaaattgagttccgttgttgcattttgagagatactattctattttgtaaatagtatactatttacgtataccttgttctatatacgttttaaaatgaattgtttgttttgattaaagatgttaagtgatttcattaatgttttagatttaaacccttgggttccctatatattatccctttagggtttagtatacttccatcaaaaaatattgtcaatttatatagaacgttatgttattcattgacaacactattcacatctaaattattttgtgtctattttcaaaaatttaagtcatgatatttgtagaaaactatacaactttttaatagatatatcatgaacttgaattaaattttttaagatcagataatatgagttacaattgaaaaggagtaaagaaaaaagaaagagaaaagagaatttctctcctaccacctatttctcttctcacctcaacaccaataataaagtcacgtcagctcacactaatcattctccttcttcgctgacgaagcgtaacaccaggacagtgatgtctttttactctccttgaaggttatttactacatttacaaatttatggtgttagttggttaattatttagtaaaaaagtgttatatctacaaatcacgcaaaactctattacggaccaacaaatagtttatttgaaagcaaaaaaacaaaacttggtccgtaacggattattgtccgtcttagaaatataatggtctactccgcaaacagatttgtccgtcttagcgacatattggtctagtctgcaaacggatttatccgctctgtctatttgttgcaaccttgtaagttttcaaagaggaaacacatatatatgttatggattcggtatgttattatatttcccggttctatttctcaaacacactctctcgtcttctccaataactaacttctccaaatcaaagccttcttcgagattttgcgcattcctcgttttctaattcgtaagtttctcttttgtgtgtgtttctaatcgaaacttttgtgtcaatttcaaatcggaaacctaattaatttgttcaattcgctgtgatgttaaaaacccctaattacgttaaatttggaattagggtttgtgtattagctctgtgttatca

SEQ ID NO: 11759 - DNA, 3000 bp, Unknown
  misc_feature (1)..( 3000): cDNA_ID_3022912_gDNA_ID_2214515_Annot_ID_184428 3000 nt of promoter + ATG
ttaaaatcggaaagatattaaaatacaagacatgaacaaattaacccaaataaatttgtagaaaaccattaccggtttaccacgcaacaaacctaagattggtcatataccaactaaataaagtgaaaaacgttattttctgtatgcacgaccctacacttgtcttaaatttaagaaggttttgtttaggactaatacaatctccactttattgagtttaccaaaaatgaaggccactgagaacacaagaggagatgacaacatcaagatgtgctagaggtaaagccagcgcctcgagcaggacaattcagatggctaacaccaacaccaattacttcctgagctttatgtacggaaatgaatcagtatttgaggatcgtgtattcgcttctcgttaatccgactttaagttattggtttccaagctatatggttcaaaattatggaaggttacagttttcagtttgagtcaactcttaacaatttaggagagaatttgaaggccctgttctttttccagacgctgcgatcaaatccagcgaccaaaaaaacagttgtttaacacacaattacgttgaagtctatagaaagttatgtggagaggaatcactcgattctaaaaacagcgacctataaggcatatacacgtgttgccaaaaataacagcgactcaacatcttcactagagacgtcgccggcgtccatattgagcgactgtttttgtatctctgttaaaaaatttgtcttcgtcggagtcgttgtcgctgtcgcagcgattaataaacgaacatgcccgaagttacagagaacaacaccacacactatttgtaaaattatgaagcaaaaaacacataagctaatgaatactcaagtcttgtgaattacagagtacattgaaagaagctaacagaaccattgagaaagattcaaagtaatggacataatttgaaattttgaatggttaaacgcaaaacatttctaattcactcagctagggatatgtgatcatctactgaaacccacgtacttggtgcaaatcatcacttttgcagtcaattaccatctttctcatgtaaactttaaagcaactttcattcctcatcaactagattcttaattaccttaccaaaaaaaaaaaactagattcttaattacaccttcatgatctaacatattgaaacaaaaaactatatacaagctcatatgaaagtgtcttagcatgtcccaaagtacaaaacttctgcaattttcatctctcaaatctcaagtaccaagaacaaagaacatcaaaaagcttacattgttgttgttgatcatcatcttctttcacgatctcaagttacacattacatgatctaacgaaacatgtactcagcctaatcattgaaacagaaactatatacaaaactcatgtgaagtgtcttgacatgtcccaaatctcaagtaaaaagaacatcaaaaagaacgttgttgtttatcatcatcttctttcagcagacctaagacgaagttctaaaagccaatggttaaactgaccatcactaaccttcaacatctcagacaaaggcatcaaaatcccatgttccttaagcaatctatgccttggctttatcttcctctccaagctaaacgaaaaatactgagggaaacgtttcagctccttaacatctccacgcatctcctcaataaaaaactcaactttaggaactaaattgttatcaacactataagtcaacaacgccggagatctcacaaccatcttcgctacttcttctcttgtaaaccctaacccttcttcaagatactcaattttggggattagggttcgttccacattcgatacaagcaacaccgtgttccgtgacgtaatcgtgtcgcgacccacgaatcctagggttttgaggaacgttaatgcaggacgaagctgataatctacagatgaaattagcaatcgaggacaacgagagatcgatttaggtatgtcttgctctgaaattgaaatctcattggataagaagcgaagaactggtaagatttcagattcaggatcagaagttaacaaatctggaaacatgtcgaggatacgaccaacggcgggtcttgagagtccggtggaagagagtagagtctcgacggagacgacggaggagattggagcagaacggagagatgggtttactcggagagctttgtgaggatctacgttaaggtcttgaaggtaaataagcttctcccggaatagaatcccagtatctgaagtttctccggcgaaacatctaatcctcacggcggagaaacacggcggcggaaaaagagaacaccttgctatcatcatcgtcggtgaggtagaaaaaaaaagtttcaatctttaaagtgtggataaaacaatggaagaagggtaaaatggtaattctggtgtaacggtcagataaagattaaacgacgtagttttttggttgagagttgtttctgcttgttcttcttcttccaatgaggatccctattctcaagcggcttaatcataagaccggtttttgcgcagagtctgttaaccgcaatcatcttctctgtctctatctctacctctggttttcgattcttcgtttcgaagttttttttttttttccctttcttcttcaagaggtcctttttaagatctcgctcatggttagtatcagcttggcgtttgaatttgcctctttaggtaagtttccttttcttcttctctttccttatctcttcttaataagggttttcacaatctctctgttttcttcagaaaaagattgaatctttattgaaaacccaaagtgatgaaattgaaattcatgatctgggtattatagattgcagattctggaaacgtattatgttaatgattcatttcaagttttgattttttgtgttggattgaagagaagaatagtttattgatgttttgtgaagaagaagaagaagagattttgattttggtttaatatatagttggggattaacagg

SEQ ID NO: 11760 - DNA, 3000 bp, Unknown
  misc_feature (1)..( 3000): cDNA_ID_3022917_gDNA_ID_2214515_Annot_ID_184423 3000 nt of promoter + ATG
tttttttagttaatttaggagatcttttttgaattttaacttttttggttgttgaaatagaagtttgtttcatataattacggaattttacatagtccaatatagtatgaacatatgtttggtatataataataccaaattcaacccatgcatggaatccatgttttcattttagaattctaatgaaaatttgcttacaatatcaaattttaaaatatttagaagtgtcaaaccttatttaaacaagcatataatacattacgtttaacatgtcacatgctataaatattttaattatatatctatttttaaataatcaaattagagtatttacaattttttaattttttaatctattaaatatttatgatattctttaaaaatattaaatgtattagtcctaaacaaaattttcttaagtttaagacaactgtagggttgccatacagaaaataacatttatcactttgtttagttggtatatgaccaatcttaggtttgatgcatgataaactggtaatggttttctacatttttttttttaacatctaaacaaactttattaatgtgaatcaaagtatacatgattatcaatgagattacaaatacaaccaattgtttttgtaacgaaaaaatgatgaagcaatacatgccgcattcttagtcaagtactttatcatcttcgtcatttccgtcaatttggtgtgactttcttgcttagggatcttcttctttttactgataaaataccggtaatgcagttgagagtcatatgcaacgatccatatgttacatcacaaagcttttggattgatcgagactctcatatagaatgagatgtcattggtcttggttgtgcttaaaacccattgttgtgtacatgacataaaccatcttccgatcattctcctccatagatagttgcttattgtcattatccattcatcccgaattgtctctttttccatggtagtttccattttccaaagtagatctgtttgtatagttgtaaagacaccaaattccgagatctccatttatatttgtaaatctgcgagaacaagactgcatcacatcgaatcatgggtttcagtgtggggataactgcggaagggtgggagagatgtcccaagaaaaccatatcatcgacaaagagaattacaatcatcaccataaaggtgaagagaaatcgaatgaagaaaataaatctgagaacaatctgagataacagaaaattccccatcacaattattgaaaacagaagaaaaataaagcaagtaacaaaatagaaccaccggcaaatgtcggcggcccgaaaaccaaagaggaaaaacggttttatcagtatccccttttgtgtcgacagagagataggagttgtttggccgttttcagggttatcgtctttaccattgggttttctacaaatttatttgggttaatttgttcatgtctttttctttttttaattatctttcagattttaatttttatttacatttttataaaatgataatatatagatatattaataagtcagaatatttgtaaattataatactaaaacttacaaaataagaatattttaaatagtttttcttttggaaatatatttaaataggtcatgaaataaataatctatgaaatatatgataatatacaattatagaaaagttagaatatttataaaaatgataatgataaaaaggatttttctgttttaatgataaaaaggataaaaaggatttttctactcgtcaaattaattatttaactatcaaacttttttgtttgttttaatgttaacttatcaattcagatttttaggattgtaccaaagcccctataaataaagagacaagcccgagttgcatcaaagtttgagagacaaaatgagaaggtttgggaagaaaaacaaaaaaacaaacaaagagacaagcccctcctctgaatgataatattgaaaacaaccaaaagttaaggataaaatacaatttaaagttttatatgagcttttccttggatattactggatttaacgtctacaaatattttaagaaactaatacaaccacattgatacaaagtatacttcgtccgtattatataaagttatgttttagtttaaaaaatggtttcattttaaatgatgttggtagaggaacaaacccacaatgttttacatttttaacgtaaaataattgttttattgtttcaagacttgttctattattgactgaattgtggattaaatattaacagctttttaatatatacacaaatttttaaaatatttattatttaataaaaaagattacatatcaaactgttaataaataactcaacagtcaaatgaactcgcgtttgtcaaaattaaaggttaatcaggtttgggataaactttttttttatgctgaaaatcgtcttgttatgattactttttttttaataaaagatgctcatgtaaaatatattctcccatatcttgggtagaacaaaatacagtataatttttacaaactcaagctcattttgattgggcattgaaatattaagttttatattccgtggttcaagtttatctaataaaaacttttgatgaatttgtgtttttctaatttcagagaaggtgttttattcgatctgtcgttttcaccaaactttctattttgatatatcgtcgcgcgtctctcaacaattattactataagtcttcattttttatttgggtcaaataaaagtcttgatttttcagcaatggtcctcacaaacagataagattggacggctgtgattttggtttcaatgtcagctaataatatgtaccgtgagattctctttgatacatttcgtcaaaggtcaaaagtaaacatgccacgtagggtgagaacattagatatttccatttgtagcctccccatccatgcccataaagttccagaagccactaaatgcaaaaaccctaaagcactgagaaagcttgtacctttgttgaatcatg

SEQ ID NO: 11761 - DNA, 3000 bp, Unknown
  misc_feature (1)..( 3000): cDNA_ID_3022938_gDNA_ID_2214515_Annot_ID_184415 3000 nt of promoter + ATG
agctaaaagtgttatgatctgatcaatgtgagtgggttccagtttgagtcattggccagttgttgtgtgtgtgaactgatttatttatatatttggataatgaatctttgccaatcaatggagaataatcgaaaaataatgttacccccgtgaccacaaaagaaaggaattataatgatatggtcttaattcgattaggacttattaatacaacagtactagtatactactcacattgcaactggatctcttaaataattttctaacctgcagatttcagaaagtgtttttttttatacgttcaatattcgtattttgtacgtagacgtttagcactactatacgtttttaagattccgatttaaaacacatttgctactatatttgtagcaactaaaaccaactccaaccgtagttttttagtagaaactcatacaattacaaaaaaaaattataaattaaaaaagagatgagagagaatctctaaaattgggaggatcgtttctattattcatataggttgtttttttttgttttttggatataaaaataaaatattaatactttttgtttttttagaaactatatgaatcctatacattggaggtgctctaatgtacaatccgttcggacacgttaattacagatgggggtgtatggctatatacttcacattcatacgattgttgaaccttgtgagataattgagatgattagctttagcaagaagagatgattttgttggattgtgtgcaggtttaaaacaatctgatttgcattgaggactctctgttataaaccaacatttttttattattcttaaaggactctctgttataaaccaacatttttttattattcttaaaggactctcttaattacttaaactaaaattttgattagcattgtatgttaaaataaaataatacattggataaataaattaaacaaaaacatacattggataaacttattaaccatcatacaattaacaaattaatgacatcgtcaataagatcggaagataaatgattggattttaccaatggtgtcaaagagttttacatgagaaaaaaagtagatttaatgtattgtttttcttaattacttcaaattaaagtattgtttcacatacttaataatgggctgacaagttttcggacacacattttcaaagacatgttaggattgagctgacaagtgaatctggatttacttgtattttaacttctaacttttttcaactagaaaagtagtggatatggatttcacttgaggaacaaaaatacaaaaatagaaacttagaaagcacgagggatgtacgtattttgttgcatggggagatattgacaaagaccatcgagttgggttttgttaaatatagtaatattttatgttatgatttgacgtacgctctataatttatgtgtaatgtatattagaaaattcatggaatcgtatcttgtcatataatacatatcaaataatgtgtattgtttttgttaaatataacataacgaaagattaattaattcaaacataaaatctatgtatctgtcaatcaagaatattgtgtaatgtagttaataaaatatgcttattagttgctatagtcgacgtatcacgtatgaatggttcgaattgatcccacagcatacgtgtttgtttctcaaccacaacctttattcgtccaactaaaacaaaaatgatcattatgagatttaccacaaaccacaagcatgactacaaatatcaaaactaataaaaattgattatataccaaaacggtatcaccaatttatgatgtactacgtatactttctagtaccgttatctgatttttaattatcattatataggatttttttttaaatgtctcttttacaatatttatataaaatcatattgtaatttacaaaagctgaggtgattggtaatcctaaaggcttccatatgcatataaaatcataatttacaaaattcttagatatctcgagagttttgaagattgcaaaccggaatgtgttccaaaaagttgtaatcaagcggcaattaaaaaactctaattaacttaactttaactatttttgatattgttcaaagttatggatttaaggattgataatttcggtttgagtcaactctcccagtaaacaaatgctagcaatataggggcgtttcaagttgcagaaaaacacactaattgtctctaaagtctacagccagaaacacaatctgataggtcccaaaagcaacaaacacacacaaaatccctttttaatggtagtttaaactacctatttgttttgattttctgatcaatatatggaaacaaatgaacgatggaaatggaatcaatcatgattcttacaacttaggggagacggagagatggtgaattgcataaacaactaaaagaaaagcactcattcaaaatcaacgtgaaccaactcaaccttcatgtccgcgttatcccttttggtctcacaatctattccatgttatgcccattattgtctatggataatgtttggcatataccagtgaaatttgttggacgaaatggtttaacatcccgtatattgacaaagaggtcgtgggttcggaacctttgttttgcaaaaaaatacgttttcttaaatttaagtataaaattcatataaaaatacggtttaggtatgaaaaatgccctataaatttatttgggtatgcaaatgcactcagaatgggtattaactcttttcaccagtcgagagactagagatagaacaaaatagaacaataaaacaatttaggggcttttttgcaaatatcaaaacccctcctaatttaactcttccgccgccaaatgctaaacccccaaaggccaaagcttctcctcctccttcacttcctcttcgtctacatcaatctgatttgagggatcatctcctgacgaagtttagggtttagggtttcatttatccctcccaaagtttctttctagtctcttcaattacg

SEQ ID NO: 11762 - DNA, 3000 bp, Unknown; identical to SEQ ID NO: 11754
  misc_feature (1)..( 3000): cDNA_ID_2707372_gDNA_ID_2214515_Annot_ID_184412 3000 nt of promoter + ATG

SEQ ID NO: 11763 - DNA, 3000 bp, Unknown
  misc_feature (1)..( 3000): cDNA_ID_2707440_gDNA_ID_2214515_Annot_ID_184409 3000 nt of promoter + ATG
tttctgtcacaccgcctttttccttcttctaggtgaggtcagttggctagtactcaagctctgagacttgaatcagtgacttaaatgtcttatacctatcctcatttcttgtttcaggtattcaatttggctagatagtaagatgagactcactacagatcctatgctgatcattgacttcttcttatggagaacaaaatcagaattcgctatctccaaccattatgaccggcattgtgtgtgggatgaagtgttacagaacaaacggctgaataagtacaaccattcggccattgatgaacagtttatgttttaccgatcagatggtctcaagaaatttgatccttcagatcctaattctcctcttccaagttgtaagtaatcaatcaacccttaacttctctcacaccatacacatttactagttttgtttgtttaatgtttattgagtgttatgtcttgttgttgttagatgtaccggaaggttcttttattgtaagggctcatacaccaatgtcaaacctcttcacttgcctttggttcaatgaagttgatcggtttacctcacgagatcagttgagttttgcatacacataccttaaacttcagagactgaattcggatagacccttgcgcctaaacatgttcaaggtaaaatagaaagaaaaaaaaaagtatataagagagtgatcattggtctcagttctttcatgagtacataaaaatcataatcaacttggttttcatttcaggattgtgagcgtcgagcattaactaagctcttccaccatcgcgtagattcatcgcctccttcacctcctacttgattgattaagtatagatagtgttcttatgtttctacaatttttgtacttttctcctctttatacttttagtctaactttgaaggagatgaaacatggaagaggaacctaattgacattgtgtatgagccattatagtaactttacagcaaaattcactgcagatatataccaaaaaaaacagcactgaaccagttactgcttaaggttagtggaaaacacaactacagtagggattttgactggaaaaaactggaaaaaaagaagtaccaattctgaagacctctaattgagaatatggtgaatttttttctaaataaaagtagatttcagctgggaaaaaaacacacttttttcaattttgttgatcatataaatataataaatatacaaaacatgttgatatgaatggggatgtagctcagatggtagagcgctcgcttagcatgcgagaggtacggggatcgataccccgcatctccatttcttttttgcatttgttttaacattatgtggcttagggtgtgagtaagagacgtaacttgtcggagaagttacaacttttaccaacggttacgtagagtaagctatgtaaacatatagataagtgtgtatgttgtcttaagtaaaaattgtcgagaataataaagaagtggaaataaaaattgtcgagaataataaaagaagtttttccactttttcatcctttgttttctctaccatgctctgtactggaagcaatgcttctacaattattcaagagcaaaaacaccaacaagactctgcttccgctggtgattgagccactgtttgttgcttgctagattgccaacaaaacactgctgatccaagagtgaaagcatacaccagaggtgttctttttgtatcttcatttgagccaccccaatcactgtcttgagtaaccgaacaactctggattttctacacttgtaaattgaactcaaaagttagatgtagctttgacatatcttcaaactctcttggcttcttggtagtgcttgatgagtggcacagacatgacccgtgatagataagagcatgcaatcattaaatctggtcacacgagcccacaaacaatgcttctgaactttgtcgcttcaccatattcctcatctagaccaccggagcacactgcttggtctagaaactgagctaaagaaggattcaagatcattgttattttcttgctgctgcttagctttagcttgggcagctgcacttccacgtgcctcagcagcggctcgttctgccctaacccttgcttcagcatttaccctttctctagcttctacagcagctttctcagtcttttctctagcttcggcttatgctccggctttgctctgtttctgtgagacttttggaagcctaaaaggttatgaagtggaaaatcacatgaatgcttcagttactatgttggaggaggcaagttagtgataatgagattggttctgatattagagcagctattttgaagaatgggggtggttcaaaagaataatgggggtggttagaaagaagtgttgaaaggactcacaaacgttagttcgctcttctctctatctctcacactctgtttttgttccagtttgtagtgtacacgtttaagaacttataagactacattgataaaaaaacttggaaacaatcttacacaacactgtcaacacacacgcacttacacacagtcatgctcttaaacacataattactacattggaattctaacagcaacacttgcacactactttgctttaactaaacttcaacctcaagctaaccaaaaaaaaacactttctcttgtttaggcctcaaccaaagctgcagtcctctgttgacgagtcatctccgacccatcttcttcttcgcttgttattctgttgctttgcttctcatcttcatcacactgattctttcttttcttgttgcaggtttgatctccaacaagaagatctcttattgctagtggcccacttgaaggttaaaattagcccatttttgttttacttaaccgactacaatcggaaaatatataatggtagctaggtctcgtatttctaggtttctctacgtcttttgttacttgttttttctagggcttattacataatatataagttttaacagatctttcttcgttcgatccgcagtcatg

SEQ ID NO: 11764 - DNA, 3000 bp, Unknown; identical to SEQ ID NO: 11752
  misc_feature (1)..( 3000): cDNA_ID_2707394_gDNA_ID_2214515_Annot_ID_184408 3000 nt of promoter + ATG

SEQ ID NO: 11765 - DNA, 3000 bp, Unknown; identical to SEQ ID NO: 11751
  misc_feature (1)..( 3000): cDNA_ID_2707398_gDNA_ID_2214515_Annot_ID_184406 3000 nt of promoter + ATG

SEQ ID NO: 11766 - DNA, 3000 bp, Unknown
  misc_feature (1)..( 3000): cDNA_ID_3022899_gDNA_ID_2214515_Annot_ID_184432 3000 nt of promoter + ATG
ctaaactcagagcacttgcaagtgacaatttggcaaaaaaaataatcaaaattttagatagttttggacgtttggttatccattctattttggtacgtatccatacgattatcggttttttggattccaaagtttagtatccattcggttattttgctttgaaatgttttcggatatctcggttatttttggatattttcagtcaactgtttttgatattttagagtatttttactattttatatatattctcaactatttttaattatttagtttaaaaatcactaatatttttgaaaatatatttatatttttgattatctgaaatatttcggtacgaatccatcaaatttggttctttctgttataaaatttaatatttgatttttttggattttttttgtttgattttggttcgaatttatttgcattgtgcagacaacgaatcatatgtgctcgtgcaacatgtatcaatcctatccgttaaatttaatattatcaacggtctagataaactcttaaaaagttgtagacaattacctcaaaagaagaggaataccaaaaagctgcctttggaaatcttgaaatgtagttgaacggttagtggtcgttagactgaaatgtattttattttcgtaattattttaatttactagtttatattttaaaattttgaaagttagaggtctaatatcatatttgaaaagtactatgaaaagtggtaatacagcaacacagtcaaagcatactcgaaccaacagtaaaaaaaaaaacataatgtcagaaaaaacatgggttgtatattaagacaacttatattaagacaacttttttttaagacaaaagaacaaatttgggaattgaagactctgcaaaatactgcaaggaagacataagagcaaacgaactttcacagtttttgagaaagccaattttcttttaagattttattaattttattgatgagaagatggagaaatgaccttttccgtagtaaaattgttttgaccgcattggagctagtgaatctgattctgattagggtttagaaaaagtaaaaatataaacatgattttctccaaaaatcacggtgttaatgactaggctccagacaacaaatcatactagtagatactcgttaaccgtgacgcagcgttggaaaagatatgtttagtattattttaaaatacatttgcatgctttatgcaatgtggtgcaattattctataattcaaagtcccaaacttgccggttagaattaaagactgatttttcgaatcttcatttattttgataatatgctgctgaattaatactactaaatagtaagaagcaaaattctttattcatgattatatatatgttttctataccacattatcaaagcatgcatggtaatgtgattggctcaatgattatctcaaagatagaagttttatattttcaatgcaaattttaaaactgttttcctgttttacccttactaaataattagataaatatttattattatttttaaagtatattagaggataaaattgtctttatacaatatttcttaaagaatgtgaaatttctaaaaaattcatcttactgagggaatggagggaatatactacaccgagatatgcacataataatacacgaatgtattttatagatacacttattagctatagagataatatttaggttaacataaataatcttaggttttgaatagatgttgtggttaatacgaactaatctttcatcggtttagtacatactattttcataagcggacaataaactgctgtggacttagtttaaagacgatttgtccgcaaaagttttattttatttttttggatccacaccattacggattataatttgtgaatgataaatgaaaaacgatccggtctataaaaagttttgcccaactgaaacgcggtaaccatttaaaactttaataatgacctccgataaattactaaaattatttagaataagtgatgttaattaaagactaaaaagtagagatggcccatttggatactaaaggaagaaaaggttgcagaagaaaagtcacacgcttccaaagttcctaaccatcaaaaccgcctgcgaccctcccatgtgctttctctctctccctctagctcactaccaaatttgtttagggatgctcgtgattatttcaaaactttgcagctacattttaaaatctttactttttttcttctaaatacctccaatatagtagtagaaatcatcacaagaaagaaaagaatccgacctttttttcttcttgctttggtgcaggaatccaactttttgtgaaatttaaccattgataaaaacctaaaatttttgaaattttaaaattttgttgaaaaatcaaagtttacctctatatatgtgtaacaataaattatgaaacgaatcataaaaataaatatgaaagttaatgtcaaacgtgtaagaacaggtgaacaagccaacaaatgtaacaaaacattcaatgatgtttgggtttatatactccaataactaccaaaataaccatttcttttttctttttcttaaaaccatgtttcaaagtacatgcgcttgtgcccatatgttttgctgcaaaataataaattcaccattgaaaccctaaatataactttttttttgcagagtttttttttttaaagtaaagaaagatcaaaaagtaaaaaataaataaaaggtagggaaaacagttaaagcagtaaatgaacattctataaattccacttcaaccatcaaccttcttcactcccatcaaagcaaaactatctttctccttctcattcctttttctctcactctcctccattaaagctctgcactttctcaaagagaatgttcatgtaatataacatcttcctttcaaagtctttcttttactgttttttttcttctatctttctaataaccaataaaggtataatttttgtttgaaatttgttctattgcaggggtaagatg

SEQ ID NO: 11767 - DNA, 3000 bp, Unknown; identical to SEQ ID NO: 11750
  misc_feature (1)..( 3000): cDNA_ID_1441000_gDNA_ID_2214515_Annot_ID_184405 3000 nt of promoter + ATG

SEQ ID NO: 11768 - DNA, 3000 bp, Unknown; identical to SEQ ID NO: 11759
  misc_feature (1)..( 3000): cDNA_ID_2707406_gDNA_ID_2214515_Annot_ID_133945 3000 nt of promoter + ATG

SEQ ID NO: 11769 - DNA, 3000 bp, Unknown; identical to SEQ ID NO: 11758
  misc_feature (1)..( 3000): cDNA_ID_2707402_gDNA_ID_2214515_Annot_ID_133946 3000 nt of promoter + ATG

SEQ ID NO: 11770 - DNA, 3000 bp, Unknown; identical to SEQ ID NO: 11766
  misc_feature (1)..( 3000): cDNA_ID_3022899_gDNA_ID_2214515_Annot_ID_133948 3000 nt of promoter + ATG

SEQ ID NO: 11771 - DNA, 2810 bp, Unknown
  misc_feature (1)..( 2810): cDNA_ID_1808676_gDNA_ID_2214516_Annot_ID_133950 3000 nt of promoter + ATG
atactggttgagaaaaagaatagtaggcccataaagcgcatattgcagtatttatggcccatgatggatctgaacttatagatcacttgcagtagccatggcccattgatggatctgaagttcagaacttatagatcactcatctccctccggttttcaatttgacccacccggtttagtatacgaactccggtttatataactttgacccagatctaattttattttaaccagcaaatacaaaaaacttccgatcccccttagcgtttccttctccggcgatattcttcttcttcggctcacattgcatcgtctctcactcgatccttcgttctttcaggtttgttatctcttccctgatattttatgcgcagttcgatcttcctcctttctctttttgttagctttatcgacaaatgtaagctagggttctcgcagagtaattgatcgatagcttccttcgtttgatctgttttgtgttgtgattccgacctcttgaaccgtataattgaatcgcgtttccatagtttcctctcgatttttgaatcgcgttatacaattgtctactttatgtacatttcgcttcggattcgtaaccgtagcttcgatttttgtgtttgaatcggtttgattagataatttatgcctttaggatctgcatcgattcgaatttcgatcttgaaatctatactactggtgattgttgcttgaggtttatattgatctctgagaattgactgtttcatggtgatctatttcgactaaatctttgttgatacatgtgtctggtgagatatgttgctcattgcttgagcaagcgaagtgaaaataagaaagatgttattatacttccctaagattgaaatccattggaagagatgtgaattacccactattgatcatcaaattcgtttcctgtgttccttttcaacttgcataccgtagcttatgtcttattgtttatatagtttcctgttggaactggcggagaatcacttagttgagtttttctgtggcagatgcgattgttttgaaagtgttataattgatcttgcttctgctgtgttgtatcttgtacttacatgtgatgtatgagtatcgaagttgttgtgacagatagcatatgagcctttacattgtttcaactattagctgtgagatatttgtgaaccttgtagtttatgatctctgcttttcttccatgagctgtgttttacaggctattttgctgtgtgtgttgttccacacagatgatctcattcaacaattttgcaattttacttctatttgcagggacaatcatttcggaaacatgccaggtcagaagattgaaacgggtcatgaggacattgtccatgatgtgcagatggattactatggaaagcgaattgcaactgcatcatctgactgcaccatcaagataaccggtgtcagcaacaacggtggatcgcagcaactagccacattaaccggccaccgtggtcctgtctgggaagtcgcgtgggcacacccaaagtatggatcaatccttgcttcatgctcctatgatggtcaagtcatactctggaaagaaggcaaccagaaccaatggacccaagatcatgttttcacagaccacaaatcttcagtcaactccattgcatgggctcctcatgatatcggactatccttggcctgcgggtcatctgatggcaacatttcggttttcacagcccgtgctgacggtggctgggacacatcaaggattgaccaagcacatccggttggagtcacttcagtctcatgggccccagccacagcgcctggtgctcttgtgagctctggtcttctcgatccggtttacaagctagcttctggtggatgtgataataccgtgaaagtgtggaagctcgctaacgggtcatggaagatggattgctttccagctcttcaaaagcacactgattgggtccgtgatgtggcttgggcaccaaacttgggtctccccaagtccaccatagccagtggttcccaagatgggaaagttatcatatggacagtgggaaaagaaggtgagcaatgggaaggtaaggttctcaaggactttatgactcctgtgtggcgggtctcgtggtcgttgaccggtaacttattggccgtatccgatgggaacaacaacgtgactgtgtggaaagaggctgttgatggagagtgggaacaagttactgctgttgagccttaggtttttgatgctttgctatctctctgctcttcctttaaggaactgaatcaaacattttttctttactcttttcttagtccggtttggtggtctttttcagggaatgttgaattggttttcttaaagacttttggattattttttttcttattcttttcatagacaccattttaaaattctaaaaaccaagatcttcatgatatatagtttgtctcttcatttgattttcttttttctatatggtaaagagtttaatttgaaggaattttgagttttgaccttcttccataaaattagatacgtgttgtctgtattttgaaccaattggttctacaaaaaaagaagcagatatataaataggcccaaaagggcccattataagtttatagggtatatgtggcctataggccttgtcttagacccatttagttcttctctatagaccgtctctctttcggcgtctcgtataaaaatctcatttgcttttctacaaatcactcccaaaattctctccatcaatctctcttacacactacacaaattcaacaactgaaaccaactcagagcaaaagcttgatttgacactatg

SEQ ID NO: 11772 - DNA, 3000 bp, Unknown
  misc_feature (1)..( 3000): cDNA_ID_2708417_gDNA_ID_2214516_Annot_ID_133951 3000 nt of promoter + ATG
catttgtgagagttaagacagagttaggtctgctttctgatttcacatgaacttatcgtgagagtttcttactaaacaattcacacactttatatgtatgcgtgttaaattttggtgagaaaaatgttagaagaaaagcaagattacgcttttatttaaccatcccctgattatcaaattctcgttatcaaaaaaatagttgccgataatatcttcacttgtctatacacatttaaataaaattatttaatttgaacagtcattattgtcagttggatgaggaaccctaaagataagaattattgccatttaagtattgataaagatatttaattaattgtaacttcagtgaaatttcatagaaagaaaaatatatattcatttgtttggttcttatcataatggtcccaagaattgctgcaccaaatggttgtatctcgaggcatcgatgccattacggtaaaagcaaatggtaaagtagctcataaagctacactccacaacatcaataccaatttaacattttcagatattctaattttttagctaacgtctgaattaacatattctaatttataatatgaagaaacgtaaatatttgaacatttatatccttaataactgcttagatataggagctctaaacataatctacactaattttcgcatgtgattatgcaaatatcaatactttgatgataaactattagtttgattaaagaatggcagtgtagtgatagataagttatctctaaacatagaaagagttggaccaaagtctcattctatcgctttcttttttcccatctatttgaatatttgactattcaggtggatattattctcgtataagaagttaaatatataattaactaaaattgggttcaaatatcttttattaattaagattatagtgaaacatgattttttttgtcataataaatctatagtgtcaagttcaatgtaaaatattttaagtcaaagtgaaatcatattaagacaaccgaacaaccacacaaaaaaatacataaaccattttgttttcatttctttatattcaaactaatcatcaccaaaataaaacctaacaaataaaggaagtgaaccttgtaatttaaaccttacttaacccctttatcagaataaggttttaattttaatgaaatctcacaaataattttttttctttctttcaccttaaattgactccaaacaaaaacggaaaccatgatgagccaaactaactgacatattcattactatatcttatttgttttgaattttaaaattaatagaaacctaaaagtaactctagtttttatgaacttatctctatttaacataataataactggtgtaatagttagtctttcgtataagtatggactgacatttgtttcttacccaattctagaatcacaatttaaaaacgtaggtttgcttcttcacttgaacaaacttgaaaaaaaatttcatcatttaactaagctcacttttaccaatcaacatatcctgcatactatttttcaccattacgatatatttatgtcgactaaaggaatctccaaggctaaacactattttggtgttcaaattacaccatttttagcactaaaacttctgttctatccaaccataacaccaaaaatcacactaaaaaaagaatctattattatataatttatttaaaagattttttttgttatttaatagttttgattagtatttattattagtataggattacataacattataaacatagtatattaaaatatatatttaaaaatacataaaattgtaattattttaagtattttcatacataataatataaaaatatcataattaaataaactatttcaagagatataatatattaatgtatccattcatttttatattttatatctattaatcatttgtaattttatatttattaattgaatttttattgatataataagtgaatagtgtttagagttatgaatagtatcacaccaaatttgatgtaacactgtagcattacactaaaatggtgtgaattttagagttccattggaaagcttttagtgcaaaaattacactaaaatggtgttttagagtcccattggagttggcctaagtagaaccactgaaccaatgcaacaaagttagacatatattataataatagacctctatctatgctatatatatgtaattttgcattaaataggccagtgtttgtggataactatcacgattaaatagtgctaatcatgtttaaatagtggtaaatttacccatcaaaaacaaaacaaaaaagattaaatagttctaaataacaaatattacagcccatcattagttgtcttgttacaaaggtagatgatgtagcaatagactaatagtacccattatatcgaagataaattactattcaactatacaaaactatacaattatatattatcacctttttttgttaggtttcttttgctgtttaattattattattcaaaaataaactctcaaaacattatcttatttaatcaacgcaacaaatatcgtaagcaaacatgctaaaattaaccactgtaaaacatatatttgtttctgtcgaacattttaataaaatattcttacaagactatttcaaaaaataacaaaaatataaaagtgtttgtcaacgaaaaataatttttaattaaataaggaaataatataataaaaaggtataaagtaaacttgaaatcggaaaaaaactaaaaaaggagaaagaacaaagcaataaatgaaaacctgcaaagtttcgtctttgcaccaaaaaacacatcaccactctcttcctctctttcctcacttcgctctttcttcttctcctcctacttcccaacttctctcctctctcttcacattattatattctctctgtttcttccaatccaatccaatctctctctctctctctctctcagaaactaaactgaaatattgcagagttttgaatacacggcc

SEQ ID NO: 11773 - DNA, 3000 bp, Unknown
  misc_feature (1)..( 3000): cDNA_ID_2708428_gDNA_ID_2214516_Annot_ID_133952 3000 nt of promoter + ATG
aattatgatttttgttttatttcgggatctaatgtatgataaatcattgttctaaatattgtatctaaaaagatttcctcaagtaggtgccaccatttgttgtccttggcattcttcctatcttgtttgagctataaagtagttaaagaatagtcaattttcatatgttttttatttaataaaaatgtatttttactcgaaatcattgttaatcgtaatttgtaatgttcatatttctcaatattgtgaaattaatacgaatgaaattggttgtgcaggtgatggtggtcttttatgtcccctttttattaggttttaaaccgaatttttattgatggaccgtcctctatttgaataatagatataactcatttcctgattagtcgaattactccatgtgatatacatatggctcgcacaaatttatgtacatgtacatttatgtgtgtatatatatttagtcttactaaattgagtggagggaatttttgttgtagcttttttgttttctttttaacgtcaatatgcagatgtatttaaaacatgttcatgcagccaaatttgctttatggtaaaatcatatatatactctctcttttttttttgtttaagtatttatcttattttattatcaccgatatagaagattgttcttatttcctttgtttcatataaactatattttttaattgatatgtgaatttcctcttcttttctatagttcccctcttcattttcatttataagttaacatataatatcatggatgatgtagtacttaattataatgaaatgataaatttattggagctgaaaaaaaaaattgggaaattatttcatagactgagtttaatgatattgaaattgaatttgatgtcgtgatgtactactgatcgattttaaatacacatattatataaaaattatatattatgaaattcacatataggatgcacaataaatattttttcttagagttacatgtatttatttatacataaagaggagaaatctgaatatatttttcttggttacaaagtagctccatctctgtagtccactcactgataatttacttcatttttttcattcttttaaacaactgataatttacttcacatgttaggaacatgtcaacttcattagcagtatgaagttgaataacatatctaatgaaatgttaatcatgcaatcattagatataaaatccacagttattaaatacttactaatcacacaatcgttcaattgtgtttatgtgagaggattcaaatcagtagtcatagtctgagtaccttagaaagataaagcagcccccagttaggtgttgatgtcctcttgccaaactaggaagctgatgagtgtactttatctgcccccatctttctgcataagtcgaaccaattattggttcatttttctcatttttttatttttattttcaaatagtttggggcaaaatattaagtggtgacacaataaaatgtggtgcattgccgtgtgtttcaaccgtacgatccgaagtgtttttttcaccattctcaaaattttgtggtatttgttttaggtggtgctgcgttgcaggacggtgatattttcttttttatatgttttgtgaaacgcatttttaaaattgtacatgttaacttttatcaatcaatataagattttggaaagatataattgttttggccatttaaaatgataagaaaaaaacaaatattcaaagtttgataatcatttatatgtgcaccacatttttatagttaccgtttaacttttgtttcacctgctggttgacagacggcactatccaacatatgttagcttgtttcacttgacatctcgtttgtttcatcaacatatatcgactatgggcgaacctcgaacccaaactaatcttttcggtgagtatatcttttgaattccatgttcataatgggttaatgggtctaaaacgtgatacaatttcgacttagataaatagaaatgaaacggtaggaatcaaaattgaaagggagcaaattgacgtcatatcttttagtattttacatcactactacttcgttacttttcaattttacattataaataaattactttttctgaacaaaataacttgttatatttttttcgaggtattttcacgaacatagcaaaagcctgcatagtggtaatatatacgaacaactaatgaattctcaaacaaaaatccaaacactaaggtttcgaatagagatgtgctgtgataataacgtatatatatacagaaaaatttgttactattggaactgcacagtctgaaccgcatcgtgcggtttggtctccaaatactagattaaaacgtgagatccgcaatacgtggtaaaaaaaaatattacaaagtacggaacctatttttgctttgaattgatatcacttttgttgggcttaaaagttgaaactaattggttgggaaaaggtccatagggcgatggtcaaagctcaaacacagaaagtaaaaaggaacacgtaccagtctaacttcatagagtgggcattgtgtaaccgaaccaagtaaacccaaactgatcacaaatcaaactgaaccactaatccactctgcttagttgagtattgttaattaaaagatgataactcctttaattcgataactactaataaatcctttgatggtttgtattctgtaaaaataaatctaaccgaactaataacatcaagcacaaacatatttgggctcaggctactcagtcataatgggcctttaaacggcccatactaagtcagaacaaagagcaagtaatctcaaaatgtcatcttcttcaaagaaagcaaaagaacaaaaacaaaaaatggaaaaagaataagtttcctttaaatttccccaatatcaaaaatggaagtcttactcaacaacgcacttcttttataaccgtttgacgtgtaagtggtccgcgcactaatctctctctccctctctttcttcttcttccacaaatg

SEQ ID NO: 11774 - DNA, 3000 bp, Unknown
  misc_feature (1)..( 3000): cDNA_ID_1832424_gDNA_ID_2214516_Annot_ID_133954 3000 nt of promoter + ATG
gataaacgttatttatatcaatcccaacagtagttcacttaataagccgtattactatatatacatatataaattaacacatttcaaagttaacaaacctagcgtctttcggcttatagaatcataaatgtttgtatagccaaaaacaacaactatatacagtatcttacataataaagtagtttatcacctatatttttaatagatgatgttttacattttatagagattaataaagatgtatgacatgttaatacatctcacttttttttccatatctctatttaatatagctcatctagtaaaactatacaattaataggaaatttaaaagcacattcaagcaaaaatgtgatttcataacactctttaaaaacacgaaggaaaatatatatattacgcgtgaatatatatatatatatatttgtgtcgatcaaaatgtaaatatattttctttaatcaaatttttgtacttttgaaagaagagaaccatctcatatttggatataattttttaaaaaaattaaggtataatcctgaagagaatagaaagaaaaagagagtgagaaattaaccagcataatgaagaaaggactatttcggattctgcagatgggatcacctaaagtgtcagtgaagagaagagtttggtggtcgtgaccaatctcacaactcttctccatacgacccatttgaattctgtccctacgatcatcgtagcatctgatcaccacctcttcatcaacttcttcttcccattgccccaccattctctatctctatctctctctttctctttctctttctctttatttataggggaaatgaaatgagaagagggataacaattcatacaaggaggagacccatcctatgttataatgtggaaaccttataaatagacacacaatatggaagttattaaagtgtcaggacgactaatatatatggatatgtcattatgtttttgtatattagttgtaaaattcataaaaagtttactataacttcattgattctaggataacaatttatgtgcaatctctcagatttgtagactaaaaataagattttagtaacagaataaatttaattaatattaattccaaatgacatatactactattacttttggcaaactagccttcatactttgactcaatcttttaataagatagtaattgttccaagtttataaatttaccatctaaaagaattttatatttgactaatgttgttagacatgcataattttgttttagtaattaatttcacattttgaaaataaaatttcaaatctttgttagggtgtgataatcacgtgttcgcattaaacttttcctaaccagttcaaagatacatattttccattttgactattttgattaattagtatttctaagttagcttgatataatcatcagaatatataattatgtagattatgaatgtaattttcgtagttaagtatcccccatgttgataatttcttgctattttgattgtatattgaaccacgtacccttgtttgtcaaagttccatattgattgtgtttctatgaattgttagatccgttgattgtggacacggtacgttgtcaagtgtaatttcagagaaatgtgttgaatatattgaatgacaatgcaacttaaactaacttttgtcataccttgtaactataatttgtaagtttcttgctttttaaagagtactttaatatgtgatttaaacaaatagaaataaacttttcatccgaaaaaaaatacaagtagggaaattatgaactaaccatttctgttaccatactaaaataaaagttggcagaccaaaagcaaaattatacaataatatgattgggagatgttttgggagtggagagaagaagtacagaacgaatcatatcttcactaacttaactaaccaaagccaaaacgaatacgtaactcaatatagattagcaattttctttttaatttgagcatttgaaaaatgtttttaaatataagatttattaccatttatgatctatgcaatgtattttcttaacattgttgagttttaggagtgatggtccacaacagactttacatggagcacaagtttagagtggagaacaatattctcggatatgaaatatacacatataggagatttgattaacatatctaattgtctggattttgagtaattgtcacataattttcagtgcgactgcagatttttttttttttatcacaactgcagatttagtcttttaacaggttttctttataaattacaaattaatatagtatgttatttcttaattaattaataaattacaaattaataaatatataaataagttcaattgtagtctagtttgggtcacaggatacttaagctttctcacctgagagtccatgaaaggccttgaaagacattaataaagcccaacgtagcccagatagacccataaataaatctgtcacgtttaccacgctttaacggtcaacagccactagttattaaatttatttattttttaaaaaaactcatcaaaacaaagtccactagttatattcgaggttataaacgtaattcaaggttattgtgctgttgggagctttgaagcggcacgatgataaataagttgacgccatgacacgtaagccgcttagtagcctctttcttcaaaccaaagactattcaccgttggattaagaaagctcactcaatcttaacccttcattttattaaataaatcctacgaccagaaaataaaataaataatttggttctgttatcctttcattgtcttcttcattcctggtaaaggcttttaatttcatggattatcttagcttctactctcatggtggctatcgagaaatcactcacaccaaaatctttgaagttctgagtttcaaagtttttcgaatttgaaactttcccgaagcaattttaaaccttttctcttcctttcgattttttctcttctggaattagaaaacttagtt

SEQ ID NO: 11775 - DNA, 1609 bp, Unknown
  misc_feature (1)..( 1609): cDNA_ID_3022972_gDNA_ID_2214516_Annot_ID_184456 3000 nt of promoter + ATG
tctctctagtgcttcaatagtttggaattcaaagttttgtatggaatatttatgtgacactttacaggatatatgtattgagatatctttttagtttcagttgaagtgaagtgacaaaatctcaaatttgtgttactagtttttgggttttgctgctcaatcaaaaaaaaaagtaaaagaaatgagtgagctcagattatagcgaggttaatatcatatccgaagattcatcaccacagctcaagatattttcatcactgctcacatgctactagatgcaccagccgggaatcgaacccgggtctgtaccgtggcagggtactattctaccactagaccactggtgcttgttgtttcaactacgtaagtttagttaattgtatgttatttgaagtcgagtgatctggttgaaggttttatgctatgctaatcatggtttatggttttgatcttagcgggtatttattggatggtgattttacccagttcctaatgatacaagatgaatcagtttatacatgtcaaaattcttgtttttcaaatgtttcaacatgtatatgtgttgtatcatctattgtaaattaagtacttgatctttctcttatgactttcaggaatatagttacagttccaatgagaagttcataaaatggacagtgacaaacatgaacgttactaaccggtggaagttgggttcatgttatattttaaacaacttactttgtagcattcttcttttgggattctcattttgactcggacactctccactgaaactagttctatacccaataagttggtagaccatggttttttatgagttacatttagtttattctaaataatataattataagaatatgagttacgtgttgagctttgtggtattttaaatggacaaactcatgagttcttacaattaaaacaaggactttcaataattaaataataaaaaagctataaaacaaaatatagaaacaattgttaattaaaagaattagagtaaatttccttaagagacctatttgaagtgttaagagtttttataagagttgaagattttcatccaaattcatggatcatttattgaatattattgacaatatcaattttttggatgcgaaaaaacttatctttctttgagtatgtcacataaatgatcgagtgatttggatgtaagaaaattaattagaaacgttggttttacctttttttggccgagatgctttatttcaagaacagaaatagtatggaatatagtaagagaaattgagtgataatacaaaaaatgttacttgaaaaatttagtttacataagggaaaaaaaaaagagctcagaggtgtggcatatctcaactgataattcagaaaaatgcaaaggacccacccaatgcttaagccaatatcatcatagcttagtgcaccagccgggaatcgaacccgggtctgtaccgtggcagggtactattctaccactagaccactggtgcttattgattctatctcttctagttaataattatctctaaaattaaacaaccttcacacacaaagtacgcaccaccacaggattgaaagagaacgagagagcaagccattgcaggaaatg

SEQ ID NO: 11776 - DNA, 3000 bp, Unknown
  misc_feature (1)..( 3000): cDNA_ID_3022980_gDNA_ID_2214516_Annot_ID_184454 3000 nt of promoter + ATG
tcggacgaagaaagaataaatatggaggcccattactatagtatttggccttgaaatattttggtccgagaaataataaataaacagttatggcttttcggatttggttgctttcaattttctcaaatgtttggacaagtgttattacactcacctaaaacaggatcattccaatttcttgggctcagagtctgtactttcttcttctttaaaccaaggtcttataagtattctctaaaccaagtcactaaacaataattggtcttgggtctggttcaaacttggatcaatgttgccacatagccattagccacacaaaacaaaaattgtcttgcctttatatggaatgaagaaaaatcgaattttgtaaccatttttgactttaaagtcacactcgccgtatacggcacaccaaatgaccaaaaacatttgaccaccaactttgctttaatgttaaaactttttttttgcatcccactactctcttcttcacctcctcaagtcacagtgaccaaaatcacacacttcacaagaaacaacctatggatccaaatgaatctccaccaaaccaatttcgccacgtggtggccatgccttatccaggtcgaggacacatcaaccctatgatgaacctctgcaaacgccttgtccgtcgataccctaaccttcacgtcaccttcgtcgtcacagaagaatggctcgggtttattggacccgacccgaaacccgaccggatccatttctccactctccctaatctcatcccttccgagcttgtcagggccaaagacttcataggcttcattgatgccgtctacacaagattggaagaaccattcgagaagcttcttgacagcctcaattcaccacctccgagtgtaatattcgccgacacttacgtcatttgggctgtgcgagtcggcagaaaaaggaatattccggtggtttctctctggaccatgtcagccacgattctctccttcttcctccactctgatctactcataagtcatggccatgctctgttcgaaccatcaggtaaagcatcagtgaattagttttgattcttgaaacttggtatatattgattcttgttgaaacttaattagtattgattcttgaaaagttagtattgattcttggtttgttttggaatctaaagaagaagaggttgttgattacgtccccggtttatctccgacgaaactccgagatttgccgccgatatttgacggttacagcgaccgagtcttcaagacagctaagttgtgtttcgatgaactaccaggagctaggtctttactcttcaccaccgcctatgagcttgaacacaaagctattgacgctttcacctccaagctcgatatcccggtctacgctattggtcctttaataccttttgaagaactttctgttcaaaatgataacaaggaacctaattacatccagtggcttgaggaacaaccggaaggctctgttctttacatatctcagggaagttttctttcggtctcggaagctcagatggaggaaatagtgaaaggactgagagaaagtggagtccggtttctttgggtggctcgtgggggcgagttaaagcttaaggaggctcttgaaggtagcttaggtgtagtggtgagctggtgtgatcagcttcgggtgctgtgtcacaaagctgtaggcgggttttggactcattgcgggtttaactcgacattggaagggatatattcaggagtaccaatgctagcgtttccgttgttttgggatcagattctgaacgctaagatgattgttgaggactggagagtcggaatgaggatcgagaggacgaaaaagaatgagttgttgatagggagagaggagatcaaggaagtagtgaagaggtttatggatagagagagtgaagaagggaaagagatgagaagaagggcttgtgaccttagtgaaatcagtcgaggagctgttgcgaaaagcggttcgtctaatgtaaacatcgatgagttcgttcggcatattaccaatacaaattaaggctcaaagaggttttattgtttcaatacaatgtaaggctcaatggcatgctcactaaatcatatgtatcttttgaatgactaaaaagtaaaaaccaccaccaaattatagctaaatcaatttcttaccatatgtcaaaaatttatagaaattctaatggtgggaaagctccccgcttatgcattatgcatcatcattttgcttgcttataatctaaaatgatgctttctcattaatcaaaccccaagacgtcacaaaatacccaaaacacatcaaaaatacaaggaaaagaaaaagagaacaaaattgaagcaaaacttaaaacgggatttattatgaggcctatctctacaattcacgaaatgatcatacatcttatttttttggtaggtgagaatagacaattgtctctcgcaatttattaaactgcaactaaaaagaatattacaaccgaacatgacctgagaactctgcctctaacataatcgagtggactacattaggagaagagtccaatgaatgaaattaaacctaacagcactgaagaaaacacattgttatcaaaaaatttacaactatgtagattttttttgtcaactagattgttattctgttagttataaacagaatgataacaatctccctaatttgtcttaattaaaaaaaaaaaaaaaattagccatgtgttgttttcttaaacagtctgtttcttgggattaggttttgtttctttaaaaagcacaccggtcacttgagtgtctaaaaacgttataaaaaacaacaaatgtgataatcagcaaaaacagcttgaaagagaagtagacacaatcattaacattatgggtaatggcctaaacaattggaccacgtttgttgtaaaagctatcctctgcactctgcagctttctcagtcctcacttctctcacccacaaagtcacagtaaccagaaacacgttccacatcct

SEQ ID NO: 11777 - DNA, 3000 bp, Unknown
  misc_feature (1)..( 3000): cDNA_ID_2707463_gDNA_ID_2214516_Annot_ID_184453 3000 nt of promoter + ATG
agaaattgtgctacaaaatatgttctatatagaaaatgtttacatgattatttaaattgtcacaggagctaccagttcatcaaagagctgacgcggtgaatagtctggtttttgaagcaaacgcaagagtaagagatccggtctacggctgcgtaggagcaatctcctacttacaaaaccaagtctcgcagcttcagatgcaactagcagtggctcaagccgagattctttgcattcagatgcaaaatgagccaaccttacagtctcatcatcaagtacttgaactagaccaagaccacaaagctctcttactaaacaacaacaacatcaataactgcaacaccaacaacaacaataacaactttggttatgccatgtcttctggacagttcaactctaactttgcctcaccaagcagcataatgcaaatgcagatgcaaatgcaaatgcaagaccctcttaagcaagaatctctttggacttaatgtaataataataataataattaatgttcgacaagtttgctacttggttatgttgaaaaagagaatatgggaacaggtttcgtgtaaggaaagtagtataagtcaaagcttaaatgcatgcatgtgatggtgatgagatgtagttatgctttagtactggagatctgttttttttttttctttttctctctttaatttggtttctcacttccatttttcttttaccatcgtttgaacagtgaaaattagatctaattcaatccaatttttttgtaatatgaagtcgccaagacattgctctctaaccactacacactttttctcaaacaaaccgacacaactttgccgcgttcaaattaagagacatttagattgtcttatggaatagctaaaagactagctaaactcaaaatctcagatatacaaaaaaatttattaaacttatttaaagtagtcttagaaaacatgcaaaagcaatttttctttttatggaatcaattattttactatagactaaaaaagtagattgtatttctacatgcgataaactgaaattaaatcgaatagaaaaataaacctcaagttgcaaactacattttattcaaaaagaaaatctacatgattcaacctttacaatttgactcacaatagatttattcgaccgacctgatttgattaatcataagctacacgttagaacacaaagtcgcctctactgttgcttttgtactaatccttaaaaaaatcatatagatttaattcaccaaaattaagttaggaaagaagaggtggtggtgttgaatttgattatgttatctattgatagtattcatgtgatcagtagacgaaaaattttcaaaatattgcctgtcgacatgggaagaatcgaatgactaaaaaaataatcgatcatgttctttaatttcaaatttaattatatatctatataaatacccttaacttgtttttgacgatcctaccaagccagagaacttataactgtcatattcataccatatgctatataattagtgggatataatactctatctttaactttacgcgtaacaactttttaattaggatttaggaataagaacctttcttttgtttgttaaaaaattctttctctttctctctcaattttttcactatataaattattaagttagacgcatgtatatgtctttttactaacacgtagaccggtagacgtccatgtgctccatgcacgtgtgtaaatacatctttttttgccatgtgtgaactaatttttttaatttgccaagccaaagttataattaattaaatagcagaaagagtcttaagagaaataatatgattataatggcagaagaaaagttaagatttacagatacatccaatagtgtatagccgcttaattaatttatccacacctcaacgaaaatttccgttggtgcgctaacgaattcaggctgtgaagttaaaagaaaataaacaaaattatagcttcacataagcgatcgatcttcaaactctacacatgacagaagcaaataactaaattaaatagcgtaaattttgtaataatactagaaaacctaaaaaccaaatgtaaaaaaccttatgggaaaaaatgtgataaagcacctaaaccatagaataacttaaaatttcaatttcccaatcaaggtatgatataaaaaccatggaaaacaaattctcagccatatttctatctgaccgagtctttttcaaaataatatatagacggtagagtcttatatagtaaaaacatttttttaaaactaatttatcttctcatatgaaaatgaatgcaaataaaaatgaccatatatgctgtaatgatattcaaggaagagatatcacaacaaggtcgaagaaatatacaatatctgaaagtcgactatatggtccactttccaaattagagatggaaagaagaaacgattatgcagcaaacccattgatcggacgaagaaagaataaatatggaggcccattactatagtatttggccttgaaatattttggtccgagaaataataaataaacagttatggcttttcggatttggttgctttcaattttctcaaatgtttggacaagtgttattacactcacctaaaacaggatcattccaatttcttgggctcagagtctgtactttcttcttctttaaaccaaggtcttataagtattctctaaaccaagtcactaaacaataattggtcttgggtctggttcaaacttggatcaatgttgccacatagccattagccacacaaaacaaaaattgtcttgcctttatatggaatgaagaaaaatcgaattttgtaaccatttttgactttaaagtcacactcgccgtatacggcacaccaaatgaccaaaaacatttgaccaccaactttgctttaatgttaaaactttttttttgcatcccactactctcttcttcacctcctcaagtcacagtgaccaaaatcacacacttcacaagaaacaacct

SEQ ID NO: 11778 - DNA, 3000 bp, Unknown
  misc_feature (1)..( 3000): cDNA_ID_2711290_gDNA_ID_2214516_Annot_ID_184452 3000 nt of promoter + ATG
gtgggcatccaagacaagattgaattcattgtcaaaccgttccagccaggcatccgtgcaggtgtcacaggttcctcctgaaaggctgctctctcctctttctcaagcttcatagcatattgtttttcatgtatacgtgatacgtcggataataaaaatataagtgaacagatatattcacaatgatcttaaagagcatttaatcacaaggttaatatatatgccgtttgaaaacagcagtattaaaattgtaagatatgatcaacagtctaatttcatatctctcatgacaaatatcttaatgcttttggtacgtagatagacagaagaagtcatatgaaggcttggctagaaaaatcaaagcaacagtacacaaatacttgttctgtttggattcaaaaaggttaggtctttgaatactgtgtaaagaaactacatctacaactttttggacgttaattaggttattaggttgttcaaaacgatgttcaacgtctgtcttgttgtgcgaatttttatggattaattattagtccatcatctcccataatatttatcacaccactaaacttcacatccatattattaactatgtcatttaagtcctttgtatgtttaacgaaatccaaagttgtagttcactcatacctttcacaatatttatgatccacttttttttttttttttttttttttttttttttttttgtcaaacaatatttatgatccactaaactctaaatctttattgataaatctaacaatggttaaccgaatgataaagacttccgtgtatttatgtgagacaattaatcttgttttcaagccaatggtaaaagcaagaccactttttgactgctatcgtgcaacaaaacctatgttttactagaaatgtgtgaaaccacactcattcgttaatgctaaataaacattaaatttattttgtggtgccaagaaaaaacaattagtctgatacttaattaaaataaacaattgaggcgtttaccatggttttgtcttactttggttttagttaaataagacaagttttatcaccaaagatggagtttatgaattttcttagtctggctctacgtaatccgataaaaacaaatgttgcttttcacgcatcgaattcgctgacctaagatgcttcgcagagattctgtccagatttttgtatattctttaaatagggggagtcggggagaaaataatgataattatcccaagttcttaattcagtcccttgtttaatcagtgtcttcccatgaaaactcgggcctccccaacattattattctcataatcactttacaaaagtttaaaatagtgaatgtggattaattaatagtataaagaggaagtgtgtgtggaggagagattggttgaagttttgatgtgaatgtctttcaaggcaacaaacattcacgttggaggccatttccaaaggagtcttggtcctaattagggtttcacgtcattctcacttctatagtgtattatcctaacattacccactctctctctttttttttttttttttcattcttatttttaattacctaaccaactttggtttttcgttttttcattttgtgttagaataaagtcaaatatagggcgctagatgtttttcaacatgtataataatataaacggatgatatatttttaattgtttagggtgtagaaaatgtgacaattattagttttatattacacaaatatatggtttcaaatctatatatatatatatatatatataattctagacatccattaaaatacatatgttaggattagattcatatatcttataataattttattttgtgttggctttttctctttttgttgtaaaatctctttttgttttctctgttgaacgcttctttcattttagatcgactatattgttttgttgattatttttttaattataaatcgttagcccaaaattgtgttaacgtgtttttgttcttctattatatctataaataagttgtatgaaagcatggaacgaaactttttgttggttttctcacttccttaagtaagcgattctcaaacttctgagatcatcaaatgagttcttttgtaacttctaaacatactcgatcatcatgaactgtataaccatgcatgtgtagatcttcctcttcttcaaaagtttctaattacacaacctaataaatatctttccttgtaaccaccaatctcactttcctcgacttttgtaatttaaaaaagagagaagattaagacatcgagagactcgaataaataaaaaaaagagaggttagtaatggtacgactgtcgtgtgtatgtgttaaagaaataagagaagagtcaaaaggacaacgtggggaaacttctcaatatgcatcggacgccaacctatcacgcgcctttgcggtgctcacttctacatcttcttcttctcctaacttactatattgccctcaacattctcatggtcaaaacgtcattaccaacgtcttttttagccgttaatatgtacatatcccgtcctaagaatccaaattaaggatccatatacactgtacttttgaactatttaaattgcataagattcaaacaagacttaacttaaaatgacatctattttgaagatttttttttctaaaatgataattattttataacgaaaagaatacaactttgtggtgagaagaacaagaaaaactaagaataggtgttttcatatttaggttaaataataaaacatttaaagttaagacattaattataacacacaaaaaattaaagttggaattaaatgaacacatgtgaacaccaacctcgctctctctagaaagccttcaaaaccctattataaatacacacctctcaaactctctccctttaactctaagtttttctttcttctttctctgctctcaaagctcaagagaactctatccttattaacttacaaggataactaaaaccggtgtaatcacgatcatagtagaag

SEQ ID NO: 11779 - DNA, 3000 bp, Unknown
  misc_feature (1)..( 3000): cDNA_ID_2707456_gDNA_ID_2214516_Annot_ID_184449 3000 nt of promoter + ATG
tatacttgatttgacaatttttgttttagtgtatcttatttagcgagtgtattcaaccaaataatttatttgattgaagttcgaagaatttttctactctgtattctcagttcgatttttgaggtttacattaatttacatacctcatccaactataaacaaacaaggacaagagtttgtggtccttttagaattacaaatttttaaaactattccatttgatttgtacttaccaacatattaaatttgaatatataaggtatttagacagacatattgatggttctttgcatgaaaaatctctgctacattttgttagtgcattatttctctacaatttcttgaataccaactgtttgaaagaataaagaaaaaggcagagtgtgtttgttctgttccatgcaacctcttacacactcgagttcatcctcagtcacgggcaaacaacagttgatgcaattcctctctggcaaatttctccacctttacagaactaacttcacttgatttgtatcagtagctactgatacaaatcaatttgcaatctcctcctccaaaagttgtaataatgggtgctaggggataaaaagaaagaacagaggcatacatcaaaagctagctttatcaaaccacatgcacaaagtttactcaaatcaatatcagaatcagaaaaacaagcttaatcaacaagtttacattaaagtgtttccttatcatataagaaggggattcctctttctttttcccaagccttcacttcaatgattagatcttcaatcatggcttagaaaagaaacacaatactatcatcttaagtctttgttcattacttcaaaaagagagggtaatagggttacgcgtataaagactcaccaggaatttgcatgacaagactcttagcacgttctaagtgttcgtactctcctcttacgagttacaagattgaagaggtttccatcctataaagacgatcaagaatatataataagaaatgcttactttaatcaagtcaatcttctcttgatgtatcacaggtcttcacctaccttttcgtagtcacgaagccatttttcttcttccttagcttgcttccaggtttcaactgcatctattatgcctttccttcttaaagcttcagattttgcttcctcatattagcatccaatgcagcaccaatatcagatagagcacgatcacctgacaagataacttatcttttaagcatatctaaattgctgtttttttcttacaaatagaagagttcttcacttaccctcattatcagttagctcaatactgcctgtcgagctcgacaaaatgcctttaactcgtattgcttctgaagtacattcaccttcagggtttccccagttttagttttctttgccactttgtcagccttgtctttattagcaatcctcttcgttttgggagcaccagtggattcctttcttttaccagcatcattagtactcgtcttgggaagatattttgcacaactccatttttgttttttcttagggtgatgaatgacttggcctgaggtgagaaattgagagtgtagagacttttgcctttgtagttatactctgccaaactccatccttttagccaatcatccacaaactctatgggtaaatcatcatgataccttaagtaagctagtttagaagaagtgctcacaacttcttgacccatttgaaactgatgaacatagtaattgacactgccccactttataagagcaccattgcaattaaaatatccaagatgaacatttttagttggataaaagaagacccacgacttgttgctttctccctctagaaattgaaagttgatgaaatctcactcccatggactgcgatcaaatatttcaagatcgtctatccatggaattgcaacatcaactccaaaatctacacttttaaccaaactaatcataagttaaatttcaatttacaatcgtttattaatatagtgattaagtaagttatcaagtattaatttatagagttttatttttgtataaactaaccacgagttaaggaggtgttattggtttatgatttcaaaagagttttagtgacttaaagtatcatgtagaatctgttgttatttaatcaaaaaaatttaaaagtatgttaaaagtttgtgttattcattaaagatttgtaaaaagtaatctaaaaatcttcataaattttagattattgaattcatacttttataaagtcagtaaattttttgtgttattctattaaaacaaaaaaatctctgattgtttatgatttaaattattatgttattggttcatgactttctacattttctttcacaaaataaagtcatagaaagtcatgaattttttttcaaaagattgttttgagaaactttagaagaaaatgtatttaattataatattcatagctggaaattgatctaatatttaattataatattaaagtttccagttatccaaaagaagatgtgagtttttttgaacttggtaattaaaaaaagaaagcaatatttcagatttaatacagattcataagaaggatccataagaaattaactaaaccggatctggtcttgaaatagtgacggacgcgtgtcccccggtcagagagttgccgtcacaatcacgcggagaaagagcgacaaatcaaaccttaaccgttaaaacgtcatcgtttcatatccccccacaaccgaacccctttcgttcgcccgtctctcttaaataaatcttagagatttctgcaaaattcgtcacttcaatttcaattttcagatctcaaaaactttttctcttttccgattccaatcttctctcgtctgctttcctcaaaggtacgttttatcttccttctcatagcttccgaagaatcaatctagggttaggtatttcaattctgatcggattttctctcttcagtgttctctaatctaatgggaatttcacatgttttctccaggttttttcatcactttatg

SEQ ID NO: 11780 - DNA, 3000 bp, Unknown
  misc_feature (1)..( 3000): cDNA_ID_3022990_gDNA_ID_2214516_Annot_ID_184448 3000 nt of promoter + ATG
tatgcaatgtattttcttaacattgttgagttttaggagtgatggtccacaacagactttacatggagcacaagtttagagtggagaacaatattctcggatatgaaatatacacatataggagatttgattaacatatctaattgtctggattttgagtaattgtcacataattttcagtgcgactgcagatttttttttttttatcacaactgcagatttagtcttttaacaggttttctttataaattacaaattaatatagtatgttatttcttaattaattaataaattacaaattaataaatatataaataagttcaattgtagtctagtttgggtcacaggatacttaagctttctcacctgagagtccatgaaaggccttgaaagacattaataaagcccaacgtagcccagatagacccataaataaatctgtcacgtttaccacgctttaacggtcaacagccactagttattaaatttatttattttttaaaaaaactcatcaaaacaaagtccactagttatattcgaggttataaacgtaattcaaggttattgtgctgttgggagctttgaagcggcacgatgataaataagttgacgccatgacacgtaagccgcttagtagcctctttcttcaaaccaaagactattcaccgttggattaagaaagctcactcaatcttaacccttcattttattaaataaatcctacgaccagaaaataaaataaataatttggttctgttatcctttcattgtcttcttcattcctggtaaaggcttttaatttcatggattatcttagcttctactctcatggtggctatcgagaaatcactcacaccaaaatctttgaagttctgagtttcaaagtttttcgaatttgaaactttcccgaagcaattttaaaccttttctcttcctttcgattttttctcttctggaattagaaaacttagttatggcttatgctcatgttttcgcttcgttgactatctcgacgatttctctccgacgattcctcccccgacttcatcgaaaccacagcgtaaaacccaattcccgaatcatatgcaatctgaaactaaactactctgctggaaaatttcgcgagatgggactatcacgttccgtggagctagaccaattcatcacaagcgaggaggaagaaggagaagcagaggagataggagaaggatttttcgaagcgattgaggaactagagaggatgactagagaaccatcagatatactcgaagagatgaatcatcgattatcttctagagaattgcaattgatgcttgtttacttcgcacaagaaggtagagattcatggtgtactttagaagtgtttgaatggttgaaaaaggagaatagagttgatgaagagataatggagttaatggtttcgattatgtgtggttgggttaagaaattgattgaagatgaatgtaatgcacaccaagtgttcgacttattgattgagatggattgtgttggtttaaaacctggttttagtatgatggacaaagttattgctttgtattgtgagatggggaagaaagaaagtgcggttttgtttgtcaaggaggttttaagaaggagagatggttttggttatagtgttgttggtggtggtggttctgaaggtagaaaaggtggacctgttgggtatcttgcttggaaatttatggtaaagttttgaacttttttcatagtttttatttttttttataattttggtggatttgagatcaaaaagatgtgatatgaagtggttaagatgactatagttgttataccttcttgttagttatcggtttcttggtctagctttgttgatgtggatatgtgtcttttgtttcttctaataggttgatggagattataggaaggcagttgatatggttatggagttaagactttcagggctgaaaccagaagcgtacagctatcttattgcgatgacagctatagtgaaagagctgaatagtcttggaaagacattacgcgagttgaaacgctttgcacgggctggttttgttgctgagattgatgatcacgatagggtactcattgagaagtatcaatcagaaacattatctcgtggactgcagttagcaacttgggcggttgaggaaggccaagaaaatgattccattattggggtggtccatgagaggctactcgctatgtatatatgtgcgggacgtggaccagaagcagagaaacagctctggaagatgaaacttgcagggagagaacctgaagctgacctccacgacattgttatggcgatctgcgcttcacagaaagaggttaatgcagtttctcggctactgacacgagttgagttcatgggatctcagagaaagaagaagactctgtcatggttgctcagagggtatgtgaaaggagggcacttcgaagaggctgcagagacattggtatcgatgatcgactctgggttgcatccggagtatattgatcgagtggctgtgatgcaaggaatgacaaggaagatccaacggccgagagatgttgaagcatatatgagtctgtgcaagaggctctttgacgctggtttggtagggccttgtcttgtgtatatgtacatagataaatataagttgtggatagtgaagatgatgtgataaaaaaagaggaaagagtatgaaatagctgagaaacaagtctaaagacaccgtctaagatggagggatcggaagtttctatttttgtgtatataaatctgtatgtagtaaacaataatatttgtctcaaatatgctgaagttccaacggcccacgtttttaaatgggcctatatattaaatattgtgagcccaaaacaaaccttaatgacttgaggacatctgtttcctcgtacgtatttctgaaattaagtgaatctgaaggtgaaagcaaagccggaggaagaaataagaatcacagaggtaaaattgtgatggagctcgaagatccaaca

SEQ ID NO: 11781 - DNA, 3000 bp, Unknown; identical to SEQ ID NO: 11774
  misc_feature (1)..( 3000): cDNA_ID_3022994_gDNA_ID_2214516_Annot_ID_184447 3000 nt of promoter + ATG

SEQ ID NO: 11782 - DNA, 3000 bp, Unknown; identical to SEQ ID NO: 11773
  misc_feature (1)..( 3000): cDNA_ID_2708428_gDNA_ID_2214516_Annot_ID_184444 3000 nt of promoter + ATG

SEQ ID NO: 11783 - DNA, 3000 bp, Unknown; identical to SEQ ID NO: 11772
  misc_feature (1)..( 3000): cDNA_ID_2708417_gDNA_ID_2214516_Annot_ID_184443 3000 nt of promoter + ATG

SEQ ID NO: 11784 - DNA, 2810 bp, Unknown; identical to SEQ ID NO: 11771
  misc_feature (1)..( 2810): cDNA_ID_1808676_gDNA_ID_2214516_Annot_ID_184442 3000 nt of promoter + ATG

SEQ ID NO: 11785 - DNA, 3000 bp, Unknown; identical to SEQ ID NO: 11779
  misc_feature (1)..( 3000): cDNA_ID_2707456_gDNA_ID_2214516_Annot_ID_133955 3000 nt of promoter + ATG

SEQ ID NO: 11786 - DNA, 3000 bp, Unknown
  misc_feature (1)..( 3000): cDNA_ID_2707460_gDNA_ID_2214516_Annot_ID_133956 3000 nt of promoter + ATG
ataaatggtgttttgataaaagcctcaagaaatgtttcaaccatcacattaaatgaattccacatgagtccaagctttctaatccactctttcccaagtgaaacttctctcttttactctcatagctttccttggctccttcttatttatctcactaattaatttcatttttactaagtaatttatctcactaattaatttacagtttctactttacattttccattagaataaatgatgagcctatactaatttccaaatattgcagttgtcacgaatatataaaatcgcaatggctaaaatatacacgttcaacaaaaaattgaacacctgacctaaattggtactatcttattcaagaatttcgacctttttagttaaaataaaaatatatcatctaccaagaaaaacatactccataaccctagaaactatatatagtgttagaaagtggttatgattcttaataatatatcaaattcatgtgatgcatctaaggaatgtttttaaccccaaaatagcggggacatgcatgaaaaaaccatttgactagcttgtgaccatcgcccacaataatctctacaaacttattcgcttgatgacaagcataatgtttcacatattttatgtatatattaattaatgagtagttttattcacaaaattatcaacttgggtgtgtagctaggcccccacaattaatgtatgatgcatcagatttatctagaattgtcttactgcccctccaaatcgatatcatatcaagttgtattaaaaaagaacatgcatctcaagattagtttaattcattatatttaaagtagttcaacctaagtgactaaatcacaatcaacccctaacgtaactaagtctacaaattaaaccaacagtcaactacatcttttttttttttgggttgtaagtttaaatttactaatcaacaaaataaatgattatataaaaaagaactacaatttaatatttatgatcagcatattttttctaatgaatttttaaatagttgaatgaccaaatttcgatatatctaccaacatcgtcaattgatgattttttttataactaattttcagtgttttatttctaacttttactctatgtttttacggtaagattagaagtgtcaagacttggatattattttgctttttattagaattagtaaatataaggaaaacagaaagctaaatttttttaaaaaaagctaactcggtatttcttcttcatttttgtaacagaaaaaccccacaaaatttgtaactatgcaaagtccgagtggaaatataatttgagcttaggatcattaaatccctatatagttaattagtactaaaaggaattatagaaaagaaaatgactcagttaataggaccactctagaggaagaataaatagtttaggtgttaatggagggatatattttagaattagaactgtcacattgggaagtggttcttcttgctaatgtattttagaatcattcaaaagaaagaagaactaaataattctctaaactaaacatttaatcaaaattttagaagacaaaaaaagaagaagaagagagaacagacatctttgggcacctcggagaaaaataagcatgtgagactcgatgcacatcattaaatgctttgagatgacatggaagattcggttctcggtatttgctcttttgtttctattttattttcttacccaaagaaaaaaataaaatctttggaaacggtgggggaggagacaagaagcaatgtttgactgagttcagttaaaatttattgaagtctcttttgtgttgaagagttgggacaaaaaaaaaaaaaaactttaaagacctgagggtttggtttttgcttaaactttagttgaatgagtgaaagaaatgagtttctgtttatgtcggaatttaataagtctgtaagattctgtaagaaacaaaaagaagcaatctgaaacatcagagcttcgtgctaatccgtagacttggactctagctcttgccgcctcgtcttttcttattttacagttttaactctaccttcgatatcaattagcatatcattgattatcactttctgtcagtaaaaacttgtatatcgttagaaaaaacactaataaatgtaatatttggcgatacaaaattagattgtataggattttgtttttctttttttcaaaaataaactatttattagaatttccaacttagactatatagtttcataatcaaatttacgattactttttgttttccatatgaatatgattatatatttaagaatgttaaagaagactaattttttcatttattccggtttgtatataaataggttaccattagatatgtgttatcttggagtactctacaaatattttctttaccaattgaatcatttcaatctaaaaaaatactgaactaatgtcattggtgctatttataatttgacatataattttatttaattgtaaaatttaaattctaatctttctatacaaaatttaaacaaaaatgtaattaatctcgtttaattgtaaaatctaaattcaaactcttatttataaacacataatttatatttaaattttgtttaattaaaagtaaatagattttgaatatttaaactaatatgaatatttttaagatgcacatactttttttttttttttggtaaggtttaagatgcacatactttctctaggtatctagtaatttattccttcaacgtctgaatcggcctcaaattttctgatttgggcttagtttggtccaagtgggcttaatcaagcatatcataactgtagtttgggctcataacgttttttttttttttttttttttgcgctgcgcagtttagcttttgatggtacggcttattttaacaacgaactcggaataaaaaagcttttgacagagagaacgaccataattcaattagggaagtactttcacaaaccggagaagattatcggagatcgcaaactatg

SEQ ID NO: 11787 - DNA, 3000 bp, Unknown; identical to SEQ ID NO: 11778
  misc_feature (1)..( 3000): cDNA_ID_2711290_gDNA_ID_2214516_Annot_ID_133957 3000 nt of promoter + ATG

SEQ ID NO: 11788 - DNA, 3000 bp, Unknown; identical to SEQ ID NO: 11777
  misc_feature (1)..( 3000): cDNA_ID_2707463_gDNA_ID_2214516_Annot_ID_133958 3000 nt of promoter + ATG

SEQ ID NO: 11789 - DNA, 3000 bp, Unknown
  misc_feature (1)..( 3000): cDNA_ID_3022980_gDNA_ID_2214516_Annot_ID_133959 3000 nt of promoter + ATG
ccttgaaatattttggtccgagaaataataaataaacagttatggcttttcggatttggttgctttcaattttctcaaatgtttggacaagtgttattacactcacctaaaacaggatcattccaatttcttgggctcagagtctgtactttcttcttctttaaaccaaggtcttataagtattctctaaaccaagtcactaaacaataattggtcttgggtctggttcaaacttggatcaatgttgccacatagccattagccacacaaaacaaaaattgtcttgcctttatatggaatgaagaaaaatcgaattttgtaaccatttttgactttaaagtcacactcgccgtatacggcacaccaaatgaccaaaaacatttgaccaccaactttgctttaatgttaaaactttttttttgcatcccactactctcttcttcacctcctcaagtcacagtgaccaaaatcacacacttcacaagaaacaacctatggatccaaatgaatctccaccaaaccaatttcgccacgtggtggccatgccttatccaggtcgaggacacatcaaccctatgatgaacctctgcaaacgccttgtccgtcgataccctaaccttcacgtcaccttcgtcgtcacagaagaatggctcgggtttattggacccgacccgaaacccgaccggatccatttctccactctccctaatctcatcccttccgagcttgtcagggccaaagacttcataggcttcattgatgccgtctacacaagattggaagaaccattcgagaagcttcttgacagcctcaattcaccacctccgagtgtaatattcgccgacacttacgtcatttgggctgtgcgagtcggcagaaaaaggaatattccggtggtttctctctggaccatgtcagccacgattctctccttcttcctccactctgatctactcataagtcatggccatgctctgttcgaaccatcaggtaaagcatcagtgaattagttttgattcttgaaacttggtatatattgattcttgttgaaacttaattagtattgattcttgaaaagttagtattgattcttggtttgttttggaatctaaagaagaagaggttgttgattacgtccccggtttatctccgacgaaactccgagatttgccgccgatatttgacggttacagcgaccgagtcttcaagacagctaagttgtgtttcgatgaactaccaggagctaggtctttactcttcaccaccgcctatgagcttgaacacaaagctattgacgctttcacctccaagctcgatatcccggtctacgctattggtcctttaataccttttgaagaactttctgttcaaaatgataacaaggaacctaattacatccagtggcttgaggaacaaccggaaggctctgttctttacatatctcagggaagttttctttcggtctcggaagctcagatggaggaaatagtgaaaggactgagagaaagtggagtccggtttctttgggtggctcgtgggggcgagttaaagcttaaggaggctcttgaaggtagcttaggtgtagtggtgagctggtgtgatcagcttcgggtgctgtgtcacaaagctgtaggcgggttttggactcattgcgggtttaactcgacattggaagggatatattcaggagtaccaatgctagcgtttccgttgttttgggatcagattctgaacgctaagatgattgttgaggactggagagtcggaatgaggatcgagaggacgaaaaagaatgagttgttgatagggagagaggagatcaaggaagtagtgaagaggtttatggatagagagagtgaagaagggaaagagatgagaagaagggcttgtgaccttagtgaaatcagtcgaggagctgttgcgaaaagcggttcgtctaatgtaaacatcgatgagttcgttcggcatattaccaatacaaattaaggctcaaagaggttttattgtttcaatacaatgtaaggctcaatggcatgctcactaaatcatatgtatcttttgaatgactaaaaagtaaaaaccaccaccaaattatagctaaatcaatttcttaccatatgtcaaaaatttatagaaattctaatggtgggaaagctccccgcttatgcattatgcatcatcattttgcttgcttataatctaaaatgatgctttctcattaatcaaaccccaagacgtcacaaaatacccaaaacacatcaaaaatacaaggaaaagaaaaagagaacaaaattgaagcaaaacttaaaacgggatttattatgaggcctatctctacaattcacgaaatgatcatacatcttatttttttggtaggtgagaatagacaattgtctctcgcaatttattaaactgcaactaaaaagaatattacaaccgaacatgacctgagaactctgcctctaacataatcgagtggactacattaggagaagagtccaatgaatgaaattaaacctaacagcactgaagaaaacacattgttatcaaaaaatttacaactatgtagattttttttgtcaactagattgttattctgttagttataaacagaatgataacaatctccctaatttgtcttaattaaaaaaaaaaaaaaaattagccatgtgttgttttcttaaacagtctgtttcttgggattaggttttgtttctttaaaaagcacaccggtcacttgagtgtctaaaaacgttataaaaaacaacaaatgtgataatcagcaaaaacagcttgaaagagaagtagacacaatcattaacattatgggtaatggcctaaacaattggaccacgtttgttgtaaaagctatcctctgcactctgcagctttctcagtcctcacttctctcacccacaaagtcacagtaaccagaaacacgttccacatcctatgaatccaatcaaacctcagccactcggagtccgccacgtggtggcc

SEQ ID NO: 11790 - DNA, 3000 bp, Unknown
  misc_feature (1)..( 3000): cDNA_ID_1033366_gDNA_ID_2214517_Annot_ID_133965 3000 nt of promoter + ATG
tcgtaggtaaagtataggactacaagtttgccaaaaaaaaaaatataggactacacaagtacataaaccgctgcaaaaaaaagggtacataaacaatgctatcgttcacttatttatgcttcaagaatccatcatgcttatgttttagctgactctctaaccctccgttcgaatctgtggctctatcttccaaccagtttatgatatcaccaaacacaatttctgaattttcattagtttccccatacaacaaagcatgccacattttggggtacagcttgaatgtcttgtccgagcttgaagccacttcgtataacattttgcttatgcttttatccgtcactttatcatcttctccgtgaagaacaatgaaaggaattgatacctagttcaaaagccatatatatataactaattaataaacaaggtttgtaaaatgttttcttcattatataaccaaatatacatatccataaatatgtctaaaaaaattagaacctggtgaagattcttctcaagatctaagctaaccaacaagagttggtaggcggtgttgaggcgaggccggcctttatagcaatacttgttctccctcacctgtaaaattcacataaatcatatgtatatatggttaataacaagctgatattacaagtaaaatttggcgtcttagatcagtatcactcacctgatttctgatgtgaggttctttaattgcaatgtcaataatatcatttcctggaactattttccacgttggaataaacttggctaacttgataaggattgagatcactactggatgtggctttatctcgtctgctaactgtccataacaacattcattgtattagttgataaacaaaacattttgattatctctgtgggactttcggtagttgatataatcatttcgataattgagttttgattacttgtttaattagtggtatatatactggtatttggttgtaacaagtagttgtgtatatatagaaactatgagacaaatgactaatgaagagtgattgaaccatttttctgtattatctaagggcatttattaccaatccaataagtagagaacattattgaaaaatatggattagtcccactttaagaaactatttttcgtttttgatttggactttttatctgattcttaaaccatcattgaaattaaatgaaaactatgaaataattttgggttcttaaaacaccaataaataatgcaagactaaagataactaaaaataattaactgaaaaaagagattactaaccttacacatgggtgctaccaaaacggcaccgtcccaaaaatcaggcttctttctggctaagagcaacacaactgctcctcccatggattctccaagtaggaacctcatcttccccttgttctcttccctctctacaaattatttttaccatttcttttagtatattaatgaaaatctaaacacatatcaaattaaggggtttctaagagaattaccacaaattgtagaataatgattagagacatcatcaacgagatcatcaaagttactgatgtaaccatttagaccctcagattttccatgtccttcatagtccattccatatacggcaaaaccggcattggctaacctcgtggctgcgcctgattaatcccatataattcgttatgtcgttagtacataactaaatataataacaatttgatcaacgttagtaaatattttaatatctgactgaactgttcatggtgatgctggactccatagcgtagccatggcagaggaagagcaatgcctttggttcttgcttcactggtttccatacacaagtgaacaacttcatgcctcgtgagttcaacacaaaatcctgccaaaagaaaaaacacacacacttgcattagacctaatagaatgattctgctagatcgagattataggatcaaaaaaagaaaggaataactatcacttttctacagtcacagagctctacatgagcttggaaacatatataaagacactaacctcttcatacataaccatgatcctctgtttttttgtcctgtttttatacaaagttaagatatgatcttgtttcaaagggatttatgcggagagcgagagggaaagagttagttgttgtctgatttatagaagatgaaaagagaggagtcacagaggaataaagcgaccccaaaaaaacaggggaccatgcaattacgctgcgttttggttgggatattttcctcgtagtagatgacgtcaccagaaacattgaacgagtccaagattttacttttcatatttgaatatgaatgtttcagccgttggtgcttgaccggcttggtttttcatttgaccaaatggcatactgagtcattatgaaatgctcataatttagtctttgaatattgaacttggggatggataaacatgcatttatgtctttgtatcaacttgttgacaaatgtatggttggttcattacgcgactcataattacacttttccatcacattattgattacgataacgtctttaaccaaaacttcttctaagattactccttcattcacaatctaattagacatgtcaaaaagaaaaagaaaagagaagaaatttattctgaaaagctaaattatgttattattatatttgaaatcaaataattctccttcaaaaacaaaaaataacagttcaatcggcgcgtgtctaattatacaactctctattcacttttttagtattttcttgcattaataaatgattttggtacaagatttcactactaggattttataatccctggcccataagatataaaactcagcccattagatgtgtgttgggttttatactcacagtcaaagcccaaatataacctaaaatctgattattaactcttagccgtcttcttcttcatttttctctagggtttctaatctcttataacaacaccgcaaaagagtaaagggacgctagagagagctcgaagacgcaatg

SEQ ID NO: 11791 - DNA, 3000 bp, Unknown
  misc_feature (1)..( 3000): cDNA_ID_2707532_gDNA_ID_2214517_Annot_ID_133966 3000 nt of promoter + ATG
tggtcacttggatttcggctcatatgctttatctgtgtgacgaatttgaagaatattcatcctacagaaccaaaagaactaaaaggaacattcaaaagaatagagaatgtgtgaaaacaatttggcacaagagattatgcgaaagtcaactcttgccctataagacaagtaatcacaaagtcaaatttctcaaaatttgtctttttctcagaaataaattataaacaactgatgtttacatatgttcaacttcaaatttcaaacacgattacttaacaaaactacgatagtctctgatatattgcggatatatatcgccagcccccacctcttcatcttggtctaacaaatcttagtgaccaacaaagtgattcacacaagaggacatattttggtgtatcaattcttcttcttcttctttttggtcaaaatggtattatcaattcttcaaaatctcagattttttacctaatgattctctattggtgtgtaggtttcatatctgtcaacttatcttgcaaatcaccgcatcactttcgtttcttttaatatgattttttctcgggtcaaacatatgtacgcaattaaaagttttctaagaaagaatcacattgcctagagtttaccactggttgagtaatatgctagagagagtcatgtcgctgcgcgatcgagttgggtttagttgataagcaatgaactgctcaaggcaagatcgagttggagtgaagagtaatgtatagagatcactaccctaacaagctaaccctcaactgagtaatataaaagatgctatgatccaataatataacaatactgtttttctgaatcaatctttcattaagatgagcttttaatatctttaacaaggaaggaaaacaaagcaaaaactcacacgagctcaaattcaaacacaaaaattgatgtgatcaagataaaagcttacaccttaatagcatacttccttattggaaagtacatttctttcttcttctccctctctgtcttcaacgatgcctattcaaatcagccagcaattattccattcagtacaataaaacacaggatttgttcatcacttctcaatatcaatctgaatcacactaaagaatatacaaatacctgatgcttagtgagtctcctcctgatggctctagtcttcttgggacgaagatcaagaggcaaaagcttcttgttcttgtatgcctctctcaaagcagacttttgtttctgtgagatcactgtcaacacctgagcaatcgacttcctcaccaccttgctgaaatcaacataaaacataacccatttgagatcaatgtgattaaaaaccagtgaccgaacaatccaacagtgatataactaagcaagtaagctactttatctatctatagaggataatgataggacctaggatacaaaaattacactaaacaacttgcaaaacataagcagaacttaggtaataatatatgtccataacaacacataaacataattaaacctagctaaatatgattactacataaccctgactaaccactaacaccagcaagatcataaacaaagctatgaagaattcagaatccaaaaaaaaaaagagttaaccaaaatcagaaaaatgtaacatttgatcacacaaagtgtgtatagaggaaacacatacatcttagagagcttattaggagcacctccagtgaccttagcgacacgaaggagagcaagctctgccttaaattccttcaactgacccgaaagatcagcttttgatttctccctcagctcatgaaccttgattctcgctgttcagattccatttcacaatataaaatcaaatctcataacctaaacgtacgaaattgtgtgttaacagaggaaaaagtttgagaatttaggcttacccattgcgtcttcgagctctctctagcgtccctttactcttttgcggtgttgttataagagattagaaaccctagagaaaaatgaagaagaagacggctaagagttaataatcagattttaggttatatttgggctttgactgtgagtataaaacccaacacacatctaatgggctgagttttatatcttatgggccagggattataaaatcctagtagtgaaatcttgtaccaaaatcatttattaatgcaagaaaatactaaaaaagtgaatagagagttgtataattagacacgcgccgattgaactgttattttttgtttttgaaggagaattatttgatttcaaatataataataacataatttagcttttcagaataaatttcttctcttttctttttctttttgacatgtctaattagattgtgaatgaaggagtaatcttagaagaagttttggttaaagacgttatcgtaatcaataatgtgatggaaaagtgtaattatgagtcgcgtaatgaaccaaccatacatttgtcaacaagttgatacaaagacataaatgcatgtttatccatccccaagttcaatattcaaagactaaattatgagcatttcataatgactcagtatgccatttggtcaaatgaaaaaccaagccggtcaagcaccaacggctgaaacattcatattcaaatatgaaaagtaaaatcttggactcgttcaatgtttctggtgacgtcatctactacgaggaaaatatcccaaccaaaacgcagcgtaattgcatggtcccctgtttttttggggtcgctttattcctctgtgactcctctcttttcatcttctataaatcagacaacaactaactctttccctctcgctctccgcataaatccctttgaaacaagatcatatcttaactttgtataaaaacaggacaaaaaaacagaggatcatggttatgtatgaagaggttagtgtctttatatatgtttccaagctcatgtagagctctgtgactgtagaaaagtgatagttattcctttctttttttgatcctataatctcgatctagcagaatcattctattaggtcta

SEQ ID NO: 11792 - DNA, 3000 bp, Unknown
  misc_feature (1)..( 3000): cDNA_ID_2711297_gDNA_ID_2214517_Annot_ID_133968 3000 nt of promoter + ATG
tatgtttctatataacatttagtaatcaaaaatgattagtttatcaaaaatctgtgtaagaaactgatcaatatgcttgatttaatttttgtacattttgctatatacgactaattaaggttagagaaaatcctttatgctcgaaaggacgaccacgcttgaaaactgcgtatgagctcttaaggatcagcaacgacttggagaagagacttcaagaggtaaattataagtgattacatatatatatatatatccaagatttccataaatgcatatgatattcagattggactcaaatagtggtaattaagattctaacgttagattttttttgtctctgtaaaatataaatcatccgatcgagaactaatgcacataatgatgataataggtttcattgccgtttttggtattacacggagatgatgataaagtaacagataaagcagtgagccaagaactgtacaaggttgcgttgagcgctgacaagaccttaaagttgtaccctgggatgtggcacggtttgctcaccggcgagacaccagagaacatcgaaattgtctttgccgacgtcatcagttggttggaaaaaagaagtgattatggaaatgataggtttgagtcagagcttaaacagcgtaatgatcgtttaaatttcaagaaatagtcgtttgacttattttttacacataaaagtgttttaatgaaattctggtgttttgcattttgatgtttaacgttgctattgtgaattgtactatatattttaagaaaacttatactatagtccaataatatttcctaaatagtccaacaaaataaagaaaaagttttcatcatctagtatgattttaaaatgagatttgatataacatagccaataagactccagaggaaactctctgattcggcttggtttggctaatgtttttagacgcaacgatttacttagatctagaaccatcagattaacaacataaaacaactttaagctttcgagaaacggaaaaccacaaagattcttagcaaagaattcatcaatgtaaagaacattgtctaaaatattttggtatagaggtgaaaactcataatcttgggaagcttgtatcgagctagggttttgtttatcgtatcagccttcagtcccctatacaaagttcctggtccatcaaagtatatgtaaggtgtgtcagaccatacatgcctccatcgtgtggacaagactgaagttctgatagctaaattggtcggaagagaggagaggatttgttggaggatcacatcaggaagcgagctgattgagtctatattttcacttgcatctcttgctagtttgacatctctgtagtgatgatgagcgtagcagtcaccggcggtggcaccgtctccgtttccgccgtcgtctgcctctgccattacgttatcaaccaccgattgtaaacctagatatttgtttgcaatgacatagctttttgagtttttgggtttatcacaaagcccagctatatatatccaaaatattttaaaaagcccattactaaacacgcacaacttttttcttgtccggaactcaaaatatgtatgtacttaacaacttaatctgtgaaaaaaaaaaaaaaaaaatgtactaccaacttagtcatgttgatgtgatcatcttcttcttggattgatattactagttgcagaaagtgacaatttgatctattagaaaataattgcttatactacacatttgttttctttcgtaacagattggtgggatctttaagaatgtatcgtcatgattctgattttatagaagaacaactttatttaagatgtgcttacatattctgcgaaaaaaccggcatgttgaatggttttagtctctctgaaccgacaacaagttttgtaatttttaattttatcttacagtcgtcacttgaatcttgatcgccaatttttacatacttgagaagaaaaatatttaaaaagccaaccgatttattcgtcaaagcctcaaaggctacagatttttttagccaacgagcaaatgatatgcacacgcggatatgggggatccaaaaattaaaatatttgttggtgtaactttgaagcattgacttaaaaaatagtggttttatcatatgaaattaaacacttaaaaatttttgtggaagttgatacgggatcacaattttacaaaaacaaatagttagtcaacggagtataacttagttttacgtctaatattgttagagttgacattttataacatgttaagtagtagaaattgtagatttgactttctagattcttcatttgatggttcttatgatcgttcgtttataaatttgtactacagaaacgattaatctaacattattttacgatgaagaactaaaatttgaacatatagtgtcactaggaaaaaagattgattttcaccttaacatctccaaacgtagtaagtagatgtgagtttgatttgctaaatcctaaatgaaaaaaaactaacaaaacacagtcaaacgtgaaagaatttttgagggggtgtttctgataaatttacgacttaaggtactagtttaatgttattttgaaagtttagggggtggttttgaaacgtcgccaaacttgaattgccacttgtcagggaatattttatcattttaaaaagaagtaacaaaaaaaacgtgttgccgtgtagaggggtgcgaggagaatctgttaaatcgtcgctatcaaacaagaaacggtgtcgcattatcgtatagtcctcttcctcaaaatcctacccaatataaacagagccgtacaacaaaaaactcgatatcttatcaaaaactcgctctccatccaacaaaacccgaagaaagagagattcagactcaaatctctcagtaggaatggttagttacgttaagatcaaatactctctggtttatatctctgtcagaccatatctgaaaatgttttaaatttgttcttcttatgtaacgaattggggtatttggt

SEQ ID NO: 11793 - DNA, 3000 bp, Unknown; identical to SEQ ID NO: 11790
  misc_feature (1)..( 3000): cDNA_ID_1033366_gDNA_ID_2214517_Annot_ID_184467 3000 nt of promoter + ATG

SEQ ID NO: 11794 - DNA, 3000 bp, Unknown
  misc_feature (1)..( 3000): cDNA_ID_2711293_gDNA_ID_2214517_Annot_ID_133971 3000 nt of promoter + ATG
agttgctggaattgaagttgccactaaagttcctactcccacaagagcttgccttctcttccaattgtttccgctgcctttttggtaagctattgaattttaataaaaatcaatccacacaagtcaatgtattacgtatgagaaggaaaatgtcacaagagtttagtttcttactactctccgaggagtcggccttaccaccggatgaaagtaaacaacaagctttgagtgatggatttggacagagaatttctgtctggtaagaaatatgaatcaatgaacaataatgatttttagttttcagaaatggagactggaatcagaacagtgttattaaccttgtgggagattgttggtgagaaaccaccacagcggattgagagtgaggagactgccatagtggctacaattcacaagacttttgatgatcaatgaacattgccttagtgttctatgtggataagaaatttctgattttcgtcatttctcggacttctccattcatcaacatgtggataaaaggataatgaaagatgcaaacaatatgtggtgatagatcgatttatgatcatttactggttagagaagatactgcatttgtatgtttacagtttataagttagtgagttttaaaaagagaatcttgataagtcaaaaacatagaacttgaattcaacaataaactgcaacatgaatgtattgtaaaacgtttttgctccaaaatactacaattaccagatgatagtaataataaatatcttaaaagcaaaactgagactacaagagacaaaaccacaatagtctttataactgcagagatagatagacttagatgatgccgatcttgttagcaacatccaaagcatcatagtctggtgtaagcctcacgtaagccttcttggttccatcaggcctgtaacaaaaccaaaccatagtgtcaaatatattgaacataatcaatctcacaacaaggcttcatagaaaaatactctttaaagtacctgatgagtgtgttcactttcttggtctggatgtcatacatcttcttaacagcatccttaatcttcttcttgtcagcacgaatgtcaacaatgaaaacaagagtgttgttgtcttcaatcttcttcatcgcagattcagtggtgagtgggtacttaaggatttggtagtgatccaacttgttccttggagtagcgctgatttttgggtacttaccagttctaggcttggtaagagtctttggcctgtggaaggtgaccttggtcctaatctttttgtccttcttcttgaaggcttgaccagacttcacagcctttgccgccttcaaggccttggccttaggatcagccttcttggtagtatcaactgcaaattacatacaacagagagtttaagcatcatataatactttgatacaaatctgacttcaatacatgaatactcagaaacacgtctacagacaaaattcatttggatactacattaatctcacttagttgaagctaatcaggaagatattgaaactaatcacctaacgaaacatgattagaaaacattaatcgagaccagatactagcgggttcagcaaaactaaagtctagtagaagaagatccaaatccatcatgttccagtgaagattcaagtggttatcaatgaaaagatcgtacctttagccggagacatggcttgaaatgattcttcacacacgaaatctgtgaaatttttagatagaaacccagaaagcgaagctcagtaatgaatctgaagaaagaaatgtaggacgatttcgagagatagtttgcaaaatcgagacacgaacctggagaggtgaagccgctgattctcaaaaccctaacttacgccgcaacaagttttatagtggaaactgaaaccctaagatacttagttgggtctataatgggcctttttaccacaatcatcatctaacccagtaagctttggattgaataaatgggccttttaccataatcgtccatcggacgcataagccataagtgacgaaaaatttcattagaaaaaaatgaaaatgagcataagatcactgattcttttggttgcacaaaaagatacttaaaagataatatgggcttgcaacattgtaaataggcctttgaccaaaatcatcatgtaaaacccaaatagaaagtgagcgtaaatttaagttactagtttatttttaacgtaatggtattggcgtaagaaacatacaaacgtgtcttttgtcttaccatacaaacgtgtcttttggcgtaagaaacatatttgcttcttctcttgtgtctatgacctttctttggttttgccattccaaagtaaattattacagaataaaatttagtcagctttggtttgacttgaaagcatacaatctttgaccaaaccaaagcaaatcgaacaatggctaaccaaaaaacaaaccaattggtcacgaaactaaacaataatcatttacttacgcttgacaataagagaacaacaagcctgctctacatgtctaatattttacgataattgtgaagaagaaagctttagctgaactggcttctaccatttttcaaaggttcttctatatcttgggtcggttgtatctaatacagtttttatactacataatagagtttgagagggcacatatgtgactcataaccatgtcatgtcacggggtcgtttaattgcagttgaatctcaactgtacacgtgtgtatgatgactcctccaatcacgtgcgagatcccaaatccattgagagaacgccacgtggataattagcagagacgtctcttctaaaggctggtccaagtatctctgtggaggaatgtcttactaccacaacagtcgtagtagctagcctcaatctttcttaattaccgattttaccctcgccgtctcttcaaatttcccatttccttaccactctctctctctctcaaaaaaaaaaaaaaaaaaatacaaagtctctctccgccgccggaaaaatg

SEQ ID NO: 11795 - DNA, 3000 bp, Unknown
  misc_feature (1)..( 3000): cDNA_ID_4262156_gDNA_ID_2214517_Annot_ID_133972 3000 nt of promoter + ATG
ccaagaccgtcattgaccatgtccgtattgtgtataatgcaagctgcatgaattaagaaacaattttcagcaacgaggaaaaaaagacttgattttgttttcataaacttggaaacttacaatgatagctccaactggatcaatccaataatcaatgtaattggccaggattactgcaatgagtccaatgatgtttgtgatgacgtcgaagaaatgatcttgagcataagctttaacgatctcgttagtgaaggatctgcagtaaagaaccagaagcagtttgaccaatgtaacagaaagcatgatcccaactacccaactctcttgctcttttgttaggttgaactccttgtgctgtatgaaagagatttcgtgaataatgtatgactttcaaagctctagaccaaagctaggtgatcaagattcagacatacgctggataacattgtgcgaagagattccaagataatctgcaatccaagtgttgccatcactgatgcaaagactaggattccctgaaaggatttgaaccaaaaatcacatattgagaaatcggaaaaactttattgacttgtcgaaggtgttaatagttgcacagagatatcaatagcagaaaacaagcttgcttaggccgattcaataacataacatataatagaaatatactaatggaagacagatcatgtgcattagtctttaaaaggatgatacaaaccagtggttgcatgcgtttcttgccaatgggatactgatacgggttgggtgtctgcatggagaaggcggtaaaccagaggatgaagccagaaagaagatcaagaagagagtccaatgtagaggcaatgatagctaaagagccactagtgacagaagcatagactttagcagcaaaaagaagcatgtttgcaatgtttgatattctaatcgccaatgtctcgcttttagccaaattatcctgctcttcctatgtacacaaaacacaaagaaattcagaaaagtatcaatcaacaagaacaaatgcatcatggtttcaacaaatgtgacaagtagtagcctcatttaggctaacctttgacattccaggaacaaagccacgttctgcaagttcatccatttcagtaaagccctcaagcatctctacttgctgctggtaataatctgccacattgtcttccggacctgaaaacaccaagacacatagcttcacaaaatcatatttgatctcttcacaaaatcatatttgatcacaaaatcatatttgttgacattacttccacatccaaaagaaagattagagacaaaaatcaaggatcgggattaatgaactctagactaatcaataccaagattcaactaaatctcaacttcataacaagagtaaaaatatatctttgaagaatcaaaaatgctaaagatagcaaacaaaagaggccgaattcaaatgttatcagctgctgctaaagattgaaactgaagaagacgataagaaaatggaaatgcggagaggaggagcaaattgtttacccaaacaaccaagacagttgtgtagtttactcggagatttcttctccttgtgttccggtgaaacctggaaatcatcgaaatttaactgccaggaacggtcaccgttaccgtgaaactcgagcagcgagatcccttcgtcggaatctggactagctggctcaaccatttttccggcggcggagagagactttgtatttttttttttttttttttgagagagagagagagtggtaaggaaatgggaaatttgaagagacggcgagggtaaaatcggtaattaagaaagattgaggctagctactacgactgttgtggtagtaagacattcctccacagagatacttggaccagcctttagaagagacgtctctgctaattatccacgtggcgttctctcaatggatttgggatctcgcacgtgattggaggagtcatcatacacacgtgtacagttgagattcaactgcaattaaacgaccccgtgacatgacatggttatgagtcacatatgtgccctctcaaactctattatgtagtataaaaactgtattagatacaaccgacccaagatatagaagaacctttgaaaaatggtagaagccagttcagctaaagctttcttcttcacaattatcgtaaaatattagacatgtagagcaggcttgttgttctcttattgtcaagcgtaagtaaatgattattgtttagtttcgtgaccaattggtttgttttttggttagccattgttcgatttgctttggtttggtcaaagattgtatgctttcaagtcaaaccaaagctgactaaattttattctgtaataatttactttggaatggcaaaaccaaagaaaggtcatagacacaagagaagaagcaaatatgtttcttacgccaaaagacacgtttgtatggtaagacaaaagacacgtttgtatgtttcttacgccaataccattacgttaaaaataaactagtaacttaaatttacgctcactttctatttgggttttacatgatgattttggtcaaaggcctatttacaatgttgcaagcccatattatcttttaagtatctttttgtgcaaccaaaagaatcagtgatcttatgctcattttcatttttttctaatgaaatttttcgtcacttatggcttatgcgtccgatggacgattatggtaaaaggcccatttattcaatccaaagcttactgggttagatgatgattgtggtaaaaaggcccattatagacccaactaagtatcttagggtttcagtttccactataaaacttgttgcggcgtaagttagggttttgagaatcagcggcttcacctctccaggttcgtgtctcgattttgcaaactatctctcgaaatcgtcctacatttctttcttcagattcattactgagcttcgctttctgggtttctatctaaaaatttcacagatttcgtgtgtgaagaatcatttcaagcc

SEQ ID NO: 11796 - DNA, 3000 bp, Unknown
  misc_feature (1)..( 3000): cDNA_ID_2707520_gDNA_ID_2214517_Annot_ID_133974 3000 nt of promoter + ATG
accaaggatctctacctttgatcaagattcatgaacatttcaacttgaccaaggcggttttcgatgtaacacaaggcccaagctattacaacaacgcgttagacatcggtcctctctcgctgaccatcaagaattctcaatctcttacactatgcagatggatgttcgaggtaacaaagttagtctctaaattcttttgttctaagataattcgaaagttatatgttactatctttgttaataggaagtaatcaaaccgtccatatcatcatcttggagatcattccaattctacaagttacaagaattgcggtggatcgataactcgatgaaccaagaacaaattaattctttgatctcttttctcaaactttgtccatcaatagagcgcctcttcattactgtaagtgttacacacctaaaaccttgttactttgttagttcttgcgtcgtgctaatacctttatttattttgtaagatcgattcaaatacttatagttcaaacgaagaagttagtgttaatgctgaccatgcaagagtagtactaagggatctagaagtggtcaaattggaaggattcaagagtgaagaagataagaatcaactgatatttgctctacaagagatagtcagtatcgatcagcctctgcttgtactgtcttcaatttcttgacttcggcttggaatggaaacgacaaaagagttatgtctaaagatacacgtatgaacatgctttaattaacctgctgtcattttaacgcgtggatatattccatttcttgctatacaagaaatcctcgtgtaaacggaacttaaatttggctacgtcaagtttacagattaaagatttttcaccagtatgtattattgtaatgtacttactatgataaattacttaaaacaacatcaagttgattttcgcaagtatgtgtatatatataagggatccaaattctcgtacacacttgcaagttgcaacttaaacctataatgcccaaatatttggcttaggtgaagtatcgtttttaaaccatgtacgtgtcttcttctctttttttgacctgttcaacaaaagcatgcatgtgtggaaacttcagctgtcaacgaaagaaaagcgtgcatcaattcatcaaaaggtcattttaaatcgattaattaacgctaaaccaactaaaccattttgattacatcatcaagtttgctcgttggacttggttaaaatacaattgcctcggaaaatattgctaaggaattactttcttaaacttagtacaacttaattagttcgaaatgctctgagttctttttttaaagtaaatcaattacgtttagaaacaaaatgttatatatcatccaacggatgatgtgaagacacataacgtggacaaaacaatcactctaattaacaataattttgtggccaaaaatatactggacatttttacaccaaccccaaatggctcagacaggccttgtggtacaaaactttcaaatggacaccctaacaaagacttattcaagttccacgtgtaataaaacatgctgaaaaatgatatatagcacaagaatactcattactcacactattgcatggtacaacatatagtacaaatttagtttagaaatatcgatctatggacttctatattattatacaaacaattttactagactaaaatgacaagatctcagtcgtttttttaaacagactatctaagaagtgaccacattttatagtgacattcataagtccaccaagaactagtacaacctcactcaaaatcgaatctcttctatagcaatgaagtcaattgggctactgtcccgttgtggcccaatttaaagaaaaatagaagctatctcattgaatctgtcaacagtaaaactgttttgaaaacgtataatcccaactataaaggtcaagttccaaacaaattatatcatatgagcagttttgctaaagagagaaaaaaagtgtaagaatgagcaaaaagggaacagatcaaatgcactggcagaaaaagaagctccatgctgcctcaatcatacctgcccccactaggtatataagctaatctcacatgtggtaacactcttctcttctatcacccgcacctttcttctttctttgacagtgaaaatagaaagaaacaaagacagctgttgttgcattctccacggcacactaaccaacctcgcacatttctcaagtttcttacaatcttataactaatggtgattaatctttaactttgactaattactacataaaagtatttcatcaaacgaaactctcgtgatcatcattgtcatgggttggttagagcacgaatcatacaaggtttcaataatacagcaaaattggttaccaaaagattccgaaacagttcaatatttgtcgacaactaccttctgtatataaagtaatgacgcaaagacgttaataaatgttgcagtgcaataatctggtccggtctagtggtgtctagacccaacttatatcatttagtcaagtctcataatataatcgttgcataaatagacataaacgaagaatatctgaaacaaaaaaacaaaacttaaaactcgtcgccgtagttgaccgttactttttgatttttaattattatgaaatatcacattcaataattaaaactatgtgttaagaaaatttaattttatgtaagatgacacagaaatacacaaagacttgtctgtctttcacttttttagactctttgacccattttcttcataattcacgaaaacccaaaaattaaaaacaaaacaaaacaaaataaaatcaaaactaacaaaaaggaaaaaaaaaaaaaaaaaagtatctcaccggaaacgatttcttcgccgattccaagacttttcttcctaagctttttaacagatccggtgaaaatttcaaaatccgaagaattctctaaagctagggtttcttaattcacgagacggaggtgatataattcccccccgtcgtagctatg

SEQ ID NO: 11797 - DNA, 3000 bp, Unknown
  misc_feature (1)..( 3000): cDNA_ID_1808666_gDNA_ID_2214517_Annot_ID_133977 3000 nt of promoter + ATG
tgtcttgctgttttatctgttttctcatcctttgccatggccaaacgaaattaattctagtctgatcatcattatacaactttgtaatgttttccaatatgatttgaccagatatagctttgtcaccatgctatgctatatgtgtgttggtgtaattatgcatacgaagtcaaatgattgtttttgttacgaaagaattacatttaacaaaaaattatctatgtactcgttaaaattagtctgtatttaattaaaggaaacgtagaacttatctagctaaaattgtaccaaaccattatatactacatcggatttagttttccaaacacattacacatccgcccaatttatacacactatacctaaatctctgatccaaaaattcaaacatatcggagtatgtaccaaatcgaacagaatttaacataaaatatgcagatttgagtggagcaaagagtgatataataatggcaaaacctaaaccacgaaaccaacctgaagagcacaccaacacatatctgagatgtgtctcggcactatcttatctagagttttcttttatatatttacattaaataaaaaaataaagaaattccgcactatatgctaaagcttttcttagacaatggaagtcatcctttcctttgcttcttaatttggtttcatagcctcaattgctcctagttcaagaacaatattttcagatgaaatttatcacataacaaaattgcacaggtggtggtgggatgatgaatcatcttaagtcttaagcttcactataccacttgttttggcggagatgattcgacatttaaagatattattcatatatttcttgaagtttatggtagtcttcgagtgttgaaaatttctgcatttaccaaaaaaaaaaaaactgtattaatgtctacttggattttttaaagtttaaacttccagtttatgaagcattggcttttcctatatactgaattttcctattcatattaattttttaaaatttgttttgttttaggtcatgattcttaagattttttttatttatttatttatttataattaactgattttgtaccgagctaacaataatccactaaaatatttacattgaccaaccatgattgtaatcccagtaaaaaaattagtcatatagttaagtgtcaagcataaaaccaccattaattggttctttgagatattaattaatatccttttaagtaatgaatatgccgtctaatatccggctttgaaagctgtattgttttgagtctttcattttgaatgatatttttatttgggttcatgacttcttatctgtattcttctatatcgaataacaatagtaaaagaaaattgtgatattttattacgaataaactatcaaatcaattgtaatgcatccgctacttaaaaaatccagctaagttaattcggtgtcaactcagctttgccaaatttgtccaatatagtgggcaatttgacattatcacccaatctttttacagggtaatttgtgtaaattcatgatatgtctttatgagaaggaaaaagaaaaagagagttcatgatatgtataaacgcatgatatattacaattaaagaataattttgatcaggtttgaatttcactaaccatcataactgatttgacaaaaatagtatattcttaacaagttaaagtaacaaacatcatcactactcaaaattttattatccgaattaattttgtttagcaaatcacactgaaagatgattggaatatatatcgtcagggagggttcgcataacatgcctacgatacaaaattaggctgtcgggaattaaactctgtggcattcgtcagatacgtataaattcccttattatttttatcaaaacattactattattattctatgtaagagatataggttccaggtggggagaatcataaagtgccaaaaatctcaaccacgacgttggccaaaagttattttgttttctttccttccacatatgatccgattcggatttcataatgcgtttttccatttataaaatgtgttatgtggacatacatttactaattgtttttccagctcctttcaagtaatatttaatttggtgggttcaattatatatctcttcttatcttttttcataaacagcaaaagcataatcgacacggatccacttgtgttcctcaattgaatctcactatacccatttgttggctaaatgtcatattcgtttgctaactcttttatttttttctcttttttttatacagaaaaataaaaataaaattcagataataattattacattagtacaatagaaaataacttttaaattatataatgctatttttattcttagctattacaataatatttcttttttaagcttgttagttacaaaacagcaaaattaacagcaaacttgttaatttgggataattttgacatgtcttttttttttttaaatgtaaccacggtaacttgtttttctgtagtatgaaataatgtgaaatctatgggatatccaatggtattgaatattgttgaatccagtgagaagtactcagtttccttggttaaaagttcagacttaaaagaaaccaaggaccaaaaccggaagcttaatttaaaatttaataagtaacaattgtagttgatgtttccatcatcatcacgaccaccaattacttatataattatgtatgctcctataagaaatcagagataacatcaaaaccatgttgtattctacaaagcaagaatagcatatacaatatactctactatcaaaattgcattacttagtggaatccctagaattcctcctaactcaaaagtcatattttcttctttttttaattcccatgaaaaatattacaaaaccctaaaaaccctcctataaaaccaacctcaacccctcccacatttctccatcagctctttcttacatcatattccaatctatcactttataacaaattaaagtctacgttgagatatg

SEQ ID NO: 11798 - DNA, 3000 bp, Unknown
  misc_feature (1)..( 3000): cDNA_ID_2707509_gDNA_ID_2214517_Annot_ID_133980 3000 nt of promoter + ATG
ttattaatgtcaacgtcaaccatttttaaaaaaaatcatagaaatgcatattgtttattttttattattatttaattgcaaatttgcaatcgtgaaggactcaaaagccgtatataaacgaattatgtaaattactaataacatttttggaaaaaatgtgaatattcaggatataaaaatagtataatacttaaattattgttcgtacaagaatgacacgtaactgcaaacgcgttgacttcgtaggcctaattaaaacgcttatgaaattgccaataaacacacacgggaaaatagtaacatccaaacattgcatggaaaagagtttaaggtttgtgaaggaatttgagaattttcttccttactttttttttctttctgaaattaaaattgttttcttccttcaattttgatgaagaagaaaacacataaacgttgcaaaacgacactatacatgttgacttttggtaggcgtaaatgattcgttttactggcaaattatgaaaagttagggctttttaataacattttttaatgatccgacacaataataattttgcatgatgattagaaataagaagacttgaccttatagataggttggttacatatgttttcacagaaatagtactcccaaacatagccttgcgagatatgtagccaacaaagtaatatatgtatttggtaacgtgacccaaagaatcttaaaaagcgtataatcttattaaattccacgattggtgaattaaaatgaaggaagcataatgtagggttacaatgatcatatgtgtgtttatgagactggaactggtcgtttggaaagagcaagggatgagaaaacggataaaacggcaagagagacgaatgcgaagagaagaagactggccgatgcatatcctttactaaagaacttatccactggatcagtcgaatcaaattctattaatgctatgtatgtgtctttcaaatctttgctcactccaaatcctgccgccgaacccgttgcaagtaaatatgatattacctgtccaaatttgaaccagattttgttatatatcaatatacagtatgacttataattttaatgtatttaaagatagtatttcctcaaaaatgatataaataccttatcaccgtagaaatcgaactgataagtaagaggatgtgtttttccggtggcaaattgggagattgttaagaacagttgtacaacggcgtaaactagtccgatgacggcagcggacagcatgtatcttcatgaatgatgaatccaaacatatatgcaaaaaataggtaaaaatagttagtcaaatattggatacaaaattttcacagagaaggtaaataatttatttacctataagcatagacatcgttgaaaggcaatttgatagacgtgcttgaaatttcgagagtgacggtgttggtgctgatgaggaccaccgttatgaggaggaaagccgcggtcaaaaccctaaggagaaggagcactgtcctcaacgtaacggacggtggtgccggaggtggtggagccatataaatcttcccgttaattaatcgttacgctttaaagagtaagatgaaaatgattaaggctaagatgttcgaatgcaagacatggaatgttgactaatttatagccaaaatttacgttgactcgagttcgaagagttgatttttgttacattataatatttaaccataatgtaaaatatatatatgcacaaattgtattcttcaattcgtgctggagcttgctggaactcgatcaccacttctaagttctaacttagtaattgaagtcgtgatatattttattgacatatggtattaatttagatttaaaacagtttttagccaaggaattgtaagtctaaattcatagtcttcgtagccagaaggcaacctttgatattatttttattatctatatctttttttttttttggacaaagcttgtatctacatctaactgagaaaaaagaatgtttttctttgtcatattattgttctcaaattctgattatacaacttttgacatcaaatcataattatgcaatcaaacaaacaaaccaaaaaagaaatatgcgactagcgtaatttttgcgccacaatgtattttatatgcatagcaaatcattagaatcctagtacaactgtacaaagttcgagttggacacctagcagcgataattcaaaccatgtttccatctaatgtaacagtatagacttagtcgtctatcaattttaggtgcaatcattcgtattaaaaagaaaacttagtttttttttcatactgtttagaggaacaaaatacatgtaacaagaggtacatttttgtttgagttaaattttacaatttttgaatatatagtcaacgaagaccgaaaaagttgagtcaattcctaagaatcaatctgccacatgcatcgccgtgcttgaagggcggctcactgtcttcttgcttattactacagttaaatctttttttttcaacatctaatgctatacttttaatctataatatatattagatgtgacttaaggaatttcaatagttatacataataataaaaatgaatatttgttagtgttacaaactgtgtgtcataatcatcattcatcaggatttcaaaaatatctcaaaattgttgtaagttcatgtaattcgaaatgaatgtgcactataagaaataaatttacaatttaaaaaatgcttcaatactggttacaaaaaaaactttcaatactagtattatactacttacttagtcaaaaaagtttatgaatatggttttttctgtatgttaatatttttaactgaaaatagtaccgacataacaagtaaagatatctttatttaaagtaacaaacattaatttcacttcaaattctcactattaaggattcctctctttgtagccacatttcaccatcactactttgttttcgcatatctttaaattttgtatacgtagcaaactctttcgagaaaacaag

SEQ ID NO: 11799 - DNA, 3000 bp, Unknown
  misc_feature (1)..( 3000): cDNA_ID_2707505_gDNA_ID_2214517_Annot_ID_133981 3000 nt of promoter + ATG
actggaactggtcgtttggaaagagcaagggatgagaaaacggataaaacggcaagagagacgaatgcgaagagaagaagactggccgatgcatatcctttactaaagaacttatccactggatcagtcgaatcaaattctattaatgctatgtatgtgtctttcaaatctttgctcactccaaatcctgccgccgaacccgttgcaagtaaatatgatattacctgtccaaatttgaaccagattttgttatatatcaatatacagtatgacttataattttaatgtatttaaagatagtatttcctcaaaaatgatataaataccttatcaccgtagaaatcgaactgataagtaagaggatgtgtttttccggtggcaaattgggagattgttaagaacagttgtacaacggcgtaaactagtccgatgacggcagcggacagcatgtatcttcatgaatgatgaatccaaacatatatgcaaaaaataggtaaaaatagttagtcaaatattggatacaaaattttcacagagaaggtaaataatttatttacctataagcatagacatcgttgaaaggcaatttgatagacgtgcttgaaatttcgagagtgacggtgttggtgctgatgaggaccaccgttatgaggaggaaagccgcggtcaaaaccctaaggagaaggagcactgtcctcaacgtaacggacggtggtgccggaggtggtggagccatataaatcttcccgttaattaatcgttacgctttaaagagtaagatgaaaatgattaaggctaagatgttcgaatgcaagacatggaatgttgactaatttatagccaaaatttacgttgactcgagttcgaagagttgatttttgttacattataatatttaaccataatgtaaaatatatatatgcacaaattgtattcttcaattcgtgctggagcttgctggaactcgatcaccacttctaagttctaacttagtaattgaagtcgtgatatattttattgacatatggtattaatttagatttaaaacagtttttagccaaggaattgtaagtctaaattcatagtcttcgtagccagaaggcaacctttgatattatttttattatctatatctttttttttttttggacaaagcttgtatctacatctaactgagaaaaaagaatgtttttctttgtcatattattgttctcaaattctgattatacaacttttgacatcaaatcataattatgcaatcaaacaaacaaaccaaaaaagaaatatgcgactagcgtaatttttgcgccacaatgtattttatatgcatagcaaatcattagaatcctagtacaactgtacaaagttcgagttggacacctagcagcgataattcaaaccatgtttccatctaatgtaacagtatagacttagtcgtctatcaattttaggtgcaatcattcgtattaaaaagaaaacttagtttttttttcatactgtttagaggaacaaaatacatgtaacaagaggtacatttttgtttgagttaaattttacaatttttgaatatatagtcaacgaagaccgaaaaagttgagtcaattcctaagaatcaatctgccacatgcatcgccgtgcttgaagggcggctcactgtcttcttgcttattactacagttaaatctttttttttcaacatctaatgctatacttttaatctataatatatattagatgtgacttaaggaatttcaatagttatacataataataaaaatgaatatttgttagtgttacaaactgtgtgtcataatcatcattcatcaggatttcaaaaatatctcaaaattgttgtaagttcatgtaattcgaaatgaatgtgcactataagaaataaatttacaatttaaaaaatgcttcaatactggttacaaaaaaaactttcaatactagtattatactacttacttagtcaaaaaagtttatgaatatggttttttctgtatgttaatatttttaactgaaaatagtaccgacataacaagtaaagatatctttatttaaagtaacaaacattaatttcacttcaaattctcactattaaggattcctctctttgtagccacatttcaccatcactactttgttttcgcatatctttaaattttgtatacgtagcaaactctttcgagaaaacaagatgaagctcgtggttgtacaattcttcataatctctcttctcctcacatcttcattttctgtactttcaagtgctgattcgtgtaagtgtttacttaatctagttaataattgtaggtcatgcatgtatcattttgaaacaagttttctgaaattctaagattttacatatatatgtgataaatgaattagcagcatgcggtggaaagtgcaatgtgagatgctcaaaggcaggacaacatgaagaatgcctcaagtactgcaatatatgttgccagaagtgtaattgtgttccttcgggaacttttggacacaaagatgaatgtccttgctaccgtgatatgaaaaactccaaaggtggatccaagtgtccttgaacgttctttgaagatcctcatcacatacatataacttctacgtactatatgtgtggaaatattaatcacattctatgtttgaaatatataaaataaaatcaatgcccccaatgttggaaatcttcaatgtgatatcttaatatatatcacgaataaaaaagtttaaatttctcaatctcatttttaatctttaatctaatttcttaacacatcaacgaatctttaatctttaatcatgtagataattatcagagcacctaaacattgcgccgttttgtgattatacaaagtaacatcgtgctgtttttgacttttgaaaaccacagatccaaaaactgtttactttcctctaagagaaagcaaagccgagtgagtccaagcgagttttgagagattcgttgactcactaccggagaacgacgct

SEQ ID NO: 11800 - DNA, 3000 bp, Unknown
  misc_feature (1)..( 3000): cDNA_ID_2707498_gDNA_ID_2214517_Annot_ID_133983 3000 nt of promoter + ATG
aaaaaatgttgatgattaaggacaattaaatcagactaaaaaccggtttaattctattaatcattcctggtttttctctcctagacctcatcttcttgaatcttgattaccaaatccgattcttgaactgtgttttaccaaacttttaccacttgaatttactaagcttctgcaatctccatcactttcttcttgtaaagcttctcctctgcatcccttaagaacttgaatctcgacaatggcgaagatgacggtgaatgtgatgatgacaatggagatgatctcactagtctattaaactcagcatcagaggatgactcaaacaaactcgagatctcttcttttctaccattacaagactccattagcaatggagttaaaggaggcgtgaacaacgaaggagaagcacgaggagtgagatatggaggagttatgacaccactttccatattaagaaacaaatcattcaaactctttccttttgtggaaaccacatcttcagattccatttcttccactgtttcttccatgattgtgaacagaaacctcggcacaagccctggaccaccaacattctcaaacccattattaagaggacactgttgttgagtgtcaatgggtttagggtttgagaaagaggaagaagaaggagaagaagaagaagggtttgtgctactactgcaacagaagatgaagagaagctctctggttccaggggtagaatagtcatttcgaaaatcaggtcttctcgtcgtcgacctcttcttacaccaaagcaagtaataaagctcagcgagaagagctaatagcaagcaaccaaagactatgcttagagcaagtcccacactgctcagagatctcatctttcttcttctagataagattcacttctcttgttcatcgttactccaacacaaagagaagacctttttatccgattcgaccaaatgtgaaatgcagaaggaatggacactatggcggttgtttatgattctgagaatagcaagggtttttgcagagacggaagaagaaaataaagttgggatgaaagaaaagcttgggaatgtggaaaaaaaagaaagaaaagcttgggaatgtgaaaatataaataatttcctaaaaaaggtgttatatagccaagtgtgtaagtgtaagtgaaactctcactcatattttagaatcaataaatgcataagtgaatacgaaattttacccttaatgaaagactttagcttctgaccatttttttttcttttcaatttatatgtcaaatgatgattttatcattgaagatgtatgaatcgaactccatgcatcattattctgacaattctactaacaattaaaatatgggagagatgactcgcgcggtgttgtagtatatggatcatgttcacagtgattcgtgcatatatatttgaaacatatgaaattacgaggaacaaaacaactctacttcattacaccattctgaaaatatttggcaagtttatctctattaatcctatattaagaatagaactccaaacctagtacactaaattaattaataaacttattttggtataaccacgggatggatgatggaagaaggggactttcaattttgactactttatgattttctgatgtttgatctactacttaactttgttacaaaaagaataccattgcaacaaaaaatttctttaatcacaaaaataaacattgttttttttccttttatcttggtttcccttacaaagcatcatatggatagcacttcaaggccttatagcccatgtgatgtgacgcatatgaagtaagagatgtgaacttgaaactgattataacacaagtagcctgagatagagtgagatttgttttgttttgcggttcttcatgttgattgatatcaaagtcagagtcagattagcctaccaaatcgaagtgtcagtgattccacctcaataatacaatttcgtaatgtgcatcaacaactatctagcctcctccatcaaccaatcacaacttcatgtagtaggctagtagcattgataatgatatccctttttagacttgtttccattcgtcatataccacttgatgacttgtttaaatccctttattctctttagtccgtgtaccaatatttttgcaaagaaagtagaatcatggattactcataactaacagaaacgttgagaaattggaaaatatgttcatagtgctaaggaggaaaactacttcttcttctcttctcaacaattgcaaataacacaagaaactaaaactgtgactcagtcttggcctcccaagtcacaatttcatgtttacaaattttctcctgcaaatatcatttcattttgcaaattaataagtttagtacggtgattatattcccttggatttatcaaataaaacccaacatatgagtccattatgcatcctcacatgaagtattttgcatttccttttatacacaccacaaaatatacagcaaacttcaactaaaacacaatctaataaataaaaaatagaacacttagttcccaccacagattttattacaaaaaaaacaaaattatcattatccgtattttatatcgtgcatcacaatttgtgattattcattgtattaacgagcccacacataaaagatcttaattatccatctacaccttaaaatctacggaccgtcttacattaatacagctagttcaccttgtgaaatctcggtaataccctcagctgcaaaagatagaagtttcatagaacggtacgtgttcattacccaacccagctttaaattttcttcttacgtgtgtatgactagacacgtaggtcccactcagcaccacgacaacccaataataaacatataaaaacaaaaagaaattaattaattttttttctttcttcatatatataattcgtttcttcttcctttttccccgagatttttttcctctgttcggtcggccattgaattgttgttgattcattggctctaaaacgaaa

SEQ ID NO: 11801 - DNA, 3000 bp, Unknown
  misc_feature (1)..( 3000): cDNA_ID_2707490_gDNA_ID_2214517_Annot_ID_184489 3000 nt of promoter + ATG
ttgcacagagaagctctcggattcttcgggtatatgtcggaggagaaaggtattgatccagacaagtacagtttcacttttgctttgaaggcttgtgccggatctatggactttaagaagggtttacggatacatgatttgattgctgagatgggtcttgagtctgatgtttatataggaactgcgttagttgaaatgtattgtaaagctcgtgacttggtttctgcaagacaagtgttcgataaaatgcatgtgaaggatgttgttacttggaacactatggtttccgggttggctcaaaatggatgttctagtgcagctttgctgttgtttcatgatatgcgttcgtgttgtgttgacattgatcatgttagtttatataatctgatccctgcggtttcgaagctagagaagagtgatgtctgtagatgtcttcacggacttgtgattaagaaaggttttatctttgctttctctagtgggctgattgacatgtattgcaactgcgcggatttatatgctgctgaatctgtttttgaagaagtgtggaggaaggatgagtcttcatggggtacaatgatggcagcttatgcacataatgggttctttgaggaggtattggagttgtttgaccttatgagaaactatgatgttagaatgaataaggtagctgcagcaagtgctcttcaagctgctgcatatgtaggggatttagtgaaggggattgcaattcatgattacgcagtgcaacaaggattgatcggtgatgtctcagttgctacttctcttatgagtatgtattccaaatgtggtgagttggagatagccgaacaactgttcattaatattgaagatagagatgttgtttcttggtctgccatgattgcgtcgtatgagcaagcagggcaacacgatgaggctatctctttgtttagagatatgatgagaatacatatcaagcctaatgctgtaactttgactagtgtgctacaagggtgtgcaggagtagccgcctctagattgggtaagagcatacattgttatgctataaaggctgatattgagtctgagttggaaactgccacagctgttatttcaatgtacgctaaatgtggtcgattttctcccgcgctcaaagcctttgaaagactgccaattaaagatgctgtggcattcaacgctctagcgcaagggtatactcagattggtgatgccaataaagcatttgatgtgtacaagaacatgaagttacatggtgtatgcccagactcaagaactatggttggtatgcttcaaacttgtgccttctgtagtgactatgctcgaggttcttgtgtttatggacaaattataaagcatgggttcgattcagaatgtcacgtggcacatgctcttatcaatatgttcaccaaatgtgatgccctcgctgcagcgatagttttgtttgacaagtgtggattcgagaaaagtactgtatcttggaatataatgatgaacgggtacttactccatggccaggctgaagaagctgttgccacttttcgtcagatgaaggttgagaaatttcagccaaatgcagtcacttttgttaacatagtacgcgcagcagcagaattatcagccttgagagtaggaatgtcggttcattccagtctcattcagtgtggattttgttcccaaacaccagtaggaaacagccttgttgacatgtatgcgaaatgtggaatgatagaatcttccgagaaatgctttattgagataagcaacaaatacatagtttcatggaacactatgctatccgcttacgcagcccacggtctagcaagctgtgcggtctcacttttcttgtccatgcaagaaaacgaactcaaaccagactctgtttcctttctcagtgttctttcagcttgtagacacgcagggttagtcgaagaaggaaaacgaattttcgaggaaatgggagagagacacaagatcgaagcagaagttgaacattacgcgtgtatggtagatctattagggaaggctggtttgtttggtgaagctgtggaaatgatgagaagaatgagagtgaaaacaagtgtaggagtatggggagctttattaaattcttcaagaatgcattgtaatttgtggttaagcaatgctgcattgtgtcagcttgttaaacttgagccactaaatccttctcattatagtcaagatcggagattaggagaggtcaataatgtatcaagaattaagaaagttcctgcttgtagttggatagaagtctgagaatactcaattcttttgattcttcttctctatcttttactgtatcaaaaaatctttctaagtataattgaaattgtgagaaatattggaaaatctgttgaaatctctgttaagagacaaaaaataaagagcccaaccggattcgaaccggtgacctattgatctgcagtcaattgctctaccactgagctataggctcttcttgactttagtgtatgctaactaatagaaatactaaacttgcatgatagaacattattttacttaaaacagaattttggagaaacataattgttaagttatatataagtagtatacactaaagtcaataagagcctatagctcagtggtagagcaattgactgcagatcaataggtcaccggttcgaatccggttgggctcttaattttttttttttaagcccagtaaaaactgggtttcgtagtaaatgggaacgtacatagaagagagattagggttgtgctatatattctccgttaaaaaaaccctagttttaaaaccttctgaaccctagccagaatacgtaagtaacttttgtgagtttttgtctgcgtgagaattttaacgtttgttgtaatctagttgaaattgaaatcggcaggtaacaaaaagtctgaatttatgattcttttatgacacaacacacaagtcatgaaacttatgaggcaattcttatatttatgtgtgtagaggcgataatg

SEQ ID NO: 11802 - DNA, 3000 bp, Unknown
  misc_feature (1)..( 3000): cDNA_ID_3023015_gDNA_ID_2214517_Annot_ID_184488 3000 nt of promoter + ATG
attttatatcgtgcatcacaatttgtgattattcattgtattaacgagcccacacataaaagatcttaattatccatctacaccttaaaatctacggaccgtcttacattaatacagctagttcaccttgtgaaatctcggtaataccctcagctgcaaaagatagaagtttcatagaacggtacgtgttcattacccaacccagctttaaattttcttcttacgtgtgtatgactagacacgtaggtcccactcagcaccacgacaacccaataataaacatataaaaacaaaaagaaattaattaattttttttctttcttcatatatataattcgtttcttcttcctttttccccgagatttttttcctctgttcggtcggccattgaattgttgttgattcattggctctaaaacgaaaatgggaattctcaacgacgacgccgttttaatcgaaccgggaaaaatctccggagatcccaccgtcgttaccgtcaattgtcctgatgaatccggtctcggttcaactctgtgtagaatcatcctcgaatttggtctctccattacccgagcaggtcaatattcaattttacttcgtatctgtttaggggaatattctctgtttgtcgtttagcttcacggaatattcttctttatgattcgaaaaattcaattctgtttttcttattttgagggtaattaatatgtttgtaaaaatggtgtttgcagatttttcaacagatggaagatggtgttatatagtgttttgggttactccagatattagctctcctaaaattgattgggacagcttaaagaatcgtcttttatcagcttgtccttcttgcttaggctctttctacttctgccttcaatccaatgtctctaagcctccttccctttatcttctcaagttcttttgccgtgataggaaaggattgcttcatggtatgtgtaaagttattgtcttttgtcttgtgcttggtgttttctttatatggttgattaaaagtttgtgtttttttggtgattcgtagatgttactaaagttttgacagagctagagtttacaatacaaagagtcaaagtcatgacaacaccagatggaagagttttggatatgtttttcatcactgacgcaatgtgagttttcttcttctttctaattctgatgtttcatttgagagaagaaccaacattaacgttgtggtttgtgactttgtgtaacagggatctattgcacacgaaacagagacaaaccaaaacgtgtgaccatctaacggctgtgcttggtgagcatggtgtgagttgtgagcttgaactagctgggcctgagttagagagtgtgcaacgattctcttcacttccacctttggctgctgatgagctgtttggcccagatgggtttgatattagcggctctagctctaacaaagcggttcttaccgttgataatcagttgagccctgcacatacgttgcttcagattcgttgtgttgatcaaaagggacttttctatgatatcctcaggacttccaaagactgcgatgtccacgtacgttaaaactgatctctctaacattaagagaacctaaccttacctctgctaagagaagttgggacttctatggttgaaagatttgtataactcaagtagttcttgtttctttatccagattgcatacggtaggttctcctccaaggttaaaggttataggaatttggagttgtttgttagaggcacagacgggaataaaataatggacccaaaacatcaagccaacttctgtgctcgacttaaggaggaaatggtgtgtcctttgcgagtgattatcgtgaaccgaggaccagatactgagctattagtagccaaccctgtggaactatccggaaaaggaagaccacgagttttctacgatgtcacacttgcgttgaaatcactaggaatctgcatcttctccgtaagtactgtataataatacattgtgttctctaagctttttgaacggttattttcggtttgttttaagattggcattgcgttttcttgtaggctgagattgggagacattcgactttagatcgacaatgggaagtttatagatttcttttggatgagagtcgtgaattcccattggctagcctccgtgcgagaaatcaagtagtagatagagtcacaaagacacttatgggttggtgaagcggatgagagtgagctttcatgaacgttatgctacactcaaggggacaaagaaacaaagtcttcttcgcttgcggcttcgggtcgatgaaaagagtgatgcaagggggttgtgattgctgttgtgtggagctaatagcgttgtaaagctttggaaattgtaaaaggattatataaccgcaattgcaatgaatgcttgtaaactcactttgcaaaggtaacatttccgttgactaggtggtcactacaagagagcgacagagttgacccgagccagaatcgcaaacatgttacatttagccatgtagtggcctttgggggataatatggtaattagacaaattgtatcgaaatatatttagagtgttgccatcaaagatctctgtgtttttgaattctttttaatcatatactgaaatttgttttagttgtcatcaatatattcatctactactgtactaatccctttataattgagtttatataacgaagaaaaaggagatatagatgcattgacaagtccataattatgtttagttgtttaccattggatctgaaatagattcgaaaaattaaacggttaagaaaaaggaaacgcgttaattaaaaataaaaaaacgaagcggtagggttaatttcgtcgtttcgttatccgttgtcgctcgctcgtgcttcatcggcggctagtaatccagtgcagcagaggtcctcctatcttaacgaaagctgtgattctccttcgtctttcaatatcattcttaggtttttgaaattcatgtgtcgtaagaaccgaggaag

SEQ ID NO: 11803 - DNA, 3000 bp, Unknown; identical to SEQ ID NO: 11800
  misc_feature (1)..( 3000): cDNA_ID_2707498_gDNA_ID_2214517_Annot_ID_184487 3000 nt of promoter + ATG

SEQ ID NO: 11804 - DNA, 3000 bp, Unknown; identical to SEQ ID NO: 11799
  misc_feature (1)..( 3000): cDNA_ID_2707505_gDNA_ID_2214517_Annot_ID_184485 3000 nt of promoter + ATG

SEQ ID NO: 11805 - DNA, 3000 bp, Unknown; identical to SEQ ID NO: 11798
  misc_feature (1)..( 3000): cDNA_ID_2707509_gDNA_ID_2214517_Annot_ID_184484 3000 nt of promoter + ATG

SEQ ID NO: 11806 - DNA, 3000 bp, Unknown
  misc_feature (1)..( 3000): cDNA_ID_3023019_gDNA_ID_2214517_Annot_ID_184483 3000 nt of promoter + ATG
gagatcatgtccaatgaccttcagaatagccaaagcacagtaagtgcttgccaagtgactaccgttgtgctttaaatcctacgcaacaaactaaactgtcaagcccacacagatgcaaaacaaagataaatcttgtaacatataaagcataaggaatatagacttataattaccccattctcatcaatgggaaactgagaactccttgaaccaaagaaaccatagaattctcctgcagagaagaacaagaacatctcattcattgatcactaactaattaacaatttgctcataaacatacttctaactaaattcaagaaaaataccatctttcagtgaaactctgttagtaggaaaggcctggaaggacaaaacccactttgcaacaacatctttatcaaccttcagaaattatagatgaaattcactaaatcagattcaggggaaaaacaaagatcgattctttgagagagaggagaaagagactaacacggtctcttgcgccgagaaaatgaagacccgagattatgaaatgagcgagtgtaagacgattgatctcctgagattggtaatggtacggaagcaactcgtacatcatctccaaatacatcaagtgtcgatctttctcgaaattcgctgacggagatgattgcaccggtggagaatactcttcttcgtcttcttcctccgacttagatcggtccgaatcgattgacacggcggtctctgacatagcgtcgttctccggtagtgagtcaacgaatctctcaaaactcgcttggactcactcggctttgctttctcttagaggaaagtaaacagtttttggatctgtggttttcaaaagtcaaaaacagcacgatgttactttgtataatcacaaaacggcgcaatgtttaggtgctctgataattatctacatgattaaagattaaagattcgttgatgtgttaagaaattagattaaagattaaaaatgagattgagaaatttaaacttttttattcgtgatatatattaagatatcacattgaagatttccaacattgggggcattgattttattttatatatttcaaacatagaatgtgattaatatttccacacatatagtacgtagaagttatatgtatgtgatgaggatcttcaaagaacgttcaaggacacttggatccacctttggagtttttcatatcacggtagcaaggacattcatctttgtgtccaaaagttcccgaaggaacacaattacacttctggcaacatatattgcagtacttgaggcattcttcatgttgtcctgcctttgagcatctcacattgcactttccaccgcatgctgctaattcatttatcacatatatatgtaaaatcttagaatttcagaaaacttgtttcaaaatgatacatgcatgacctacaattattaactagattaagtaaacacttacacgaatcagcacttgaaagtacagaaaatgaagatgtgaggagaagagagattatgaagaattgtacaaccacgagcttcatcttgttttctcgaaagagtttgctacgtatacaaaatttaaagatatgcgaaaacaaagtagtgatggtgaaatgtggctacaaagagaggaatccttaatagtgagaatttgaagtgaaattaatgtttgttactttaaataaagatatctttacttgttatgtcggtactattttcagttaaaaatattaacatacagaaaaaaccatattcataaacttttttgactaagtaagtagtataatactagtattgaaagttttttttgtaaccagtattgaagcattttttaaattgtaaatttatttcttatagtgcacattcatttcgaattacatgaacttacaacaattttgagatatttttgaaatcctgatgaatgatgattatgacacacagtttgtaacactaacaaatattcatttttattattatgtataactattgaaattccttaagtcacatctaatatatattatagattaaaagtatagcattagatgttgaaaaaaaaagatttaactgtagtaataagcaagaagacagtgagccgcccttcaagcacggcgatgcatgtggcagattgattcttaggaattgactcaactttttcggtcttcgttgactatatattcaaaaattgtaaaatttaactcaaacaaaaatgtacctcttgttacatgtattttgttcctctaaacagtatgaaaaaaaaactaagttttctttttaatacgaatgattgcacctaaaattgatagacgactaagtctatactgttacattagatggaaacatggtttgaattatcgctgctaggtgtccaactcgaactttgtacagttgtactaggattctaatgatttgctatgcatataaaatacattgtggcgcaaaaattacgctagtcgcatatttcttttttggtttgtttgtttgattgcataattatgatttgatgtcaaaagttgtataatcagaatttgagaacaataatatgacaaagaaaaacattcttttttctcagttagatgtagatacaagctttgtccaaaaaaaaaaaaagatatagataataaaaataatatcaaaggttgccttctggctacgaagactatgaatttagacttacaattccttggctaaaaactgttttaaatctaaattaataccatatgtcaataaaatatatcacgacttcaattactaagttagaacttagaagtggtgatcgagttccagcaagctccagcacgaattgaagaatacaatttgtgcatatatatattttacattatggttaaatattataatgtaacaaaaatcaactcttcgaactcgagtcaacgtaaattttggctataaattagtcaacattccatgtcttgcattcgaacatcttagccttaatcattttcatcttactctttaaagcgtaacgattaattaacgggaagatttatatg

SEQ ID NO: 11807 - DNA, 3000 bp, Unknown
  misc_feature (1)..( 3000): cDNA_ID_3023022_gDNA_ID_2214517_Annot_ID_184482 3000 nt of promoter + ATG
gtttgtttgattgcataattatgatttgatgtcaaaagttgtataatcagaatttgagaacaataatatgacaaagaaaaacattcttttttctcagttagatgtagatacaagctttgtccaaaaaaaaaaaaagatatagataataaaaataatatcaaaggttgccttctggctacgaagactatgaatttagacttacaattccttggctaaaaactgttttaaatctaaattaataccatatgtcaataaaatatatcacgacttcaattactaagttagaacttagaagtggtgatcgagttccagcaagctccagcacgaattgaagaatacaatttgtgcatatatatattttacattatggttaaatattataatgtaacaaaaatcaactcttcgaactcgagtcaacgtaaattttggctataaattagtcaacattccatgtcttgcattcgaacatcttagccttaatcattttcatcttactctttaaagcgtaacgattaattaacgggaagatttatatggctccaccacctccggcaccaccgtccgttacgttgaggacagtgctccttctccttagggttttgaccgcggctttcctcctcataacggtggtcctcatcagcaccaacaccgtcactctcgaaatttcaagcacgtctatcaaattgcctttcaacgatgtctatgcttataggtaaataaattatttaccttctctgtgaaaattttgtatccaatatttgactaactatttttacctattttttgcatatatgtttggattcatcattcatgaagatacatgctgtccgctgccgtcatcggactagtttacgccgttgtacaactgttcttaacaatctcccaatttgccaccggaaaaacacatcctcttacttatcagttcgatttctacggtgataaggtatttatatcatttttgaggaaatactatctttaaatacattaaaattataagtcatactgtatattgatatataacaaaatctggttcaaatttggacaggtaatatcatatttacttgcaacgggttcggcggcaggatttggagtgagcaaagatttgaaagacacatacatagcattaatagaatttgattcgactgatccagtggataagttctttagtaaaggatatgcatcggccagtcttcttctcttcgcattcgtctctcttgccgttttatccgttttctcatcccttgctctttccaaacgaccagttccagtctcataaacacacatatgatcattgtaaccctacattatgcttccttcattttaattcaccaatcgtggaatttaataagattatacgctttttaagattctttgggtcacgttaccaaatacatatattactttgttggctacatatctcgcaaggctatgtttgggagtactatttctgtgaaaacatatgtaaccaacctatctataaggtcaagtcttcttatttctaatcatcatgcaaaattattattgtgtcggatcattaaaaaatgttattaaaaagccctaacttttcataatttgccagtaaaacgaatcatttacgcctaccaaaagtcaacatgtatagtgtcgttttgcaacgtttatgtgttttcttcttcatcaaaattgaaggaagaaaacaattttaatttcagaaagaaaaaaaaagtaaggaagaaaattctcaaattccttcacaaaccttaaactcttttccatgcaatgtttggatgttactattttcccgtgtgtgtttattggcaatttcataagcgttttaattaggcctacgaagtcaacgcgtttgcagttacgtgtcattcttgtacgaacaataatttaagtattatactatttttatatcctgaatattcacattttttccaaaaatgttattagtaatttacataattcgtttatatacggcttttgagtccttcacgattgcaaatttgcaattaaataataataaaaaataaacaatatgcatttctatgattttttttaaaaatggttgacgttgacattaataaaattcaactcctatcgttatagtcaatgtaatcataatcattatttaatatttttgcttagttaattcgcgcattccgtgtcttgtaatcttgtatcataacaactagtataaaagcctaaaagggtgcatttgtttttggatataagtttttaaaaggtgcttaaaatttacattttacatagttaatatggcagttctttttcttccctctaattatacgtttatgtaataaactgtcagtgtcagtgtgtcaccatcgaatctctgagaagctctatgagttcctttggatacgttgaccaaaccttccgtgtgcaatttctcaattcgtcaactaaatgaaagtattgagaaattgtaatcatcgtaaacgagtagcgaatgtgaacgttgatcgctaaattggacgccgttatataaggccttagtcggatagtcaaactctctagattttatttcctaaatagaactgttttcaatattgatattgcagatagaaaaatgataaacggctttgaagtttcgccggtagataactaactatatcttcacaagcttctttataatagcctttaccttaattttaatttgcacttaatttaagcttggtgtgttttttaagtttgagatttaaaatattataggaaaaaaatatgtatcccattgatttggtaagctagacgtggtgatccagtttgagcacgacttcaacaataaactttggtatatttcataagtatctttattttgtttgtttgacatttaccgtcattacttggtcccatgccatagagcaaaagtcaactcttatccctctggcagcaagttttggttataaattaatctcagacttttatcttcctcttcctctccgattaccaatttaagaagatcattaaatttcattcaacgtactgatcaattttatg

SEQ ID NO: 11808 - DNA, 3000 bp, Unknown; identical to SEQ ID NO: 11797
  misc_feature (1)..( 3000): cDNA_ID_1808666_gDNA_ID_2214517_Annot_ID_184481 3000 nt of promoter + ATG

SEQ ID NO: 11809 - DNA, 3000 bp, Unknown
  misc_feature (1)..( 3000): cDNA_ID_3023025_gDNA_ID_2214517_Annot_ID_184479 3000 nt of promoter + ATG
ttagtacaccacaaattgtgctcccatcaaaagcaaatgcaaaaatggacacaaatgatgcaagtgttgtgatctcgaggcctaacaccaatgaatcagtctaaaataaagaaaagactaacggcgattattaaaatataataagagaaaacaatgagtgtccgatttctaaacaccggatcgatcgttgcttattggtagagtgttattgtaatgctaattttggctttgttaaattttgtatccggctacaatatatgaaatgttttgcactactaaaagtacctttacttaaaattatatagtgttttgagttcttaatttataacacctcttcaaccacttgtgggtttcctacgtatatttccaacagctggccaataaatctgcaacaaaaataatcatgtttctttctttgtatacgtaatctacaaaaagttattggaaaataatgcttttagagcacgagtatgatgtaatgcggtagtgggtagtggagcataatggatcaaatcaaaactttttatgaattgggacgtgttttagagattctgcatgttgcggtttctggtcgccacataagaaagcatctcattatataagaaagcatcacgttgtgagatagttttgtacttgatgtgacagcttttgtactttagttacagaaagcttcatactgaaagagcattgagtgtatggtgctgttttgttcgaatattctacgttagtcatttcaaaatcctatcggatcaccaattcaccatcctacttgacgtcggtaaagtagaaagaaaaagctttaggtcgagcgaacaatagaagaatgaatcaaaaatgaacgaatgaaatactgataatttgaatccctacataataataaaagtaaacaaatagatattttgtatgatatatttttttctgaaatgaattatgtgagaaaatacataattacatttactactatgactacttttagctctttaatacttactagttactgctatctataaaatatgagaaaagtaaaataaatgatatggacaatgagatccacatctgtttgcagataatatatgcttaaaaattttaatttcgaataatttctatatagttgacaaagaaaaaacaaagaataatatgcacatctgctgacgttttctttgtccatagagaatgaatttggaggacttgtctcaagtccatatctataaacttttcttaatatactgtaaactttgagaaagttagaagaataatagaataaaatattttcccttttatctgtaatatgtttccattcaaaactatagtgcggcgtttgattgtaagaaaattacgctatgtttcaatttaaattttggtgcttttctgatacagtcgatggttgatttaagaagcaacaagataatgcttcaaagcttcaaaaatttgacaacagtgaaacaaatcccaaagaaaacatccaaaattctcaatccaagatcctcacttcttctaagcaacaacactaggcctatatctagttccactatccataactcttagtataaaacaggctctagttcttgatttctcaaatttgactagtacataatcctacaactacgagtcacaaaactacagagactacattcataactctatcatgcttcattcttcagtacactgcctctcagttatagttgattcaacaatctctacactacaagcttcactgaagtaaatcttctgaaacaacaccaaaacttaacctttgactcaccacaagcccttttctgaaatttgttgttcaacctcacaggaaatgtttcgggagaaagatggttggtttgctgctaactgagaggaagtatcactataaagcatctcgaactagtccactaaacaaagctcaagctgaaatactataaaatctcaaaatacagagacatctctagcaatcaaaaactactagcatttggcaaattaaccattggagatagtaagccagagtctgtatgattaaatttcatacaaatctaactcttcctcaagactcacaaatacaaaaaaagaaagcagtttcagagacgtaataaagtcatgaatcacttgtggtcgtcttcatcgattgttccaaatttctgcttgaaagattcttgcttctgcagccacatcatgtgaccctggaacacgaattaattacagaaattagttcaaaatcaaagatttatgagcttcgaaaatttcaatgtaagaaaaccctagaatcaacaaattcattggaaatgcaaaaattgacctgaagaccagcagcccagacgatgatgaaggaagcaatccagaatctcttgtccttgacgatcgtcttcacatcgaatctcgtcgccattaaaccctttcgttaagcatcgaatttgctcaaaatcggctatttgagaattttgattcggattttgttttttctgtttacatccaaacttggttaacaaagttcgttaccaaactggcccaagcccaatcaaagcccaataatattttgtaaaacgctaacgaaaaattgaaactggaccagtctatgattccaatctatgaatccaaacaaaatggaccgatcacatatcacaaaaagtcataatatctggtctctgcgtttatatatccatgacaatctgacttcaaaaccaactttgaatattccgtatgaacatttggattcctccaaaatccggaaagatgttgaaatacgaatgaagacatcatatattatcatcataggacttttttttccttttcagtgtcatcataggatgtatgtacgtattagcttttatacaatacctaacaaaaagatatacaatattatatatatcaagaagtgtgtttaacaacaaaagtaacatgatcgacgccgagaatccagttttatgaaaatccaaatccgtacgtacctaaacgtacatttctttaaaacctctccatagcaaattcaaagcaatacctcacagtgaaataaccatg

SEQ ID NO: 11810 - DNA, 3000 bp, Unknown
  misc_feature (1)..( 3000): cDNA_ID_2707520_gDNA_ID_2214517_Annot_ID_184478 3000 nt of promoter + ATG
aaggatctctacctttgatcaagattcatgaacatttcaacttgaccaaggcggttttcgatgtaacacaaggcccaagctattacaacaacgcgttagacatcggtcctctctcgctgaccatcaagaattctcaatctcttacactatgcagatggatgttcgaggtaacaaagttagtctctaaattcttttgttctaagataattcgaaagttatatgttactatctttgttaataggaagtaatcaaaccgtccatatcatcatcttggagatcattccaattctacaagttacaagaattgcggtggatcgataactcgatgaaccaagaacaaattaattctttgatctcttttctcaaactttgtccatcaatagagcgcctcttcattactgtaagtgttacacacctaaaaccttgttactttgttagttcttgcgtcgtgctaatacctttatttattttgtaagatcgattcaaatacttatagttcaaacgaagaagttagtgttaatgctgaccatgcaagagtagtactaagggatctagaagtggtcaaattggaaggattcaagagtgaagaagataagaatcaactgatatttgctctacaagagatagtcagtatcgatcagcctctgcttgtactgtcttcaatttcttgacttcggcttggaatggaaacgacaaaagagttatgtctaaagatacacgtatgaacatgctttaattaacctgctgtcattttaacgcgtggatatattccatttcttgctatacaagaaatcctcgtgtaaacggaacttaaatttggctacgtcaagtttacagattaaagatttttcaccagtatgtattattgtaatgtacttactatgataaattacttaaaacaacatcaagttgattttcgcaagtatgtgtatatatataagggatccaaattctcgtacacacttgcaagttgcaacttaaacctataatgcccaaatatttggcttaggtgaagtatcgtttttaaaccatgtacgtgtcttcttctctttttttgacctgttcaacaaaagcatgcatgtgtggaaacttcagctgtcaacgaaagaaaagcgtgcatcaattcatcaaaaggtcattttaaatcgattaattaacgctaaaccaactaaaccattttgattacatcatcaagtttgctcgttggacttggttaaaatacaattgcctcggaaaatattgctaaggaattactttcttaaacttagtacaacttaattagttcgaaatgctctgagttctttttttaaagtaaatcaattacgtttagaaacaaaatgttatatatcatccaacggatgatgtgaagacacataacgtggacaaaacaatcactctaattaacaataattttgtggccaaaaatatactggacatttttacaccaaccccaaatggctcagacaggccttgtggtacaaaactttcaaatggacaccctaacaaagacttattcaagttccacgtgtaataaaacatgctgaaaaatgatatatagcacaagaatactcattactcacactattgcatggtacaacatatagtacaaatttagtttagaaatatcgatctatggacttctatattattatacaaacaattttactagactaaaatgacaagatctcagtcgtttttttaaacagactatctaagaagtgaccacattttatagtgacattcataagtccaccaagaactagtacaacctcactcaaaatcgaatctcttctatagcaatgaagtcaattgggctactgtcccgttgtggcccaatttaaagaaaaatagaagctatctcattgaatctgtcaacagtaaaactgttttgaaaacgtataatcccaactataaaggtcaagttccaaacaaattatatcatatgagcagttttgctaaagagagaaaaaaagtgtaagaatgagcaaaaagggaacagatcaaatgcactggcagaaaaagaagctccatgctgcctcaatcatacctgcccccactaggtatataagctaatctcacatgtggtaacactcttctcttctatcacccgcacctttcttctttctttgacagtgaaaatagaaagaaacaaagacagctgttgttgcattctccacggcacactaaccaacctcgcacatttctcaagtttcttacaatcttataactaatggtgattaatctttaactttgactaattactacataaaagtatttcatcaaacgaaactctcgtgatcatcattgtcatgggttggttagagcacgaatcatacaaggtttcaataatacagcaaaattggttaccaaaagattccgaaacagttcaatatttgtcgacaactaccttctgtatataaagtaatgacgcaaagacgttaataaatgttgcagtgcaataatctggtccggtctagtggtgtctagacccaacttatatcatttagtcaagtctcataatataatcgttgcataaatagacataaacgaagaatatctgaaacaaaaaaacaaaacttaaaactcgtcgccgtagttgaccgttactttttgatttttaattattatgaaatatcacattcaataattaaaactatgtgttaagaaaatttaattttatgtaagatgacacagaaatacacaaagacttgtctgtctttcacttttttagactctttgacccattttcttcataattcacgaaaacccaaaaattaaaaacaaaacaaaacaaaataaaatcaaaactaacaaaaaggaaaaaaaaaaaaaaaaaagtatctcaccggaaacgatttcttcgccgattccaagacttttcttcctaagctttttaacagatccggtgaaaatttcaaaatccgaagaattctctaaagctagggtttcttaattcacgagacggaggtgatataattcccccccgtcgtagctatgatg

SEQ ID NO: 11811 - DNA, 3000 bp, Unknown; identical to SEQ ID NO: 11795
  misc_feature (1)..( 3000): cDNA_ID_4262156_gDNA_ID_2214517_Annot_ID_184476 3000 nt of

SEQ ID NO: 11812 - DNA, 3000 bp, Unknown; identical to SEQ ID NO: 11794
  misc_feature (1)..( 3000): cDNA_ID_3023029_gDNA_ID_2214517_Annot_ID_184475 3000 nt of promoter + ATG

SEQ ID NO: 11813 - DNA, 3000 bp, Unknown
  misc_feature (1)..( 3000): cDNA_ID_3023033_gDNA_ID_2214517_Annot_ID_184474 3000 nt of promoter + ATG
tgtttcttaattcatgcagcttgcattatacacaatacggacatggtcaatgacggtcttggagaacgttaactctcttgttgggaaatcagctagaccagagtatctgcagaaactaacttacctgtgttggaaccaccataaagccattaggcacattgacacagtgagggcatacacatttggctctcattattttgtggaggttgatattgttctcccagctgacatgcctctgcaagtggctcacgacattggagaatcgctgcaagagaagctcgagctactagaggagatcgaacgggcttttgtgcatcttgattatgagtacactcacaaacctgagcacgctagatcccactgttagctgtttatcctttttaaagatctctacgtttctatatctttacaaattaatcttcactgtattgttgtttagtagacaattgtgagataaaggaatacctttgtaactatttacttttgttttgcgtgtttcatttagcaacaagattataacttctcttccagtctcaatgaataaagttgacatatgttagattagtctcaagcagaagacataatagaaaccacacaaattgcaaaaaaaaaccattagtagtttattctctgatccacatattcaaatggatgttgtcttgtgcagacgaggaggagtcctatttaccattattatctttctttctttttttgtgaaaagtgcaaacaaaaaaatgaaattcttgtcacttatggaggattattatattcgatccaaatcttactgggttagatgatgattgtggttaaaggcccattcgaggcccaacaaagtagtttgagtctcagctgcttcacctctccaggttcgtgtctcgattctgcaatctgtctctcgatatctccctacatttcttttgtccgatccttaactgattttcgttttcctgagacagatttctagtgtgaagaatcatttcgagccatgtctccggctaaaggtacgatcttttcattgataaccccttgaatctcactagaacgtgatggatttgaatcttctaccattagtctttagttttgatggagacgctatttaactggtctagattaatgttttcaatcatgtttcgttaggtgattagtttcaatatcgtcctcattagcttccactaagtgaggttaataaagttttcattttaattcgtttatatgtagtccttcaaattggtctatcttgatctgtacagaatctatttacaatcttcataattgatatctagttacagcagacaaggagagaaaaaccaacaactgattatctttctttcatttctcagtctcttcctttgaccaaaacattgaagaagctcattcagtgagtagtccaagacgagttttaagcttctcgaagagaaataagcaaaagcctggtttccaagatacagacagtagaaggtcatcttcatttagagcatcagaagtgcatggacctaaaccctcagaggtgtacggtttcgtaggatcgatatcgactgttgttgccacagtcatcttcttggtatgggcatatgttccagataagttgttggagtctataggaatccattactaccctagtaggtattgggtattggctatgccaacgtatttgatggtgactctgatgttagctttggctttttacattggtctcaacttcatcgccactccacccccaacctctctcaataccttgtttggtgagtgcccgcaccgctctttaatttcctctcatctgatgttattggagatatgagaaattgtttcctaaaaatctgttttctcaagtaagtgctcgctgtgtcattacaatagctagagctagaatgcttcgaaatgttggatctgcagggcgtggttttgggagtttgcttaggatgataattctagttatgtttgtttgtttggtatggcagatgagtacagtagagaacctggtgaatttgctgctgggatggaggaaggtgaagacaggcctatagatccaatctctgacattgatattacaagaataaatgatcttatgttcaattcaagtgattaaaatttcaaattctctagaggtagtaaccatattgactaagccattactctcattagtaaatggattcaggttttagtgactagtagagtgatcacgtgtaaaaggagattgtgattaatgattatctccagtccagtgatggatcctgcactatctttcttcttatatgtcaaccattaccagtagaaatcatcaagagaaactcaagtttggtaattgacccgtaaaacatgattatataaaaacttatgcatgcttttttttacaagcctggatgtccgaaaatgaagtacaataatctatcaagaaaaacactaaccataaaaaaaaaatgtgtttaagagaaataatttaaattgtttcagtataaatataagtaaatataatcaaacattcagtgaaaaaaaaaaaaaaatcaaacattcagaccattttagaacccaccttgggaaaaccacaaattagcagttttctctcagagaccaattctctcaatctccgtcgtgcgcttttgcttgattttgtaatgtaagacttgtgtttggcattttgtgatttccgttttatttgcttcttcttctctactcttctgtattggtagagtttaattctcgtcaccaaattttcgagttttgttcgaactaaaactcaaaatctgggactggagggatatttctctcctgggttcatttgactatgatcttcgaggtagcaaaattgatactttatggattgatataacagagaatcaaattttggtagattaggttattttctactgttataagacgattgctcataccaatttgactagtgttttatgggtttgggatttaaccattgtccaaattgttaactttggctaattatggtatagaaggaatctgaggaattgatacaagtgggctctgatg

SEQ ID NO: 11814 - DNA, 3000 bp, Unknown
  misc_feature (1)..( 3000): cDNA_ID_3023037_gDNA_ID_2214517_Annot_ID_184472 3000 nt of promoter + ATG
gttatttcgatattaacaaagcttatttcgattatacccaaatggaaaatcattcctagtcaagatatcatcgagatttcatataaagagccagaaattagaaaacaggtatgtttctatataacatttagtaatcaaaaatgattagtttatcaaaaatctgtgtaagaaactgatcaatatgcttgatttaatttttgtacattttgctatatacgactaattaaggttagagaaaatcctttatgctcgaaaggacgaccacgcttgaaaactgcgtatgagctcttaaggatcagcaacgacttggagaagagacttcaagaggtaaattataagtgattacatatatatatatatatccaagatttccataaatgcatatgatattcagattggactcaaatagtggtaattaagattctaacgttagattttttttgtctctgtaaaatataaatcatccgatcgagaactaatgcacataatgatgataataggtttcattgccgtttttggtattacacggagatgatgataaagtaacagataaagcagtgagccaagaactgtacaaggttgcgttgagcgctgacaagaccttaaagttgtaccctgggatgtggcacggtttgctcaccggcgagacaccagagaacatcgaaattgtctttgccgacgtcatcagttggttggaaaaaagaagtgattatggaaatgataggtttgagtcagagcttaaacagcgtaatgatcgtttaaatttcaagaaatagtcgtttgacttattttttacacataaaagtgttttaatgaaattctggtgttttgcattttgatgtttaacgttgctattgtgaattgtactatatattttaagaaaacttatactatagtccaataatatttcctaaatagtccaacaaaataaagaaaaagttttcatcatctagtatgattttaaaatgagatttgatataacatagccaataagactccagaggaaactctctgattcggcttggtttggctaatgtttttagacgcaacgatttacttagatctagaaccatcagattaacaacataaaacaactttaagctttcgagaaacggaaaaccacaaagattcttagcaaagaattcatcaatgtaaagaacattgtctaaaatattttggtatagaggtgaaaactcataatcttgggaagcttgtatcgagctagggttttgtttatcgtatcagccttcagtcccctatacaaagttcctggtccatcaaagtatatgtaaggtgtgtcagaccatacatgcctccatcgtgtggacaagactgaagttctgatagctaaattggtcggaagagaggagaggatttgttggaggatcacatcaggaagcgagctgattgagtctatattttcacttgcatctcttgctagtttgacatctctgtagtgatgatgagcgtagcagtcaccggcggtggcaccgtctccgtttccgccgtcgtctgcctctgccattacgttatcaaccaccgattgtaaacctagatatttgtttgcaatgacatagctttttgagtttttgggtttatcacaaagcccagctatatatatccaaaatattttaaaaagcccattactaaacacgcacaacttttttcttgtccggaactcaaaatatgtatgtacttaacaacttaatctgtgaaaaaaaaaaaaaaaaaatgtactaccaacttagtcatgttgatgtgatcatcttcttcttggattgatattactagttgcagaaagtgacaatttgatctattagaaaataattgcttatactacacatttgttttctttcgtaacagattggtgggatctttaagaatgtatcgtcatgattctgattttatagaagaacaactttatttaagatgtgcttacatattctgcgaaaaaaccggcatgttgaatggttttagtctctctgaaccgacaacaagttttgtaatttttaattttatcttacagtcgtcacttgaatcttgatcgccaatttttacatacttgagaagaaaaatatttaaaaagccaaccgatttattcgtcaaagcctcaaaggctacagatttttttagccaacgagcaaatgatatgcacacgcggatatgggggatccaaaaattaaaatatttgttggtgtaactttgaagcattgacttaaaaaatagtggttttatcatatgaaattaaacacttaaaaatttttgtggaagttgatacgggatcacaattttacaaaaacaaatagttagtcaacggagtataacttagttttacgtctaatattgttagagttgacattttataacatgttaagtagtagaaattgtagatttgactttctagattcttcatttgatggttcttatgatcgttcgtttataaatttgtactacagaaacgattaatctaacattattttacgatgaagaactaaaatttgaacatatagtgtcactaggaaaaaagattgattttcaccttaacatctccaaacgtagtaagtagatgtgagtttgatttgctaaatcctaaatgaaaaaaaactaacaaaacacagtcaaacgtgaaagaatttttgagggggtgtttctgataaatttacgacttaaggtactagtttaatgttattttgaaagtttagggggtggttttgaaacgtcgccaaacttgaattgccacttgtcagggaatattttatcattttaaaaagaagtaacaaaaaaaacgtgttgccgtgtagaggggtgcgaggagaatctgttaaatcgtcgctatcaaacaagaaacggtgtcgcattatcgtatagtcctcttcctcaaaatcctacccaatataaacagagccgtacaacaaaaaactcgatatcttatcaaaaactcgctctccatccaacaaaacccgaagaaagagagattcagactcaaatctctcagtagga

SEQ ID NO: 11815 - DNA, 3000 bp, Unknown
  misc_feature (1)..( 3000): cDNA_ID_2707494_gDNA_ID_2214517_Annot_ID_133984 3000 nt of promoter + ATG
gaattctcaacgacgacgccgttttaatcgaaccgggaaaaatctccggagatcccaccgtcgttaccgtcaattgtcctgatgaatccggtctcggttcaactctgtgtagaatcatcctcgaatttggtctctccattacccgagcaggtcaatattcaattttacttcgtatctgtttaggggaatattctctgtttgtcgtttagcttcacggaatattcttctttatgattcgaaaaattcaattctgtttttcttattttgagggtaattaatatgtttgtaaaaatggtgtttgcagatttttcaacagatggaagatggtgttatatagtgttttgggttactccagatattagctctcctaaaattgattgggacagcttaaagaatcgtcttttatcagcttgtccttcttgcttaggctctttctacttctgccttcaatccaatgtctctaagcctccttccctttatcttctcaagttcttttgccgtgataggaaaggattgcttcatggtatgtgtaaagttattgtcttttgtcttgtgcttggtgttttctttatatggttgattaaaagtttgtgtttttttggtgattcgtagatgttactaaagttttgacagagctagagtttacaatacaaagagtcaaagtcatgacaacaccagatggaagagttttggatatgtttttcatcactgacgcaatgtgagttttcttcttctttctaattctgatgtttcatttgagagaagaaccaacattaacgttgtggtttgtgactttgtgtaacagggatctattgcacacgaaacagagacaaaccaaaacgtgtgaccatctaacggctgtgcttggtgagcatggtgtgagttgtgagcttgaactagctgggcctgagttagagagtgtgcaacgattctcttcacttccacctttggctgctgatgagctgtttggcccagatgggtttgatattagcggctctagctctaacaaagcggttcttaccgttgataatcagttgagccctgcacatacgttgcttcagattcgttgtgttgatcaaaagggacttttctatgatatcctcaggacttccaaagactgcgatgtccacgtacgttaaaactgatctctctaacattaagagaacctaaccttacctctgctaagagaagttgggacttctatggttgaaagatttgtataactcaagtagttcttgtttctttatccagattgcatacggtaggttctcctccaaggttaaaggttataggaatttggagttgtttgttagaggcacagacgggaataaaataatggacccaaaacatcaagccaacttctgtgctcgacttaaggaggaaatggtgtgtcctttgcgagtgattatcgtgaaccgaggaccagatactgagctattagtagccaaccctgtggaactatccggaaaaggaagaccacgagttttctacgatgtcacacttgcgttgaaatcactaggaatctgcatcttctccgtaagtactgtataataatacattgtgttctctaagctttttgaacggttattttcggtttgttttaagattggcattgcgttttcttgtaggctgagattgggagacattcgactttagatcgacaatgggaagtttatagatttcttttggatgagagtcgtgaattcccattggctagcctccgtgcgagaaatcaagtagtagatagagtcacaaagacacttatgggttggtgaagcggatgagagtgagctttcatgaacgttatgctacactcaaggggacaaagaaacaaagtcttcttcgcttgcggcttcgggtcgatgaaaagagtgatgcaagggggttgtgattgctgttgtgtggagctaatagcgttgtaaagctttggaaattgtaaaaggattatataaccgcaattgcaatgaatgcttgtaaactcactttgcaaaggtaacatttccgttgactaggtggtcactacaagagagcgacagagttgacccgagccagaatcgcaaacatgttacatttagccatgtagtggcctttgggggataatatggtaattagacaaattgtatcgaaatatatttagagtgttgccatcaaagatctctgtgtttttgaattctttttaatcatatactgaaatttgttttagttgtcatcaatatattcatctactactgtactaatccctttataattgagtttatataacgaagaaaaaggagatatagatgcattgacaagtccataattatgtttagttgtttaccattggatctgaaatagattcgaaaaattaaacggttaagaaaaaggaaacgcgttaattaaaaataaaaaaacgaagcggtagggttaatttcgtcgtttcgttatccgttgtcgctcgctcgtgcttcatcggcggctagtaatccagtgcagcagaggtcctcctatcttaacgaaagctgtgattctccttcgtctttcaatatcattcttaggtttttgaaattcatgtgtcgtaagaaccgaggaagatgacgacaccaatcaccgggaaaaactctcctgttaccggaaaagaagaaggcgaactatctacctccgacgacgaagtatcaattctcgctactataacttatattttctgctattgattttcacagtctgcgaatctggattctgttgcaccctgaacatatcaactgatctctctcgatttgtgtggtttttgagatctgcctgtgttcaatttgtatgggtttatagatttggggtataaattgtgttagttcagagactagagcttatttcttagtgattgttcgttgattatttgatttcaaagctttcgtgttgcattaattgcggcaatccactgtttccagaatgttttattattattgattagcagatttcaaaaccctaaaatttcaacgattttgtttttcttaggtacaacca

SEQ ID NO: 11816 - DNA, 3000 bp, Unknown
  misc_feature (1)..( 3000): cDNA_ID_2707490_gDNA_ID_2214517_Annot_ID_133985 3000 nt of promoter + ATG
ggatacacgagagccggtttgcacagagaagctctcggattcttcgggtatatgtcggaggagaaaggtattgatccagacaagtacagtttcacttttgctttgaaggcttgtgccggatctatggactttaagaagggtttacggatacatgatttgattgctgagatgggtcttgagtctgatgtttatataggaactgcgttagttgaaatgtattgtaaagctcgtgacttggtttctgcaagacaagtgttcgataaaatgcatgtgaaggatgttgttacttggaacactatggtttccgggttggctcaaaatggatgttctagtgcagctttgctgttgtttcatgatatgcgttcgtgttgtgttgacattgatcatgttagtttatataatctgatccctgcggtttcgaagctagagaagagtgatgtctgtagatgtcttcacggacttgtgattaagaaaggttttatctttgctttctctagtgggctgattgacatgtattgcaactgcgcggatttatatgctgctgaatctgtttttgaagaagtgtggaggaaggatgagtcttcatggggtacaatgatggcagcttatgcacataatgggttctttgaggaggtattggagttgtttgaccttatgagaaactatgatgttagaatgaataaggtagctgcagcaagtgctcttcaagctgctgcatatgtaggggatttagtgaaggggattgcaattcatgattacgcagtgcaacaaggattgatcggtgatgtctcagttgctacttctcttatgagtatgtattccaaatgtggtgagttggagatagccgaacaactgttcattaatattgaagatagagatgttgtttcttggtctgccatgattgcgtcgtatgagcaagcagggcaacacgatgaggctatctctttgtttagagatatgatgagaatacatatcaagcctaatgctgtaactttgactagtgtgctacaagggtgtgcaggagtagccgcctctagattgggtaagagcatacattgttatgctataaaggctgatattgagtctgagttggaaactgccacagctgttatttcaatgtacgctaaatgtggtcgattttctcccgcgctcaaagcctttgaaagactgccaattaaagatgctgtggcattcaacgctctagcgcaagggtatactcagattggtgatgccaataaagcatttgatgtgtacaagaacatgaagttacatggtgtatgcccagactcaagaactatggttggtatgcttcaaacttgtgccttctgtagtgactatgctcgaggttcttgtgtttatggacaaattataaagcatgggttcgattcagaatgtcacgtggcacatgctcttatcaatatgttcaccaaatgtgatgccctcgctgcagcgatagttttgtttgacaagtgtggattcgagaaaagtactgtatcttggaatataatgatgaacgggtacttactccatggccaggctgaagaagctgttgccacttttcgtcagatgaaggttgagaaatttcagccaaatgcagtcacttttgttaacatagtacgcgcagcagcagaattatcagccttgagagtaggaatgtcggttcattccagtctcattcagtgtggattttgttcccaaacaccagtaggaaacagccttgttgacatgtatgcgaaatgtggaatgatagaatcttccgagaaatgctttattgagataagcaacaaatacatagtttcatggaacactatgctatccgcttacgcagcccacggtctagcaagctgtgcggtctcacttttcttgtccatgcaagaaaacgaactcaaaccagactctgtttcctttctcagtgttctttcagcttgtagacacgcagggttagtcgaagaaggaaaacgaattttcgaggaaatgggagagagacacaagatcgaagcagaagttgaacattacgcgtgtatggtagatctattagggaaggctggtttgtttggtgaagctgtggaaatgatgagaagaatgagagtgaaaacaagtgtaggagtatggggagctttattaaattcttcaagaatgcattgtaatttgtggttaagcaatgctgcattgtgtcagcttgttaaacttgagccactaaatccttctcattatagtcaagatcggagattaggagaggtcaataatgtatcaagaattaagaaagttcctgcttgtagttggatagaagtctgagaatactcaattcttttgattcttcttctctatcttttactgtatcaaaaaatctttctaagtataattgaaattgtgagaaatattggaaaatctgttgaaatctctgttaagagacaaaaaataaagagcccaaccggattcgaaccggtgacctattgatctgcagtcaattgctctaccactgagctataggctcttcttgactttagtgtatgctaactaatagaaatactaaacttgcatgatagaacattattttacttaaaacagaattttggagaaacataattgttaagttatatataagtagtatacactaaagtcaataagagcctatagctcagtggtagagcaattgactgcagatcaataggtcaccggttcgaatccggttgggctcttaattttttttttttaagcccagtaaaaactgggtttcgtagtaaatgggaacgtacatagaagagagattagggttgtgctatatattctccgttaaaaaaaccctagttttaaaaccttctgaaccctagccagaatacgtaagtaacttttgtgagtttttgtctgcgtgagaattttaacgtttgttgtaatctagttgaaattgaaatcggcaggtaacaaaaagtctgaatttatgattcttttatgacacaacacacaagtcatgaaacttatgaggcaattcttatatttatg

SEQ ID NO: 11817 - DNA, 1771 bp, Unknown
  misc_feature (1)..( 1771): cDNA_ID_3023131_gDNA_ID_2214518_Annot_ID_133987 3000 nt of promoter + ATG
ccagatgaagctggcagaagatgtgtctaagaagtttgaaatcgttagagcaagaaatgaagagctcaagaaagaaatggaatcgcagaccgctagtagccaagtgaagtttgctgaaaactcggaaaagctggaagagaagataaggctccttgagatgaataaaaaaacagccatggactggaaatctcgtactgatgatctgactcaacagttacaagaagcgcaattagtcgctgaaggtttgaagaaacaagtgcatgagctttcactttcccagaaatccatcaagactcactctatttctcctcagaaagtcagagacctggaaaaggctgaaatgaggcttttgaaaaaaaagatgaagtttgagagaaattgtgcaaaacactcccaaacagtggctaaatttgaaaagtttcgaagggaatttcagtgcgaagagctaggtcggttgaaactggagttcggtagtcttacgaatcgcatgaatctactggatgagtatttttcaacagacgttgaaggtacagctggccttggaaaggtttgtttctgccatagtttttgtacactttgtctccttatcgttatttgaaaattggcttgatgaccatagacatgttatgaaatttgatacatagaaggtgaatctgactatagaagatgacaacccaaaaaaatgttttaatatttggaatagtgacctttatcttaacatggtttatttacagcatcataccacttttatacgttgctgtttttgattattttaattcctttttagtctccttatgctcatcttattgctatgcaggctacaggatgcaggaaactgctgacgctaaattcacagaagaaccgtaatggtgaaaagcattctgacgcaagatgcaaattggtagccagctcaggttatcaggagcaggcttgcaagttgtctgcccacttaatttctaaatctggacggggcgtgagtgagtctgtctcaggtactatttctcaattggagtctcctactggaggctctagaaaattaccgagttctggagtaatttccagcgcaacatctttttctgatgggcagttactggcatcacagggaagagagcagttctctgttactacttcagcagaaatagcaaaagataaaccgaatatccaaccaacaaaatcaagtatgctccaaaagatctccgataccagtaaaaatggaaatctctgtttggtggcagaaaactatcttcaaaggtgtcagagagatattcatgagaactctcggaaaagaaaaagaatgttagaggcagttgtgtcccataagcatctggcatctggtgataaaaagaaaaatttgccgattggagagaagatgggcaccttgcagtccatgattgtaggaactgggtctaggccttcagaaaaggaagaaaccttggtcccccctgataggcaaggtggctcctccgcaattgacattacagtttccaagaaaagaagggtttcttgtaagaagaagataattgtacagaattctcttgagttcaaccagtcaggcaagactccaggtaatatagctgggaaaactacgtgtctctctactgctactggacatgacgtgaaaacattattttcggaggactttgctgctacagattatatgaagttgctagagttggataacttggaagaagaaaattattaccagatggctagagaatcgcttctgtcccctgatcttcctcaggtagattttttgggttgtgagatcatg

SEQ ID NO: 11818 - DNA, 3000 bp, Unknown
  misc_feature (1)..( 3000): cDNA_ID_2707619_gDNA_ID_2214518_Annot_ID_133988 3000 nt of promoter + ATG
cccaaaaaaaaaatgtcgttaccattttctttcaaaaacttacttaaattatatacattttcgtatggttgaataaggagcaaatattgaccagtcataccgattataaatcttctcagaagataaagagacatagtggtattaattcttctttgtcatttccagttttttttacaacatagctgaacaaacagtgtgtgtaagcgtttagttattattgcaatagaaaaattgaaagcagagaaggtggtaggtgtgtaattgtaattggtcgctaatattctataaataaaaattaagatcaagcttttagagaatattttatttcaaatatcatagattttacataaagttggtagacttatttttttttctttttgagtttgtttcaaattatacatatgctcattcaattattatggaggctctctgcgcgtacaaaacgaaaaagacccatataaaataatataagtggttttcctggactttctgtaatgatcaagtccaaatgttactatttttgattcattatttcacatgatttttttttttcgcgagcgtagtttattttttctacattttttccttcaattctgtccaaattaattttagggtccttcatgaatcacacattcacaccctatgaatttgacacatttttcttttttttgaaaatcttgtgcttttgcacatctcagacatgatacatgatacatccttaggagttagggctggtccagactatatcatgataataacatagttatgataatgcgaatgtgaatgttcgaccattagcattttttcccactcaagtgtaataatgaacgggcacaatcccaagttgatccctatcatttatgcttataaaatttcatcaaatatcaaggcaaagcatgcaataaataagtgaaacatattacggaaaatttagtaattagtgattttatggttagcattaggattcaaaatatcctaatgcaaaacggacggacgacccgtttggtgaaaagtgcagtaaattagtgattttgactttgaccgggatggaaaattgttggtgtctttagttgatttttcaatttcattttacactagagtcaaaatagcactgaatttttttttaaagcaaaaattaaatatgaacagtgtacactttttagtttttacataagatattatataaagttgaataatattatgcggaatttggaaagaatctgtttagtagacttttagttttggttcaacttttcttttttcgtctatatagtcattagatatatttgattcaattttattatatgtgtgtatagcgtgtgtgcatattgaaactttgaagcaagtttgagtctttagacaatctcactttgttgcttttaagctatacatagctcagagtctcagaataccatcaatcacaccactttctgcaataattcgttaacctaaatcgaaaccaaaagtaaaataaagatggttgttttgattctagcgaggatgaaactgagaccaatcacattttacatgtattaagaaactaaaaatatttataggtcatcaatggttatcgattttaatatagttttaagattataatttttggtttttgaattttagattttgggttttagattttccaaaaataaagatatatataaaaaaaaataggaagaaaaagtcacgttaatattgttaaggaaaagcgaaaaactcaatttgaaaactcaattttgctattttttactattcataatactcatcaattttttaaaaaaatgagtgtgtaaaaaatataagtagaaaagtcaaaacggcattaatctactaaaactcacttttagcatccgtaattattttacgaaaacttaatttagttcagttttttctgctaaagttattcaattaattattttgtgatttttgtgtcataccaatcaagaccaaaaacaatataaaaattagtaaatattcaagtccgtaatttttgaaatagaaatatttatattacacttactcttttggttcgtcaatattgtcgaggtaataaagcgtagggtataatgtatgtgtagattttttgattgcctagtcaaagggtaaccggttaacaaggaagattattagttactacaattctaggacaggagagaatgtatttaggcttcacgccacaactactgaagatagtggtgtcgctatctttagatgtgataaacataaagtcgtgtcggtatccttgaaaagttgaaattagtgcgtattagcattgtttatccctaaaggcacatatatattgttccttactttcaaacgacatatatttcttcagaaccttttgctataatatgtctgaataatcattacaatatagtatatacacacaaaacttattgatactatgcattctctttggctatgttggaaaattcacttgcatgacttgtataaacttctaagttatgcatgcgttttaaataatcaagttactactataaattaagatacaggtatgtatagcaattaattaaaaactaattaatacagtttagtaatgaataatgatataaacattatacagtacagtgtcgctgtttcagtaatgatataatattcacatcagatttacatgtaaagattcagatcatagcaaattagcaatgaagtaaaggacaatgcaagaaattgaccaaattacttgaatattctaataattcatttcttttctttttttggttggcgaaacatatatatttggttacgttatatgcttaagggatatactgcttatttttcaagtaatcaaaatataaagatagaattatagtaaggagataaaagttgagattttagtaatagaataaaaatagtaatgaagtaatatttacaccaactttacgtgtaagccatccccacacacacatcaacctcctatataaacctaaacacatacctcaaacaaccaaaagcaaaaacctcatcgacataaaaagaaaaatg

SEQ ID NO: 11819 - DNA, 3000 bp, Unknown
  misc_feature (1)..( 3000): cDNA_ID_2991587_gDNA_ID_2214518_Annot_ID_133993 3000 nt of promoter + ATG
caaaaacaaaaattgacattttttttcttcaaaggatcagaaacattttttttgttgttgctaaaaatgtaaatatttcatagaaaaaatatatattaggtttatgatcgatcattttcaacctagacaaatgaacaaaaaacactatcgaaatgcctagatttgcaatgtgaaaaaatggtcggcttcatgacaaacacttagatccacgttggtgcattacaacctcatcactactacatatcttttatcccatattatatttctctctcttttgtttttccttttatcaaattatatagggtctcaattaaatatccattcagtttgcgacgttgcgtgtgttaaacagatacaaaatcgacgtattaatatacacccagatttatgcatttcgacatataaaacacaaaaattcactttccttggaaagtttggaggttggatcaagtttataagtgaccgtctccaacaaggcaacaactcaagttcttagtagaaaaaacactgcacatacatctggatcggtaatccatttggatgattttattccaaaaagaaaacccaattacaatattttttttgaagtctagatctagaaatatctttgctattacatattcctctatatatatctatgttttaattcctctacaaacaattttttttttgtcaaagctctacaaaacatttctgtttttactttttaaattggaagtcaaaaatatctttgttcaacgtttcttttatatgtagaatgtagactgtagttctctcacttcccggccatttggcttcttttagtattttatcaaaggagataaagaaaaataaaatcgcgacccatatgatatgaagcaggcctcgtctctaatggccacgcagattcattttaatatgaaacggcatgaacttatatattgtttactacaataattagaccatacggtgcaaaaattaaaacaaaataagtcatgcatccctcgttctacggtgacgcatgttgatgaacggattctataaaaatagtaatatttaatatctgttatccagtcagatatatttaaaacaatataagaatttaaattgacaaagaaagataaatctgattaaccacggaatatgtgtgtttagattggtaacgtatgattagacacatcaatgctatttaaaagatgcatatgatgataacttttagaagtgagaaggcctttggattattagggattacaaatagtaaacttattatagattacttgagaaaagagattcattaaaacaaaatttgcataaagtaagaaccaaactagaggagcttattccaagaagatgcattttacatttaaaaggtgcatgtaattaatgtctgataaccataactcattaattattctaattcagctaaaagcgagcctaaacccattacacagagaattgcacgaatcacaagtacacaaattgatagaacatttagactttagaggttgatattttttgataaactatagtattgatttatgttattaattgggttgtgtagcacgaggacttctttgaacatgtgaaatgaatattgactttacgtaaaatcgaccatgccctttaagtgttcctcaagttcatacaaaaacaacagtcatactcttatatgtatattataacatgatttaaatttgaactatgtttatttaactatatcctatatataattattacgattgagagatgagaaagtttgttacagatgaagaagaagatattttccccttaaatttctgtaaatgtattttgtacaagtatatatacgatgacaatacaaccggttaatataacccgcgtaatacaaaatcaattaaaccgataaattaaatcaacactctctgatatgacccctcaatatgaggattcgaaaatgttgagaatgctcatcttggactttagatgttcaaactgatgtgagaacaaatgtttagcaaaatatcagctatttgatcatccgtgggaacatgaagcagtttaagctcaccatcatccaacttgtcacgcacggtatggcagtcaatctcaatatatttcgtgctctcatggaagatataattgattgcaatatagataacatctgtactgtctgaaaacaagataagaatcgaagtagtatccgtttaagatacgagcaatgtatgcaaccaaaccaactcacaagtagcaagagctaatgctcagtatctagaaataacatgttgcttcttagatcgacatgagatgatttatgaagaaatttgagctttgatggctctaataccatattacgatcgagagataagaaagtttgttacagatgaagaagaagatattttctgattaaatttccgtaaatgtattttgtacaagtatatatacaatgactattcaaccgattaacatcaccgtaatacaaaatcatctagaccgataaaactaacctaacacattctgataataacaaatatgaatttattgattttcttttaattaagaatagctcgttcaaccaaatgttgacatcttttttttttttgaacactaccaaatgtagacatctagtacactaattcaaccatgtctgtcgtctaatactatttcgagtagtgtgtgatatgcttaatatataaaaaaaacttgttcacgtttctgattttaaaacatagactgaccaaaagctcacaacacacaactagatataaagcccaggagtcaaacaaagaacctgattcgttattttgccgcacaaggcccaaatcaaattagtgatgttacttgaacagttcaaaaagaactgggattattatgcattcagtttataacttaaggggttattatgttattaacccgtttactttcgtttggattttggaattagacgcgaagctgtgaaatctagaagaagaagaagaagaagaagaagaagaagaagaagaagaagaagaagaagaagaagaagaagaagaagaagaagaagca

SEQ ID NO: 11820 - DNA, 3000 bp, Unknown
  misc_feature (1)..( 3000): cDNA_ID_2707609_gDNA_ID_2214518_Annot_ID_133995 3000 nt of promoter + ATG
agcaagcaccagagatccgtccatgctcactgagttcaggtcttggagcttcacctagtctaccctcaggatcagacccaatcacattgaaatatctgaagaaaaccaatttgaagacagaatgaactcaacttcagggcaagagaaaacaaacacagaggtcacacacacacacacataacagaattaactaacaaccttaggatcataactgccataatagaattcttggagaaatccaagatgatatcttctgccatctttttagcctttccatatggattgattggaacctgtggagtttcctctgttattggcattttctcaggctctccataagtagcacatgtgcttgaatatatcaaagtcttcacaccatgagcagccattgtctctaaaactaccaatgtgttcgatgtgatattgtgataatacttgcaaatgacagaacacaaaatattatttacatcaatcttacagcaaaggttaaatcattttgagaaggaacaaaaatactcacttgagaggaaactgtgtgctttctccaacataagcaacagcagcaaaatgcatcacagcgtcaaatgcgttttcagaaaatattttgttaacctgaaagaatttcttatcaagaaaacacacacaaaaaagcttgtctgtgtgtttatggtggtcttatatctaaaatcacaatgaaggatcatacagcatttgcatctccaagatcagcataaatgaattgaagctttccaggttccggaaacagttgttgcaagatcttgactgcaccgaggttccctcgagatagattgtcctgccaaaacatgaaaagatttacttctttacttagatacaacacgagaagcatgaatctatgtaaggcaatggagatgtatgtataccacaatggtgacacggtatgaatcttttagaaggcgtaaagctgcatgtgacccgatataccctgcaccaccagtgactagaacatgtgtaactcctggttcacttcgagaaaactgaaagatgaagaaaacattactactacaaaaatgagacactgtatcaatatcaagttaagtacatataagaagtaataccacgcttggggtattgaaggttggggattggttgagcaagagaatgcacattgctgtaagtgtcatgaccaaaacaatcttccccatgtaattgttgttcttctttgggtctgcaaaatccaatcctacactccaaaaatcatcaacatgtgtgaaattttgaatccaaataagaaacacaagaaaagcttatgactttggagctaactaataagcccccagaaaatctaaaatctctatcaacttaccaaccacttctaaacaagtaagcaaaatatttcagacaaataaaaaaaaacagtagaaaaatcaggttttatcataaaagtctaaaagatattcctgtgtgtaccttcaaaagacatagatctgttttgcctcccggttctagctctgcctaaattcagcattttgattctgaaagtacacggcgtagtccagtttcagctgtaagagattaacaactcgaaatatttagaaaactcgcacctgcaaaaacctcagtaactccagtttgggtgggaacatgtaggtctttcaaataaaaatgaaaatgcagaattcacaccgacacagaatttcacaacaacaaaaaggccaaagttcagcctgtacatgaggaaacagaagaaaactgtagaaagcaaaaatgttgtataatctggacttgaccaagaatctctcttctatagtaagaaagattcgatctcaattctaagtggaaaaggttagaacgacttacgtacaaaggaggaaagtaaagagagtggtcttgacggtgaaagcgagcgaagggaacacgagacacgagacaagagaagagctataaagttgaattaaatgattactttattgagatttttagacacaagtaacgaatgaaattgcaacaagtattataagggacgcggtgattggaacgagggagctccggcacctgtgcgtaccgacgaactctctgctgcacatgtcggcaaaagtctctacgtggcttttactttatggccaaaacttgactacctcttgaccaacatattatagtacaacaaaaatttacggaaaatattagtataatgaatgataagcaaaacaaaatctattgtttttggttgtaatatttgtaaatgatttttagatagttcgataatttgctagttataattagaaaaatttcgaatagagttataaagagtagacctttttgtatatagtaataaaaataattggctataaactatgttgacttcataacattactacgtcttcttaaaaacaaaaacatgactacatcttgatcaagaaaattaaagcaaccgacagttccatgcacattgactttactagatctcgagaccatttattcctcagttgtatagatttgtttatcttttttgaatttaatgttagaaaaaaaagaagagaaattgctttcattgagagttgaactcaagacctcctgcatactatatatttgtttatcaaatatacattcattgattaaactaatttcatatatcataaaatttgaatcgtacaaagatcaccacaagtcagaagactaataaaacaccactaacctgaacaagcacatgttctttgtattaaaaatgtgagagaataattcatcatgaaaaagtcataatcaaagtcaaagcctaaccctttttaagtcttttcggggccgtcttggagcaggcctaacaggctagcggccttttaagacttactctactacatttagaggtcaagttataatggatcaaaaattgaaattgaagagaaaatgtaccaatctaataaactaatcaaactatgtgtaccaaaacgtaaatatcagaaacatcctatagatggttcgggtcctctggttcgccagtaaaattatgaccgcagactgaaaaaa

SEQ ID NO: 11821 - DNA, 3000 bp, Unknown
  misc_feature (1)..( 3000): cDNA_ID_2707601_gDNA_ID_2214518_Annot_ID_133998 3000 nt of promoter + ATG
aagatgtttatgtgatggctgaatctcttctggagaaatttgaggagaaatggctcctgataatgcctaaacttgtggaggaggtacaccaaatgttcagtttccaagtattcgtctttgtaatatcagtgatgtgttaactgtgatgttatgaacaggaaaagaaacaagtagacgaagaagcggagaagcatgccaataagcagcttacaatggaggctgcacaagcggaaatggctagggatttaagcaacgaagtaagcaaatgcaaaaccaattatcagctgttgatctatttcatttcaggccatttattatagctgtgggttgatgagtttgctttgtacgtatctttagctatatgagattgatctgcagctggagaaactccgggaatcagtagttcagagatgcaggtataaataacctcttctgttgatcatttttacccttaatgaagggttcgtaaccgagtttttggtgtggttttggaaataaacagaaaactgtccactcaagaaaagaaaggactttctgcagctctaggtcgtctctcacctgaggatctgtctaaggcgttaaaaatggtttcagagagcaacccgagtttcccggctggagcaccagaagtcgagcttgacattgatgttcaggtcaacaccaaaatcttccttatttctttgtggttttgcatcagatattcaggttttaacggtttcctctcttgtttgtgaacagactgacgttacattgtggagactgaaggtgtttgtgcaagaagcattgaaagcagctaacaaaagctctggaggaacaaacgctcaaaacaataacaatactggaactggagagatcaacaagaacaatgcaaaaagacggagagagatctctgatgcaatcaataaagcttcaattaaaagagctaagaaagcttgaatctctctctatctcttgatgtgtttattgatacagaaggaacaagagtttggtgaacaccaatctaaattagaaactttccagttccattgcgcatgttgcttcaaatgttgagcacaatgtaaaaaagaatgaatgggaaaaaaatctgagctatagaggagatataaagaagactgcttgagggagaaattctgacaaatcttctaataaaatcttcagtttgagagatctttggtgtgttgaacgtttcttcgatttcattaccttaaacctcggcacttataatttaaaatcaatttttaaaaatgataatatgatgttttgacccaaaaaaataattaaaaaaaatgataatatgatgtagggatttgaaaactaataacatacgtgaatctacaaacatataattttttagtactaaagagtatgaccacatgcttcattctactgcaatatgaacacaaatatgtccaaacaccaaaccaatgagataatatgggaaatttgctaaacttcaaacatgacatttaacaacctattcacttgtttttgaagatttcgatttttttttacaaatttgatagtatatgaaagatatgtgcaattgtaagacgatacaaaaacaagcaagagaagatcaaggaacgatttattcaagaatgccaataggctatgagtaatcttagctataaagtgaaaacaaggtttacttttgggcctttagctcaatgtctatttcaccatagattaatctttgcccaaacatggaataacaccaacaagtatggggtgcaaatagttgtacatttagatgaaaaaagtatgttaaacaaaattggcatctatttgtcaccatatgttcaacactttcatctttctcaactcagattgtttccaatcattcatctacgcacaatcatttgcacccataatctactttcatggtcgaataactttttttgtagttcccaatagcttacatcaagagtttccaaagggcgattgaaagtgtcgaaacgatgggacattacataatagtttgtgctatcgtagtttctatctttagcacaaactttccgagaactttctatggttctatctttaggttttaaaaatttaagatgacaaaaatgataactagatatttaatataaaaaaggcaaaagtgttaaacacatgtctggttggccattcttctcaaatccaccatcattatatatgttgtagatatttatttcataaaaggtctaatactttagaatagatatacaaacatcattaaaaagatattttaatgcaaataactatatggcttaagaaaatcttaataaacttgaaagttgctggtgacacatcaacaacactattataaacactacaaaatgtgataaaaaacaaaatagactaaacataaactcgaacgacgcgtgggttattttctagtatatatagttaattatcataaaaagataatttaatggtttaatacaaataaccatattgcttaagaaaatcttaatcaccatagaaagtagttatattcttacattaattttaaatatatttagtttttccactctcataatattaaatttaaaggtatatatttaaagttttaattaattaagtcgtgcttgttttcttctatggacattgaaagccaagggccatgcccactgattctcttctcttatatattgatgccattgttcttctctcaaagcccacaaaacagttctgaaatattttggtaagataaacccaaatgttggtttttattcccgctaatattaaactatacgcaaacagagattttacttaataaacagggttcctctgtttcaaagcttctcagttttctcatttctgagttttcttctttctcttaagccctctctctcttacactcagttttttgtttcccatctatgtctcttgtacttacattcttctgccgtctctgtgaaattggtcgtatttattgtataagagctcttatatatacctttttcttataatctggttttggtgacgtttgttcagggtataaactagaagatg

SEQ ID NO: 11822 - DNA, 3000 bp, Unknown
  misc_feature (1)..( 3000): cDNA_ID_2707593_gDNA_ID_2214518_Annot_ID_134001 3000 nt of promoter + ATG
ccaccttgtcttcgtctgcggatctgaagctccttgaagttcttgatttgtctgaaaactctctcaattcgccgatacctaactggctatttggtcttaccaacctcagaaagctattcctcagatgggattttctccagggttcgattcctacggggttcaagaacttgaagcttctagagacacttgatctgtcgaataatctggcactacaaggcgagattccatcggttcttggagaccttcctcaactgaagtttcttgacctttctgcaaacgaactcaacggtcaaatccatgggtttctagacgccttctccagaaacaaaggaaacagcttggtctttctcgatctcagttccaacaagttagctgggacattgcccgagtcacttggatcgttgaggaatctgcagactctggatctttcatcgaattccttcacgggttcggtcccttcctcgataggaaacatggcgtcactgaagaaacttgatctttctaacaatgccatgaacgggacaattgcggaaagcttggggcagcttgcagagcttgtggatctgaacttgatggcgaatacatggggaggcgttctgcaaaagtcacatttcgtgaatctcagaagcttgaaaagcatccgtctaacaactgaaccatacagatctcttgtcttcaagttaccatctacttggattcctcctttcagactggagttgatccaaatcgagaactgtcggatcggtctgtttccaatgtggctccaagtacaaaccaagctcaactttgtcacactcagaaacactggtattgaagatacaataccggatagctggttctctggaatctcttctaaagttacttacctaattctagcaaacaacagaatcaaaggtagattacctcaaaagcttgcgttcccaaagttaaacaccattgatttgagctccaacaactttgaaggcacttttcctctctggtctacaaacgcaacagagctgcgtctttacgagaacaacttctcgggttctcttccacaaaacattgacgtcttgatgccaagaatggagaagatctacctctttagcaacagcttcacaggcaacatcccatcgtctctatgtgaagtctccggactgcaaattctgtcactgaggaagaaccatttctctggtagttttccaaaatgttggcaccgtcagttcatgctttggggaattgacgtgtctgagaataacttatcaggcgaaataccagagtctcttggtatgttaccttctctcagcgtcttgcttctgaaccaaaattcgttggaaggtaaaatcccagagagtcttcggaattgttctggccttacgaacatagatctcggaggaaacaagctgaccgggaagcttccttcatgggtaggaaagctgtcttctctattcatgcttcgtctgcaaagtaactccttcactggtcaaatcccagatgatctctgcaacgttccaaatctacgcattctggacctctccggaaacaaaatctcgggccctattccaaaatgcatcagcaatctcacagccattgctcgaggtacaaacaatgaggtgttccagaatctagtcttcattgtgaccagagctcgtgaatacgaagccatagccaatagcataaatctttcagggaacaacataagcggagagatcccaagagaaatcttaggcctcttgtatctccgaatcctgaatttatcaagaaactccatggcaggaagcattcccgagaaaatatcagaactgagtcgcttggagacgcttgatctatcaaaaaacaagttttctggagccatacctcagagcttcgcagcaatatcttctctgcaaaggctgaatctttcgttcaataaactggaggggagcatacctaagcttctcaagtttcaagatccatccatttacattggaaatgaattactctgtgggaaaccacttcctaaaaaatgtccaaaagacattaaatagcaaaatgttgtagtgaattgagcataaggaaggtgctaagaagtaccttacaagataatgtacctgctcatataccaataataataaaattatcagctcaattcaggaacttagcctctaaagacaaatcaatgtaatgaacaatgaaatcttcaggtgtcatatccgaataaaacttggaagtttacaattataactacctgaccaggtaactttaagtagtttagaacagaaacattactttcagcagcatcactagcaaaaaccaagcaactaatttaaatcttctgaagcaaacctaaatgattcagggtagaacaaggacactgcatacttgtcaacaacacaaatgctaatctagagacagtgaattttatagaaagaaatgcccacttggcaaagagcacaaaacgactaacatacataccctatctaggaatataaagagaaaaaccttcaatttgtttcacacatatttgatcattcacttgaaaatagtactgagaacgagaaacaacgacttatctgcccattttcaaacaagttaagaaagttcagattgatgaaaactacacattgttctggataccaagaaaaacatacatttgagtctgcacatactcatgacctagatcccaaagttgaaacaacaattcacacacaaaaggttatgtctctatttctaggaccttattgaaacagtaataagataacaatttgagtccaaagtttctgttttggctgttcatccacacaaaaatgcaagcatggagtgaagatgggcagattctaggaccgatactcatcaattatcaatcaccataacaaaatttaatcatctctataaaatcccatctaaaaagaagaatccacaactaagcatctatcaatgggagaaaaaataaactagaagagctttcagattcaaacaagcaaaacctgagctttcacagaaggaactaaatcacatgatgaagaaatttcaatcacgatg

SEQ ID NO: 11823 - DNA, 2767 bp, Unknown
  misc_feature (1)..( 2767): cDNA_ID_2707544_gDNA_ID_2214518_Annot_ID_184530 3000 nt of promoter + ATG
aagaatagagatctgaaatttggactcaagtttaatttgtaggaaagctttactaaagatctcaatgaaaatactctgtatcaacaaacaataaaaataataattctaatcatcgttttttttttttttcctaagattccaatcatagtttttaaagctgttatattgctttttatatctacaaagacttttttttaagtacctacaaagactttaacgtaaccatgtgacggagattatttttatttttattttctaatgaacgtgatggagattattacaaaaacaaaatctcatgtgcatgtacaaccaaagtagacttaaaggaaacttggttcagcattacggatgggatggtccaatataatttggatattttattgtttttgtttgataaatggttcaatagtaattgataataacgtgaatatataattgaaagttcgatcttttcgtgaatctttgaacttcttgataaatgatgctatgacaaagaatatacaaatataaatattatataactaatcgataaaatcagtgacaaagaatatatgtattaccctacacagggctacaactttccattgtgattctcttagtttaaataatgtgaggcttttgtcatgtaatacttactgtatttatctggaatgtattttgatgaacttcaggtctattcaatgttaataaaccattttcttggatccaactgatcttgctatgaatcttctgaatatctttttctacagaaaatgtcaatttttgaaattaggggtctaataaattaaaggacttttttttttgggtgcacctattaaaaggactatattaaattattgttgcctaaaagggtaagtacgggatcacctggcgtgacatgtttaattacccaaattagacaaattacttttgttaacccggtcaatgtttctttatatatcaaacgttcttaatctttttataggtaaaaacgttcgtaaggtcaaaacaattgaacgacgattaaaatttgccaaaataaacgtttggcatccatagaacttctttttttttccctccaagactccaaccaatatcattatctactcgaaaacatgtctggtaaatctaatactataatatagatctaataaccagtttagaattcaaagaacgataaaataaaattaaaaatcactttttcacataatcagcttttgatattttccgttggtgaaatttgttgacggttacatttcattacaatacttttttttggataaattcattcatttcattacaatactttatatactatttttttatattttttttcagctacatacatatgaatgtatatttgaatccaatgatatagtgagaacactagcacacaaaccactaatacttgtcaattttcttgaattaaaacctaagtttataatatataaatttttaacaacttaaactataagccttataaaaaatccaaccacccgattgtaaacatatgttttaagactgtgaattgggtcatttcaacttttaaacgcaagtttcaaccatttacatcaacaattgtttcatcggcttctacttggaaatttggtttaggtaactatgcacatcttgaaaacgaagtgttttctttcatcatttattattattcaccaaacccaaatcactacttcttttaggtagctttaatgcaatcttgaaaaaccaaatgtttctaccaaaactacatctgaccccactctggtgatggtgcttattcccaccgtttattgtgaaaaattgatccagtgaaatagctctaaattttatcttcttcatcttttttttacatcatcatactaatcagtttatttgccctttttgaacttgatttttttttccccaataaaaacgcagagtagtttttgagtgggtaaaaagaattgtactttcagtcagaacactagttaaataatttcttcgatagttccaataaaaactctccacgttcatatctgtcagaaatcagaatcatatgcgtactttgtctctctctttctctctatagaattctcaatttgcctgtatcttttttactctctaatcagctgcagagaaagagaagtcaaaacgcagctctctcttgcgttttcttcctttctcctttctcaattccccagagaacaacataactctgtaaaagggaaactctattttgttctggtaacttcaatagtcctcgttttatttcagtgttatattcttttattcgatggtcctgaatcgaacaggacccaccgatggaacagtgagaatctgttttcttatataaagacataatttttccagttcgttgtgtttatcctccatagaaataatgtcggggttggtttttggaattctctaagtgttgtttattgatttttgtttagttttgctgggtttactgttgaagttttgatttttttggcatattcttttatttgatacttgtttgattgttacatgttcctgattatctttggctgcttgttaattaacacgatatattagctagtatttcgatatcttttctcaaatttttttggcagttattgtaattagtatatgtaagctcttacgacattcctctttaggaacttttctttttcttgaacaatctttcttgtttgtgaaagttttaccttttttaaagattcgaaaccaattcaggttttgcttgtgtaaaaagatctggtcttgagaggaaggttggtttttattgtgttagaatcaaaagtagttttaaatg

SEQ ID NO: 11824 - DNA, 3000 bp, Unknown
  misc_feature (1)..( 3000): cDNA_ID_2707548_gDNA_ID_2214518_Annot_ID_184529 3000 nt of promoter + ATG
aactgtaaagctgggagggaacttctcttctgagaaagacatgaatatcaatcaatgtaagttgccaattgccataactagtgtaaggaggatcacataaaaacaatcacatacttccttcagtctgcttccatagccattctgaaaccgcagaatcatatgcagcaacatgctgaaaggccttccacgcaagttttctgcggaattgttggtcgctctgtcctcctttgagatactccaaaacagcttgataatctcctgaatcgacaacaatgagaacgtctttgtggttctgttgaaaaaacaatagaaaatatacatttataatcttgaaaataatcttgcaagtgtaaagaaaaagtctcatatgcacagatatatgtattaccttagcagctgctctaatcatagcagggccaccaatgtcaatgttctcaatcccatcctcaaaactgatcccacctggagcagtaactttttcatagaacgggtacaaattgacaaccacaacatcaaatgtacctgtcatagaattaaaaaaaaaaaaggtacagttaaacataaggagacactataaatgacttagtctcaagcttaatgtagaggatcaatcaaaggtcaaaactcaccaatcccatgctcattaagagcttccatatgatgctccacatcccttctagcgaggataccaccatgtatgtttggatgcaaagttttcacacggccatcaagctttaagagaagaaaaaaaaaaaggagagctaagtttaatatactaaactcaacaaaacaatggtataaaccaaaacttaaatataaatatcagcgagatcacaagaccaaaacttttagcaagagcagcgagcataagagaaaagaaaaacatgccatttctggaaaatgagtaagcttctccactttggtcacagagactccagcattctccaaagtagaggcagttcctccagtagaaacaatagtgtatctacacaaatatcaatgaaaaaaggaatcatttacatataagatagaaacaaaaccaaaatttgtatagttctaagtaagagagagttgtgaagaacacataccccaattcttgcagaccgttgccaagagaagccaagtccctcttgtcagatagagatatcaaagcttgcttctcccctgattcaattaaagcccgattatttgaaaatcactaaaacgtaactgaaaatcgatcactgaatttgaaattgcagcaaaaagaaaaattgtaaaccagaggagcctgaggattgcggctgattcctctgagcagtctgagactctgccatggctcgaacagcaacgaaacttggacacagcgacgtacgatagacctgctcattgaaaattccactaatattaaaaagtttagcagaacatgaaacaaagacacaaaggaacacgtccacacacagaggagaactcacaggctgagtaaaacgaaaaggcgcgacggattttttgcgaaacaagccgcagagaatatcgccggagcgagcactcacggaggtggcggtggcggctgagctgagcatagtagtctgattttgaaacagtgtgtagtgttgagctctgttaggttttgtgattttgcggctaattttggaaataaattagaaaaaaaaataaaaaaaaaaggaaaatatgtaatttattattggcgtcaggtggaattatgtatttattattatggccttgacagttagattacacctggaatatttggaaaattggaataaagcttctctttttatttcccccaaaaataaaactaaactattttaactccaaattttaaaaaatttagtagaaaccaaaattctcaagtgtaaactaattagtaagaaataaaactttattggatcagagtggtaatattacaaaagactaactatggagatgacgaaagcttcttatgttttatatgatattttatttgcttttcagaattttaaataatgtaagtagataacaattattttattggtaggcataatagtttttttctcgagaatatagttttgtttttcgaattgtcaaaattagaagagagattttaaggaaggacttggcttcttctcctactcatcgatcgtcaaaccgaggacgcttcacagtctctggtgccgcctttcctggtataaacctttttctctacttctctccttctttgcttactcgtcttccttttaggtgtatgctgtttttgaattttgatcattattatcgaaaatctctggatccgatgtgtttccacctgaatttcgggtaatgatactcagatcttgcattttctagagtttcagtggttttgatggcttgatcggcttttgttttttggttgggtagaggtttttagctcagtttttggttcgaaatgacgcttatttgtttcctttttgaggtttggaattgtttcacggacttgattgaattttggatttagttctatgttttgatctgttgatttacactctctcaaagttacgatgggtttgctaatagtttggtgaagttgatcgattttagtttcagcgattcctgttagtttaaacttgaagagactagaaagtagtcattttagctagtttcatgttggaaagtatgcacagtcagatatttgtactggatgatctgtccctgctagagtaaagagttttattggtttgtataccgaaaatgttccttaaatagtatggttttctgagttttagccgtatgctattttggtttttttgttcttgaatatgtttgactacttgagtaaagttactcttctcctatttcaggcacctcaatgagagtttgagttgttcatgatagaagtcgtcctgttctgcagccaaaacgttagaaatttgcgaaggatgcttatgcaaagattttacttgggtcatgatcatgatatgtcgcctacaagcgtttgtgagggagcttatgaactagatagatagacaccttgagaaagaaaac

SEQ ID NO: 11825 - DNA, 3000 bp, Unknown
  misc_feature (1)..( 3000): cDNA_ID_2707552_gDNA_ID_2214518_Annot_ID_184526 3000 nt of promoter + ATG
aataattttatggtggtaggaatctaataatattcagttatctagacaaagcaagaaaaacgatatcaattgacatcgtgacaactataactatctattatacacatcgtttaaaaaaaataaaacaataccattaaaatccaatcgacgtatgtaaatcatcatcgttgacttgccaaaataaataataggaaaccttataaaatttgatgctaactaactcgggcgggtttcatccaaattaaatagaaacattgacggaacatggagtgtccaatacacacaagatccaatcattacttcgaggagtcacttcaaaactccaaataacaatgacccaaacaaatttcattggacaatgaataattaacacattattatccacaatcaggatcgtataaactaaaaacctttaattcggggctagtttagaagtcatcactttcccgtgggtcattttgtaatttacatttcccaaattatctcttttagtttctccgacgatgcctgaaaaataccaaacattagttacagtcggaatttcgaaaaaccctaattcagctaaagtttgatcgttgatctaaaagctcgagtgatgaagggaaattggtcgatcgtacgaaaggttcttcatcgccagttctccactctccgttcctcgacaccatcgtcgcgattatctacttccatccgaccgcttgttctggccccaaactcgatatcgtcgctaatcgctagaaattcgttgttcactgcctccaacattggtccatccatcgattttaacttctccaacacttcgcttcctcatcggagaagcctctgttcggaagctggaggtaattaatcaattggttctgctgcttcctgcgtatttgcgtaaatgtctgtgattagcatgatcttggctggaaaacgagattgatcagaggaataagcttgagtttatagtgctaggctgctagctttttctatgggaatcaaaattactaagctctaactctaccaaaagccatttcagcgaatttttttttagaaattgggaatttatctgtgcaagtcagttggagaaaactaaagtttgcatatttaaatgagtatctatctataacgtctctgtgttagaaatgaatctaatcctgcaattatgatgttaggtgaaaatggtgttgttctagtgaaatcagaggaagagttcatcaatgcaatgagcaaagctcaaggtaaaccattacacttactttcttacctcacgctaagtggatgtgtttagtatgatttgctgcttatgtcctcttcttgttatctgtactcagatggatctttaccatcggtcttctatttcactgccgcctggtgtggaccatgtatgttaattcttctgaaagtgagttttgttctgtatggtaatttttttttgtgagtggccttattagtttgtgtttcattttactttaggcaggtttatctctcctgtaatcgtggagcttagtaaacaatatcccgatgtaactacgtataaagtcgacattgatgaggtattttcgtcttgcttttgaactctatgcatatatgtctattttcgttgggtttctgtgattagaaccttctacagtgttttgagattgaaacaaaggagacgattatttggtgtgctgtatagaaccttactcgccacactctgtttcaatgttatgtatgcgatagagttagcgagtaaaatagctgaaccagacaatattagtcaagcttctttacggctctttgcgcaatcttctgtgctcatgaatttttgcttaaaacttaatcctttcttgcatatctgtagggcgggatttcgaacactatcagcaagttgaatatcacggctgtggtgagctttcattaccctgtctttccaactataatctacattttacaattagcaggaataactcatgttgaaacggggatttttatatttgtctcatgaacatatatgatgcagccaacactgcatttcttcaaaggaggctcgaagaaaggggaggttgtgggtgcagatgtcacgaagctgaagaatctcatggaacagctctacaagtgaagacctaatccgttctagtaaagaacgtgttgaatagctgctagttaagactgtccaatcaaatcaaggttaaaaaattcttgcttcctttttcaacaataaggctttatgtagttttctccaaataatgatgagatgtttcatatgatttaaccgatgaattgaagttgggtatgcaaaagacattcctctgaattacaatatacgctaatgatatcattatcattagactcacaatttgagatcaatctagaaataatgaatgcgctgaatcagtttcgtctttgttcccccttgttgttcaggattgtaattgcccttttgttttgtttgttttctccatttcctttgggcttagtttccggaaatttgtttgtgtccgtcggtgacaacttcaaaaaatatcgacaagtcataactttttatcaaaattttgactaagttgtcaagcccttagtcgacactcgacgcccctgacattaaaagtattgactccagtgccctgtgccggcctaaaagagggcctattttgggactcttttgctggcaaattgcgccatatgtagtggagtaaatgtgtaaaaaaacagttgaatcaacataaccattatttgatcagaaaagaaaacaaaaatgtggtgtaatgagaggaggatacggtatgtggaaacttgatttacttaatttcaaaggagacctacggagtcaaagagagagttagaccaactaattgtccagagggattgagattggaggaagggtattatggtactttacgaatactattacgttgattaatttggatactttgtcttcttcttcgtctctctcccctcgcgcatcttcggtgctataaaacaaactcacgactagatcatttttggagtgagatttacgtttgatagactactaca

SEQ ID NO: 11826 - DNA, 3000 bp, Unknown; identical to SEQ ID NO: 11820
  misc_feature (1)..( 3000): cDNA_ID_2707609_gDNA_ID_2214518_Annot_ID_184507 3000 nt of promoter + ATG

SEQ ID NO: 11827 - DNA, 3000 bp, Unknown; identical to SEQ ID NO: 11819
  misc_feature (1)..( 3000): cDNA_ID_2991587_gDNA_ID_2214518_Annot_ID_184505 3000 nt of promoter + ATG

SEQ ID NO: 11828 - DNA, 3000 bp, Unknown
  misc_feature (1)..( 3000): cDNA_ID_3023118_gDNA_ID_2214518_Annot_ID_184502 3000 nt of promoter + ATG
acacttttcaagttttcatcattttgtactgattttcttctaccttcgaaagaaagtaaaatgggcttcaaagtgattaattaattggctcttttcatttagcatattccagctcgttttagtgttttacttaggtgggttagtaaacttggcggcaaagtcaaagaatgaagcacgtggaaccactaaaccagctttacccgccaaagtcgccgtcttttaccaagtccaccagagaatagaagaaataaatttttcataattatctttgttaagtaaattatgaaaaatgaaggattaggaaatcgagagaggctattggttaaaaaatgtaaggcctaggcccaaaccaaaagaatcgagagtatgcagttattgagtgagatgagtaacggcaagctgagtaaatatgtgctaattattcaattattatgtctaattaattattcgcattaattctaaaaatagctgccaaataactttaaagtgacggttactcttaaatttgtagctcaattctcagtttctcatatatcgataataacttacaattaaaaaaaaaaaacttacaatctaaatatgttatgaatatatatattataaataacatatatgttaacataagaatatttcttaattgatttttcttatctctaatttttactcagctaattatgcacgttcttatacaatacacacttcttcctactaaaaaaaaatatatttgattatgtttatgttggcgaggaaactgattaataagaaatatttatttaagctagatattttattaaaataaataaattatgtcctaataattcggaggtggttaccaaaaaaagatgtaaaacccgaagtaactcctcctttatcttcgctaaaaccctaacctctctcagtccgactctttctctctcatatataacgcgtaagagacagttaactagtaaatcaacttacaacgttgaagtctacttgaaacaaaaaagacacaacattatcgtctaaaatcaatctacaggtctttcattgattctctcatatatcctctcctgtctttacttttttttttcttaacttgttttatacgtctatctatatatgtaagctcgttactagtaattaaagcttagttaagcttaataataatgtattaaaatagtctgtaactcctctcctgattgcttcaccttcttctttactacaggtttcagctcctcaatgtccatggattgcttaagctacttctttaactacgatcctcctgtccagctccaggattgctttattcccgagatggatatgattatccctgaaaccgatagtttcttcttccaatctcaaccgcaactggagtttcatcagccattgtttcaagaagaagctccttcacagacccactttgaccctttctgcgaccagtttctttctccgcaagaaatctttctccctaaccctaaaaacgaaatcttcaacgaaacacacgacctcgatttctttctccccacgccaaaacgccagagacttgttaactccagctacaattgtaacactcaaaaccatttccagagccgtaacccgaatttcttcgaccctttcggcgacactgatttcgttccagaatcttgtaccttccaggagtttcgagttccggatttctctttagctttcaaggtaggccggggagatcaagatgactcaaagaaaccgacgctttcatctcagagcatcgcggctagagggaggagaagaagaattgcagagaagactcacgagctcggaaaactcatccccggtggcaataaacttaacaccgccgagatgttccaagccgccgctaagtatgtcaagtttttgcagagtcaagttgggattctccaactgatgcagaccacaaagaaggtaataaccaaccccaaataagaactttatcatccaattgaaactctaatcgtgttttctcacaagcttcttaatttgtttacgcagggtagctctaatgtgcaaatggaaactcagtatttgcttgaatcgcaagcaatccaggagaagttatcaacagaggaagtgtgtttggtaccgtgtgaaatggttcaagatctaacaactgaagaaaccatttgcagaaccccgaatatttctcgagaaatcaacaagttactgtctaaacatctggctaactagttttagtttcaagcctgaagttctctatgcctaaatttgtgtctgttatcgttgttttgtcttcttagttagtgttttgtcttgttgatttaggggctaattatcctggttaatctcctcttaactgggaactaatacttcatctgtattagtctatgtattagcttttgtctgacattgttcttgttagttaatgtatgtccgcatgttgaagctttcttacatttaaaagagatctttgtgtaaaatcaagcttttatccataagaattttggggctttattattttctgggttttacaaattcaaagcccgaacattttctccgatttacccgatcgataaggggacttgattttccggacttctgatttactatatacattttttttttttacaacttcatataaaaaaatatgttttctgtaaatttgaattatttatggattgaacatcaaaactttagattaaacaacaataacaactttagattaaattttggtttaaattctttaaatctagttaatcacaacttgttgtcaaaacattttcttatgatttgtttcgatcatttgtttgatgatttgttttgatcatttctttcactggcagttaaaatttccatcattttcactattttacacaaaattaataagtatggttcaccaaacagtgcgcatgacctcataaaatattcaatggttacaaataactaaacccatcccaaacattctttatttagcaacaaacccacactatataatagttgtaaattcaatggtaaaaaagtaaaaaaaagctatccaataaaataaaa

SEQ ID NO: 11829 - DNA, 7 bp, Unknown
  misc_feature (1)..( 7): cDNA_ID_3023131_gDNA_ID_2214518_Annot_ID_184497 3000 nt of promoter + ATG
ccagatg

SEQ ID NO: 11830 - DNA, 3000 bp, Unknown; identical to SEQ ID NO: 11825
  misc_feature (1)..( 3000): cDNA_ID_2707552_gDNA_ID_2214518_Annot_ID_134010 3000 nt of promoter + ATG

SEQ ID NO: 11831 - DNA, 3000 bp, Unknown
  misc_feature (1)..( 3000): cDNA_ID_2686605_gDNA_ID_2214518_Annot_ID_134012 3000 nt of promoter + ATG
ggcaccaggctttcaagaggtgtttcaggattcacagaatacgggatataatgaggttgtggttgaacatgtaaaggagcagacctcttctcatctatatagcctatgcttgccatgtgacctgacgtgtaaatttggtggttaccaagtccggggaactgcaattgttgtcctagataaggctgtgaaaatggctcatttccagtagaaaatcctgttacaggttgagaagtttggctcgctggtaaagattcattacctgctaagggagtaagcgaagccactgctggttctgtagcagcccgatcgatcttcctatcaaaattcccatgaagtagttcatccaaattgttcccgggaggacttaatccaagggaacttctccgtgaacttagatccatcccattgacagcaacaacatactgaacctcagaatcaccctctgcatgttccataacaaactgagcctcctctatatcactgcttgaaaacaagaacatcctgggcttctcagatcctccattaccaaacacgatacattcttccatcatgttttgtaaatcctcgtcagaagatacagagactagggcatcaagatcctctcctggcagctgatattttatggtgcgtgcttcaggaaatatttctttcattttatgcatgagttcttggaaagaaatagtcttgctaatccgtatgatacgcgtttcaccacctacatacctaagtttctgatctctggggcggggtataactttaccaccaaaactacacaagaacttcgcacggttcaaagagctatcagaagctctagaagaaaccaaactatgacgcctttgaccagtatcatttttcgaagagataactggggctgactggaccagttcatgataggtcttatcttcaattctagaagggggtttcctctcgtgctcaaagctctgacgtttttcttctatgttaagcactgtagcgttagggccactctctgacattggatgaaccattcccagagcacttaagttaacagaaacaggcataccactgtgctcaccatacacatttgggatgaactgcggtttcataataaccctatctctcataaactcaaaagcaaattcttcaccggtctgtattgagtagtttagcactggccgagcaggggttgaaacaccataatctggaggtcgtacataagtgttaacattagttgaagagtcgtgggaaaacctttgattaatggagccaagtccctcatctctagggtcaggggcagtataccgaacatgttcataaccttttgcttgatccatgttttctttctcaaggtgtctatctatctagttcataagctccctcacaaacgcttgtaggcgacatatcatgatcatgacccaagtaaaatctttgcataagcatccttcgcaaatttctaacgttttggctgcagaacaggacgacttctatcatgaacaactcaaactctcattgaggtgcctgaaataggagaagagtaactttactcaagtagtcaaacatattcaagaacaaaaaaaccaaaatagcatacggctaaaactcagaaaaccatactatttaaggaacattttcggtatacaaaccaataaaactctttactctagcagggacagatcatccagtacaaatatctgactgtgcatactttccaacatgaaactagctaaaatgactactttctagtctcttcaagtttaaactaacaggaatcgctgaaactaaaatcgatcaacttcaccaaactattagcaaacccatcgtaactttgagagagtgtaaatcaacagatcaaaacatagaactaaatccaaaattcaatcaagtccgtgaaacaattccaaacctcaaaaaggaaacaaataagcgtcatttcgaaccaaaaactgagctaaaaacctctacccaaccaaaaaacaaaagccgatcaagccatcaaaaccactgaaactctagaaaatgcaagatctgagtatcattacccgaaattcaggtggaaacacatcggatccagagattttcgataataatgatcaaaattcaaaaacagcatacacctaaaaggaagacgagtaagcaaagaaggagagaagtagagaaaaaggtttataccaggaaaggcggcaccagagactgtgaagcgtcctcggtttgacgatcgatgagtaggagaagaagccaagtccttccttaaaatctctcttctaattttgacaattcgaaaaacaaaactatattctcgagaaaaaaactattatgcctaccaataaaataattgttatctacttacattatttaaaattctgaaaagcaaataaaatatcatataaaacataagaagctttcgtcatctccatagttagtcttttgtaatattaccactctgatccaataaagttttatttcttactaattagtttacacttgagaattttggtttctactaaattttttaaaatttggagttaaaatagtttagttttatttttgggggaaataaaaagagaagctttattccaattttccaaatattccaggtgtaatctaactgtcaaggccataataataaatacataattccacctgacgccaataataaattacatattttccttttttttttatttttttttctaatttatttccaaaattagccgcaaaatcacaaaacctaacagagctcaacactacacactgtttcaaaatcagactactatgctcagctcagccgccaccgccacctccgtgagtgctcgctccggcgatattctctgcggcttgtttcgcaaaaaatccgtcgcgccttttcgttttactcagcctgtgagttctcctctgtgtgtggacgtgttcctttgtgtctttgtttcatgttctgctaaactttttaatattagtggaattttcaatgagcaggtctatcgtacgtcgctgtgtccaagtttcgttgctgttcgagccatg

SEQ ID NO: 11832 - DNA, 3000 bp, Unknown; identical to SEQ ID NO: 11824
  misc_feature (1)..( 3000): cDNA_ID_2707548_gDNA_ID_2214518_Annot_ID_134013 3000 nt of promoter + ATG

SEQ ID NO: 11833 - DNA, 2767 bp, Unknown; identical to SEQ ID NO: 11823
  misc_feature (1)..( 2767): cDNA_ID_2707544_gDNA_ID_2214518_Annot_ID_134014 3000 nt of promoter + ATG

SEQ ID NO: 11834 - DNA, 1801 bp, Unknown
  misc_feature (1)..( 1801): cDNA_ID_2706352_gDNA_ID_2214519_Annot_ID_134015 3000 nt of promoter + ATG
agtaaatctagaacccaaaatcctaaatggtcgaatggtcggctgatcatcggagagtcacttttcaataagcgaactagcaacttgtcgacttggtaaattgacctaatttttcttttaaaacaacttggttttctaacctaaatatttttccattcataacattaaaattttagaaagaaggccaaatttaaatagactaaaattgtctagtggccaacccctcagcaccatctcgtatactttagaaaataagaaaattgagataaggaatcttcttccgaagtcacgaagacaataagtgaaagcagacaagaactgtccccctgatttcttttgcaccaaattattatggatttgtataagggaacctcacttaaggccagttaagcacaaaagaaggtttttatgcactatcctttttgaactaataatgttagctttttaaaacaacaacttgaaaacttttttaattcttgaaaatacattgcgaaaagcagaatgatttttaaagcggggaatcttttttttctttttaattgtgggaaagattaagataattcatgaaccatgtgatggccatgttttattacaactgcatgggctcggggctttcttttttctttatttgttaagggtccaatttcgagagtagtgtaaatccatgtttatgtcctcgatcagtgacaataaaatgtgtgtagtttcacagacatataaatagtcagagaattcattgtttctgttttgttttgtagtatatattgtatggaaaaagggtgaattgtgtagtctagtctcattaatatagtaagtatagactgtatagttgtttttaattcattgttgttgtttctaagaaagtagaaacatattattgcattaatcaataacaataattatatcaacaaaacaaaaatagtcaattgtatcattgtatgatacatatatgtatatagagtattacgaatatggaatttcttgtaaagccagatgaaagaacatccatgaagaattctcttccatatgtttacaaacaaacctttaaatgccatcacatcatctctttgacccaataaatatgaccttaaagatcttcggttaggaaaaaaaaatatcagttcgagttggagatcttgatcagctgaatcctgatgtgggacaagacaagtaaaggagaagctgcacaattaattccataaatttggagcataagtgggccgtcattgggtaagatctgggcccataatctctgaaaattgtctaaagtatttaactaggatctcaaatgatttgatgattctcaatcattttataatgttgtttatattttggtgttaatgttttcctttacaaatgaaatgaaatgttaaaacaatgagaaaacatgattgggatttattcataaaatgtttcagattctgcaaacgacgattcaatgcctaatttcatattacaataaagttggagaatgaatgaatgaatatacagtaagaacgaactaagaagaccgcagtctttcatcggcccctactaattttattattggttttttaataattgttattgttagtgtttcgtacttttgacctgtcttgtaattaaaatatatttatttattccccaaacaaactacccaaataatttatttatataaaaaaaggtaagaacacaggtcagcgagttggactcatcaagcttagggagagaagaatcgtagaagaaaactcgaagacgaagcaattggtaaagactatcagcagaagaagcttgcggattggggttttcattttctgtaatg

SEQ ID NO: 11835 - DNA, 3000 bp, Unknown
  misc_feature (1)..( 3000): cDNA_ID_2707666_gDNA_ID_2214519_Annot_ID_134017 3000 nt of promoter + ATG
atattcgaaataaaaatctaactacatatgggatatcacatatttgactatactttttttttttttttccgacaaacgttattcattacttaaacagagtcattacaaagttgttactcaagtcaaaaaggtaaagtaccagtatcagaataaaagcatgtagaaatacaaccaaacttggccaagtcatgtgctaacttatttccccgtctacgaacaaagctaaaatgaatatttgaaaattttgaagcccaaaaatgtatatcctcttaaaggttggcaatagaactgtgagatgttgatccgttggctagatttatcagtgtttgactatatataatggaataattaggtgaaaatttcgaaatgcatcttagcagagatggtgatgacttaataaattatatcttattaattttgggtaaaaaagaagaaaatatatatttgtggtcaacatctgtttgtataggagaattatgttctttattctaactttgaccagaaaatttaccttttacaagaaagaacttacccctttatattacaagatcatgcctacttgatatgatcctattacaacataatgaagaatcatagggatttgtcgtgatacacatatcccagtagccttcacactatataatcagtctaaacaaagaagaagaagaagaagaagaagaagaagaagaagaagaagaagaagaagaagaaatgaacaaaatctcaaatcattaattaatgaacaaaatctcaaatcaaaccgaaattactttgattaatgattttagaaatgttattatgaattgttcagatttagagtttgtatgttttaactaatgtaatcctctaaaatctcattaaatacaaaaaaaattattcgtaattactaattccttatccacaacaaattccttgacaaattagaagagagtctaaattgtaaaaaaacaatacacccagttatcaaaaccaacgataatttgatctctcaataccatacaaattgtattataagagaaaacaaatttagcattggttgattttacaatataatctaaacggaaagagttttttatacatataattgtaagaaagattttaaccgtataataaaatagtaaaaagaataattgaaaattaactacagcttaacagagatataaaaaacagtacacattgattcaaggggcaatatacaactcattaaatcgtgaaaacttgtttaatgacattgtttattagctatttattttaatataaaaaattggtcaacgtgttgatatagaaaaatgtatggttttttctaactttgaccagaaaatttcacttttttacgggaaataacttatacccctttccttttatatgacaagatcatgtctactttgcaaaactaattgatcctatagtaactacaacatcatgatgacgatttcctaatcaccccaattaatcatagggatttgtcgtgatacacatactccaatacacactatatatatatatataatcaatctacacaaagaagaaacaaaaaaaagaaagaagtaagagattattatgaaaatggcaatcaccatgaaaactttaattgcatatgttttcactgtcctcctcatcatctcttctgttcattgtcgtatgacaacaacaactagtccaggtattggtttatccttgtacccacattttataattatcgttttgttttaataatcatttttatcaataaataggttttggaataaagcagcaggatagacaatgcttcgagcatgcaccatatttatgtcgtggcggagaaggcgactgccgtatgtattgtagagatcttgatttttcttttggcacatgtttttctggtgtatgctgttgtcaaatttaaatacaagtataagcaaaaaaataaaccaatttactatttggtatctgcttggaaattaacgtatcaatatttatcaaatgttttgattgtcctatacatctgttattattatttttacgtcgaaattgagatatattgattaaaaatgattaaagtcatagtacaattgttcaattatcccagaggatagacacaatcagaattgatggaaagaaaaagacacatacagagttgaaattacattatagacacccaaatttacgttttgcccacccagatatgaatgtcttggcataagcttgctatagacgtatcataattaccttcattgtctgatacataatactttgaacgagataaataaatataatatcgaaattactttgattaatataaacaatagcttttgcaattcgaaagaaatctcaaatcaagtcgacaaacaatttaatgattttaaaatagttgattgtagaaaaattgttatgatttgttgtaaagtctccctaaaccagtaaatcctacttaataaaaccaaaagatttgtttttttcatctaaaatcttttaaaatcattaaagatttaatgcttaaaatttgaaatatttctatccaacaacagtgtattttaaatcagttttccaaacaactagtttcataacatcggatttagaagatattctaaaatccctagttgaatgacatatgattatgttctttttcaagaatttgaatacaccttctaagtactgtatacggggaaaacaaatcacatatttaactactatatcgccaatgtttataatcaggtacaaaattcttgaatacacccttctaaatatatcaggaaaacaaatcatattctactatacataaaagaatatataccatattatttgccagaaaaaaaaaccatatcaccaatgtatacacgtaactataggttaaaaaaaattaagcaaatagatactccctcgatcttcgttggtgtatacagtatacataccccaatataaatagtttgtgtcacactataagtatgatcagtctaaacaaagaagaaacatttaaaataaaaacaggttaagagattatcataaaaaagggcaatcaac

SEQ ID NO: 11836 - DNA, 3000 bp, Unknown
  misc_feature (1)..( 3000): cDNA_ID_1379513_gDNA_ID_2214519_Annot_ID_134024 3000 nt of promoter + ATG
ggtacggtgctcaagccgggtaccagggcggttatcagactcagcaacctggtcagggcggtgcgggaagagggcagcatggtgctgggtatggtggtccttacatgggtcgttagattagccactcaggtaattattttcagcttcttttcatctatttcattgatgttctgtatcagaagactttttttgtagttcgcttggttcccttgtgtatttcaagacatggacttgctgtattttgaccttttcatggttactccattatgttaaactttttgcgttgcaagatcattttgttttcaaagttcctgtgactttgttgtgtttctgaagggtgttaggttttgcatcagtttataaaagtcttctcttaatttcttaattcattgtgcagatattccaatacagtactttttaaaattggcctggtgaatcttctgaagttattaaggagctgatgcaaatggagttgtttagtttttggatgaaatgttactctttcgtgtcttcaaaatacatgactcttcaaacctttcaagaagttttagttttcccctacttgttttctcaactctttttatgatatcccaaatacactgttctgatttaacaactatcgtttctgttttaaacttttgggaacgttttcatttgtaaaacttaaacagtgttcctcatggacacacaaacgctttcactatgtttgaatccgtattttccattttctcttaatcagactcgtttttattggttctcgctatgtttcgcggttttgtggaatttttccatgcacgtaattcctcttaagattttgaccttgtgagagtatgatcacacatcactatgcatatgtacataacggcttatcttgattaccacatattatatctgcttaatccttattcctcttgcaggtaatttaagagcaagctgaacggtcaacacttacgcccaacaaaaatctatggggtaccaaatatttgaatgccacctatctgctttttcttttatatatactgaaaagtgaaaagggatgaatctatgaattggtagctttataactaaagaacgaattaagcaaaagttgttttcttgtttaacttagctaggcatctacctgaatccaaaagagcaacttgttttgttttgtactaataagtatcaacaagtcttgacctgcacatgtcaagtttttgacttgatttagagcagcttgtttcttgtgtgtccttggagttctctactgtttctatagctttgaatgagctttccatttgaccacatctcaaaaaatttggtaatgtgccttagaataacaccgagtttggtaacacagctggaattggtgttttgctgtggcatcatgggagctctgaaatgtcttcccagttaaaggtgagtataactgtttgcattgtgaagatttgtattaactatagaacattgaattgatggtgttaagttcttacacaagcgtgcttctcggtttgaactgtttcttttgtatgttgaatcagagcttagtttataggaaccagagtatctacttagtcattctctaatgctaagtgctaaggttctacctagttgccctctaggcccttatgttattgataacttatgaagctatttgaacacttgattcttaggagacctaagttggtacagccagatagagtgtatgttcttgttctctatgtgacaggatcaagctgccacacatagttcaagggtatgctctgtgtgggtttgctcagattgaggacaaatctatacaaggaagtagagtctttgacattttgatgttgtatgataagaagaagaaaggagagtaataaagaaagagaaaagggaaacagaaacacgtgggagaacatcccaaagaggaagcacacgcggatcttcatgcaaagctccccgattctcccatgtggtccctttctccctttgtccccctcctctttcttcttttctcattttactcctttttttaccattatacaacgaatcttttttatcataattttttggttttggtttattttccaataacaccttcttggttacttcccattctcactttttcatataagaaactcactttgggaaacttatgtttgagaatgacaagtctttttagagaaagtgatgtaacaaatctaaagtgattatataataaccttgcacaatgtttttgattttttgtaagattcgaatattaggtttattattcgtagggaataaacttactttcaaaagcgttcataagttaatactttcatatatgatcataagtacggacactattgttttttgtttgtttgtgtttattctaaaagaaagtagcttttaattgaaatgtcctcagaggcacagtttaaagttcgagtgtaacagtttctaaggcaaaataagctctctttctactatttctctttctctttctactatttctctcctgtggagaaactcaggagatagagagagagagagagaagagaagagagcatgtatgtttggttttataatctctctactcataccaaagatttgtctcagacccaccacttggacagagagaacccaagctcctttctctctttttctcgatctactccttcttaatctccttttttgaaacttgaagccactttcaacatcatccttaaacttttgttcccttattcacaatctcctgccacctctcatttctctagttgagttgttatctgcgtttttaagcactcgaatactgcatgcaaattccctgattgtttgttagtaccttagagattctcgattttttagttgtttagattgaaccaggattactaaattgttattgttttctgtgtaaaggctacatatatgggttctattagaggaaacattgaagagcctatatctcagtcattaacgaggcagaactctctctatagcttaaagctccatgaggttcaaacccacttaggaagttctggaaaaccactaggaagc

SEQ ID NO: 11837 - DNA, 3000 bp, Unknown
  misc_feature (1)..( 3000): cDNA_ID_1009222_gDNA_ID_2214519_Annot_ID_184564 3000 nt of promoter + ATG
caatattcttgacgaaagaattcaatcatatgaagaaaacaaaaatgcagttgattgtacctgagaggtaggaaatgatgcgtagatctttcaaccaaacagttggaagaacaatgagagcagttaagattccaaataaatgcttagagtcaagtcggaacccgagcaaatccaaggatgtaccagggaaaagcccggtaaggttatctccttccaaaatgatgaattcaacacaatatgactacagaaagtggacagcgaatctagtaagtttaaattatagagacagaaacaagctctagatccatgagtaaaattcggctacaaaaaatcttcacttacatatagttctgtgtacaatagcatctgcacaaaagacacataacattgcagaaaccataagcaactgaaaacagaacaactgatcaaaataatcaaaaggaagataaaatctatggaaccacttacacagataagaatacgaccatatttgccaaaagctgcttctccaatatcaggataagtgataatgccggtcttgttctcgaaacagtctttcattaaagtagcagtgtaacaacaaataacagcaaataagagaagaattaccatacttgcccaaccagcttctttcactgtataaggtgttgagagaagtccaactccagccattacattaatagctgcaaccaatatagagttacacatgttttcttaattaggccaagaatcataatcagtttttagttaccattgaaaatggtttgaatgacgctgcatccatagccaccaatgggcaattcctcagcaaatgagcctttatgagaccaagcagattgtgtagctgaggctttgtctgaatcatcatgcctctcaggaagcaaaggtgcttttgactcaacatctaaattacttctgctggctctatagaaactcggaggattactcctgagcgacccgaagattggtgatgccgcaatcgtataagaatcagtcgtttccctaaaagaaccacaaaacttgtcaatgtttcatcacaaaatctcaaataacaaaactttatgagatgggttacaaggaaagtttcgagctttacaattaattacctgaagctttgaggccattgaacctgggaaatgaaaggttcatcgatgtcgtcgtcacgatcaacagcatcaccaggaagatctccgagatcgctttgatcagtttcactgtcgttctcgtacttactgctgttgtcttctagatcttcgttatcttcgtcatcttcgaacgtaacgtcggtttttttctccttatcattgttcttgtcctccatatttcgaacaaacccaagtaagaatagatctagagagtatcaagaaccttagaggattaaatctcaccgaaaaaggaaaaaaaaagatcaaatctttatgattgattttggttacagagtgggttcgagaactttgcagagaggtggcaaaagactaataaggaaagctgagtgtctgagcacaaaatgtccgtttttttttaatcaagaattttactttttcgaggatttgtgtgatttgattgctcttgttctccgtctctctctgttcgcgagagttgattgcccctagttataaggcgggaaaatagtgacgtggcggtgatgatagagactagaggaaagagatcaaagttgagaagcaatgtttttagacttttgatcgacgacaagtgttgcgttgagatggttcgatatattgatccctcgtagggatgtgttgccgtagccgggatcactaggacttggaaagttatatgttctagtattctccaaaaatttaaaataaatattcaaaacatagaataatttataaatgcctagaatattaagaaatatataaagtttcaatattatggaaaaatcatgtttcttgtaaaatatataaaacggtttttagcctattgacaaaaagaattcataacgcttagttccaatgatatctattgacaaaaggaattcataacctttctctctttatttctttcacgtttaagatataaatggcgaatgataccatgaatgttgctggattcttaagcttattctaccttttttttttttcataggcttagtacttacttaaactcatttgttgttctaaatctaagtgtctcgcaagagtccaaagaaggagatgggagtgactcaaggtcgacgagggaatggggtgtaaatgtaatcgtgttagtgaacatagaaatacattatctctatgtggtgacatgtgaattttctccaagtgtcaaacttccatatgctcattaacaatccaataatttaagctttttgacaaaattgtattttttttggtcaattatctccaatgtggttttaaacaaagatatatattaaataaagatttacatgccttttccaccttgatattttgcaaatcatgagaatctcttccttttaatgttgccagttatataggttaaaaacatatttgcatttcaaaaggaatattaaaaaaacttaattgttctgctacattttggctttcaaaagtcatattgtgagtctaaaactattaaactgtaaacaaaggaaaataaaatagtatttatatgctatatgtaaaatatgaaatgaatagactcacactttttctctagatccttaagttaaactgtcacgcttccggtacgtggcttatcgatcaggaaatgccaagatactgatcccacctcacaagtcacaagtcacggtctccaaaatttatttctcaatattatccttcaaatttgttacgatatgcaaaaaaacaagaagaaggaagttatcacaatatgggtcaagctctcaataccggttcgtcctttctctttctcccccaaaatcacgtctttcattgatgttcacttcattaataaaattatcatttttttgtttggtatacttaattatggaacgaagcaaaaggtaaaggagaggtagacgcgaaagacttggaagct

SEQ ID NO: 11838 - DNA, 3000 bp, Unknown
  misc_feature (1)..( 3000): cDNA_ID_3023149_gDNA_ID_2214519_Annot_ID_184562 3000 nt of promoter + ATG
gttaaaatcactgaaaaaaacagagttaaactcgttgaggcattctgtcgaacaacataagttcatttttttttccttttcatcaatctagtaaatgaactcaaagagtgaaactttaagcttctccgtgtatcaaacacatataatcaaatcaccaatacaaatttagcaaacaaagcaaagctcgaaaggatcaaacaattagtagagacttcatatcttattgagcttggcgaggaggaagacggtggcggaagtgatggcggggataaacaagtcgttgggaacggacgtcggagctatacggttcttaatgaagacggcgatcgcaggaactccgaagatgaaaagtagaaattcctttactcctccgacgccggtgaacccaactccgattaaaacctcttgaagaagcttctgaaactcgtccttcgatagcttcttcccctgcccgagattgtgtatctgctcgtttcaaaagtataagagacgaagaagatgataaatctttgatcccagtaattaaaccaattggttaaaacattgtgattcaattgtaaaatcttattttggtttatagtaaaccaagtctaagcctctctatgtaacagagacttagatttgggcaaaagcgttgaagttattttttaatgtttatcgttgcataacaatacttatcatattcgctaatcgctaggtataaattatgttttgctcaagtatatatttcatttttaatattcttttcgtgttattaaatttagaaaaggttaagagaccaaatgtttacaaattccttacctaattttatcaaatcaaaagaagtgtcattaaacttatataatgaagaatagaaattgaaagaatttaatacctcataagcttgttgtagtttctcaacacttggcaccttaagttgagtgccaccgagtcttctgttaatttccctgtcgcaccaaatacataaaatacgaatatcacatcacatgtaaatatcattaccataatcataatatcatggtgccgactatatggctcgagtctttatcgtttatttttatttcttaaatcattgacttataaaccgcccatgagcattaaataatttgtctcaaaaactcgaaagaaaatcgttattgaaaatggtttaataaccaaatctaatcctttccgactcatattggtttcattataacacttaacaagtaaaagaattttactcgactgcttcagccacaatgcggtagaagtcgccaaaggaccattcttgatcgtcatttttttcttctaagcgtttgcggtagcaattttcagccatagcttccaagtctttcgcgtctacctctcctttaccttttgcttcgttccataattaagtataccaaacaaaaaaatgataattttattaatgaagtgaacatcaatgaaagacgtgattttgggggagaaagagaaaggacgaaccggtattgagagcttgacccatattgtgataacttccttcttcttgtttttttgcatatcgtaacaaatttgaaggataatattgagaaataaattttggagaccgtgacttgtgacttgtgaggtgggatcagtatcttggcatttcctgatcgataagccacgtaccggaagcgtgacagtttaacttaaggatctagagaaaaagtgtgagtctattcatttcatattttacatatagcatataaatactattttattttcctttgtttacagtttaatagttttagactcacaatatgacttttgaaagccaaaatgtagcagaacaattaagtttttttaatattccttttgaaatgcaaatatgtttttaacctatataactggcaacattaaaaggaagagattctcatgatttgcaaaatatcaaggtggaaaaggcatgtaaatctttatttaatatatatctttgtttaaaaccacattggagataattgaccaaaaaaaatacaattttgtcaaaaagcttaaattattggattgttaatgagcatatggaagtttgacacttggagaaaattcacatgtcaccacatagagataatgtatttctatgttcactaacacgattacatttacaccccattccctcgtcgaccttgagtcactcccatctccttctttggactcttgcgagacacttagatttagaacaacaaatgagtttaagtaagtactaagcctatgaaaaaaaaaaaaggtagaataagcttaagaatccagcaacattcatggtatcattcgccatttatatcttaaacgtgaaagaaataaagagagaaaggttatgaattccttttgtcaatagatatcattggaactaagcgttatgaattctttttgtcaataggctaaaaaccgttttatatattttacaagaaacatgatttttccataatattgaaactttatatatttcttaatattctaggcatttataaattattctatgttttgaatatttattttaaatttttggagaatactagaacatataactttccaagtcctagtgatcccggctacggcaacacatccctacgagggatcaatatatcgaaccatctcaacgcaacacttgtcgtcgatcaaaagtctaaaaacattgcttctcaactttgatctctttcctctagtctctatcatcaccgccacgtcactattttcccgccttataactaggggcaatcaactctcgcgaacagagagagacggagaacaagagcaatcaaatcacacaaatcctcgaaaaagtaaaattcttgattaaaaaaaaacggacattttgtgctcagacactcagctttccttattagtcttttgccacctctctgcaaagttctcgaacccactctgtaaccaaaatcaatcataaagatttgatctttttttttcctttttcggtgagatttaatcctctaaggttcttgatactctctagatctattcttacttgggtttgttcgaaatatg

SEQ ID NO: 11839 - DNA, 3000 bp, Unknown
  misc_feature (1)..( 3000): cDNA_ID_3023156_gDNA_ID_2214519_Annot_ID_184559 3000 nt of promoter + ATG
tgtaataactgagtagaaaactcaaaaaaaaaaactattatactaaaaggttttttttttaaagacaaaatactaaaagcttataattggaaaataattgacagaaatgaaggcaaaaggggtccatatggacaagtgggaagaggagggtagcacagcggtatgtgctgtatggtctgtcctaattaaagggtctcttaaaatcgatctaatttagcgagggccctctaaatgcccctttcaaaactcctaattttaatgtcactttatacatttttccattctattcataaagttgatgaggttaatcatcatatatataatatattacagtgggttctaaaagaataatatttgggaattttggtgttagttcactatcaaaagaaagttatcaaaagcttcgacaaaaattttttaagtacttttttaaaattgaacttaatcacatagatcttcaaagaagtcaagtcacgtgtacgtacacagatattcaaattctcatgacaaataagataattccaagtttacgacttagcttgactcgatatatgtcaacaaaagttgtaagaatctcgtatagtacgagagtcatcaattttcgggttttcccataaagaataaaaatacctccctttgtcttttattcattttataacaaagtttagtttctctaaggcacccatatgacatggtatgtaggagaaaatgattatacacactatttcatatcgcagacttgaaagaagaaaacttacatacgaatatacgatagatggattttttttttccattatgttatgaataacataacagatgtactcaatagtggcgaaagtcatatttttatatctagctacctagttcaattcttggtttgaaggaatttatttagatgtagagacataaacaatgtaagaaaatctaaacacaatttcacaaagcgaagtattcccttggttcaaaaataactatcacatcttaatatttatgagtctcaccaaatacaaaacgaatcatattttcaccataaccattatagaactcgaacctaaattttttgaaaattgtcggcgacactattaccaatctctagctgatgagttggggctgatgaacgactatgctgatggcgatgaattattaattttggcctaattataaaaattgcaataataccataaccgaagaaattggtgatccttttgaacactaacgacaaaagacaccaaaaaacaaacaaaatttattcgttgttgcattatccggggagcacgtaagtgggttgactttggaagtaaacggacccaaacgacttctcacttcttccaagacaatctatcaagtagatacgtatttatggagttattgtccatgaagatatccattacacatagaaagagaagttctctggaccaatttgttttttgttaaagtccattggaccaaatttcaaattccaaaagcaacacttacaagttacaactttcctcatcaacgattctcaaaatccgtattttaaaaggataaataagataagcccactggaccaaattccaaaagcaagccctcgtccaatgctttacgttgcccaaagattacgaaatccatgagaaaaaggcttttgtgaggaaaagcaaagaaagtttggttacatgataggtactagaatgagctcttaagtatgtaaatttacaaataatttgtaatctttatctatttctcttcgatcaatttgttcattgttggcattacacgctgattgatgatcgtgagtgataagcttagttcaacaaaacaaagctgatggtaaaaatctcaccctacaaaaatctcacttcctgaatgtgacttggggagatttttttttgttctcttccggaaaagcagaatcttcattaaaaacgggctcaacccaatgggctttagacccgacatagagagggtttcatcaacaatgccacatctgttaattagtaactgagtcaaatactaacaaacaagttctaaaaatattaaggcactgggggttttggaatttggtttgggaccgtgtgtgcctgggacaattcaccctaaggtggggctattatatctttggaaataaaaagacttcaattttgtttttagttcacatcttatcaactgcatgtcgtatagcccacttcactttagttgaactaccaaaaggagttgaccaagtcggtgttggtttcgtgagattttggctttaagactttcaagattattatgtggatacatcaataaaccaacttttgttctataatctttaaagtatttttgtacaaagtagttggaaagtttggttgaattaggctacggacaaaaagagagagtagttggggaggtaattacgatttcaatacattctttgcctcaagtgagatttgattttgttgatttgagtagttttaagattgaaatggatcaacctaaaaatcggtgcaacgagcgccagctgttacgcacgacataacctctataaggtcactttctctgtaactagaagcctctcatgggattgtcacttgaagtcttcttatgacccaaccaatgtcattagtggttttgcatctgtttccacctactcctaactgtatttattgctcacccaacttaatgttgcaccttctattaaatagcctcacaacgaatcttttaaaaccctaaacctcattattgttcacagttcgatgtctcttttagtgttttcttattaaaatgtttgtgtttataatgtcttcaacttcaagcttacttgcttaatacttgtaaatatatatatatatatacacagacacatacacaaagcgtgactacatgagacagctcctcttgaattgcgtgtgtaaatgactaaaaaggcaaaaacaaattttcttttcttgagccgtaaatcaatcaatctctctctctctctctctctctttagccactaatctcactctgttttctctccctcgtttcttgctttcaatg

SEQ ID NO: 11840 - DNA, 3000 bp, Unknown
  misc_feature (1)..( 3000): cDNA_ID_2707641_gDNA_ID_2214519_Annot_ID_184557 3000 nt of promoter + ATG
atgttgagagatttagggaagattgttaaatgtcaaatatttaattattcaaagatttttttttctaattatcaaaaacaaacattaaaatctagtggcagttattgtaaataattcccaactataggatttatttcacaaaatggctgctatatagattttttagataaaaccgatcaaactctttttcttttcaattattaaactctttgatgggttaagaaacataaaaacaaaaaggaaaacagaggagaagaatcgaggatccaaaagcccatctaaggtgagagaagaggggtccaaactgagattggaacaaaatcggttttagggtttcagaaaggcccaaattagattcgagtagagcagtcccacagtgactccgacatgacaacacttgagttacacaagaccaccacgtctctatactctaagtctatgccgtacgtcaaaggcaccaactctttcatcacatatattattaatcaatttatacaaaactccaaataattcacgggaccaatactgaatcgaaactaaacgaatttgttaaaatcggactttgtagatgcaaccgaaacagagtaagtacatgaaaatacgtacaactgcatgtgatttattgtgaaattctatgggaaaaaattgaattgacatattatgcaaaatgcccgtatgttacataaacttttatttttgtgtgtgtgacttaacatgagtgtataaatggaactttttttgttttattttgtttcatataagaatttacgatgtaggaaaaaaattagaaatgaaaagaggtggcaaaagaaaaagaagtgggagaaaatagatgtcaaggaatattgatattcttcttttctccgatacattacttttccttccattatcttctagtaataatttaggcttttgctgccaaataactcacaaccaaaaaagcccaccgaggaagatggttgttagggtttttctctgttttatactttccttgggctatcttacgtacgtaaaatatttctttatatatttgtctagtttcatcttcaatctgaaaatattattcaagtttcaggtacgattcatcaatctttgtattgtaaattgactcttctacaaaaaaaaaaatgaaaatagaaataagaaccaataactaaacttaaagaattaaatatgctaatttcaattccaatgtgccaacaatgaacgcaattatttgatcttagactaaaataatcactcgaggaactcgtttcaaaagaaagaaaccaatcaaatcattgccttccaactacggatactgagtttttttaactcattataacacgtgagatcgtcactatctcacgcatttttctttttgggtgggtaattcactatctcacggattacataaatgtttatggattatgacgattggctgcattggaagatgtatagcccaagaaaacatatttaatccagtatgatagccttgtgatgctctataatttaaagcatggttttatatataactgtgacgtaaatatcaaggtctaaaagcattgtcattttatttttatttcgtataaatgaaaactttagtctaaaacacccggtcatgtaaaagttaaaggaaaaagaaaagaatgatagctgattaattatggcaatgtcgtactatactacgtcgagaactattcatgattagatattcatcggtatgataaatcatatatatgtgatgtgcctagtgcagaaacccaaactattatttatttatctactcctttgggctttgacgtgcaagtaaattcttagatgttgttttcgaagtttatgggtaggcaaaccaaaatctggaatgagatatagaagaaacaaaaagaatttcgagaatgaaaattatgtctcattttaaattcaaatgaactataattcataataagaacatatgttaaatgatgtttttacaacttgatatggatttaaattacataaaagagaaaacacaacttttacctactccttctcacaactcattcatttttggtgtaaagttgatatatgtggtggacaagtgaaatttggcaaaacttggtttaacaattggctaaccctatgaaacaaattaggcctttgggtagagctttcttttatcaagtaccaacttcgaggttatatatatgctctgcttttatatattttggcatgattctaggactcttttggatccttcgattgatatttgtagacatagcaaaattggcagtgcaaagataaggttgctgtgtaagtcttgatagaatttagcaaatatagagactactcatctcgtctattctctctctataagttaaaattgatgggtttgatatcaacaagacattacaatatttctaaaacataagaatatctatacattagccatcaattagcaacaaattttttaataatcaatttaccatcataattttgtagcaagttggtgaaggaagactcttttcttggcagccaaacatcacattaatcccattttaacaataaagtgattaaaaactaaaagaactgaataaaataaaaacaaaagaaatgaatgaagcctttggctttgctttttctctttttgattctctccactttatttttcttgttgctactgctaaaaaaagcatcttcttcttccttttttcattcttaagagtcttttgcttttccttgttcgactctctcttttcacttatttagcttttgcttctgattggaactaaactcaattctctccttcttcctcctctttgcgtgtggtttatcttcctctaattaatctattgatctcaattctcaacctttttgttaatttcaatttccttacccctctctgcgttctgggtttccgagtctcgatttctgggatttcttgcttctcacatgaatctgtttcgcaacctaacttattcatcggagtgatatcgatattcttctcaaattttgaagcttttcgtttcgaattgacaattc

SEQ ID NO: 11841 - DNA, 3000 bp, Unknown
  misc_feature (1)..( 3000): cDNA_ID_1807670_gDNA_ID_2214519_Annot_ID_184555 3000 nt of
gaaaagaaaagaaaaaacaatggcggatcagctcacagacgatcagatctcagaattcaaggaagccttcagcttattcgacaaggatggtgatggtatgcttcatcctccctttccctctatcatcgtaggtcttggccgtataattctgatttagtttctgcttgatttggttcccttttgatatgtatcgattaccgtggtgacggatccattgttcgtatcctcgcattgactcttttcgttttcgatgttccaaatcattattgaattcaaggatttgtttgtgcctttgttcaaattaaagatctatgtagttcggatgaaatatttgtgaatcagccctgtggtgttagtgatgattcatgttttcaattcgtattttgaccagtttttattgatttgttctgattctggatttgcatcgtagtaacaccaatctttgattactttgtgtaggttgcattaccacaaaggagcttggtaccgtgatgcgttccctcggtcaaaacccaaccgaagctgagcttcaggacatgatcaacgaagttgatgcggatggtaacggaaccattgatttcccggagttcttgaacctaatggctaggaaaatgaaggacactgactctgaggaagaactcaaggaagctttcagagttttcgacaaagaccagaacggtttcatctcagctgctgaattgagacatgtgatgactaacctcggcgagaagcttactgatgaagaagttgatgagatgattaaggaagctgatgttgatggtgatggtcagatcaactacgaagagtttgtgaaggttatgatggctaagtgaggattgaaacaacttcttcggctttctccttttttttttttgactaccttcttatgtaatttcataaagaatgttccttcgctttgttctaaaatttcattcatggctggtttttgctggttaaaaagacaggaatgttatgtgtttttaccttttgtctaaatgactcattgttcatgttattgacaggttcagaacctgattcttgaaatataacagtaatgagatcttcttctattatcttcgtattgatcattctctttagaatctgtcgtcgtatgtagaagcaagaagatgcttatcggttgcggtaagggtagggagcttaacccgagttggctcagacgatgaatgtaaaggagagaagagtatagaagttgtctcagacattccattgttgaagtcaagcacagtctctaagctgtaaatactctctccagctgcataaccacctaagagttgatacgatctgtctgattgatccatcgtcaaacacatatcttctgaacctatcatcaatcaattcagatttcttgagtgtcacaattaggttcaatttgctaaatggtttcctcaatcaaaaattcaaaattcaaaacttacaggcagcaagttcaagctgagtttgataaacgaattcaagaactgcggagacatctcgctcgaattcatgaaacggtccgtcttcgaaattcatcttccttagcttacatactccttctcctaactccatcatcgctcctttatggttcttcaaatcccaaaacactcactaaaattacctcaaacgtgaacgaaaacgagcaatagatggagttaaaaggagagtagatttacgttgttgaatagatggtgaaatccaacagcacattgaagaattccatggattaaggtacgagttggttcctctgcttgaatccaaagagcttcaagcgcgtcatgacttttgtaataatccctcttgttgaagagagtcactgcttcctcaaagctccaatattcttccttatcctcgtcactatcctcttcgtcttctccggcgtggtcgttgtatctgacgattgatcttcgactgaaacggacgcgtatggagctaaattttgtggaggctcgaatcgttgaagcagtaacagagattggagaagaagggattaaggagctgaagaaagaagatggaggaagcgtgaaagatgaaggaacctggaaatgtttcgaagaaactgccattatcaaagtcaaaggtcgagctctgtctctactgcatggttctggcttgcgccagttttgtggtcaccgttttaccaaaactttgtaattgggccactatttgggtccttattttttatataatttaggcccatattttatggcgaagccttcctcatatcatatggttgtctcattcgtaaattatttttctgcagtagctttctcttatgattatcaaatttgttgattatttagggcttttatgttgtcaaaaaaaaaaaattagggcttttgaatactcaagtttttccagacattaagttaaaacaaatactgtatattatttaatttttgttaaataacaaatttatgttatcgcattgcactgtgtgagatttatccggacaaaacacaatgatagaagcagcataaatcatatcaggatatgccttttattgtttatctttaataccttagaaatggtatcttatcataataacttaaaggatcattattatggtagtggtaaaacatcattattattcataagtaaagatttaaagaatgttcaattttttgagatttgtttttgaatttttgaattttggaaatgcagtaatatactatatagtcccaaaagtccgtatgtatcttcagttcaattgatggatcatatagaactatttagaatgatgatggtggcaagacaatgacctaattaaggacccttcctaaaaatttcaaactctatagcaactttttccccaccaatatatatataaatacaaaaatcaagtatttaacatctaaaataaaaaaaataaaaaaaataatctacactctctaccctctcatttcacgtatatataatccatcttttaggacagaacccaccgaaagctccacaaaccccattaattaacaaaaaaccaaaagaaggcggcgcaaacaaaagata

SEQ ID NO: 11842 - DNA, 3000 bp, Unknown
  misc_feature (1)..( 3000): cDNA_ID_2707639_gDNA_ID_2214519_Annot_ID_184554 3000 nt of promoter + ATG
atgatcaacaaaaacagtagactagacatttcgctaacacttaattaatctcaactaaaagtaaaacagttcgtcataatcacatggatatatacgaatatataagaaagaaagaaaaccaggcactgcttatattctttggtctgaaaaatgtggtcaaatgtacacatttagaaagacatgaacaaagaaagagataggagagtttggattcatttggggacaaaggtgacataagggtcgctttgaaactcacagcatacaaacatagaccttctcttcactatatatacatatatattcacatgtatagtgtgtatatgtaaatcgaagtaccctagtttcttttggacttcaccaatcacatctgttacttagattcttctacgtcgacaaatattcccacaatctcaaaaccctagtcatcacaccaacaaccaaaaagatatatataaatagaggaaaataacatgacaaatattctttatatataatatagatctttttctttttcttgaaaaagaaaaaaaaaagaaaagaaaaagaacacaccaaacctacttacaacatttgcttacactcccaagacttagtaactaaaaccatataacatatatattattaaagaggaataaaaaaggttttggtaattataaccaagttaattatgatcataccctatatatattaatcaattatagactttttagtgtgctcaattctcatcatttcacaccattatgatgtgatccagcgcacgacgccgctttgaccgttctcctcctccaccaccagaactacgttccatcaacgacttgcttgaccgctcaagcagcgacttgagagcattttgcaaaaaatgcacagactcgacgccgtgcatctctttgtcagcagctacgacaagaacacttcttgtccgaccaccaatggttaccatctcagctcggagagtcttcatgttaagagacttgagaatctccataaggtccggcaagagatctgatctatcttcacaacatagagaggctttgaagattatatgaccgtcgtttgaatagtctccaaagtgtagaacactaatttcgtcggtctctgatggtaataatgtttggtcggagtcggaggtctctagggtttgctgtttaagttctctgactcgttgaactactttggcgagcagtgtggctttatcggtctgaaaatagaaacatgaaattacaatgaaaagtttggatcaagaagttgaaatttgatgtttgtatcaaatcaaatcaactgaaaaagcttgagaactttcccaaaaagtgatatactatcccaacgagcttcacaaaaaggccatgaagcttttcgtttttctcatctgatcactactcgccagttttgaatattcaaatcaaaatatatatcaatctttagaattataaatgtagaaaattagggatcatctttgataaatatgtgcttgttaataagtaagaatagtaagacaaaaaagactcaattgaaaccaaatgattataaaatgttatcatgaaaaagtacagtattcatgagctaacaccaaatcgaatgaaacatgagaaaattttaaagatgtaaactctgggttagagaagatgcaaaaccctaattatatacccatttcaaaaatcttttcttaaaatttcaaagaaatatatacgtacagatgtataaacatcatatgtacgaggagagatacatacgccaaatgaaaaagtatcaaaagtttatattaccttagaattacaagagagtacgttacgaagcttgttgagatgagaattgatcctctctctccttcttctctcagcttctttgtggttcctcaaagcagctaaagctctgtcttgagccatcgtttctccgatgccggagatcgccagtgggtaatacgatgacgtcgacgacgaagacccacataagctctgcatagtcgtcatgtagtcgccggagacgcagtaccctccaccgccgacttcgtttccggcaagaaacgagtacaacatctgatctgaggtctctggttgcattatcttttgtttgcgccgccttcttttggttttttgttaattaatggggtttgtggagctttcggtgggttctgtcctaaaagatggattatatatacgtgaaatgagagggtagagagtgtagattattttttttattttttttattttagatgttaaatacttgatttttgtatttatatatatattggtggggaaaaagttgctatagagtttgaaatttttaggaagggtccttaattaggtcattgtcttgccaccatcatcattctaaatagttctatatgatccatcaattgaactgaagatacatacggacttttgggactatatagtatattactgcatttccaaaattcaaaaattcaaaaacaaatctcaaaaaattgaacattctttaaatctttacttatgaataataatgatgttttaccactaccataataatgatcctttaagttattatgataagataccatttctaaggtattaaagataaacaataaaaggcatatcctgatatgatttatgctgcttctatcattgtgttttgtccggataaatctcacacagtgcaatgcgataacataaatttgttatttaacaaaaattaaataatatacagtatttgttttaacttaatgtctggaaaaacttgagtattcaaaagccctaattttttttttttgacaacataaaagccctaaataatcaacaaatttgataatcataagagaaagctactgcagaaaaataatttacgaatgagacaaccatatgatatgaggaaggcttcgccataaaatatgggcctaaattatataaaaaataaggacccaaatagtggcccaattacaaagttttggtaaaacggtgaccacaaaactggcgcaagccagaaccatgcagtagagacagagctcgacctttgactttgataatg

SEQ ID NO: 11843 - DNA, 3000 bp, Unknown
  misc_feature (1)..( 3000): cDNA_ID_2707635_gDNA_ID_2214519_Annot_ID_184552 3000 nt of promoter + ATG
tgtttttataaactatttattaaaagttagtataagaaaactataacataaaagtaaaatataatttagacaaatgtagcgattggtccagttactcatccaaaattccaaatgaatcttccaccgttgataattctattccattgttttcttctgtagaagaccatatattattaagtctctagtccattgtcaataaatggaaatacaaaaaaaaaaaaaaaaaaaaaaagaagaagaagaaaaagacagcatttaatgaacgaaaataatattaatgaatttggaagaaggaacgaaccaacgagaaaaatcaacgaaataatttagacaaatgtagcgattggtccactacccatccaaaagtccaaatgaatacttcaccgttgataattctattcaattgttttcttctgtagaagaccatatattattaagtctctagtccattgtaaataaatgtttctttcaaataaatggaaatacaaaaaagaaaagaaaaaaaagacagcatttaatgatgataacgatttggaagaaggaaccaaccaattagagtaacaaaccaaggaggcgactcacatgaaagcaaaagctgacatggcagtgaattcagttttataaaaaaggcttcaaggccgagagttcgtagtacaaactcttctctcagtcatcacagaaaataaaaaacaatggcgaataagttcactagacaacagatttcagagtttagggaacagttcagcgtatacgacaagaatggtgatggtatggttcatcgtctctattcctctaatcgtacatattggatcctgaatcatcttcaaagcactgaaaatgactaacacaagtccttgattacttcttgtaggtcacattaccacagaggagttcggtgccgtgatgcgttccctcggtttaaacctgacccaagctgagcttcaggaggagatcaacgattcggatttagatggtgacggaaccatcaatttcactgagttcttgtgcgcaatggctaaggacacttactctgagaaagacctcaagaaagatttcagactctttgacatagacaagaatggtttcatctcagctgctgaaatgagatatgtgaggactatcctccggtggaagcaaactgatgaagaaatcgatgagattatcaaggcagctgatgttgatggtgatggtcagatcaactacagagagtttgccaggcttatgatggccaagtgagatttaaacaacttttccgcttcccctttttttactacctcttatctaatttcataaagaatgttcctctcttgttcttaaatttcattctgagttcttgtgtgtatggctaggaatcaaggtcatgatactaaatatgacacaactggtggcactttggagagggacttggcggccggggttgccaaaaatatcatcgcagcgccaatgaccgacttcatcaaaaatttgttcgaagcgttgttttcttgaaatggtacatcagtaactttatgccattagggtctggctggtatgttagatctctctaaaaaggcgtttgatctttgaaaataatttctatgtaataaatttattgtgttaccatcttttcttgcatgcaatttattaaaatgagtttgtaatatggtttcagtatcgaatataattggggtatcaatgtatcttttgagaaaaacatttaaaacgtagcagaactaattattgaaaactggtagcattactaaaaattgatctaaatcggttaatgatttggcacatacagtgatcaaatcagctaagcctcatatctcaccgtcccagagttcttcaagactcttataaggactcatctaatgaataatgacatgcctcgcaccaacctgccctgcaacattgaaaacacacgtctacaatttcgataacccaagtgttttgagcaaaacaaaggacgccctttgacccatttggactacaatgtgtggaaaattactgcatgttcaatatcagaaaacttggataacatgtcttcgatatgggcttttcttattttgtacccgtgtaatttcgctggcccaaaatccaaagcaacaagggtaaatttgtatgcagtacatgtggcatgttgggtcatatggaaacaggtcacaagactcagattctttacattgcggcgggtagtagtagctttctagtctaccttgagattgcccctgcccgtgattcttgagtcgggcacaggaagtggttttctgtcaactttacttgctcaagccatccccgcaaggtagaaacttctgtggtctttctcgttatttcttatgtaccatgtttttggtcgtttgtgtagtttcttctaaccttccacacacttgtcttgcgaattccttccacagcagagatgttaaatcaggaatattcaggatgtagaaacttctctgctctttctcaagtagaatgcacttgtggaatccctcagatcagatttcattggtaacgttcgttaacttcaacaacaacactttactaaacatgtgctaatcaattgtcatacgcttgtatttcttcgattcatttttatcttatgcaagtgttttctctattatgatttatttagttttgcataaataaggacactccttcggagtcagtataagaaaactataacctaaaatataaattaggcaaatgtccactcacccatccaaaattccattgtaaataaatgtttctttcaaataaatgaaaaaaaaaaaaaaaaacaagttggaagaaggaaccaaccaagtaattgccagtcaaaggaggcgactcacacttgaaaggataagctgacatggcagacaacgatcctgcgtagaaattgcgtgaacgtggaaaagtttgaggatatagccgtcatttcaaataattcgggtactattatataaggcttcaagtcctggttcgtagtacaaattgtctcacaaactcttctttcagtcatcacagaaaacaaaaaaaaca

SEQ ID NO: 11844 - DNA, 3000 bp, Unknown
  misc_feature (1)..( 3000): cDNA_ID_1808111_gDNA_ID_2214519_Annot_ID_184551 3000 nt of promoter + ATG
attctcctccgacaagttcatatgcaatcatctgatgagcatgtactccaagcttggagattttccttccgctgttgcagtatatggacgtatgcgtaagaagaattatatgtcatctaacatactcatcaatgggtatgttcgtgcaggcgatttggtaaatgcccggaaggtgtttgatgaaatgcctgatagaaagctcacaacttggaatgctatgattgctggtttgatccagtttgagtttaacgaagagggtttgagtttgtttagggaaatgcacggattggggttttcgcctgatgaatatactcttggtagtgtttttagcggatctgctgggttgaggtcagtgtctatagggcagcagattcatggctacacgatcaaatatgggcttgagttggatttagttgttaatagttcgttggctcatatgtatatgagaaatgggaaattgcaagatggcgagattgttataagatcaatgccggttcgtaatttggttgcatggaatacactcatcatggggaacgcgcaaaacggatgtcctgaaaccgtgctttatctgtataagatgatgaaaatctcaggttgtaggccgaacaagatcacatttgtaactgtgctcagttcttgttctgacttagcgataagaggtcaaggtcagcagattcatgcggaagctattaaaattggggctagctctgtcgtagctgtagttagttcattgatcagtatgtattcaaaatgtgggtgtcttggagatgcagctaaagctttctcggaacgtgaagatgaagatgaagtgatgtggagctcaatgatttctgcttatgggtttcatggacaaggcgatgaggcaatcgagctgtttaatactatggcagagcagacgaacatggagataaacgaggtcgcgtttctgaatttactttatgcgtgtagtcattctggcttaaaagacaaagggcttgagttgtttgacatgatggtggaaaaatacgggttcaagccaggtttaaagcactacacttgtgtggtggatttgctcggtcgagcaggctgtttggatcaagccgaggcaataataaggtctatgccaataaaaacagacattgttatatggaaaacattgttatctgcgtgtaacatacacaaaaacgcagaaatggcacagagagtctttaaagagattcttcagattgaccctaatgactctgcttgttacgtcctgcttgcaaatgttcacgcctcagctaagagatggcgcgatgtatcagaggtgagaaaatcgatgagagataagaatgtgaagaaagaagcgggaatcagctggtttgaacacaaaggtgaagttcatcagtttaagatgggagatcgctctcagtctaaatctaaagagatctattcatacctgaaagaactgactctggagatgaagctgaagggatacaagcctgatacagcgtcagtattgcatgatatggatgaggaggagaaagaatcagacttggtgcagcacagcgagaaactagcggttgcatttgcgctcatgatattacctgaaggtgcaccgattagaataatcaagaacttgcgggtttgcagtgattgccatgttgctttcaaatatatatcggtgatcaagaaccgagagatcacgttaagagatggtagtagattccatcatttcattaacggaaagtgttcttgcggcgattattggtagctgggcagttaaagtatgctatgactctctgcttcagagtctttctggagtcttaagcactcagattggatcgggaagccatctgggacgaaagcattcagcagcaagggtaaaattacactgcgggtagtagctttgtagtctaccttgagattgctcctgcctgtgttattcttgagtcaggaacatgaagtggtttgctgtcaactttacttactcaagccatctccgcaaggtagaaactatggttcgcgttatttcgtatgtaccatgtttttggtcgtttgtgtagtttctaaccttccacacccttggcttgcgattctttccaaagcagagatgttagatcagaggatggagtgggttctcaagtagaatgcacttgcgaatccctcagatcagatttttcataggtaaagttcgttaacttcaacaacaccactttagtaaacatgtgataatcaatcgtcataagcatcttcgattcatttttatcttatgcaagtgtttgctttattatgatttgttaagttttgcataaatacggacgttgaagcacttcccagaactcatgagtgtttttataaactatttattaaaagttagtataagaaaactataacataaaagtaaaatataatttagacaaatgtagcgattggtccagttactcatccaaaattccaaatgaatcttccaccgttgataattctattccattgttttcttctgtagaagaccatatattattaagtctctagtccattgtcaataaatggaaatacaaaaaaaaaaaaaaaaaaaaaaagaagaagaagaaaaagacagcatttaatgaacgaaaataatattaatgaatttggaagaaggaacgaaccaacgagaaaaatcaacgaaataatttagacaaatgtagcgattggtccactacccatccaaaagtccaaatgaatacttcaccgttgataattctattcaattgttttcttctgtagaagaccatatattattaagtctctagtccattgtaaataaatgtttctttcaaataaatggaaatacaaaaaagaaaagaaaaaaaagacagcatttaatgatgataacgatttggaagaaggaaccaaccaattagagtaacaaaccaaggaggcgactcacatgaaagcaaaagctgacatggcagtgaattcagttttataaaaaaggcttcaaggccgagagttcgtagtacaaactcttctctcagtcatcacagaaaataaaaaaca

SEQ ID NO: 11845 - DNA, 3000 bp, Unknown
  misc_feature (1)..( 3000): cDNA_ID_1379513_gDNA_ID_2214519_Annot_ID_184549 3000 nt of promoter + ATG
ggttgggtttaaaccaagcatttgggcaggctttgttggggacattagggacagctagcccaggagctgtaggtggaatgccaagtggctatggtactcaagcaaatatctcacctggggtctatcctgggtacggtgctcaagccgggtaccagggcggttatcagactcagcaacctggtcagggcggtgcgggaagagggcagcatggtgctgggtatggtggtccttacatgggtcgttagattagccactcaggtaattattttcagcttcttttcatctatttcattgatgttctgtatcagaagactttttttgtagttcgcttggttcccttgtgtatttcaagacatggacttgctgtattttgaccttttcatggttactccattatgttaaactttttgcgttgcaagatcattttgttttcaaagttcctgtgactttgttgtgtttctgaagggtgttaggttttgcatcagtttataaaagtcttctcttaatttcttaattcattgtgcagatattccaatacagtactttttaaaattggcctggtgaatcttctgaagttattaaggagctgatgcaaatggagttgtttagtttttggatgaaatgttactctttcgtgtcttcaaaatacatgactcttcaaacctttcaagaagttttagttttcccctacttgttttctcaactctttttatgatatcccaaatacactgttctgatttaacaactatcgtttctgttttaaacttttgggaacgttttcatttgtaaaacttaaacagtgttcctcatggacacacaaacgctttcactatgtttgaatccgtattttccattttctcttaatcagactcgtttttattggttctcgctatgtttcgcggttttgtggaatttttccatgcacgtaattcctcttaagattttgaccttgtgagagtatgatcacacatcactatgcatatgtacataacggcttatcttgattaccacatattatatctgcttaatccttattcctcttgcaggtaatttaagagcaagctgaacggtcaacacttacgcccaacaaaaatctatggggtaccaaatatttgaatgccacctatctgctttttcttttatatatactgaaaagtgaaaagggatgaatctatgaattggtagctttataactaaagaacgaattaagcaaaagttgttttcttgtttaacttagctaggcatctacctgaatccaaaagagcaacttgttttgttttgtactaataagtatcaacaagtcttgacctgcacatgtcaagtttttgacttgatttagagcagcttgtttcttgtgtgtccttggagttctctactgtttctatagctttgaatgagctttccatttgaccacatctcaaaaaatttggtaatgtgccttagaataacaccgagtttggtaacacagctggaattggtgttttgctgtggcatcatgggagctctgaaatgtcttcccagttaaaggtgagtataactgtttgcattgtgaagatttgtattaactatagaacattgaattgatggtgttaagttcttacacaagcgtgcttctcggtttgaactgtttcttttgtatgttgaatcagagcttagtttataggaaccagagtatctacttagtcattctctaatgctaagtgctaaggttctacctagttgccctctaggcccttatgttattgataacttatgaagctatttgaacacttgattcttaggagacctaagttggtacagccagatagagtgtatgttcttgttctctatgtgacaggatcaagctgccacacatagttcaagggtatgctctgtgtgggtttgctcagattgaggacaaatctatacaaggaagtagagtctttgacattttgatgttgtatgataagaagaagaaaggagagtaataaagaaagagaaaagggaaacagaaacacgtgggagaacatcccaaagaggaagcacacgcggatcttcatgcaaagctccccgattctcccatgtggtccctttctccctttgtccccctcctctttcttcttttctcattttactcctttttttaccattatacaacgaatcttttttatcataattttttggttttggtttattttccaataacaccttcttggttacttcccattctcactttttcatataagaaactcactttgggaaacttatgtttgagaatgacaagtctttttagagaaagtgatgtaacaaatctaaagtgattatataataaccttgcacaatgtttttgattttttgtaagattcgaatattaggtttattattcgtagggaataaacttactttcaaaagcgttcataagttaatactttcatatatgatcataagtacggacactattgttttttgtttgtttgtgtttattctaaaagaaagtagcttttaattgaaatgtcctcagaggcacagtttaaagttcgagtgtaacagtttctaaggcaaaataagctctctttctactatttctctttctctttctactatttctctcctgtggagaaactcaggagatagagagagagagagagaagagaagagagcatgtatgtttggttttataatctctctactcataccaaagatttgtctcagacccaccacttggacagagagaacccaagctcctttctctctttttctcgatctactccttcttaatctccttttttgaaacttgaagccactttcaacatcatccttaaacttttgttcccttattcacaatctcctgccacctctcatttctctagttgagttgttatctgcgtttttaagcactcgaatactgcatgcaaattccctgattgtttgttagtaccttagagattctcgattttttagttgtttagattgaaccaggattactaaattgttattgttttctgtgtaaaggctacatat

SEQ ID NO: 11846 - DNA, 3000 bp, Unknown
  misc_feature (1)..( 3000): cDNA_ID_3023170_gDNA_ID_2214519_Annot_ID_184548 3000 nt of promoter + ATG
aacaaaaagaccccacaaagtgaatattcccccaaaacccaaatcacaccctcaggattcagattcttccattaaaagcaacaaaatcgaaaacgttacacaaaatctggtttcgacattcacatatcaacaccattgttaaaataatctattcgcagcctgaaatatccggtttcataaaaagcaagagaaatcgattccctaatacattaagagaaacgaattcgtattcgactattcgtttacacatcaatggaagagaaagttgtcaccttttattataaaaaaaaaacagaaaaaagttgtcaccttttccagaagaaagaaacgaaacccgtgaatgaatgagtcgacgggtttatacttggaagaattatccgggagattttaaaggagaggcctttaagcgttaaagaggtagctctggtgactgctattcgtttgtctctttgctgttttatggcgatttatatatcatcatcatgtgttccttctggaaaacacaaatcaccatctgaacgaaataaagagttaaaagagttttctactccaatattccttcaaactacaaataaatattttatatctttttttccgtggtcttatttttattagagttttatttctttagcattattgtcgctaaagagtagtggatttggtatcatcgattttagtcctattctgtttgttttgaaattgtttttctttatgtcacgtcgccggaaatttgttggccataatttagtaggatatattgggtgcatgtctaccaaaataatgagataaataataattgatggaataattagaaattaattatattttatatcttttattggaaacttttctcattattctttttttatttattttatatttcattgtaaatggtaaaatttgtgaggaatctattattttaccatataataatgagataaatggataataattgatggaataattagaaataattaatattagtatatctttttgggctaagctaatgcaagactggtcaattggagatgaacccaaaagtcatggtacattctatatgggcctcaaaagtccatgtgacataataattcaaggcccaataggcgtcttcttgttatatatttttttttgtttctcaataagacaagaattgtcttcacgcttccgcgaatcgttaagcttcacaatttcaagcgaagaggatcaaaaaatcaatttttttggagaagaaccagaaatcacaaaaccctagagggctctcttcaaatcaaccattaaaaccgccaattccgttatgacaaagaagagaaagctcgaatctgaatccaacgaaacgtcagagccgacggagaagcagcagcagcaatgtgaaaaagaggatccggaaatcagaaatgttgataatcaaagagacgacgacgaacaagtagtagagcaagacacactaaaggagatgcacgaagaggaagctaaaggtgaagataacatagaagcggagacgtcgtccggatctgggaatcaaggaaatgaggatgatgacgaagaagaacctattgaggatctattggaaccgttttcaaaggatcaacttttgattcttctcaaggaagctgcagagagacatcgcgatgtagctaatcgaatccggattgtggcggatgaagatcttgttcatcgtaagatcttcgttcacgggcttggatgggatactaaagctgattcacttatcgacgcttttaaacagtacggagagattgaagattgcaaatgtgtggttgataaggtatctgggcaatctaaaggttatggctttatcctctttaagtcaaggtctggtgctcgtaacgctcttaagcagcctcagaagaagattggaactcgtatgactgcgtgccagctggcgtctataggacctgttcaggggaaccctgttgtggctcctgctcagcatttcaatcctgagaatgttcagaggaagatttatgtcagtaacgttagtgcagacattgatccgcagaagttgctggagtttttctcaaggtttggggagatagaagaaggtcctttggggcttgataaagctactgggagacctaaaggtttcgctttgtttgtctatagatccctagaaagtgccaagaaggcattggaggagccacacaagacttttgaaggccatgtcttgcattgccacaaagcaaatgatgggccaaaacaggttaagcaacatcaacataaccataactctcacaatcaaaattcccgttaccaaaggaacgacaacaatggttatggtgcccctggaggccatggacatttcatagctggtaataaccaagctgtgcaggcgtttaatccggccattggccaggccctcacagctttgctggcatctcagggtgctgggttgggtttaaaccaagcatttgggcaggctttgttggggacattagggacagctagcccaggagctgtaggtggaatgccaagtggctatggtactcaagcaaatatctcacctggggtctatcctgggtacggtgctcaagccgggtaccagggcggttatcagactcagcaacctggtcagggcggtgcgggaagagggcagcatggtgctgggtatggtggtccttacatgggtcgttagattagccactcaggtaattattttcagcttcttttcatctatttcattgatgttctgtatcagaagactttttttgtagttcgcttggttcccttgtgtatttcaagacatggacttgctgtattttgaccttttcatggttactccattatgttaaactttttgcgttgcaagatcattttgttttcaaagttcctgtgactttgttgtgtttctgaagggtgttaggttttgcatcagtttataaaagtcttctcttaatttcttaattcattgtgcagatattccaatacagtactttttaaaattggcctggtgaatcttctgaagttattaaggagctgatgcaa

SEQ ID NO: 11847 - DNA, 1801 bp, Unknown; identical to SEQ ID NO: 11834
  misc_feature (1)..( 1801): cDNA_ID_2706352_gDNA_ID_2214519_Annot_ID_184539 3000 nt of promoter + ATG

SEQ ID NO: 11848 - DNA, 3000 bp, Unknown; identical to SEQ ID NO: 11844
  misc_feature (1)..( 3000): cDNA_ID_1808111_gDNA_ID_2214519_Annot_ID_134026 3000 nt of promoter + ATG

SEQ ID NO: 11849 - DNA, 3000 bp, Unknown; identical to SEQ ID NO: 11843
  misc_feature (1)..( 3000): cDNA_ID_2707635_gDNA_ID_2214519_Annot_ID_134027 3000 nt of promoter + ATG

SEQ ID NO: 11850 - DNA, 3000 bp, Unknown; identical to SEQ ID NO: 11842
  misc_feature (1)..( 3000): cDNA_ID_2707639_gDNA_ID_2214519_Annot_ID_134029 3000 nt of promoter + ATG

SEQ ID NO: 11851 - DNA, 3000 bp, Unknown; identical to SEQ ID NO: 11841
  misc_feature (1)..( 3000): cDNA_ID_1807670_gDNA_ID_2214519_Annot_ID_134030 3000 nt of promoter + ATG

SEQ ID NO: 11852 - DNA, 3000 bp, Unknown; identical to SEQ ID NO: 11840
  misc_feature (1)..( 3000): cDNA_ID_2707641_gDNA_ID_2214519_Annot_ID_134031 3000 nt of promoter + ATG

SEQ ID NO: 11853 - DNA, 3000 bp, Unknown
  misc_feature (1)..( 3000): cDNA_ID_2707645_gDNA_ID_2214519_Annot_ID_134032 3000 nt of promoter + ATG
tgagattgatggtgaggtgggtcgtggacattttggatatacttgctctgctaagggtaaaaaaggtagcttgaaaggtcaagaagttgctgttaaagttattcctaaatcaaaggttcgatctttgaaactgaaaatcaatttctcttaattctgtattcgttatgttgttttgaaatatatgacaatgatttcgaattctagttttatcgccatgtgtttatagaagtatacagcttgtttctcgaccccgagtcattgcttagtgttgaatggttttgactgcagatgacaactgcaattgcgattgaggatgttagtagagaagtgaagatgttgcgggctttgactggtcataagaacctagtccagttctatgacgcgtttgaagatgatgaaaatgtttatattgtcatggagtaagtatacatttctcagtgagatgtcttaagatcatttgattttcaattccaggattgcaataaatatattgtaatctccttttaccagattatgcaaaggtggtgaactcttggacaaaatacttcaaaggtaattgctaatcacacatggctctgtatctgattgattttctcttctgaatcgtgctttgactggttgagcttgatctaattaggggtggaaaatactccgaagatgatgctaaaaaagttatggttcagattctcagtgttgtggcttactgtcatctacaaggtgtggttcaccgtgaccttaaacccgaggtactttataatccatggtgatgtttaatttctagattgttctctcattgtttttttttgtaaatcattttggcttttgttgacacttcactttctaggtcccatcacattaagcagtctttgtacacatagaaatgagttccactaacttatgcagagtgataatgacggttatgtttctttctatttgtttgtttacctttcacagaactttcttttctctaccaaggatgagacttctcctctgaaagcaattgattttggtctttctgactatgtcaagccaggttagagatgttgaaattgactcaagatttctcatatcaaactcatcttcatgttaaatagaaaatttgacggtgttttgcaattctgcagacgagaggttgaatgatattgtagggagtgcttactatgtggccccggaagttttacaccgtacatatggaacagaagctgacatgtggagtataggagtgattgcttatattcttctctgtggcagtcgacccttttgggcccgtactgaatccggaatctttcgagctgtactaaaggcagaaccgaattttgaagaagctccttggccttctctatcacccgaagctgtagattttgtgaagagattgctaaacaaagattaccgtaaaagactaactgcggcccaggctttgtgtaagtataatatctttgatctctataacaggtttaacacatcattattttgttttcatggttctgcacttcttatattctgaacatctgagtaatcaattgtctttttcctcaggtcatccctggctggttggctcgcatgaactaaagattccatctgatatgatcatatacaagcttgtaaaagtgtacataatgtcaacttcattgagaaaatcggctttagcggtgagtttgattccacagaagctgtgacatatatactacttacttaacaatttcaattgttgagttctttgaatgaaaactttatgattaatgggttttgtttttcatggttttaggctcttgccaaaacattaactgtaccgcagttagcgtatcttcgggagcaattcacattgttggggccaagcaaaaatggatatatctcgatgcagaattacaaaacagtgagttgtttttccatgattccatcaacctcttcagttttcttttgcgatcttctgtgattattgaactttcctctacaaatctcaggcaatcctaaagagttcaacagatgctatgaaggattctcgagtgtttgattttgttcacatggtaagaaagctataaatataaggactataagcttaatcattaggtttggtggtttaacgttgtaatctctgttgggatgcagataagttgtcttcaatacaagaaactagactttgaagagttttgtgcttcagcattaagcgtttatcagctcgaagcaatggagacatgggagcaacatgcacggcgtgcttacgagttgtttgagaaagacgggaataggcccatcatgattgaagaacttgcatcggtataagttttaccctttttaattcacctaggggctagagaagactcgtgaagagcaaaaaacctggtcatgcttgatcttaagcatctgtatgttttaaattgcaggaactcggactagggccatcagtgccggtgcacgttgttcttcaggattggataagacattctgatggcaaacttagtttcttagggtttgtcagattgctacatggcgtgtcttctcggaccttacaaaaagcttagagtaacgccattgttagatgagaaaagatgcaactaggtggagtagatctggtttcttctttcctctccacttcttgatagtttttttagttttctttttctattcatggttaagcttctgagtcaaagattcgataattatgtctgtgagtgtatttgtgtgtggtgggaaggaaaggtttatgaagaagaggaatgtacagaatgagacatatccgattggtgtttttaatccagtgatgtttacgtgtgaagcactcttttaatggcagccggaaaaaacaatttgtctttgtgccatcgttggatcagagcaatgatacgacacgtgattgtgtctcacattgtcagagacaaccacgtgactttgaccttaagatctctgatctcatcttaatctctacctaaccgtcgcaaagattctttctttctctcttcttactctgatctagacactacaacagtttcattaatggcgaca

SEQ ID NO: 11854 - DNA, 3000 bp, Unknown
  misc_feature (1)..( 3000): cDNA_ID_2994434_gDNA_ID_2214519_Annot_ID_134033 3000 nt of promoter + ATG
accgtctcaagacgacacaaagtcacgtgatctgcacgtgtcagattgtttgcacggacttcgacctggtgaccatttcgagatccaatggcgacgaaccaaagagttcccttatggtgcctcttctttctctctctcttttccaaatatattgttctaaattcgaattaaaattcgattacttgtgcgtttgattcgtctgattttggtgaatttctttaattttccggcgtaggttggtggttcggaatcgttggtcatctacaaaactgcgacggcgtacaaaattgtcgttgcgactctgacggtaacaatttaattagtgtttttattttttggtcagaaacagtcgattcgttaattaaggaaaataaaatgtttaatgggatattattggcaatggcagagaatgtggtgatggagttcagacaattcagaccggaatcaccgtggagaagaacggtgataaagaggaaagaccaccgtgagacgggaaatgaagaaaacggtttctacggcggagtaaagaaattgggtacggaggaagagatttctacgtggaagcaattgtggccatcacaagccttggagtagtgttgtaatgtttttggttttcatttaatactttgcttaattgtaaattggttagggaagagactactatttcgatattgtcgcagtagtagtcttaattccttccgtcgttgactgtaaacagaattttttaatcgaaacaaaaaacgacggaattatttgtataaaatagcttaaagattttaaggaaaagtgtttatggccctaatgcaattgctttaagactttaagaatttaggacttttgatgtgaaatcgttaatgatgatggatgcaacaacaaattgggtttattatttatattaaaactatacggtaaatattgtaacaaaatgaaaggatttgggctttatttgcaataatgttattatatgaattagtttaatgcataatgctgataaattattaaaatcagcaaacaataatgaaagattctggattgttctgtttcagctgattatttacattagatatctgagttgttgtttgaattcgagaagttcccggaaacatccctccgtagaaaattcatcggaggcgacttgaggagaaacacggaagctccgatctcacaatttcgcgacgaactcgcttcagcgattgtttctgttcatccgattaagatgaacggaggtccttccggtttcagttacgtatcgaaattgaataacccatttctcattttaacagcttctgggtttttggattaatgtcgaaatctttgaaatttgcagataatgctccggtcacgaaagccttcgtcatcgcgactgctcttttcactgtgttcttcgggatccggggaggttcttccaagctcggcttatcttaccaggtcatttctcatttgattttgctgtattttttattatcgtttttgatttttaagctcttctgggtatatagaagaatgaggatttgaatttggctcagatttgttctctattcgatattcttggtaccaattgtttagctgcgttcttattaccaacattggcactataaaagattacgggttatgcttaggtttccactgcagtgtgcaaggttttgactttattaacaggaagcagctaaaccgataaagctttagtcttggcatcatactgtatagtgctatactttgatggagtttttactaggattagtcatcagacagtggtgtgagctgaataatagatgggtttcttaagcaaatttaggctccaaatatttaatagttcgataatttgcgtctactcgtctgattgtgtatgtcagtagccttgcatttggaaagatgttttgattgtttcagagatctttgtttgtgtggtacaagttcagatttgtttcttttgagaaacggctggtagctgctatgaaaaggtatctctttttaaacttctgccaatctcattgcaggatatttttgagaagtttcggatttggaagttaattatatcggcttttgccttctcgtccacaactcaattgctttctggcttatatttgctatacttcttccgagtctttgagagacagattggttcaaataagtattcggtaagggatagtctagctcagttttttcttcatgacctttttttgtctattattttggtaaatagcaagatacctgctgatatttcctttgagattgaaattctatgagttaatatgtgctcattctgcaggttttcatcttcttctctggatttgtatcactaatactagagaccattttgttatcattgactaaaggtaaaccttcctattttcagatagtctcttcaaaaactagaccggtttgatatgatttacctttatgatatgatttgggggcgctaatgcagacaactatatgggattgtagttattagttagccttgttactagtctttccccactcatcgaaggaaaactgtgaagggaggattgggatattgtgacgatctttgttggtttcaaattctgacctgcaatttccttcactcatactattgaaaatatcttataaagaattcccttggtccatcatttaaattatcaagaaatgctttttgtgcattcttaataagcatttttgatatgaccttttatacactccgtatcacaaacactttacagttattgatagtgggtatataacaaactgctgtcttttttgtagatcctactgcaaacctactgacatctggaccatacgccctcgtattcgcttcttttgtacccttcttcttggatattccagttacaaagaggtttggtgtattgggcgtccacttctctgataaatcattcatataccttgcaggtgtccaggtaaacaataccatatgtttatttgtaggacttcttattcttcttcttattttcattgataattgtctcggtttcaatatttgtagcttttactatcatcatg

SEQ ID NO: 11855 - DNA, 3000 bp, Unknown
  misc_feature (1)..( 3000): cDNA_ID_2707681_gDNA_ID_2214519_Annot_ID_134034 3000 nt of promoter + ATG
tgtatggtctgtcctaattaaagggtctcttaaaatcgatctaatttagcgagggccctctaaatgcccctttcaaaactcctaattttaatgtcactttatacatttttccattctattcataaagttgatgaggttaatcatcatatatataatatattacagtgggttctaaaagaataatatttgggaattttggtgttagttcactatcaaaagaaagttatcaaaagcttcgacaaaaattttttaagtacttttttaaaattgaacttaatcacatagatcttcaaagaagtcaagtcacgtgtacgtacacagatattcaaattctcatgacaaataagataattccaagtttacgacttagcttgactcgatatatgtcaacaaaagttgtaagaatctcgtatagtacgagagtcatcaattttcgggttttcccataaagaataaaaatacctccctttgtcttttattcattttataacaaagtttagtttctctaaggcacccatatgacatggtatgtaggagaaaatgattatacacactatttcatatcgcagacttgaaagaagaaaacttacatacgaatatacgatagatggattttttttttccattatgttatgaataacataacagatgtactcaatagtggcgaaagtcatatttttatatctagctacctagttcaattcttggtttgaaggaatttatttagatgtagagacataaacaatgtaagaaaatctaaacacaatttcacaaagcgaagtattcccttggttcaaaaataactatcacatcttaatatttatgagtctcaccaaatacaaaacgaatcatattttcaccataaccattatagaactcgaacctaaattttttgaaaattgtcggcgacactattaccaatctctagctgatgagttggggctgatgaacgactatgctgatggcgatgaattattaattttggcctaattataaaaattgcaataataccataaccgaagaaattggtgatccttttgaacactaacgacaaaagacaccaaaaaacaaacaaaatttattcgttgttgcattatccggggagcacgtaagtgggttgactttggaagtaaacggacccaaacgacttctcacttcttccaagacaatctatcaagtagatacgtatttatggagttattgtccatgaagatatccattacacatagaaagagaagttctctggaccaatttgttttttgttaaagtccattggaccaaatttcaaattccaaaagcaacacttacaagttacaactttcctcatcaacgattctcaaaatccgtattttaaaaggataaataagataagcccactggaccaaattccaaaagcaagccctcgtccaatgctttacgttgcccaaagattacgaaatccatgagaaaaaggcttttgtgaggaaaagcaaagaaagtttggttacatgataggtactagaatgagctcttaagtatgtaaatttacaaataatttgtaatctttatctatttctcttcgatcaatttgttcattgttggcattacacgctgattgatgatcgtgagtgataagcttagttcaacaaaacaaagctgatggtaaaaatctcaccctacaaaaatctcacttcctgaatgtgacttggggagatttttttttgttctcttccggaaaagcagaatcttcattaaaaacgggctcaacccaatgggctttagacccgacatagagagggtttcatcaacaatgccacatctgttaattagtaactgagtcaaatactaacaaacaagttctaaaaatattaaggcactgggggttttggaatttggtttgggaccgtgtgtgcctgggacaattcaccctaaggtggggctattatatctttggaaataaaaagacttcaattttgtttttagttcacatcttatcaactgcatgtcgtatagcccacttcactttagttgaactaccaaaaggagttgaccaagtcggtgttggtttcgtgagattttggctttaagactttcaagattattatgtggatacatcaataaaccaacttttgttctataatctttaaagtatttttgtacaaagtagttggaaagtttggttgaattaggctacggacaaaaagagagagtagttggggaggtaattacgatttcaatacattctttgcctcaagtgagatttgattttgttgatttgagtagttttaagattgaaatggatcaacctaaaaatcggtgcaacgagcgccagctgttacgcacgacataacctctataaggtcactttctctgtaactagaagcctctcatgggattgtcacttgaagtcttcttatgacccaaccaatgtcattagtggttttgcatctgtttccacctactcctaactgtatttattgctcacccaacttaatgttgcaccttctattaaatagcctcacaacgaatcttttaaaaccctaaacctcattattgttcacagttcgatgtctcttttagtgttttcttattaaaatgtttgtgtttataatgtcttcaacttcaagcttacttgcttaatacttgtaaatatatatatatatatacacagacacatacacaaagcgtgactacatgagacagctcctcttgaattgcgtgtgtaaatgactaaaaaggcaaaaacaaattttcttttcttgagccgtaaatcaatcaatctctctctctctctctctctctttagccactaatctcactctgttttctctccctcgtttcttgctttcaatggagaaacagtacctcactttcatttctttttgtttctccatcaccatttgtgggttcctcatagtttcttggctggcaagaagcataatccgtaatgggattagaacattaacatggagaaaggaaacgaagaggaagaaaaagaatcaagaagatgaaaacaaaatg

SEQ ID NO: 11856 - DNA, 3000 bp, Unknown; identical to SEQ ID NO: 11838
  misc_feature (1)..( 3000): cDNA_ID_2707685_gDNA_ID_2214519_Annot_ID_134036 3000 nt of promoter + ATG

SEQ ID NO: 11857 - DNA, 3000 bp, Unknown
  misc_feature (1)..( 3000): cDNA_ID_3245305_gDNA_ID_2214520_Annot_ID_134039 3000 nt of promoter + ATG
tatcattcttgccatctcttttatacttcaatttatattaattagttagttacaatgtatatttattgtataggttcgaggaatttgaagtattttctattgtatatggtataagataccaaaggacacaagtctaatcgcatgtgctcttctcgtttggttaaaaatcgctgtgattgtttttttactaaaaatcaagctagatgtcatattaggaactatatgttaataacttcatattgcggccattgttacgtaggtgttggaaatagacatttttgttatacaatcactagacatttttcttcttcatcttttttttttttgacttacatgaatataacttataagttcttacttcataaattagggtcataagagtgagcagatgttgtttgatataactggatatcttctatatatgattacagggaagtataggaaaatggatacgatgtaattcgaatatacattacgatgacgacattattagcagcataccatatcatatgaataacagcatcaacggataccgatctcttatttacaggtttgattaaaattacattttaaagaatcgatctagttctctatacaaactatgcggtttttggtaaacagtggtgatcacgatatggaggtacctttccttgcaactgaagcttggataagatctcttaattatcctattattgatgattggaggccttggataataaacaatcagattgctgggtgaataatttttacaatttttttttttgcttctttattcattaactcagtcgaatcatgagctcattagtcattttgaaatccctcttacgattttcttggacagatacacgatgacctatgccaataagatgacatatgctactatcaaggcaagtttttttttttgttcttactcttaatgttttttattacacaaatcattttgtttctcagtaactgttttgaggggtttactatagggaggtggacacactgcagagtataaaccagcggagagctttatcatgttccaacgatggatcagtggccagcctctgtaataataagagatgatgatgccctatgccaatgaaaaagaaatatttgtagcatcaacttttatatatatatatatatatatatatatatatgtttacaatttaatctactacaatattgtaaaagaagatcatctttaagaaataaaaatatttttaaaatgggctctcaacaaaacaaaactgtgtaagtccaaacgtctcataaataattaatcataatattcatgtctccaatcaaataaacctgagggagatggaagagatcgatgtttccaaaggcatactcgacaactatgctttcgattttatcaaaaaaaaactatatttttgtggatgttataagttttctttcagatcataatcattgagttcttgggcacatttgcaagcaccacacctcttacaatagtccaatgtttcttgagcatatttggcttcttgggcatgccgatcgctgcgggctagaagaaaatacccgtgtgatcgaagacacaatgccgataacaaccttgctcttgtaggacataaattccttgacacatgcaaaagttttacaaagcttttgcctttttgtatatcccctttttattttacattgttgaccaaatttgagtcaaataggctaatgacaattaatctactcatcaattcttttttctttgttcttgaaatgaatccattttatcaagaatgaaaacaaaaatttgaactaaaccgagacttgccgaaaaacggttaagtcatcattaataaacaacgcaggaagtggatcatatttttttttttttaaatgtaaaatttattcatcaaaaaagatcatagttacaattagtctgttcatttcgtcgccgcgggtacctgcggccactaaacaaacagactatatatgcatctatgatcatcttaatgtctttgatgagtttggcttggtatttcggtaattcaccgtgtctccactggttttgttctcgtcagattgtgtagatagtggcttgaaaggcgtatcgcaaaatgaaacaatgggtgcgactaatactagaatctgagattgctttaaggatatcaccaaactggtacgtgtcagttgctgagatatcccatgagtgagcttgtaccaaatctgagacgtgacattacatgagaagaagaggtgatcacgataagaaagtggatcgtattgtatttttttattccatcctctaaaaaagggtcaaatgatcattaaagaacaccgaaaaaaatggatcatattgtattttatataccaacctcttgatattttaatcgtttgactctttttttttttttttttggcaaattgccatcatcgcctaagataaccagttttccaatttttaaaacaattattatactatctttccgtcgataagttgtagtttgtcagatattttgaattgcaaatcttgtttagttaacaaagtcataaactacttttctcaaaatcatctcttcattccttagatccattataaaagtagagcgtgtaacatgaagtagttgtgtgcgtgtaacacgaaacagctacgtaacacaagaagatgttgattataaactaatagtcttgggattataatcttttattaatttatcgatatactaattgttctaaaaaaataatttaggatcgaagaaatatataaatttattaaggtattaattcatccaatatgatttcaaagatcctcaatataacctactcctacatgtgactattcaacaaaacgtctggaaacctctattattgataatatatggtcctacatatgactattcaataaaacgccagcaagcctcaattattggtaattaattaactaattgaactctacatgtgataattatcttttttttttttttttggattaaagatataaagatccttgtatcctaagatgactcaatctttagaaactaagagaga

SEQ ID NO: 11858 - DNA, 3000 bp, Unknown
  misc_feature (1)..( 3000): cDNA_ID_2707736_gDNA_ID_2214520_Annot_ID_134040 3000 nt of promoter + ATG
cttccaaccatttttatgctggcggagattcttattccggtatgattgttccggccctcgttcaagaaatctcgaaaggtatcatcacatacttttatttgaatatcgtttaaccgtgctctttaaaataacacactatgatgcaggaaattatatatgttgcaaccctcctataaatctaaaggtaattgcaatttaaatgctctttgtaatttcgtaagtatattgatttttaaaaagtttcgatcaactaaaaatcactaggatatttttttgtacactagaaactgatagttatgtgtcgacaaaataaaagagattgataattgtgtatatatataatatgtttttgttaagttgataattaatattattcttaccaaaaacagggttatgtactcgggaacccgataacgcacgaagacgacccaaactatcgcattccattttctcatggaatggcactaatttcagatgaactatacgaggtatgaaatatgtggcatgcttaaattcgactagtcttgttatccttggcatttttcacaactctttttaatgttaaaaacattttcttattaaaaaaaagtcaattagggaagcctgcaaaggaaattatttcaatgtggatccacgaaacacaaaatgtttgaaacttgtcgaggaatttcataaggtacacattgcacactttgaaatttggtcgatgttcagtaatttatcagatagtgaacatctaactcagatttgtttttaataaacttacagtgtaccgacaaactaaatgaattccatatactatcaccagattgcgacacggcatctcctgattgctatgtaagtaatatgtcttttctccacctagtgactcttgtaaaagggttggaaaatgaattgatgaagaaacattttttctttttcaactacacattaagtaaaataccgctccatgattaagtcaacaaaaaaaattgcattttatataacttccaagaaacatacttttaaggttgcttttgcagttatatccattttatctcattagcttttgggccaatgacgagagcgtccgcgatgctcttcatgttaataaggtatatgccattaataatgtgtgatgataaaaaagaaaagaagccttaaaatctaaactatggccgattgatgattacagaggagtattggaaaatgggagcgatgtaactatctgagtaaaccatacaacaaagacatcaagagcagcgtaccataccatatgaataacagtgttagtggctaccgatctctcatctacaggtaagagttagatacctatatctaaattattaagaacctgatcaaaaatttcctaattagagactcaagcaaaaccaaattaaatcaaaccaaaatttgttattattttacttttaaacccgaaaaaaggaaacaaaaatgaatagacaagaatttattaaaaatatataggcatatccatattacgtagaaatttaatttacgtaaattattatgtatttatgttttgcaattattattattttatttttttgtgtaaacgcaattatttaacttaaaacaacctaaacaaaccgaattacatcatggtgaaacgaaacaaaccaaattacagatggattttattttgttttactttctcttaattcaatataaaaaatcgatacattaatccacagtgtccattcatacatacaaaatttaagagattccaatattttgcgcggttgatggtgaacagtggtgatcatgatttggtggttcctttccttgcaacacaagcctggataaaatctctaaattactctatcattgatgaatggagaccttggatgattagagatcaaatcactgggtatatatatttttttgtgtttttgggttttcttgttctttcattttctcatcgtatcacaagcttataaagctccggtaaaaatcattcatcctttttttttaattgacagatacacgagaacttattccaataagatgacatttgctactgtcaaagcaagtcttcttgtctcaatttaacatttctatttgtcgtttaattaaaaagtattttctaatttgttttaagcgttttgattgtagggaagtgggcacacagcggagaataaaccacaagagagttttatcatgtttcgaaggtggattaatggccaacctttgtaaaaattacaattatgaattatctactatgtgagctatttgttcctgaggaggtttagaactctaccactagttcgacatgctatagttaccaataaatgaggtcttatttgggtctagggagactacaggccaaagacttggaacttcttggtttattgttatatgttgttaggtaacatttttgtgttattcatagattttaccttttggtacttttatcttctcacagattatattgttctgtgttgtgctgttattttttacaattaaacttagatttttaataaattcttttttgtctcaaatttaataagttatatacctatctccattttactcaacaatattttttagatgaataaaatatttctgattgtgtttttttatctttgcgcgcatttagtactttttctgtattgaaatgtaaaattatattaacaaaaaaaactgactttgcatttagtatcacttttagaggattgaatttgatatccaaatcatatcaatatttaggtaaagatgtggcgaggataagaacaaaataataagagccataaaaccaacgcccctaccttatccattattcatgctgttggggattttgatcttatgtcaaaagtgtataatggtatacagtgagggagagcgacgcatgcaacattataaaatatctattttcataaccaacccgatatggctgctccacaaaagaaaccaggcctacgtaacgtggagctactttgtaattataaagatttattgtttcccataaactggttaaatgattttagaaactaaagtaaa

SEQ ID NO: 11859 - DNA, 3000 bp, Unknown
  misc_feature (1)..( 3000): cDNA_ID_2685968_gDNA_ID_2214520_Annot_ID_134041 3000 nt of promoter + ATG
gtgagatccaaccctatccgaccgtatatacgccatgttcagaaggttgtaaagacttgtttaccaattctataaattatcgtatgatatttttatatgttttcacacggttttgacaattattttttggaagatcacctattctgaaattgctgcagtccaaacacgtttaaatgtataatttgtttcaaaatagttgaccaaaaaataaatgtgatttggcgatataagtgacaaaatcaattcttttaaaacgggtaaatgtaattttggttttcttatcgttttattcaaacaaaattcattgtataactcgtgaaaaaggtatatgtaagtttatgttgtatgacgagaaaaatcacacgacgtcaatatgtgaatgcaagatctgcactttaaattttgttataagatctagggatatggtctagattctcatcgtatgagcctaatgattttaggattgaagtaatcgacgatttggatttgtattaacgaactgaaaaatgagagtacaaaagagatctctttagacatgacaaattttttttgttgagtatttttctgactaaacattacacccaaaaaacataagtattctttctggctgtaaccatacgtttttcttcatgtctccccttctccttttaaacgtactagttcgcagttcaaacaccacctcgatcttcgattacattttaattgagaaggacaaatattttattttattttttgggttttaaattttaaagataggactggctagatggttaaggttgtgacaaaattttcttaatgttgaggagaacattttcgttacaaattaagataatcagataaatatgtggtgatttgcaacttccgtaccttatcattattcatggtgttggtggactattcccgaagttttagcgacaaacgcaactcccgtaccttatcatcactaatataatatgattttgaatttatggataagtctagtgacatatatagtgcaaatggttgtctcaaataaagaagctgaaagaattgaaacaatattcaactagtcttttatcatttgagatgaaaaagttgaaaaacattattcaacttaaaaattgaaaaaatagcaagttataaagaaaagttgttcaacttgttcactacaatttgaatgatattgaatgatattcaatcctaaatgatttttattccattcaattttaggcaaccattcgtacccatacagaaagcaacatatatgatactgattgacaaaaccacttcgaaatggttgctccacacaaacaagaatatgagaagggcctacacaacgatattaattactgttaatttttgtttttgtctgcctgcatttagaatatggacaatatctcttcccggaatttgccatacaatcacaacaattaaagcagcgtaccataccatctaaataacagcattaatggctaccaatctcttattttttaggttagagtttagatctactttttaaaacctgattagcttgttccctctacaactataattaggggtggacgaaattttcgtcagggaaataaaaccaaattgaatcaaacagaaataaaacctatatacgttttaaaaattggtttaattatttgatcgcttgtctgtttgttctctgaagtttagtttatacaaccaacattgatatgtgtattttaagggatgatcattttcagttctgtttggttaatccggttttagtaaagctgttattaccaaactcttacaaaagtaattccgtttttttttttgttttttttttattctcggtttaaaattcgtgagcaagttatacataggttgatgacacaaaacatgatatggtgctgatggaactaaagtttccatgctagttagatcagcaaaacgcatcaaccataaactataaatggccaagattatgtcacaaacatccaggtacataattcagaataaactttttattacaaattttacgtcctaacaagtaacaagtaacagagagctcaaaaaaaaaatatgcatacagttatcgacatggctattttgtatcacttttaaggatttcacgtaaacaacgtccaggtacatgattcagaattctacactaccctttgtttgaggaagcgacacatgcttaatgcttttggccttttgccaagtgtatcaagaatggtataaactacaagttgacaatatattttaggcgaatgatttcaatggtggtagtactgggacgatacacttgtaacatttcaaacaatgcagtgacaacacaacagaacacaacacaacacaacatattttcctttgatcttgagaccatgcatcaattgcagctatcatcttttccacatactcagatctagacaaccaagataagtaatctctatttaaataaacaagcataatgtagaaaaagttatccagaaacaacaactctagtcacatataaaatttggcatggcctctgtagaagatagcaagaatgcttcatttcactattgcatcaaggacacaaaagttagtttaaaaaaaaaaaaggagaagataatgtcaaacatatacgtgtgcagatagacaccatgcttcatgtcattattgcatttttcttccctcacagcccatcaccaaagaccaagaacacacacaaaaaacttgttttaatgcgattttaatgtatttctctttacacaatcttactattttttttttatataaaacagaacaaattagtaagtttattatttgtgagggtgtttgattttaattacataccatattaataatttttgcttgggcctggaccacccaagtgtaaaggattatgaacaaaatcaagagcattaaaagcaacgtccctaccttatccgtgtttggtgatattatcaaatttttgcaaaagcaacgtacccatcttatcattattttataaagatcctatgtctatccgtaaatggactaatctttagacacacagagaatata

SEQ ID NO: 11860 - DNA, 3000 bp, Unknown
  misc_feature (1)..( 3000): cDNA_ID_2707728_gDNA_ID_2214520_Annot_ID_134044 3000 nt of promoter + ATG
tatgtttttgctgttaactgttcgaatttgtgatcataccctttagattattagaatcatatcttctctagtgatatgtgtgtgaatgaatcaatgataaaagactctcctttttcttaatcaaactgtgctttgtacgtaatttttatctattatattctcatgacattttgatccacttgtgatcagcacaagatcagtataaagttgaagttgatcaatttgtggagcatggatcctgaatataccgacgatttattaaagtgcgtctttgttttcagttttacgcttatttttcgtgtgtgcattgcgtataatgatttaccgttgttagcacatcaacagccatttggagaagcaaactgaattgcttttagaaactcgtaaaacgatgactcaagaactccaaacacttgaggtttgtttgatgaaactttgtgtacttttgatatgaataatatgagcaagaaatcaatcttacatacatttgtgtttataggtggaagaagagatgatgatgcggaaattctatgagttaatgtctagacagcgcttaaataagaaggtttgtataaagatagttttttttttttgaagatgataatgttggtattgattgagattgatgttggttcttttgaagaaaatggagaagactcaaaatgtgtcacatggtaaagaaatagttgaagtggaagatacttctagtacatccagagagttaatcgtatatgtaaggaaaaggaaaaagaatcaaaagccaacataatgaagatatccatttcttgtttaagtgatggatatagttttcacattgtttatggtgtgcaataataagttgtattttttgagtgatgaaaatttatacgggtatgtagtcatgaaccttgtaagatgttcttggggtcataagagttttatctgatcctgcgagacgataatttaataacattacaagcaaaatatatccattgaagtaatcgtactttaaagatgctatggagagattatggaagcccaaaactctcttacactaatggttgatagtcgttttgtatattttacgctatttacttagtaagttattgagttttcgatctcttctcgagtttcatcgcagtgtaaagggacctagagtaatactcaattggttgtagtcagaagcctgtgaaatttagcatgttataagaaccaagtttaattcagatagtgacaaaagtactgtggagattttgggtgttaaagtagcgacctttatcaccataaacccctctctttctctccattacactcgtgtgaaagaaacttagaaagaaagacttgaagcagagtagaaacagagaaattgcagagaaagtaaagtgcaagagagagtttttacgtgttcaggtctcagtgtgaaaccctactcacgccgggaaacttgttgtcccggaatccactagaatcagtccttatatacagttggctcttactggagcttgtacatacacaactcattaactacattcaaccaaacacgccattccatctcatctactctctgcatctttgattctttgtcccctgtttttcctgttttgttcgaacacttctacaaaggacagaacgacacaaacctttaaaaggaaacaatgctgcaggcgtgcttcctcttcaacgacttgtacgagatgggcttcttgcgtatgggcctgaagttttctaactttgaatcaaaccttctgattccttgagagtcttctcttgccttctcttcttattcatgaaactcgaagacaaactctcacaagtacattattgttggggtcactagccatctaggatccatcggatccgccgctaatctctttgcaagtatatagtgaccccaagtcaacttccgccgcagatagaagccttttacaccaaccgtcgagccgcaagatgacaattcctcacttcataactatcatttataagttttgactttgaaagaaactgactttaaaatgaaaatttcattagtttaagtgaaacagcatttgaagggcaaaaaatagtcccctaaatgtttgatgtaatttaattgcttgtccatatgaaaactgtgaaatagaaaaaaaatcaagttaaatttcaaaaaaattataaattcttactgagacttaaaatcatcagtgttgaatgattaattataaattttgtaagtatagactcatattatctgcataagaaataaagttatcacaaaaagaggtttataaatcaatcgtaaagttttattgcatcatctggttcgggtttctttgtattagatcatgtttaaattttctcttgtacagactaaattccagccaagacatctcctaaaatctcactcacaagatcttgatcgttcacatttacaggctcatacttctcatttcttagacaatggatttggtagagggacatgaatggcttgctcttcttgtctcttcggttcctcctttgtaaggggttctccaagcagatattggtccaacgttcacctaaacggtgacgcgtatgcaggatattcaaaactcaaacccacaatccaatgacctaatcttgcttgagaggtaaatttcaacagtttgagtatctttaaacccatacaagaaatagtaaaagtgatacttgtagaggtaaaaatggttaagaaagaattgttagatacgagaaatgtccattcgtatcctgaaaagctctttcaacatttttattcaagtattcgtcatgtttgctacgtgtaaactaaatcactttttttttttttttgtgtgtgtgtgagagagatttaataacttttattaagagacaaactaaacaacatccttcttagtcactactctctctctctctctatatatatatatatatatatatatctagtctctacagatattttggacgagaagattcatcaaaaagaaaaaaaaaataataaaggaccattttagggaagtgagaacaaaaacaaaagtggtagctatg

SEQ ID NO: 11861 - DNA, 3000 bp, Unknown
  misc_feature (1)..( 3000): cDNA_ID_1807848_gDNA_ID_2214520_Annot_ID_134046 3000 nt of promoter + ATG
ctagtgaccccaacaataatgtacttgtgagagtttgtcttcgagtttcatgaataagaagagaaggcaagagaagactctcaaggaatcagaaggtttgattcaaagttagaaaacttcaggcccatacgcaagaagcccatctcgtacaagtcgttgaagaggaagcacgcctgcagcattgtttccttttaaaggtttgtgtcgttctgtcctttgtagaagtgttcgaacaaaacaggaaaaacaggggacaaagaatcaaagatgcagagagtagatgagatggaatggcgtgtttggttgaatgtagttaatgagttgtgtatgtacaagctccagtaagagccaactgtatataaggactgattctagtggattccgggacaacaagtttcccggcgtgagtagggtttcacactgagacctgaacacgtaaaaactctctcttgcactttactttctctgcaatttctctgtttctactctgcttcaagtctttctttctaagtttctttcacacgagtgtaatggagagaaagagaggggtttatggtgataaaggtcgctactttaacacccaaaatctccacagtacttttgtcactatctgaattaaacttggttcttataacatgctaaatttcacaggcttctgactacaaccaattgagtattactctaggtccctttacactgcgatgaaactcgagaagagatcgaaaactcaataacttactaagtaaatagcgtaaaatatacaaaacgactatcaaccattagtgtaagagagttttgggcttccataatctctccatagcatctttaaagtacgattacttcaatggatatattttgcttgtaatgttattaaattatcgtctcgcaggatcagataaaactcttatgaccccaagaacatcttacaaggttcatgactacatacccgtataaattttcatcactcaaaaaatacaacttattattgcacaccataaacaatgtgaaaactatatccatcacttaaacaagaaatggatatcttcattatgttggcttttgattctttttccttttccttacatatacgattaactctctggatgtactagaagtatcttccacttcaactatttctttaccatgtgacacattttgagtcttctccattttcttcaaaagaaccaacatcaatctcaatcaataccaacattatcatcttcaaaaaaaaaaaactatctttatacaaaccttcttatttaagcgctgtctagacattaactcatagaatttccgcatcatcatctcttcttccacctataaacacaaatgtatgtaagattgatttcttgctcatattattcatatcaaaagtacacaaagtttcatcaaacaaacctcaagtgtttggagttcttgagtcatcgttttacgagtttctaaaagcaattcagtttgcttctccaaatggctgttgatgtgctaacaacggtaaatcattatacgcaatgcacacacgaaaaataagcgtaaaactgaaaacaaagacgcactttaataaatcgtcggtatattcaggatccatgctccacaaattgatcaacttcaactttatactgatcttgtgctgatcacaagtggatcaaaatgtcatgagaatataatagataaaaattacgtacaaagcacagtttgattaagaaaaaggagagtcttttatcattgattcattcacacacatatcactagagaagatatgattctaataatctaaagggtatgatcacaaattcgaacagttaacagcaaaaacataattaaagaaccaaacaaaaaaaaaaaagcagatttagagaaagaatatcttagttagacaattcgtcgagcaactggtgtgcatagtctcgtgcctatcaaatttttcacaatgccacgatacttaaatcagaaacaatcaattacgtctaatatatagataaatcatcaaaaaggaagttcttttacgtaccctttcgtcaaatttaacgattcttataactttcaccaccataaacacttgacgattctcttcttctctctctcaatctcacccaaaatcaagtcctctcttctacaatggagttgactgggctaatgggccggtgtgactaggctaatgggccggtctattgtgacccaaagagaacaacaaagataaataaagtttcgatttttatgtttatcagctctatgtgcttctcattagatgagagactttcgctaatattttatgtgtttgttttgttttttgaatgcagaagtccataaactttatatactagcgtaagaatatcctaacttaacattctaataaacataacacttatataggttgaactacacttggtatttgatatttgtagttgtaattttcttttagggttctttgaaccactccacgattttgatccttgattaaattttaaagtatgttgaaaagtagaaaatatgtgtatcgagaaacgatctctgacttctctgatgttatgctttcactaaccatctttatagaaaacatacaaaaagatttgattcgttttgtcctttgaataaatgttaccaagaaattctgattaccgcaggaaagatgcaacttttggattcgggtttatattttaacataacaaatttacaacacaatgggcaaccaaaaagaggagttcatgtgccaagcacttagaaaaaaagaaaaaaaaaaaaaaaacaagcgtggtgtttgggttttcgagccttgagaggttggtgggtgtgttgttgtgaatctctaagttttctctgtaaattatatatttgtttacatgtatataaaacaatgtttctttttaaagtgacccttttaagctttcttgaaaacaagattgtgcatagatctcttctaagatccttagctttgttttctcttttgtgtctaaagatcttgaaagtcttgtgtgcaataacttattaaagagatagaaaaaa

SEQ ID NO: 11862 - DNA, 3000 bp, Unknown
  misc_feature (1)..( 3000): cDNA_ID_2707720_gDNA_ID_2214520_Annot_ID_134047 3000 nt of promoter + ATG
gaaagttaactcgaatcactaaaacggatttgtatttattttttttaagacatcttgattgataacacaatttgctggaatagaactttgatgtaaaaacccgaaaatatgaaccgtttaatacttgactaaagtcactttcctcaaactttttaatttctgtttctgttttttctttttactttgaaatcgtgaaaggatcaagaatacgtataagtctacaaatatagttcttttgcgaaacctaattcgaagactcaatctcaacactagcaactctaaagaagttataagtttcttgaacaaaaactaagaaaggaacactaaatttctagcatacacgaatgtgacggtggagaacattataaggtaagatgggaagatatatctgaaactacgcaccgttatatttgccttagattagtgcctttcttcgtctctctttttagtttattctgaatcctatgacgtaagcgcttttgtcatgtacatcattgactatagatgacacatcatattcaaattgagatggttgtattttacaaaggaaaaatctacattttgatctgaattattagtttagtgtcaatttttataaataacttaatactactcacctcatcaaagaataattccaaatggaaataactaagaaaatatttggtacaactatataataacaaaagttcacgacaatcctgtgtttatgaaaaccccatttttccatttgaatgcctctcaagtcttgcttggttcgacattttgcgtttttgagtaatataaatatatctttatgttagatagagatggtcgatattcagatattgttttaaatttctatacgaaatgggaataacgatcatatattcacagtaactaatatgtgatggatattaggatatacgtaaattggtagtatcttattattttgaaagggtgggaatctacgattagacaatcctgtgggagaaaaaaaatgcttgatcccatgaatagacagattaaatataatcgaatccaaattatttatgtctataagcatctagatgatatacacatcaattgactaattaaggcgacatacttattttgaaatttgacggaataattaggttctttagtaacacacttgctaattttattgaacttttagaagagtttgattaaaaagtcttaagattgttatggaaacaaatgggggccatgccaattgccaaacgcactttcatacgatatattcatttattcgattttgttttgctaataattctcgattacaattccatcattctgatccgatttcattaggtgaatattaccaagcgatttttaaaaaatgattaattgtgtgattggagtagcctaactttataaaaggggaatttttcaactagttaatgagtcgaacatatcaattgttttatattgccaactataatgttgtcgtgatacatatcctttattcaagtcatgaagtttttcttgtccctttcttttttatgtaacctttcctgtccgtttcaaaacatgaaaattcaaggagacgcaaattcgagtatattatatatacatggtcatgtttttcttactaacgtaagaaaaagtaaaagatattaatacacaaataaatcaatgatactattttgtttctactacttttaaccacttttaagattgatgataagagtaagactagtgtctagtgatatacgattacattttactgcaacgatttacatatatgtagtgtttaataagcagccaatgactcgttttacaaattattgttgttagttaaatgtttaattattttttgtcaacacaaaaatgttaactttcgtataatgataagtagtataaatacaaaacgattctgtttcatatttcttcttttgggggttgagtttttgcatctcctttcgtattcatatatgtattttattaacataacggctcatttatgatgccgtgtcaataactaggcctatcaataacaatgacttagagcaaatgattagaggtaaggtaagagtaacaattatacatacgttcatgcaaaaacggataattatgaacaaataaaattaacaaagagaaaatgaaaagagagtgagagaaaccataagccgccatttccacttctcactcacactttccacgtctcttttctgagcaagttccatatcaatgctcgtcttaatcacccattaatattctcacttcatagcatcgacaaataattatttttctatttcatttaaaattattctaattccatattgagttgttctctgatatctttgtataaaattcctaactaaacaattgtttaaagaacaaaaataatcattttattaaacggggaaaataagtaagaataattaactcagccctccactattagattattgtattgatactactaatctgatcattccaaattcttttttcctctgtgcatgatctcatgaaatcaattccctctagattcgttcatttgtttactgaaaaattcactatataaaataaaacagtatattccaaaaaatgaacattgcgaaaaatgagcataattaatagggaattaatattgggtcctattaactctctccaatgatagaactatttaatttgttattcataactaaaatggcagccgaaaataataccaagagtcattttcaaaaccttttaaaaatcttattatttgtatttttaaaaaatcttagctcgtatagcttaaacattagattcacatcatagcttctgtgttctttgcttatacctcacgttatatttatattaaaaaaaaaatcctatgtcctcggaaaatctgctgacttcttattgcaacagtctcacttcttttcctctatataaaaccctaagctactacttcacactttattctcatttctccatatctctctctctctctctttcgctctctcaatctcctctgtttttagttattagaggaattagaaaacagagaatatg

SEQ ID NO: 11863 - DNA, 3000 bp, Unknown; identical to SEQ ID NO: 11857
  misc_feature (1)..( 3000): cDNA_ID_3245305_gDNA_ID_2214520_Annot_ID_184578 3000 nt of promoter + ATG

SEQ ID NO: 11864 - DNA, 3000 bp, Unknown
  misc_feature (1)..( 3000): cDNA_ID_2707718_gDNA_ID_2214520_Annot_ID_134048 3000 nt of promoter + ATG
aagctttgtgttaatgaacttgttatttcttgttgatcctgaagctttgtgttatattaacttgttatttgttgatgtgtgtgtttatatagtgcaaggtttgtatgcaaacattcatctgcacgacatcggaagtgaaatgcagggagcacgcggaggcgaagcatccgaaagccgatgttgtcgcttgtttccctcacctcaagaagtgatgaaagctattatctcaactataaaggattccaatgtataacgtatggatcctcatctttcctatgtttgtatcaaagtctcgacaaattttatggtttctatttctctctacttgtttcaacaataagtctcttgctatgattatataatgaagctttgtgtggaacctttttttttaatataagttggcttcttttcgctgttgattatgtttctatgaaagtaaagattaccacaattttgatacaacaaaatcattacaaagtttttggttgaaaaatagtagtaagcatcatcaatcaagcttcggttttactgagttcgtagtctgctgctctctgcggctttaacttgagcgaagtatggatgatcctatagatcaatagagaaaccagagattataagtttgacttgatcatcgggtaaaacaaaatcaaaagatgtgtgcacatgaagatcatcgggtaaaacaaaatcaaaagatgtgtgcacatgaagaggatttttaccatggcttctcttgcggttaatctgtcttgatgatcatactgaagaagcttatcgagaaaatcaattgcctaaagatgtatacaatgagtcaatacacccagaacgaagcaaaactatgtttttcgaaaaagagtagtacctcaggtgagaccaaatgttggttgtccgcgttgataaacttggaccatggtttggggacatgtctacaaataagagtgacttcaggttttaactcattggtataaaattaactgagccagagttgagaacagcaacaattttgacttttaaagacagagagattcagggatggaataaaaccttccaacaagtgcttccagttgagggtcaagatctagctgatatttgtttaggtaatgatctaactcattggttcccaacacctatgcacacgtttcaatcagaaatcatatacatggatttaagtttacaatgtaattttatgccaataagtcatagactagcaatataccttggcaattttgacaagttgatcatgattatcatggccataaaagaacggttccttacggaatatctgcagcatcaatatttgacaagtgaataagcaacagcaaagtattaacgactaccattcggaaattcaaatgcttgcaatagcttcagcattgaagctagagagaagagtgaggggattattagttctcaccatgccagcaaacatgcaaccaagactccacatgtctaaagaatagtcataatcctgtagatcaactaaaagctcgggacccttgaagtatctggcaattaattcacaggtttttagtctaatgcatttaacaactacaagaagctttgattgcacagctaaaagtttcaatcattggcatctacgaatgaccctcttaggcttgccaagacaggtggaattaagctgtggtatcggatattacctcgaggccacgcgaacattatactcttttccgggatggtaaaactcagcaaggccccaatctatcagacgaagtttacgcagctgatgatctatcatgacattatgaggcttaacatccctatgcattattccttgagagtgacagaaatccaatgcctgaaatgcaataacatcagctctggattccacgataaacatttgtatgtacggtaaaagtcatttatggtaaataccgatacattaccttcagaagctcataaatatagtaccggatatcgtaatcagtcaatgttggatacaatactttaaagtccacactgttgacaaactcaaataccaagctaggtgttttggagtgctcatctctaacaatatcatacagcttaacaatatttggtccaccacataggttctgaagtattttgatctctctctttatctgcataacatcaagtttcagcaaaattagccatctttatgtatgcaaattcatcagaaatgagttctactaactgatcaccttcttcttttttacgggtttgaggatcttgataacgcaacgctcattcgtattgacgtttttgccttcgaaaacttcactgtattttcctctaccaacttttctcacaacctcataatcatcttgatgactgaagaatcacacaaaagtatttaagaatctcacactgttgaatttcaaaatccaatatttgctaatagatacttaaaacaaagtgtcttcaagagacctaagtccaaaccctaaaaaattccaatttctctgatttcgaattcgatttggcaacaaatcaatcaaattccaccgaaaatttatcaaaaagaagtcaaaaatcgtaaattcatcaaagaaaaattctaaagctagaagttttacccccattgaacaacgagagactcgtagtcccaatactctttaggacgaacaacgttaacatctgtataaaccctagctttcgacatcaatttcgatctgaaaaaatggagaaatttgcgatcgcaatcttctctttgatcgtcaggtttgtttcaagtggacgatgatgatgacaacagaagaagtgcgttgtgcaggattagaaaaaggttgaagaagaatctctgatacccaaaaaccacctaaaccaaatcgaaccgattcaaccacactcgaaccgaaacaaacccaatcggatcgatttcaatcacactataaccggaccgaattgtttaaacgacatcgtttcgaagagaagccaaagaaaaagaaaggagagaaataaagcaaattcgttaccttcacttttcattttctgaataagagttaaaaaaagacattaatg

SEQ ID NO: 11865 - DNA, 3000 bp, Unknown; identical to SEQ ID NO: 11864
  misc_feature (1)..( 3000): cDNA_ID_3023222_gDNA_ID_2214520_Annot_ID_184587 3000 nt of promoter + ATG

SEQ ID NO: 11866 - DNA, 3000 bp, Unknown; identical to SEQ ID NO: 11862
  misc_feature (1)..( 3000): cDNA_ID_2707720_gDNA_ID_2214520_Annot_ID_184585 3000 nt of promoter + ATG

SEQ ID NO: 11867 - DNA, 3000 bp, Unknown; identical to SEQ ID NO: 11861
  misc_feature (1)..( 3000): cDNA_ID_1807848_gDNA_ID_2214520_Annot_ID_184584 3000 nt of promoter + ATG

SEQ ID NO: 11868 - DNA, 3000 bp, Unknown
  misc_feature (1)..( 3000): cDNA_ID_3023226_gDNA_ID_2214520_Annot_ID_184583 3000 nt of promoter + ATG
aaattattaacaaatcaagaaacgttatgaaaaacagaggatttgaatcttgttttacctttagaaacatgtcaattgcgcgatataacacgtcgtgagagtgtcttgggaagctagagagtgtctcagcgagagagaggaagttctgaagagggagattaggatctcttgatttctcagctaagtatccatcaatgagctttgccacggatactttcgagtgagttttcggatcacggttcataaactccttcactaggctctgcaccatatccaaatcatacattaagatatcattcactgttgtctcttcaagctgctcgctgactcttttctttaacttttctttcacggtttcttcacatccaagaaagatcgatgctcgatgtagcttggtcaagaagctagaggaaatgtttcctttctcatccgggagaagctctatgattgtattaatcaaagatctatcaatgagttgcatggactctttgctaaaaccagctattcttcttattgcataagcatgtaatgcttctccaataacgttactcgggactttacctcggttcttgattgctttgatggcttgtttatacaaatcgatgtgaagctcgcataaatcttccacccaccagtcttttggaacaccatcttctggttttctcactttctcaagcttcttcttcctgttgtaagtataagaccatttgactttcgaggtgtctatcgaagcagtagaagcaatagagccgagacaacgcttcacgagctcctctgagtcatcagacaagagatcttttgtggtctgaagaacaatgatagaatctttccaactacggaagatggttgagttcaagaaaacatcaatcttgtaaacgagattgcttttctcaaacgtttcattcatctccaagaactcagccgcgcaacgaaccgcaaccacattgtaagcgtttaaagtaaccgtgatgccgtaacagaacttgacacaaatctcaaaagcaacagaaccaccaggaatctctgatatgtcaatctcatcaatttggttcttcttctcctcttcattttttgatgttgctatgtgtttctgcaagaatccgcttttcgacagcaatgggaactgaaaaacacacaaaaacataaaaactttgcttcttctttgatgttttaaaagctagagtttgtttcataccttatgcagatagaacttgacattgccgatgatgatgatgatctctgtttctaactcatttgttacatacctaagagccaataaaaataatatcagttttagaaaaaacattgcttaagcataatcagagaaatacatagaggtaaatatttgttttctacaaacctaacattgtctcctttagacagaaatgaatcaggtttggttccaagtttcataaacttcatttttttctatctctttaataagttattgcacacaagactttcaagatctttagacacaaaagagaaaacaaagctaaggatcttagaagagatctatgcacaatcttgttttcaagaaagcttaaaagggtcactttaaaaagaaacattgttttatatacatgtaaacaaatatataatttacagagaaaacttagagattcacaacaacacacccaccaacctctcaaggctcgaaaacccaaacaccacgcttgttttttttttttttttctttttttctaagtgcttggcacatgaactcctctttttggttgcccattgtgttgtaaatttgttatgttaaaatataaacccgaatccaaaagttgcatctttcctgcggtaatcagaatttcttggtaacatttattcaaaggacaaaacgaatcaaatctttttgtatgttttctataaagatggttagtgaaagcataacatcagagaagtcagagatcgtttctcgatacacatattttctacttttcaacatactttaaaatttaatcaaggatcaaaatcgtggagtggttcaaagaaccctaaaagaaaattacaactacaaatatcaaataccaagtgtagttcaacctatataagtgttatgtttattagaatgttaagttaggatattcttacgctagtatataaagtttatggacttctgcattcaaaaaacaaaacaaacacataaaatattagcgaaagtctctcatctaatgagaagcacatagagctgataaacataaaaatcgaaactttatttatctttgttgttctctttgggtcacaatagaccggcccattagcctagtcacaccggcccattagcccagtcaactccattgtagaagagaggacttgattttgggtgagattgagagagagaagaagagaatcgtcaagtgtttatggtggtgaaagttataagaatcgttaaatttgacgaaagggtacgtaaaagaacttcctttttgatgatttatctatatattagacgtaattgattgtttctgatttaagtatcgtggcattgtgaaaaatttgataggcacgagactatgcacaccagttgctcgacgaattgtctaactaagatattctttctctaaatctgcttttttttttttgtttggttctttaattatgtttttgctgttaactgttcgaatttgtgatcataccctttagattattagaatcatatcttctctagtgatatgtgtgtgaatgaatcaatgataaaagactctcctttttcttaatcaaactgtgctttgtacgtaatttttatctattatattctcatgacattttgatccacttgtgatcagcacaagatcagtataaagttgaagttgatcaatttgtggagcatggatcctgaatataccgacgatttattaaagtgcgtctttgttttcagttttacgcttatttttcgtgtgtgcattgcgtataatgatttaccgttgttagcacatcaacagccatttggagaagcaaactgaattgcttttagaaactcgtaaaacgatg

SEQ ID NO: 11869 - DNA, 3000 bp, Unknown; identical to SEQ ID NO: 11860
  misc_feature (1)..( 3000): cDNA_ID_2707728_gDNA_ID_2214520_Annot_ID_184582 3000 nt of promoter + ATG

SEQ ID NO: 11870 - DNA, 3000 bp, Unknown; identical to SEQ ID NO: 11858
  misc_feature (1)..( 3000): cDNA_ID_2707736_gDNA_ID_2214520_Annot_ID_184579 3000 nt of promoter + ATG

SEQ ID NO: 11871 - DNA, 1898 bp, Unknown
  misc_feature (1)..( 1898): cDNA_ID_2707714_gDNA_ID_2214520_Annot_ID_134051 3000 nt of promoter + ATG
aaaatcagaggagcggcatttataattaattgtggaagatatatggttgaactagcagcaaccaattctacataattaggaggagtgtaacatgccttggaggttcagatatagaagctagagaaaaaaacttaattattgttgacatagtattctgcttttccatgtaaatatttgagaaaaaatcttaaattattgttgacatagtattctgcttttccgtggtttataaatgactctaaatctctaacggaaaaccttagtgtttgacgaaaaaataaattaaaaatagaagtagtgtggactctttggaagtgtaaaaagggttgttacatagtactccaagatgtaaaagaagttatagaatgaatctcttggaagagctccttaatctacaactacgaatagagttgaagatggtgattaggttcgtatctctttaactataaaaaaaaaaaaactatatgaatggatatgaaatgagaaaattgaagtacgaaacaggtcctaaaactgttcctatttatttggtatgatatcatttcaaacttgagaattatttagcattaaactctacacgaaaaaaaaaaaacttgcattacaagtgtttttttttttgttttttgaaacacgttaaagaaccgaaacttgatcagttattagacaagcgaagctaccctttgtgtttgttgacgatcctataataaagtttttcacggaacgccctgacggttaatcgcatcggtagaagaaagatccgtcgatgcagcgcctccaccgcgtccaagaccgcctgaaggagtgggagcatcggtggctccacctcccataccgagtttaggctcttggtggccttgtgctccgtaacctttcatcttgtaatcttccaagttatcatagtccaagtatggggtcttgatagactcgaggtcgtcgtttttaacttctttcacttcttgctcggtcgttggtggctttttctgatcctccatcttgttatgcgttttgctaaatgcttgcccgtgagaggtttacacttgctgcttatatagctcacgtatagctcgtatatttctgacacgtgcggtataccggtggcaattagtaagcttctcgatatacgtgacttttatgttaagatttacgttatctaaactagggtcctagaagcatctgcaatttaaaaaaaaaaaaacaaaaaaacattaaaagtttttaagttttatacgattgtttttgacgttttgtgcaagaaagcctatctttataattttatcatttatttctaaaaatataataattatataaagttatatgatcacagaaatattatacaaaatttcactattacaatatataatactaatattcaataaatttatattggacattccatctacctgaaaaaatttattttctttttctgattcatatatatgtgataaaataaattcgatgaatggtagatgaatgacaatgcatcatgaaaaaacacgaacaaaattatcttcattttgtatgtcaacacttctcaccaaacgtcttattcactaactcattcaagagaacgatcatgatctagtcatttattaccttatattgaatagtcattattcaaataatattagtatgatatttacagctaaatattatcaattaaatagaagaataaggagtggttgtctttgtataatcgaaaatatagccaaattattggccctcggcccttcgtaaactaaagcgcgttaaaaaaacaaaactacagctggaactggaagcatcgaatagttgaatcaaaatgagtctcaacgtgagagcctcaagtctaaaatggattgtacaaaatgataaaattggctgcttctttatccaattgtaaacaaacacaaacccatatg

SEQ ID NO: 11872 - DNA, 690 bp, Unknown
  misc_feature (1)..( 690): cDNA_ID_2711335_gDNA_ID_2214521_Annot_ID_134053 3000 nt of promoter + ATG
gccgagatagtgtatgattgtcactattaccaaacgatagtgctagcatcgtaacgtgagtccccattccccaagtttaattttgttgcggagagaacgattaacctttagatctgacacattccgtaatttttaatcttgctttagcaacaaagagaaaaaaaaacttttcatatttcttctatattatacggatacgtaacaataacaaaactatatgctagtagtaaatttatgaagattgattaaaacaaagagagtagcgttttggagtaaaaataggagagctcgaggtccaatggtgcaaaattgttagctattcaacggaccattagtctactattccccaatttctataatctctctacttcgcatctccaccctccatttttcacgtatacccctcaggatctcgacacgtcagatttctctttaggtccaaaatccaattatcttttaataaccaaaataattcggaaaccaagtgatttctaacaaaaacaactgtgcacacacgcttgtcgatattcaattttttcacaattcccaaataaaaaaactttaacaaaaaattcataattccaagtcccacgaatgtagcttttgatacaaagtcttaaatattcttttaaacattatatacaaaaacatcttttactcattgattgttcttgctgaaaacctgaaatg

SEQ ID NO: 11873 - DNA, 3000 bp, Unknown
  misc_feature (1)..( 3000): cDNA_ID_2707740_gDNA_ID_2214521_Annot_ID_134054 3000 nt of promoter + ATG
aattatcttttaataaccaaaataattcggaaaccaagtgatttctaacaaaaacaactgtgcacacacgcttgtcgatattcaattttttcacaattcccaaataaaaaaactttaacaaaaaattcataattccaagtcccacgaatgtagcttttgatacaaagtcttaaatattcttttaaacattatatacaaaaacatcttttactcattgattgttcttgctgaaaacctgaaatgcctcctctgtttcttccttcttcttcctctgctctgtttctacttcttctcctcctcttaactctccaaaccctaacctctatctctctctctcagccacaggctctccgttcaccagaaaagtgtggaaacttctctgtctccttccctttccaactctcttcctcctcctccgcagccgcttttcgactctcctgcgaaaactcctccactctgtttcttcacataaaccaccaaagctaccgaatcatcgagttcttcaccgacggtctcctcgtagacttcccttcgtctccttcttgtcgccaattcaacgacttacgctctttccctttctccgcaaaccaattcttctccatctctttcgaaaacgtaatcggtctttacgactgcgaagattcttctctctgtaaattcggttgcgaaaccaacgatctcttcggttgtgacggcagagaagaagacgaaacctccggtggagatatcggatgttgctatcctttgtctgatcatagcgcgtggcgtgtaggtgatgatttctctgtgtttagtagatatggatgcagaggattctcttcgtggcttgttccaagagggacgaacagaggaaaaagaggcgttaaattagagtgggctattccaagaaactcgccggaggctatttgtgatcgtgaggctcgaactgttaacgctacggctattgaaggaagtgttcgttgtgtgtgccgtgatggcttcgtcggcgacggcttcctccatggcaccggttgcttaaaatgtcagttttatttcttcttttcatttattttcgtgtatgaaacagagtacgtttcaagtaaccttattttactattctaaacaatgaatagaaatattttgtttcactatgaataattcataactgagtcatatggttcgttgggttactaaaaaacttagttttgattcagctcagtaattcattttgccttagtttaaaaagacaagtgtttcttgagttacaagcaacttacactacttggtttactgttgtaacagcttgcttcaaagacggaaaggaattatatggagacaaatgcaagatcaagaaacacaacgggaagaaactcactgttttagccggtaatttaagataatctcatctgaataatttgaaccaaacttcttgctaaaatcattaatcatatgcaggtgttttggctcctctgttcatactaggctcactgttagctctcttctgtctcctaaaacgtccggtaacaagtcacaaagatcaacagttcgatatatctacaacaactaccactactaatagtgtttcgtttcgcaaaggttacaacaagactcgtctcttcacgtaccgtgagttagaagaagccaccaaagggtttcaagattcacaaaaactcacacaaggcaaaaccggaacaatctactcaggcaatctaacaaacggaacacgcgtgatcgttcacaaggttctctgcgaaaaccagattgaattcatggagatttcgtctcagattgatcatctatccgcggttttgcatagaaacctcgcgagaatcataggtttttgtatggatattggatataatccactagttgtttacgagtatccggtaaatggatcgcttggagaccgattgcggctagggcttgattggtgcaagagagttaacattgtagctgaagtcgctggtttactcgcgttacttcagtatgagaactatccaccgattctacacaccaacatttcttctggtaacatcttcttagacgaagattttcaagctaaagtcacaggttttggtttgcagaggaaacagaggattgatactagtatgtacgatttcgcggttttgcttctagagattgtgactggtttaaagcagagagaagagacggtaactcaagcgttacagaagattagaagcggtaagcttgaagaaatcgtggatccttcaatgtattttcatgagcagcctgtggcttttagagaacagattggtttagtagctgatatagcgactcggtgcgttttgtttggtggtgatgggaaatttggaatggttgatgcagctagagagctgttgcagatcgctggaaacaacggtggaggcggctgcgataagaaaagagatggaattgaggaaacgttttcgaattcaagtttgcttcagatgatttctatgtctcctgattctatctatctccctaaaacctaaaacaaaaacagaggaagttaagggttttttttgtttgttttgaatgtatgtaaattaaaaacgctttgcttgagagtaaagaaacgtccttttcttgattactagattgtgttctgagaaaataaatcgtgatcgcgattggaagtcacgattataacaacgtgcaggcaaagagtaagaagaaacaccataaacaagtacaatgttttgtttttcttccatttttaaatactgaattttctttaaaagaaattgaaaggctgagaaagaatatctctcgaatcattaaattcgattttgaccaaatcgttatgctattattaaactctttttgtctggtatatatatatgatagctttgtttttgcagaacttacattttgtttttgtccctttgaaacgaaagaagatccaaaggtaattaatactaatctctgattgtttcttggtttattagatctttccaaatgctctgttttcttctgcacaatcaataaatctgttagttttaacgattgatgtgacaatag

SEQ ID NO: 11874 - DNA, 3000 bp, Unknown
  misc_feature (1)..( 3000): cDNA_ID_1807391_gDNA_ID_2214521_Annot_ID_134057 3000 nt of promoter + ATG
ctgctctcaaagcaaagtagtccacacaaaacaaagcgcccacaggattactcgtgtccaaggaaagcaagagtttgcagacctccaacgctgacctatgacagccacgcctgtccatgtttctcatgtgagtgaaaagcgtcttgaagaacagcttgttttcatcgtggttaaactccaaccggcagttaccctggaacggagtgaacataggatgccacgcacgctccaaaccgtacaagcattttccaatggaatctgcagccatatcattctcacctacaaacttaaagtaatccgccatagttatgagcgactcaatatggtaaggattgtgtataaggacacttgctacaccattcaaatcatggatagcttgtgcagcctgaaatgctctctgagcctgctcatatgaggatgaatgggtatatctacacatcaaaagaaaagtatttcatcagatgtacaaatttacaatgtctgtattttctatacacacacccaacgaaaaaacaaaaagctgtaaaaattgttacctgaagtagttgttaccatctttagtctctagaaactccattgagaaagatctatcccatcgagaccaattctcttttggagataccagaaccgtctttgtgatatgatggactccacgccttccccctcgtctagagctactaccaccttgagagccactctcactctcaaatgatcgcatagcctttgaaccatacgttctcctcaactcgttctcaagattcagatacttggaatctatttccaacacaaatcgtgaagaagcctttttggaagaatcagcatttggttttgtctcctgaaccttatcttgcttagagttagcattgagaccaagtgcttccaaagtttcatccaaagtcatttcagctttaggcacattagagccactctctttgttcttcttctttttctttttcttcgacttattctttgacaccggctgcacatgatcagcgacacttgactgatgatccgcatcttcgttcttcttctcagctatagtctcatcatcaatctcctgcaatcaaacccaattgttacagaaacactttgtaatcattactcctacgaccaacaaaatatgaatcagctctagacatcagaataaaaaaccataagaatctgaagatcaaaccattgaaactatctacattcaaacttatcaacacattagctattttagaacacggaggaggataaaattctagatactaaatctaccgaacaatctaatcgtcaaaatctgagagactgacctcaggatcttcatcaccatcgttcaagagatcgaatggattaatcgaagaacgggctcctgattcttcttcgtcctcttcttcttcttcttcgtgatgtttctgaagtttcgaatcttcatgttcctggagaaccttcttcagcaacctcccagacatatcttctcctgcttcgtcttcggaaaatcgaacaaggacgatttcagacggcggagaaaggcggcgacaccgacgactagatgattatctcgtcgatacacgctaatccctcgcttctctcaacctttttaggagaacaaggtatctttccggtttttacttaaccggtacatttaaaccggtagaactgtagattgttattccgggagagagagaaaacaaccgagatgcgggagaaagaacgacggcgttttacaatcccttttttacctcaacgacgtcgttttacttgacacaattggcgcataaatttatattaaagttcgaatttggaccgcatataaagttggttaatttatagaatccaatgctttcggctaagctaataattagagtcaccacgagcacagctaaattgtatctctttagtgatatcttcacttttacttcaaaaagtattgtaataacgaattcactatccccttattattaaaaggggaagtacaaagtaaaattttgtctaatttggcctcaattttgatttcaattttggattttgttatttgctattcaaaatcattaaagataatttggtcttaataatcttctaaactttatatgatctgattgaatctaaaccgttcaataaaattaattcccttcaatctaaaccgttcaacaaaaataagtgaaataattttatttttttatcttcactttaaagacatataattataaataacataattcatatggtctttattttgccaaaaaagtgtataacctgtcaaatagttaaaaaaaacacttataatcataaaaaatattataccaattttgtgaatcttacatttttgtaaatattttactttcactaaaattacatacacatttttaaacacattttaacacatttatcttatcactaaataacaacaaaaaaaaatcccaattattatttaattatgtttgattaaaaaatttatatttataaatttaaaatatcaaatttattcaaatatttagtataaaaaccaaataaaccgattgtccgcggtttaccgcggattaaatcctagttattattattgcgattccctttccccatgctctgaaatttgttaatcatttgtccctatttctgcttaaccacttacatttcataatttttgagtttatattgtttaatgtatatattttacactattactttcattacttaatagtcagaaatctcataccataatcattacgatacaaaatcatagtccaattattttcttcattactgactttttcggctcttttacaaaaagctaatatctttatctacagttgatcatattttaattttcaccaaaagtataattaaacagaagactctaatcatatcagtgatcaaagtgggccaacatgggcccatacacgccacaaagaacccaacccaaaagtccaaagatattctttaagctcagtttataaattgcattctctttctccttcctacaggccaacccaacatcaacgacttattcgagagaaaatg

SEQ ID NO: 11875 - DNA, 3000 bp, Unknown
  misc_feature (1)..( 3000): cDNA_ID_2707747_gDNA_ID_2214521_Annot_ID_134058 3000 nt of promoter + ATG
aataactatgattttaaaaaaacacttattagatacgacgtggacgagcccaaatagacaaaaacccattttaatgctaatttacacagaccaaagaaacaaaatcagaggaagaaacaacaaacaatgctcataataatacacaattaaggatctctagtaaccctattgaaagtttgaaacaaactaatcacagcttcttcaagtgttcttgtctttagtagcagcagcatgagatttgaaccatggaatccacaccgaagttgtcttctgatatgctctataagcttcagctctgtattgttgtttcaccatccgacgctcgacaaggatcgttacatagaccagacacagagtattgaccaatgcaccaatcaaagtccacccttgaccaaggttccaagcaaatatgaccaatccccaccaccacaattgctctcccaagtaattaggatgtcttgagtaacgccacaaacccgagtccagattggggattttgggctttccttgctccttgagcttttggtttccggttacaaactcgtgaagctgtgtgtctgcgaagtacgccatgacgattccggtcaaacagatagccgaggaaatgaagtcccagatgtttagtggctcatcaatggaatggatgacatataaaggcagacatatcccaatgaggaagatctgagcaaattttggaaaaaagaagcaacatgagaaacagaaagcatataagctaagcatcaaatatatataaaggtaacaatggttcaagcccttataaccaaaagactatcctgttctccaaatcatcctcataaaggcaagcttagattaaaaacgagctctttgaggcaattcatcgaacagttggtggtcatgtacctgctgagaaacgtagacagagaagaaggagagccaccaccagtgtttcccgtactgtttccgtaagtcgttgaacctccagtcttctctagctccccattcccaattttcccgccggaagtagttatgagtcaacctaatgctccaaatccatgtcagagttatgacaatcatggatctcagcttattgtactgtgacaatggatgcgaagcgaagtaatgaaccagcattacaggtatcactgtccaatacacatcgatcatctgcaaaattaacgaattttttcaaaaactaaaaaattgcgaattttaacaaatgggtaacagatttggagactatggatgcgtacccagtggctagattggagtaaaccgatgacccagaagagcacattgacgtttaagaagaagagaaggtttgctaatagaagaggatgattcaaacaccatgattgaatagaagagagctctgaatcggaagatgaagagtaattactgagaaaggtgaggtagaatacgatagaaggaagtggagcaagaaatgcgacaatggcgtttctaagattccgattcattttctctcgaataagtcgttgatgttgggttggcctgtaggaaggagaaagagaatgcaatttataaactgagcttaaagaatatctttggacttttgggttgggttctttgtggcgtgtatgggcccatgttggcccactttgatcactgatatgattagagtcttctgtttaattatacttttggtgaaaattaaaatatgatcaactgtagataaagatattagctttttgtaaaagagccgaaaaagtcagtaatgaagaaaataattggactatgattttgtatcgtaatgattatggtatgagatttctgactattaagtaatgaaagtaatagtgtaaaatatatacattaaacaatataaactcaaaaattatgaaatgtaagtggttaagcagaaatagggacaaatgattaacaaatttcagagcatggggaaagggaatcgcaataataataactaggatttaatccgcggtaaaccgcggacaatcggtttatttggtttttatactaaatatttgaataaatttgatattttaaatttataaatataaattttttaatcaaacataattaaataataattgggatttttttttgttgttatttagtgataagataaatgtgttaaaatgtgtttaaaaatgtgtatgtaattttagtgaaagtaaaatatttacaaaaatgtaagattcacaaaattggtataatattttttatgattataagtgttttttttaactatttgacaggttatacacttttttggcaaaataaagaccatatgaattatgttatttataattatatgtctttaaagtgaagataaaaaaataaaattatttcacttatttttgttgaacggtttagattgaagggaattaattttattgaacggtttagattcaatcagatcatataaagtttagaagattattaagaccaaattatctttaatgattttgaatagcaaataacaaaatccaaaattgaaatcaaaattgaggccaaattagacaaaattttactttgtacttccccttttaataataaggggatagtgaattcgttattacaatactttttgaagtaaaagtgaagatatcactaaagagatacaatttagctgtgctcgtggtgactctaattattagcttagccgaaagcattggattctataaattaaccaactttatatgcggtccaaattcgaactttaatataaatttatgcgccaattgtgtcaagtaaaacgacgtcgttgaggtaaaaaagggattgtaaaacgccgtcgttctttctcccgcatctcggttgttttctctctctcccggaataacaatctacagttctaccggtttaaatgtaccggttaagtaaaaaccggaaagataccttgttctcctaaaaaggttgagagaagcgagggattagcgtgtatcgacgagataatcatctagtcgtcggtgtcgccgcctttctccgccgtctgaaatcgtccttgttcgattttccgaagacgaagcaggagaagat

SEQ ID NO: 11876 - DNA, 3000 bp, Unknown
  misc_feature (1)..( 3000): cDNA_ID_2707783_gDNA_ID_2214521_Annot_ID_134059 3000 nt of promoter + ATG
cttttcgaaacgatatcgttgatgatccttctttcttgaatagacacaacagtaaaggtttggcggaaactacgtttaaggcaatctcaggtgcttcggttagtgccaatgtttccacggctaggactgggaatcaaatggcattgtgttcaagtgacgttttggagcctgctgcttcatttgagagcacttcctcgtttgcttctattcctttgcagccgctccctcgtggtggttcgggacccttaaacggattcatgtccgggcctctagagagaggttttgcatctggtcctttggatagaaacaacggtttcatgtctgggcctattgaaaaaggagtaatgtctggaccccttgatgtatctgatagatctaatttctctgcgcctctttcttttagacgtaaaaagcctcggtttcagcgttttatgaggagtgtgagcggaccaatgaaaagtacattagcaaggacattttctagacgatctggagggttaagttggatgcatcgcttcttcttgcatccagagactagggtttcctgggctgttggaaaggacggtaagctacatggtgaagaccctgaaagttgtctagagagcaaccgtaacttgcaatgggctcatgggaaagctggagaagatagggttcacgttgtgctttcggaggaacaaggatggctctttatcgggatatatgatgggtttagtggaccggatgctccagatttcgtaatgagtcatctttataaagctattgacaaggaattggaaggtcttctttgggattatgaagagccatctgaagataatcaattgcagcctgaccaggaacctcctacagaagagaacatgtgtgatccagaatctatcagtgagcagcattcaaagtcagtagtggcagaaagtgaggaggttatgattgatgatatcagtagccttggaaataccgatactcagattgctgatggtccacctggagactcagctggtcctggcaagaaaagcatgagactttacgagctacttcaattggaacagtgggaaggagaagaaatcgggcttaaacgatatggagggaatgtcgctctaaacaatatgaccaatcaggttgaaaatccatctacttcaggtggaggagctggaaatgatccttgtaccaccgaccgtagtgctcttgatgggattccgaactcgggacaaaggcatgggactaaaaaatcacagataagctctaagataagaagaatgtatcaaaaacagaagtctttgcggaaaaaactgtttccatggagttatgattggcacagggaagaagggatttgcgttgaagagaagatagtggagtcatcgggaccgattaggagacgctggtcagggactgtggaccatgatgctgttctaagagcaatggctagagcactagagagtactgaagaggcgtacatggatatggtagagaagtctcttgacataaacccagagctcgcgctaatgggttcatgtgttcttgtaatgctaatgaaagatcaagatgtttacgtgatgaacgttggggatagtcgggctatcttagcccaagaaaggctccatgatcgtcactctaatcctggttttgggaatgatgagggtatcgggcataagagtaggtctcgagaatcacttgtgcgtattgaactggatagaatatcagaggaatctccaatacacaatcaagcaactccaatcagtgtgtcaaacaaaaacagagatgtgacctcttaccggttaaagatgagagcagttcaactatcaagtgaccatagcacaagtgtggaagaggtatatctctgactaattcatctgaatagtagtgaaagtgcaagactttggctctggtttgccaaaaagcaagtttctttacctgtttcaggaaatttggcggattagatctgaacatccggaagatgaccagtcgatacttaaagatagagtcaaaggccaactaaaagtcactcgagctttcggtgctggatttctcaaaaaggtacaaacaaactttgataaccaaatcacattaagactagttcatcttctaacgattccatgcttgcagccaaatttcaatgaagctttgcttgagatgttccaagtagagtacattggaacagacccgtacatcacatgcgaaccgtgtaccgtccatcacagactgacttcaagcgatcgtttcatggttttatcctcggatggattgtatgaatacttcagcaacgaagaggttgttgctcacgtgacttggttcatcgaaaacgttcctgaaggcgatcctgctcaatacctcattgcagagcttctctctcgtgctgccaccaagaacggtacagttttaacaactaatcaatgattggtttagtacggttaagcagccggttaatgtgaaaataaaaccaacatatttggcaggaatggagtttcatgatctgttggatattcctcaaggagatagaaggaagtaccatgatgatgtctctgtcatggttgtgtcacttgaaggaaggatttggcgctcgtctggacaatattatccagagagaaaacaaaaattcaatagataaattaaccaaacacaaaaaaaaaaaaattaggttttggcttattgttttcaaacaatctttcaatttcccggaagttcaaaaaaagaaggcctaattctgtttttccttcttcccaatccaaaattgatcaaaatagctatttatgaaaatgttagttacaactagaatcagaatcctctgaatgagctagaaggtcttctcacctgaaaaagtcaacgcgtgtgggtcgttttgagccgttaatttacaatttcgtctttattcgattttttattttctgggcggagctaatcaaaatccaattctccggcttcttcttttgcttcttcttcaatggtcacgaatcttctgcgaatgtgtactgaatctctcgtttcagctaaagattcagattcattatg

SEQ ID NO: 11877 - DNA, 3000 bp, Unknown
  misc_feature (1)..( 3000): cDNA_ID_2707787_gDNA_ID_2214521_Annot_ID_134060 3000 nt of promoter + ATG
aaaacatgaccaggatattcaaattcaagtatcaccaacaacacatctgtggaagcaagcaagcaagcaactagagagagaaagagagtaccaaccagctcctttggaggcagcagcctgaatcaaagtgagaggcaccataagaagctgcgacggagatgtcaccaccaattgactttcgagtaacgagatctcatcgtctgtatctctcacattcccactcccaatcacacctaacacgataaacagccaaagccagaatatcgccgccgcaatacgcaacacactcttcatctccgccggagtcctgaacagagctgaaaatcttgactcgaaaagatcgatttctgtggactctgacaaatcttgtactgttgcatgtgtgtgattgatagcgagagaagtctttatggctttttctggttaaattctttcacgctttcatcattatggtaataaattgatttacgtcacgaaccaaatctttgaataattaattgattttcttgaaattaatatggttctaaaaatacaagatacagtactaattttcttgcaattttaatttatcttatttgagacataattattagaggatttttactgttattaacatgacaaaaagtgtctgtcttttgaatgttcctcctcaattactgccaaaaccaattaattaaatcattaattaaaaagcttaaatagtttatttcatttttgtcggcatcggctctgtttaacagtatcttatgccgcatccgcgcatcacacgtgttagtaatggtctgtaacgaggccttttataatcactgggcctatttaatcatcacaagcccacctcactattagctctttcaaggaccgtatgatccaactgtatgatacaattttggatgaaacattgaaactgattgtgaaaattctgcagacactcttacgcagtcttatattactactaaatgaatctatgatactaagtcatgtaaataaataaaaaccgtaaaacagaacggtgaattttaacgggaagttttcatttttgtggaggtgcctgcccactccaatatacaacttttgttttattctggggttttgaaataaaatatagtataatataaatagttaagttagtggatgaattgatgataatggctttggttttggatctgtggacgcaattactaataaataaaagaatacaacaaaaaacaaacaatgtgaaaccaaaagcataattttctagggcgttgaaagagtttgtcagtagtcagaaactcaaaggcaaaaaaaatgagagagtggatttggtttaagtcaacaaatttgttttgtttggtttaaagcgtgactctctctatgtgctcgtggagttggcctcttttgcatgttaggcatcattacaaatttccttatatatatatatatatatatataaatctcattcgttacatagaaagaatcttacggtattactagacatgaaaaatgttaagtttacctcgtttaataagatagtatatagagcattgagatttaaaataaacctacttggtaaacagaatatgataacattaaaaaagaagactaacatgttaacatactttaacgttcaaactatataatatcattaacactggtcaaatcttccgattatgaggagcaagattcaatgcaaccaaatataaaaaattgaagaccataacaaaaaaaaaacattgataaaatgggtgtgaataaaaaacgggacccgcatagaaaaaattgaaaccatgcaaagggtccatcgatgagaacaataatgacgtgaatcacctgtaattgtatacctccaatcatttgcaaaccccattaatataaattctgaaggtttaaaacattgtggaaattcacttcttcatctcttctttttaatgatcggttatgtatttactctctaagaatgtacgtaaaaaaaaaagtacttttaatgtatcaattcttgtaaaaaatatccaataaatcagatgtaagaggaaaataaaaataaaaactctaaaaagacgatctttcgcttttacatttttcaacgcagtttttagactttttactctgtttttttttttttttttttgattaccctccgaaaccatttgaaaagcccgagacaactcttttcttctctgctcactctcacctatgagcttaaggaaattaaaagaaaaaggtgaaatcatacataattcttgacctgcttaaatcaaaatcaaacctgttgcagcagcttcaagcttcttctttttcccctcttcttcagctctatttggattgtgactctactaattttcgattttgaatcttggtttctccgtaacatatctgaaagaggggtttctgggttttagcttcttttttttcccctgaaaagcttggatctttaacagctggtcgtctctgcatggttcaatctcaatctgggtcttcttcctttttttttttcttttttaaaaaatgggtataattgtttttttttgtttttgtataattagtttttaaaaatgggtactttttgtcagattcccatagaagaaatctaaaggggtgttttttccccttgtttactgtctctattttgcttccgatgtgttcaatacaacactgtcttctctttgccgctcctttagatctgtttccagtttctgcttgatgatccatctccttcttcaacaggtcagatcactgtttctgtttccatttcaagacctcagaatccaaagcttttgtgggcattcagctgatttttaaaaaaatccgaatttgatactatcaggtgcttgtttgcgttttaatgttcagagattgagcttcagatgatgcttggattctgcataacgcgtcgaatctttgtaggctttataagaatttcgcctcttgttaagtgttgtggtgctggaaattgcggaaactctttagaggtttatgatgagattgtgcctccaaggtgtttgtagtattgcctgagtgatg

SEQ ID NO: 11878 - DNA, 3000 bp, Unknown
  misc_feature (1)..( 3000): cDNA_ID_3023312_gDNA_ID_2214521_Annot_ID_184614 3000 nt of promoter + ATG
ttgtgctaacttcatgtagtgtttagatagtgtttcattcactggccatagacttattttacaaagttatatgtgcatgtcattatatagtgtagaacttaaaacacctaaccaagaacaacaatacacacacacaaacataaggaaaaaaaaacttttccatggggctcgtaattttcttggcactaattgtcttaatccttattattggtctcaggatattcaaagcttttatgattcttgtttggcatccatttgtgttgaccagaagactcaaaaaccaaggaatctcaggcccaaattacagaatcttttacggaaacctcagcgagataaagaagatgaagagagaatctcatctttcgattcttgatcctagctccaatgatattttccctcgtattcttcctcattatcaaaaatggatgtctcaatacggtgtcgttttctccaactctctctttgttcatcttttattttagattttattcgaggataatgcgtaacacacaagttatctatgttatatattattaggagagacttttctttactggaacggaacagagccaaggatatgcatctcagatcctgaacttgcaaaaactatgttgtcgaacaagttaggtttctttgtcaaatcaaaggcaagacctgaggctgttaaacttgtcggctccaaaggacttgtctttatcgaaggtgctgattgggttcgccatagaagaatcttgaaccctgctttctccatcgataggctcaaggtattttaatccttctttcttagcttgacttgagaaattaaacattagagccgaataacttaattttggttgtaaatttctcattttgttgatcagatcatgacgaccgtgatggttgattgtacgctcaagatgttagaggagtggagaaaagagagcactaaggaagaaacagagcacccgaagattaaaaaggaaatgaacgaagagttccaaagactaacagctgatataatagcaacctctgcgtttggaagcagttacgtcgaaggaatcgaagtgtttagatcacaaatggagcttaaaaggtgttatacaacttctctcaaccaagtctctatccctggaactcagtaagttaatcattctcctactttcagttctcaaacaagattcttaggttttgacatatattggtcttgtttcttgtattctaaggtaccttcctacgccttcgaacattcgggtatggaagctggagaggaaaatggataactcaattaagagaattataagttcgagactacagtcaaagtcagattatggagacgatcttctcggaatcttgttgaaagcttacaacactgaagggaaggaacggaagatgagcatcgaagagatcatacatgaatgcaggactttcttcttcggaggtcacgaaactacttcgaatttattggcatggacaacgatgttgctgagcttgcaccaagattggcaggagaaactcagagaagagatattcaaagaatgcggtaaagaaaaaaccccagattcagaaactttctccaaactcaagctggtaatgttcatttttttcaaagggtctcttgtgagacaatgtttcttgcggttgaagaaacctgtttatttcttgcagatgaacatggtgatcatggagtcgcttcgactttacggaccagtgtcagctttggcccgagaagcatcagtaaatataaagttaggtgacctagagattcccaagggcacaaccgtagtcatcccgcttctgaagatgcatagcgacaagaccctttggggatccgacgccgacaaattcaacccaatgcggtttgcaaacggcgtttcccgagccgccaatcacccaaacgctctcctagcattctccgtcggaccaagagcttgcattggccaaaactttgtcatgatcgaagccaagactgtgctcaccatgattcttcaacggtttcggtttattagcctctgtgacgagtataagcacacccctgtggataacgtcactattcagcctcagtacggcttacccgtaatgcttcagcctctggaagactgaagtaaaatgcccaaataaatcggatgtcttaatgaatatacctcacgtgtgtgacaagtctcctccatataggccggcttattgctgatggtgggggcttaacaaatcatccttgttaagttattgggcttttactatctcagtttggaacccttgatgggctaaatagttattaataatttaatatattgtgacattgcatgtataattgaaaagtggaaggaagtgtgtaacggttatgaattcaaaagccaggctaaagcaacttgaaaacatgagtaatcgacaattcagaaattataggaatctcgaacctcctttcgttcagaaaaagacagtccaaaatgttaataagttataacaatataaattgtcctctatgacttcaaaatattttattacagaaatggcaaaatgccaaacgaaaaatctggatcgctgtttacattatttgtggttgccttgtgagacgatcacgtgaactttagcttttacacgattttctacgtgtgtcatatatcccaagaaacaacatctacaacttctgtttctaacttgtaacgtgtaagcaagctacaagaagataaagattacttccataagcaatgacggcatctgttataatcgatgctgttaaaagactgtccccacacctccattagcgataggcgattttagaatccgaagtttcctttattgtccgttacgttgtcttactttctttcccatgtaaaataaattcccattactcctatgttattttgttcggttagaattttattcattatatcttcaaaacagcttgtgcttatatcagaaacagaagtcacgacgaccctcacactacacacgacacataaaattgaaagccccactgcgaatccaccacaaagcaaaaaaaatttgtttgttattcgaatg

SEQ ID NO: 11879 - DNA, 3000 bp, Unknown
  misc_feature (1)..( 3000): cDNA_ID_2711331_gDNA_ID_2214521_Annot_ID_184612 3000 nt of promoter + ATG
cttaaacgtagtttccgccaaacctttactgttgtgtctattcaagaaagaaggatcatcaacgatatcgtttcgaaaagacccagtgagtgtctcagaatcaatagtgcttgaatcaatggtgaacctctccgagttagacggagtaatatcaggagactcaaagatgcttggcctaacgtagcaaaaggaatggcctaaaccttcatctaaaggttccagaaactccaaatcaacaccgtttttgtcattagacggcacgaaacaaccaacaacacgggaagtcccgtttcccatcactcaggcaatactacaaacaccttggaggcacaatctcatcataaacctctaaagagtttccgcaatttccagcaccacaacacttaacaagaggcgaaattcttataaagcctacaaagattcgacgcgttatgcagaatccaagcatcatctgaagctcaatctctgaacattaaaacgcaaacaagcacctgatagtatcaaattcggatttttttaaaaatcagctgaatgcccacaaaagctttggattctgaggtcttgaaatggaaacagaaacagtgatctgacctgttgaagaaggagatggatcatcaagcagaaactggaaacagatctaaaggagcggcaaagagaagacagtgttgtattgaacacatcggaagcaaaatagagacagtaaacaaggggaaaaaacacccctttagatttcttctatgggaatctgacaaaaagtacccatttttaaaaactaattatacaaaaacaaaaaaaaacaattatacccattttttaaaaaagaaaaaaaaaaaggaagaagacccagattgagattgaaccatgcagagacgaccagctgttaaagatccaagcttttcaggggaaaaaaaagaagctaaaacccagaaacccctctttcagatatgttacggagaaaccaagattcaaaatcgaaaattagtagagtcacaatccaaatagagctgaagaagaggggaaaaagaagaagcttgaagctgctgcaacaggtttgattttgatttaagcaggtcaagaattatgtatgatttcacctttttcttttaatttccttaagctcataggtgagagtgagcagagaagaaaagagttgtctcgggcttttcaaatggtttcggagggtaatcaaaaaaaaaaaaaaaaaaacagagtaaaaagtctaaaaactgcgttgaaaaatgtaaaagcgaaagatcgtctttttagagtttttatttttattttcctcttacatctgatttattggatattttttacaagaattgatacattaaaagtacttttttttttacgtacattcttagagagtaaatacataaccgatcattaaaaagaagagatgaagaagtgaatttccacaatgttttaaaccttcagaatttatattaatggggtttgcaaatgattggaggtatacaattacaggtgattcacgtcattattgttctcatcgatggaccctttgcatggtttcaattttttctatgcgggtcccgttttttattcacacccattttatcaatgttttttttttgttatggtcttcaattttttatatttggttgcattgaatcttgctcctcataatcggaagatttgaccagtgttaatgatattatatagtttgaacgttaaagtatgttaacatgttagtcttcttttttaatgttatcatattctgtttaccaagtaggtttattttaaatctcaatgctctatatactatcttattaaacgaggtaaacttaacatttttcatgtctagtaataccgtaagattctttctatgtaacgaatgagatttatatatatatatatatatatataaggaaatttgtaatgatgcctaacatgcaaaagaggccaactccacgagcacatagagagagtcacgctttaaaccaaacaaaacaaatttgttgacttaaaccaaatccactctctcattttttttgcctttgagtttctgactactgacaaactctttcaacgccctagaaaattatgcttttggtttcacattgtttgttttttgttgtattcttttatttattagtaattgcgtccacagatccaaaaccaaagccattatcatcaattcatccactaacttaactatttatattatactatattttatttcaaaaccccagaataaaacaaaagttgtatattggagtgggcaggcacctccacaaaaatgaaaacttcccgttaaaattcaccgttctgttttacggtttttatttatttacatgacttagtatcatagattcatttagtagtaatataagactgcgtaagagtgtctgcagaattttcacaatcagtttcaatgtttcatccaaaattgtatcatacagttggatcatacggtccttgaaagagctaatagtgaggtgggcttgtgatgattaaataggcccagtgattataaaaggcctcgttacagaccattactaacacgtgtgatgcgcggatgcggcataagatactgttaaacagagccgatgccgacaaaaatgaaataaactatttaagctttttaattaatgatttaattaattggttttggcagtaattgaggaggaacattcaaaagacagacactttttgtcatgttaataacagtaaaaatcctctaataattatgtctcaaataagataaattaaaattgcaagaaaattagtactgtatcttgtatttttagaaccatattaatttcaagaaaatcaattaattattcaaagatttggttcgtgacgtaaatcaatttattaccataatgatgaaagcgtgaaagaatttaaccagaaaaagccataaagacttctctcgctatcaatcacacacatgcaacagtacaagatttgtcagagtccacagaaatcgatcttttcgagtcaagattttcagctctgttcaggactccggcggag

SEQ ID NO: 11880 - DNA, 3000 bp, Unknown; identical to SEQ ID NO: 11877
  misc_feature (1)..( 3000): cDNA_ID_3023320_gDNA_ID_2214521_Annot_ID_184611 3000 nt of promoter + ATG

SEQ ID NO: 11881 - DNA, 3000 bp, Unknown; identical to SEQ ID NO: 11876
  misc_feature (1)..( 3000): cDNA_ID_3023324_gDNA_ID_2214521_Annot_ID_184610 3000 nt of promoter + ATG

SEQ ID NO: 11882 - DNA, 3000 bp, Unknown
  misc_feature (1)..( 3000): cDNA_ID_3023328_gDNA_ID_2214521_Annot_ID_184609 3000 nt of promoter + ATG
acgccgtcgttctttctcccgcatctcggttgttttctctctctcccggaataacaatctacagttctaccggtttaaatgtaccggttaagtaaaaaccggaaagataccttgttctcctaaaaaggttgagagaagcgagggattagcgtgtatcgacgagataatcatctagtcgtcggtgtcgccgcctttctccgccgtctgaaatcgtccttgttcgattttccgaagacgaagcaggagaagatatgtctgggaggttgctgaagaaggttctccaggaacatgaagattcgaaacttcagaaacatcacgaagaagaagaagaagaggacgaagaagaatcaggagcccgttcttcgattaatccattcgatctcttgaacgatggtgatgaagatcctgaggtcagtctctcagattttgacgattagattgttcggtagatttagtatctagaattttatcctcctccgtgttctaaaatagctaatgtgttgataagtttgaatgtagatagtttcaatggtttgatcttcagattcttatggttttttattctgatgtctagagctgattcatattttgttggtcgtaggagtaatgattacaaagtgtttctgtaacaattgggtttgattgcaggagattgatgatgagactatagctgagaagaagaacgaagatgcggatcatcagtcaagtgtcgctgatcatgtgcagccggtgtcaaagaataagtcgaagaaaaagaaaaagaagaagaacaaagagagtggctctaatgtgcctaaagctgaaatgactttggatgaaactttggaagcacttggtctcaatgctaactctaagcaagataaggttcaggagacaaaaccaaatgctgattcttccaaaaaggcttcttcacgatttgtgttggaaatagattccaagtatctgaatcttgagaacgagttgaggagaacgtatggttcaaaggctatgcgatcatttgagagtgagagtggctctcaaggtggtagtagctctagacgagggggaaggcgtggagtccatcatatcacaaagacggttctggtatctccaaaagagaattggtctcgatgggatagatctttctcaatggagtttctagagactaaagatggtaacaactacttcaggtaacaatttttacagctttttgttttttcgttgggtgtgtgtatagaaaatacagacattgtaaatttgtacatctgatgaaatacttttcttttgatgtgtagatatacccattcatcctcatatgagcaggctcagagagcatttcaggctgcacaagctatccatgatttgaatggtgtagcaagtgtccttatacacaatccttaccatattgagtcgctcataactatggcggattactttaagtttgtaggtgagaatgatatggctgcagattccattggaaaatgcttgtacggtttggagcgtgcgtggcatcctatgttcactccgttccagggtaactgccggttggagtttaaccacgatgaaaacaagctgttcttcaagacgcttttcactcacatgagaaacatggacaggcgtggctgtcataggtcagcgttggaggtctgcaaactcttgctttccttggacacgagtaatcctgtgggcgctttgttttgtgtggactactttgctttgagagcagaggagtatgcgtggctggagcaattctcggaggagtaccgaaatgataactcattatggctctttccgaatttctcttattcgcttgcaatagcacgagtttatcttgaaaagatggagcctacctcttcctcagaagccactcccagagatacttcgaagcaaagctctttggatctcatgacgcaagctttgaagcttcatccaacagtactcaacaaactagtggaaaaagtacctttaaaagatcaggcatggacaaagatactcaagcattcttacttccgatcagatgaatcaaagatcccgtctttagatcacctcatcaaaatatatgttgagaggaattatcttatatggaggcttccagatgtacagaaattgcttcggagcgctgctgatttagtcattgaatctctggaacaagatggaaccgaagctgagagctggctttgtgtaagattagaagctttctcttctgagaataaccagtaagcgttttgaactctcactcacttgtcaatttctttttttttggctagagctgatcacgtatggttctaacccattgcaggtactctcatttatcaacccatgatttctctgattcgatgccaactctcccaccagacaatttgcagaactttgtggctgatccaagaatggtgggaggagagcaaatggctgaaggtggcgggagaggtcaacaccaagcaccaccaccacgtccacgtgatttggcaaatcggagtccattagctgtgttgattgagtcaatacttccatgggctaattttggagatggagaggatgagattgcacatgatgctcaccaccaaccagacaacaatggctaatcaatggctctaactgaagaaagaagaaaactgctttaaagtttacaaaatgtggccttccttttgttgtacagtgccattttgatggtttagtctatggatcatttgttacttgggtaaatcggacttggtcattttcgattcatgttctggtggaataattgacagctttcattgctcaaaggctcggttaaggtttgagccggttcacgatgtcaggtcaaaatactgccacgtattaaaataaaaaaatgaagagtaattatagaaaataaagctgtctcatcttcctcagttctcagtttgtcaccatcctcgagcagcttttgagctttgaaggtatcgactaaattattattattatttttttctcctagacattgttactctttggggataaattttttatcttgtataagcttatccatcaggttcgaaa

SEQ ID NO: 11883 - DNA, 3000 bp, Unknown; identical to SEQ ID NO: 11875
  misc_feature (1)..( 3000): cDNA_ID_2707747_gDNA_ID_2214521_Annot_ID_184608 3000 nt of promoter + ATG

SEQ ID NO: 11884 - DNA, 3000 bp, Unknown; identical to SEQ ID NO: 11874
  misc_feature (1)..( 3000): cDNA_ID_1807391_gDNA_ID_2214521_Annot_ID_184607 3000 nt of promoter + ATG

SEQ ID NO: 11885 - DNA, 3000 bp, Unknown; identical to SEQ ID NO: 11873
  misc_feature (1)..( 3000): cDNA_ID_2707740_gDNA_ID_2214521_Annot_ID_184602 3000 nt of promoter + ATG

SEQ ID NO: 11886 - DNA, 3000 bp, Unknown
  misc_feature (1)..( 3000): cDNA_ID_1808366_gDNA_ID_2214521_Annot_ID_184625 3000 nt of promoter + ATG
atataccagtcaaaacttaatttatgtgcatagaaatctctgtaatgttttttaaaaaactatatttttacattaaatccgttacccttattatttggactcttgtttaattcacaattaaccagaatcatacaaattaaaacattcttttacttgatttttctctgttagtaaattatagattataacttaaatgtaaataaaaattgttgtcgttgttaatttgctcattttatattttgaaacaaaattaggattagtgactcggtacccacagataaaaacgccacaattcactctttatcatccattcatttttgaaaatagtcaaaaccaaaaacaaaaaacatccaaatttagaaaatccatataaatcttttatatatacgtaacatttctcttcctgtttctaatccattcctttccaatccacgtccaaaaaacaaaaccaaaaaaaaaaaaaaaaaaagacaaaaaaaaatgaacactccaataaaactcgcctttctcattctctgcattgccctaaccgcaaccgcatttatagtcccagcaaaacgtgacgccgtttcaccacaccaccaaaaagccgtcgatggaatctgcagcgttgtgcaagacaaacgtctatgcagcattaccttaagaaacgtcccaagcgatgatcccgccgttttggttcgttacttagccacggcagcagaagcgtccgttaaaaagggtttgaagttcctctccggaatcaaaccaaaatacaaaggaaacgccttcgccacaacatgcatcaccggctgcgagaaacagctacacaacgccttggacgactttgcagatttctggaaagccgcaggaaaaaatctaacgagcatggctgagaattacttcacatgtaagaagaagatgacttccatcttcacttaccattccacttgtctcgatgacatttacgacaagacgttgcacaaagtggtcgaaggagggattggccttgggaaaagaatgagtggtgagtctgtggatgtgttcgctggaatgggcaaagtctttaacactttcaacattaagaccaaacttaaccagaaagataccgacacgttgctcccaccacctttgtccttttactactattgattttatttatcaatatatattatatatcataaaacacaacaaaatgtactgcttcggtcgatggtgatgaataattttcatcgattgggttttcagatattttggggatcttgtaaccaaaggttccttttgatgtatgtttgtatttaatatgttatggattataatcatgtatggacctcgtgattggaaaggatatggaataatgtgattatctaataataaaaacgtaattaatatcgtatttgcatatatgtattttatgtttatacattcttactcatattttcgtttgttttttttcttcattgatgctccacattctgacgtaaattttgtaatcaatggctacatacatttttttaaaaacaccaaaaaccaacgcaatttgattccccgtaattcgtcattatttagtgacctaactaactttttaccatacatcctactcagccgaagatgaataccatttcgtcgctgattttacttttgtggatttgtttgtagtatataatataccctttatgtttagtaggcaaaatgtgtagttattaaaaaaaattgtggttatatattataagtacttaattggttttattaactagacatgctactgatcagccgaagatatataaataccattctgccgctagttaatttatattttttgttgctacaattctgttttctttcttgtagtgagtgatttactctctctttgttggttaatgtaaagatgtgatgatttactctcactattgatttatttttcactatgaaaatatgtagatttagatattttacaaaggggaaaaaatcaattgaaaagcaatttagaagttttatcttttgtgggtcacatattaattcttatacgtatgtattaagttccgaggggcgagggatacgaaaatgtaaatataatgtttctcgttaattaatcaaactgctatatatatatatatatatatatatatatatatagctacgtttatatacatagcatgttgcaataaatcaaatacgtacgggattgttgcggtgcatacgtgaagacaaagtatatatattgtatgacaaattgaactggtctggttacctatagtagagctcattttttaggattttctgttaagaagagctcatttaaagagtttgttatatagaagctctgaatatttataatttagttatataatctggttcattcatatccgatactgcatgcagaccagttaaccaatggaatgaaggtgaaaatatgcgctttaatgttttgacctatacatagtcaagctatgacatgactgattttaaaaggattttttgtaactcggttttatacaagtttggtttgtttggtccaacttgacatagtatttaactaaggattaaaagtaaaattacagctaatatcacttaaggaattataaatttctctttatttttatttatttttttcttctttattttatttttagtcaatcaaaccaccacaacttctaatcaggggacgtacgccatatttatcttatcgtgaccaattttaatccgcaactaagcaattacaaaaacaaatctttaaagttaattatagctttcttgaccgaatactctcagccattcgtcgaccgcaaatctctccctctccatgcaaaatccatgcacggtcctaattttagaaaccaaaaagcttctatataaacctccagcatccatcacaatagatactggcccaagtcattcaacaacttggcttttatctaataaagcccctccctctccgataaaccttaaataaaaccggagggagagcaaaaaataaaaacaaaaatatacaaaaacaaaaacaaaaaatcataaaaaatg

SEQ ID NO: 11887 - DNA, 3000 bp, Unknown
  misc_feature (1)..( 3000): cDNA_ID_3023285_gDNA_ID_2214521_Annot_ID_184624 3000 nt of promoter + ATG
atgactaaggctggacgtggcagtaatgacggtggtgctaggatcagagcaacctttgtggtggctaaggacggaagtggacagtttaagactgttcaacaagccgttaatgcttgtcctgagaaaaacccaggccgttgcatcatccacatcaaggctggtatctacagagagcaagtgatcatccctaagaagaagaacaacatcttcatgttcggagatggtgcaagaaagaccgtcatttcttacaacagaagtgttaaactcagccctggaaccaccacttcccttagtggcacagtccgtaagtctcaccaaaccctaattcactagttaggttaacaaatatttttctctacatatatagctcatgttatatattattgcgcagaggttgagtccgaaggattcatggcaaaatggatcggattcaagaacaccgccggtccaatgggacaccaagctgtggctatcagagtgaacggagaccgtgccgtgatcttcaactgcaggttcgacggttaccaagacaccttgtacgtcaacaatggtcgtcagttctacagaaacattgtcgtgtcaggaacagtcgacttcatcttcggcaaatccgcaaccgtgatccaaaactcactcattgttgtccgtaaaggaaacaagggacaattcaacacggtcacagccgatggaaacgaaaagggtctagcgatgaaaatcggtatcgtcctccaaaactgtcgcatcgttcccgacaagaaactagcggcagagagattaatcgtggagtcatacttgggaaggccatggaagaaattctctaccaccgtgattatcaactccgagataggagatgtgattagaccagaaggttggaagatttgggatggggaaagtttccacaagtcatgtaggtacgttgagtacaacaaccgtggaccaggagctatcactaaccgaagagttaactgggttaagatcgccaggtctgcagctgaggtcaatgacttcactgttgctaactggttaggtcctattaactggattcaagaagccaatgttcccgtcacgcttggattataaggcgtataaatcaaatcaaatcaaatcaaaaaaaaaaaaaagagtagtacgtgctcatgtaaaaggtgaaaatacaacgtcgttttcggtagggtaatatgcgcggggagatgaagttgtaagatttgctttttgtttgtctcacgtatgaaagatgaggaaaaaaaaaatattgaaaatttatgttgtttgatttttgtttctatgttttgggatataataatttattcgctgtgttgtacctatgtttaataacctttttaaaatattataatttaactaatttattttacgttgttgtcaattctctaatttactgaaattattatggacattcatataattaacttgcccgatatttctccattttgggtttactttgagacagaggaacaatcgtgtcttcttttctaactcagtcctgtcttttttttttttttttttttttttaatttgcatacaaatggattacagtcgtcgcaaatgcttatttttaaaaataaaaaatgggtatatcaagtttattgtgatctttttttgtttccaaattgttttggttttagaagatatatggcaacatttttttgggtgaaacggatacaatgcaacagtggtttaattgattaacaccaacttacccaacagagatgcaagctgcacaaaaattttgcgagattttttttttttttattttaaaaaggaaactgctaaaatatacgtacgagactaatgctatgttacatatttccaaagatttaatcttcttccaacgggtatttataacatctagtttaaaacctctaagacgtaaaatttcctttctcttcttagacgtagtcatctgagattctgtcacgatagctagacccatatctctttcaacgttatgtaaattataatataagtttctaatttttatttttaaatgattattacttttgatccctcattgttttttaaaagtttttttacaccttttcattcaagattttattttaaagttgagttttagcatttaagtccaaacagaaagttttataatactagaaacttggatgataaatttgcaatacaatataaatataaactggattttggatcatgttatttgatataatttattcatcattagagatttcacaaattcaatttttcgtgccatcatgtagatttatcatacaagttattaatttaatttgatttttcaaaaatatctttttaaaaagttttaaaatttgatttaaatttttatctatttaaattttcaatttttagaatttgaagtaatagaaagttaatacgtttgatatacgatgtaaaaactaaccattgaataatgtcaattgataattagggattttcacaaacttaatatataacacaatgtcgatttgttacacaaatcccttatttagaattttaagtaatgaaaaattagataataaataagaaaaattaaccatatttggatcatttcacctgaccttgtttatagtaaggactaatgactattatagaaagttaatcctaaattccatatatatggacgtaagattgaaataacgtaaatacccttagtaagatttggaactgcaaatttacgttcggcatccttttctaagttcgacgtcacgagctccagcgaaagttaaataaagctttttgaccaaatattctcagccattcgttgacccacatcaatccctctccatgcaaaatccatgcaagttactaattttagaattcaaaaagcttctatataaacctccagaatccatcacaatagatactggcctaagtcattcaacaatttggctttaatctaataaagcctctccctctccgattaaccttaataaatccggagggatcggagagaaaaaagaaccaaaaaaaaaaaaaaacagaaaaaaaaaaatg

SEQ ID NO: 11888 - DNA, 3000 bp, Unknown
  misc_feature (1)..( 3000): cDNA_ID_3023289_gDNA_ID_2214521_Annot_ID_184623 3000 nt of promoter + ATG
agatggtgcaagaaagaccgtcatttcttacaacagaagtgttgctctcagccgtggaaccaccacatccctcagtgccacagttcgtaagtctcatcaaaccctaattcagtagttaggttacacatatttttctctacataattcatgttttcgatatatatattgtgcagaggttgaatcggaaggattcatggcgaaatggatgggattcaagaacaccgccggtccaatgggacaccaagccgcggctatccgagtgaacggagaccgtgccgtgatcttcaactgcagattcgacggttatcaagacacattgtacgttaacaacggtcgtcagttctacagaaactgtgtggtctcgggaacagtagacttcatcttcggcaaatccgcaaccgtgatccaaaacacactaattgttgtccgtaaaggaagcaagggacaatacaacacggtcacagccgatggaaacgaattgggcttagggatgaaaattggtatcgtcctccaaaactgccgcatcgtgcccgacaggaaactaacgccagagagacttacggtggcgacatacttgggaaggccgtggaagaaattctcgaccaccgtgataatgagcaccgagatgggagatttgattagaccagaagggtggaagatttgggatggggaaagtttccacaagtcatgtaggtacgttgagtacaacaaccgtggaccaggagcattcgctaacagaagagttaactgggctaaggttgccaggtctgcagctgaggtcaatggcttcacagctgctaactggttaggtcctattaactggattcaagaagccaatgttcctgtcacaattggattataatttataaagcgtatatgaaaattattttagtttttaagtatatgaaaattggtgtatgaaattggtttatgaaaactttttaagaaagtctataatgtttttcctctgttaatttgcttcatctaattaaggtcatattgcaatgcagacaagtactcatgttgctttattataagttccttcttactgagtctatatgtttttcctctgttttcttcatcttgttttttttataacaaatcctcggttttcttaaagaagagaaaactaaagtaatgacaataataaaagtgttttctatgtgttttaacttcttataaacttttcatcgaacgaggaaaaagaattagattatcctttggtacagataatggaacaagcttcatgcccatataccataggcctacatcagggaaatattcaatatcaaaccattacgccaagttttaaaaaacactttatcatttaaaatttcatataagttttgtttatttgaaaatttagaacctcattttttggaaattattttagtttgaagtatcagccacatattttattttctattgtttgtcaatttctaattcattgaaattattatggacatgactattttagggaagttttaaaggcttattggcaaagtagacactttttcaaaaataatttgtaaagtaggtagttttttttttaaattagagaaatagatactttttttgctttttgtgagatagagaatttgtctaatagactaaaaaacaaaatacatatcaaatactaaaataccctttatcttgagagagaataaaaattatatgaagaaccatttttattttattttgtttgtctttatctttttatttttttattttagtattcttaaatacttaaaaaaattaaatattatttttttaaaaaaattacattaacttttagactatttatctgtcatcattataatgcacaaacatttaaaacatcgttttgtacactaaccattattcgttggtgtacaagtgtgtacaccgatatttcataaatcatcaccgacttctcttatacttattaatataagtaatattgttttaatattttacaaacataatgattgtataaaccaaatattattattcaatataatggtgtacatgatggtgtatataattaagttactcttaataatgtacaaaatgattgaaactattatgacgattggtggatagaatgatatatacaacttttaaatgataacatacaagattggtagacaaagtgtacaaaacttggtgtacacttatagagaatgtataaatcattattttaattagtggtgtacatcatctcgtacaccaatgttagtacattgtctcatagatttttaaaggtgtacgattatgtacaccatatttttcatcatctatgtacatcattttgtacactgttatactcagtgtatcattttctacatcagtaattatattaatttttacgttattgttgtatattactattagtacaccaattttaacaatatcacgtacaccgtcggctgagtttaaataaaaattgctacatatttttgaaatagcaaaattagactttttaaattcacataaaaattttaaaaactaatatgattatgtggtaaaattttatgaagaaatatcatcaaataaagtaaaaatatttaagtaaaaataaaaaataggatttgacttgaattttgtctttatcttactaaataacaaaataacaaaaggttatataagtcatttagtaaaatctttattaaacaaaaagtattattagataaaaaagagaaaaatgtctatttctcatatttctaaaaaaattacatactttacaaattatttatagaaaaagtgtctattttccaacttatctcaacttttaatttcaaatttcaaatatatagacgccagaacgaaatgacgaaaataccctaattaagatttggaactgcaaatttaccaaaaccctcgttttatcttttctcgacggcgacgagagaagccgccgtcacgagctccggcaaaagttctttcatcttcaccgttcggtctgaaacttaaccagacagatcgaaagagaattcgaaaacttgtgctaaaaaaaacatg

SEQ ID NO: 11889 - DNA, 3000 bp, Unknown
  misc_feature (1)..( 3000): cDNA_ID_2707761_gDNA_ID_2214521_Annot_ID_184622 3000 nt of promoter + ATG
taaggtcataagagggaagccaagaccatttccaatagatccaagcgtcccgaggatcatcaagaggaaatcaaaggaatctgcaaaagcaaagagcttataaaacggcaccgttttggttttctcatgttcctcgtctttcttctctgttttcttcacttcttcttcttcttccttgtctcttttggtctcagaaacctcttctagtatatttggatctccatttaagccgctctctgaagccattagagtttcacagatacctcacgatcctaagcatttaaaagaacagaggagatatgtaataagtttctaaatctatgagctgatgagatcttcaagagagagtatatatctaaatagggaacataaaggtcaggccaagaaggaaaagaaacaaagacttttcaccaaccatgaaaacaccctaaagatctgtatattgttttttcaagaacatgtgaaaaaataacgaaacctgaagcaagatctgtcgtttacaatgaggaataaccgaagctacggcccagataagaacataaagtacagagtttccagtataaaaatgattaaagcagagaatataaaaatatatatatatacctcgaaaagcaacaagaagaaagtgattagggtttagcggcttcttggtgtcttgccgtataaacagcagttgaaaaatgtgcagagagctctctctctctctctctgcttatatatttttatataattgtaagtgaagtttggaaggactcatgtgagtttatatatgctctgtttatttcttgacgaacaagctgtgacttgtttgagagaaagagaaaatggatgccatgaaattaataactactacttcgtaaaatttgtgaaaaatagtctttttgttgttgttgttagtaaagttaaattgtaaccatagcacaattggcgtagttataaaatagggaatcttgtgtatataaaatgaattatgcctttatgtttgtaatacaatataatacgtaagataacattttcaatattttatctgcccattattgtctaatgctgaccaagatgattaattatagcattaaaaaaatataaagaacgaattgatcacagcgatcgacgattagtctagctgttttgttcaactacaactctattattttaacataaagttttaatacgggaggaccgtatgtctgtataatcccgcgaatcactcatatgtacaatatagttattttttttattttttttggtatcagtgataagatatatttgatctcttattatagctagttaattagccatgttattagcagcttccatatgtccttactccttatcatcgtttaaaacgattcgttttatataaaaactcgaattttgtatgtacgtctttgtgtgtacatatacacatcaatatctcaaaaaaaaaggaagaagctgagttatgatgattttcttgcatcgctttagttgactttctcgttggcattagttgtgacttgtgactatggatggacaaattgacaagtgctgcaagaacccattcctcactagtaatctttgttatcataattgcgttttgccaacggatcgatgggaattattgatgtgttaaaacaaacgaaaaatcgaattcccataaatgtatatttcattagttattttgtaagttaagctaaaaatattataaaattatattttctggtcagattatatctttgcactaccattctaggttggaaccacgtgaagcttattttactttacgagcaagaaacacgtccgaattttaaattatcgattcaaaataaaacaaagaaaagtcaaaactacagagaaagggacctttctttcttccagggagccagggaaggaatggtctcgcattacttcttctgcgccttttcagaatcaatgaatcttatcgaaccaataacgattctgacgtcattcctgacatataatgatattcctatatttatcacctacccacgtatatcttttgtctatagcaagaatttactacttggggaacaagttatcaaatactacttttctaagaaaagaaaaactactagttgcaattttattccaaacattgatgtgagagtgactacaccattaataaatcgtgtgaggcgctattcagatttttcatttttcgatgaagtgtggatttgttttgtcatttttattgtaagtttttgttttggtgcacataaatatttaatttctattaatttaaaatatctgctgaatgacactaattattggactcattaattcactcgatagattattgacatttttttcagtaggcgtagtagacctttttccgggggaagaaaaaaagtttaagcggttcgattcccactaaccttttggagaatcgtgtcacgtgtcgaatagacccaaatcctttaccctacatgtttgaaactgtataaaattcccgacgtaaataagacgatcttgacccggcccgagaacccgaatctatggattttgaatttggaaacccaacctacaaattttttatatatcccactgacaaagccgttactagcccatgggcctaattacttcaaagaatgctcaacttttgatttttaatagagaagaaaaagtttgaaactttatcatatattgacttgtcttgttgctctctagagtgcaatcataccattgaatacattttaggattcgttttcagatggtttaagatataatcactctgaacgcaaatgcaaattagaatgtattttgatccaagcatttctacatgtactgctttgatctgaatcgaaaagagcaagtcatggttactccctcaataatcgccactaagaagagtaacagcttctttgacttttggaagcatttatcacatagagattaaatcattcaccaactaccactgcagtccacacaaaaaaaaagcttaaatagattaaccaaaaaagcacaagaaaactaaatgcagaaagagaggaaaagagacaa

SEQ ID NO: 11890 - DNA, 3000 bp, Unknown
  misc_feature (1)..( 3000): cDNA_ID_3023293_gDNA_ID_2214521_Annot_ID_184621 3000 nt of promoter + ATG
tttgtttgattggtcttctgtgtatgctttgatgcatttagatgacaaatcgaagcaatctgcagctcgaggactacccatgtgaggagcttcgaagccaacctcattgcagaagttccaagcttcaaatgccactctgagaccgtctctcttcatcccaggatctccaaccgctgatctctcgtctccatgaaccaggaggatcaagtttaccacggccaagattggagccagttgcttcatttgtctcttttcctctctttctgcatttagttttcttgtgcttttttggttaatctatttaagctttttttttgtgtggactgcagtggtagttggtgaatgatttaatctctatgtgataaatgcttccaaaagtcaaagaagctgttactcttcttagtggcgattattgagggagtaaccatgacttgctcttttcgattcagatcaaagcagtacatgtagaaatgcttggatcaaaatacattctaatttgcatttgcgttcagagtgattatatcttaaaccatctgaaaacgaatcctaaaatgtattcaatggtatgattgcactctagagagcaacaagacaagtcaatatatgataaagtttcaaactttttcttctctattaaaaatcaaaagttgagcattctttgaagtaattaggcccatgggctagtaacggctttgtcagtgggatatataaaaaatttgtaggttgggtttccaaattcaaaatccatagattcgggttctcgggccgggtcaagatcgtcttatttacgtcgggaattttatacagtttcaaacatgtagggtaaaggatttgggtctattcgacacgtgacacgattctccaaaaggttagtgggaatcgaaccgcttaaactttttttcttcccccggaaaaaggtctactacgcctactgaaaaaaatgtcaataatctatcgagtgaattaatgagtccaataattagtgtcattcagcagatattttaaattaatagaaattaaatatttatgtgcaccaaaacaaaaacttacaataaaaatgacaaaacaaatccacacttcatcgaaaaatgaaaaatctgaatagcgcctcacacgatttattaatggtgtagtcactctcacatcaatgtttggaataaaattgcaactagtagtttttcttttcttagaaaagtagtatttgataacttgttccccaagtagtaaattcttgctatagacaaaagatatacgtgggtaggtgataaatataggaatatcattatatgtcaggaatgacgtcagaatcgttattggttcgataagattcattgattctgaaaaggcgcagaagaagtaatgcgagaccattccttccctggctccctggaagaaagaaaggtccctttctctgtagttttgacttttctttgttttattttgaatcgataatttaaaattcggacgtgtttcttgctcgtaaagtaaaataagcttcacgtggttccaacctagaatggtagtgcaaagatataatctgaccagaaaatataattttataatatttttagcttaacttacaaaataactaatgaaatatacatttatgggaattcgatttttcgtttgttttaacacatcaataattcccatcgatccgttggcaaaacgcaattatgataacaaagattactagtgaggaatgggttcttgcagcacttgtcaatttgtccatccatagtcacaagtcacaactaatgccaacgagaaagtcaactaaagcgatgcaagaaaatcatcataactcagcttcttcctttttttttgagatattgatgtgtatatgtacacacaaagacgtacatacaaaattcgagtttttatataaaacgaatcgttttaaacgatgataaggagtaaggacatatggaagctgctaataacatggctaattaactagctataataagagatcaaatatatcttatcactgataccaaaaaaaataaaaaaaataactatattgtacatatgagtgattcgcgggattatacagacatacggtcctcccgtattaaaactttatgttaaaataatagagttgtagttgaacaaaacagctagactaatcgtcgatcgctgtgatcaattcgttctttatatttttttaatgctataattaatcatcttggtcagcattagacaataatgggcagataaaatattgaaaatgttatcttacgtattatattgtattacaaacataaaggcataattcattttatatacacaagattccctattttataactacgccaattgtgctatggttacaatttaactttactaacaacaacaacaaaaagactatttttcacaaattttacgaagtagtagttattaatttcatggcatccattttctctttctctcaaacaagtcacagcttgttcgtcaagaaataaacagagcatatataaactcacatgagtccttccaaacttcacttacaattatataaaaatatataagcagagagagagagagagagctctctgcacatttttcaactgctgtttatacggcaagacaccaagaagccgctaaaccctaatcactttcttcttgttgcttttcgaggtatatatatatatttttatattctctgctttaatcatttttatactggaaactctgtactttatgttcttatctgggccgtagcttcggttattcctcattgtaaacgacagatcttgcttcaggtttcgttattttttcacatgttcttgaaaaaacaatatacagatctttagggtgttttcatggttggtgaaaagtctttgtttcttttccttcttggcctgacctttatgttccctatttagatatatactctctcttgaagatctcatcagctcatagatttagaaacttattacatatctcctctgttcttttaaatgcttaggatcgtgaggtatctgtgaaactctaatg

SEQ ID NO: 11891 - DNA, 3000 bp, Unknown
  misc_feature (1)..( 3000): cDNA_ID_3023297_gDNA_ID_2214521_Annot_ID_184619 3000 nt of promoter + ATG
tatacaacttctagcaacatttgtaggaggctttgtgatagctttcgtaagaggatggcttctaacgttggtcatgttatcttcaattcctctacttgtaatggctggtgcacttctggctatcgtcattgctaaaacagcttctcgtggacaaactgcttacgccaaagctgccactgtagttgagcaaacaattggttctataagaacggtaattaggcttacttatacacttttacttagccaaaattaccaaaaccacaaagacttactatctacatttttgcaggttgcatcatttacaggagagaaacaagcgataagcaattacaataaacatcttgtcactgcttataaagcaggagtcattgaaggtggttcaactggattgggtcttggaacgctctttcttgtagtcttttgtagctacgctttagcagtatggtatggaggaaagttgatattggataaaggctacacaggaggacaagttctcaatatcatcatcgctgttttaactggatccatgtaagtacctttcattagcaatacctctttggttcattaacttccctgcaaactaatttgagatatctttttgttccttccttaggtcgttaggtcaaacatcgccttgcttaagcgcatttgcagctggacaagccgcggcttacaagatgtttgagacaattgagagaagacctaacatagattcttatagtacaaatggtaaagttttggatgacattaagggagatattgagctcaaagatgtttactttacttacccagcgagacccgatgagcaaatatttcgcggattctctctgtttatctcgagtggtacaacggtggctttagttggacaaagtgggagcgggaaatctactgttgtgagtctgattgagaggttttacgatccacaagctggtgacgttctcatagatggtattaacttaaaagagtttcagctaaaatggattagaagcaagattggacttgtgagtcaagaaccagttttgttcactgcaagcatcaaggataacattgcgtacggcaaagaagacgcaacaaccgaagagattaaagcagctgcagagctagcaaacgcatctaaatttgtggataagctaccacagggtttggatacaatggttggagaacatggtactcagctttccggtggacaaaaacagagaatcgcggtggctagagcaatcttaaaagatccaagaatcttacttttagatgaagctacaagcgcgcttgatgcagaatctgagagagtggttcaagaagcgcttgatagaattatggttaaccggactactgttgtggtcgctcatcggttaagcactgtgcgaaatgcggatatgatcgctgtgatccaccaaggcaagatcgtcgagaaaggtaaactacctaacattcttattcactttttgcatatggatacacatgtgtgatagcaaaatttgatgaacaggttctcacacggaactactaaaggacccggaaggagcttattctcagctgattcgtctacaagaagagaagaaatctgatgagaatgcagcggaggagcaaaagatgtcatcaattgaatcattcaaacaatctagtctgagaaaatcgtctctaggccggtctctaagcaaaggaggatcatccagaggaaacagcagccgccattctttcaatatgtttggttttccagcaggaattgacggaaacgtcgttcaagatcaagaagaggatgatactacacaaccaaaaaccgaaccaaaaaaagtctccattttcagaattgctgctctaaacaaaccagagattccggtgctaatacttggatcaatatccgcagcagcaaatggcgttatccttccaatctttggcatactaatctccagcgtaatcaaagcgtttttccaaccacctaaaaagctaaaagaagatacaagcttctgggcaatcatattcatggttcttggtttcgcatccatcattgcatacccagcacaaaccttcttctttgccatagctggatgtaaactagtgcagaggatcagaagtatgtgttttgagaaagtggttcacatggaagttggatggttcgacgagccagagaattctagtggaaccataggagcaaggctatcagcagatgctgccacaatccgtggtctagttggagactctttggctcagacagttcagaatctttcatctatattggctggtttgatcattgcatttttggcttgttggcaattagctttcgtggtcctcgcgatgctcccgcttatcgcactcaatggatttctttatatgaagttcatgaaaggtttcagcgctgatgcaaaggtaaactagttttttttttttttttttttgctaagataggtaaactagttactacttttcatacatataccaactagattctctcaatcatttgattaacgttactttaaatcattggcagaaaatgtacggggaagcaagccaagtagcgaatgacgcggtagggagcataagaaccgttgcttcattctgtgcagaagacaaggtgatgaacatgtactcaaagaaatgtgaaggtccaatgaagaatgggattcgtcaaggcatagtcagtggtattggtttcggcttctctttcttcgtcctcttctcttcttacgctgccagtttctacgttggagcacgccttgtcgatgatggcaaaacaaccttcgactctgttttcagggtacggaaacaaaacacacaacatgttgatgataaatgccttcccttgagagtttcttgatcccttgtcatgtttaacaatgcaggttttctttgctttgacaatggcggcaatggcgatatctcaatcgagttcgttatctccagattccagcaaagccgatgtagctgctgcctcgattttcgcaataatggacagggaatcaaagattgacccaagtgtggaatcaggaagagtgttggataatg

SEQ ID NO: 11892 - DNA, 3000 bp, Unknown
  misc_feature (1)..( 3000): cDNA_ID_3023300_gDNA_ID_2214521_Annot_ID_184617 3000 nt of promoter + ATG
tcatttcaattcatcaaacttcgttattataatttcatccttcacaaaataacacaacgtgcaagcatagtgtagcttggtttggattgaaccatgtaagcaattagagacatatacgcactagagttgaaaccggcttggttccctcgcttaattcaggtttcgatatttcagtttggaaaaaatgtactaattagttggaaccaattgagttttagagaaatattgaagaaacaaaaaaaaaatcaagagaaaaaggataaaggagagatgttccctaacaacactacaaattacaatttcctcactttcttattttcttactgcctccgcctcctctctgtcccctcttttcttccattattttcatttgcatcttctctttatttctttgcaactttaatcttatgatatgtaaattgtaaatatactcatttttttctatattgaataaaaaaacttttgttagaaaaagatacacatatacgatatttcctcaaaaataatatgaagtactgattttggcagtcattatagaattgcattttattggaaagatacacacatagttcaagtactttatatatgcgctaattttgagaactccactttactgcgtcgtggttgcttgtcagtcaaaacttgggcttgcttttaagatgcgtgattgcatttgcatgtctcgtggctttctttttctgtagcccctcttgttggactaatcatagccttttgtttcctccctttgctttaacattactgaaattatcggattgtttctttcatttgttgattggatgtatgtttacattattacatgtgtattcattgttataatatacaagttttaaaacattacttcccctaccaaataatttcaaatatatatatatatatatatatatattcatgaagcattttttattttattttggtttaatgaagcattaaattttgaacttgcttatgttacttttatgatattggaagaagtcgaattatttcttcgttgatatcgtatataaaatttaaaactcatagaatttctattcaaaaagtaattggtgattaaatgaatggagtgcctatatatgtattttttttttcttgcaatcaattttgatttagaatttgcatgcatgatatttttttaatatttttttatcctttaataatttttttttatattatctaaagttgtatttgtattccttacataaagtttggttactttcatctctaaggtaaactgctaatattaaagaaagtaatttaatggaagcaaaaagtgttaaaatatgtaatataatttgaatggaagagtagcccccgagggcaatcaagtggaggtcttccatggttaggatgcagaagcttaatacgtttatatagatagataaacaatagcctccataaagtaaaagatacttgcatgcgtgcgtgtaggtattgagtcgagatgttacgtgcgtgtctttttatagatactatatattattggttcttctaaatccttaaaaatgttaagattacgcacgcaattcatgaattgtatatagatttaccaaatcttgaattgattttaaatttcttacaaagcaaatacactggtagtgtgacattttgtccctgtggattctgtatgacgtaatctcgttcctcacattatgacacttaatcgagtgtttttttttccctatcattttttttgtaaatttatcctctacaaattatgtatgtttgtgaactattaaatacgatgttgatatatatatatatatatatataaactatataataaataagtgaattattttacgagtatggatcataaataaaacatggaataacaatagaatgtttgttaaatagaactcaaattaatgatcagttatgtacagtccggccttaggcccaggcactacccacttgggccgggcctggttatgtagcatatatataaacgctagtcaccgggatagttggacttggatggctctagcctgacccgtcaaagtttaacggaaacttgacatatgcaaagaccgtctccgtttgaactttgaagcgattgaaattttttgagaggcgaattaaggcgccaaaattttgagaatgataagtagattacgacacatgtactcacctcaatctgacggttacgatgcaatgtaaatacgaagaaatctcagggttaaaatcgtccaaatgttcggcgtcgtgtatacgcaattcagctacagacagtgtttgttacacaccattttgagaaatctaaattttcattttcccccgcttctctcctagaaatttcgaatttctgcttctctctctctctatcagttttctcagatcttattccagttaatattccggcgatcttctttctctctttgatcacttaattcttcaccggaatcagagagtcagggctttcgcacttgtacccgcgagctttgattaggtaatttcttagccaatgataccatcgctcgattttctctgttttcgttttcgattcatggctcgttactctcatattcagtgataagtcgtcgcgatctatgccccctttcgttaaattggtgttatcgtctcgattttgagtttagtaccagcgttatagtgttgtctttgcataatcggagagttttggtatgaaattcgttgctagagatatcacatctcgctagttgttcatcgtttcaagcatctattatctgctgcttctcttgttttcgtcatattatccagatctagcaccttcttattttgggattttctattaccaaattttttatccgagtgttagaaatttaccattcctaatgattaatttatcatccattatcgctgaatatagcctgcgttgtactgctttacttctctgtttgtgttgctattcagaaattatatgagtgattaggtgttcgttgatatttacattctttttcccagcagaattgttaaccttgtggtgatacatttcaggaaaagatg

SEQ ID NO: 11893 - DNA, 3000 bp, Unknown
  misc_feature (1)..( 3000): cDNA_ID_3023308_gDNA_ID_2214521_Annot_ID_184615 3000 nt of promoter + ATG
aaaccaatgaacaaatgaacaacaataagaagaagctaaagtcctccaaaatcgaatttgagagaaatgtttcgaaaagcaacaaatgtgttgaatcatcaacattaattgatgtttctgctaaaggtccaaagaatgttgaagttactacagctcctcctgatgagcaatctgcagctgttggtagatccacggaattgtattttgcttcttcatcgaagttttctcgaggaacttcgagagatctaagttgttgttctttaaagaggaagtatggagatattgaagaagaagaatcaacctatttaagtaatgtaagagaaattaattagctgcttgtcttagttctttcacatggtagatcattaattgtctttttcttattgcttatgcagaattcagatgatgaatcagatgatgcgaagacacaagttcatgcgagaacaagaaagccggtgactaaaagaaaacgaagcacagaagtccataagttatatgaaagagtgagtttatatgtatgaaaatttcaccttagttagtagaaaaaaaataatgtatgaaaattaatgctaattaaggatttgttaacagaaacgaagagatgaattcaacaagaaaatgcgtgctttgcaggacctactaccaaattgttacaaggtttgagattaacttaaatcacattacattgtttacttagtcttagagagttaattaattttctctttgtggagatttctgaatatctgtaattgttgatgataggatgataaggcttcattgttggatgaggctatcaaatatatgcggacccttcaacttcaagttcaggtattcaaaataatacaccaattcaataaaatttcattgagagataataaaatgattcaggtgttaattatttaaacacagacttgtgtttatatttacatataaatttgttttttaacattaaaatatactttgtaaagtgtttttgttatcaaatattattgcgtttggcttttacctttacgaatgattcttgataaagtcactagaaactagtttcataagagaaaccaaaacaaattataaacgtaattaaacactaatcaataaacaatcaaaagtttattccttatttattttactacaaatttttttacatatatataagattcttaattaacatgctctaataattatttacagatgatgagtatgggaaatggattaataagaccacctacgatgttgccaatgggtcattactctcccatgggtctaggaatgcatatgggtgcagcagcaacaccaacatcaataccgcaattcctgcctatgaatgttcaagcaaccggttttccggggatgaacaatgcaccaccacaaatgctaagctttcttaatcacccaagtggactaattccaaacactcctatcttttctccattggaaaattgctctcagccattcgtggtgccttcgtgtgtttctcagactcaggctacttcttttactcaattcccaaagtctgcgtccgcctcaaacttagaagatgcaatgcaatatagaggaagcaacggttttagttattatcgctcgccaaactaatgatttgtagaaagttgatgttttctccaactaactaactttaagcaaaaaaaaatgatcgtctactctgtgttgttagtctatgggcttttgggccttgattcttggaacgatttgaacttaattccaactattttcaaagtggatgtacaaagtaaaatataacaaatataagttatcatagactctataacaaagttataagtagaggacgtgcaattgcataatgatggatgatgatgagtgttcaattacgataaaccgattttaacgcaaacccaactaagatgaagacaactcatttgacctaaatcgtaatttgaaacgaattttgccatgtttttgggattaaggaacaatctcaatgatgagattgagtaaagtactacaaaacttgggcttgatgggctttttagtggactaatatctactttattctttcttttttcaaacattaaaaaattaattgggctttttcaaacacgaaaacaagggagtgcaatagtgtgatgaagatgagactcacacattgaatttctgatattttagcgtcaggtgcgttgaaaacttgaaatcaatgtgaagattctcttttaaaaatagatgactcttatttcatgagttaacatgatacttaaagaaagtggatagttaagtctaaaccaattcttttagtatagaaataaaatttcaaccacttcctttaaatatgaaaccatgcaaaagtagataacaaacgaaaaagtgtttcattttaagattcgatgtcacgatccatcacattgcaccgttggttgataaatatctctcatctttgtttatttattttcacaatgttgtacttctatttctataacattttcgtttgaattcaaataccaaattaactctccaaacaattagttcatcaagtattttgttcacaatgatatgttaacaacaaatcattgattcattgtccatgccggattattttaaagatacagaaacagtaaacctaagatacaatgaatgctaaaactaaattattctcccaaaaggattacttagctttcatgagtaattttatatttttcttttatccactcattttttatatactttctataattgtcttattacgtaacaaatatgtgctataggcatatttagaatctactctatcatcataccatatataagacacattttactttattaattactttttgtttgttctcaaattgaaaataaacagacgtgtttgtgctaacttcatgtagtgtttagatagtgtttcattcactggccatagacttattttacaaagttatatgtgcatgtcattatatagtgtagaacttaaaacacctaaccaagaacaacaatacacacacacaaacataaggaaaaaaaaacttttccatg

SEQ ID NO: 11894 - DNA, 3000 bp, Unknown
  misc_feature (1)..( 3000): cDNA_ID_3023266_gDNA_ID_2214521_Annot_ID_184634 3000 nt of promoter + ATG
atctctttgctgtggttttgataacagaaattattaatcagggctttagaaaccggtttaacaaaatagtacatcttagccgatgaagattcatatactgtagcagcttcaattatgtttggttaaatttggaattgcaaacattttggttaagtttagtatttttgaaatttgttgactttttaaaaagtaaagtaactgacaaaaatacaacattatagttttgggcttaggcccatcaaagcattctttcattaggcagtggcggaaatatttgttatagtggttaattttaatatcactatattataatatttaacttatttatctcacattaaaaactttattattaattaatttaaatattttgagcatttctatttcttttttttaataattattgttttctgataaaaagatttgtagttctagaaatatttcaaaagtgtgaatttgttaatttatcattttctactaaatttttttaatatacttgcgagttaaaactggtttaacatattttcttactcaaatttatttatctaaatgtataaattagtattcatattaccgcatttgtgtataggcgttaatgtagagagttccaccattgatgtgccttcccgtttgaatttaagcgttataaacacattttgtacaatatgtgaagatccttataatcagtttgtgatttattttctttctttgaacgagttctatattgcaaatgagtatgatgaaattaatttgtccaatgaaatttaagacataccaatgttgatgcattttttcaattattttattttcattggacctttttggaatcatatttgttagttgataattctgttaaccaaaagagagtaagcaaagagttgacagaagattcagctagaatgcgcaaagacaaaaagaagcgtcttgagcagaaaaaataaaaaaaggatctggagctgcagatcaaagaccttcaaaataaggttatggattcggcaaagaaggttaatgagctggagctacaaagaaatcaaattgagaaggagaaaaaaaaattgactagatacatgaaaaagttaatgaacataaagttaattatatagtaaacagtgtaacataaattttcagtttattaatagaaaattgagaaaatttatcaagatagactagtgtggggatctatgtcaaaaccataaatgtgaccaagctcttagtaaaatatgttaccatttagataaatatgatttgtttctttgtttgtaatcaacatatattaagataaaacttaaaactacacagatttagtgaaaactttttatatatcattgaaataatgattatctaccttacatagatttctagtgcataatcgcaaatgattcacgtgtataaatattagcctcatgagtcgtgatgtactatcgccctaatataattgctgtgtcctttgaaacctatttaacaatgtcgcaaagcaagtaattgcttaatttctctctttcagtctctcacacacatttaacatttttattaattcgtttacaagttgttgttttttttttaatatataaattattattattattattatttttcattcataaaattccaataatccgaaaaacgttacaagaccaaacggtccagcacagcacgcaggccgaaagagacataaaaacaaaggcccaaacaacacagagagggcccaacaacaaaagagccaaatactgaaaacctgaagcaggccaaacaagcccaagacaaacaaaggaagcccctgcaccttggctcccaacctgcaacaagcacgacaattcgtttacaagttaattacatatctaatgatctactttttctatatttatacagaagaatggatggcaaaatcgtgattataacagggggagccagtgggacaggagccgaatccgctaggttgttcactgaccacggagctcaagtggttgtagttgacttacaagaagagcaaggcaaaacgtcgccgtttcaatcggcaaagacagagcaagtttttaccgttgtgatgttacaaacgagacggaagtagaggacgcgtcattaagttcaccgtcgaaaaacatgggaagctagacgttctgttaagtaacgccggcgtcgttcttttcagccaacccggcgtcttggaaacaccgggaagcatccttgatttgaatcttgaacggtttcaccgaacaatggctgtcaacgttcgtggagcggctgtgtctatcaaacacgccgcacgagccatggtggagaaaggcacacgtggctccatcgtttgtacgaccagtgttacgtcggagatcgtggtcagggacctcatgaatacacggcgtcgaagcatgggctcgtcggactgattaaataggtttgtggtgatttagggaaacatgggattagaataaacggcgtcgcaccgttcgctgtggcgacggggtcacggggatgactagtcacgacgaggagacggcgaagcagacggaggagtattgcgaagccagagggatttttaaaggtgttgtgttaaaggctcgacacgtggcagaagctgctctgtttctcgcttcggatgattcggtttatatcagtggtcagaatttagcagtggacggtggtttttgcgtcgttaagcctatttgaaactaaataaataaataaaatcggttatttacttattaaagtgtgtatatttttttcaaccaaataaaaacattattatataggaacaagtgtcactattatggtgcataattcagaggtcaaaccaattcttgagccattaaaaaagtaaaactcacatggcacgatagagttgacttttaagatacatatacccccatgtataaatatccacacatagctctctcgtagctctatccttcaaattttcataacgtctcaacaatgtctggaaaaaggcaatttcctcatctgattttgtaacctttctgctcaactttatacccatatacataaatg

SEQ ID NO: 11895 - DNA, 3000 bp, Unknown
  misc_feature (1)..( 3000): cDNA_ID_2707769_gDNA_ID_2214521_Annot_ID_184633 3000 nt of
cacacacatttaacatttttattaattcgtttacaagttgttgttttttttttaatatataaattattattattattattatttttcattcataaaattccaataatccgaaaaacgttacaagaccaaacggtccagcacagcacgcaggccgaaagagacataaaaacaaaggcccaaacaacacagagagggcccaacaacaaaagagccaaatactgaaaacctgaagcaggccaaacaagcccaagacaaacaaaggaagcccctgcaccttggctcccaacctgcaacaagcacgacaattcgtttacaagttaattacatatctaatgatctactttttctatatttatacagaagaatggatggcaaaatcgtgattataacagggggagccagtgggacaggagccgaatccgctaggttgttcactgaccacggagctcaagtggttgtagttgacttacaagaagagcaaggcaaaacgtcgccgtttcaatcggcaaagacagagcaagtttttaccgttgtgatgttacaaacgagacggaagtagaggacgcgtcattaagttcaccgtcgaaaaacatgggaagctagacgttctgttaagtaacgccggcgtcgttcttttcagccaacccggcgtcttggaaacaccgggaagcatccttgatttgaatcttgaacggtttcaccgaacaatggctgtcaacgttcgtggagcggctgtgtctatcaaacacgccgcacgagccatggtggagaaaggcacacgtggctccatcgtttgtacgaccagtgttacgtcggagatcgtggtcagggacctcatgaatacacggcgtcgaagcatgggctcgtcggactgattaaataggtttgtggtgatttagggaaacatgggattagaataaacggcgtcgcaccgttcgctgtggcgacggggtcacggggatgactagtcacgacgaggagacggcgaagcagacggaggagtattgcgaagccagagggatttttaaaggtgttgtgttaaaggctcgacacgtggcagaagctgctctgtttctcgcttcggatgattcggtttatatcagtggtcagaatttagcagtggacggtggtttttgcgtcgttaagcctatttgaaactaaataaataaataaaatcggttatttacttattaaagtgtgtatatttttttcaaccaaataaaaacattattatataggaacaagtgtcactattatggtgcataattcagaggtcaaaccaattcttgagccattaaaaaagtaaaactcacatggcacgatagagttgacttttaagatacatatacccccatgtataaatatccacacatagctctctcgtagctctatccttcaaattttcataacgtctcaacaatgtctggaaaaaggcaatttcctcatctgattttgtaacctttctgctcaactttatacccatatacataaatgtgtgtttctaatgatttgttttttttttccagattggatggcaaaatcgtaattattactggcggagcaagcgggattggggctgagtccgttcgattatttaccgaacacggcgctcgagtcgtgatcgttgatgtacaggatgagctcggtcaaaacgttgcagtttcgatcggtgaagacaaagcgagttactatcattgcgatgtcacgaacgagacggaagttgaaaacgccgttaagttcaccgtcgaaaaatatgggaagcttgacgttctgtttagtaacgccggcgtaatagagccgtttgtgagcatcctcgacttaaacctcaacgagttagaccgaacgatcgccattaacctccgcggcacagccgcattcatcaagcatgctgcacgtgccatggtggagaaaggcatccgcggctccatcgtttgcaccactagcgtcgcggctgagatcgctggcacggcaccacacgggtaaaaactaatattcacaacaaagactttttaattctttagacaaaccaaaagtgcactaactaatttcgttttcaaaaccatgtaataataaatagtggatcgctgcaacggagtattataattaaaagaataacaaagtgatcatgttgtcacgatttattgacaataattttttatcgttaaaattcaaaatagaatgaattgcttactaataatataggtacacgacgtcgaagcatgggctgttgggtttgatcaaatcggcttctggtggattaggaaaatatggtataagagtaaacggcgttgctccatttggtgtcgcaacaccgttagtttgtaatggtttcaagatggaaccaaacgtggtggagcagaacacgtcagcttcggcgaatctaaagggcattgtattgaaagctcgtcacgtggcagaagctgctctgtttttagcgtccgatgagtcggcttacgttagcggacagaacctggctgttgacggtggttactcggtggtgaagccgtagctataacaacttggccacaaagatcccatgatggaatattggaattttgtttttttggtcaaaagttgacttgacttaattgttgtagaggcatggggattgagaagtttctgaggttgcaaatttccttgaaatgtggatgttgtatttttatatggtaacattcattatccaacatattgcacatctcgaggataatttatttaaacaaatactacaagcttatttgataaatcgtctttctagtctctctattttgactatgggttttgaattttgatatttcagtgaagaatcctaaccatttagtactaatttacacgttatagtttcaaaataattgattaaaaaacaaaataggaaaaaaaaaattgattaatataaagtctacgataaatacagagaacggagcatatctagtcgctctttcaggtctacttgacttataattaatctgtctctctgtctacttttgaaatccttcaaaaatg

SEQ ID NO: 11896 - DNA, 3000 bp, Unknown
  misc_feature (1)..( 3000): cDNA_ID_3023273_gDNA_ID_2214521_Annot_ID_184631 3000 nt of promoter + ATG
tagagtcaacggcgttgcaccatacgcggtggcgacggcgataaatagccgtgacgaggaaacggtgaggatggtggaggaatatagcgcagccacggggattctcaaaggtgtggtgcttaaggctcgccatgtggcagaggcggctttgtttctggcttcggatgattcggcttacgttagcggtcagaatctggctgttgacgggggttatagcgtcgttaagcccatttgaaggagagaatattctataaatcaacacttattaacgccttaatattttactttcaacgagcttttcacgccattatctttttttttttttttttgggtcaaatcacaccatggaataatcgcctataacgttacgtaagcaattacgtatgtactatagttaattcggataaataagggtaacgttattaatacttactattaaagtttctttacttgtaatttactgcaaaaaacaattgttggcttaatggttattaattacaaagtatcagtccacaatcacatcaaagaatttgtcgggacaagaaacagaagagttgacgaagagaagtcaagaagaagaagagtcgtcgaaaaagaaaagtcaaaaagacacacaaatatcttgggcttggcttcatcaccaaataaagaaaaagccgacaaaagtccagaggcccattaacagctcaagcccaagatcagattcaaaaacacaaacaaagatttcagaaactcaatcaaaaacttcctcctgtacaaattacaatgcaaccgttatcaagttcttttttttctttgatccttaaataatgatgataagattgaaagtctcagatcatggttgcataacattagtctataaaaggaaacataagatgtaatcaaaatcataaagttgtcatctttaccgttatcttatccttttcattttctcttcacaaagaagataaaactagaagtactaccatcaagttgtaccaattaggcgtggagccatggaaaatatgcgtgtaaaaacatcgcagatatggatggacatgtgttgtttcaatggtagacacaattagttttttgaaaaaatggcatttggaaattgggatgtcactgttgagtaactttatataccggaaaacttactattttttcccaaactcatctaaattatatctaatttatatgtctttatcaactcaaaactatgaattaaaagtatgatggaaatgaatccaggcataaaatatttacttcacatgagtagcaaatagaaatatagatttgggatatttttttggttgggttaaaggttgatgtcctcatgtggatatcaatttgttacttaaacacaaacactggttaaatttagactgttataggatatcaattcgtggttagcggagttaattattgtttcttttacacatgtcaacaccgtgtttaatcttagttcaaatctcaaaatgtgtgggtaagttatagctagaccacaagaagaataaaaaggacaggaaaaatcaagaaaacgtggagtaaagtggtaaaagcaataaaatgtgaaatgcaactcttgggttataaattaagtgtacacatatactcagtcgacattttatctcagtttgtatacctttcgacacatcaatgtcgggactcaggcaattgctttatctctctataaacaattgtgcatgtatcttacatacaaatgttgatcagttcaataattacttgtccatgcagtagattggaaggcaagatcgtaattataacaggcggagccagcgggattggagccgacgccgctaggctgttcacggaccacggagctaaggtggttatagttgacgtacaagaagaactaggccaaaacgtcgcagttttgatcgggaaagacaaagctagtttttaccgttgcgatgtgacaaatgagacggaagtcgaggacgcagttaagttcaccgtcgaaaaacacggaaagctagacgttctgtttagcaacgccggagtcttggaaccactggaaagcttcctcgactttgacctcgaacggtttgaccgcataatggctgttaacgttcgcggtgcagctgcgtttatcaaacacgcggcacgagccatggtggagaaaggcacgcgtggctccatcgtttgtacgacgagcgtctcggcggagatcggtggggggcatcatggttacacggcgtctaaacacgggcttgtcggcctgattagatcggcctgtggtgatttggggaagtatgggattagagtcaatggagtcgcaccgtacgcggtggcaacgccaatgactagccacgacgaggtaacgggaaagcagttggaggattattttgacgccaagggaattctcaaggggatggtgcttaaagctagccacgttgcacaagtggctctgttcttggcttctgatgattcggcttatataagtggtcagaatttggcggtggatggtggttatactgtcgttaagccaagccgtgattaaaactacaatcaaaatcgggactttttacattttgaagaataaatgtggtattaactattaagaaacatataagcaacagtatgtatgtaaactgtaatacattaattttgaataaagcaagtcaaaatatataattttaacttacaatattgaaatcgttaaaaatgcttatatcctattttgtgtgtagtttccccctataaatctttgttttcccattttattttgttaatattgaccttgatatttttggacttctctttcatttattttatcaactcttaattttaaaattattcatgattcatgttttcatgtacatgcatctataagttatctaactgtcaatttacacgagtaacaaacgatcacaacagctggtcgtctcgctttaaaaacaacccacctgccgaaaattccactccatgcataaacaaaccactttatttttttagaactaatcaaatgataaaaaaatttgtagttagtaaatcatg

SEQ ID NO: 11897 - DNA, 3000 bp, Unknown
  misc_feature (1)..( 3000): cDNA_ID_3023281_gDNA_ID_2214521_Annot_ID_184628 3000 nt of promoter + ATG
aagaaagtatccgtgaattcccatcaacacagtagccaagaagttgaacaaagttatcatgtttaagcctagaaaccatggaaacctacaagcagtgtcaaaatttcccaagttcttaaacacaaaaaaagtgagacatttatgtgaccataacacagtagtaacagaaaaccacacaaaacctgagcaaggaattcattgtcaggctgtttgttagaatccaactttttaatcgctgaaggcagatcattgtttaataccccgtagtatactcttccataagagccttcaccgatgagagaattcgatccaaaatcatcagttgcttctttgagttcactaaaagggataataggtacttcaataggctgcaacttcacaactggaggacccttctgtgcagtttcagaggcttggtggtgccttgcatcatttccttcacaccaaaaccaaaactccaatgaggaaacaggaaacaagtaaagtcttgattttttggatagcaagatccaactttgatacctggaggaaagtgtttggcttggttatgacgacctccataatcagcagttttatgcatatcatcatcctccccacaacacccaaagcaactcattttctttaaagaatcaaaattggagttcaaaatggaaaagagaagagcataaaaacggaaaatcagtcgaaatcgagaagagaggaacgaaatagaaataatctggggaaaaaggttttacctttgggggatccaacaacacggagtgaaacggaatgtgcaaaatgttctggagaattattagagagagtgaagaagaacaaatgacaatcaatgtcttgagcttaattagagagaaattataggtacgagtgattagctctcccaagtttgactggattttcaacgccagcgtgtcgacattaacaccgttggattatttgacaatgacccaaaatccaacgaccagattgccacatcgttttatttcattttgtttttgtcttacatgatataataattacaatcataataattttcttaaatgacgctttctatatggagtattttcctttgtttgttaattagtgccatatcttttagatataaaactattaactatgacttggtaattaatacgtatagtcaaatactaggcatcctacgttacgtttctatgcatttttttatataaaagtgtaagaaccaatactagcttaaaaggaaacgagtagaatttcgtaatgaaaaaagacttcaaatgttaccttttaaattcagtttatgtttccgcgttaccttttgaaatctcgttgctttcgtacgaaaaagacaagaaaatagaaataaattagaaagggtggtttggtgagtaatgggtcgtatatgtgggagtcgttatcgtgcatgtgaacaaaatatggccatgttcgagacgaatcatggtgtcttttaatttggtgactacattattttaacactaatcaatatctttctcgaaccatatgatcatgattagccgtttctatattttctcttttaaatagattatatatgggaattattagccggaactttgccgctgcggttggtaataccttttaatacacttatgatttgtctctttattcggttcctaattcagtatacatattggggcttgagtttgaacggaaggtatatcaatgtcataccaccaataataatcagcatcatgcatggtttttaaaatgtggaataatatatacttttaaggacgataatgagattatataattgaaaggaattagatccattgagattctaaagctaccaagacgaggaacatggaagacgtggcgcattggattcttcgttcgagtttatcatcatatcatgtgactggtctctctttctttgtactcacactaacaaaacaaaatgttaatatcccacgttaaattaaatgattagaggccatcaaaggataaaaacaagaaaccaaatctaatatactattttataataaaaaattaaaagcgggtttatgtaagtgggccaaataaaaagagtgggccaagaaagcccagaccataatgaccacatggagaccgaaaggttgacccaattagaaaacttgttatatctttaggagtcaaagtcaaagcgcgtttacaaacaccgacactttctttgtcaactagcggttaccgcggttgttcactaggcacggaacactcgatttcttcccaagaagtcgcaaccaacacttactatgtatggtacatcacaacatagacaataaaaactcttggaatgttccgcgaaacaggtgattattgactaccatgagtggggaaatgtggggtaagttaacaagtacactgcttcacatgggaaaaagaaaaatgagatacacataattcacaaaatataatttttatcttagacaatttttttaaaataatattaaaatcagtgtagaagtggtccccaccactattttgtttttccttaaaattaattattatttttgctggactaaataaaattggtttttttttttctctctctgtcctaactctttttctttctctgttttgtatctctctctctctctcactctttgtctctcccctaacctttattgtactagcataaccattaccatacatactcttctctatcacgccacaaacgcagattcatcacatcttcttcttgttcatagcatctccatcactattgggctctcttcaaaggtgtatttctggggttacttattccttctttgtattgattagtgttgaaaaggtgtctctgttgcgttcaagagctagctttagggctatatattaagaggtttccagaggttttttttggattataggcatctgtgtttggcttacatggatcctttttttaaggttttctgggcaagactaattgattaggaccaaagtttgtgtttttatttgtttggatctacaaagatcaattaggctgttgttgaattggatcgagtg

SEQ ID NO: 11898 - DNA, 3000 bp, Unknown
  misc_feature (1)..( 3000): cDNA_ID_1808200_gDNA_ID_2214521_Annot_ID_184627 3000 nt of promoter + ATG
ttttcctccgacgtttattatggccagccaaacgtctacgacaacttctctttccttcatcaaactcctgaagaagatggaacctgcaagagagaagaagaagaataaagttggattcattttttgttgttgggaaagagagagagagagagacatacctactacattgctgacaaaagcgctgcaagatacctccgacagtggcactagtagccttggaatgcatctcacagaccttatggcgtctatgataatccttaactttactaagatcagcttcacagttttcgacctgacaaacggctccggatttggtcttcttggcaggaaaaaggccatcactttcaccattaagattcaaagtaagagcaccattagtgtctccttgaatggcaacagctctcctcttcttgtcattgccttcatcagagcaggaggaggagctattggacgagtttcctagagggaaaaactgacgtcccctagtagtttgggtggcgagaaagagatcaccatcccatttccaatcattcaaatcccactccacacttcttttacctacggacccatagaattgttgagcctccccaccttcatcaattctagcttccatcactcgatccaattcaacaacagcctaattgatctttgtagatccaaacaaataaaaacacaaactttggtcctaatcaattagtcttgcccagaaaaccttaaaaaaaggatccatgtaagccaaacacagatgcctataatccaaaaaaaacctctggaaacctcttaatatatagccctaaagctagctcttgaacgcaacagagacaccttttcaacactaatcaatacaaagaaggaataagtaaccccagaaatacacctttgaagagagcccaatagtgatggagatgctatgaacaagaagaagatgtgatgaatctgcgtttgtggcgtgatagagaagagtatgtatggtaatggttatgctagtacaataaaggttaggggagagacaaagagtgagagagagagagagatacaaaacagagaaagaaaaagagttaggacagagagagaaaaaaaaaaaccaattttatttagtccagcaaaaataataattaattttaaggaaaaacaaaatagtggtggggaccacttctacactgattttaatattattttaaaaaaattgtctaagataaaaattatattttgtgaattatgtgtatctcatttttctttttcccatgtgaagcagtgtacttgttaacttaccccacatttccccactcatggtagtcaataatcacctgtttcgcggaacattccaagagtttttattgtctatgttgtgatgtaccatacatagtaagtgttggttgcgacttcttgggaagaaatcgagtgttccgtgcctagtgaacaaccgcggtaaccgctagttgacaaagaaagtgtcggtgtttgtaaacgcgctttgactttgactcctaaagatataacaagttttctaattgggtcaacctttcggtctccatgtggtcattatggtctgggctttcttggcccactctttttatttggcccacttacataaacccgcttttaattttttattataaaatagtatattagatttggtttcttgtttttatcctttgatggcctctaatcatttaatttaacgtgggatattaacattttgttttgttagtgtgagtacaaagaaagagagaccagtcacatgatatgatgataaactcgaacgaagaatccaatgcgccacgtcttccatgttcctcgtcttggtagctttagaatctcaatggatctaattcctttcaattatataatctcattatcgtccttaaaagtatatattattccacattttaaaaaccatgcatgatgctgattattattggtggtatgacattgatataccttccgttcaaactcaagccccaatatgtatactgaattaggaaccgaataaagagacaaatcataagtgtattaaaaggtattaccaaccgcagcggcaaagttccggctaataattcccatatataatctatttaaaagagaaaatatagaaacggctaatcatgatcatatggttcgagaaagatattgattagtgttaaaataatgtagtcaccaaattaaaagacaccatgattcgtctcgaacatggccatattttgttcacatgcacgataacgactcccacatatacgacccattactcaccaaaccaccctttctaatttatttctattttcttgtctttttcgtacgaaagcaacgagatttcaaaaggtaacgcggaaacataaactgaatttaaaaggtaacatttgaagtcttttttcattacgaaattctactcgtttccttttaagctagtattggttcttacacttttatataaaaaaatgcatagaaacgtaacgtaggatgcctagtatttgactatacgtattaattaccaagtcatagttaatagttttatatctaaaagatatggcactaattaacaaacaaaggaaaatactccatatagaaagcgtcatttaagaaaattattatgattgtaattattatatcatgtaagacaaaaacaaaatgaaataaaacgatgtggcaatctggtcgttggattttgggtcattgtcaaataatccaacggtgttaatgtcgacacgctggcgttgaaaatccagtcaaacttgggagagctaatcactcgtacctataatttctctctaattaagctcaagacattgattgtcatttgttcttcttcactctctctaataattctccagaacattttgcacattccgtttcactccgtgttgttggatcccccaaaggtaaaacctttttccccagattatttctatttcgttcctctcttctcgatttcgactgattttccgtttttatgctcttctcttttccattttgaactccaattttgattctttaaagaaaatg

SEQ ID NO: 11899 - DNA, 690 bp, Unknown; identical to SEQ ID NO: 11872
  misc_feature (1)..( 690): cDNA_ID_2711335_gDNA_ID_2214521_Annot_ID_184601 3000 nt of promoter + ATG

SEQ ID NO: 11900 - DNA, 3000 bp, Unknown; identical to SEQ ID NO: 11879
  misc_feature (1)..( 3000): cDNA_ID_2711331_gDNA_ID_2214521_Annot_ID_134061 3000 nt of promoter + ATG

SEQ ID NO: 11901 - DNA, 3000 bp, Unknown; identical to SEQ ID NO: 11878
  misc_feature (1)..( 3000): cDNA_ID_2707751_gDNA_ID_2214521_Annot_ID_134063 3000 nt of promoter + ATG

SEQ ID NO: 11902 - DNA, 3000 bp, Unknown; identical to SEQ ID NO: 11893
  misc_feature (1)..( 3000): cDNA_ID_2707755_gDNA_ID_2214521_Annot_ID_134064 3000 nt of promoter + ATG

SEQ ID NO: 11903 - DNA, 3000 bp, Unknown; identical to SEQ ID NO: 11890
  misc_feature (1)..( 3000): cDNA_ID_2707803_gDNA_ID_2214521_Annot_ID_134068 3000 nt of promoter + ATG

SEQ ID NO: 11904 - DNA, 3000 bp, Unknown; identical to SEQ ID NO: 11889
  misc_feature (1)..( 3000): cDNA_ID_2707761_gDNA_ID_2214521_Annot_ID_134069 3000 nt of promoter + ATG

SEQ ID NO: 11905 - DNA, 3000 bp, Unknown
  misc_feature (1)..( 3000): cDNA_ID_2707807_gDNA_ID_2214521_Annot_ID_134070 3000 nt of promoter + ATG
gggattcaagaacaccgccggtccaatgggacaccaagccgcggctatccgagtgaacggagaccgtgccgtgatcttcaactgcagattcgacggttatcaagacacattgtacgttaacaacggtcgtcagttctacagaaactgtgtggtctcgggaacagtagacttcatcttcggcaaatccgcaaccgtgatccaaaacacactaattgttgtccgtaaaggaagcaagggacaatacaacacggtcacagccgatggaaacgaattgggcttagggatgaaaattggtatcgtcctccaaaactgccgcatcgtgcccgacaggaaactaacgccagagagacttacggtggcgacatacttgggaaggccgtggaagaaattctcgaccaccgtgataatgagcaccgagatgggagatttgattagaccagaagggtggaagatttgggatggggaaagtttccacaagtcatgtaggtacgttgagtacaacaaccgtggaccaggagcattcgctaacagaagagttaactgggctaaggttgccaggtctgcagctgaggtcaatggcttcacagctgctaactggttaggtcctattaactggattcaagaagccaatgttcctgtcacaattggattataatttataaagcgtatatgaaaattattttagtttttaagtatatgaaaattggtgtatgaaattggtttatgaaaactttttaagaaagtctataatgtttttcctctgttaatttgcttcatctaattaaggtcatattgcaatgcagacaagtactcatgttgctttattataagttccttcttactgagtctatatgtttttcctctgttttcttcatcttgttttttttataacaaatcctcggttttcttaaagaagagaaaactaaagtaatgacaataataaaagtgttttctatgtgttttaacttcttataaacttttcatcgaacgaggaaaaagaattagattatcctttggtacagataatggaacaagcttcatgcccatataccataggcctacatcagggaaatattcaatatcaaaccattacgccaagttttaaaaaacactttatcatttaaaatttcatataagttttgtttatttgaaaatttagaacctcattttttggaaattattttagtttgaagtatcagccacatattttattttctattgtttgtcaatttctaattcattgaaattattatggacatgactattttagggaagttttaaaggcttattggcaaagtagacactttttcaaaaataatttgtaaagtaggtagttttttttttaaattagagaaatagatactttttttgctttttgtgagatagagaatttgtctaatagactaaaaaacaaaatacatatcaaatactaaaataccctttatcttgagagagaataaaaattatatgaagaaccatttttattttattttgtttgtctttatctttttatttttttattttagtattcttaaatacttaaaaaaattaaatattatttttttaaaaaaattacattaacttttagactatttatctgtcatcattataatgcacaaacatttaaaacatcgttttgtacactaaccattattcgttggtgtacaagtgtgtacaccgatatttcataaatcatcaccgacttctcttatacttattaatataagtaatattgttttaatattttacaaacataatgattgtataaaccaaatattattattcaatataatggtgtacatgatggtgtatataattaagttactcttaataatgtacaaaatgattgaaactattatgacgattggtggatagaatgatatatacaacttttaaatgataacatacaagattggtagacaaagtgtacaaaacttggtgtacacttatagagaatgtataaatcattattttaattagtggtgtacatcatctcgtacaccaatgttagtacattgtctcatagatttttaaaggtgtacgattatgtacaccatatttttcatcatctatgtacatcattttgtacactgttatactcagtgtatcattttctacatcagtaattatattaatttttacgttattgttgtatattactattagtacaccaattttaacaatatcacgtacaccgtcggctgagtttaaataaaaattgctacatatttttgaaatagcaaaattagactttttaaattcacataaaaattttaaaaactaatatgattatgtggtaaaattttatgaagaaatatcatcaaataaagtaaaaatatttaagtaaaaataaaaaataggatttgacttgaattttgtctttatcttactaaataacaaaataacaaaaggttatataagtcatttagtaaaatctttattaaacaaaaagtattattagataaaaaagagaaaaatgtctatttctcatatttctaaaaaaattacatactttacaaattatttatagaaaaagtgtctattttccaacttatctcaacttttaatttcaaatttcaaatatatagacgccagaacgaaatgacgaaaataccctaattaagatttggaactgcaaatttaccaaaaccctcgttttatcttttctcgacggcgacgagagaagccgccgtcacgagctccggcaaaagttctttcatcttcaccgttcggtctgaaacttaaccagacagatcgaaagagaattcgaaaacttgtgctaaaaaaaacatgagggtgttaattcggccaaatttcttgagcaatctgattcgatattgctctagaggtacgcattcacacgatcgtagcctgcgatcggttctctcgtcaaatatgattcgtctgtacaccaccggtacgtaaatatgatctgaataaacattgcattggattatagtttagtatttgattgaattgagatgtataatgacaggaatg

SEQ ID NO: 11906 - DNA, 3000 bp, Unknown; identical to SEQ ID NO: 11887
  misc_feature (1)..( 3000): cDNA_ID_3023285_gDNA_ID_2214521_Annot_ID_134071 3000 nt of promoter + ATG

SEQ ID NO: 11907 - DNA, 3000 bp, Unknown; identical to SEQ ID NO: 11886
  misc_feature (1)..( 3000): cDNA_ID_1808366_gDNA_ID_2214521_Annot_ID_134072 3000 nt of promoter + ATG

SEQ ID NO: 11908 - DNA, 3000 bp, Unknown; identical to SEQ ID NO: 11898
  misc_feature (1)..( 3000): cDNA_ID_1808200_gDNA_ID_2214521_Annot_ID_134074 3000 nt of promoter + ATG

SEQ ID NO: 11909 - DNA, 3000 bp, Unknown
  misc_feature (1)..( 3000): cDNA_ID_2707815_gDNA_ID_2214521_Annot_ID_134076 3000 nt of promoter + ATG
aaaggttgacccaattagaaaacttgttatatctttaggagtcaaagtcaaagcgcgtttacaaacaccgacactttctttgtcaactagcggttaccgcggttgttcactaggcacggaacactcgatttcttcccaagaagtcgcaaccaacacttactatgtatggtacatcacaacatagacaataaaaactcttggaatgttccgcgaaacaggtgattattgactaccatgagtggggaaatgtggggtaagttaacaagtacactgcttcacatgggaaaaagaaaaatgagatacacataattcacaaaatataatttttatcttagacaatttttttaaaataatattaaaatcagtgtagaagtggtccccaccactattttgtttttccttaaaattaattattatttttgctggactaaataaaattggtttttttttttctctctctgtcctaactctttttctttctctgttttgtatctctctctctctctcactctttgtctctcccctaacctttattgtactagcataaccattaccatacatactcttctctatcacgccacaaacgcagattcatcacatcttcttcttgttcatagcatctccatcactattgggctctcttcaaaggtgtatttctggggttacttattccttctttgtattgattagtgttgaaaaggtgtctctgttgcgttcaagagctagctttagggctatatattaagaggtttccagaggttttttttggattataggcatctgtgtttggcttacatggatcctttttttaaggttttctgggcaagactaattgattaggaccaaagtttgtgtttttatttgtttggatctacaaagatcaattaggctgttgttgaattggatcgagtgatggaagctagaattgatgaaggtggggaggctcaacaattctatgggtccgtaggtaaaagaagtgtggagtgggatttgaatgattggaaatgggatggtgatctctttctcgccacccaaactactaggggacgtcagtttttccctctaggaaactcgtccaatagctcctcctcctgctctgatgaaggcaatgacaagaagaggagagctgttgccattcaaggagacactaatggtgctcttactttgaatcttaatggtgaaagtgatggcctttttcctgccaagaagaccaaatccggagccgtttgtcaggtcgaaaactgtgaagctgatcttagtaaagttaaggattatcatagacgccataaggtctgtgagatgcattccaaggctactagtgccactgtcggaggtatcttgcagcgcttttgtcagcaatgtagtaggtatgtctctctctctctctctttcccaacaacaaaaaatgaatccaactttattcttcttcttctctcttgcaggttccatcttcttcaggagtttgatgaaggaaagagaagttgtcgtagacgtttggctggccataataaacgtcggaggaaaacaaatcccgaacctggcgctaacgggaatcctagtgatgatcactcaagcaactatctcttgattactctcttgaagatactctccaatatgcatagtatggtgttttactctgctcatctctatgttgtcttaaagtttgtatcagctgctaaatttctatccctttgcagaccataccggtgatcaagatttgatgtctcatcttctgaagagcctcgtaagccatgctggcgaacagttagggaaaaacttagttgaacttcttctacaaggaggaggatctcaaggttccttaaatattggaaactcggctttgcttgggattgagcaagctcctcaagaggagttaaagcaattttcggctcggcaagatgggacagctaccgagaacagatcagaaaaacaagtcaaaatgaatgattttgatttgaatgatatctatatagactcagatgacacagacgtcgaaagatctcctcctccaacgaatccagcgaccagttctcttgattatccttcatggatacatcagtctagtccgcctcagacaagtaggaattcagattcagcatctgaccagtcaccctcaagttctagtgaagatgctcaggtatgtatattcttacctcatccattccattattttctggatctcttagcctgctgatattttcctgtgaccttttcgtaatttgttatgattccatctcagatgcgcacaggccggattgtgttcaaactatttgggaaagagccaaatgaatttcctattgtcttacgaggacaggtattggtctgcttgattattctcaagttcttactttgtgatgttggaagttaaactgatgtgctagtttctcgatatacagattcttgactggttatcgcatagtccaactgacatggagagctacataagacctggctgtatcgtattgaccatctatcttcgtcaagctgaaactgcttgggaagaagtaagctaaacttcctctcccctctttgacaatactcgtctttataaagttccagactcctcaagggtttttattttgcttggcagctttcagacgatctgggttttagcttagggaagcttctagatctctccgatgatcccttgtggacaactggatggatttatgttagggtgcagaaccaacttgcatttgtatataacggttagttttgagaatactttcaccttgtgaatacctctctggatttctcagtatttatcgtcaatccggggttgcaggtcaggttgtcgttgacacttcattgtctctaaaaagtcgtgattatagtcacatcattagcgttaaaccgcttgctatagctgcaacggagaaggctcaatttacagttaaaggcatgaatctccgtcagcgtggcacaaggttttgttccgtttttctttttaatgaaattttggccttccttgtcttaattttcttcttctttgatgtctaa

SEQ ID NO: 11910 - DNA, 3000 bp, Unknown
  misc_feature (1)..( 3000): cDNA_ID_2711325_gDNA_ID_2214521_Annot_ID_134077 3000 nt of promoter + ATG
acatataagcaacagtatgtatgtaaactgtaatacattaattttgaataaagcaagtcaaaatatataattttaacttacaatattgaaatcgttaaaaatgcttatatcctattttgtgtgtagtttccccctataaatctttgttttcccattttattttgttaatattgaccttgatatttttggacttctctttcatttattttatcaactcttaattttaaaattattcatgattcatgttttcatgtacatgcatctataagttatctaactgtcaatttacacgagtaacaaacgatcacaacagctggtcgtctcgctttaaaaacaacccacctgccgaaaattccactccatgcataaacaaaccactttatttttttagaactaatcaaatgataaaaaaatttgtagttagtaaatcatggcattgatcgtttattggtatgacttcatctgctttgcgatagttgcggctgcaatcgtcacgtccttgtggtttctatcccgcagagacagaggctgcgtagtaattgatgatacgtcccacgatagcttgttaccactttatagatcgaacaaccgtggttcggctcggttatgggccagttgctggacaagattacatcccggctggctactctttactcgttccacctcttttctctccatggctgctttattggcttgggatgtcatcaagtgggacgcaagcatcttcgtctattacacagagtgatctttcttcttttagtgttctaagccaaaattctgaatgtaatcagatccgcattgttcatgactaatgttatttggttttgtaacagatggaccttcatgcttgtgatcatctactttgcggtacgtcgtaacagcttttcgaataagagtgttaaatccgggtattgtttatgttcattgggttctctgcagatgggtattgtagcttcagtatatggttgtttgatacatttaaaggagctaacacttgaaactgatgaagatgtggtagtagaaaaggtcggagatgagttccggcgaagattagaggtttgtggttgtttcatgcagacaatttttcaggttagtgtcaacagtcacggagtcccaattttttgcttcatacacactttcacacagtaactcttctgtctggtttgtgttaaagacaagtgcaggggctgtagtgctgacggacattgtgttttggttagttatagttcctttcctatcgactactcgctttgggttaaacacggtaagaacgaacatttcagcctatgtttaacaatgaaactactcaagactctactaatcgaatttatgatttgatgcagttgacgatctgcatgcacacggcaaatgcaggcttcctcctgcttgaaacactcctcaatagccttgtaagcaaaaatgaagttaaccaagacaatagattttaagaaaagagcctaaagaaattcgtttgttctgatttcagccattcccttggtttcgaatgggatatttcgtgctatggagttgtctctatgttatattccaatggatcatccacgcatgtggcttcacttggtaagcaataacgacttacattgatgatacttaacccacaacttagcgcaaccaacctattctaatcaactcgaacctatctcaggtggccatatccgttcctcgagctagacaagccatgggctccgatatggtaaccatcctcattaattctatctaatcaactttataatcgttttaaagatttgacggattgtgattatacactaacaaaacaacatattcacaggtacctatgcatggcaattgttcatatcccttgctatggagcttatgccgcaatagtaaaagccaagaactcctgtttcccatatctattcccaaatgctcttgtaacttagattagattgtgtgaactataaatcaatcatgcaataagatttgaaagtaattcaaataaagagcataaaaatatccataagaaaaacctagatatgaaattcaaacaagttcaacataagatccacaacatccaaaaacaacttccaaattccaaaaaaaaagcagtattcaattcaaaatgatagagatcgagatgaaaatcattcctgagctccttctttctggtaaacgtaggtgagaccacacttaccacagtagtgacgatcgaaatgactcgccatgaaagtcccagcaccacaggttgcgttagggcactccttcctcaaacgctgaaccttacctgaaccatcaaccttgtagaactgaagaacagcgagcttgaccttcttgtgcttgtgcttgatcttcttaggcttggtgtaggtcttcttcttcctcttcttagcacctccacggagacgaaggacaaggtgaagcgttgattccttctggatgttgtaatcggctaaggtacgtccgtcttcgagctgctttccggcgaaaatcaatcgctgctggtccggtgggattccttccttgtcttggatcttggccttgacattgtcgatggtgtcagaggactcgacctcgagagtgatcgtcttccccgttagggttttcacgaagatctgcatctttttttgcttttacggcggaagaaaatttctggggaaactctttaagtggtgagaagaaataaaagagtagtggttgagaaactagggttttggagctcgcttttacaattacgtaattacccctttgaaaatgggttttattaattacattgggcttcaaaggccttttaacgaatctcagaaaattaaaaaatgagttggagatgcgggggatcgaaccccgtgcctctcgcatgcaaagcgagcgctctaccatttgagctacatccccaatatgtttacttgtgtctgaattaaaataataataggattgttgttccttcgtctcttttctcttataagtggcctgttgcaatctctctctgggtttctcctgagaaaatcgttggagttagaaaccatg

SEQ ID NO: 11911 - DNA, 3000 bp, Unknown; identical to SEQ ID NO: 11895
  misc_feature (1)..( 3000): cDNA_ID_2707769_gDNA_ID_2214521_Annot_ID_134080 3000 nt of promoter + ATG

SEQ ID NO: 11912 - DNA, 3000 bp, Unknown; identical to SEQ ID NO: 11894
  misc_feature (1)..( 3000): cDNA_ID_2707773_gDNA_ID_2214521_Annot_ID_134081 3000 nt of promoter + ATG

SEQ ID NO: 11913 - DNA, 3000 bp, Unknown
  misc_feature (1)..( 3000): cDNA_ID_2707876_gDNA_ID_2214522_Annot_ID_134083 3000 nt of promoter + ATG
atttaaaaaatagtaaggttgcggttgtgcacgcaccttagaacttgaataagttctccattttccgctggtacttgagaaaagactgcaattcgcttttcaattgcctaataatagcaaacgaaaaggaatataatttacaaaattgtaaagttgatcaaaatggcacgcctttaaaagatatgagagagtgacttacctgtattattggataacttctttctacatgagttagaaacattccggagcttgtcctcacgtcacttttaactccctaagcaagaagaaagtgataagaaaatggaagagtatggttaagactttgaaagcataactagaatatgtctactatggaagagaatgaattagactttgcaggcaaacctagagcgtttctatttgtgtccaatgtttgattgaaacaactgaacaatcgaaggcagagagtggatgtaatagaaattttacttcttctacagaactaaaaggaaggtattgtccaatacctttccggtttttacatcaacaacagtggaaacttgaaggcgaggccgggcgattgcttttaggtattcacattcctgcaaatatacatatcaggagaaacaagaaaactattttaatgggaagacaaaaaacagccaaaagctcttttgctaattcttatgataatacttagaactgagcctaagattttgcttttctatcaaatcttagcttatccttgctagaataaagatgatatgaacaagttttttctctacttaaaggcctaacatcagcaagaacagactattctacaatcagctaactcaatgaactagaatttattagtggggggtgtatatacctccggactgagaaagtcatgaagcacaataattcgaggggaccaactgactacttcaggcttgacctgcactaaagaaaataaacattagctggaagcacacaaaacggacctagatttacagaagtaaaacaaaaaacgatacatgtgtgtgtaattttcatagtttcacaaagagatagtatatttaagaaatgtgtccgtactacaaacaatttaatttttctcctccatgtaccaattcttcaactgtagaggtatataaatgaaatttttaggcaaccataggccctaagaaaaaaaaacaactgcaaaatggatacgatatacttacattgccaatccgtaacaattctgcatctttgtcatttgcccaccgggagacatctgaaaataaacaagtcttgccattaatcgattcggtatcataacatgtccacaaatcaagctctataagaagagtcttgtcataaagccgagattcaaatagttagaaagagactattatgttaacaacctaaatgcaagcatagttttggatagaaatgatcacaccaacctcgtagatagcgggtgttctgtcctcgaagtcctcttagagacggaaatccagttcctgaataagaaggagaaagaatttagaaatcaaaaggacaccacaacaacaaaacaagcaatagaaaatccaaaaggggatcatctcttcattgtagtaagcataaactacaatcaaaatccctgatctagtcctacgaattcgttgacattgtagtgcaatgtcctctcaatcccttgctcaagagctcagatacctatatttgcaattctatcaccaaagacacatctacaagtataaatgaagaaaataagaaagaaagaggagttaccgtacgaatcttccaatctattaataaaggccaattgtaacaaggaacctgcagattccaggaacaaaagagaaacacaatctccatgagtttacgaaagagccgtttcaatttctcacagagtcaatttggccgagagaaaacaaaaaaaaagatataaactttgaagaccaaaattaaaaatcaaatgtagaggactataaatagagagaaagtaccgatgaccattccgacagtgacaaatgtcaagagaccgaagacgatcttcatggcaggagccatgtctagctgatctcgatctccgatcaaaataaaataaaaacttgggagagagagagagagatcagtaacagttgttgttgttgcagaaggaagaaaaagagaggagcttgagagttgagagagatttgggtggagaaaaaacgtcagaggagtttcttctcagagatcttctcttctctttaaaaaaacaaaggcctttttctttcttctttcccttcctttttgttttaattattttttgaatatccgtcatggactctttttctctttttactttctttttggaaaaatattcatcttgtcagagtaaattaaggtactaattacaaagggaaccaaacagaaaaaaaaaaacaaattgttttgtaattagctcaaaacgaaattcaaagggaaaagattttaagtacaaactgtaaatttcttgtaattttatataaccaagaaggtgtttctctcctgaattattcgtttttcttgatatttctattgttaaataaacagataaatcgagttcatataaattagttatctaaataatttagtttttcttgatagttatcaaatgaagaacatttaaaccggccggtacgatgacatttagaatttacaatcaaactcctctacttaactgttctatttgtttgtttgacatactagacaagtcaaaatacatcgtggggatctgaattctgctcaaaatacttttgaaaccattatattttacataatgcgacatatattaatttatgatttttgattagttgagcaaaaagagctgtcgtatatcatatagttttaatgaatcactcaaaaattggcacaatagaaacagtaaaagaattattgaatttagaggataaaaaagactataatatcgaccgtccgatatatcccagaaagattttaacagcaactctttgtctcttcttcttcttcttcttcttcttctctccgatttgctcagtcgattgcgtcatg

SEQ ID NO: 11914 - DNA, 3000 bp, Unknown
  misc_feature (1)..( 3000): cDNA_ID_1807585_gDNA_ID_2214522_Annot_ID_134084 3000 nt of promoter + ATG
gcggtgataagagaaataatgagaggaaatggtatctagatgcatgtagtgacgaagaaaaagagagctatgggagttaccaaaatgtcttggccaacccaagaatacgatgtgtgacgttttataaaccagaaaacagcaaacgccaaacaaacaatattcaccaaaagcgacaacactgacattgttccaagcaaagggagcttcacagatttccgagcaagatgtctgcattttctgcaggcggaacaaacatatatctgttaagagatgttgaccagaaaaagagagaagtgaaataatcaggaatatttcagaatacctcaatataacagccataatgatgttgtgcataccctgaaaacaacagccactgcgttaaattgacggaaaaagcacatatacatttaatctaaattctagacaggttcaaaaccgccggatgttaatgaaattacctgcatgccgccaatgcagaaaaatatggtgagcacccatacaaaccatgatgacatgaagtagaaaaggagcagcagaaatatggaggctgttacaataaaaaatacagcaccagtgacacttatatcaaggatttccttctctgggtcatcttttctggtcccagcactagaaacatcctggaaaaaattcagtaaattatttttttttctttaaaaagacattgttaattcagctacataaactgaagttttgatcaccaagtctacagaataacaagaggctgctacgcaaagtatctgggaaatgtaaactacgtgtataggatatcaaaggcagttaattgtagaaaccatagcatgcaaaagtgcttaaccacaattctctggtacacctttgctagtatgctgtaagattcattagcttggtcaggatctgtaagctctgaccacagtgatgcaacgacaacagttcccacagccatgagcaataacaatccagctgtgaggtccacggcaggacgctttggagcatacaacaaaagctcaactgcatcataaagaaactggacttagcctaaaagagatttatacgaataccagatggttcaaattgtagagctacaggaccaacaagagaaaaactgaagtgcgaaatcacaaaggctcaccattcttattgtcaaccatagacttgttgagagcatctccgcttgacttagagatcattaagacaggtatgctcacatttagagatgtgtccttttccatacatcccatctcatcaagatctgataacagatcatgagtaaatcatatgatccaaagctacgaaacacgaaaaacatcaatccgaaaccgtattgaaaagaaaaaaacaccttctttgtcattaatgactaagagagcagaagcaccagctgcctcagcatgtttggccttctcagtgaaagcacaattgccacggatcgacaaggcaatatgtccatctaactggaacaaacaatgtcaatacaagatatcaatgaacattgccaaaaaaaaaagtcagcttgcacttccaaattacatggtggaagccattgacttcattctaaaagcaagaagaaaagagaaactgaccctggaagagagatgggaacaagagtccaaaggatctacaaaagcagcaggaaatctaagagcttgatcaggaacagaaggcaaggcagctccaaattgagcagttaagccagtaaggaagtctccttcaacaccatcaacccaatttaagacctttacctatatgaagatcatttccaccaaatatagaatctcattaacaaagagagagagagaaggaaaactagatcaatcaactccactgaaccagagagtgattagatacgaagtaaagataagaaattgaatgcaccatttgaaacttattggtacagccaggagactcgaggctggaatcttcggtccacgatacatcgtcggccgccgctaccgaaaaaccaagcaggagaagaataagtactaaggctgaatatcggtgattcggcggatcaaacgacgacatgacgcaatcgactgagcaaatcggagagaagaagaagaagaagaagaagaagagacaaagagttgctgttaaaatctttctgggatatatcggacggtcgatattatagtcttttttatcctctaaattcaataattcttttactgtttctattgtgccaatttttgagtgattcattaaaactatatgatatacgacagctctttttgctcaactaatcaaaaatcataaattaatatatgtcgcattatgtaaaatataatggtttcaaaagtattttgagcagaattcagatccccacgatgtattttgacttgtctagtatgtcaaacaaacaaatagaacagttaagtagaggagtttgattgtaaattctaaatgtcatcgtaccggccggtttaaatgttcttcatttgataactatcaagaaaaactaaattatttagataactaatttatatgaactcgatttatctgtttatttaacaatagaaatatcaagaaaaacgaataattcaggagagaaacaccttcttggttatataaaattacaagaaatttacagtttgtacttaaaatcttttccctttgaatttcgttttgagctaattacaaaacaatttgtttttttttttctgtttggttccctttgtaattagtaccttaatttactctgacaagatgaatatttttccaaaaagaaagtaaaaagagaaaaagagtccatgacggatattcaaaaaataattaaaacaaaaaggaagggaaagaagaaagaaaaaggcctttgtttttttaaagagaagagaagatctctgagaagaaactcctctgacgttttttctccacccaaatctctctcaactctcaagctcctctctttttcttccttctgcaacaacaacaactgttactgatctctctctctctctcccaagtttttattttattttgatcggagatcgagatcagctagac

SEQ ID NO: 11915 - DNA, 3000 bp, Unknown; identical to SEQ ID NO: 11913
  misc_feature (1)..( 3000): cDNA_ID_3023382_gDNA_ID_2214522_Annot_ID_184647 3000 nt of promoter + ATG

SEQ ID NO: 11916 - DNA, 3000 bp, Unknown
  misc_feature (1)..( 3000): cDNA_ID_2707872_gDNA_ID_2214522_Annot_ID_134087 3000 nt of promoter + ATG
aacatccgtcgcttccaatttcaaacccctagtttctcgagaagcatcctcatcgttcgtcactcgctccgccgccgagccacaagaaagaaaaaccttccatggactgtgctatgtcgtcggcgacaacatcgacactgaccaaatcattcccgcggagtttctcactctcgtcccttcgaatccagaggaatacgagaaactcggttcttacgctttagttggtcttccagcttcttacaaggaacgattcgttcagccaggtgagatgaagacgaagtactcaatcatcattggcggtgaaaactttggatgtggatcgtcacgtgaacatgctccggtttgtttaggagcagcgggagctaaagcagtggtggctcagtcttatgctagaatctttttcaggaactctgttgctactggtgaggtttatcctttggattctgaagttagggtttgtgatgagtgtacaactggtgatgttgcgactgttgagttgagggaaggagatagtattttgatcaatcatacgactgggaaagagtacaagcttaagccgattggtgatgctggaccagtgattgatgctggtggtatatttgcttatgctaggaaagctggaatgattccatctgctgctgcttgattttgacttcaggtatgattctgtaacttgatgatgatgatgatgaggattggtaataggttaggattgagatcgaatttgtggaatagtctaggaagcttgacattgaattgaacgatgcaaaacatagttttcaatggttctagttagagaaagagaacacagtagttgggattctagttttgtgttgtttaaaatgtgttggtttagtttttgtgtgagattgataatgacttgttattctttctcttcgcttaagacttactttatctttccattggttcaatttctagattgtacatctcttgattgtagttgttgggagggtaaaagttatgatgttggctgatcttttccatgctcatatccattaagacttgagtgtccgatagtagaacaatacttcactcttattttgtctctaagactcctttttttttttcctttttttgttctatttgttttgcaggtgtcaatggaagtgcatgagagtcacttcaaggatcttgatccaataataagaatatgtaatgtttccaaaagcttatgaacctaatctatgttttatgaatatatatgactatcggctttagtcttcagtatcagtttcttgtttacatttggatgtatcagctgctaaaaaaatgcatagtttcccatcccatttgaaacgacgttttctctcatgtcttccactaatataatcttctggtcatgagaacagaacaggagctctgtttttctcacacaatgatcgaacacacttttgtcatatagtatagagaaatattaacacttctttttaggcatccgtatctagagtctttgtttcactgtgacctacctaagtatatcaaaacgcacgtttggaattctgaatggcactttcgtaaataggagggtacaaacatttctccttttaaattgttttcatcgtgaactctctcactcactcaacaaagtaaagaaacaatggcgtattctcttcctacatttccccaagccttaccttgctcgtcaaccaaaacttcttcctccttggctaccttccgatctcctttcttaagattcaatggttccacttccttaatcccctcctctatctccatcacttcacgtggcacatcctccccgaccatcatcccacgtgctgccgcctcagaatccgactctaacgaagccctagccaacacaaccttccacggcctctgctatgtcttgaaagacaacatagacaccgaccagatcatcccagcaggagccgcttgcaccttcccatcgaaccagcaagagcgtgatgagatcgccgctcacgctctctctggtctaccagacttccacaaaacacggttcattgagccaggagagaacagatcaaagtactcaatcataatcggcggcgaaaactttggttgcggatcgtcacgtgaacatgctccggtctgtcttggagcagctggagctaaagccatagttgctgagtcttacgcaagaatctttttccgtaactcggttgctacaggagaggtgtttccgctcgagtcagaggttagagtctgtgaggagtgtaagacaggagatacggtgacgatcgagctgagtgatagtggtggtttattgactaatcacacgaccggtaaaaactataagctgaagtcgatcggtgatgctggaccggttattgatgctggtggtatttttgcttatgcgaggatgatgggaatgattccatcattagcttaatcctcttccataaccatgatggtgttcttgtatgcataactatttgatgaatatttgtgttttagagttttctattttcttaacttttttatgtttgtttgatttggtattgttgttgttacctaaagaataagaaatcaaaagcaaaatagaccgacatgttccaagatatgtgaatatggtgagtgtttactaaattatgcgaatattgttgttgcaaccttattttcttccaagttgggcatcaatttccctttttgggcttagtcttcttttgtttgtaaatttagtttgttttagtttattgttggcccatttctgtagggtttggcccgttaagtaagtaccatgtaaacccagaaaatttacaacgaaaaccctttagcaaaaaagtaataattccgttggtaacttttctcattgtagtacatggcatattttacttactctactaaccaatttggtttggttattgaaaatttggcggtttaaacaaaccgatataaaataaccgttaagcggtaaaagaaaggacatcgctaaacctaaatttgcgactcctactttataacgccgctcttcttctccattgtttgtatactctgaaaaac

SEQ ID NO: 11917 - DNA, 3000 bp, Unknown
  misc_feature (1)..( 3000): cDNA_ID_3023374_gDNA_ID_2214522_Annot_ID_134089 3000 nt of promoter + ATG
aagggccgtcgaggttgaagtcggagctgagattctctagtgggagtagtagccatcaagaacataattctctaccgcgaatctcggaggttgaagcggctgcagcggctagaaacggtgtcgcatcaagtagtatgagttttggaaataatcgtactaacaattgggacaactcgtcttctcatatcagtttcaccattgatcaacccggaaaacggtccaagaactccgactttttcaccttagaaactcaggtattttctataactttaatttgaggttatttatgtatgtgtatcaatacttttagattatttttttatacaacaaagttaataaatctcggattcttctaggtaaagggagaaaagagtgaatatccccaatgttagttgttttgtgtattattagtttctataggcttggagaaggtttatgattgatctataataggttgacaacttgatactaagaaagtatattatcatatcgtatgaaattttatatcagtttaattaacttccataaagttagcaatagaattccatgttgaaatattgccaacagcaatgtctatgtcacaggttcatgtgtataaactgcttggagaaggtttataacttttcacaagtccttggcaattaaatgatttgtgtgtttaattatatgtatggtccacaagttgtatgctaacaagtgttattatatagtgcgcgtcatatacaatatgaattctacaagcccaatttaaattccatatccacaacagaattccaagttgaaataaatgccaataaagtgcaaatagccaaatttctgtgtgtagaagccagagttgagtggttgtgtaatagatataaatagcttagagaagggttatgattaatttatgtatatttttcacaagccctttgctaccaaatgatttttgtgtaaacattctcactgatgttggtttggttatgatattcattgagtggttatacattgattttcatctcaatatatatggttttgacttttagtatagcatgccgcaaacaactctggaaatggcgacaatggagaacttgatgaacatcccagaggactcggtgccttgtagggctagagccaagcgcggcttcgcgactcacccacgcagcattgctgaaagggttagtttattctattattatggtgattactattgcataagtctagatacaaacttaaaaggtgaattcatttgaaaccaaagaaaacaagagtaaaaattaggttttatatatgatttggtttgcgtgtttgtggtatataggagagaagaacgaggataagcgggaagctgaagaagctacaagaacttgtgcctaatatggacaaggtaagtgatattatttctgtttttaatgtaatgttggtgtggttttacatatctataataagtttgaaaaatttggcagcaaacgagctacgcagatatgttggatttggctgttgagcatatcaaaggtcttcagcaccaagtagaggtgcgtccttagatacaaaatgaatctatatatgcaaaagtgacattttctcaaattgaagcaaagggtgatcatattccttctatgttgggaaaatgttaccttaaagccaaattttagtattttagaaaatagttatattaatataatggttagttattgtccaatatgatcataaccatggatcaaccatttactcggacgtgttttttttcttccagaaaatttcatgacatatcaaaatgtcatgcacgtgaaattaaaatattacattctcatgatctcttaacaaaagggtttttgcgttggtctcatgaaaatgttttcgttatgttcatttatatcattttcacccagttgaaataaaactgatcatacatgcatcttaaattttgttaaaaactttcgtaatagaatacgttaagtcgttaacagtagactcttctaagaatctaagttaagaatcatgcataatagatggttatacattatatactatatatttatcatacacttggtctacgtcatgtttgatcggttagattctgatgtcccgtttattcacatgtctaggtctcaatgtcttattcaagctaagtatgcatatggagaaattaatatgattttttaaaattatctcttatatatgtgcagtcactggaaaagggaatggagagatgtacttgtggggcatgcaagaagcgatgatgaatgatattgttccaagtatgatgcaataaagtatagaagaaaaggagatcacttacgaaccaaattctaagacagaaagaaacatagcaaaaaggagttattttggaggtctaaagaaagtgatgatggattaatgaaggctggttttgttactctctgaaagtcttgacctttattataacttaaaattcgatcaatcgattttttttttcctgttttcctcaaagttggttaattttagcttagagcaaaacccattatttgagattgaaagagatgcgcgtttgtgtgtgtgaatataatcctacgttttgaattttgatctgtgaataaaaatctcagaaaaacatcaggaggatcatagttgttttcaacaaatgtatataaaataaaaccttaattgaaccaaattcattatttcaaggaaataaatgtactcagaccaatttattttttcttttgaaaactcatatggaaaatccacttggttaccaattattttagaagttgtaaattacacacacacacaaaaaaaatgtgtactctttgaagaagtttatttcatcaatttagaaaagattcttataaaaaaatacataattaataaattaaaatagaaataaatcataatatgaattttggttaattatgatggaattaatttcatgcgcaaaataatactcattaattgcgctcacaaacaacctaataaaatccaaacaaagctctctttctccaacaaaggcgttacagagaagaagaagaaggagaaatg

SEQ ID NO: 11918 - DNA, 3000 bp, Unknown
  misc_feature (1)..( 3000): cDNA_ID_1807341_gDNA_ID_2214522_Annot_ID_134090 3000 nt of promoter + ATG
aggcttcctttctagggctaaagttaattatctttatagacttctagtgcaatgttatagaagctttattaattatgactaagtaaaatacttcccaaatctcatttacaagcgattttaataatattagtggttgtagctttcttagtcttatgtatctataagaacaaaatattgcatatttcttactttatgtaaatactttaagatatatcttggaatttgactgaaaaaaagtaaatcaacgacatttaatttatgtgagctattaacttcacttttattgtggttttaatacagtatattctaactatttctcacatttttatcgtctattattttttaaaatagcaagatttttaagcatagaacttgagaatacataataggtttttttttgttgttaagaagtttaatattggtggttggtaaatttgaaattttgtatgattttaactgagtcataaactgttttaagaaaatcatgatcggtctgattcatgtagggttgttaaccccgttgaaagttagacaacctttagttgccatgaccagagcatttttctaatcaaaactgcactgaaatactaaaaccgaaaccaaaattaatgtaacgagtcaatttccactcatcgcatcatcactaatttttggtcttgaaaacatattaaaaatcctttattaaattttttttcaagcatataccatacaaaaatttatagtcattaaatacctatatttacacaacgcaaaaaaaatcaataactgtgtatacgtaagaaaatcgctgagcacacatccacatttggaatttcgtacttggaaccacctagctgtcatgaagtgaaagtgattcgatcaaataaccaatgatatctcttaattagttagttgttgcatatacacactctacataaacaactaaaaatcaagaaaataataaaatatagttaggttaaccaatttatttttttgctaagaaaggttaaaaccaatttatacaaggaagagacaaagtttatctaaaattttcaatccggttagtttggttattcttttatatactagagaatgtttattcttgtatacttacatgtcttttgtaagaataatatacttacatgtatacaagcaagacatgtaagtatgttattcttgacacactttcttttgcagctttcgccaaaaagagacagaaaatcgtattacatgaccaaccgaattttctaaaattgagaaagatagaaataaatagattgatcggcaactaactcgcctctctagtctctagataaaaatttgttggccggcaaaaaaagatataatttgttgtcttctctgtttcatttaaattgataataataatagcaaatttcacaggtaaaaaaacacatgggtaaaagatatttgaacatggacctgaaaaatcaaaatagatagtccatattgattcaaatgggccaactctgtactctttttttttttatatatatatataaccgttattctattgaaaaaggataagaaaatatatgttacaagcttttaaggcctgatcggctaaatagcccaatacaggcataaaagcccaaataaaagtttagtcgatggcccaagtaaaagaaatcaagtacccaatttttgattctttagatttgatgaaaacgatggaaggagaaagacgaggagttgacggagagatagatgcggtgaagattgaaatcaaatattgcagtggagttacgatatctatttgtttccgcccaaaaagaagaactccatcctacaatcaaaagaactagttaaatatttctgtatgaagtagaaattctacaacctaaaagtaagaataatatacttacatgtcttgcttgtaatgtcttgtcgcaacagacttacgtgatccgttagcaaaatttaaaacgttaaagtaatatgttcatactcctcaacataaccctagaaatgatgaaacaatagtatagatatagacatatagtaatcagcaacaaagtcacataaagatcctcatcatggaacaaatgggatctttgcccatcttaaacataaatgtggaatctaaatcaactgtttaaaaacaaatacaaggtctatatcctaatcaatggacgttcaccatggtttaatttaataaaaagtgcatgtgtatttttattataaaatcaactaaacgtataaatgtaaaatggatgttttgtcatggtctgcctttctcttggatcatatgggtggtcgaaaacatgaacaatgaaatagacttttaaaatcagaataaactataagtatccataataaagtacaaagttaaataacaatttgattcccatattaatacaaaatggaatcttaatgacccacttgacgataactaaactaatatccatgttaatttcatcacccaaaaaataatgaaggcttcgattctctgtaaatgtattcactaacatttgtacagtccatcatcattttgatatttgcttctctcttatgagaatataaaattggcattttaggctgtaaagtttatcaatgaatatgcccggaatcattatatcgataccgtcatacataataataactccatttaaaattgaatttttgatagaattaagattaacctaataaaacgaaatatcttataagaaaaatgatgctaagttataagaaaaattcgcaaataacgtcaagccaccatctgtcaaccacgtgaggtgcacgtgcgttgacgggaccgtgagtaggagactctctcttggtcaagcacccacaaggcacaaggacaagccatcgctctaatttgtcacccttagtttaattaatttaatttaacagtcctaactataattagtaaccctcttgcattatcatatagtattaattaataactactcaaagtctctttctctcaaaccctctcctcaagattttttcctaagcatcagattagcttttgtagggtttttcttttccggtttcatg

SEQ ID NO: 11919 - DNA, 3000 bp, Unknown
  misc_feature (1)..( 3000): cDNA_ID_3023363_gDNA_ID_2214522_Annot_ID_134093 3000 nt of promoter + ATG
cttccttgagattgttttagggtgaatctgaacaaagacaaattcgatcattgctgattgctttgttgccgttcctcaattccatgtatctggctcttacgattgtgtaattgaaatgagattatgatgaagaatgattcgtttgtttctttttgttctatctatacatttgtggtgatatatatatatatctttgtttgaaacgttaatagataagctgctcatactagttatacaacagactccatagaaggtgacatttgtttaagatactcttgttcctggaacacatacgaagatgaagaaagtcttcggacaaactgttagagacctgtaagtattttcgtacccgaaatttaatgatattctcaatctgtgtgtggtttatttcttttttcattgacgggatgcttcattttatgttccatttattcagtaagagagaggtcaacaagaaagtgctcaaagttcctggagtagaacagaaggtaatggatgctcttagcttcttctctctttttcttcttatcagaaattcttccgcagcagagatttagatactgttttccatttttatgcttgagtttatcaatttctttatttgtttctaaaaggcttttataaatagagagcttatcttggttgcattcatcgtcttgctaaacaatgtaaagcgagatatccaactttctcttatcttgttttgtctgtgctttctcttattcaggttctagatgctactagtaatgagccatggggtccacatggatcacttcttgctgatcttgcgcaagcttccagaaattagtaactacgaccaccttccaacttgctatattttgctgcgattttggacattgcacaggaattataaaaacatgttacttctatttcagtcatgaatatcagctgatcatggtggtcatatggaaacgccttagcgacaccggaaaaaactggcggcatgtctataaggtaaacaatattattgtcttgctggcttaatttgtgttgaatttctgtagcagtgactaaagtatttcatgctgtttacctcttctctctccccttcaggctttgacagttttggagtacatggtaggccatggatcagaacgtgttatagacgagattagagaacgtgcatatcaaatttcggtaatgactaccttgagtacattattttggaagtattcaacatcaagagaatcctttagtgctatatctcagtagttgactatcttacttgtatatatgtctattttccttgtggcagacattgtccgattttcagtatattgattccggtggtagagatcaaggaagcaatgttaggaagaaatcacagagcctggtggctttggtgaatgacaaggaaagaatagctgaagtcagacagaaggctgctgctaatagagataagtaagtttgcttgtcattgtatctttctggaactggtggatagttttctctctgtgtgagtctcggtggacactcgtttgatttcttgttgctagtggcttacaattgttattatgcttctcggtagtctattaattggtagtactggcactttaactgtattagcttctgaattttgaaagtttttatctcgagaaaaaaaaatgacatgtcttttggttcattcaaaatatgctgaacatatcaacctacattattttacaacaggtatcgcagctcagcaccaggtgggatgtataagccttcaggcggatatggggataaatatgattacggaagccgggatgaagagcgaagtagttatggaagagaaagagaatatggttacagagatgatgatagaaatagtcgtgatggagatcgtcattccagggactctgaagaccggtatgggagagatggtaatagggatgatgattacaggggaaggagcagaagtgttgataactatgggtcacgaggtaggagttcggaaagagagcgggaggatgatggccattcttcatcacggtatgttaaatttcaagtcgcctaaatcctgaaataaaaaaggaaggggaaaattttgaagattatcaactccatttggatagaatatttttattttgaatactagcgtagatgtccttgattttaaaaatcatttcgaaccgcaatcttcttagtctagttccattttcaaattttaaatggatacactcctttttgtcctgtaggggcagtggtgctcgagctgatgataattctcaggatgggaggtaatttctgataaatttctactgaagtttaggcattcttttattgtatgacaactcatctcaccttctttcgggattataatggtagaggggggctccagaggaagttttctgaacaaaatattggcgctccacccagttatgaagaagctgtcagtgattcacgcagccctgtatatagtgaaaggtgatcattttctgctttgaaaattgaaagctaccttggtttttattggtgctgatgaatctttctatgccagggatggtggggagaccccacaagttaccgctccaggagctgcttctcctcctcccccacaagttgctgctccagaggctgcttctcctccaactggaaccaacacagccaatacaactgctacttttgttaatgaatcaccttctcagaaagttgagactttcgatgaatttgatccacgcagtgcgttttcaggtacagaatactcaaactcttgcaattctttagttgtatcttgagatattttcttagtttttcaaactcctcggcagcatagagattacatgaaaatctttaatcaataactataactaattcagtaaatgtttcaaggcttagttggagggtgtatgattgtattctcatgtctgtatggtatatttctatcccattaaactctgcttgttctgagtgtggccgttgtgttcctttacttttccagctggccctccagcatatgcatctacagatggtgttacagctcctccaactgtgacttct

SEQ ID NO: 11920 - DNA, 3000 bp, Unknown
  misc_feature (1)..( 3000): cDNA_ID_2707848_gDNA_ID_2214522_Annot_ID_134096 3000 nt of promoter + ATG
agaaccctatttgcataaacagattcgagtaagtaatcatagcaaaacatactccttatcagattcagtgaagctaaaaaactgtaaagtcttcaactttatggagaacacaatcaacaacagtagacgatcaaattcacaataaccagatacaaattgtgaagaattggtttagcaaaaattaatcagtgatggatttataaatcattaccagaggtgatacagtaaggaaacccagctcgttcgatgagtttggcactaagagcatcgaagcaacatggaccctgaagaacaccaggggattgcataatattccttagcttcttcgccggagaagatggaagtttcgcgtttcccgattcatcggaaactacggtggagttaacggcgccacgaaatcgtcttgagacagagaaggggttcgcaaataattctccgacggtttgtgtgaaagaagaagaggcagaagaagggaaaaaactcgatttggattgtttatgaagaattcgaggaggagaagagctgcaaaagctaagtgccgccattgaagccttgaaggattcacttctgttcggtaaaagaaagaaacagaaattgatcaaaagaaagaagttggacaaaccgaaacaacaagaaccagaccgaaccagatttaataattaaaaaaaaaaaaaaccatgtcacgtgagcttttttagggttcacgtgatcatctctatcgtcgaaatacaagcggcggacttcaaaatcataacttttttcttcgctcctctcttagcatcgccgtgaatcgttggtctcagtttctccgtccatctttgattcgtcgatccgtaagcatctattcagtttcatgtcttttgttctaaactttttggtttgattggggttttacctttggttaattaaagctttctagattcttagtgtttggattgaattctgtaaggtttggtaaaactataccaggttagttgctatctagctgcaatgggtacagagacggttgtgcatgatcaggcaagatgggcaatggctgcaatggaacgaaggcttgctgttgcaaaagctcagcttcttcaacaacaacaacagaagaatgagaaagataagaaggggacttctgatgtagatgtctctatgaaagaatctcatcaagctgattcactgcctactccctcaaagacatcaattaaaaaaggtttgatggttgagtataaacgaagaatgattctctctagcaactctttattgaactctgattgtcatgggaatttggttttgtagtagatcccaaggatgatgattctgttgcatatacaaagttgtcccatcccgttgatgagaatctgctggcaaccaatgttaaggtatattcagattcttgaggagaacgaagctcggccttcttctgtatgatagataagattgctcaatgtgtgtgtttttttgtgattcagttttctagtgcaaagggaactatagtagacaaggttttgcataaccttcttcgaagcggtgactctgctcaaaagtacttgcaaggtactaaaagtgtgaagctggataactatatccttcttgataattttgtacagtcacggtcttcggcctctggttctaaaaaggcatcacagaaggattcaaaacgttctaaaagccgtatgtctatgaagcgactcaagaaatctggtgctttgcatatccctaaagatctccaaaagtgagttctttatattttttttttttttttttgctgtcatatagattgaactggctcagcctatgcatctgagtctattattttggtattcttaataaagtttaagtgattacttgttcacttgtgtttgagtgcaggtttgatttgtttaagccaatgcatggtatgtgggaaagttacatgatgaaactcatcaaggtgaccgggtaagctacttatctgattaccgaaatactgattcaaactatgtgctttctataaggacgaaactgatgggagtaatctagtatacacaatcattttaagcttggtcatcattcttagacaatttactttttgcaggaagattcaattatctttaactcttctctcagcagatcttcatggtgctttcatgtttggtaatccttcattctttcacaaatctgtagtactaggatatgatcttttgtctctcactcactttccaaaacttaacttctctgtacgcttaaacaaaccttaaaactagtccttttttttcatattgtaatttgttccaatcatagcaacctattttacttgtgacagttgctgagtgcaagatagcatcattcactggtgtacaaggcataatggtgcgcgagacatccgaaacatttggaataatcacacgagatgacaaatttcgaggtatcttaaagcttttttcaccaatatatttgccataaatatcttgaatcgttctcttccccagcctcaaggcttaacttagttattgtaaacaatctgatacagttgtaccgaagaagctctctgtcttcatcatccaactcgactgctggaagattactttacatggggacaagtttatttcaagagacaatattgttcaacgttaatgctaaaaatgaagctctagtcgtttttcttagctagtggtagaaagcaaccattgatgaccacagaagcatcctaatctcacaagattttgctttagatctttccttatggacccaacattttaatatatttcttaatcttgaattttgtatgaatcctctgtaaatatactactgtgttattgttaatactaatttttattattagaaaatgagtgcttatatctcagaaatccatctggggccactaataaagacaagtacagttgaagattccaaggtgagtctgacttaactaaagtaataatatttcacatcactgtcctctctctctctctgcagctctaaactgttttgaaacctaattgcagaagaagtccagacaaaaaaaagagg

SEQ ID NO: 11921 - DNA, 3000 bp, Unknown
  misc_feature (1)..( 3000): cDNA_ID_3023355_gDNA_ID_2214522_Annot_ID_134099 3000 nt of promoter + ATG
ggcgttcactgacagcttcttgttctcctagcggtttcccttgtgctcatcctcacaccttccaaaatattatcaactcggataacaaaacatatatatgtgatcaaccagacaattttttaatatatatttctatagtcaacgatgagtacgcattttaataatccggtgaaagattagtcggactaactaaataatttttttgacatataataaacacttggaccccccaaattgagccttaagaaaagactaaaccagttctattagttgcgtacaactaacgatgatcaacttgagtgatttatatcggagatcgtgggtagtgatacgggtcaacaatataaggatttagagatcaattaggaattgaagttaaaccttttcaattttcttaaagttccctgatccttattcattcatcgtatccacaaccattcttaacattgcccatggctaagacgctggacctcttttggcacgaacatcctttatatgaaaaatatcgtatgttcacttgccaagagtgccataggagtgctatacccttctttgaagttttttatggatgcttcagatgcaatataaaatggcatccctattgcgtgccaaggtcaacgaagaatattaaccacccttgtcacccgaaccatcccctagaggttctcctccaagggccacctagttactctgacgagaagtgcagcctctgtcaacggaaactctccaacttcgtttaccattgtaagttatgcaatttcagcatagatatggaatgcggaaacaggcccccgccccacaaagtggatcatccaaagtgccacgagcatgcactcaccctcatgggaagggaagtatccttcacttgcaatgcttgtggtacgcatggtgaacggaacccttatgtatgcctaccatgctctgtcatgtttcattatgattgtattgatctaccacacgtcatcaacatcaatcgtcatgatcatcgcatttcacattcatatcctctcaaacgtgggaattgggtatgtgaaatctgtcgtcaagatatcaacaccacgtacggaggctattcatgcaacaaatgtccagatttttttgttcattcaaaatgtgcaactagaaaagacgtgtgggatgggaccgaactcgaagggatacctgaggaagtagtagacgttgcgccatttgaagtgatcgaggaaggggtaatttatcatttctcccacgagaaacataacttattccttattgaggatgtttttatagatggtgctgaagacatgcattgtgaagcttgcgcccgtccagtctcttctgagaagcactacaagtgcgtggaatgcaagtttattcttcacgaagagtgtgcgaatcttcctcttacgaaacgacatggactttccacaggtatattttatcttcgcttcgggaaggattttagcgaacaaaatttcagttgtgatgcttgcaatagagatggaaggggttttagctacaaggatgaagagggtgtggtactcgatgtgttgtgtgcgtctctctctttcttcaagcaccccaaacttcatcctcacacgttatttctaaccacaatagatcgtggtacttgcttagcttgcggtgagaataaactcaatgtgctgcgttgtgttgattgtgattattctttggattacaaatgcgccactctaccattagtcataaagcataggtgtgatacacattatttagttttgcgctctggggaggaggcgcctgaaggtaaatattggtgtgaaatctgtgaagccgaaaccaatcctgaaagatggttctatacatgcgatgattgtggggtcgtgtgccatattgaatgcgtaaccggggactttttgaacataaaacctggaataataatgaagaacagggagaataagtttgaagtgggtttcaacgatcacgattctagaccaaaatgcactgattgtggctctcgttgtaggttccctaggtttttcaaggttactagaaaaaatattgagtactactattgctcaaaagcttgttttcagaatgcgaaattctgaatgcctgaaggaaggcgaaaggaaggatttggaaacataaaaagaatatgggtttttacagatggaggctgtgtaatgtttttcaattattttcagataaacttgttttctatatttggatttattgttggtttgctcattcagttcataaaactatttatgagaaagagagaaagagagagagagagactttgaaggtaattattcttcacaccttttattataattcaccaaaattgggatgtttgttctattcttgatcacacgcctctctgtcgcttccttttgacgttttctttcttttcttagctttttcttttatcttttgtgttttctgtcttttcttttccgtagttatttgggattccaaatttttttcattcctaaatttctccacgagctcatcacctcctttcgtctctgcctctcatttgtctacaaacattttttccttttgattcgtctctctggtttattgctcgttgatcgtttgtttctaaattgcattctgatttctgatggatcgtgattttcatcgtcgtggtcaagtggtaagcattacacgcaaacacagctttgatcattaaaaatgtcatcttatttaaatcatgtcttgagatcacgtaatggtcttaggtcaatcaagatcaacgcgcaacaaattctaatgtttttacaaaatttgaaaatacttatctacaaatgtatttataaagaaacctaatttgcctttgtgttgatcatgatagacaattgttgttattagcctgttgatttgaaggcagagtcctctgttttcctgcaacatgttagaacagctcatttatgtgttttggtgaaaacgcaggcgaatgatcgtacacaaagcaactttgttcgattggataaaccgagagctgtagacgatcttgatataggcaagagagggaag

SEQ ID NO: 11922 - DNA, 3000 bp, Unknown
  misc_feature (1)..( 3000): cDNA_ID_2707838_gDNA_ID_2214522_Annot_ID_134100 3000 nt of promoter + ATG
acttcagcatccgtgcctggacatcattagttatcagaaaccttcgcgagcttgaaaatatagcagagccattaagttgtggtacgagactattagctagactttgcatcttgcctcctgcatcttccacggcagcaatatcaacaaaaggagattccagaaccataaacgacgaaccaacctccccagccacccttttggcagccaataaatgaccattaaaacttgtcccgaaaatctcccttaaaaccacaatccctgcaatactttcatacttttctttgttaaccttgtctacaaaacactgtataagaactttaaaagctgatgtagggattgaatcactaatcccatttcctaatacactctcttcaacttgagcttccccaaaagctgatttgtccacttgagcaactaccgcaccaggacgaatttctcgtataagacactcagcatcactagcagatctctctgataaattctgagcagcaagtatgtaaatagttgaatcatgctcaggaactctaatagcaaacacaaagttctttgtactctctggtaacgaaagtctatgaacaagctcctttgattccttcaagtcactgttttgaaaaatcgaaaagggccatatattttgaagactattcgcaaaaaaaaatgccaccattatcgaattcgactccaaagacagagactttcaacctcagtaaaccaagccctccaaggcaaaccaaacgaatccgagaaaacacttagattgaattcaatcgagctgggcatagataaagcaattcgtctactgaatcatgcaggcaatttcgtatctacttataatcgaattttgaagatcaaaacgagcacacagatgaatcaacaaaggccgatggagagagaatttaaaaaaaccaaccgggaaattgagaatcacagcagacggaggaaggacatacactgatttcgagattagggttccgattagtatcaaattcgatggttcgaacccagtaatggattcttcaattcttctctgtgtcctttttggtcgatgaaacacagacgacgaattcgcacacaacacacagtctatattgagattccggttagtagttattcggtttggttcaagttggttatcttcattttctttatttagtcggttttgtattagaatctgaaagttattaattttggttcaactttgaataaaattagcaaagtttatatggatataataatcactgtacagtaattaatcttaataatgtaaacaatgtatcaatatattaaatttgaagttataatttggtgtcacaagtaaattttgttttggttcgaaatcagttttagtttatacagaatttcattctaaatacggttttgctttggtaataaatccggggataattcacaagtaaatgatgttgtgattgaacaaaaaattttttatgaccgaactgaaaactgattgtaacactggtgaatcttcttttaaagtaacgaaaatgaaacttcattacaactttataagaatcatttataaagtgtgaagtgtgaaaacattcgttgtgtttatgtgttcgataatgttttgtgtgcaactacaagtctacacgaaagtgcatgcatattgtgtgtgtatcttgttttaaggaatgaattatagatcatatgccgtagatgtcacatatttctaggatcatgtgaattcgtttattgttacggtattcaaattcagacaaaccctaaaatacttcaagaccaattcaaaatttagtttaaagtggagtaccaaaaaaaaagatagaataaaattcatgataagtgactccaagacttcttatatcaaaaatttcattttaaatttgcttgtttagtactccatattcttattcaagttttaacatcacaatgatgaagctctcagttcataaaacgaatgcattaacattatattatagtccttaattagataagtcctacaacaacaaaatcagttaatattcgtgtttacgttacactaaattaacaaaaaaatagtattaaacgaagttacgaaccaccattgagtcattaactaaaaacataaacaaacaaaaatcaaagtttgttttttccttttataaatgtaagtccaagcgaaagaaacattggaccaaaaagccaaaacttggatacaaatacaatcctttccatcacccgcatgacacgtcagcgtcactaaagcttcaacaccactcatactcaactcttattggtctgtcacaatcagcaatcaccacgtgtcaacgccagaaacagacagaaatccaatttttttttttgttaaaatttgatttttgtgggatgttttttgtttaattaaattatttccaaaggtaacgcaataaaacggtgttgtgaaatcaaagcaaaaaaaacacaaagggtcgtgcgagagcataagagcgcactctaatcgaccgacggattcataccctcttcttcctcatctctctctgcttagtttctgaatgtgaagcttgaggagagttctatatccttttgaattgctgtaatttggatcttacatagacgagagcagtccttctggatctacgcggtttaggcgggaggaggttttggtattgggaatgcgtttttgagctgatcttatacgtctattcaggttggtttgatcgatctggttccttatttattttcccagagttttatttctgttcataaaaatgtgatttttacaatgacgctactagttatgcttgattctgctcttaccttacattcttgttctttatttggttttgagatctgctttagctcattttctctgtgaattgtcggttttgtagctattgagatctgattgcgttttgtttgagttcctctttaaagttgatatcttttgttcagaaggtgtttccttttgcttgattgctgtttttcaggtttagctcagtctagaattggttggcttgggaaaggtcgatgaagaacgggatg

SEQ ID NO: 11923 - DNA, 3000 bp, Unknown
  misc_feature (1)..( 3000): cDNA_ID_3023351_gDNA_ID_2214522_Annot_ID_184662 3000 nt of promoter + ATG
gcaaagatatcaacttcagcatccgtgcctggacatcattagttatcagaaaccttcgcgagcttgaaaatatagcagagccattaagttgtggtacgagactattagctagactttgcatcttgcctcctgcatcttccacggcagcaatatcaacaaaaggagattccagaaccataaacgacgaaccaacctccccagccacccttttggcagccaataaatgaccattaaaacttgtcccgaaaatctcccttaaaaccacaatccctgcaatactttcatacttttctttgttaaccttgtctacaaaacactgtataagaactttaaaagctgatgtagggattgaatcactaatcccatttcctaatacactctcttcaacttgagcttccccaaaagctgatttgtccacttgagcaactaccgcaccaggacgaatttctcgtataagacactcagcatcactagcagatctctctgataaattctgagcagcaagtatgtaaatagttgaatcatgctcaggaactctaatagcaaacacaaagttctttgtactctctggtaacgaaagtctatgaacaagctcctttgattccttcaagtcactgttttgaaaaatcgaaaagggccatatattttgaagactattcgcaaaaaaaaatgccaccattatcgaattcgactccaaagacagagactttcaacctcagtaaaccaagccctccaaggcaaaccaaacgaatccgagaaaacacttagattgaattcaatcgagctgggcatagataaagcaattcgtctactgaatcatgcaggcaatttcgtatctacttataatcgaattttgaagatcaaaacgagcacacagatgaatcaacaaaggccgatggagagagaatttaaaaaaaccaaccgggaaattgagaatcacagcagacggaggaaggacatacactgatttcgagattagggttccgattagtatcaaattcgatggttcgaacccagtaatggattcttcaattcttctctgtgtcctttttggtcgatgaaacacagacgacgaattcgcacacaacacacagtctatattgagattccggttagtagttattcggtttggttcaagttggttatcttcattttctttatttagtcggttttgtattagaatctgaaagttattaattttggttcaactttgaataaaattagcaaagtttatatggatataataatcactgtacagtaattaatcttaataatgtaaacaatgtatcaatatattaaatttgaagttataatttggtgtcacaagtaaattttgttttggttcgaaatcagttttagtttatacagaatttcattctaaatacggttttgctttggtaataaatccggggataattcacaagtaaatgatgttgtgattgaacaaaaaattttttatgaccgaactgaaaactgattgtaacactggtgaatcttcttttaaagtaacgaaaatgaaacttcattacaactttataagaatcatttataaagtgtgaagtgtgaaaacattcgttgtgtttatgtgttcgataatgttttgtgtgcaactacaagtctacacgaaagtgcatgcatattgtgtgtgtatcttgttttaaggaatgaattatagatcatatgccgtagatgtcacatatttctaggatcatgtgaattcgtttattgttacggtattcaaattcagacaaaccctaaaatacttcaagaccaattcaaaatttagtttaaagtggagtaccaaaaaaaaagatagaataaaattcatgataagtgactccaagacttcttatatcaaaaatttcattttaaatttgcttgtttagtactccatattcttattcaagttttaacatcacaatgatgaagctctcagttcataaaacgaatgcattaacattatattatagtccttaattagataagtcctacaacaacaaaatcagttaatattcgtgtttacgttacactaaattaacaaaaaaatagtattaaacgaagttacgaaccaccattgagtcattaactaaaaacataaacaaacaaaaatcaaagtttgttttttccttttataaatgtaagtccaagcgaaagaaacattggaccaaaaagccaaaacttggatacaaatacaatcctttccatcacccgcatgacacgtcagcgtcactaaagcttcaacaccactcatactcaactcttattggtctgtcacaatcagcaatcaccacgtgtcaacgccagaaacagacagaaatccaatttttttttttgttaaaatttgatttttgtgggatgttttttgtttaattaaattatttccaaaggtaacgcaataaaacggtgttgtgaaatcaaagcaaaaaaaacacaaagggtcgtgcgagagcataagagcgcactctaatcgaccgacggattcataccctcttcttcctcatctctctctgcttagtttctgaatgtgaagcttgaggagagttctatatccttttgaattgctgtaatttggatcttacatagacgagagcagtccttctggatctacgcggtttaggcgggaggaggttttggtattgggaatgcgtttttgagctgatcttatacgtctattcaggttggtttgatcgatctggttccttatttattttcccagagttttatttctgttcataaaaatgtgatttttacaatgacgctactagttatgcttgattctgctcttaccttacattcttgttctttatttggttttgagatctgctttagctcattttctctgtgaattgtcggttttgtagctattgagatctgattgcgttttgtttgagttcctctttaaagttgatatcttttgttcagaaggtgtttccttttgcttgattgctgtttttcaggtttagctcagtctagaattggttggcttgggaaaggtcgatg

SEQ ID NO: 11924 - DNA, 3000 bp, Unknown
  misc_feature (1)..( 3000): cDNA_ID_3023355_gDNA_ID_2214522_Annot_ID_184661 3000 nt of promoter + ATG
cagtttctagacccatattcatctgttccttgtatagctgccattggattcagtggtacacaagtttggagaaccggtaagaccatatgtactttagattttaagtatttacacgttatagtcaagcaaacgtactcaagtttgttttctatccctttctatctttcagaaggatttatcactgctgaagaccttgcatccagtttagagaaagcgtggttaggacttcatatccaggtacgtgatagctgctttctcacttatggtggtgttcgtccttctatacattttcagttgacttttctcattttcaggaaacaactgcaagtatcttttcagcagcacttgcatcacagaactcagagacacctgtttctagtgcttcgagtgttgtcttgcctcccggaagtgttcctttagatgcagcggttgcatctccatcgacggcttctagtgttcaaccctcagagacaaagtcaacggtaacatctgcatcaacaacagaaaacaatgatggcacagttgcagttaaggttgtccctggagctgaaatcatttccacattactttagtttgttgttttgcttacatgatgcagcctttttttaaaacagggcaaagaatctgctgaacccagtaatttgtgtgatactactaaaaaccagccagcaccctctgttgatggaactaaggccaatgttgaacatgaagcgacagagacccctttgcgtgttcaggcagaaaaggagccaattcgtcctacagccccaggaacaaatgataatacatccagggttcgatcttctgttgatagaaaaaggaaacagggaactgtgataaatgaagaggatagtggtgtaggtgttagtggaagggacattaatctaacaaaatctgtcgatacaaaagagaccatgaagccaaaggatgaaggaggagaggaagaggatggagaaaaatccaaaaaagcatctgacgttcatttaaacattcgattacctgatggtagtagccttcaggagaagttttctgtgacaagtatattgagaatggtcaaggattatgtgaacagtaatcaaacaatcggactgggtgcttatgatcttgcggttccttacccacgtaaggtgtatactgaccaaggtacgtaaaatctacaatgcatccaatagatttttatttttatttggtaaagaacattttaccttaaaaccagcttcatcttgatcgaagatgatgttttctgccatttaggttttttttttttttttttctggtcagtttggactagtgtagtagatacataactccattactcttaatctctgcagatctggataagtctctatccgagttgagattgttcgatagacaagcacttgtagtagttccgcgaaaaagagcaaccgtctatcaaagaggaacatcttactcggagtctaacaacaacacagaccctaatagtggcggttactttgcttatgttagaagagtactgtcttatgcaaacccgttttcatattttggcggtggtactgccaacgcatcaagctctgttccagaacgtcaaacaagtatgcgggaatatgatgagtttataaaatccattctaatgcagaaagtcgtgtaattgctaatctgattctctctttttctatctataggaccaaatacggaggtgagaaacaatctggggcaagtagggacgtcctttcaagatccatcagaaggtaggagcaacgttaggaataggagaccaaccacttctcggattggaagtaacatccatacgttgaatcacaatgaagatgaggctccgtttggtgatggaaacgctttttggaacggaaactccacacagtacggtggtggaagcggtggagacagtaatgatagacgatgaaataagagaagttgaaatctgtgtggatagatacagaaacagctcgggtgtttactttttatacttgactctttatgaaccatttaagagaccagctgcaaaatgtatcctgatgcgtttccgttttttcggttgctcgtattaaatttaaatctaaaaaaactagcaatttctgtttgattaaattcggttctagaaattaattagtgtcgtttgattaacttcggttccaatcataacaaaaatattagagttaaatggttgcttaaatataagaatctgtatattcttttctatgcaagtgaagacttcattgaactgtgaaaaggcgttcactgacagcttcttgttctcctagcggtttcccttgtgctcatcctcacaccttccaaaatattatcaactcggataacaaaacatatatatgtgatcaaccagacaattttttaatatatatttctatagtcaacgatgagtacgcattttaataatccggtgaaagattagtcggactaactaaataatttttttgacatataataaacacttggaccccccaaattgagccttaagaaaagactaaaccagttctattagttgcgtacaactaacgatgatcaacttgagtgatttatatcggagatcgtgggtagtgatacgggtcaacaatataaggatttagagatcaattaggaattgaagttaaaccttttcaattttcttaaagttccctgatccttattcattcatcgtatccacaaccattcttaacattgcccatggctaagacgctggacctcttttggcacgaacatcctttatatgaaaaatatcgtatgttcacttgccaagagtgccataggagtgctatacccttctttgaagttttttatggatgcttcagatgcaatataaaatggcatccctattgcgtgccaaggtcaacgaagaatattaaccacccttgtcacccgaaccatcccctagaggttctcctccaagggccacctagttactctgacgagaagtgcagcctctgtcaacggaaactctccaacttcgtttaccattgtaagttatgcaatttcagcatagat

SEQ ID NO: 11925 - DNA, 3000 bp, Unknown
  misc_feature (1)..( 3000): cDNA_ID_1032702_gDNA_ID_2214522_Annot_ID_184660 3000 nt of promoter + ATG
atggacccaacattttaatatatttcttaatcttgaattttgtatgaatcctctgtaaatatactactgtgttattgttaatactaatttttattattagaaaatgagtgcttatatctcagaaatccatctggggccactaataaagacaagtacagttgaagattccaaggtgagtctgacttaactaaagtaataatatttcacatcactgtcctctctctctctctgcagctctaaactgttttgaaacctaattgcagaagaagtccagacaaaaaaaagaggatgaatccatcacaacaacacttaccaaagctatgtcctaagcgcctattcctcttcttcactccattcttattgttctctctctattacatcctcaccactatcaaaaccatcaccatctcttcccaagatcgtcaccatcctccacagcttcatgtaccttccatttcccattactactcccttccagaaacttcagaaaaccgatcgtcaccacctccactactactaccaccaccaccatcatcctcatcatcgttatcttcttactttccactctgtcccaagaacttcaccaactacttgccttgccacgatccatcaacagcacgacagtacagcattgagagacactatcggagagagaggcactgtcctgacatagcccaagagaagttcaggtgtttggtcccaaagcccactggctacaaaacgccttttccatggcctgagagtagaaaatatgcttggtttaggaacgtaccattcaagaggctagctgagttgaaaaagactcagaattgggttagacttgaaggagaccgttttgttttcccaggaggcgggacttctttccccggtggtgtgaaggactatgttgatgtgattctgagtgttttgcctttggcttctgggagtatcaggactgttctcgatattggatgtggagtgagttcagttacatgaatagacaccagaacttgattcatcttgatattttacagcagtattactactttcgattatgatggattccatgtgttttgttggacccaaaatgtcaggtagcgagttttggagcctttttgctgaactataagattttgacaatgtccattgcaccgagggatatacatgaggctcaagttcagttcgcattagaacgtggactccctgctatgctcggtgttttaagcacttataagctgccttacccgtcgaggtcttttgacatggtccattgttctagatgccttgtcaattggacttcctatggtaatgtgtgtatttaaatagacctgtttatatgatttagttcactgtgttttgaactgcttgcttcatccactctgcttctgatactgaaagagagaacattttatccagatgggctttacttgatggaggtggatcgtgttttacgtcctgagggatactgggtgttgtctggaccccctgtagcatcaagggttaaatttaagaaccagaagagagattccaaggagttgcagaaccagatggagaaactaaatgatgtttttagaagactttgttgggagaagattgctgaaagttacccggttgtcatctggagaaagccttctaatcatttgcagtgtaggaaaagactaaaagctcttaagtttcctggattatgctcttctagtgaccctgacgctgcgtggtgacttcactttcccaaaatctaatttgctctgcatcttcaaaagcttaagcttgattcggttggatctttttattaataggtataaagagatggagccgtgcatcactcctcttccagatgttaacgacacaaacaagaccgttctcaaaaactggcctgagagactaaaccatgtgcctcgaatgaaaaccgggtcgatacagggaacaactattgccggcttcaaagctgacacgaacctgtggcaaagaagagttttgtactatgacaccaagtttaagtttctcagcaatggaaaatacagaaacgtcattgatatgaacgcaggattaggtggttttgctgcagctttgatcaaatatccaatgtgggttatgaatgtggttccatttgatcttaaaccgaacacactcggtgttgtgtatgatcgcggtctcattggaacttacatgaactggtaaatcactcaaaacgtctctgatatcatctaatttgacatctcttataccatattttccggtttttgtaggtgtgaagctttatctacataccctcgaacctatgacctgattcatgccaatggtgtattcagtttgtacttggacaagtaagatccgtccctaacttgaaaactttgatttacattcatttggtgatcaaagtgtaatggtttctttttctttgtttcttatgatagatgtgacattgttgatatactcttggagatgcagaggattcttagaccagaaggagcagttataatacgagaccgttttgatgttcttgtcaaagtgaaagccataaccaatcaaatgagatggaatgggacaatgtatccagaagataatagtgttttcgatcatggaacaatactaatcgtagataactcaattaaataaaactctttttggtatcacacactactacaaaaaatttggaaacttttgagagagttgttggtttgggtttaaattggacaattacaaaaattaagaggtgcatttagatattttgaaaactttaatggacctcataaatatttaataacaaacatgtaacgacgttattgtgacggtggcgttaagtcgttaactgcgtctgatctactcgtagcttcttcgttcttcagcatttgatcggagtaggtaaagttgtggatctctttgtttcttgctaattcaaattgattaaggttcctgggtttgatcggctctagctaggggtttatggtactcgttatataattcactgaatttagggttcaagggttctgattgatctgcagtgacctttttgattgacag

SEQ ID NO: 11926 - DNA, 3000 bp, Unknown; identical to SEQ ID NO: 11920
  misc_feature (1)..( 3000): cDNA_ID_2707848_gDNA_ID_2214522_Annot_ID_184659 3000 nt of promoter + ATG

SEQ ID NO: 11927 - DNA, 3000 bp, Unknown
  misc_feature (1)..( 3000): cDNA_ID_1388384_gDNA_ID_2214522_Annot_ID_184658 3000 nt of promoter + ATG
caaggtggttacaaccctcaacaatcctatggtggtggataccggtaagatcaagccaaacatgatgcacttgacttcattcgtgtaatcaagaatacgctcgcctgtgctttttctttactctgggatatgtaatatcagtcgataaaagtactcaggttacattattcatccaggcaacacggctccacgaattttcttctctgtttgttcttgccttactcgtcactcatcattcatttttatttttttctggtttggaccaaattgagagcttgttgtgaaatttgtaccagtgtgagagtggcaaaccttgctcgggtctgccctttttttgttatatgcatataatttgatatatacacattcacttctatttctttattttgaagatgtgtaatacatttctcattcacggaacaaataaaatctttacatttttgtattctctttttaaatgtttcccggctgtatttactttttcttcactaggtgtgtgtcattctagaaagacttggattctgtcacctgcagtgtctttaaaatctaacaaaattttccctccgacctcatctgctgcatcgtccatcaattgcttcaagttcacgcctcctaaagctgcgaattttttgaggatctgtcaataactatgcctaagaaaactgaaacagaataagagagacttaggagtttttgaatacctggaacaatgtttgtgacaccttccaagaatccggcctgttccaaccataagacaagttttgcatcagctcagataaaacacgaaaaatggccctcgaaagtggacttaccggaattctgacatcgagtttctcaaacccatcgcgtccgatgattttgatcctcaaagatcgtgaccagatccgcgaaaaggggtttcttggttcattataaacctcaggtgttatgacttcaacaatcaggtcctctctctgttctggatcatctttagccacccgttgattacgatagacgctactgctgctcacttcttgaaaaggataaaacatatatttagttattgatttgacatttcccaaagatgttacaactgaaaacttccatgtctcacctctatctgatgacgaggtagcgtaccgcttctcttcttcctcgtaagtgtcaaaaccaagaatctctccaatttcttctaaagacgccatgcttcctggtggaggaattcgcccacccttgattgccaatagagcgtcctgcaagtgttccacatagttcttaagtctctttgccaccacagtgaagtcaacacattattggcagaaacagaaagattgtgacctgcattgcttgaatagatactccaatcaatgaaattggatacgccactagcttatatccaatctcttctagctccagcgggtttagaattggaatttttcctccgctttcaagcatattagcctacacagaccacaaaaatgtatcttcgtatctccagggaatatatcaagatacagaaagagtagtttccggcgcaaagtgaagttaccaatttaggaactagtggatagacattgcagaatgctttcatctcttctctagaaacaagagaatcaacggagagaacatcagctccagcatctgtaaaagctcttgccctaatgagtgattcctccagagatatcgcttcacgggaatcagtttgagctacaattacaatgtccgaatcacactctctacgtgcatcaaccgcagctttaacacgcatcactgcttcctctctagaaaccactcttctctcactcttagtattttcacaacaaacttcatcattgatgataattcctgcaaagccagctttaatatatcctttgacggttctcttaacattcatggcattaccgtatccattgccaccgtctccaatcaccggaattgatacagattgagtaatttgttgaccttgatcaaccatttctccataagaaattagacccttatccggtaaaccaagccgagacgctgaaatcgagaaccctatttgcataaacagattcgagtaagtaatcatagcaaaacatactccttatcagattcagtgaagctaaaaaactgtaaagtcttcaactttatggagaacacaatcaacaacagtagacgatcaaattcacaataaccagatacaaattgtgaagaattggtttagcaaaaattaatcagtgatggatttataaatcattaccagaggtgatacagtaaggaaacccagctcgttcgatgagtttggcactaagagcatcgaagcaacatggaccctgaagaacaccaggggattgcataatattccttagcttcttcgccggagaagatggaagtttcgcgtttcccgattcatcggaaactacggtggagttaacggcgccacgaaatcgtcttgagacagagaaggggttcgcaaataattctccgacggtttgtgtgaaagaagaagaggcagaagaagggaaaaaactcgatttggattgtttatgaagaattcgaggaggagaagagctgcaaaagctaagtgccgccattgaagccttgaaggattcacttctgttcggtaaaagaaagaaacagaaattgatcaaaagaaagaagttggacaaaccgaaacaacaagaaccagaccgaaccagatttaataattaaaaaaaaaaaaaaccatgtcacgtgagcttttttagggttcacgtgatcatctctatcgtcgaaatacaagcggcggacttcaaaatcataacttttttcttcgctcctctcttagcatcgccgtgaatcgttggtctcagtttctccgtccatctttgattcgtcgatccgtaagcatctattcagtttcatgtcttttgttctaaactttttggtttgattggggttttacctttggttaattaaagctttctagattcttagtgtttggattgaattctgtaaggtttggtaaaactataccaggttagttgctatctagctgca

SEQ ID NO: 11928 - DNA, 3000 bp, Unknown
  misc_feature (1)..( 3000): cDNA_ID_3023363_gDNA_ID_2214522_Annot_ID_184656 3000 nt of promoter + ATG
cggtgaagaatggcgactccggcatggagtcatgccaaggctcaatgggtagtcgccatgttggcgttactcgttggctcggctatggctaccgaaccttattactatagctctcctccaccaccgtatgagtataaatctccacctcctccggttaaatctcctccaccgccttatgaatataaatcaccaccacctccggttaagtctcctccaccaccgtattactatcattcaccgccgccgccagtgaaatcccctccccctccttatgtttacagctctcctcctcctccggtgaagtcccctcctcccccatactactaccattcaccgcctcctccggtgaagtctcctcctcctccatactactaccattcaccacctcctccggtgaaatccccaccaccaccatattactaccattcaccacctcctccggtgaaatccccaccaccaccatactactaccattcacctcctcctcctgtgaaatctcctcctcctccatattattaccactccccacctcctccggtgaaatccccaccaccaccatacctttacagctctccaccaccaccggtaaaatctcccccacctcctgtctacatctacgcttctcccccacctcccacacattactaggctcatcaaattcaacaaaatttccccattattcaagtaagtcctatacttatacctttacctcataatccgttttaataattgtgccctaaataaaatcggaatttcttctttcacaggttttcttttaaaaaatgaaataaaggaagggtcaaagtcaaagagaagaagaagtgaaccaaataaggatcgtggcgtggaaatcagaaacaaaacatctctaacaacgatccacatcacttcctcttcttcaatgtcgctcatcttccacttgtgcatcattatctttgcgtcttcgtcaagtcaaattgtttccaagacccttttagatcgtatcatactcctctttgttcccttttgttgttaagtgaaaaaatgggttttggtaatttaattgttgtgcatacattttctattttgttattcttccgttaatgtaatgaaagagttgttagcatataaaacaaagttcagtttcttctttctttggattatgcgatatacagtcataacattttctatcttaaaacatagttccaacgacaaaagtagttccaatgacaaagttaaaagacatattcttttaggttgggcacgacattgtttcgatctgttcgtccagagaaagttatcattgcttcaaaaggtgggaaagtggaagtaacacatcactttgatctcattggatcattaataattgtgtttatgtaatacgtcagagactcactttcattcaactaatttccacctactctttttgtttcaaccttaaaaaaaaaaaatattgagcaatactatatgcttaatacaaaaccattgactaaaattaaagaatgttgaaatgaattaatatcaaagttatagtttatattcttctatttaatcgaaacatggaaccaaacaaaagcaaatgaaaagcagcaagtgctgaagaattggttcgaaataagtggagtggttgtactttgggctttgggatagcattagctgattttgaggcccattggctaaacgtatttggtaatttgcctccaatttttttgtcaccgtcattttgtttgttgtttggcaacgacaccttccaaactttatcgttatgcttaagttgattttgataaattaatttgataatgatgaagtgaaattcaatgaagctaataaacacaattttgataaattaatttgatttcaacagtactgaaatatatagtattaggtctagtagcttccaactccactagacataaagcaattttgtcccaacaaaagttttggaataaagcatattgtatcttctcatttccaaactgtatatgagaatagaaactttataaaactggttagaccaaagtaataattatgttgttctcaattaaacagctgtgatttttcaaatccaaacattatattgatttggagcgccttaataatattctccgtgtttagttgcgctgtcttatttgtattattctttttttttttcactatttcatttttatttatttattttatctgttgaattttctcttctggctgctgttttcctctctctctctctctaaactcgagaatttttgtagagagaggaggcaaagtgcgaaagctaaacgcagatccacgatcaatctcctccaccttcaaaagccttcaaaagtgtttcttcttcgtcttcttccttttattatctgtgccttgacagatccacgatccgattctggtcaaattttacatttctgcaggtacgatcttagctctttttgttctttcatgttcattattctttttctggatctattgtttccatttttaaatttccggttgatttttttatcttgttcgatgtgattctattttgtggagggatgttattagctttaagatctgtgtgagctgcgtttttgaatgtgaatcttcctttttattcgattttgattgttaccgtttgaatttttagtctgcttaggagtcggattttgttgattttgacttcttctttatatcctttaattgttgcaaaattcggaaattttgttacgagctggggattttttccacttccttgagattgttttagggtgaatctgaacaaagacaaattcgatcattgctgattgctttgttgccgttcctcaattccatgtatctggctcttacgattgtgtaattgaaatgagattatgatgaagaatgattcgtttgtttctttttgttctatctatacatttgtggtgatatatatatatatctttgtttgaaacgttaatagataagctgctcatactagttatacaacagactccatagaaggtgacatttgtttaagatactcttgttcctggaacacatacgaag

SEQ ID NO: 11929 - DNA, 3000 bp, Unknown; identical to SEQ ID NO: 11918
  misc_feature (1)..( 3000): cDNA_ID_3023371_gDNA_ID_2214522_Annot_ID_184654 3000 nt of promoter + ATG

SEQ ID NO: 11930 - DNA, 3000 bp, Unknown; identical to SEQ ID NO: 11917
  misc_feature (1)..( 3000): cDNA_ID_3023374_gDNA_ID_2214522_Annot_ID_184653 3000 nt of promoter + ATG

SEQ ID NO: 11931 - DNA, 3000 bp, Unknown; identical to SEQ ID NO: 11916
  misc_feature (1)..( 3000): cDNA_ID_2707872_gDNA_ID_2214522_Annot_ID_184651 3000 nt of promoter + ATG

SEQ ID NO: 11932 - DNA, 3000 bp, Unknown; identical to SEQ ID NO: 11914
  misc_feature (1)..( 3000): cDNA_ID_1807585_gDNA_ID_2214522_Annot_ID_184648 3000 nt of promoter + ATG

SEQ ID NO: 11933 - DNA, 630 bp, Unknown
  misc_feature (1)..( 630): cDNA_ID_2702086_gDNA_ID_2214523_Annot_ID_134102 3000 nt of promoter + ATG
gtcatcttcacggcacagaaatatacacaaaaccaaaagcttactcaatcttttgtttctctctctttcacatgcctttgttcttactcttcctcaagactcaagtctcgtccttttctctaggccctctcactcagactcatcacactctctctcggtgcagataacgaacttacacaactccgaagctcctccctccacatctctccggttagtagatttcacaattcaatcatgcaatgctccacttagtttctacattgcttcaatgatctctttccattactccccataaatccttttccaatgatttgaatcacgggtttgaaagtttagcggcgcaactatatatttgaattaaatgaaagtttcttgtaaagttcttaacgtttttgtacgttttccatcttcttcagatttgtcgttgggttcatgtgtgtcagtatgtataattaattacttaaattagtcaactactatggaatctaggtagctccgacttatttatttatgttttggttttccagatctgttttggagaactgtgtaacatcattaagtttggcagagaaaaataagttggtgtcagtccatctctgatcttctctaacggctttggttggttctatg

SEQ ID NO: 11934 - DNA, 3000 bp, Unknown
  misc_feature (1)..( 3000): cDNA_ID_2707942_gDNA_ID_2214523_Annot_ID_134104 3000 nt of promoter + ATG
gttgttgaattatttcttacaatgtgtgatgatagctgatatcagaaaaaaaagatggaagatgttgatccaataatggttttgacccggtcacctaacttaccatggataaattatcactaaattgcatatctaacaagaaaatattacagtttgattccttattgttgagttaataacgcaccatgttcatattaatcattcaccatgcatgcatgcatgcaccacatgttgtaaacaaaatgccaaaaagactaatcacaagtctaatgggcttgggctcacaaacatttttaatcaaatcgtcgaaaatttaaattagcactggacgaaagagatggaggcgaagacagagagacactttctggtttcgaattttgggaccgccggtggtgaagtttcgagtgcgacggagaataagcgagacctgttcggcgattcggcatctggggaatgtactgagagagagaagtttctgggaggagctcaaagttagtcctcttttgctttccgtgtttcaaaatcgctaatctagaatgattatagattgctgttttcgggttttgaggtcattatgatctagattggattctattgaaattgtcttaagttatccagctaggggttttactgttagttccttcattttccctcactgctttgtctttgcaattttctctattgttgtggttctttggattttctgttttttctaggatcatgtgattgaagaggggaaaattgataaggtcctttagtttgaaaaagattgacagatgtgaaatgtgaagttattatatagaagtctagatttcttgttgcatgaagtgaggttccaagataattcgatcagattcggtcttgattcagtaaacatgtatttagaccctcttgagtataatctaagtggcttctgcacatcgctctgcatgttgttgaggaattcatctttgttggtgtataaattgcagagaatgacaaggaaaggagggagcaagaatgcaggacaaaccatcaagctccactttttctatgctggttgctcaacttgggactgttatcaccattcaaagcccattccaggtgtgcactagttacttcctagataaaagaatgtacccttttttgaaaaatttgatagattttgggaatgtgacaatttttacaggatatctaggtttaatcaatggtgggattttcctctataccaatatatactgtggcttgctatgcaatagcaaacaagaaatcgaagtaggataaggttggttatcacagtttaagttttgagtgtgtacaatgagattatgagatggatttttgcataattaagttgtttctttttgtggtgtttgccttcaggtacatgaagaaatcatctcccagctagtactcaagattttctatcttcgttatggtctaatgcagctattcaatcagatgtcattgcttctgcgtaagtctcaatttagtcgttcagttgacaatctcaaagctgctgctagtccgtgccaattaataatagcatccactatttgttttaggagatatctgaacagatagccgagtatttctctaatccatatataatcctttaaaagtcagcttgtgaacttagaagccatttactattccttcccctttagaatgtgagagttatttagtaatagtttagtcactttgtgatatttagacattttacatccaatgtgggatcttataacaagcatgtgttattttgaatcacagatgaaagaggcaggacatgagcaaatcaaaacctttttactcaatcgaccacagccatgacacggcaccgtttttggttcttgtagcagtcaacaggtgaaagagaccagagaggtatgtctgttaacaaaagcattgtgaattttttttgtattgtttatgtcttaaatccaaatatgtgaccccattttggtccatcttgggtcgcacgtgggtgtcccagttagctactctttttacatctgcactgttttggacccatgtcttggctccatgttatttattacttttatttttttgcgccaatgtcattattattcaacccaagataatttttttaataaaataaaaagttcaaagtgaaaaatgaagaaagtaaagcaaaagagatgttaagctattgattcatttttcttttacaaaaacacgtcattttcacacaatcataacgttttcttttacctttttacttaggtttgctttcattatggtctagtcttcataatcgatcatcaagtatattatactaacttttttttcttgacttttgtataaccaatgtatgagaatgtactaggtagaaaacacctttgcaattataaaaatggataatggacgtgaaaactgaaaagaataagaattgggaacactaaatacaaatcaaagacttggctgctatacgattccttcctctatttttctgtgccctttaattaaagactaactaaattcaagaagcttgaaagaagagaagacatgcactgcagaaaacgtaactaatgcattaaagaatctgtgactctctgatgtgtaaagttgagaaaagcattatttaccaacaaaacagtgtaacggtagtattcggttttttggcagttctttaaggggcatttctggtacctaactaaaacttctaacggtcctttttcctaacctttcactatcccattcatatataaatcaataaaaattccttagccatcaccatctccaccactaccaaaaagctttcttctaactcagctgcaacttcgaaaaagagaagctttttcgctttgccttgtcctcatttctctttcacacaacttttctatcttatttaaaaccactctgttcttgttttctcagtcattcctctgattcaatcagattcttttagttttcctgattctttagcagattcatgagctcataagaagaagatttgttgttgagtgttaacccagaaagaaaaaggaagactttagaatc

SEQ ID NO: 11935 - DNA, 3000 bp, Unknown
  misc_feature (1)..( 3000): cDNA_ID_2707938_gDNA_ID_2214523_Annot_ID_134106 3000 nt of promoter + ATG
ttgcctagagactataaagaaagatatattgttttgcatgggatgaattgcggggcaaatctcctttggcagagaagcattttacttgcatatctagccaatgcgatctgccataggagtattcgcccagtaatccaaccatacattatctctctgtcttcataaacatgcatcttcactactatttaatatattcttcatatttcacattgcattttgagttattggaagttggactagcaaagtatgtatatatagttgatgaaagtgtttctatatagtgaatgaatgcgtatagaaagcatattctctggcacatcccatgtttcatagagcatatgtgtctagtataatcctaaagaccccttcatgcggtcctcatgcttctgctttcagaagttaccaggctagtaaatggtatattaagttttgtgattcatgttttgataggaaattgttccatagcatatgctctttatatcaaggtttacatatacattacatagtttgagtttatcctttgaagcaataaagtgagagaggaaaactgagattatttcttggtagaaagcattacagggcgaatcctctattggcagtggaagttgatgacccttatatgttattttctcatcattttcctctgccaaaggagatttgcctcgcaatgcttcactaacgttatggggttattcatttctccaatatccaaatctagtagctaatattttcatttaatagtgttatttgaggcagctcatatacttttgtaatttgataattgtaaaagattttactagagcctcttcaaattaactcctttcttttgatttggacgttatctcttcgttagaggctttcacacacatagtcaaagaatgctaaactaatgagaatccgaaaacccaagttccacaatcaagttaaaacgatataacggtttacaaatttttatcataaaatactaagaaatgtaacatgattcattttacaaaataattatcgtaacaaaatggttttaaggatctttaggtttgatctatatcttgtgaaaaccgagaattgattgctaataactatgcatttggacattgatcctcgttggctggtgacatctctcatgattagtatagatcttgctaagtaaaaaacttaaaacggttatctataatctaaagccagtatatattatcttatgtgatttgtcaaatagctaatgatcagttacaatagcatgcaagttttgttttagttggatatacttactgaatatgctgccagtacctgacgcatctaactttgatatttggccttttcaaacctaaatcataaaatctccaaaggtgctacaagaataggatatatacaagcatttttattatttttaaataagtatttgtctatttgaatttatattctacctatggactaattaaaaaataagactttataccacaatggtaaagttgacttaattgtataactgattttatataataacaatattcgtacttaagttttcataaaagtttgaactattttttatgaacaagagaaaaatgtgcacttgccaaaactatacaataaacaatttatgtcttaggttgattggttcataatcatttgtagttgctcgcaaaggctatgtttctgctatgattgggtgctacaatgtttttcttgttaaactcattattttactactatctagcaaaattcaaagtaaataaacttaacattgcaaaaagagaaagttaagaagcaaaagtttgcgagtttttccaaaataaaactctggagaggacaataccatggatcattccatttttagagtataaacctttacaagttgtctttgtcaaactttttggcaagtcaaaagtttaattctcgaatattaatcatcttaaattataaaattatacaaacgtacgtatagagagattttattctagattggaaggatagtgccattgaatatgcttattgcaatgttatatataaacacaacacatataattattgcagtagagagatgaaaaatacatagagaaggtgaatatgcattacagggcaagatcaccattggcagagatctattacttcattcttgcatcatatgcataaatgtttgtggtgagctctctgccaaaggagatttgcccggtaattctcttgcgccaatgttttatattaatttgttggtttttggttagtaagattttaatttttgagtccaagtggacactagttcccttggatcaaactcgtcgaaatcgacgattctaagttctaactttcaagaaaatcattgaacgatatctatcaatgtgtctttgttatgtttcaaagatgttgtattaaaaaagatcgatggtcacaaactctttcctcgtggcgatcagtagatgcatgaaggtaatgaattcttctatatatgcatcaagcgggtcagtgaaacattggttatgtaactaaactttaaaacttaaaaaaaaaaaaacttagctttgtcgactttagcttagtatgtttatgttggatcagaattatgatttgtatgcggcaaagtttatggttggtccattgtttgatcaaaagaccgattccatggccgtggcagaaaccacgcatatgagaattggcttgtcttgatcatggttgtttatttattggaggatttagaatttatggttagaaactggtaaaccgaaatcaatgcttagtgaaccatgactgggttaaattaaagaaagggcaaaatgggaatataaaatataccacatcctatataagtacactgagtaagcggcaattcacaatttgataaaatttcatgcgttagaatttgcaatttagcgagaagcgaaaaagtctgctcctttcgattcttcaggggttttagggtttttctcgactcgagtaagagcgaggatatttcgcgatgttctagattttgggtatttttaatcggaaccctagtttctctgtaatcgaacc

SEQ ID NO: 11936 - DNA, 3000 bp, Unknown
  misc_feature (1)..( 3000): cDNA_ID_2707934_gDNA_ID_2214523_Annot_ID_134107 3000 nt of promoter + ATG
ctctaattgatatcatttctatcggtatgatagctttatattacacgatgcagtgactttagctttggagtaatcctaaaacttgatagtgaagctatccaggtaacttaccaatcatacaaatgcctcttatcatgtcaatgctataatgttattatttatttcaagatttgctgtaactccattttatttcagattcttaaaggggttcctgacagctcagaggtctctattgtcaaagccagcgaaataaaatacaaaatttggaagaaaatcaatgtgcaagaccgttacaaaaatgtcgtcgcggtgaaagatgttgtcagggtcattgagggtcctagcaaagtgagttcctttgcagtctggtcgtttttttgttagcaaactctttaaatatcatttgataagtcttataccgatttatatatttgtgatagggtaaacaaggtccagtggtgcaaatctacaaaggagtgttgtttatacatgaccggcataaccttgaacacactggatttatctgcactagatgctcatcttgtgttcttgctggtggcaatttcaagacaccagccctggttcctccatctccaaggagattccaacgggcagacatgggatataaccgtatgtcagatttcttcgtattattttggttctttattcttgactcgtccagtgcatgttaaagaggggcccccctacgtatgacttgtaaataggtttagtctgaaactgttatgcgtaacttagaatgcattcgtttactgcagctggagctggagggagacatcagggtggacgagggagaaggggtgacgatcatttggtaggtacttatgtcaaaattcgtctggggcctttcaagggatatagtgggcgtttagttgaagtcaaagataagctagtgcgtgtggaacttgaggccaagattgtgacaggcaagctccactgtaatttcacttctattcacagctggttgctgaatgttgaatgaattctaactctttttgtatgaacagttgagcggaaggcgatatcagatatgactgataatgtagtcgcaaccccgcagtataatatgggaagccaaactcctatgcatccttcccggactccacttcatccctgtatgactccaatgcggcattctggaggtttgtcaccttaatttcgcagtttcaagatccaatcatttgtttgtgtttttgtttctcatttgacaacatgtttgatatgtttatgtaaaaaattcagctacacctatccatgatggaatgaggacacctatgcgtggtagagcttggaatccttacatgcctatgagtcctcctaggtactttaacatggccactcttcatttattcccataaatatttcacattctgagcaagtgtctcaaaccaaaatatggttgttgtgtctcagggataactgggaagatgggaacccgggatcatggggaacaagtccatatgaagcagctacgcctggatcagattggggtagtagtactcctggtcgtagtagttacagagatgccggaacaccaataaacaatggttttgtctactaccttttatgccttaacggtttcttgctttgacgaatcttattctcacacacttttctcatgcagctaatgccccaagtcctatgacaccaagctcaacttcctacttacctaccacacccggaggacaagcaatgactcctggaaccgatctcgatgtcatgtctcttgatataggtgcctgcctatctcttagttttataccattggtgtttttgattctcatattcttaactctaccaggtggagatgcagaaaccaggttcatacccggtatattggtcaatgtacacaaagctggagaggatagaaatcccggtgttattcgagatgttcttccggtttgtcctctttaaactacacagaagaatgttgtattggagtaaacattttccagtttactgattatgtaagcctctttttcctttgtggtcatcatcaggatggctcctgtgtagtcgcacttggacacagaggtgaaggcgagacgataagagcgacacagaacaaagtgagcctagtttgtccgaagaagaacgaacgtgtgaagattcttggaggcaagtattgtggttcaacagctaaggtcattggtgaggacggtcaggacggtatagttaagctagatgaaagtctcgatatcaagatattgaagctgactatattagccaagttagttcatgagtgaccccattaggatcgtttatattttgctaattaattactctttacataacattcttgagatttatttaattctttgtgactttgcaactttattaacatatatggtttgacgtaatctttcataaacgactcttcttctttctccattttctctcgtctatctacatataaatcttccaaagaagatcacgatcacacaatatttctattgttgtacattactatataaacataggatacatagatgaagtgagctctagaaatgaaatccatggtctcttctcctaaacgaaggtctttataagaaaaacgtcaacataatttcttctcaattcgttcaatgtaaaaccttatcattgtttgtacattctactatgtgtgtttgcagcaagagaatggtgagagtagcgatcaaagtcagaccaatctacgaaccctggagtgcacactaggtgctcgacgaaatgtcccagtgagacttcacttctaaaaataaaaagtgaaattattatttccccaatgaagaagatcacgtgccatgcacctgaccgtttctttatctcttccttctggctcaagttacataaaacgtctctactctgttttcttctcgtaaacagaacagtactctcccaagaaaagctgatactttttttctcttttctttctcagtctctcatgaaagacaaagaaaccaccaccattttctcgagaaaattctgactcccttggatacg

SEQ ID NO: 11937 - DNA, 3000 bp, Unknown
  misc_feature (1)..( 3000): cDNA_ID_2707930_gDNA_ID_2214523_Annot_ID_134108 3000 nt of promoter + ATG
caaagcaaagctgggaatgtccataacgtcacctcaaggaaagtctacggatggtggctattttaccaagataaagacagaacttcagaattggatagatcttgcaacaacgaagatgcaggcgactgtggctgtttctgatataggtactatggataatcagaaagaacctggggaagaagatacttcttttgatagattgaagaagatttgggttaaattggatgacaagaccaaaataaactttttggtagtagactttgaaaagcttataggctatatacaagataagcatgggacggaagtaaaagagcactttcagaaatgtatacccatcgccaataatcttcgatggagatgttggaagtgccacatttgttctcaggttaactactgttttacggattgcaagatgcacatcttagataatcatgtgcacaactctgaacctgactttagtgctcgtcctaagtgtgtggatgagattttggctgacatgatatgctgtggggattggaagcctgtggatacagcggaggcagaaaatcttatcaaggatagagctaagcgcggggaagagtttgtttatgttaatgggtggtgtagtgattggcctgaagcgaaagatcgcgagcgggaaaacgtactcaaacagtttgccgaggttctaaaatcttcttgtgccaaggagaattgtactctttcatgtaccctttgggactggttgagagattacacagaagagaatctggaactacctggagttcctgggatctatcttgatcaatgttgcttctttaagaaccctcaatgcatctgcttcttagatcttaagcaccttgaacacatcctcaagtattttagacagctcaccacagatgttcgcgcgagtttagttccaaaagtagtgaatcagttttgggaaaattcccaggtcaaggaaagaatcgaccttgagggagtagctacttataatctgcttctggacaagagactgctgtatgaagaagagcttgaatcggataagatagggacagtagagcattataaatctacagggatttttgaggatgtaatgcctaagggtgataaaatcgtctcttggattcttgactgcccagaaatcgatcgggaatttgtgtctcaaatggcaaacggcgtacacaatagtaagctatggttagcagctttgagaatagtacggtgtgtgattaggaaaaaggaaagctactatgataagagacggaagatgctaacctatgagaagatgttgggtgaggctgagacgatttgtgacagagaagacactaggaagaatgttaatcagcggagcacatatgagtctgcacttcgaatgaaatgtgaggatcttgtaggtaagcaagatgatgatacaaaatgtttcttgagtgttgtaagagatgtttttgaaagacaaagctctccgagctttgaagtattcgaagataagaagtgtatatccgaactctcttctactgtcccgaatgatgatgtgaaaaaaagtctgttaacgctaaggaaatcactgaaagagaaggtattcttcttcctcttctttcttgttattcatatgaacaagatttgatctgtgatggctgatatgaggtgtttctttttcgcagttccctttgattgattcaaagattttgcagaacaaatctacgtacgaaaagctaatagatgtattcccgaagctatcagcagttgagtatcgcttggtggtccttccattcgtgaagaagttcttacaggtttgtcgacttgtggattttattaatcaaagatcattcacttaattccaatttaacacatttgttttctggcaggataaactgaagaaaatgatgaaaacaaacagcagttcagttgctgcaggagattctgctgaacggaaacctaagaagagacatctttgaaatctgttgttgttttgctgttgttttttgagttaaagtgagttgactatctgatgcagggatttttttttggaggatcattcttgcagatggagacaaactttttgagtattagttgtctagaaacagtcttttatgttctcggaaaatcttttggatccgagagaaacatggtgtgagaatttgtagtttgttttaggatcagatgcatatatgtttgtgtgtctggagagattgagaaaaactgggacatagatacaatggaaagctcttgttgatattcacaggctttgtcaaatttatcaggaaagtggtgaaaacacattttttacaaattgttaggaagtcaatttctctctaatccaaaagaaaaccctcttacttcactaatccaagattagttgtctcactttatcaacgaaaaaacattccaaaattgcacacacagagacattcaatgaactattttctctcatagttcaacacaaatttttacatcaaagatcaaaacttcaaacgctatttgagcaatggctccgcctctttctaggcctcacctccgcttccgtcttctcgacttcttcgtcggtgatcacatcaagaaagctttcagagacaaagaaatatgaaatgttggtaacggtgagagaggatgagaaaaaccttacttggaaaatgatcatggtatacttctactatgtgtttgtcttgcagcgagagatacatagagaagagagtagtgagaggtacgattcaaagttcggaggttaatctacgaagcctggagcgcacgctaggtgctcgacgaaatgtcacactgagagtttggtcttttgaaaaacttattacgcaatgaagatcacgtgccttgcacatgaccgtctctttatctccctcaacagctgtatatcaacgcctcgactctgttttttcctcgtaaacagaaacagaaccaatacacttccaagaaaaagctttctcttttctttctcactctcccatttccttggaccttaaagaaacccatcattttctcgagaaaactttgactacctgcgttcga

SEQ ID NO: 11938 - DNA, 3000 bp, Unknown
  misc_feature (1)..( 3000): cDNA_ID_2707926_gDNA_ID_2214523_Annot_ID_134109 3000 nt of promoter + ATG
atgtctcaaatggcaaaggtggcaaagggcttacacaatcgtgagatatggttagcagttttgagaatcgtacagggcctggttaggaaaaaggaaagctactatgataagcgacggaagatgctaagctatgagaagatgttgtgtgaggttgagaccatttgtgacagagaagacactaggaagaatgttaatcagcggagcacatatgagtttgcgcttcgaacggaatgtgagaagcttgtaggtaagcaagatgataatagaaaatatttctggactgttgtaaaagatgtttttgtaaaactatgccctccagtatttggcgtattagaagatatggagtgtatatccaaactctctgctactgtctcaaatgatgaagttaagaaaagtatgttgaggttaaggaaatcgttgaaagagatggtattcttcttcctcttctttctttttatatattcatttcaacaggatttgatctgtgacggctgatatgaggtgttttttttttgttttggagttccttttgattgattcaaagattttgcggaacgaatgcacatacaaaaagctaatagatgtattcccaaagctatcagttgttgagtatcgcttggtggtccttccgcttgtgaagaagttcttacaggtttgtcaacttcaaagaccagtcactgactcactggtgttggattaaatcttattgccagtttaacttaatttgttttctggcaggataaactgaaaaagatgatggaaacaaatagcaattcagttgctgcaggagattctgtcaacatgcagggctaagatttttggaggatcattcttccagatggagaaaaactttagagtactacttgtttagaaaacagtcttttaatgttctcggaaaaacttttggattggagagaaaaactgtatatgaaaatttgtagtttgttttaggatcagatgcatatatgtttgtattgtatgtgacaatagacacaatacaatgcattgttgatcttcataaactttggtctataacttcttgagacatggtcatagcagataaatttagtaggttggtcacacttttacttcactaacccaaagattatagtaatttcaacagattgattgtcatataaccaacattccaaaattgtacctaaactcgtcttccctttataaagggtttattggcaaagtagacactttttcaaaaataatttgcaaagtaggtagtttttttagaaattagagatatagacattttttttgctttttgtgagatagaggatatgtctaatagactaaaaaacaaaatacatatcaaatactataataccttttatcttgagagagaataaaaataatatgagagaccatgtttactttattttatttgtctttatctttttaatttttattttagttttcttaaataatttttaaaaaaaattacgttgacttttagagtatttatatgtcatcaatttaatacacaaacatttcaaagatcgttttgtacactaaacattattcattggtgtacaaatgtgtataccgatattcataaatagaagtaatattgtttttaatattttacaaatataatgattgcataaaccaaatattattacttaatataatggtgtacatgatggtgtacatgattaagttaatcttgatggtgtacaaaatgaatgaaactattatgacgattgaatagaatgtgtatataacttttaaatgatagcatacaatattggtaaacaaagtgtacaaaacttggtgtacacttacagggaatgtataaattattatttcagttagtggtgtacgtcatctcgtacaccaattttagtacactgtctcatagatctttagaggtgtacgatcatgtacaccatattttcaatcatctatgtacatcattttgtatactattatactcactctatcacttcttacaataatattatatattgatttttacattattgtcgtacactaatatttgtacaccagtattaataatatcacgtacactgtcggctgggattaaataaaaaaatgctacatatttttgaaatatagcaaaattagtctttttagattcacataaaaaatttaaaagtcaatatgattatatggtaattttttatgaagaattattatcaaacaaagtaaaaatattaagtaaaaagaaaaataagaaaaagtaaaatttgacttgaattttgtctttatcttactacataacaaaataacaaaaggttatataagtcatttctaaaatctctattagacaaaaagttgtattagagagaaaagagaaaattgtttatttcttttatttctataaaaactacctactttgcaaattatttgttgaaaaagtgtctactttccgacttatctcttctataaataaacagacaacacacagagagacattcaacttcaagggacgattttcctctcatagcaacaaaacaaatcacctcaaagataaaaacttggaacataaaccaacgaaatggctccgtctaatgatcatttgcctttttctagtcctcacctccgcttcattcttctagaattcttcacctaagaaagctttcagagacgaggaaatatgaaatgtaccattttataccgtcctactaaatgtgtctgtctcttacagcaagagatccgttccgtagagaaaagactggtgagaggtggtacagttcaaaggctgagattaatctacgaagcctggagcgcacgctaggtgctcgacgaaatgccacactgagaggtcatcacgtgccatgcacatgaccatttctttatctccctcttgctcagccaacagttgtatataaacgcatctactctgttttcttctcgtgaacagaacaattctctcccaagaaaagctaacaactttttctttctcagtcaaagccaaagaaaccaaccattttctcgagaaaattctgactcccctggggtacg

SEQ ID NO: 11939 - DNA, 3000 bp, Unknown
  misc_feature (1)..( 3000): cDNA_ID_3436094_gDNA_ID_2214523_Annot_ID_134110 3000 nt of promoter + ATG
tcatagatcttgcaacaaagaagatgcatgcggctgtgactgtttccgatacaggtactttggctaatcggatggtaacgataaagaaagatccttcttttgatctattgaagaccttttgggttaatctggatgacaagaccaaaagagaacttttggtggtagattctagaaagcttatagactatgtagagaataagtatgttgacaaagtgaaagaagattttgggaaatgtgtatccgttgccaataatcttcgatggagatactggaagtgccacatttgttctcaggtatactactgttttacagattgccagaggcacatcttagataaccatgtgcaaaaatttgtacccgatcccagtgctcgtcctaagtgtgtggataaggtattagctgacatgatatgttgtgggaaatgggagcctgtgaatacagtagcggcagcaaatctgatcaaggatagagctaagcgcggggaagagtttgtttatgttaatggatggtgtagtgattggcctgaagctaaggatgaagagcggagtaaaatactcaaacagtttgctcaggttcttaaatcttcttgtaatgaaaatgatactctttcatgtaccctttgggactcgttgatatattacacagaaaggaatctgcaactacttgaagttcctgggagctatcttgataaatgtagcttctttaagaaccctcagtgcatctgcttcttagatcttaagcaccttgaacacatcctcaactattttagacagctcaccacagatgtccgcgcgagtttagttccaaaagtagtgaataggttctgggaaaattcccgggtcaaggaaacaatcggtattgagcgacttacatctaatctgcttcttgatgggagactgctgtgtgaagaagagcatcattttgatgacacagggagtgtagagacttttaagtccagtggaatttatgagcatgtgatacctgagggggacaagatggtctcctgggttctcgactgcccagaaatggatgagaaacttgtgtctcaaatgggagagggcgtacacaattttgagatatgttagcagctctgagaatagtaaggggcatggttaggaaaaaggaaagctactatgataagagacatagaatggtaacctatgataagatgttgggtgaggctgaaaccatttgtaacagagaagacaataggaagaatgttaatcagcggagcacatatgcgtcagcgctgcgaatgaagtgtgaggagcttgtagtgatacaagatgatgataccaaatgtttcttgaatgttgtaagagatgttcttgaaagagcaccttctccaaaatatgaagtattaaccgacaaagagtatatggagagtatatctgggctatctactgctgttcaaaatgacattgttataaaaagtctgtggaagctacgaaaatttctgacaaagaaggtatgtattcttcgtcttcgtttctttctactcattataacatgttttgacctgtggctactgataaaaataagaaatcttgggtattttttgcagttccatttgattgattcaaagatattgctgaacgaatttacacaaggagagctacatgaattcccaaagctatcagcaattgagtatcgcatggtggtccttccgtttgtgaaaaagtttttacaggtttatcaacttacggaaattatcaatcacagggaactcacttggtgtttgttacttaattccaacacaacataatttgttcttctcgcagggtaaactgaagaaaatgatcatgaaaactaaagaagatgacttcagttactgaactagaagctaagaagagagctctgtaaaagaggtaaaaatctaatgaatcctatcaacagttgttgttttggtgttgttctttgggttaaatttagttgtgttttttatgcagggctacaatttttgaggatcattcttgcagatgaagaagataaacttcgagtaggagttgtttagaaaacagtcttttatgttctcgggaaaactttgtacccgagagaaaactagtctgaaaagttctagtttgttttaggatctgatgcatatacgtttgtgtgtctcaagagagattgagaaacacattgagaagtggtgagaacacatttttatcaaagtgaaaattgtaaaatgcctcttaaaattgttgccgtccaaaaaacagacgttaggtggtcgtttagatttgactaattgtttatgtcgacaccaaatccaaagcccatttgacccgccttacaaaacaaaacatcggcccaatctgtgtccccaaaaaaaaaaaacttaaagcagacgtggcagaccctgattcgttacactatcgtgtcgagcatatttttctcgcgtcgccacgatttggcaataccctgagaaataaataaaaatcgaaaatggattataaggtgaccttcgtctttggttgaccatcaaaaactacaacgctctttctccgtaggaaaggggaagcaaataaattatcgaagcccactggtttcggagctgatcggtctctatttctctcttcatacatatctcgtaagcttctcctccctcttttatcttcttccaatctcctcaattgctttctcctttaatgttttcgtttctccaatcgttatttgtgagtcttttctattcagatctgtgtgattgttgatctctgttcttagatctgtttcgcgttttctagatatcgaatttctatgtatgtaatacgatgtagatcggatgcgttattgtagatctggtttttttggatcgactgagtcaaaaatgattgactcagtttacgaaattgttcagttacttagctgcgaaaactgtgattcgtgaattttgtagctagattatgaatgtggttgcatgcgtttggatttattgagcttacttggaagtgatttgtgatttattattacagaagcagataaagttgatcggatactaga

SEQ ID NO: 11940 - DNA, 3000 bp, Unknown
  misc_feature (1)..( 3000): cDNA_ID_2711353_gDNA_ID_2214523_Annot_ID_134115 3000 nt of promoter + ATG
cgcctggtgccaaaaagagaaaggctttgaagaagaagcagcaggagcaggaagccactggagtcgctaccaacaacaaaggcttcaatggtcatggtactgtctttgttactgtttttggttttcgcttagaatttgtagttgctggatcgatatggattttggtgattctagttgctgtttacaggattttatgtctcaaatgggtttctggtgttaggtaaagtttcttcttttggtattatacaaaacgaagtgaatgatgctttggtcctactttatagggaatttttggtgggtggggatgaatctgatggggtattgagatttagccaatctctgtttaattattgttccaaagtttgtgactttactctaatcacatcatgtctgagttgtctctgtgttgcttctggatacttgcaagttgcaacaagtgctggatgttttttcctatcttttttagtaatcctctttgaatctgaagagtaagtcttttattgccctggatctataagtttactgaatatctcaggacatgatgaacatggaagccaagatgagagagacagtgatggcaatttgagttcccctggatctcaaggaaatgaagaatttgggactagagatccatcacctcctccattatctagtttagggaaagacattgttaaagagaaagcagaagatgcagactttactgggggacaagtagcgaaaggtgaagacgttattgaagttggaagaggaagaacggatcacgaggagaatggtgtaaacaaacaactcaattcctgtcctgaaaattttactcaaacttctagagaggctgatagtacttcaagtttggaaatttcacctgctcttgattctgtcaagcctatgggttcttctgtctcaaaagttgtgatgtctgacaaaagtaagcaagttgagagttcgacggactcggattctctccaacagaagtctgatgaaaaggaagagatccttagtccaagatctgctgaggaaactaacaaagaaatcaagaatgtgaaagaatatgaagtgccagaatgttctaaagaaaaggtataatttccttctttttttcttgcatcctctacttgaggttatttttcagttttctgaatcttctggacatatgtgcagagtcttttgccttctggtccaccagtttttcgaacgtcgtggttgagttgctgcggtttgtttgatgtaatggcaggatctgaaagataaatacgggttagtaattcttttataaataagttcagtaaaactttttcacttgactctgagcatcctaacattctagtaagctaagtaagagggttcatgggcttgagcaagaatttcggatagtggatgggctcctaggtatagtactgcttagctcaagagtttcaatcagtttctctatcctcattcaaacccttctcagaagtaatttcctactatatcttggtcatgtttgttcttgctttcaagtgtttgaaattggtttgaaccaatgataaattccaagtcatataataacatcacctatttggctaccgttgaaacctagcactgtaggattctagtctctgaaactttgattcctttactcgaaagctacctccatgttgtttacatgggtaatcagttaacttttacccaccgttcaaaggatcagagttttctagtattctctccactcttctcgaaggacctagttctgatctttcttgatattatgattcataaagtgtagttcatgaatatttggatatgtatcattttgtctcatcagtgtctatgtgtgatgtgaagaacaggaggaggataaaattgcaaacagtgaacagcagaagctcaaagaacagccgacaatacatgattcatggtctgtagattcttctctgtacaattctcaaccatttatatctgttagaacaataatgtgagtgttattaagcaaacatacggaaaaaaacataaacttgtcacgttttggaaatgtatattcgagatctgaacacagttatgtttttcgtttatacatcatatttgtctctctatcaatttggggggagatcgaacagtccaacgctgtgcttatgttcgacagctcttataagttgttaagctgtatcaccttatgatcaatttgctttcaaaattctgtttttttgttcagaaatttcatttcgtaaagtgaacataataatcaaaccgtgaggttttctatcagatttcgcatctgttttgttcttcagtcagactcgagtcttgagagatctgtgtcggtgattaacgcggcataggagaataaacaaaacacgaaaataaatgttttttaatatttaaaaagcgtaacttttgacgttttaaggccgtaacccacttagcttgcttcactggaatcaacccgctaagctcgttctctactagatcccatccgaaaaatcctacttgcttcccaaagttgcaatctttgaggatctttgacataaccataaatatcctctggtaaatcttttgcctcaatattttttattcttccagcaagcctctttcgatctcattgcttaattctgggtattgcttttgatgtattactagtttgtgattttgttttggtggaacaaagttatttgattggatccatttttaacatttttaacattttgaactcttcttcgagtagtaagatccgagtgtttttgtatatgcttcagaggtaactcttgtttagtttggtccatatctagatctgtaactacgtgttggttcttgctctgctcaagtttagaaaattgtgtatataagctaacgaatttaatctcttgtgttgaccaaacaaaaaaatctcttgtgcctgaaaaatttgactgatttgtttttagtttatacttaacatttctactggttgtattgcgccagtttcatgtcttctttgtgattggtattttaggtggatgtgagtaaggttgcattgattccaaggacatg

SEQ ID NO: 11941 - DNA, 3000 bp, Unknown
  misc_feature (1)..( 3000): cDNA_ID_3023398_gDNA_ID_2214523_Annot_ID_184687 3000 nt of promoter + ATG
ttgtgaatgaaaactagtatgtaatctagtaacatttgctctttcagatttttaattatcaacggagtatgtgataagttcgaatcttctacacaattaaaaatatgataacttcgttaaatagtttaagaaagctaagatgaattaacttatgggaagttggaaacaacactttttgtgtgttttactgggaaaggaatctaaacgtctgcgggtacagacacatcagggcattgctttcggcccacgcgtactattttctatatatatggtgctgtgttttaacgttagcggccggtagcagagtacaaaataaattcattttattaaacatagaaacaaaaaaaataattagtagttctaacttttagtaatatttgaaaaaggtgctttttagttattttcaactcattttgataattagattttcgttctttttaattatagaggttcaattatgaaattttacaatgtttaagactttacaatgtttaaattttagtactttttatacgaaatagtattttgagatcaaactacaagataacaccacaattattttgcaaaaccaagtgcttaagacagtttaataaagacaaaaataattagtaattaagaacacctaatgatgaaagaaccatgaaagattgattcaccataaacacaaaaattcatctaaacaaggttaacaattgtctccttatagcgcttagatttcacaatttatgatgattgatgactcaattactaaaatttctattttgttttcctaagcttatttttcaaccgatatataaggaagaaaaaaacacttgaaactacagacgctaataagtactaaagtgaatgacatctcttttatttgtttctcctttttttcgttgattaacaagaaatcaacaaaataatctttggctcggcatttagacttttaggatctgaaaaatgaaaattggcggagtctacgcaggccctacttttcagatctatcttgaaatgcgaatattatatactctggaagatttaaattatctggtggagtaatcatttcagtgagaaatagtaataaattaatactactatagtacattagtagtactatacctgaatatgcattggaatttgtggtagaagactagaagtagtaagcttcttttgtttttaatcaaacaggtagtaagcctcataaattatgtgataaaaactgataagaattttcttttgcaccaaaaaataaaattaaaaaaatgagaaaaaaaaaactgataagggttccgattttgggaatagcaatagatgagagctaaactgaaattgttataggagtttagatattgtttagttatacttatatttgtatgtcgataaaatataaactgtgaagtcatggtgttgtgctggctacggaacaaaccacgtaaacgggtttatcctgattattcgttgcttacagttttggtttaattcaacacgtacgcaaataccacatgcaaatctaattaagtaacacaaaaatctggatttagtttggcaagtaaatggccttcgccaatggataatgttttccttaagattcttaaaccttgtctttttaacttttaagcaacgtatgcttggataatatccaataggcatctcttgcaaatatgataattaagaactcgtacaatttatatcgattgtcttctaatgtacgtaatttcattagtttactccttgtttatattcgtgtttatgagtttgagtttatattttagtacattaccgtaaacaatcctttatacgtgatatactgtttttgtttgttaacagggaaatatataccattttcgaactaccctacatatatatggtagcctaatgatatcgtcgattgtataactatgtttggataactaacaaaatgcttaatccaatattataattttatagtcattttgagaagatttgttctaagacaaaatatatatagataagaaacataattgcatttaattttaatagaaattgaatgtaatttttttgaaattaaaagttagagaggtattcaccatttcacctagtgatttgaaatttagcaacaaaaaggaataaatcttatgttattcaccattttacctagtgatttgaaatgctactttaaaattcactgctattggaaactttttaaatattggatttttagtgacatcaagggtttatagaggattttttagttaaaaatacaaaatctaaatctcctagtttcaactttttaagtgaaatttgaggagattttacaacaaatcataataacttcccaaaattcacctaaaatcatctaaaacttaaaatcatttaataggattgaataaggttcattttactacttggcagttggcacataatataaaaagatggttagttaagttattgtcttaagttatatgattgtgcattgctgttgaaagatttgctgatctacgttgttgtcatcgattcgtcaagattatacgaaccagctacatcctacatgtctggtttttataatcacattgaataaaatgaataaatatattttattgaaaacgtcacgtttaaattcatatacatttgattgattatataatgtagtccaattaattaatctctcctctatacagctgtttctatagattattaattaatggacttcctcgtttcacatggtagacatttcagatttagctttgtgtttacccagatctggattcaggtatctcggtttaggaattgtaaagtttcgtgtagttttatggggttgtgttatcggttaaatttggtttagtctagttggaactcggtttgcttgtcccgtttgttttaattatccggttatatttggtctaacgaggccaattaatgcccacgattatacaaacttttcaatttaaagttgacttttactttcattttaagacaatggatactcattttgatcgatgtagatagacatagagaacaagagaaaaagagagaaag

SEQ ID NO: 11942 - DNA, 3000 bp, Unknown
  misc_feature (1)..( 3000): cDNA_ID_1028949_gDNA_ID_2214523_Annot_ID_184683 3000 nt of promoter + ATG
acaacaaataaacaaacaaacaaacaaacaaacaaagtagcatgtttcttatatgttcacgttgtcatgccagactattttttaggaatggctattgttaatagatttttaaatattgccattcatcgatttctcaggaaggaaataatatgccgggagaaaaagaaaagaagatcgaacctaagaaccttacagaagcagagttaataacgatggaagaaaagtcccggatggagcatgagcataccatgaatataatggaacacaaagtaaaactgtatttaaaacttcgtataggtttaaacatgttcttgacaatacgtgattgattttaatattctctcgttatctatctttcaggtggagcatgcgctaaaacaaaatgaggaaacatatgacaaagagatgcagcattgtgtgattgatgtatccaactctactgataaagtactaataaaagatcgaccacataaattcggtgtgatacttgcacaactttcaaattatcatctacttttattctgcatgttttattgtttttgtttcttctacttttgcatttttccaactctattgtaatgttcgtgcgtcaatgatgcctccatacatgcatgttaaaccttgtttgttaataaaatgtgtttactaaaacatacaataaatctgaacaaacgccaaattacaaatttacaagtgatcaagatgtggattttcaaactaatatttacgctttgtataaaatcttgattaaaatcagtaaaaaaaaacgagtaacggtcaagaaaataaatgttgatagagatcaacataaagaaatgtaagaaagaaaaaccacgaagcagattattttaactttcaggaagtttttaagtgatccagtggataggtggtccatatatagtccatacgttacatgttcaagcattgacttctaactttcaatagataaaggacccatacgttacatgttcaacaatgaatttataatatagtacgtacgtggtgtttagtcccaactttgctcctctcatatatacgtgttgtttagtcccaattttcctcccctttcacgcctcagtctcatcctggctctcatatagacattacaaagtttgagtttatcggactgtttcttttttctcattttattttataattgcaaaatcaattacgtggtgtttaagcctaactttgctcctttcatcatggctcacatgcatagacgttataaaatttgtcttattatactgttatttttatcatctacttttatagtttttacaaaattagttgaatttgttttttaataatgtaattaaaaagaataatatttttactattaagaaaaatatcaagtggtccattaatgaaaattaaaccttactttttatatatgatttaacttatccattcatttttcttttgttattcactcatttatatatatatgattatttcgtggattaactaaagttgcctatatcttttgctcttcactgacaaagggataagaagcttgtaagttttacttggtatatatagtctgcctattcttcctctcttcattctccttttcaaaagatattatttcatgatgttttattatcagaatatggctgatcaggaactgccaccctccgttacaagcatagttctagtagggcgtaataatggcaatggaaaaagcttcactggaaacaccctcctcggtgaaaaactcttcatatccaaagcagatgcaggaggtgttaccatggtaattaagtaaaatgtaaatatagagctttgagataacagtaaggtaaaaaacagtgtgttttgctgtgcatataaatgtgaagtgattcctaccaaacaaaaaaaaatgtgaagtgattactgtatgcttcgcttttagataaaactaagacttaattaaccacggagaacatttttaatgtattttatatatttgttttctaaaatgtttttacacttttagacatatcataagagtattcatctactgatacacaataaccactagatgattgactaccaaaccaatatttaggaattactattgcatatagattttaaaaatcctgcaaatcatcggtttctcaggaagaagacgataagctcaaggaaaaagaaagggagatcgaatctaagagccttgcggaagcagaggtaattgcaatgaaagagaggtcacggaaggagcatgaccatactatgaatatggcacacgaagaagtaaattagtatccaaaaaaacattgtataggtgaatacttgttcttcacaaacatgtgattgattttaatattctctgtttaatctatctttcaggtggagcatgcgctaaaacaaaatacggaaacacatgaaaaagagacgcagcatcatgtgattgatgtctccgacagtactgccgatgaagtagtaataaaagatcgaccacataggtttggtgtgattgtttcacaacttttaaatcatcatctactactgttttgtgtgttttattgcttttgcttcttctacttttgcattttcccaactctactgtaatgttaaggatatctccataccgtctttgccaacaatatgtgtctactaaaacatacaataaatctgaaaaagatgaattaagtgatcaaaatgggaattttcaatctaatattagaagcctataaatctagtgatgaacaaaaaaaagttgtaatgaaaaaaaaaacaatagtgatgaacagtggatttttggaggcagaccgacacgtttaataaatgggctcagccttatctctaggcttttgtgactgttagtgtgacatttgattttccccaaaacataaagacaaaaaggagagaaacaactccacccacatcacacaaaccaacaaacccacaagctccataaatctttcaagtgaacgactaaccaatacggcaatacaataccgaacctatcttcgatatctctagtctgtttttgtcgtaaatccattgatcatg

SEQ ID NO: 11943 - DNA, 3000 bp, Unknown; identical to SEQ ID NO: 11940
  misc_feature (1)..( 3000): cDNA_ID_2711353_gDNA_ID_2214523_Annot_ID_184682 3000 nt of promoter + ATG

SEQ ID NO: 11944 - DNA, 3000 bp, Unknown
  misc_feature (1)..( 3000): cDNA_ID_1015460_gDNA_ID_2214523_Annot_ID_184678 3000 nt of promoter + ATG
tctggacttgtgatgcaactcttggctggttccaagattattgaggttgacaacaatgttcgtgaggatcgtgccctcttgtaagtgttttcgtttcccattatgaagtattggcattacaatacgtgtttggttgaactgtttcaatgtctggtttgaattgattgagctgtttttggaaaaccctaaggttgtggtcgtgtgagttcttattctgtgtttgtacttattttgtaggaatggtgctcagaagcttctaggtattctgattgccattggtgaggctgttgcatatgttctttctggaatgtatggtcccgttggacagcttggtgttggaaatgccattctgatcatccttcagcttttctttgctggaatcattgttatctgccttgatgaactccttcagaagggatatggtctcggatcaggaatctcccttttcattgccaccaacatttggtaggtcaacttcttcctcactttaaaaaatccaaaatccttttcggtatattgaactcataagagtttatattgatgttctgcagtgaaagcattatctggaaggcatttagcccaactaccatcaacaccgggcgtggagctgagtttgaaggtgctgttattgcactgttccatatgctgataaccaagtccaacaaggttgcggctctccgccaagctttctaccggcaaaaccttccaaatgttaccaacttgcttgccacagtcttgatcttcctgattgtgatctacttccaaggtttccgtgtggttttgcctgtgagatcaaagaatgcccgtggacaacagggttcttacccaatcaagctgttctacacctctaacatgcccatcatcctccaatccgccctcgtctcaaatctttacttcatttctcaggtacagccattctttccacttcactgtatgggacgtatctccacaataacatattgttgacattgaattttcctcgtggtcaacagcttctctaccggaagttcagcggaaatttctttgtaaaccttttgggacaatggaaagaatctgagtacagtggacaatctattccagttagtggtctggcttacctcatcacagctccagcaaggtaatgcagcagtgtctttcattattcgttttaatcaattcaaagttggcatgcatcaactgagcttgatgaatatatgttactatgtggttgcagtttctctgacatggcagctcacccgttccatgcactgttctacatcgtcttcatgctcactgcttgtgctcttttctcaaagacatggattgaagtctctggatcttctgctagggatgtagctaagcagctaaaggtaataaaatcataacagcttgatgtatataacctgaatgttaacatggtgttggatctctgactctgaaaattaaatgtcacaggaacaacaaatggtgatgccaggacacagagaatcaaacttacagaaggaactgaacagatacatcccaacagcagcagcttttggaggagtttgtatcggtgcacttaccgttttggctgatttcatgggagccatcgggtcgggaaccggaattctgttggcggtcacgatcatataccagtatttcgagacctttgagaaggaaaaagccagtgaactcggcttcttcgggttctaagttagcttaaagaaggtgtaaactttgcctgaggcaaaaaagcagagcagaagaggctttagcttctgtgcccacctcaaacacagacaatttgtggtggcacttgggttagactacttttttttgttgttgttgaaacgaaattttctctttagtcatttatgtttttttgttactttttacaagttaaaaaacttatgtgatagacgcttttctaatgtatgtttctaggaatttcactctttgacccaaataaacaaatttacagttttgaatacaaagcaatttattatcttcttggttccagccaatgtgaaatgtttttcgtagcatactttgcattacatgcaagcccaaatggtgaaactagagaaacctccaacagtatggtgaaagtatacaaccctcaatgtggaacgatatggttatgagtaattgatctcaactactagctaatgcagagattggtaagtgtgactaattatgatccgttacagtgttacatactgctctttaatttcggcattcataacaacaaagattttttttgagatttttgccaaacgcgttttacaaatctttttgctcataaacttcttctttgttcttcacactcgcaaataaatttggtgtcgctgttctacacagtccaactctaaacacagatatgatatcttaggggtctttgatttgacgagccacactaattttgtagccatccatcgtcaagccacggaggcaatattcgcatccttacgacggaggagctcgcagtcactggaggcatttttgacaacaaccgttaatctctccggcgtcccgctaattcaaaccctagcttcaatttcaacagagctcgtctcgtgctttatctcttcctccaccgttccaaatttcaaagagactccaaacttgacctacctcaaattcatttgcaactcttgatatttcttgagaacgagagatggtattagttcttttgccaccgacgagaagagaataaagctttgagctcgtagcgttctctaggctaaacttttaaaaacactctccataaaaacttaacaagagaagaatggtgaagtaacgtggatatcagaataggcaagaaaaaaccaattataacttaataagaaaaagggtcctaatagcaaaattagaaaatagaggagcccaaaaccctagtcaaaatagatccgagggtcttaattgcaaaattaaaaaacagaggatctctcgaaaaaccttaaaccctactctcaagtctcaattcggcgcgacggactctttgttcacttttgtaattaagattctcttgtagtgtat

SEQ ID NO: 11945 - DNA, 3000 bp, Unknown; identical to SEQ ID NO: 11939
  misc_feature (1)..( 3000): cDNA_ID_3436094_gDNA_ID_2214523_Annot_ID_184677 3000 nt of promoter + ATG

SEQ ID NO: 11946 - DNA, 3000 bp, Unknown
  misc_feature (1)..( 3000): cDNA_ID_3023413_gDNA_ID_2214523_Annot_ID_184676 3000 nt of promoter + ATG
tctcaaatggcaaaggtggcaaagggcttacacaatcgtgagatatggttagcagttttgagaatcgtacagggcctggttaggaaaaaggaaagctactatgataagcgacggaagatgctaagctatgagaagatgttgtgtgaggttgagaccatttgtgacagagaagacactaggaagaatgttaatcagcggagcacatatgagtttgcgcttcgaacggaatgtgagaagcttgtaggtaagcaagatgataatagaaaatatttctggactgttgtaaaagatgtttttgtaaaactatgccctccagtatttggcgtattagaagatatggagtgtatatccaaactctctgctactgtctcaaatgatgaagttaagaaaagtatgttgaggttaaggaaatcgttgaaagagatggtattcttcttcctcttctttctttttatatattcatttcaacaggatttgatctgtgacggctgatatgaggtgttttttttttgttttggagttccttttgattgattcaaagattttgcggaacgaatgcacatacaaaaagctaatagatgtattcccaaagctatcagttgttgagtatcgcttggtggtccttccgcttgtgaagaagttcttacaggtttgtcaacttcaaagaccagtcactgactcactggtgttggattaaatcttattgccagtttaacttaatttgttttctggcaggataaactgaaaaagatgatggaaacaaatagcaattcagttgctgcaggagattctgtcaacatgcagggctaagatttttggaggatcattcttccagatggagaaaaactttagagtactacttgtttagaaaacagtcttttaatgttctcggaaaaacttttggattggagagaaaaactgtatatgaaaatttgtagtttgttttaggatcagatgcatatatgtttgtattgtatgtgacaatagacacaatacaatgcattgttgatcttcataaactttggtctataacttcttgagacatggtcatagcagataaatttagtaggttggtcacacttttacttcactaacccaaagattatagtaatttcaacagattgattgtcatataaccaacattccaaaattgtacctaaactcgtcttccctttataaagggtttattggcaaagtagacactttttcaaaaataatttgcaaagtaggtagtttttttagaaattagagatatagacattttttttgctttttgtgagatagaggatatgtctaatagactaaaaaacaaaatacatatcaaatactataataccttttatcttgagagagaataaaaataatatgagagaccatgtttactttattttatttgtctttatctttttaatttttattttagttttcttaaataatttttaaaaaaaattacgttgacttttagagtatttatatgtcatcaatttaatacacaaacatttcaaagatcgttttgtacactaaacattattcattggtgtacaaatgtgtataccgatattcataaatagaagtaatattgtttttaatattttacaaatataatgattgcataaaccaaatattattacttaatataatggtgtacatgatggtgtacatgattaagttaatcttgatggtgtacaaaatgaatgaaactattatgacgattgaatagaatgtgtatataacttttaaatgatagcatacaatattggtaaacaaagtgtacaaaacttggtgtacacttacagggaatgtataaattattatttcagttagtggtgtacgtcatctcgtacaccaattttagtacactgtctcatagatctttagaggtgtacgatcatgtacaccatattttcaatcatctatgtacatcattttgtatactattatactcactctatcacttcttacaataatattatatattgatttttacattattgtcgtacactaatatttgtacaccagtattaataatatcacgtacactgtcggctgggattaaataaaaaaatgctacatatttttgaaatatagcaaaattagtctttttagattcacataaaaaatttaaaagtcaatatgattatatggtaattttttatgaagaattattatcaaacaaagtaaaaatattaagtaaaaagaaaaataagaaaaagtaaaatttgacttgaattttgtctttatcttactacataacaaaataacaaaaggttatataagtcatttctaaaatctctattagacaaaaagttgtattagagagaaaagagaaaattgtttatttcttttatttctataaaaactacctactttgcaaattatttgttgaaaaagtgtctactttccgacttatctcttctataaataaacagacaacacacagagagacattcaacttcaagggacgattttcctctcatagcaacaaaacaaatcacctcaaagataaaaacttggaacataaaccaacgaaatggctccgtctaatgatcatttgcctttttctagtcctcacctccgcttcattcttctagaattcttcacctaagaaagctttcagagacgaggaaatatgaaatgtaccattttataccgtcctactaaatgtgtctgtctcttacagcaagagatccgttccgtagagaaaagactggtgagaggtggtacagttcaaaggctgagattaatctacgaagcctggagcgcacgctaggtgctcgacgaaatgccacactgagaggtcatcacgtgccatgcacatgaccatttctttatctccctcttgctcagccaacagttgtatataaacgcatctactctgttttcttctcgtgaacagaacaattctctcccaagaaaagctaacaactttttctttctcagtcaaagccaaagaaaccaaccattttctcgagaaaattctgactcccctggggtacgatg

SEQ ID NO: 11947 - DNA, 3000 bp, Unknown; identical to SEQ ID NO: 11935
  misc_feature (1)..( 3000): cDNA_ID_3023417_gDNA_ID_2214523_Annot_ID_184675 3000 nt of promoter + ATG

SEQ ID NO: 11948 - DNA, 3000 bp, Unknown; identical to SEQ ID NO: 11934
  misc_feature (1)..( 3000): cDNA_ID_2707942_gDNA_ID_2214523_Annot_ID_184673 3000 nt of promoter + ATG

SEQ ID NO: 11949 - DNA, 3000 bp, Unknown
  misc_feature (1)..( 3000): cDNA_ID_3023424_gDNA_ID_2214523_Annot_ID_184672 3000 nt of promoter + ATG
gggtcacaagccttgcaagctcaggagaaaaccatttaggacacttaaactgccctttatatatctttgtatacataaccaatatgttcttgtcatcaaatggaagataaccagccatcaatacaaacaagatcactccacaagaccaaatatcggcttttgcaccttcataacctttccttgtcaaaacctcaggcgccaaataagctggtgtcccgcaaaacgtttgacagattccttcttgcttgagctgctccgagacaacgctgagcccaaagtcagagactttcacgttccccttgtcgtccaaaagcagattctcaagcttgagatcgcggtggtaaacaccgcggctgtggcagaaagcaacggatgagatcaactgctggaaatatctcctcgcggttccttctcgaagccgtcctctagccaccgtattataaagctctccgcctcgaacgtactccatcacaatgtaaatctttgtcttcgtagccataacctcgagtaggtgtacaatgtaagggtggcggacacggcggaggattgaaatctcccgtttaatatgaccggccaatccactcttcactatcttctccttgtcaatgactttgatggcaacatcctcgccagaatgaatgttccgtgctaaatagaccttagcgaagcttccgtggccaagaagctttcctatttcgtacttgtccatgagaatagagccttgtggagtccgcggactcctcgggctctctggagtactggtctctttgttcgtattttttgtaacgattcgagcaagaagacccgccatgaattgtattggcgttgggccggggatggccaacggtgtagatagtacttgagccatccgtaggctgagacttttatttagttctggttgctctctaagtgtaaatgtaactgttgtttgttgattccgacacggttttaccgggaaacgaaccaaaacaagaaaatgaaatgaagaaacggacaaaaataagatatggtggggttgttgtttcggttgtgatgttgtcttaacttggcctttttcgtgttcgttttataacagttttcgagttgactttatcttatgtttcgagaagctgaaaagtcatttgattttaaaatattgctatttgatgttgaagttttatcctaatccaaatattttgccaacagaataacacgttggacggattttcaaattataaaaggcaaacttatatgttctatccatacgcaatgtcaactttggaatacatttaagctttcttaaaggacagataataaggttgacttatcaatgaggctgatagataagcagatcatggttcgttaagatgtcatcacacattttatttagcaaatgtataggtttatgtgatacgtgagtattatagtctttaaaaagatactgtatggagtggtatttgtgggcaccacgtgttttgctgagtcggtgcttactgtacattgtggacttcacgttgcagaccaaaaccagtggcttcaaatttaagactccaagtttcactttctccttatttatttttttgataaaaagttttcaattagattatattcatagtttcatacttccaaaatccgttttctgtattttaatttggattacgagactaatcttgagtgcaactttatcatccggaactttattctgaaattggatataatcaattaaattcagcttgtttgtgtacaagcaatagcattcaaatagattcagctaatataccaacacttagactaaattaggagaatatatcatgtcataaattgttcttcagataaaaaatctcaattgatgatagtagtttattcattttaatgcataattacgaatttaaaactctcaagaaaaaaataactacctcagaaagatttccaggaaagcttatgctaaaatatgcaagcacgacggaggtttatcctctttcgtataatttgtgttagtattgtattaagaaatgtataaactaatacaacatctgctgtcaaaaaagaagaagaaagatctaatgcatatataaaaaaaaaaaaaaaaattttaccaaaaaaaaagaaagaataaaagatcgatgtgaagaccactttaagatagtacatttgtttggataaggtgtattacgttaataaataaaatattatctaaaaggaaagattcaaaatttgtaatagttgcaaataaaaaacacaaaatttggtagtaaattaatatgtaagaaactattcagaatatgtagtgtaatgattatggagaaagatacttatcattcatgagaaacaagattaacttatacacacaacacagttcatgaattctaagagacaaccaagaagagatagatacgaagagacaagtgacgagtgaagagtaattagaactctttcctaacaatgatgaattgagttaagttcctatattgttggtcaaaaatgacatccttaagagaaaaggtcaataagttgttagagtcactgcacacaaacacaatgatctgtatccgagtctgattagagatttcaatacattgaacatgacctatgattatgaattgacaattgagtaccagatgagtttacatttacatatgcataaaaagccattgtctaactcatcattatacaaaaagaaaagggttgttgaattatttcttacaatgtgtgatgatagctgatatcagaaaaaaaagatggaagatgttgatccaataatggttttgacccggtcacctaacttaccatggataaattatcactaaattgcatatctaacaagaaaatattacagtttgattccttattgttgagttaataacgcaccatgttcatattaatcattcaccatgcatgcatgcatgcaccacatgttgtaaacaaaatgccaaaaagactaatcacaagtctaatgggcttgggctcacaaacatttttaatcaaatcgtcgaaaatttaaattagcactggacgaaagag

SEQ ID NO: 11950 - DNA, 630 bp, Unknown; identical to SEQ ID NO: 11933
  misc_feature (1)..( 630): cDNA_ID_2702086_gDNA_ID_2214523_Annot_ID_184670 3000 nt of promoter + ATG

SEQ ID NO: 11951 - DNA, 3000 bp, Unknown
  misc_feature (1)..( 3000): cDNA_ID_2707908_gDNA_ID_2214523_Annot_ID_134116 3000 nt of promoter + ATG
cctgctgaaatgtcaatctgggtgcatcctaggttcgcgtcagaccctactcggccaattctagacaaaataggtctcagatcgaagagtttagatctgaataatagattttgggtttcgtaggccggactagtctacacccattttcattttttttttttttttccttggctcaacttcaaatactcattaaccaacgtgtttacaataaccaaattaaatcaaagtgcttctaagccactgtggcacaatagaaaacaatttgggatcataattcgagaacgaaatagattcccgtgctattctatccgccactttgttaccgcctcttggagtgaactcgaacttgacctcttcaaaatgatggagcagctgctgaatgtcttccaaagccggttgaagggttggccaaaagtcatcagaattcagcagattaactagagcttgagcatcagattcaaaaattattcttttatagttaaatctgctcatcgtgagaactgcccaccgcaaagcttccagctctgcttccaacacattcttcgtccttggcagagctcttgctcccatccacaagactcctccactctcgttacggaggatccatccaataccacacctaggattttccaactgccatgtagcgtctgtgttacacttcacccattgataaggaggagctttccattgcaccgaaagatttctctccacttgaggaccagaggctttcccttcaagctcccgtctagtactccattcctcaaagtcttccatcgctcgtctcagaacttccggggcatcatactcctttcctttaaacatcagctcattccgtgatttccacagacgccacaggagccaaggcacaagattgccaatttttcccaactttggaatttccacttccaagttaagaacccaatacaaattggcgtacaaagaatcagtccactctccttcaggatatgctgggatcggtgaaatagcccagacaagtctagcgaagcaacatttgaataataggtggttcactgtttctctactatctggacatctcacacagctcgcctctctaaatagatgtctataggccatatttcctgctaccgagagacaattagataaattgaatgtactatttttcattttcattttttttgaagcatcttttcaaagtatttatagttgaatgtttttcttttctgttaaaggatcttcattagttgaatgcttatactttttaaaataatatattttttgcttgttttagttttaaaaagtatatttagtaatcattctaaaatttaacaaaaatagtttctattaaacctatcccctttattaaggctatatgttaagaatttataaagaactactaagtttgttagatatgcagttatgtgagaaattaataatttcgtgctgttttctttagcattttgtttgaaaatgtttcactatattattgacggatattattttgtttgtatccaaaacagtgagtgatgtgaacaagttgttgttagatgacatttctaactcgaatttaaatataaagttgatattgttcaggttgtttttctctacttgatatgatgaagttacgtattgtagagtataaataattatatgactacttttaattggttttaggtcgacatctaatgactaatagtgtgtttgggtatgactttttgttaaaaacgtgaatgtgtaacatcatgacaatattaatatattgaatcttgtgtattggtcttatagtaaatcatagttttagagggtagaatttctaagaaatacaccaatgtcaccatgtgtaattagttcttataattatcatccatttttaaaattggaggcccaaatttctgagaagcatgcttatcgcaacacatcattatgacatgtttgtaaaattttcaacagatttgtggttattagttcatagtttctcactttatatatcaatgataatatgttactaatggtgtttgtattttatgttccatataaaatcggggattaacaaagtgataattgtgaacatacaatttgatttgatttgaaaagtgattaactaactgatttgatatttagcatcttcgatatatttaaaagagtctcatgcatttccacaatatatcattattctaaattaatggagacgttaaatcgattattccgactgttgtgttgacatatcatgcatacttatccataatcaatttgccccaaaaacaaaacaaaaacatatacataatcaattgatttgtccgaagtaagtataagactatcaaaaacgatagaagaaacaataaacgatatagttcataaatcaaaacaaagacaacactcaacagcaaggaagtaccaaagtcaatatcttcaaaagtcgtctttgcctttctgtttcgtttaccgtttctacttctacattatacgcatactaaattaagtaagcaaattaaactcaagtgtcacttatacaaataccaataattgtattttatttggtccctaattaatttaatagttttatttaaaaattaaatcttgtttcataaaatgttttatttttctttgttcggtttccaaattctaaactactaaactaaattgatatctcttctaaattaacatatttttatttttttacaacattagagataaggtgatacactgatacaatagatggagagagctcattttacgtatatatataataaaagatttttgttttgttagataatctaaaatatgattgttacgtcgatttaacttatccatacactcttcttttgttactcactcgcatatatatgattgtattgtagaatgtagattaccttgtcattcttctttaatttgttcttcattcacaaaaggatcagaaagctcgtgagtttctatttgatatagtactctgccaattaaacttccttttcctatttcttcattcttcttttcaaaaggtattatttttatgtactcaacatg

SEQ ID NO: 11952 - DNA, 3000 bp, Unknown; identical to SEQ ID NO: 11941
  misc_feature (1)..( 3000): cDNA_ID_2711345_gDNA_ID_2214523_Annot_ID_134120 3000 nt of promoter + ATG

SEQ ID NO: 11953 - DNA, 3000 bp, Unknown
  misc_feature (1)..( 3000): cDNA_ID_1807705_gDNA_ID_2214524_Annot_ID_134122 3000 nt of promoter + ATG
tttttcaacaccatgggatataaattacttgacgttttggaaatctccgctatttttatttatattaaatggcaaaactgtcaatatttcgttgacaccttagacacaaaactctatggatcgttttaggcttttagcaatcaagttatacgttaatactagactaaaacccggatgataagtatcttctaaattgaacacaaacatataatttgatgcgttggaatttttatttaaaatttacgatagtttgtcgtaaaaatgttgatataatttgatccttcaattgaaaatgataaatcagcggttatataatattttaaaagaaaagaacgatgatactaatgaatgagagattaaagaaaacatatcaaaacaaaacaaaccacaaaagtaaatgaatagaaccatgaaacagactggccattaaatcataccctactaatgttgatataaaccacatgttgtatttgtatggtggagtcaaatccacctactaaagagatgtagaacgtaggtccccaatctacatttctttggacttttttaaacggacatttattttattttgttaattaaaggaatatttattgcctttatgagtccatttccattctcctaacgaacgatgaaatcatattaccagcaccaaattttgatggcatgagtgaagaatctagggggtgctgctgattatatacaatttcttaccactacagcgaaaggaaaagattagtccacttatatgcaaatccaaaatattttaagacaactttatcttgaaaggtttccagaaaagtacaaccgataatttagtgttacataaaaagtgaatcatataaaagatcttaagatgagtgtgtggcataccatttcagaagttaagggagatgacgagtgataaaaataatggtatggtagaatgtaagcaaattatataatgaaattgggtttaatttaaatgagctatgtgggtagttagttatacagtcaaattaaacagttttgttttattttttttcttctaacatatattaaatcgactatgagataatataattgaaaatgcgttaaacttttattctttatagaaccccaaaataataaatgtcaacattcaaaatgaaaaacatattatgaaaatataaaatttatttgataaattagatgtaacacattaaaaatactgtggtgtagaaaaaaaaacaggaatcatgtaatacttataagatgatatgagtaaaaaaaaccccgtataaaattacagtattctttgtactaatatttgaaatttggttaaaagtagattacgtttcccttaattcgttattgatttatagtatttttcctctttagttttctatcttcgtctcctaatttatatatgttgattagttaatactgcattattagatgacaattaaaaactaagtctagtggttagttggatgaagattaattactaaatctattaattagctgggtgatattgacaattcaaatatatcttagcacttacagctcgattggattttatatactaacaagtcaacttttaggccggtgatatactacatttagcgatcgtatgtataatgtatagttcaacttcaatttaaaaaacaaaagctgataatgaaactgttgcacgatttttttgtatatgtatcaagtatgttcattgtacatgaaagatatactcaattgcttatgctgtcataattatctaaattattaagtataattaagctatagatattgttaattacttaattgtattagtcacggaaactgataataccaagtcaaggggaaaccaaagattaggcgtgagacggttctcattgctgaccttgtcggaccaaagaccttagtcatgttactctgctttaggtttcgatctatttccaccaccgaaaccagttttgatttacaaataataatatttctctcattttatttaatcatataaaactctcagtgtttatttcgacccccgaaaatctttatctcttaccttgaattgtgttagatatatatatatactaatagtggaatcatttttcaaaatgtgaaaacgaaaaaacttgatgaagtttatgcaggtcattgtcatgctattgagtacatgctcatccagagttccatatatagaaccttgaaggtccctaatccttgagtcacatcctaaaggctttccttagcctatccaacctgaagtgatctcccaaccatttaggaatttgatctcgtttgctctctaaagctttaactactcttccgacgtattctccaaaacaaaaccaaggaaatttgaaccaacagttcacaaactccaaaatgtatgcacacgtaaatataagattatatttatggttttatgcaaaaaaaaaactttcaactaattttttttgtaactaaaccttacatctctaaaaaaatgtagatttattttataaagtcaaaaataatacacagtataaacctcacaactatatattataaatatttttctagtcatatacatcagatatataagatattaaaagaagagttgaacttcttatcgtgagaaattcgatttgataaattatttgtcaaatgtttacgaacttgacattagcatgaaagggttagaatgcatattattattgattttgtgtgattaattcgtattttctaaaagtgaaaaaaataaaattgagaaatgttttttgcacaaatcctttatatttaaatgatcgaccagacggtaattcatttgaatacattttgcttaaaagaaaataatacaattggatcggcgacagactgtatatttgttaaattggtcgatgataaacgtttgagttaaataaatattatcgacagacgactattccttcatatagaagcgacaattatttttttccagaacatttacctataaaatctttctacttatatttgtctgcgtgtgacttttaggagagtaagaaaatatcgaaggtcagaagaatg

SEQ ID NO: 11954 - DNA, 3000 bp, Unknown
  misc_feature (1)..( 3000): cDNA_ID_1808418_gDNA_ID_2214524_Annot_ID_134127 3000 nt of promoter + ATG
agcaaaaatttagacaaatatttctttaactccaacacaaaagtacacatagcattaggttattcctaagatttctgggcttctggtcctaaaatcccattcactactgacgtagcgacaagaactccgacgaactcagccgccacgacggctccagcttgtgtcaatccattaaagctaaccgccgtcacgatttccttctctgccgtctctacacctctctccgccgcttctaatcctttctccgccgcatcaacgcctttctccgccgtctcaaagccttctttcacgatctccaccgcttcttcttctgctttcttcagtttctttcttataccaaataacggaatattctccgccattgatgcaggctgaagtcccgtcactaccgtcgctgccgtcaacgaaaataacagattcctgcgagaggcgccggtcagcgagaacgaagaaagcgcgggtttgttagaatgcgccgctcgtgggctaacatgcgcggttcttgcgcaacgcgcctgaagagctccactgccgccgctgagtaaagaaagcgaaacagtcgaagccattttttagatgatctcacaagaaacgaaaaaagctctcagatgtgaaatagaaaatacgaaaagttttgataatatataagataacaaaataatttcattgtcaattgacgtgacacgtcatctccattgagattctttgataaatgggtataaaaaagattataattaaagaataataaaacattttgtacgttaaatccaatttattttatttattttcaatccactttcagccccaaaactcagcaaaatagattttttctgaatgaaaaaaaaataaaaaaaatccatgtacacaaattagacttcggttttgggtcttcttgttctgtctctgcttttatataacttgagttctgctttgcttctgtgtttctttaaatttattataaaaatggaaaagattgagttttctaaatgagctccaagtagctgtagagaagctaatccacagctacggagtcctagttatggtcacgttgttcctaagatggatcgcatccttcgctgcattgtcagtcatatgtttcagatttaaaatattttgatcttatgtataagtcttcttcttattttttaatatatttattgcttatattttgttttgggagtcttttgatgatactggatcaaacgaaatggaagtactcaaacaatatgttaacttcgctattagctccttacctcttctgtagccttcctttagttgttttccaattcttgaggtaacaattcatacacacaaaaaataccttttgttgttgttcttgagtatgtaacaatgatcggattaagtatttgatttgtattttcaggaccgggtttgggacatggatcgctctcctcagtcattctcaggcttttcctcccaaaccgtttttctggttaacaaccttagaatagtaccaatgagatttgaaacaatattagttacgatattaatagtcttcagtgttgatatatagtaatgttagagaacagtttgcgatatgaatatttattctatttaaactagtaaaggtaggcaatccggtttagaggcttcgcacgattactcgttactcgttactcgtctagtacacgttacttgcttcgtaccaccttgagaaaataagtacccgttactcgttttctctttatcattttatatacatacatttcgtattgtattagtttttaaaaacatatttaaaatttagattaaaaaaataaagtaaattttaagcaggttaaaaacatgacaaatcatcaacaagtactcagcaagtaactcgcaagtaatacaacaagacaagtaactcgtatgtaatcattttttagcaagcacttgaaattaggggtacagagcaagtcaagtaacaaagatccctaaaatagcggctactttgccttgtgcccacacttttacagtttaaaactttaaatgttttagtttttggtttctttggggttaaaactgaaatcataaacaaccaactgtaacttgtatatatgtttgctatcggttcagatattgataaaaaagaattaaaactattttaagattacaatcatttaatttgattatatccccttttaaattttaatacgtatatttttgaaataatattttttttcaaaaattgtttgatttgtttgtttgtgtttttttatatgaaattaagtggttttataaacaaactttggttcaatttggttttaactactttgatttgttttcttttttttacttacatttaattattaatgttttgcacaccccaaatcaattggtgtctttttgcagactcgctagagcttccgagtgcaacgattcttcttactgtggttacaccaaatttcttagtggaaatagtcagagacaaactaagagataaaggaagtgtgtgccttttcacgagcatgtactttctcagtagtcacactaaagcttgtggcttctttatggttggtcgtaactcagttttgcatcaaatattggaaactttccgtttaaggaattataaagatgtattattgtttaatttttcggttttgatgattttgtttgcgtttacatttgaagaaaaaacgaaaaaaaaaaaatcattgttaatttttaggggtgggcatttcggtttaacttcaggtttggtttagcattttgcaatgtagttttggaatatcttctcaagactttttcaactatggatggcttaaaaataattttagcagtccatgacaatgacaaaatcatatacaaaatgtcaaatctagatataaagaaagttcctcgtgttgaatccctttttggttatcaaaaaaaaaaaaaaagtaaccataaatacgaagacttcggttttgggtcttcttgttcctttttataacttgagttcttctgctctgcttctgttttttttgtattttggcttcttttagttcatattgaaaa

SEQ ID NO: 11955 - DNA, 3000 bp, Unknown
  misc_feature (1)..( 3000): cDNA_ID_1808967_gDNA_ID_2214524_Annot_ID_134128 3000 nt of promoter + ATG
aaacagccgtcagttcttaataactatacacttcaaaaataagtacatgatatattttggtcaaaaataagtacatgatatatttatctctaactcttttatacttgcctcttctccaacaacttgtcgatttcaggtaggacacgcttattaacgtagacacgtcattgcgttcgtattattataacgtggcagatttagccatgtcatatatcccaatcactctgatttttttttgccaccgtccccgtgaagatcaaccaattctagtttgcccaaaaaaaaaaaaaaaaaaaagtttattttcaacttattttcttaaagaggttttttctaacgtcttactttattactttgttaatttaaattatggattacatatgtaaacattgcttataagtcaatttactataattgtccacacacaaaaaaaaaaaagattacatagttttggttttatcgataggacaactaatacattacaaatgtttaggtataacaatgtaatcagaaaactatgtataacaatgaaattacacttactttctttcataaaatcttacacattaactaataattatcaaatctgttttttctttataagttaaaaaaaaaaaaaaaaaaaaaaaaaaaaaaaaaaacgagtttcactaaatagccccattggtgcagtatcaccccattggtgcagtatcacatgaaatttcttttcttggaaaaaataaataaaaatttgataaatataaatattaacgtagaaaattgtctgtattcagttaattttggtatcacacttatgttctaatagattttaacccgcggtataccgcggagacaattcattttttaaaattaatatatatataatttgtaaattattttatagtttacaattgttactaagtaacgtcctgccaaacccgtcccgccaaacccgttcacaaaaaaaaatatttattttattaatgttgatcttatttataatatgtttatgaatcattgtcaaaagattttattcgttgcgggatgttgaacccacacatttttcgccaattagttaatatatgttcattcttaaaatttcgaatcacaaaatatgaagaattttgtttttagattttttaaactctatatattctataatgatgttaagtttttttgatatattaaactttttataaatttaaatattattaatgttttatgaattttaaatatataaataataataattaaaaaattaatattttttgccttttaggtaatgatataataactctaaaagcaagaatttagaagatttaaatctttaattaaatattttcatacctaaataattaatgtcagtaccatgacattgtaaataagttcaaataaatgatttgtttatttaaaaaaaaaaagtttagtaagaacaatatttatttaaacaaaaaactttgttttaaaatattgttaacaaaatacttttatgctaattttaagggattgatgtgaagtttgtttggattaaatttgattgataatgtgattgacaatttaaattaagaatttaaagtaaaattaattattttgaaaaaaagatttaatgctaatggcattgggttgtaaataagtcaaactcaaagatttatttgttaaaatggctgcaaaaatgtatatatagattattcgtgaaaataaaaatttaaagatattcctctgctttttaaagaattaataactagtattaaagtaaaatataaaaaaaaatacccgtaaagactatccacaaaaaccataatcatgctcgacaatgaaattaaataacattcaatggttaaatctcgtagcttcttggccatcaaaatcatagggcttagtgtatgccaaagctaatcatctcttcatgtacgaaaatgaaagtaatactaataaatgagaaccatatatgaaatgcatggtccttcctttttatgatttattaatattgtaattattatacgttattatcagataataaatttcagatcatgcaacttatacacatccccacatcgatcaccatcagacatatactacgctttagccaaaattaaatgcatcacgaacataacatttgtggttgatgtgaatagaatagaatacagaagtaacaaatctactcgaccaaaagttgaacggtaatataatttactattcaatattttcaattttcaacaaaccttatctaacacttccaactaccatacgttgataaaaattgttagtttattagtcaatttgcactcctctattaaaaaaacattggagaacttgttagtttatagtcaatttgcactagttctctattaaaaactttttaaaaattaacttttagggtttaaacacataaatagctgagaaaaatctagatatatagaattgagatttaaaagaaaaaaaacttcaaaaaatcaaccggaataacatttaaacagtataatcctttttgataaactacgaatttactggtcgaactacatacatttccctaagcaagatacatttcctagtttaacgcttcagcctaaatatcttactatttttcaaactttttatcgactgcgacatacatacttacattctcatatcgactggtccatttatctatatccttaataaactgtctattaacccaaaagaagagccgtcattagtcaaaattgagcaaacgaattcaattcccaaaccacagtccctaaactcgtaattatacaccaaaacaaatggcaaacaaatcacaacacagaagctgtcatcctcccaacttacttaaacagcctgtcattgtccccacttgtcgttcaaacttcaaaataaatattaaaaacacataatcacaaaaagacaaaacaaatccaatgtggcatattctttttatatatataaacacacaaaaacacatctcacttctcatctcctttctactattcccttttggccggaaaccgagtcgactcattgagtcaaaccaaacca

SEQ ID NO: 11956 - DNA, 3000 bp, Unknown
  misc_feature (1)..( 3000): cDNA_ID_2707954_gDNA_ID_2214524_Annot_ID_134129 3000 nt of promoter + ATG
tctatctaattatattaacaatatcacaacactgtcactaataatataagggcttaaaatttaaaacctaattctttagagatgtcacttttggctatttgttaaatatttttatttcccctgggattctttgacaaacgatagtcttcttggtactggaagacaattctggtatccggctaaatataaagtgatataatagattaaaatataaagtgaaataaaagaagtagaaaagaaaagtaacttagccacattgtgaagtttgcgctttacagcattgagcatcctatgtctatttcctttatgtcttggagaaaacaatttttggaggtatttccattactaaagtttttttatatactataaatatttaatttatttttttgaaaaaagtatgtgggaatagattttctaaattttaacgagtttcattgttaaatagaaattgaatctaaaacaattataatgaaaacacttttgcactatgctaaaaattctaaatgttttaaaatatatttctatatttcaaaattttatgattgtatatcaatcatttacattgaatttttaccccaaaaaacttggttagcaagaataattcttagatattgtcatatactgtatttaggtcgttgatgagttttaaaaataacaacgtaattttagattatgaatggtgacatgaatttttttacggtgctaagaagcttgatcatacaatttgcacttgaccaattgcgaattttatttaatttgtggcatgatgtggaataatacaacgttgtttaagtgaaatgcagatatatcttttaagattttcatgttttgtgaactgctcaccaaccacccaaattatgggaagtgtggtttttttttatgctcgtttttatggtcaagaaaaataatacatttaatttttgcattaaaagttgcaaacgttacttagaatgaaacagttttttttaaaagattttcattcaactcttttttttttttttttttttttctgttagactgattatgtttgatacgtttactttgtattagtcacattccgttctgctccatctactgaaataacattaaccaatctgaatcttatattaaagaccttatagtacaatagttgacgacaatagaatatctaattgttacaaaacagtgagaaaatattgtcaaactaagtggatcggcgatgcatttgtcaattgttttgtttatacaaagataatgaaattgagacagggaacattaaaacgtcaaatcatttagaaaaagtagaattgtagttgtttggatagtagttttattgatgtactgataagtggtttagtaatcgatctcatcttaattagttggccaaatgcaccaacaactcgaatgagatgcaaactttataatccttattttataattttaagcaatccaaatatttgttttttctttatttattgccgtttcatttgactacttgattatagtcatatgttgaaataattaattatcaattagcattagtaaacaggaattacatcatctatttataagttgaaatataattagcatgtttttatatataaaaggaaacatatgtatgacaaaattcaaatagactatagttatatgataatgagactctagatcgaccacattggtgtaaagaaagtaaaactttaattttcttagaaaatataaattttgtatgatataaacctaagcagaatatgtatgtgtaagtaaatcaaacattaggatttaggaatgaggacaaaagttaagggaatgtaacaagaaaagaaacaaaaacaaaacaaaacgtaggatcctaataaccctatgagtgtagaagaaacagaacgagacaatgtgcaatgcgatggttcaacaactcccacttacattccaacaagcccatacaatacaatagttttttttttcactttacaagtaacttttaatttgataatttggaagtcgttcaaatattgacaaaagagtatatatataatatatatttttgtctccttttgttttcgtttttctcgtttcaccacaaaaatagtaacggaaggttgttttaccctctggcttgtctttgtagtttgtacatatcaattgttgactttttacttttcgatatcaattatcaaagactctttatctcttgggacggtcttttattacttgttacaatagaaaaatcgtaaataaaaaatgtgttatggcgataaaaatttgggtgtttaaacatataacacactctttttttttttgataaaacacataacacactactttaacatatatttttctttaaaccaaacatgtaattacactgcttttttactgtttatccaccatatacttatcaagaaaataactagtatacacattatttagcaattcgtgagaaaggttttttgttattttaatagtaataattttacgtatatcgataacccacgtaaattgttgtgctttttaatgcaaaagagaaagtccctaaaaaaacaaaaaggttaaagattgctaaaggctaagagaggtgatgatgtgagattcttctctctagggtcaaaaagtaatactcacactctttttgctcttctgtatttctctgtgtactggcgcgtgagatagaacagaaaataaagacatcaaatctttgctacatgtctttggtcgtatccgtatatatgttcttcttctaattattttagcagaaagaaaaaaaactaatcgctttcataaactcagatttgtttttttttttcaatggtagaagaagacaagtgttcttggagtttagtttcttcttatgattcattcataaatccgaggaaatatatcaaatctgtttctttctttctctaagtcaaaacccaactaagagattcttcttcttctttctttgagatcagttacaaagtgagctttgtttttaagttctaattgctaatttgctacacataagttctgtttagcttcttagagatg

SEQ ID NO: 11957 - DNA, 3000 bp, Unknown
  misc_feature (1)..( 3000): cDNA_ID_2707962_gDNA_ID_2214524_Annot_ID_134131 3000 nt of promoter + ATG
gcagtattattctctctcttttttttcaaaataaaatacttttatattaataataaataattatgagaaaaaaattattcggaagaaaaaaagttacttgaaaaaaaaaaaagttacttgacatagtaaaggatcagaagcatttttgaatactgttttggtttcttttaaaagcaaattcaaggttttaacacagtaacaattgtttctatgctagggaatagggataattatttttatgtgtggtttataaattgacttataagataaaaaaaaatataatactataagaaaggaaaattatgtgcaggttatgttagcgatgtgattaaaaaaataaaataaaaaatagttacaatttttaaaaatggatcagtttggcatttttattctttcgtttttttcaaaataaagtacttttatattaagaaaaataattgtgagaaaaaaacaaagtaatttaaatgtcagcgaaaatttgttacgaagaaaaaaaagttacctaacatagtagtaaaggagaagctttttttaacactgttttggtttcttcttaaagcaaattcaaggttacacacagtaacaattatttttaatacttaaaattcattgaaattatatattggttggttaaactttaacttgggttgaatggcaatatatcatttcaccaaaaatatcttaaatatatatatatttttaccaacaaattcagtatagtataaaacatgtcactaaaagaaaacagtctatttccatgtaaaatacagaaaaaaatgtttttccaaatatattacaaaatactttttagaaaaatcctaaaacttttaggagtaaacgcctaattaatggctgaccatatatatttttattggaaatatttgaatcaaacaaatattgaagtattttttttttgttaatagtggttgtcgcattaaagatttaagaaatcttttttattgaatttgttgacaaaaaaattataaaattttaatcagcatcaaaattaaaactaattagatagagttttgagatctatagctttagtaacttggaatttgtgtccaaagtttaaaagttgctgacaatttatgaataacggagttaaaaagaaaacttaaaatttttggtgttttatcattagacttaaaaggactatactgaattttggaaaagttactgggtcaagtgaataaaaaaatgttaaaatgcacaaaccatctttctgctttcacatagagatcttatttctcaacagtcaacactaaaggccacataacacaacaataacttgttaggatacatatggtgagtggtaacaggaatgtcggaatcaaaggctaggtcaccaaagaggaaccaaacgatattggattaaatatatagaagaaatttattaagaaacacatcgttgtttgagacataagagatcgaagcaaaagcaaatgattttaccctaaagattggagtttgggtatggaaggtcataccttatgatatgtgatggatgcaagtgactacaggaggttgaatctacgaatttcagatctatactttgcttttttggatacgattcttctcttctggattgtgataatttataggtctaggggctaaggcatcggtatttggtgaatgtaccatagccacaatgtcaaaaaagggaaaataaatttctatgttaggggtaactgttattgtgtggttataaatgggattataagataaaaagataatatagggaaggcaaaaatgtatacgtttcaatcttctatgtttgtatgtaaatgagtttggttttgctaatgattatgttagctgtcattgacaaaaaaaaaagttaaataatagttacccgtaaaggggaagataaatttgcatttggaaaatgggccagtaaatatttttatattaacaaaacaataattatgagcaaactaaattattatcttttaattagttgtaggggaaatgatttgtttctttcttaaactcaaataaccctataagttggatattactactgaataacaacaatggttggtttctctattaccacactcggtacgaatcatcaaagaataaaacatacttaaaaacttcataaacacctaaagaagttactcaaagaacatcgtcataaattacgcaaatcgtaaatgtttggaagattttttacaacagtggttggatatcgttctgaaaaaactagacgtttaagtttatacaacaatggttctaatgagttgaacgtcggagaaaactatgtagtgactaaattcgaattcattataaggcaattttgtttactataattttattgaagttctttttaaaaaagttacacaatatagtaaatgattaaaactttttgaaatatcggtttgatgtccttccaaaaaaataaaaaacatataacgtttaaatcacagtttattaaaaaaagtgttcaaatgagtagaaaaaatgagaaattttttaaagtgattaaattgtaagtcatagttaaatggcaattttagtttaatataatctttatttagctttaaaaagaaagaaatattgtagtcagaaaatgttaatgcaaaatgacaaatgtaacagcgaaaaaaaaaacggtctagttagagcgcatgaatattgtcgtggaaaatgttcgtcggaaaccccgatgttttttgtcgatatatgatattatgtcaatacttataattcttgagcttttttgtcaacttgataatgttcaaccttataatctagtccagatcgagaagaaatattaatatgtgtatcattaataaatcacattttatatctcgcataaaactcatatgtttcattttcgtatctagttctaaagttagttctctctttttcatgaatatgtatggtgtaagaagtgatgaatggagtttagaaatcttcttgtaaatttaagaggcatgtttcaatttccgattgcaaaaccaaagaaagaaggttggacacaaagaatacatg

SEQ ID NO: 11958 - DNA, 3000 bp, Unknown
  misc_feature (1)..( 3000): cDNA_ID_3023447_gDNA_ID_2214524_Annot_ID_184712 3000 nt of promoter + ATG
ttaagcactacttcttaggcataattgaccacttctatctaattaagtaaattattgttttttcaaaccaatttgctaatgtaataaatttggatttctgttttttgccaaactatttgtcaaatttgtggacattgcttgtcaccttccaataagtttgtaactagtggctgcaatactatgcatgtgtcagtatataacttgtttagtactctaataattttaccaaattgttaattatagctccccaacaatcgggagacttcttaaagcttgacgaacatatgccgaaagtataaacgacaaatagcgatcattcaaataacgttttctttgaaataaacacgttaccgaccatatggtgataaaatcgtatgtaacaaataatgttatacatatttttatgttttgtacaaataacatgagatttcgagtatattataaaattataacaacatgtttgaaatcaattaaaaagtatattttttgcaaaaaaaaaaaaactctaaaaagaaatatcatcataattaacccaagaaacgacaaaaaagaaaaattaacacaaaaaaaatatgtaattttcttctgttaacacaaacgtttatctgatttatataaacctttcaaaggattagtctttccatagcaatgtatcccaaaaagatattcgtttggttcactccgaaaactaaaaccttaattcaaaaatttgatagttttccattatttttttgtctagttgtgagtttgttccatcctaacacgtgaagtgaacacttatctatttgttccacttgcttgttcttctatactatatatttttctcaaccatccaaaaacatgcttctttctttttcacttcatttcacaaatgttttgtgtatgttcaagattcttggtattgttgttctatactatatgtttctcgtacattggaaaccataactccatactcgaatagaaaaaaaaaaaattaatctaattttaagagaaaggtttcttttaaaaaaaaatttttccttttaaaaaagtctttttccttttaaaaaaaaattttggtaaatctttttatgagttatgtgtatgagaatttttgtctctacattttggagttcgattttcgttttagtttaggatggtgaagtatttacaaaaaagaaatctatttgcgaacctaaatatcgaataatcgtatctttagatgtagatggattagtacatatcgtgatatcgatagatccacacatagtttgtaacaaaaattatcaaaatgactactagtaaaagtgtatttatcaaaataatctagtagttagttaaagttgatttaaaaagaaaaggaaaagtatgtggatccacgtcaggttgcgtgcacgtaaaagtcttttcattccctagttcttctgctctgttgccgttgtgaacaaatttaggtttctaaaaacaaaaactaacacttgttttgggaaatcgctataatcgaacggctacgataccaccgcaaagctatcacctctaccaacccgaacacgtgtacgtctctcatcacttccacatttctcgcgagaaaaaccaaaagagtttcgtaaaaaaaacgaatattcctgctgtaatattaatttctcgtgtacgttccgatatacgctgacgtgtacgagtctctttatttttaggtttaaaaaaacaatgttattatttgtaaacagtatataaacccttttagtctctattgtttcattattcagtcgtaaaataaaaccgaatttgatttttatttttctctctcaaagtttttcttgggagagcaacaatggcgatgaggaagcttttatcgaagaaactcttcaatatcacgaatgttgcttcacagagtcttatgaattgtcgcatttcgtcttcttcgttagccgtacgaaccagagttccgaatgattcaacagatacaaccaaaatcgcaccggagcctggagatttggcgatgtcgcgaaggttcatgcataacagtgctatgattaggccggcggagattatgcagatgccggtgggagagagtttgattgagaaactccgtgagattgatggaagcaaggatcggattcgattagacggactttctccgccggagagggagacgagtttgacggtggcggatacgaagaagctgcttagagcggcgcagatcgagattgtgaaatcgaagctaagagaaacgggaagaagctggatgccgtataaggagtttgttagcgtttgtggtgaagcttcttcagatccagatctcggatctaaaatcgcgaagatgcttgatgattcagcaaacgtcatcgttttgggagattccgtttgtattagacctgatcaggtactttcttcgttcttcttctctagccttttagcattttgaaatcgtgctttgtctctgagatctctctgagtattgcagctgattgattgggagagataagagagagatttaaaaactctctgaaaaaaacggattaggttctcaaaagtttttgttcgattttgattttggaagctataccgaaaactgataccatttttattcggttggatctcttttcttttggttccaattcaacaggagaatcaaaaacctctgtgtttttaccagagttccataggaggttcccaagtttgagagagatggtgataaagaggaacagtttctacagagaccacaactctttttttttcccctaaaaaaaaaaccattggttggattagggttataaattgagtcaagaccctttggtgatttgataccaaaacctaaacataaaaaaacttcaaaagagagagttgagagaagcttactaactggttcttgggggttattagaaagtttatagagatgatgatgataatgggttgggtttatgtggagggattagtcaatagtggaagatcttaaccagaaacagggatatggggatggattgattgactttataaactagtcattgattcataaagatg

SEQ ID NO: 11959 - DNA, 3000 bp, Unknown
  misc_feature (1)..( 3000): cDNA_ID_3023459_gDNA_ID_2214524_Annot_ID_184706 3000 nt of promoter + ATG
tcattagcaaaaccaaactcatttacatacaaacatagaagattgaaacgtatacatttttgccttccctatattatctttttatcttataatcccatttataaccacacaataacagttacccctaacatagaaatttattttcccttttttgacattgtggctatggtacattcaccaaataccgatgccttagcccctagacctataaattatcacaatccagaagagaagaatcgtatccaaaaaagcaaagtatagatctgaaattcgtagattcaacctcctgtagtcacttgcatccatcacatatcataaggtatgaccttccatacccaaactccaatctttagggtaaaatcatttgcttttgcttcgatctcttatgtctcaaacaacgatgtgtttcttaataaatttcttctatatatttaatccaatatcgtttggttcctctttggtgacctagcctttgattccgacattcctgttaccactcaccatatgtatcctaacaagttattgttgtgttatgtggcctttagtgttgactgttgagaaataagatctctatgtgaaagcagaaagatggtttgtgcattttaacatttttttattcacttgacccagtaacttttccaaaattcagtatagtccttttaagtctaatgataaaacaccaaaaattttaagttttctttttaactccgttattcataaattgtcagcaacttttaaactttggacacaaattccaagttactaaagctatagatctcaaaactctatctaattagttttaattttgatgctgattaaaattttataatttttttgtcaacaaattcaataaaaaagatttcttaaatctttaatgcgacaaccactattaacaaaaaaaaaatacttcaatatttgtttgattcaaatatttccaataaaaatatatatggtcagccattaattaggcgtttactcctaaaagttttaggatttttctaaaaagtattttgtaatatatttggaaaaacatttttttctgtattttacatggaaatagactgttttcttttagtgacatgttttatactatactgaatttgttggtaaaaatatatatatatttaagatatttttggtgaaatgatatattgccattcaacccaagttaaagtttaaccaaccaatatataatttcaatgaattttaagtattaaaaataattgttactgtgtgtaaccttgaatttgctttaagaagaaaccaaaacagtgttaaaaaaagcttctcctttactactatgttaggtaacttttttttcttcgtaacaaattttcgctgacatttaaattactttgtttttttctcacaattatttttcttaatataaaagtactttattttgaaaaaaacgaaagaataaaaatgccaaactgatccatttttaaaaattgtaactattttttattttatttttttaatcacatcgctaacataacctgcacataattttcctttcttatagtattatatttttttttatcttataagtcaatttataaaccacacataaaaataattatccctattccctagcatagaaacaattgttactgtgttaaaaccttgaatttgcttttaaaagaaaccaaaacagtattcaaaaatgcttctgatcctttactatgtcaagtaacttttttttttttcaagtaactttttttcttccgaataatttttttctcataattatttattattaatataaaagtattttattttgaaaaaaaagagagagaataatactgccaaactgacccaatttttaaaatccaaactaaatttatgtgtaactatttgtttgtttgctttttattttggaaagctaacataaccatatatacatacatagataaatatacctaatcatatttttccaatcctatagtattatttttatcttataattcaatttataaaccacacataaaaataattatccctattccctagcatagaaaatattttatcttccatattttcgacattttggccatggtacatgcccaaataccgatgccatcgaccaataaaatcttcattcataatccagaagaagataagaatcacacatatagtaattcttttctccttttataatacaaatctcaaaattcatagattcaaaaaccaaatcctctcttaatttgcatcgcaccaccacagatcaaatcacaaaggtgtgtgacccttccatgcccaaaatccaaatctttaggtttaaaaaaaaaacatttgcttcttattatatgtcacatacatgatgtgtttcgtgttcccactttataactctctttttttttttcgttggttcttcttccgtgacctagcctttgattccgccatgtctgtttccatatcctaagtcctaacaagttattgtgttacctgaccttctctcatagttattaaaaacccaaatgttaaagtttttgttttgtggcagcattttaacatttttggtcacctccacctgggtttgttgattggtcatgttattgatcttcaatttggtatctttggaccaacttttttttttcttatatatatctgtataattcaatattgggttctttctaatgtagggtttagatcaattcttcatttcttggtgttgattttgttttgtggaattcagggttttagctaattgttcttccccagttaggagttttacttcttaagatctgaattgtttagattagtaattctgattagtaccaacaatgtcatgtaatataattgacttcgtatgtctgaaaatgccttattagaaatttcttatggtgaatgttagaaatttgattaggataggaaagcaatttatattgactattgtttttgtattcccctgttcttattgcagaattgtgtgtttgtatcaaatcctgggtttaaagaagtgaaatatcttctaagtggtgatttatggaagttaaa

SEQ ID NO: 11960 - DNA, 3000 bp, Unknown; identical to SEQ ID NO: 11957
  misc_feature (1)..( 3000): cDNA_ID_3023463_gDNA_ID_2214524_Annot_ID_184705 3000 nt of promoter + ATG

SEQ ID NO: 11961 - DNA, 3000 bp, Unknown
  misc_feature (1)..( 3000): cDNA_ID_3023467_gDNA_ID_2214524_Annot_ID_184704 3000 nt of promoter + ATG
agttttataacatcatagacgaaaccaaacacaaataatttgatctaacccttaatatacaagtaggtaattgaactcaaattatttgggtatattatttgtaaaatatatgactttatttacaagatagaaactaaagaatcatatttgaagtcgaattccattaaccactacaattagcatggttggtcatctaccataaagaaattaagttcatgttttaaaatttacgaaataaatagaattatatatttataatgtttaataagttacttatacattttaaatgcattttgagaccaaacggttaccttagttttaatatttagaacagaaatacacttccagtaaggttttaaattatagcaagtgattaacttaagaaacactgtattagtggaaagatccaaaactttcttacattgagattgaggaaaaggccaaaagcttgtcgattgtatatttaaaactaattggacgctagtgaatttagaagtgatcctaagaatgacccaatttaaattttgattgtcataatataactaaatactatacttttgtgataatctatgtaagttgagctcggtaacagtgttacaacttcttatttgcacggtgtcggggacacaaattacggtaaaaattcaagtgtcaccactaatgactgttcctttaatcaatactgggtttcaaataagataaaaaaaaaaaatatatacttacattgatttatttgtatggagtttaagaaatgtgagattggtgtggtgactttagacttggtggcatgtgagattagatcatgatttgccagcagagagagacaaacatgcttttatgaatcttattaaagatgcatttgagttatgaaatactactagtatttattacaaagttgttacttatttattgcaaaatgtctcaaagaaattaatgttgcacatgaagtagtacttattggataccggtttttaattccatcgtgccgtaaaaaatcagcttcttcaaaagaacgaaacatttctttaacatttttgttaattaattgttggagatttaggggttataaagtagaaaacaaaaaaggttggggcaatttaggatttaaaaaataaaaagggttgaaaatggaatcatacaaataagacaggaaaaagctgaagtttacaaaggcatttggacaagagagtcaatgccaatcataactagcaaaacaaaagaaaagaaaaaggtatctctactttaaattcactttttgatcacatgtaacacacgcgcttccaccgatttggtgtatccacaagtgattttgcaaacacatttttctacaaaaacaaggaatttaatatttgtatccatttctagcgtgacccataatgccataatggagtttgcaattattaatcttgttatctcatgcatattttcatgttgctttagtactaacaatacattgtattaatgtcttgtatgtatatatttgtgaaacgatttatatctatttagctttcgatcaaaaagactatatatagtgtagaagtaaatcaagtatttcagtattggttgtttgaaatatgagtaaattgcttagtgtcagaagattcttctaaaaaagatcgggggtgcatgactttgtattttttcgtagataaaatatagttccactctatatataagtgtgtatttttaagagatttatagttatattctctgaagtcaaaatgaataataagtcaactattcagagtcaacgtcctccttgttgtcaaaatatatacatatcaattttcaatgattggtttctgcccgatatatataaatagagacgataattttttattttatataatatcatattttactgagtataaaaaaaaacatgaagaaaactcagacctcgatggcttgatgaaacgaaaatatgctaaaaaaatgtttgcaagtgaaaaaagaaaagaaatttgggatattaatctggtttgttccgtcattcttaaccactcttaagaaaatattagaatcatgaaaataaagtgaacatatggttgatggcctgatgttgatgggtccattaaattgttttacacattatgactcgtttggtaaactatccaacaagagttgtgattttttgttcttatttcccctttaatgttttcacccttaaagtagtaggatggctaagtaggatgcttcaagtaaattatgttgtcaatcataaagtaggattcagtttgagataaattaaattaaattaaattaagctcttttgtatacaaacctccacatcctaaagaaactctttcggcaactaagacattttgagaacccaaaattttgaagacctttcgattttgtaacatctatgagcctgtcttgaggagtctaacaatcataccaaagtaaagtgttttggccattgtgaatcttaacacgagtgaagttgattactttgtctttaagtttctaaagcctacgcgataagcctattccaataacatttttgtatcttatcaaaatgtagttagctaataaaacaaaccccatttttctagtttacaggtttttatacaaaagagaaatgtatacacggaagtgaagtgagagctcacctcttatgccactattggagaagaaataatcactcgtgccattcttatgtttggaatattattattgatttttatttaaatcgaaaaatgaggaaaggatgaaaaacccttgcgaaaccacaaaaactacaagaaaacttaatttgttgggctcgggtccaaaaaaaaatgtaaatactcggcccagttgtattatttacagaaaaaacctaagtaaaaacctaagttcccccttttcacttctcgacttcttcctcttctctccgtcgtcgtcttctctcgtctccgacgataccactttcaccggaaaaatcaatctcttctattcttctttcttctccgttttcgttcgtctttgtctctttcatatccgcaaatttattttcca

SEQ ID NO: 11962 - DNA, 3000 bp, Unknown; identical to SEQ ID NO: 11954
  misc_feature (1)..( 3000): cDNA_ID_1808418_gDNA_ID_2214524_Annot_ID_184700 3000 nt of promoter + ATG

SEQ ID NO: 11963 - DNA, 3000 bp, Unknown; identical to SEQ ID NO: 11953
  misc_feature (1)..( 3000): cDNA_ID_1807705_gDNA_ID_2214524_Annot_ID_184694 3000 nt of promoter + ATG

SEQ ID NO: 11964 - DNA, 3000 bp, Unknown
  misc_feature (1)..( 3000): cDNA_ID_2707968_gDNA_ID_2214524_Annot_ID_134133 3000 nt of promoter + ATG
taaaagttttaggatttttctaaaaagtattttgtaatatatttggaaaaacatttttttctgtattttacatggaaatagactgttttcttttagtgacatgttttatactatactgaatttgttggtaaaaatatatatatatttaagatatttttggtgaaatgatatattgccattcaacccaagttaaagtttaaccaaccaatatataatttcaatgaattttaagtattaaaaataattgttactgtgtgtaaccttgaatttgctttaagaagaaaccaaaacagtgttaaaaaaagcttctcctttactactatgttaggtaacttttttttcttcgtaacaaattttcgctgacatttaaattactttgtttttttctcacaattatttttcttaatataaaagtactttattttgaaaaaaacgaaagaataaaaatgccaaactgatccatttttaaaaattgtaactattttttattttatttttttaatcacatcgctaacataacctgcacataattttcctttcttatagtattatatttttttttatcttataagtcaatttataaaccacacataaaaataattatccctattccctagcatagaaacaattgttactgtgttaaaaccttgaatttgcttttaaaagaaaccaaaacagtattcaaaaatgcttctgatcctttactatgtcaagtaacttttttttttttcaagtaactttttttcttccgaataatttttttctcataattatttattattaatataaaagtattttattttgaaaaaaaagagagagaataatactgccaaactgacccaatttttaaaatccaaactaaatttatgtgtaactatttgtttgtttgctttttattttggaaagctaacataaccatatatacatacatagataaatatacctaatcatatttttccaatcctatagtattatttttatcttataattcaatttataaaccacacataaaaataattatccctattccctagcatagaaaatattttatcttccatattttcgacattttggccatggtacatgcccaaataccgatgccatcgaccaataaaatcttcattcataatccagaagaagataagaatcacacatatagtaattcttttctccttttataatacaaatctcaaaattcatagattcaaaaaccaaatcctctcttaatttgcatcgcaccaccacagatcaaatcacaaaggtgtgtgacccttccatgcccaaaatccaaatctttaggtttaaaaaaaaaacatttgcttcttattatatgtcacatacatgatgtgtttcgtgttcccactttataactctctttttttttttcgttggttcttcttccgtgacctagcctttgattccgccatgtctgtttccatatcctaagtcctaacaagttattgtgttacctgaccttctctcatagttattaaaaacccaaatgttaaagtttttgttttgtggcagcattttaacatttttggtcacctccacctgggtttgttgattggtcatgttattgatcttcaatttggtatctttggaccaacttttttttttcttatatatatctgtataattcaatattgggttctttctaatgtagggtttagatcaattcttcatttcttggtgttgattttgttttgtggaattcagggttttagctaattgttcttccccagttaggagttttacttcttaagatctgaattgtttagattagtaattctgattagtaccaacaatgtcatgtaatataattgacttcgtatgtctgaaaatgccttattagaaatttcttatggtgaatgttagaaatttgattaggataggaaagcaatttatattgactattgtttttgtattcccctgttcttattgcagaattgtgtgtttgtatcaaatcctgggtttaaagaagtgaaatatcttctaagtggtgatttatggaagttaaaatggatgagttggttcttgacgtggatgttgaggaagcaacaggtagtgagttgttggtgaaatctgagccggaggctgatttaaatgcggtgaagtctagtaccgatttagtcacggttaccggacctattggtaaaaatggcgaaggcgagtcgtcaccttctgagcctaaatggctgcaacaagatgaaccaatagctttgtgggtgaaggtaataataatacgcgttttttatctccaaattcggaatctttaaattcgatttttgtatggttaatgtttggtgtcttgttgtggtgttgtagtggagaggtaaatggcaagctggaataagatgtgcgaaagcggactggccattgacgactttaagaggcaaaccaactcatgataggaagaagtattgtgtgattttttttccgcatacgaaaaattactcgtgggcggatatgcagcttgttcgatccatcaatgagtttcctgatcctattgcttataagtctcacaagattggacttaagttagttaaagatttaactgctgctagacgctatattatgcggaagcttacagttgggatgttcaatatagttgaccagttcccttcagaggtataagctcagtatttgatataccgaaggatttggattgcatttggttttaacgctttttaatgttgcaggttgtttctgaagcagctagggatattataatctggaaagaatttgcaatggaagctactagaagcacaagttatcatgatcttgggataatgcttgtgaagcttcatagcgtaagctactctctttgctgttaaagttttagagtatttttggtttgattcggctttgtgtaatgttgttcagatgattttgcaacgatacatggatccaatctggcttgagaactcgtttcctttgtgggtacaaaaatgtaacaatgcagtgaatgcagagagtattgaattgctgaatgaggta

SEQ ID NO: 11965 - DNA, 3000 bp, Unknown
  misc_feature (1)..( 3000): cDNA_ID_2707972_gDNA_ID_2214524_Annot_ID_134134 3000 nt of promoter + ATG
tgtaacaatgcagtgaatgcagagagtattgaattgctgaatgaggtaatggcttcaccagaggctgatagtgtcattgatgtgtattgtttccttaactgaagccactttatctggttgtgtttaggaatttgacaattgtatcaagtggaatgaagtcaaatcactttctgagtctccaatgcaaccaatgttgttgtcagaatggaaaacgtggaagcatgacattgcaaaatggttctctatatctcgccgtggtgttggcgaaatagcacagccggatagtaaaagtgtgtttaactcagatgtccaggctagtcgtaaaagaccaaaacttgagattcgacgtgcagagacaacaaatgcaacacatatggagtctgatacttcgccacaaggattatctgcaattgactcagagtttttcagttctcgaggcaacacaaattctcctgagacgatgaaagaagaaaatcctgtaatgaatacaccagagaatggtttggatctatgggatggcattgttgttgaagcaggtggttcacagttcatgaagacaaaagaaactaatggactgtctcacccgcaagaccaacatataaatgaatcagttctgaagaaaccatttggttcgggaaataagagtcagcaatgcatagctttcattgaatcgaaaggaaggcaatgtgtgaggtgggcgaatgaaggtgatgtttattgttgcgtgcatttagcttctcgtttcaccacaaaatctatgaagaacgagggctctcctgctgttgaagcacctatgtgcggaggggttactgttcttggtaccaaatgcaagcaccgatctctacccgggtttttgtactgcaagaaacaccgtcctcatacagggatggtgaaacctgatgattcttcatcttttctggtgaagagaaaggtatcggaaattatgtcaacattagaaacaaatcaatgtcaagatttggtgccgtttggagaaccagaaggtccatcttttgagaaacaggagccccatggagccacgagcttcacggagatgtttgaacattgtagccaagaggataacttgtgtataggttcttgctcagaaaacagctatatttcttgcagtgagttctcgacaaagcactcgttatactgtgaacagcaccttcctaactggcttaagcgtgcaaggaatggtaagagtcgaataatatcgaaggaagtgtttgtagatctcttaaggggttgtttatcgcgtgaggaaaagttggctctacatcaagcttgtgatattttctacaagctcttcaaaagtgtcttatcgttaagaaactctgtcccaatggaagtacagatcgactgggcgaaaacagaagcttcaagaaacgctgacgctggagttggagaattcttgatgaagttggtatccaatgaaagagagagattaactaggatatggggtttcgctactggtgctgatgaagaagatgtatcattatcagaatatcctaatcgactacttgccatcaccaatacctgtgatgatgatgatgataaagagaaatggtcgtttagtggatttgcttgtgctatttgcttagattcttttgtgagaagaaagcttttggaaattcatgtggaggagcgacatcacgtgcagtttgcggaaaagtgtatgcttcttcagtgtattccttgtggcagccattttggagataaagaacagttgctggtacatgtgcaagctgtgcatccttctgagtgcaaatcgctaaccgttgcttctgaatgcaatttgactaatggtgagttttctcagaaacctgaagcaggcagttcacaaattgttgtgagccaaaacaacgagaatacaagcggcgtacataaatttgtttgcaagttctgtgggctgaaattcaatttattacctgaccttggccgtcaccatcaagctgaacacatgggaccgagtctagttggctctcgtggtccgaagaaaggaataaggtttaatacatataggatgaaatctggtaggcttagtcgtccaaataaattcaaaaaaagtcttggagctgtctcatataggattagaaatagggctggtgtaaatatgaagaggaggatgcaaggttctaaatcgctcggcacagaaggaaacactgaagctggagtatcgccgcctctggatgatagtagaaactttgatggcgtaacagatgctcattgctctgtggtttcggatatattgttgtcaaaggttcagaaagcaaaacatcgccccaataacctcgatatcctgtctgctgctcgatcagcttgctgtagggtgagcgttgagacctctttggaggctaaattcggtgatttgcctgaccggatatatctcaaggcagcaaaactttgcggtgagcaaggtgtacaagtgcaatggcatcaggaaggatacatatgctctaacggatgtaagcctgttaaagacccaaatcttctacatcccttgatcccgcgacaagagaatgatcgattcgggatagctgtggacgctggacaacattctaatattgagttggaagttgatgagtgccattgtatcatggaggctcatcattttagtaagagaccgtttggaaacactgcggttttgtgcaaggacatcagctttggtaaggaatcagttccaatttgtgtcgtcgatgatgatctttggaattctgaaaaaccgtatgagatgccttgggaatgctttacttatgttacaaactcaattcttcatccgtcaatggatcttgtaaaggaggtatcttacttgttctagcttgtcatacccttgaaacagagatgtgactccatgttgtaaccttgttttttgtccgctgtttgcagaatctgcaactcaggtgtagctgtcgcagttcagtgtgctcgcctgtaacttgtgatcacgtataccttttcggtaacgattttgaggacgctagagacatatatggaaaatcc

SEQ ID NO: 11966 - DNA, 3000 bp, Unknown
  misc_feature (1)..( 3000): cDNA_ID_2707974_gDNA_ID_2214524_Annot_ID_134135 3000 nt of promoter + ATG
gttacctatctattaaatgcgtaaaggaggataaaggacacaccatacgtgtgaaaaaggaggttccacacgtgatcgatggttgtgcatacgtgtgagttaaggggtgggattcacgtgagagattcacccgaccaaaaactatttttttcggaaaacaaattttagttttcaaacatagaaaataaatcgaaaatagaaagatactggtaggagtgaagaaggttgggctgtcaactgtcaatcccatttgcagttagaaaaaaaatatgtgaaaattaaaatcataaaagtatatttggagaattttaatgtaacttctttctttgttttctgttttaattttctgctatttcaaggacgtgagctatgaaaataagattttaggtggctggagaaagttgtgcaaataaaaaagtggcttgagaaatatttctaattttgattatttacaaacttaaattttgatttagttcgatgaaatattaatcatttacttggctgcccatgaatcacgattcatataggaaatgtaaaaataacttacacatattttctcacacaaacaaatgtgttttcaaaacaataaataatttggtaagcgttgttggggtcacttaaattatgttgatatatataaggtggggagaggcaaaaatagcacgaagtttcaattatgaagtagctgaattggtagaaataaccaaacagttttgaatttaggaaatagtccaatttcttataggcaacaaaaatattctaaattatccgttagcaaaaaataatatttattgagaaatcacttgcattaatttagattaagtaaatagttcaaacaaaaatttgcgtgctacacaattttcgatttggtatctgattctggcatgatagattccaacataagtctccatagatatatatacaagtgggcttttcacttttgctttcaagccttccattagtatttatcctattgtggatttataacctacatagcatatatccaacatgtctctctaactgtttgtgggatggatacgcacgtcaaatcgattttggaaatttttttttttttaatatttaatatacctaggataatgtaatgactaatgatacgttaattttaacagaaaataattgtgtttgtatctatacaacgtcattataatgtatggctgaaattaattttataagtataggtttagaaaaagagatagctgaaggtgtagttgtgaaactacagaaccataaaatttcgttttttccatgcattagttgtgtgtggatggtttacatattacaaacatcgatgatggtgaaaggctatcggccgaccgtgaaatcgtgcagaggattaatctttggattttagtaaatattttgtaaagatgatttggaggtttagtcatcaggcatgttgtcataacatcaaggttttttttaaaacaatggtatttttaaaaatattattgttaaagggatattttttaaaatgggtaatctaaaaagcaattttaaaaaaatttcaataatctttgagtgataaagttttattaattaatatagatataaaataatattttgaaagttgagagtatcgtttaacacagaatgagatatttcctaatcaattaacacaaaatgaaacaacctcgatttgcagctagatttttgctttatcatatcaagcttgaggtaatctctaatgcttttttttttacgatttcgtgatgatagatgtaatatagcggtttctgcaaagaaatttaaaataattgatttagccacatatgttaccaaaatgtaattataatttgatcgatttttatgtatttcatttgtttcatattataatttgatcgatttttgatatatcgtatgattagttaattgaataaatgtacatacatgaaaaagtagtctaaaatgacataggtctcccctaaacaacaaatacacacaatattaaagaataaaattagagagcatcataggaatattatataagtatttaatttgtcaaataagaatattttattttattttattttggctcgaaataagaatatattgaagcacaaaaatatgtggaagtatttatggtggtggtttggttcattgagatatgacctttggactcaccttatcttcctattctttttagtttgctttcataaattagtttccaaattaactcctttaaaatgttgatatcagccgacatttccgtgataaaaagtttttttttctcttataaataaataataacgttgacaaaaaaaaaagacaagaaaaaaaaacaaggataatttcgtaatttcaggatgtgtatagtttttttttgtctttcctcctcatcgttattgatatgaagaaacctttgccgattaaaattaaaaagaagatgtttataaaaatacttcattataaaaaaatgataaatcaagattttaataacaaaaaaatattaaagaagattggtgggttaaaaagggaggcgatgaagaaagaacagcgacctcttcttctctcttccctctctcttcctttctctttgggagagatttttttataagtttttggttttgcagaatttgctgaataaaaactctcactaacagagaaatataaaataaaaagagtactcaagaaaaagaaagctagagagagaggtatagaagaaaacgatagctataagctcatcatcaatcatttctttaattctctgcaactccaaggtacttcctctctctctctctctctctctctataccatatatgtagatgatgaccgaagctgaaagtgagaaccttaaaagagttacaagaaagagattggagaaaaactgtataatacctagttgactcctctctctctctctctctttctttttcttgtattttttttttgtatgtgttatataagattctctgtgtatgtctgaatccttacaggatccaagagctttggaaaaaagatataatgaataacaagatatg

SEQ ID NO: 11967 - DNA, 3000 bp, Unknown
  misc_feature (1)..( 3000): cDNA_ID_2707982_gDNA_ID_2214524_Annot_ID_134138 3000 nt of promoter + ATG
ttcccatttttatgttgttgttgataaaatagaaattaatgaatggtgtacaattaaatggttaattgtatccatccgttttggagttcccgtgtcttaaggtaatggaacaagcaatgtgaagctttggatgatgttcttaattaatttcatatgttatctttgattttcataatgtttgtttttgttatccatatagtttgttatacattgtgatgtgtatctctattaaaagaatgcagtgaattcgacttataaagaaaagacaaaaaacagatcgattactctttacggtattgatgctagaagccaagggatattcccttccataatatatatgtttacaagaataatttgtcgtgttatctcataaaaatatgcttttctgacgctatcttggatcggaaatcatttgtatatatcaatttgttggaaaaaaaactaaattaataaagagatagtaattttacattttggtcaccgaaataattctacaggttatgcttttttttttagaataatgacaaaagaaacatcatgcaacgaacaaaaaatattatgatctaatctaatatagttatccaaaataattcaatccctaaccctaagtgaaagattatatattctattttcagcaaagccttataactattcttgtaaataaatctaacctatataagttgaacaaaaatttgaaattttaataagagacaagaaaacaaattatcaaatgaaaatggacgaacgctcttgatttgtcgcaacattctttactagtccacacacgtccaagcttatggtgacaattttcttaagtatcacttgtgttattgatttggaaaggtcagcaggcaaaacgtagtaaaatttataactgaatcataaatcttgatcactaaaacttaaatcgttgaacctaacattaatataacaaaatggtctattttctaaaatttgatacattcaacatagtctttttatttagaaattgtagaatagtcagttaacccataacttagcttacctcttacattataaattgataatagtaccctttttgtgcaaaacaaaataataatagtatttggatgtatatcagctatcagcattggttgggtctaattatttaagtggccacttgctggcatcaccattagcaccaagtcagtgttggtattgtaatcatattaagcactacttcttaggcataattgaccacttctatctaattaagtaaattattgttttttcaaaccaatttgctaatgtaataaatttggatttctgttttttgccaaactatttgtcaaatttgtggacattgcttgtcaccttccaataagtttgtaactagtggctgcaatactatgcatgtgtcagtatataacttgtttagtactctaataattttaccaaattgttaattatagctccccaacaatcgggagacttcttaaagcttgacgaacatatgccgaaagtataaacgacaaatagcgatcattcaaataacgttttctttgaaataaacacgttaccgaccatatggtgataaaatcgtatgtaacaaataatgttatacatatttttatgttttgtacaaataacatgagatttcgagtatattataaaattataacaacatgtttgaaatcaattaaaaagtatattttttgcaaaaaaaaaaaaactctaaaaagaaatatcatcataattaacccaagaaacgacaaaaaagaaaaattaacacaaaaaaaatatgtaattttcttctgttaacacaaacgtttatctgatttatataaacctttcaaaggattagtctttccatagcaatgtatcccaaaaagatattcgtttggttcactccgaaaactaaaaccttaattcaaaaatttgatagttttccattatttttttgtctagttgtgagtttgttccatcctaacacgtgaagtgaacacttatctatttgttccacttgcttgttcttctatactatatatttttctcaaccatccaaaaacatgcttctttctttttcacttcatttcacaaatgttttgtgtatgttcaagattcttggtattgttgttctatactatatgtttctcgtacattggaaaccataactccatactcgaatagaaaaaaaaaaaattaatctaattttaagagaaaggtttcttttaaaaaaaaatttttccttttaaaaaagtctttttccttttaaaaaaaaattttggtaaatctttttatgagttatgtgtatgagaatttttgtctctacattttggagttcgattttcgttttagtttaggatggtgaagtatttacaaaaaagaaatctatttgcgaacctaaatatcgaataatcgtatctttagatgtagatggattagtacatatcgtgatatcgatagatccacacatagtttgtaacaaaaattatcaaaatgactactagtaaaagtgtatttatcaaaataatctagtagttagttaaagttgatttaaaaagaaaaggaaaagtatgtggatccacgtcaggttgcgtgcacgtaaaagtcttttcattccctagttcttctgctctgttgccgttgtgaacaaatttaggtttctaaaaacaaaaactaacacttgttttgggaaatcgctataatcgaacggctacgataccaccgcaaagctatcacctctaccaacccgaacacgtgtacgtctctcatcacttccacatttctcgcgagaaaaaccaaaagagtttcgtaaaaaaaacgaatattcctgctgtaatattaatttctcgtgtacgttccgatatacgctgacgtgtacgagtctctttatttttaggtttaaaaaaacaatgttattatttgtaaacagtatataaacccttttagtctctattgtttcattattcagtcgtaaaataaaaccgaatttgatttttatttttctctctcaaagtttttcttgggagagcaacaatg

SEQ ID NO: 11968 - DNA, 3000 bp, Unknown
  misc_feature (1)..( 3000): cDNA_ID_2711378_gDNA_ID_2214525_Annot_ID_134140 3000 nt of promoter + ATG
catgaaatccatattactatatttattcatactattatttattgtatcatcaaaacataaacagattcagaaaacaaaaaatccatatgatttaatccatttggacaacaatgaaatatataatctttaatgagaaccatataaccataaactctaaaatcattataaacaatcatagttccttaacactaaattctaaaccctaaacattagatattaaactctatacattaaaccctaacttctatatctaaaccctaaaccctaaactttaacccataaacactaagcccttaaccatatacgtataccctataccatataccatataccataaaccctaaatcccaaaccttcttaatgttgcccataaatattaagcttaaacctcttatccctaaaccctaaaccctaaaccctaaactttaaaccctaaacgctaaaccctaaactctaaaccttaaacacctaaaccataaaccctaaactttaaaccatagacactaagcccttaaccatagaaatatatcatataccatttaccatataaaccctaaattttaaaccttcttattattgcttataaatattaagcataaatcccctaaacataaaccaattgagaacataaaaaattcatatgatttaattcatatgatcaaaatggaaatatataatctaacaagaagcatataaccctaaacccaaaaataattgtatatgaccatggtcaattaaccctaaaccttataccatctacaataaactctataatcattgtaaacaatcatagttccttaacactaaatctaaaaccctaaacactagatactaaactctaaacattaaaccctaacccctaaatttatacccgaaaccctaaaccctaaatcttaaatcctaaatcctaaatcctaaatcctaaaccctaaacccctaaaccctaaaccctaaaccctaaactctaaacccttgatattaaaccctaaacctgttaaaccataaagactaaacccttaacaatatacatataccatatcacgtataccctaaaccctaaaccctaaattctaagatcttcactttaaaacttcttgttgttgtccataaatattaaacataaatcccctaaatataaacaaattgagatagaaaatccatattatccaatccatatggacaacaatggaatatataatctccaatgagaaacatgtaaccataaaccctaaatcattgtagacaactttgattcttcaacccaaaaccctaaatcatctaaactaaacgcgaaatcctaaacaataaagcctaaatcctaaaatgtaaacactagatactaaatcttaaaccctagacattaaaccctagcccttgactttaaagcctaaaccctaaaacctaagttttatatgtacataatctataaccaccacttttgatccatgataatctaaagcacgcttcttaacctgaaaacgtaaaatattattgagatcgatgtgttcatacacaatcttacgatatacactcgtatttatgttttgttaatatgtaatcgtggataaataaatataaacattttcataaataaacttttgttgatatgaccaacaaaacttgtttcatcacattttatcaacatcttttacataacgtaacactggttttatgaatagtattaacaaaacacaatcattttgaattatcgaccgtcaacacacatccaccaaactctgaccatgtggtcatttcaaattatcgcctatcactcttctttgatttgttttgtattttttccattttttcattatttgctcatgtgttttaatgaaaatagcatcaaactacctttaagttacaaatttatagtaagaatatatgtttgggttctttaattcaactctctctctctctttgaggaatttccacaaatatttggtggccaaatctaagatttgtaaaaagacaaaaatttgaccaagacaatgatggatacactaagagaagaagaaacctagcaattaaaaatgaaaattttaaccttatgaggttgattaaagaatgagaaactgaataaaaatcttgaaaatttccaacttttaagatctaagaagagaaagaaaaaagaaaaatctagatctactttttggtgtttttgatgagagagaagagagataatgtctcaaaccatttccttttttcattaagatattttaagtgttttgtgtgtttaattttgtaaagagtagagaaaaaaatgaatgaaaagagagaaaaagtaatggttgtaaattatggtaagtttggattgcttaggttgggttgatggtgtagtagtaaaaaaactttaaaaagtgtttactctttctaaagtgctttattgcgtaattgagtttcaaaaaagtgtccaattacctaatattctcaaaaacatttatcatgttaatgacatttctgtaattaacgtaaatgagaaggatatatatggttgatttttcttttcttttttatagttacttaattttcaaattattaatgttataaaactaaaaactattcttttaaacatatatattaatatagccttaaattttaagtgacattgaagaaaattacgatggaattgaaaatgcttacaacgatattaagtagcttaaaaatatgaaattctaaaatgtgcaattcataaatttaagattcctagatgtagtccataattatatttttatctgtttggttttttataataaattagaaaaaatggataaaaaatgtaaccttagctaaaaagaaaaagaaagaaagacccaataaccaacgaaatccatttacccgtccataggtcttgggttcggcccatcagtttcccgccacattgttcccgccaaaactcatagtcgacataaagcccttgcccccactctctctcttcgtttagaactttttgataagagagaaagagatagagaaattcgtaacggagacgaagcaacgatg

SEQ ID NO: 11969 - DNA, 3000 bp, Unknown
  misc_feature (1)..( 3000): cDNA_ID_3023497_gDNA_ID_2214525_Annot_ID_184741 3000 nt of promoter + ATG
ccaaatgatcaaacaaacaaagctccatctaaatgatgcatttagatgaattagcaaatgattagcaaataatcaaacaaacatcattaagatgaatcattcaaatggattatttggatggatcatttggatgcaaattccaaatgatcaaacaaacatggccctattattcctcactttcaacctttcctctttaaccgaaaaagtatcattatttcttccgcctctcactttgcctctcctcttcacatcatcccttcttggtttccaattcatctttgggtatgatgtcgttacatgatttacttttagggtttatcatcaatcacatgtctcttcctctatgcaagtttacaagttttcgtatttctcaggtttgtaaattttgttatagttcaattatcttctctcaagtgatttggtgttattgtgtctgcaaattttagaatttttggcattactgtgtcgaaccactgacccacatggtctattctctttatctaaattgcataagtttctcttgctcataaaattctctatttaagaaaaacaactttttatttgtaggttcatattccaaattccaatctccaattatgtcactcaatattacacctatctctcatataactctagtaacggatcgatgtaaaatcaaggtgagaagtgcccttggggatttccccaaaaaaaaggataaataagggaattcactggattgaatcttcttcttgtagatgataaggtacaattttgtggatttttctgaagtctcactaaaatctattatatcatgacctatgttaagatttacttagaagaaggagaactgatgagactaatgtagagctctgttgtactactacattatagtttttaccatctttaaaagtttggtattataagaggttcgtttgattcaattttctatatttcattctttgctatatgaaacagtatcacatatactaaaccgcctctctaatctttgtcgttacaaactactaatgacttggattagaatcaaacgaccttgtggatattttttttttataaaattaaatttattttagttggatatttgtctaaatcaatgtattcttttataacttgatgtaaactgttagtgacaaggtttatattttattttgaaacatggaagtaggatacaagcttctgtaaaaagtaaaaagtaggatataagtaggatattatattatgggtacatcattgccatcgctataatttgttttattatctacagttttttctcttcatacaaacgtaagttatttctttatgcaattttctaatttgcaaacattattagagagattattgggatgaataaagttaaggagatcatcactattgcttaatctttagtttaaagatcttgggtaatttttattttcacctttagttcatgtgtaaatttttttcgttttaaccattagtttataagatctaatatttcctccacttctttttttactcagggattcactcattgatgctgccttgtgggtaaacttgcagtagatggatgtccactctgatattaaatctcaaccatcagataagaaatcaaaaatttttgtggatgattcaactatctcagagaaaaaagaacatgatttgttggcggtggaattgagggacgagaagctgattagaaaaaaagtagaagttgatgaaagaaagcaaccaaatttcaggatgaacaatctttgatagcggttgagaggaaaggaaagatggtgtgtgacacgcgcccctaatttttctctcgaaggcgaaacctagtctccggtcagatcaaatcgacggagctgtaatcggacaatgagtctaaatactctcatataatctaacatactcctatactcttaatgaattttaaaaatccttgtttaccttacccaacaaaccggaaccggacggacgaaccaaaccaaccaattacggttaagtctccaaaccaataccatttaagtcacaaaatattaacctatcagaaattcccagaatttcttttcctccctcacaaaatctaaatcgacgactgcagccaacgtcgatttgttccgacgttgaatccaatcgaccaagctcgccgtcgttttgcttctgttattcaaagtgagctttaccattctcttcttatactttggacatcttaattcatcaagtcttgtgttgttgtgtttgaattttgtagatttcaattagatttgatagatttgaaattggtgttggaaattaatagacattatgttggtaactatatattctgggtctattaagacattttaatgtactgtaatggttgattcgtagttaatcttaggcagattactgtttttggtccgaaaatctttgctagaacagaataatctaggtatacctaagaaacgtggtatagctgtgtgaagcactatttatggtataactggtatttctgaaaatgagcgtggtatagctgtttgaagtacaattgatggtataactggtatttttgaaaatgagcgtggtatagctgtttgaatagtataactggtatttctgaaaatgagcgtggtatagctgttcgaagtacaatttgctagaacaggaaaatctaagtatagctaacgtttttttttttgttttttccaggagaatgggcataatcatatattttgattatgatggatattattcaaaaaccggagaagcatatcaatggaatccaaaagtagttggtttgtatggtatattgtttagtacatcatcaatggaggagattacttattcgtggttagtggataagatatgcacaaagatgaagatagatgaatctacgatgaagctgaaattgagttacattccaacgggtgttaaacctcctacatatttatatattagggatgatgatgatgtatatgtttatctaaccacgttggatgaagagaaaagtagaagtgtcttgcatgtagaagtcggtatgagttggaaatg

SEQ ID NO: 11970 - DNA, 3000 bp, Unknown; identical to SEQ ID NO: 11968
  misc_feature (1)..( 3000): cDNA_ID_2711378_gDNA_ID_2214525_Annot_ID_184723 3000 nt of promoter + ATG

SEQ ID NO: 11971 - DNA, 3000 bp, Unknown
  misc_feature (1)..( 3000): cDNA_ID_2708012_gDNA_ID_2214525_Annot_ID_134145 3000 nt of promoter + ATG
ccttgggatagagacgattatcactggaactagtagatccaacgttccattaaacgccttctgggcgctggaacgtctgggatcggattccagttgatcagaaaggaataagcagtaaacacaactaatccacaagggattcaaaaaatctacacttaaccaacagattcgaccaggggttccacaactactctatcccatcctcagaaatcctaatcactactcagacaacatgcttaaagacaataacatataaacgaaagatgaacaagcaaaatgaaagcaaattctgaataacttagaagaaaaatcgaaatacaaagttgtaggaatgaaaagcggctgctgaataatggtgcgaaattcgtgtctctaaagtgcatgtctcagggcgaaacccttagagacttatttatactaagataagatagcgggcttcgagcccacttacggcccatggacagtgtgatcaagagtgtcggctcaaagtgggcttcctgatgggcttcgaatgggcttcgaatgggccttctcttctcttctctttccgatgctcaggttgtctggttgagtgcggattgatcaaagggtcgagctggtggtcgagtaggttggttgacagaatggtccgggctgcttcttgccctctgtgatcgagtaagtgtgtcagctgtcaggatggactggttcttctcctctgcgatcgagtataactggtggactggcaaagtggactgcctggtcgcctctgcgatagagtagaattgcagaatggactgcctcctctcctctgcggtcgagtatatctggcagaatggactgcctggtctcgtctatgatcgagtagaagtgtctagatggactgctgagctgactgcttccctctctgctactggtgatcgagtatgtttggtggaagtgtgactttctgttctgttttccctctttctgagcaccaatagctccaaaacacctgaaacaactccaaaatgcagaatgtatgcaagactagtcctagactcgactaaagatgcaaaatgtacaaaaatgatggtgaatgctatgaaagatggatgaaactagactcaaaatggtgataaaaggatgtgtaaaacatgcaaattataaacttatcaattctctaaaaaatactaacatacaatgacgaatatacccccgtattattgcaaaatttcgaaatggatggactagcaaatggaatgttaaataaaaaatggattagtgaatgaaactttataattctgatacttttttgtaattaatggaattcgccaatgtgcaactccaaattttgaatttttcattcacacgtagaaacgtttatgagtttttaaatagttagcaaaaaaaattttggactatcacacaaaatacttcaaaatcttatggaatttgacatcaaatatcactaaatgatcactaacttttttttcaatgaccacttaaattttgttttatttcttctaaaaatccaccaaatcactagccgtcttttaaaatctctccaaatctaaaatccacaaaatcttacaaaatactaagttcaatacacccttttttgtgataagtgtaaaacacacaaaagaaaacatatataaatggataatggatgggaacataaaagtccacattatttatatattaattttttaactcctctcaaaataaagtacataatttattattcaatcgatgaatttaatttgattatcttaatttggagttacaaataacaagactatcaagaagaaataacaagtttgccattgagttaaaaaatttctgtaatgaaaaaaactcgtttcaaaacgcgcggatccttttgacccggattttaaaataatgggtcataacttctaatcttagtcatccattacatttcatagtagccattgactttttcagtaaaaatcaaattatacagccagattttgggaagaaaaagctttcttttttttttaattaatttattttcttattcaataccattcataattacgtgggtttcaaattagaaaactaattatactcctatactatagggatttataatacttattatattttaaaatattacttatccaatcacattatcacctttcaataaatattttttatgtagatattaaaatatcaaacaaaaactttacttaacaaaaaccagatatgttgttttttaaatgtaacatatgtttttaattagaaatattgtaccggattattcttattgttttttcaaaaaaccttaaatgctaactaattcaatttgttcacgaagttttcatttagttttttagtatttgtcaaagtttcaaaactaaatagtaaataaattataaaataacaactaatatttaaatagtaataaagagataacaaacgatgattacagtaataatataatattattatatttcttaaatatttttgtataattaaaatagataaatattatcaaaactgatttagcatttatgatttctttgagatatttaggaaatatttttaaatattacaatcataaaataattaattatcataaactttggttttaaatcaaatcgttaaacaatcattcaaagaaattgattttaaaaagaaacaaatggttttaattaggaaagttggtgtaaaaattgattaaataaagaaagaaaataacagtattttctttaagactctaccgaattagctctgtagttataactcaatcattaacaaatcttaaaatcttttttagaaagctgtttccataattcaatcgaaaagattgaaaaggcgatgtcgatagaaaaccctagcgccgctagggtcgtgaatccaggagatctcgatgagcacatggaggagaacggccggccgccgggagggggtttaacggggtcgccgtagtgggtcgataaggttcaaagttgctactgtggaggaattccaattcctgagacgagattgagtgcagagtttgtggcttcgaggatg

SEQ ID NO: 11972 - DNA, 3000 bp, Unknown
  misc_feature (1)..( 3000): cDNA_ID_2711370_gDNA_ID_2214525_Annot_ID_134147 3000 nt of promoter + ATG
aattataaagactaagtgttgtgttgaatctagttatttcggttaaaattcttttcttatcaattacaaaaacatataattgtacctagtgttacaaaacataagtagatataccaaaataaaacaatagaacatgaaacagttataccaagttttgaaattaacataagtagatatacaaaaaacctaataaacatgttcaacagttgtaccaagttttcaaaagcataaggagaaatacaaaaaaaaaccaagtaccaagttcgaacagatgtaccaagttttcaacaaccaacatagttatacctaaaacaaaccaagagttgaaattgtttaaacattcttctttgtcttttttctcctatacctcgtctgtataggactccgatacaccggcttagcatccgtcctcgactctgccagcttcttgaccacctttggctttttaactccctctttactaggatcatctccatcctcatgtgcctttcctcgcttcttacttggctcagccaccttagcatcttgaggcacctctttctccttctcactatcagccacctctatgtccttctcactttcaggcaccccaatctcacttggctcagccacctctttctccttctctccatccatctcatcatcttgaggcacctctttgtccttctctccatccatctctccatcactctcagccaccttacctccatccatctcatcatcttgaggcacctctttgtccttctcactttcagccaccccaatctcactttcagccacctctttctccttctcactttcagccaccactttgtccttctcactttcagccacctccttatcactgtcaccttgagccacctctttgtctatctgagtctctgtttctccaacctctctctccttatcaccttgagccacctctttgtctatctcagtctctgcatcactcccttcctccagctcgttttctttatcatcaatctcctttgaaccacaagcgtcttcagttccaatgcctgattgaattgatttgattgcagcttccatcagtttcagtcttttatcttgctcttcatacttcttacagaaatctttcatcctcttgttcatggacttaaatccattctccatcaaattcttcatttcgtttacaacctcagtcaaacctccatcacttggactagtcagagctgcagcagcctttcccttgcctttcttttccactgcggcttttcttggagcttttaccacagtagacaaagctttattagccacaaagctccggtgtgctacatcttcattgagcaacggttcaaaacatatagtcctctcctcatcaactagacgtttcttccagccatcagctattagatcatcgacatcattcacttcacactccttatccataattctttccaaaagtagcttctcatcaggagttgaagccaagatactctgaatgtcctgtgcatgataagaaagtccaattaatataacatacatgatagaacatacatgatacatgatagataactaataaatatgtcatcactaaccttagttgtaccgagtttgtcatacacatctgacattggaaaccctttcatagtgcttgatttaaacttccttttacacatccgggaacactgaggatctgcggattcaatatcttcgcaaaaaatttttctgagaactgggatcgcctcaaatgctagatactacaaaaaaacaatacaagatttttcaaaaactaataagtataactgctaataaaaacacagttgtacatagtttaactttcttaaaacaattcataaatgcataatgaaatgacatacctccaaaggcataacaaaactaggaaacaccttttgtggaccaactacttcattgcactttttaatcaaatagaaaatgtctttcacattttcttcaaatgcaaatcttccccacggaaatgttttgcacaactctagatcagccacagccctaaggaagaacttctccacatagatatacctaatttatacatagatatattgtttagtctctaaaatatctaagttatattcgaacatagatatacctagtttttagtttcgaaaatttctaagttagattcaaaaaagatatactcaatttatgcatagatatactaatttatacatagatatactttttaaaatttctaagttacaatatcaataaagatataccaaattcatacatagttatacttttctaattgtgtaaagtttaaagttcatatcgctctatcgtcgttagagattgaatttgttgcttcagaatccacttcagcagccgatgctactactacttcgtcattgattgtctgtgaaaccaccacctctgccgccaatggcacacctgcgttctttgttcgagccatttctccaaacctacaaacaaaatcatttggattagcactactcttcagtcaatttcgatcacaaaacccaatctgaaacaactcggatcgacgaacaattaaatcacttacccaatttcttagtttcctgtagatataccaagatcgacgaacagttatgttgttgtcgttgacgagaattgagaatggttttactggattttacagtgacgaaataaggaagaaacaaaaaacaaagggaagaaagagatgtgaatcaattttaccgcagagaattaggggaattagggttttatttggatttgacccgaaaacagtgggcttgggttattttgggatccatttgccctggttgggtcgtaattaatcaatattcttagagttttctgagtactttttttacggaataaaaaaaatcaaaaagaaaatgctctttataagaagagtgtatgagattactcttcagccaagaggagcccctgagaatttgtttcgctgtaaccaccgcgaaacgtcgccggctgttctcttaatcttcttaggagagcctacttccaatcaatcacttcacagtatcccactcgatg

SEQ ID NO: 11973 - DNA, 3000 bp, Unknown
  misc_feature (1)..( 3000): cDNA_ID_1808251_gDNA_ID_2214526_Annot_ID_134150 3000 nt of promoter + ATG
aattattctatattcaatgtttgtcgtttatggatttgcaaacatttacaagatcatgcacacaacacaacacgtaactataagcaataaataaaacaagattcagatttaagataattaatcgtttttagaggaacggaggaaagaacatgtgaaaacaactatgagaagaaaactcagtactatcgatgatactaccatcaccaagcttgaacatcttaacagcttcatcattcattccatcattacaatattctccatcattatcatcgaagtagatataattcttcaaaagtccatggtactcggaactctcatcatcatgcttgataaattgatcagcttctgcgccactctgatacgttcatgagaagttggcacgtgtgagaactgaagtgagagattggagtcacgtgtgaagaagattataaatagtaagagagagtagagagaaaagcatcctgcgtgatcattgatgtgtaaagaggattagagctttatgtgctctgttcttgggagataagattggagaactgtaactccaagcttatcgatttagggtttgtttcattgtaattgggattttaaggataagaaagagaaattcatagtttcattcttatcacactctttcgcacattatcaacgaagtagatagaattgttcaaacatccatggtactcggaggctacaacagtaaaacaactgtccctagccacaatgagtgccttgtctcccaaggacctaacctcaacccattttgccacatactcgtccatcttataaaccttaaaaccaactgtcctttgactccttcggatataagctttctttaagcgaagttgatgaataatgcatagatctccacaatactcaacgagtctcttgttgcaactatcatatccgtcgtagtccattggaattgaaggtgtgaattgaaggaggctgagcggtgataaactaatccaccaaattgcgccggttaggtctaaggcatagacttgtcctttatgaagtataatgtccaagaaatcttcaacttggtttttgatttttgtccatattctactactctcttctccactcttgcagcaccagattttgtcatcctgtccgactgcgaaaatcagattgtctaggaaaacaactctagacaatatatgtgatggtccttctttacctatcacgccttgtattaaatacttatcaaatatatgaatctcgtaagattggcgaatctctgaaacctcaaatttcaaaaggtctagggtttgttgtgaaggggttaggagctggcgaaagaaaggagacaagagattaatcttactggattcagagacttgtttggttctgatcagccatcctttgtaagaacatgaagaagggccagttacacggaagaaagtggtgggagagagaacagtctctatcatcttgttggaggaaggaaggttgcattgaaagctcttcggtgtcgcagccgccgaacgccagggtttacagatgctacgtacacggaggacgtcactaatggaggagaaacggtttgcggttaaattgatgaggtctccaggtaattcagaccactcaggtttttccatctttgaatcaatcgacgatgtgagagcgtgatcaacatcggctcgccctctctgttataactccatatatatacacaacaaaacttaaaccctagatacttgaggacttacgtgggctggactagaatccatccaattcctagttggattttcgattagctattatcacgtgagtaatatctgcattacatgtattgacttagtattattgttggagcaatgttttttttttgttaaaaattattattggagcaatgttttgtttttgttaaaaattatttgagcaaaccaaaaaatcgcagaatgaattataaaacagttcgtatttcgatgaaatttcgtctctccctctcaatagctttggtgcaaattaatacccttactacatacatgtcaacttaactctaattctaacaaatagaacagaaaatctggagagagaaaaaaaacgtaactagatgaaagaaaagaaaaaaaaaaagacttcaaaatttgtataaaaatatagaaatgttgaacaaaaattattaactctaaaccaaaaattaagacaatgatctaatattctaatatcatgaatcatgatagaaaaggaacacctaactccataaatgatggtcatgcaatgatcaaatttctcctttatcaattattggtttatattccaatgtccaaactcgaaagtcgaaacaatctcctccatatatagccatttctttccctaacccattaaaatacaaaactaaagaaccatcaataattttttcaactgaaaaaggaagaacaatttgtgatccaaaataaaagagagaaaaaaaaaagtggagaaaggagaccaaaagtagaagcgtggtttactccaattgacggtaaacccctttgacaagtagaggcacttgatagtagtgtaacaaaagtacaacgatgggtgaagattggtcaaacatcaaaaggaccccatactcaaaagatagtattctgtttatttataatcatatatttacaaaaaactaacattcagaatataaaaatattagaatatgtaaattttgcaaacatagaggagtattaaatatagttaaatagtttcgaattaaacactaaataattaaatgttgacaagaaaaaaaaacataaaaattaatacggattccgtgcgttacaataacttagcaatattactctctagtagagatgagaacttgagtacttgactaataatttcaacgcatgttgtcttcttgcgaaatagtcccacgctattctaaaggtgggctagtggaaagagtgtagaacccacttttcaaaagcacatcaactactatataaattaatgaaccacctaacaaacaaacccacacattaaactaaagaagagagaactttagaggttagagag

SEQ ID NO: 11974 - DNA, 3000 bp, Unknown
  misc_feature (1)..( 3000): cDNA_ID_2708018_gDNA_ID_2214526_Annot_ID_184750 3000 nt of promoter + ATG
gcatctcgctcatacttgtctgagagataaaggaacaagcttgcaaaaattcatacttggcaatatagatatcaaaatcagcttaaagatgtaaactttgagaacctcgccaaaagggagaaacaccagcattagccgtcggataaatctgcagcttctcaatcggtttttgcggttcttctatgattttcaagccagaagacattatttattaccacacgccgtatcttcataagaacaaaaaaaaaaatcatgaatttgagtaaattagagaagacccaagtaactcaaaaagtagaaaaaggaagactaacctgtgttcgtcgacgttaaacgctctggttcttcttccctgagaaaaaatctgaagaagatttttagagttttgtttaagacattaagctgcagggttttaagttggtcggcccagtcgtggttgggccaatgtggacttatagtctgaatgaataaaacaaatttttaaccttaatatatgctttgaatatacaaaacatctcctgatgttgtaaccgcaatgtgtttgtaccatgttgctgttacatatatggtaccacttaaaggagttaatttggcggacgaaatttttgtaataaactatcattgaagtacacttccttgaaaccttttttagacaaatccaggtttggcaattcattagacgttaagacataaagactctcacctcggaggatatggtagcctttcaaggatatggtagttttggtattcctaaatccaaagtgcaatatgtcaaaacggagcctatcatctcttcactcataattaacaataataatggctaatttaggggatataaactattttggccagaagaatagattgatttgatggaaacagattgtacagagttgataacggtgacaatactgcgtggataatcgtttaatagcaattagacaacagtcaacacacccaaaccacatcaattacattgcacacgacaaatgacagatatatcagaccaaaccgtatttaattatatccaaaatcttatataaaattgtgattatcacaaagaaccaagatttgtacggtgtcgacacaaaacaaagaagagaaacaaaaactatttcaaacatgtcccgactaatcttcgttcgctcatatgcaattatgcacgtgtctacacatgcgaataatttgttcaaatatttccttttgtcatctacacctaccacatgtaatttaagacctcactagctgtgattttgatatttaagaatataccacatacagttttaaactaaatatttgatatgaatgaactactaatgcaaagttgcaaactaccgctaacaatcaaactcctattaagttatgttttcaaaacaggttcattgctttaatgaacgtcactaattcaaacctaagtaaaaaacttaacttttgtgtgagtatctacttgcagcaaataattactttttgttttgacaatatgttcttttggagtttttctcaatattttgcaaagagttggagtctaactctctgcttaaaaatcctacggagatgattacacctcttgcactatttatacatatccttcaaagttttttgaagtctaaattctctttacacgacatagacaaactttcttactttggatggtgaaaaaatctggttaacataccaaaagagtggtgcaatagtggttactattattaacgtcatttcacgatattgtaactagctagttcaacagttaaaggtaaatttatatcattttttttggggacaaagtaaatatatagtatcattgtttcaataatttctgcattaatatatatatccacagcattaatatatttttcataatgtcatggtagataagatttgctcgaaaaacgaccctactgaattaacaattttttttgtttatttgtcaacaatattttttttttcctgaattaataagtttctgtgaagctaccttcttcttactgagcgtctcctgtgggttcccatatacactgttttctatcacacactttgttgtttacttgtatgtattggaatggttcataaactccataaaccaaaagaatcgggtccaattttttttccaatatctaaataaattttactctataaccaaaataaccaaaattgaactaaaggaatttcgatatcattacacattacattttaaattctataaccaaaaaaaaaacgaaaaatatataaaagactaataaattgtccctacttttctaaatgaataagtttcggtgaagctacctttattacccagcgtctcctatgggttcccttattacactgttctgttctctatcacacacacactttgttacttgtctctatatatcattttaaaattaatatctttttttttcagacacaccatctttgaatcttcttcactcaaagctttgtcatattcaacgaagactttctttaaacaaaacttttaccgcatttaatactcgtcaactacacacacacacactatacatttattcagcttgtgttgtgtatatatattgtgttattcctcaacttggttgttgtattcaatttctcattcctccttaagttttctctacacaagaagatagagataaagacttgacctttttcaagtcttccttggtgttaatactctgcaaattcttgaggtatgtctctgattcttacatgggtcgattataaaagatgaataaaatcataaagtctccacctttatggagttattctgaatgtgtttgttgaaatgtctgaatgagattagatttttatccatcgtcggctataataaatgtgtttggtggtgatgataggaatgactcagtaaacaaattaatatattaatgatagttggcttagagaaaaaagattcgtttgtcaaagtttttgatattgatctgaatttgatacgtgtgcagggtagtttggaggaagagatcgtgtttaatattgttgtttaatcagagaaagatg

SEQ ID NO: 11975 - DNA, 3000 bp, Unknown; identical to SEQ ID NO: 11974
  misc_feature (1)..( 3000): cDNA_ID_2708018_gDNA_ID_2214526_Annot_ID_134152 3000 nt of promoter + ATG

SEQ ID NO: 11976 - DNA, 3000 bp, Unknown
  misc_feature (1)..( 3000): cDNA_ID_2708022_gDNA_ID_2214526_Annot_ID_134153 3000 nt of promoter + ATG
cagcttgaaccacattactaataaaaaagatagaggaccatcaagtgactcaccagagctcctcaacaacaaccgcgcaatccgctaagttccttcttgttctgtaactcttgtacaccttctgtaacgtagttgcagctgcatcaagctcggtgaccggtcttggagagaagaacacaaaaggcgtaggtggagtaatagtaggcttcgttatttggattctctcacagttccttccattcaaactgttacgagcaggcttcgtcggttcaacaatctcctcatcttccttgttcatcggttcagtctcaacttctgtcacaatctcccagctgttgaagctcaaagaccgctccatacccgtcttcggagacttttcctgcgggttctcactcttgaaactgttggttcttgaagtcaagcctccttctttaagttttaagctgaaagatctggtttcaagaaaactctcgacagggttcttgaaactgaagaactgggtcgtcacaacttctttccaagcagacaagagcaaagaaagagaaagacccatctttctctgattaaacaacaatattaaacacgatctcttcctccaaactaccctgcacacgtatcaaattcagatcaatatcaaaaactttgacaaacgaatcttttttctctaagccaactatcattaatatattaatttgtttactgagtcattcctatcatcaccaccaaacacatttattatagccgacgatggataaaaatctaatctcattcagacatttcaacaaacacattcagaataactccataaaggtggagactttatgattttattcatcttttataatcgacccatgtaagaatcagagacatacctcaagaatttgcagagtattaacaccaaggaagacttgaaaaaggtcaagtctttatctctatcttcttgtgtagagaaaacttaaggaggaatgagaaattgaatacaacaaccaagttgaggaataacacaatatatatacacaacacaagctgaataaatgtatagtgtgtgtgtgtgtagttgacgagtattaaatgcggtaaaagttttgtttaaagaaagtcttcgttgaatatgacaaagctttgagtgaagaagattcaaagatggtgtgtctgaaaaaaaaagatattaattttaaaatgatatatagagacaagtaacaaagtgtgtgtgtgatagagaacagaacagtgtaataagggaacccataggagacgctgggtaataaaggtagcttcaccgaaacttattcatttagaaaagtagggacaatttattagtcttttatatatttttcgttttttttttggttatagaatttaaaatgtaatgtgtaatgatatcgaaattcctttagttcaattttggttattttggttatagagtaaaatttatttagatattggaaaaaaaattggacccgattcttttggtttatggagtttatgaaccattccaatacatacaagtaaacaacaaagtgtgtgatagaaaacagtgtatatgggaacccacaggagacgctcagtaagaagaaggtagcttcacagaaacttattaattcaggaaaaaaaaaatattgttgacaaataaacaaaaaaaattgttaattcagtagggtcgtttttcgagcaaatcttatctaccatgacattatgaaaaatatattaatgctgtggatatatatattaatgcagaaattattgaaacaatgatactatatatttactttgtccccaaaaaaaatgatataaatttacctttaactgttgaactagctagttacaatatcgtgaaatgacgttaataatagtaaccactattgcaccactcttttggtatgttaaccagattttttcaccatccaaagtaagaaagtttgtctatgtcgtgtaaagagaatttagacttcaaaaaactttgaaggatatgtataaatagtgcaagaggtgtaatcatctccgtaggatttttaagcagagagttagactccaactctttgcaaaatattgagaaaaactccaaaagaacatattgtcaaaacaaaaagtaattatttgctgcaagtagatactcacacaaaagttaagttttttacttaggtttgaattagtgacgttcattaaagcaatgaacctgttttgaaaacataacttaataggagtttgattgttagcggtagtttgcaactttgcattagtagttcattcatatcaaatatttagtttaaaactgtatgtggtatattcttaaatatcaaaatcacagctagtgaggtcttaaattacatgtggtaggtgtagatgacaaaaggaaatatttgaacaaattattcgcatgtgtagacacgtgcataattgcatatgagcgaacgaagattagtcgggacatgtttgaaatagtttttgtttctcttctttgttttgtgtcgacaccgtacaaatcttggttctttgtgataatcacaattttatataagattttggatataattaaatacggtttggtctgatatatctgtcatttgtcgtgtgcaatgtaattgatgtggtttgggtgtgttgactgttgtctaattgctattaaacgattatccacgcagtattgtcaccgttatcaactctgtacaatctgtttccatcaaatcaatctattcttctggccaaaatagtttatatcccctaaattagccattattattgttaattatgagtgaagagatgataggctccgttttgacatattgcactttggatttaggaataccaaaactaccatatccttgaaaggctaccatatcctccgaggtgagagtctttatgtcttaacgtctaatgaattgccaaacctggatttgtctaaaaaaggtttcaaggaagtgtacttcaatgatagtttattacaaaaatttcgtccgccaaattaactcctttaagtggtaccatatatgtaacagcaac

SEQ ID NO: 11977 - DNA, 3000 bp, Unknown
  misc_feature (1)..( 3000): cDNA_ID_2708026_gDNA_ID_2214526_Annot_ID_134154 3000 nt of promoter + ATG
tttcagccaaatgggtgtatcctcttccgtgactatgctgtcggtgatcttgctcaggtttgatccaccttttattacttcagaaattcaaagttatcgctactcgtatgcccattttgatgcacttgaaacgaaaaaatatttctactacagtttcatgcttaaaaaaaaacattgtggtctggctttccttttaggaagaacaaccacttcttaagagatttagtatcctttagaatacgaaggcgtggttaccccttatgtgtttcagtatttcatcaacaggagaggttctctgggaaggatcagaggatcagcgagaacttttatgtgagaggtgatggcactgtaagttctttctttctcctgcgctatttatttgcagtacacatttctataattttgcagatctgtgatgattttgttttctatgcagcgtgcattctacttttctaatgaattcctagaaactttgttttctgaacaaggatttgaagttgaggagcttgatgtttgctgcaaacaagttgagaatcgttcacgcgaactggtcatgaatcggcgctgggtccaagctacatttcgtcgaacaaatggcaacaaaaacccttgtgatagtttgactcctgccaaattagataaatctgaacaacaggatagcattcagtctaaatctgaggagcaggaaagaaaagagattattgattacactgacattgacatatctgatggtctggctatggaaatgtttggagcctccccatcaagtcatgaggtaagagacttcggtaatctcattgtttttacatattttctcgaagagtatttttaatttaattctatgcttacaagtccatatctgtttttctattcgatttgttgtcatagatgagcgtggttaagcttagggattctgcttttaaaatcaaacttttgtcaaaagaatatcaacatacttgcaaatctacggggttgatgctctgggagtctgctcggcttatggcttctgttcttgacaggaacccaaacattgtttctggaaaacgggtgttggaattgggttgtggctgcacaggaatttgctcgatggtagctgccagatcagctaaccttgtggtagcaaccgatgcagacacaaaggcacttacgctattgacagagaacatcacaatgaacctccaatcttctttacttggaaaactgaaaacaagcgtacttgaatggggaaacaaagagcatatagaaagcattaagcgtttggcttgtgagggattcgaagttatcatggggacagatgttacctatgtagctgaagccattatacctttatttgaaaccgcaaaagagttgatcttacggaaaatgggagacgacttagaggtgcaagagaagccggcgttgattctatgccatgttttcagaagggttgatgaaccttctcttctgtcagctgcatctaagtttgggtttaagcttgcagacagatgggctgcaaattcaaaggaatctcctattgggaacatcattgacagttggttttccgaaaaggatttggtcgcagaaatcccgagttctgcgttgcatattctctattttcagatggagtaactatgtggtagaggagcaaatgttgattaactggagagttcttttatattaaaaaatcctcattgaatctcaaatcaatgaatgtcctacatgtattcttctatattagcaatggattttttgggtataaaactattacatgatgatgacttgttgttaccagccttccttatcatccatttccctcacgattttgacatttttaatggctttatgagagttgaatccacatgttaactcggtcctgcagaaacactttcccttttatgacttggattttgttggcatgttagtttagtcagtctccccctcatctaattccatcaccactttccctcattctttgccacacaaaagttgtccaaatgttcacatttccttctacatgagcaccgccatggataggtgaattatacatttacatctcctcttgtgggtttagcttgaatcataatgttttggagagttcttgtgatagattcacttccacaaaaaacctttgcttcttcaaaattactacataactccatgacataaaaaaattactaaaaacattattaattttatttttatattttttacacattgaccaaaaaataacatgttatgaaaactgaaatgataaaaatatgaagaatagtataggttttttatggtaagagaagtttagttagtgaattttttttttttttttttttgtattctcaaaatataaatagattcttattttatttcttttttcgtgtccttaaatatttatctgaatttttaattaataaacgacgatcaaaatagttctcaatcagttggatcatctttttattcctaaataaataaactccaaaagcatctctctgtttcttctcctctcttcaagctttttgtttcgtctcagtcgtcgtcatcatctctgacaggtgaattgaataatattccactttcattattccttcttcttctttatagcttttccacatgaatttttgtgtttgtgcttgtagatctaaggttttgtccagtttccggagtaattgaaatttgcagagaaagaaaaatccaatttttgttcattttggaaaaaatctgaattagactgattgatagtacacattttttagaaattttggagaaacccatgtatagtaagctacaaaatgatcaattatactcagatcatttcagatatataatgagaaatggtagattaatcattgttatttgttaggttgattcaaataaacattagaagctatttgatgaatctgtctatgtctacttgtggcagcaaggttattcacataggcaaagaagtcattcttttgcatgctgttttccaataaagttaattctctaacagaacaagtttcgagattggatattgacgacaacgat

SEQ ID NO: 11978 - DNA, 3000 bp, Unknown
  misc_feature (1)..( 3000): cDNA_ID_2993656_gDNA_ID_2214526_Annot_ID_134157 3000 nt of promoter + ATG
gtgtttcgtttgtggattttgttttctcatgatttttaaaatcccatgtttacacgatcataacgtttcgtcaattttaaaacgataactctataagtaatagcgtgtaccttcatcgtatttctttcgacgtcgtaattatgatcaccattcaccattttccttcttttttctttttagggtatataacgcaactatataaagcacacgtacttaaagaaacccatttgggcatgtgttgtccttgctgtggatcacatgcataagtctgctttttctttttaatatgaattgtttttgacttcatatataggaccaattcaaacatttatatttaaagaatattttactcagtattattactttcttttgtaatgatttacaattttgtgccactcgtatgtatagcgttttaaagaggttacttaccagtagtttttgtccaaattttatatgtgaaataacccttctcggaaggctaccacatttccattaaattattggaaaacttttacaaaatgtgacaattcgatcggaaggctactatctcataggtattgaggcaggatagtcactaagttaatgattctgcatcggtcacaaacgtggtgatcgacgtgaaaagattgagccctcgcaaaagtgagatggtgctttgtcaaacttttgcgataagtgatcatgataattacaaattaaacttcatttttgccgtttatgtgtcacttaaaattatgttttattttagttttcttaaatgaaaaaagagagtttatatatatatatatatatatatgaatcaaaatgttagttagtggatcttttgattctgaaaaattgttggatatttgtttcctcgcttaaattggtatttatagtagagtttgaatcgaggatttgaataggttcaagaattattttaccctttggaagcgtcatctcgctttgagttctactacgatgttatggttagactcccacggtgggagttcccatttactcttaaatgcaactgaacgggctttactatttgatgcaatgatacaaagaaccttcagatttaaacaatgagacgatcgcaacacaagagaataatgttactgatccttctacaacaaacactgcaccaaggcctagtttgcttgattgaatgaagtatacaaagcatagacacttatcacatttaaagtatttgtaatatggcaatttcgtatgtgttaacacatttctcaaattttaaaaatcgtttatatggatcttataaaatatggtagtaataatttaggtgggggattgggtcattatttatttctcttctattttgctactgcattaactaatattaggctaaaagttccttaaataataaagcttttttatgcgtaatgtagccgccctcatttatataggtctcaccaccaatcgattaattgtaagtaacagaaattgttgattatagttaaatgagtcgttgataatttgtttaaatttgtaaactcttcaggcaaaatttatattatgtgaacaaaattgccatatatttcatatcatgaatgaatttggtctaaacatactccatactgtcaaggtttaaaaaacattatattcatacaatcataccatgaatgaatttgtgtaaagctgtaaactcttcttgcatcctagctattttcctcttcttcttttttctttttctgactagtcatatagattttttttttgatttttatttgatcgttggagaatcttcaaaagatgactccactcatcttttcaaaaactacctagaccatatacagggctctccgtctacaacaattagcgtccggaaaacgtaaagaagtctacaacaattagcgtcctcgtggatcagtatcgtgacatttgtgtcatggaacctatccttggcagtcgaagttaggctcactcccaacggtctaacttctaagtgctcactaaaatatgaaaaactaatgttctcgaacaaacaccacctataatgactcaaccctccataaaattcgaaaactgatcttaaacaaaaatatatataagtgacgtaaaacataaatttatgtatatctattaaataataaattagtgaagtaaaacataaacttaatcgcataaaagtttaactttattttgcttctcaatagattttgactacataatagacgtggattttagtcaaacacaagcgatattgcaaaatttccgatatatatatatacacgtctttttcactaatagaaaagtaaacatatcagctcatcttttctctattggcagttctcatcatcttaattgaaaatttatgtttccactttttttagcttagatacaaactcaactttgtaaaagattttcttgttgcatattaaattttacatcacaacaaaaagaaaaaaagaaataaacaaaggagatcaaataggttgtacataaattaagcaatcatacaacatcaaatcaacagctaaaaagttcagtacaatctttacttccgaatttacttcattgtcttgacatcatgttctaaacaaaaaccaaaccaaagttctccacaaacctgtcggtttttaaccaaaccaaagttactagcttaattcaaaaaaaaaaaaaaacagaactgattcagaaaccccaaattgacaaattgtcaaattgtcaaaaagtggtcatctttatcctttgacatctggttagtataaaaaattgtaataaatgcaaacataagatccaaaactacaccttattagaacggaggaattaagagtgacataactcactccaactacgaccagtacaagtagttggcgacattaactacctctcaccaaccaccaaacccaatccccacaatattaccattactctcatataactacacatattcatatttacattttttgccaacacaactccttataagatatacacttcatcaacctatagatctcactcacataatcaacctacaaaacaaaaacaagaatg

SEQ ID NO: 11979 - DNA, 3000 bp, Unknown
  misc_feature (1)..( 3000): cDNA_ID_2708030_gDNA_ID_2214526_Annot_ID_134158 3000 nt of promoter + ATG
atccactaactaacattttgattcatatatatatatatatatatataaactctcttttttcatttaagaaaactaaaataaaacataattttaagtgacacataaacggcaaaaatgaagtttaatttgtaattatcatgatcacttatcgcaaaagtttgacaaagcaccatctcacttttgcgagggctcaatcttttcacgtcgatcaccacgtttgtgaccgatgcagaatcattaacttagtgactatcctgcctcaatacctatgagatagtagccttccgatcgaattgtcacattttgtaaaagttttccaataatttaatggaaatgtggtagccttccgagaagggttatttcacatataaaatttggacaaaaactactggtaagtaacctctttaaaacgctatacatacgagtggcacaaaattgtaaatcattacaaaagaaagtaataatactgagtaaaatattctttaaatataaatgtttgaattggtcctatatatgaagtcaaaaacaattcatattaaaaagaaaaagcagacttatgcatgtgatccacagcaaggacaacacatgcccaaatgggtttctttaagtacgtgtgctttatatagttgcgttatataccctaaaaagaaaaaagaaggaaaatggtgaatggtgatcataattacgacgtcgaaagaaatacgatgaaggtacacgctattacttatagagttatcgttttaaaattgacgaaacgttatgatcgtgtaaacatgggattttaaaaatcatgagaaaacaaaatccacaaacgaaacacgacatcatatatatattctaaatatgtagtattgatatgtgatcaaaacattgttaggttaaacttgaaaaggaaaaaaagttgctgttaaaagaagttgctaagacgtatgggaaattagtaatgttgacaagagaggtatggatgttgaaatgtttatgatgatatctaacttatggctgtcttctttaatgagtcaaatggctgatgcattttacgggaagtagttgaagcaaccccttataccattattgcacattattattatttccctctctcttttttgtattgtttttaaataaaaaaaaacaatttcagatcggttaggtccttttggaccatgaattttgtaggccataaaaaaataaaaaatagaagtccaaaacaaatgaagcagtgaataaactttaccaaaataagatccaaacacgtacgtgcatgcttgaatttgttcataaatgactgaagatttttcatttgattgactaaatattgtttttacttctttgcctttttttcttttataggttttgccaagaaaccaaaagcataggtaatgaacatggaaatccgaaccatcttcatcttatatgatacatactcatttagcaaagaaaaataattaaaggatttagtttttggttgtcacaaaaaagctttgtttcaagaactctgtcattgcgcttatatcaggaaagaaacttgaacaaaaaaaaagagctttgtttcaagaagaagggtctatactctatagtctatatatagtgcaacagaaaatgatcacgtgaggttgtagatataagagaagattatcgaaccaatcttctaagacaatttcagacttaatagttaatactagtagttttcttatatatacaaccaaaaagaaacggtttaagaagtgaaatataaaaaaactatccaatcttatccaacgagtcatggttctaaactcccgttgacttacataccataaccacagtcaaccctaagataaagatggctaaaatatgaaataattgtggcccttcttattattatatcaaatataaattcacaaaaattcaatggatgaggatgatagaactgggtttaacatgggcttccaacctaaaaccaattgacaataggtggagtggtccgaaccttctatatatcacttgataattcctccaatttttgatgtggaactttctttcattaacaaaggatacaaaagaaaacctctcataagcgacaatattaaataggatttagttatttagcaaaaaaagtagaactttagttatagtattttcataacaattttcttattatttaaccgcttgttaccaatcataacaaaaacaaaaacgtgatggatagttataagatgatgaaattgaagaactctgaaagagaggttcatgcttcgacacacaaatctcgtcaagttttgtgacttcgtctagaaacgaagattaccttataatctagctttttattctaattttttttgcattcatggttataaatggaagggatttgatgaaattagatgggattggagatggagaaggatggaggcacctgaagagagaagaacaattgttaaaactataagaaattaaagaataaaaagataaaagagtatcatgaagagtgaagaagaaacaatggtcataaaactatatttgcgattatttatgcaactttatatattttttattttttttaatcttttaatttattttatattactattgtaatgagattttacttataacaaaaaaaaatatttttactattcgacttcttgttacaacttaaccattttcattatgaccaaaaacacactttcacaaaaactttgaacaattttcatttctttttgttacaaacccctccaaaaccaatcttaaaacagttttcatttacataaaccttgagattaaatcacattaaaaatcccaaatcatatgggtttaaacttaaacagaatcttataaaaattcgaaagcccaatatgttttgttttcccaacaataaaaatagattggaacagaaaggttgtgggaggcacacattacacaccaaagcagtgttttctttctcctgaaaagatttttcaagctctctctttctctcaaaggtaaatgcttctctgatttcgccatttttgcttactcgattcaaaagac

SEQ ID NO: 11980 - DNA, 3000 bp, Unknown
  misc_feature (1)..( 3000): cDNA_ID_2708034_gDNA_ID_2214526_Annot_ID_134159 3000 nt of promoter + ATG
gattgtgttcagtggctagctaccatattaatgtgaagaggcataggatgttagtagaactagacatattttcaaatctaccctggtcttgattcacttgttctgacatgattttgcagttgctgatacacttctctggaaggatttaaagcagactcttattgccatattcattctaattagtatctattataactttgttgcaactgggtctaccgtcgtaactgctctttcgaaggctctattggtagcatctgtatttttgttcctccatggcattctaccagagaaaatgtaagattcctgagatgccaacttttgatagattttcatttatgtgcaatatgaactaccttaacctagttctctaataatggaaaccagaaggtatatgccaaacatttttgaaacactgtgtatcgtactcttcaatcaggaacaagtaatataagcaattgctgtctatttcagtttacgaacaactgaatatagatgcttattttgcagatttggttatacagttgaaaagattcctgcatcgcaatttcacctctcaaaagactcatcacatgacctctcattgtcagtgatctcttcatggaacaccactgtaaaagctttaagatctctttgccaggggaatgattggagcttctttttcaaggtatttttccttgaactagttattgctggcaagttccagtcgtacgatatcttatcccaacctgaaacagaaatagggacaaaattcgattgctgaagttctctttggtaataatattgtaacaccgctttggtgtttttaatgtcataggtggtcttcgttttgttagcattgagtttggctggagccatatctcttcacagcatatttgttataggtacacactcactctctatctagttttactacatgccaacgctacggttgtatgaattatagttcttcaacaataactggttttgttgttctgtttttgttcaacaggactgcccattgccttccttgcttttctcgtgtacgaaaagaaagagcaagagatcgactcaatagtggtgagttttaaatctttcgcatgcaagcacaaatccgatgtgtatgagaaattgttcggaagcaagaaacatgactaaaaaccctttttttgcccagcatttgtaattttcttttgtttccaacgacctctaactctggtttgagcttttttcaagttttattatttgtgaatctcttttttactcatttctattggtctttgtttacatgcttggagaaaaatggatgttgagagatgccctattaagccacaacttttgtcctctaacatgaaagtaagcattgaaaaatcgaatgaatttgtgaaaaaaagaaaggagagaagaaagattcgcaaggttgattcctaaagcacatgtccttagtcccgtgcctttgaatatagaatcaattgatagattatcaaaccacaaaacaactctaatattgaatttaatgacaaaatattagtaaagaccaactttatgaagtggcagcctttttatctacttgttgtaagtctatttctcgaattttcctttccaaatatccaaaatgtaattaatgtaaattgagttaactatattccaatatcattaaaatcatagagacgaatttcataacgaataaagaaaaaattttaagcttcaattttattgttaatattttgttgtacacatgttaaagcgaataatttagcatatgaaattcttacagaaccacgttatattacatatgtaaacaacatatctccgaagtagttcttttgagtttaatttaaagttgttaaaaaataaagattatctgaaaataaataataatacaaaaaattataaaaataaatagaaatgtttaactggatcccatccatctaaaaacagaagcttacaaattaaaatttgtattatcactccacttttattaaaaagccaaaattacaagacttgttataattacaagagttttggtgtaagtaattaataaaaagaagtcgggtcgggtcgggtcaagcccaactatttttgaatcacaagagttatctctcagtctcactagtcacttgcaaagaagcgttgtgtgagagttttgaatagaaagagtagttgtctctcattccccaaatttggaatcacgccgataaagccaaaattagccccacgaaaaagctccgacaaccaaagtaaccatctttttccgaggattcatcacttaaagcaccattttgtccacaatcactcaaccctaaaatctttttctcctttgaatccttttcatgcttcttcttacattccccgatttctttttcctctgagaaagtgatttccttttgattttgattcttttttagtctttctgcaatgattccgtattttgaattaaggatttataaaaaagcagagattggagcttggtttgttgtctatcatcaactatcacaatgggtgctctcagaagaagaaatgttggtttgattgattcaaagggttgttctaagttgtttcctgttttacaatctcctcctcttactactacttcaatgtctcagtccaatggtccattctcttctcttgtcatttgtgtcactggtttatccaaaggtaaagactttgttcctttttcaatctctattaggcagaaagtttgaatttttatgttccatcaatattaaagttttattcttctagactttcagattctgttgttataactttggttttatgtttgtaaatttaaagaatttgttcctcttcaatctccattagtcagaactcagaagtaggatatttatgttaatcaatctttagatttcagatgctgttgtgaatgtgatcttgttgtattcataacattggttttgtgttgtgatatgttaaattgctttgtttctttgcagatgcaagaaaacaagtcaaggaagcgacagagagactcggaggcgagtacactcctcatcttcaccagcg

SEQ ID NO: 11981 - DNA, 3000 bp, Unknown
  misc_feature (1)..( 3000): cDNA_ID_2708038_gDNA_ID_2214526_Annot_ID_134160 3000 nt of promoter + ATG
agtaacaaacatcttgtgaagctgatagggttttgttgtgaagaagagcaaagagttcttgtttatgagtacatgcctcgaggtagcttggagaatcagctctttcgaagtacgtcatctactatatttttacctaacttgctaaaagttgtttcaatttttgctatatatgttctagaccgcgttacaaaacattttttctgtttaaacctaaaagaacaactccacgaagactttaattacgttttagttatagaatgacaagaataaaaaatattgaagaaaagaatccatatggttcacgttaacttcgtcaagttcttactttatttatgggtcgtacactacattaataacttcttaaaaaactatatattttttataatttagataatattcaatagtattactaactttgaaaagtgtgtgaattgggacaggaaatagcttagcaatggcttggggaataaggatgaagatagctctcggagccgccaaaggtttagcttttctccatgaagcagagaaacctgtcatctacagagactttaaaacctctaacatattgttagactccgtgagtttttttttcctttttaaattttgtatccactattaaatcaaattaaagtggtatttctcaactgactctttgatatttcaggactataacgccaaattatctgacttcggtctagccaaagatggacctgaaggcgaacatacgcatgtaactacccgagtgatgggaacacaaggttatgctgcgcccgaatatatcatgactggtaacatttttgtaaggaatttatttcttttaccgtgaagcgatattctttgagatatgtctttaatggtttacatgtgttgtaggtcatttgacgacgatgaatgatgtatacagttttggagtagttttgttagagctgataaccggaaaacggtcaatggacaatacccgaacacggagggaacaaagcctagtggaatgggcgcggcctatgttaagggaccaaagaaagttagagaggataattgacccgaggctcgcgaaccagcacaaaacagaagcggctcaggtagctgcttccctagcatacaagtgtctaagccaacatcctaagtatagacctacaatgtgtgaggtggttaaggtcttagagtctatccaagaagttgatattaggaagcatgatggcaataacaacaaagaaggaaagaagtttgttgatataaataagtttaggcatcaccgtaaaggcaaaagacgtgtgaacatcgcttattcagattctctcgtttacaaggaatccaaggcaaagcaaaacgatggcatttgaaatacatcattttctcatatgaattattaagcattcatattctatgaacgcaattcttatcttaagttatgaccattcttccaaaaatttgaaggaaagaaaggtgatgttataagtatcctagttctctggtattttagattaatttcctttacataattcaaaaatactttgtacaaaagagtcatgtacaagaaatataaaataaatgtttgtaaatcatatatatatacaccagtttgttgggcggacaacgttgaagttatttcgctctttaaaacatagtagatgatcacttggttggttattatggagattggaattgcaataaaatcaaatcatgtatggtacggcagctacccctagattattcttggtgattccaatgaaattatgagctcctcggagcactctcgttttcaagattacatatgaaaccgtttgggtatatttgagtttcagaatgctgtataaatgtaataaattattaaatttttatatttattttatctatatcaacaataagtatacttttttccctagatgacttaaattcaaagcaaattaacaataacaatcagtttgaagattatttttcctaaatataaatataattgtataaactttaattagatttttaaaataataagctaattcaggatattcaaaatatatagagaaatcttattaaaaaaaaaaattagttgaaaggaaatagttaacctaataaaagcaagtaatcaaagcccaaaaatttacaattaaaacccttagtgataaggattaagtgtcattagtagttaataaataaatgttgtagatagatggagtcactaaaaaaaaaaaaggtcaaaacgagaggcgcaaggtttggtgtcttgttaaataaatcttgtggtgctcgtgttacctctttagccaaacaacacccccaaacaattactcttatagagagagtagaagaagacgacgcttaccccaaaactcgaatccctaggaggtaacagcttaagctctccgattaccccaaactgcaaaatttctcatctttctctctctttatcttgttttcaacagcagcctttacctttttcttttaacctctgatcttgttatcttccatggatccatttccttaaaggtttgctctttctttcagagatattcttatctctacgaatctcatcttgatttgggttcttcttttttgtgtggtttaataaatcacaaatctgtttttttctatcttggatttacttaaaaatcttgtttttaataaagggttttcttttatttcagtcatttaaagatacccttattctagaatttagtagttgtgtttcaaattttaagtctttatgtgtttgtctggtaagaactataaaaaagctgcaatgggttttgacttatgagtttgtagccactgaaaatgtatctctttttcttgtttaggttttggtaatatgaattgagaagtccacgcacgtgtgtatctctattaccgtcaggtgtgttacctttcttctctgagtaatttgtttgattaaagcaaagtattttgcaggtttcttctttgagtaatttgacttagaaaagccaaactcttttttttgcagattttggtttaaaagcagttatttttactagtcttgtaagaatg

SEQ ID NO: 11982 - DNA, 641 bp, Unknown
  misc_feature (1)..( 641): cDNA_ID_2708052_gDNA_ID_2214526_Annot_ID_184768 3000 nt of promoter + ATG
gtcatctgtgaaacaagccacagagagacaaagactcgtaagtattgggcaacgaaagcgacctcctttattcaccactgccattaacatgttcttcttctccttcttcttctacattttatgaccgttttacccttcaagagagagaaacaaaatcactccctctcactcactctatctctctcttctgcaaagcttcagaactctggcagagagataaaagatgatggggtttttaactttatcctccccaaataattcttcttcccttcatctctctctcttacacaacaggtccctacatttgtacaatctcctctctttaaagactctctctctttctctctccatctctatcttactctgtatttctgtcgtctgagcactcaatgaaaccactgtaaatttccgccagaatttgatgtgatggaacgataaaaatcattttttctcggttaaagtaaaaaaacaaaaacaaatttctgtagaaatcataataaaagaaagaaaaaaaatctaatgtcggtacataatacggttctcttcttcttctctatcctctgtttcttcttcatggagacttgaaagcttttaaagtatatctaaaaacgcagtcgttttaagactgtgtgtgagaaatg

SEQ ID NO: 11983 - DNA, 3000 bp, Unknown
  misc_feature (1)..( 3000): cDNA_ID_3023585_gDNA_ID_2214526_Annot_ID_184766 3000 nt of promoter + ATG
tctatattgttgaacagttattgcatgatggaacaaaggagtttgctcaaaatgaaacagattctgctaaatatatgttatcttctgaaagtattgtaagtggttagattcataggtcacttgagctgtctttgttagagttttgagtcttgtgagtaccttgtcttatggtagtcaacttattatcgtaatatcaggcaattggggagaaactatctgagattggtggtaggttagactatccacgtcttaccaaggacatcgctgagggaatagaaacactatggaaggatcctgcaattcaggtgtgtttgtgtgtgtgtgtgcacgttttatttactattgcactcaaagttgaatacatgatttaaacgtttcattttgtaggaaacttgtgctcgtggtaatgagcttcaggttcctgattgtacgaaatatctgatggagaacttgaagagactatcagatataaattatattccaactaaggtataaccaaagtatcattctttgttgaaaacatttcaagtaatgatcttaaaatggttgaataaaactcattggatcagcctcggaggatcaatgtattaacaaacagaagccttttgctttccatattagcctagttgagctagcattttcagagaccagagtcaatatgcaatttctgtgacatgtgtcttccggaatgtgttgtcattggtgcattttttctatgttggtgtttcaggaggatgtactttatgcaagagttcgcacaactggtgtcgtggaaatacagttcaggtaccaactactttttgttttaccctttttcctgtttgattgttagtctttcatagatgagtaattgtttgataagctctaagtgttagtctggttcactaggcaatatgattagctaggcggtttgtagtagctgtgttaacagctcagcaacaatcttgttaatgtagtctctctgcgatgtgtaagttatttggtgaaatgaataaaagtgtttacggattcgattcctatgattgccactaagatgtactaatagaacatatgaattccataccaatatcaaacttgttgttgtggtgaatctacttgtaatgatccgttaccaaagatgaattcacaaatggtatatgagataaagcttcgtttatgcagccctgtgggagagaataaaaaaagtggtgaagtgtaccgattgtttgacgtgggtggacagagaaatgagaggaggaaatggattcatctgtttgaaggtgtaacagctgtgatattttgtgctgccatcagcgagtaagctcacttcattataaattataagatatcctcgtactgtccacatattgccaaaacattaactgagttttgatcataggtacgaccaaacgctctttgaggacgagcagaaaaacaggatgatggagaccaaggaattattcgactgggtcctgaaacaaccctgttttgaggtttttagttacatttttatctcatcttttaaaaatttaaagacactcttgagatgggtttggttacaaaaacttggttctctttacgcagaaaacatccttcatgctgttcttgaacaagttcgacatatttgagaagaaagttcttgacgtaagaagaactaaagcatatttatttgttttgataggcaagcaagtctttttgttcaataacgctttcttattcaatgtgcataggttccgttgaacgtttgcgagtggttcagagattaccaaccagtttcaagtgggaaacaagagattgagcatgcatacgagtaagcttgtctccaaactttactgattcccgccaaactgttaccgttatatgaccttatttttaatttggattcaggtttgtgaagaagaagtttgaggagttatattaccagaacacggcgccggatagagtggacagggtattcaaaatctacaggacgacggctttggaccagaagcttgtaaagaaaacgttcaagctcgtagatgagacactaagaaggagaaatttactggaggctggccttttatgaccttattattacatatctctagtaaattacctctccttattattataagaaaaactcgaaaactgaatgaccgtgtaatttatctttcgggacaaaagacttagcgattcaaaatctaatgtgtctcgatggctacgactagtttctattttatcattgtttttgttaacattcctctgtctttgacttcttatttttttttctcatcaaaaacatctcattttgatcttgtttttggggttatattattattaaaatgaggcatccacatcccgaaatctagaaagtgaaacacaacacaaaacgtaactttatcagtactaaaaagttttggaatgttcctaacatgaaaaagttcttacattaaaaaaaagtatgggggtgaaactgaacaaatacaaaatatgatgtaaaaactgaaataaaagtaaaacacatggggtctaccgtgatttcagaacattcgaaaaagcgactttaaaaataattgcaccgaagaaagaagaaccctgaaagcaaaaaactcttcgccgttgttgtttcttacgtcaaagaatattccttcttctctttcgttaatagatcccaaaaaaaaaaaaaagcttcattgattcttcttcctctgtttttgattccgttttcgagcaatcctctgaaacatgtatgttgttgttctctctttcttccaatggtgttctgattttgctttttctgttatacgataatgataacaatcgcttcttagtttgattaatacgaaactctcaaagatcacgaaattggttttgttagggaaccatttagatcaaggcttgtttgtgattgttgttgttgattcagctttgatttgattcgttagccattgattttgatttgagaatttgtctttgtttgatttttcttgcagaatctttggtacaattggagttatattcaaaagcttataaatgtcaaat

SEQ ID NO: 11984 - DNA, 3000 bp, Unknown
  misc_feature (1)..( 3000): cDNA_ID_2711382_gDNA_ID_2214526_Annot_ID_184765 3000 nt of promoter + ATG
atgtccgttgactttgtttcttccatgattaaaatttaagaagtaaggaagagaaacaaatttgaaccattgattttgttactcttaactaaataatcatttattcaataactaaaggtcggttggtcttcaggtacgaacgttcttctatactaacttgtaaattgtaaacgtaacagattgtgcagtagagattgcggttacaaatgtttgacaacgatcacaaaaattgtttaacaccgcgtattcttccgccaacgtttgcggcagcgggtggttaaaaattacactatttttaagttttaaattcaaataaatttaataacttttttgactcttggagtcatgctctgaacacaaatgattcattttccggagaacataagtgcattgtatccgtctaatcgtcccaacatacttcactataaatgtaatttaatactaacaattaaattgaagtgttgttcgtcgcatgcatgtatgtacgtacaataattatatagtttcattatcatagaactgtcggggaaattgtgaatcatcaccagccgccacatgaacttatttgccgttgttctggtttaaggctggtaagatttattcggcggctgtaggcctgtagcccttgaaatatggtagacaagatcgtccatataattaagattttgtttttcacttctaaattaattaatgggtgacttgggcgattttgtattgttgtttagtggctagaaagaaaacttttaacgataaatttacttatgcaaaaattatattagtttagtttagcaactttatatgtacttaattagtaaaataatacatttaaatgtaaactatttgtacatattaatgttgtccaaacaatatgcactttttgaatttttttactgtattctccacctagtttttctaattcatccaagcattttgatgaatttgcatgtctccatagatgaattagtatctactatctctaaaaactcaatctccaccgaagatattgcttaaccaatgtgctcctagaccaaatccaaaaccttagccgcttcatacttaacatccacttttgtagcatcctcaaactgttttacaaccttttcaaccgggacacaatcgccttgtcttagtagtgaagcgtaggttaatcatggatgatgatttttgttctttgacaacatctggtaaggtttttggtttatggctcaccctttttactttttcggtctttcttatatagtgttttggtgggttttttctcgttcatttttcacgaccttcttatcctattactagggtcattaaattgttcgttaggttaaagagatttacaatatgaaaccgattatgtccattaaaacgtgaataagacagaaaagagcaccaagaaaatgaaaaataatttaatgtatgttcaggaaatcctatgaaaacataatgattgatcgggtttattggttttgtagctggtggtttaagtggttagggaagctatgtatttataatttattgattcaatatggttttgcatctgaaatatatttaagcccaaccaataaatataccatcactcgccaagaccgtttctcagtggaaacattttgtgagaagttcaagtcgatgttaatgattgtaaggatttaacggatgtgatgtttttgtaggttgaagatttaaagtactatatgatatgttgtgtttttatcgattttgaatctttattttctttcctaaatcaaaactgcaatatatttcctaagctagcaaaacccattctagatataagtagagtccagcttgtaatgcaactgcaaagcaaaaatcaagatatttcgatacaaggacttgatgtcataaaattccaaatttgttttgtcttgccacacttagtaattctcttccaataatggttaacttaatagtatataaaataaaaatgcatataggttccgtaattaatcttctttatcgtcacgagaggcacatcttttttcaacatttgaccactctctctctctctctctcaggacctttcggcgtaatttcgtcttcccctttgcttaacattttctttctttctttttgaccaaatattaaaaatatatccatttttattttatttttaattaaattcataatttgcattttatgtatttataataaaaaggagagaataaatccaaaagagtgaagcaaaaacattaaagcggaaagaaagtggtaaaacaataatagaaacaggagaagcagaagtactacttcttcttcttctgctctcttctcagaccttgttttgtactttcttcttcttcttcttcttcttgtttgcgaactccgatatcttcttcactacctttgactccatttctttttcttcttcaggtgaattctactttacttttcttcttaccccaaatttactcttttgggttttatgaaagttttgttttttattactcagatcttgtcctagttctcctccttgttctgttgtttttctgtttcgtttcgaattggttttgtttttcaagtttagggttttgtagatcagttcgtcgttactgtagattggaaatgaaaattatgattctttggatctgattatagcagttcaagtgtgaactctatctattacttgatttgctatctcacagtttttgaatttcttaatggtgttagctactcgacttttagagctcattttcttaactactgaacttgtttcatttgagaggtactaatccagtatatattataaagtttaatgctttttcttacttgcattctttgaacatgtttgctattttggtgagtgaaactttatgtatatttatgaattttgagctaaagtattgattgtttcataagtaggtgtaggcattgtcttgttatgagaagcaactgtagctggaagctcaagtatttgtttttagctgtggagcttgaatcttgatagttttcgacttctatgttattacctgtggggatatagaaacaatc

SEQ ID NO: 11985 - DNA, 3000 bp, Unknown; identical to SEQ ID NO: 11981
  misc_feature (1)..( 3000): cDNA_ID_2708038_gDNA_ID_2214526_Annot_ID_184762 3000 nt of promoter + ATG

SEQ ID NO: 11986 - DNA, 3000 bp, Unknown; identical to SEQ ID NO: 11979
  misc_feature (1)..( 3000): cDNA_ID_3023547_gDNA_ID_2214526_Annot_ID_184760 3000 nt of promoter + ATG

SEQ ID NO: 11987 - DNA, 3000 bp, Unknown; identical to SEQ ID NO: 11978
  misc_feature (1)..( 3000): cDNA_ID_2993656_gDNA_ID_2214526_Annot_ID_184758 3000 nt of promoter + ATG

SEQ ID NO: 11988 - DNA, 3000 bp, Unknown; identical to SEQ ID NO: 11977
  misc_feature (1)..( 3000): cDNA_ID_2990166_gDNA_ID_2214526_Annot_ID_184753 3000 nt of promoter + ATG

SEQ ID NO: 11989 - DNA, 3000 bp, Unknown; identical to SEQ ID NO: 11976
  misc_feature (1)..( 3000): cDNA_ID_2708022_gDNA_ID_2214526_Annot_ID_184751 3000 nt of promoter + ATG

SEQ ID NO: 11990 - DNA, 3000 bp, Unknown; identical to SEQ ID NO: 11984
  misc_feature (1)..( 3000): cDNA_ID_2711382_gDNA_ID_2214526_Annot_ID_134162 3000 nt of promoter + ATG

SEQ ID NO: 11991 - DNA, 641 bp, Unknown; identical to SEQ ID NO: 11982
  misc_feature (1)..( 641): cDNA_ID_2708052_gDNA_ID_2214526_Annot_ID_134165 3000 nt of promoter + ATG

SEQ ID NO: 11992 - DNA, 3000 bp, Unknown
  misc_feature (1)..( 3000): cDNA_ID_1014010_gDNA_ID_2214527_Annot_ID_134167 3000 nt of promoter + ATG
gagaaatatcgaaatcgctcccctaaaggcggtgtggaaagggaaaatcttaagagttatggtcaagaggataaaaagaggaaagcagaggatttagacagtggaaaaccgaatgaataccagaatagacgccggaaaggtggctctaagctatcagaagaagaaagagctgctagattgaagcaaatgcaaatggatgcagaggtgcacgaggagcaaagatggacaagattgaagaaagccgatgagaccgatgcagtggaagctgataagaacaaagtatccacgggcaagagctttttggacgatgctaataagagtgtgtatggagttgagaaaggcggaagctcaacaattgaagaaagcgtgcgtcgcagaagctattattcacaacgtggaactgcagctgaaggcaatgcgtttcgacgctgatgatgtaaaaatattgttacaacaaaacacaatgtatactaaggtttgtgtcttttttgatattttttttcagtttttgacattgtatttctgattccagaatattgttgagcatcaagctctttaggtcttttgatatatgaagacaacgaggctgaggcccattgtcataagcccattatggggtggtccagtgttttatcccggatcgagcgtgggatttgaatagttagtgtgtaatcttattcagtgagtgggacgttgaaatgaggtgtatgagtcagtcaatgaatacccgtgacatgtagttaagccataatactccaagattcccctttggcaccttttaaataaaccacgagatgaagccactctctcttttgtctttttttaatatgttttattttctttctttttcttgtccatctttttaaaaataattgaaatttgacctagggtcgttggtgtgttataattttgattcaatttcgaagttcgcatgttgataagaaaaatataaacatttgattcgaaaatgtttaaaggaaaaaagagagatggatttgtaatggaaacattttgacgtgtgagattttaacctctcctattttcaaagattgggcaatatggggttagaagcttgcaagggggggttcacgtgtagcgtaaatgtacaatgatgtcacttcctacactttatcacgtccttgaatttataggaataaagcaaatgttctaatcaataataccaatcttgcatgtttatttaattattatatagaagtttgattttataacgaattgtgtaatatagtacttttgtgatgccgccgttcctgaatatgttgactttgcaattgcaagccagacctagaactgaagaaaaaaatgtacgaattagtcatttatttattcgaagcataattcatttggaaaatcaggaagaccattatagtacggagccaaaatatttgaacatcacctaacatgttttgtaagcttctttgatatttattcttgttaataaaattttactttcttacggacaatagatgcaaccaatttgcattaccttctaaaaatatctactgtagttgtagcggtgcacatcaattattataatttttgaaaaaatggtgtacccaaaaaaacataaatattgttatagcaatgaatacaaatcaaagaaatatatgtatttaaaaacttaaaaatagaagagttgtacgaattcactaccgaaatagacaagatttattttggccaataccaaaattaatggtatataggacatgagtgagtcggcttaaagagaagaaaataaaaagaaataagaaataggaggagatgtaacagaatggaaaacgaaaggtgtggaaattgatttgagaagatgtcgcctaataatattaaccgacaattagtggcctcttctctgacttttgacttatacactgttttttcacatttgttggtgctctctcactcccacccaatcacggcccttcttttctaatcttactactctataaaattaaatattttttaaaaacttatagtgatcatagtgtggaacatttgcttcaatagttgacctagtaatttaatagtatctatatgatgtatacaatgttctttttgttgccaatatcgatagaaaaaaagttttaacttattcgaaaaaagaagacaaaaattattatagagtaggttcttgtggatttgaatcgatttgtgatttgtgaatactacttaaatagaattatgtaagattctacaattagtgttttatgtggttagagatgataaaaattacagttagatgattaaataatatttccgttgatacggatttggattctctaccataaatacttccaattgtttatgttgatgagaagtgtgatcagttaataaagaattaagacgttaattaagaaattgatatgtgcaaaaattgatagggcatcattaggcaatttaaaaagaataatagagaatggcatttaatcctatcaatcatatttagtttgcctatttagttttgaacctttcgattttaaatttaactttattgtcactataccagaaaagaattgtagtcatttctccaaatgaaaaagatttgaacttgggaacaaaaaaaatttgaaatcccaagaaaccttttaaagtagtaacaaaggagtagaatgttccagttcagtaaaatttcactttttctataaaggtgacagtaataaaataagatactcttttttattttaaaaaaaaaccttcgaatttttccagaaaagaatctgacaaaaataaaatgaacagagaaaagaaagcaaccaatcttatgcaatagaatccaaaaattcacttgtctctattttttaaaaatgggtcctttttatgaaggttttgccaaagtgtcattagtgcccagaattaaacgcaatccacttcaatccaaaatcccatactaaattaaaaccaacacacaggaagaaagaagaaacctctcatcttcccctctcttctgttgaagaaagcttaaacctttctgggtttcttttaact

SEQ ID NO: 11993 - DNA, 3000 bp, Unknown
  misc_feature (1)..( 3000): cDNA_ID_3023651_gDNA_ID_2214527_Annot_ID_134168 3000 nt of promoter + ATG
actatggcgacaagggttagtttcttcttagctctggtaatgacggtggtgattcttgctccttctgtcgtctctggagaaaatgggttttccgatcttaaaatccgtactcacttgaaacgactcaacaagccagctctcaaatcgattaaggtgaattccacagtgatattagagagaaaactccataaaagtttcattcttttgctgttttctgggaataattttgagtttcttaaacagagcccagatggagatatgattgactgtgttccaatcactgaccaaccagcttttgctcatcctctgctcattaatcacactgtccaggttctgtttactcttctttcttttgtttgattctctgttgtttttcttctgtatagttctgacattgttgttgtttatgggtgtattatagatgtggccaagtttgaacccagaaagtgtatttagtgagagtaaagtttcatcaaaaaccaagaatcagcagtctaatgctatacatcagctttggcatgtgaatgggaaatgtccaaagaacacaattcccatcagaagaacgagaagacaagatctttacagagcgagttccgttgagaattacggtatgaagaatcagaagagtatccctaaacctaaatcttctgagccacctaatgtccttacacaaaatggtcatcaggtaattatttttcttcacatatgaattagttttggccaatttttgttgtgtctattaacctcttcctttaccttttgttgttgatttagcacgcgataatgtatgtcgaagatggggttttctacggggctaaagcgaagataaatgtatggaagccggatgttgaaatgcctaatgagtttagcttagctcagatttgggttttaggtggaaatttcaactctgatcttaatagtattgaagctggctggcaggtatttttcttctttcggtttttgatagttctttcctgaaaaagaaactgtttttgattcaaagatttgtgttttcaggtcagcccacaattgtatggtgataataggaccagactcttcacttattggactgtaagtttcagactattcaatctagatttttgtttttgtgtgttttggctttcttgatgaatcattcttttgtctctcacttgtgaaaacagagtgatgcataccaaggcacaggctgctataatcttctatgctcaggatttgttcaaatcaatagagaaatcgcaatgggtggatcaatctctcctttatcaaactatggaaactctcaatatgacatcaccatactcatctggaaggtaaaccaacaacaaatatccatgttgttaccatctatttagtggtttagctatggtttgagaaatttcagttttgtttttttgttttttctcaggatccaaaagaaggacattggtggttacagtttggagagaaatacataataggatactggccagcttcactcttctcttacttatcagaaagtgcatcgatgatcgaatggggaggcgaagtggttaactcgcagtccgaggaaggacaacacacaaccactcagatgggaagtgggaggtttgcagaggaaggttggggaaaagcgagttacttcaagaacgttcaagtagttgatggatcgaatgaactgagaaacccggagaatcttcaagtgtttactgatcaagagaactgttacaatgtgaaaagtgggaatggaggttcttggggaagttacttctactatggtggtcctggtcgaaaccctaattgcccttaaagatttggtcgacttactcacattgcagatcattccaaatcaattgtataaaaaacatataatatatatatatacacattcttaagtatattattaatttcaggtttgaagagtggtatatggtatattcaaattcatctgcagaatttgtttgtttgtgtgtttgagagtgttttctctgtttccatggagtgaagagaagataaatttcttttaaagaacatggtcccatgtgtatactgaaatcaaatgatcccattattaatttatttgtatttttttttttgtatatgagtggtactttgttttcaatgacctgtgttaatagctttgtctgtatgtaccaaaacatggagatgggacttttggctttggatcttcattaatcactcatgtttaacagtatctatcagaattattggccaatcttcattacactaatactattatgtataaatctattaactatttttgtgatacttcatttaagactaacataaactttgttttttttttaattatcagcaagcttccattgtattggaactatgtttttgtgattgatcaacaaaacagaagcaagttaaaatttacaacttgaaatttttttcttataattatctcaaattaaacttataattacatctatgtgaatgacagatctatcttctcatgtccactgttatagtcaacgaaatgtttggggccataagccacaagagagttgactttgatcacgttgacgagttctcaatcataaaagcataatcaatttaacatagtatgagacttataattaatttaacaaagtattcaatggtgccaaaagaaagttcaataaagtaccgaccatattaaaattcatgtagagatttaatttaaaagtgaacatggtgcaatttacaagttcgtgacctctacgcggaatggttcatgcagagtaacaaacaaatgataatttaatttaatagaatgataattgatttatatttgcttcaaagagaaaaaagtttaaaactgaattatatccttcttgtcaatgtcacagatagtttaatactttatatagataacgtcgaagacgaggttacaaaaaaaaaagaaaaaagaattctggttagagttgagaaaaaatagtaagttatgtagcattccacttctataaattccaatgaatactgtctaaaagttttgctaagaactgtatagccatg

SEQ ID NO: 11994 - DNA, 3000 bp, Unknown
  misc_feature (1)..( 3000): cDNA_ID_2708139_gDNA_ID_2214527_Annot_ID_134169 3000 nt of promoter + ATG
aaacaaatgataatttaatttaatagaatgataattgatttatatttgcttcaaagagaaaaaagtttaaaactgaattatatccttcttgtcaatgtcacagatagtttaatactttatatagataacgtcgaagacgaggttacaaaaaaaaaagaaaaaagaattctggttagagttgagaaaaaatagtaagttatgtagcattccacttctataaattccaatgaatactgtctaaaagttttgctaagaactgtatagccatgatgagaatgaccggtttcatagtagctatgatgatagcagcggcgatattcactacttgcgttgatggaaacaagttcttttatcaccgggaaattaaagtacttcgacatttgaaacggttcaacaagcctgctcttaaatccattaaggtacatatcttatataaatttcatgacaaaaattaaagaaacctttttagagatgaattctaatacgctttcattaatctttcttgcagagtgaagatggagatgtaatagattgtgttcctatcactaatcaaccagcttttgatcatcatttacttaaaaaccataccatccaggtttggtttcacttccaagtctatctattgttttaaaacattatgatttttgaatcaattgtgacgtaaagtttacacatgcagatgagaccgagtttctacccggtaagtgattctacgtacaccaagagggaggcaaaggctgtaactcaggtttggcacaaggctggagagtgtcccaaaaacactgttccaatcagaagaacaaagaaagaagatctcttgagaccaaaatccatcaggagttttgggagaaagtctcatcaaagcattccaagaactacaacctttgatccaacattaggtcatcaggtacaagtcaactacatgcacacacacacacaaacacatgtgtatcattgttaatgtcttgtggcttacgcttttcatttcttttggagtgcctttagtacgcgctaatgggtgtgagaaatggaaaattttatgggacagaagttgcaataaatctgtggaaaccatatgtccaaattcctaaagagtttagcttggctcagacttgggttgtgtccggaaatggctctagtctaaacaccattgaagctggttggcaggtttggttccttcttgactacatcctctttgcttttatgcaaaacacttaacttgctctaatattttttgtcttaatttataggtttatccagaactatatgatgataataatcctagattctttgtttattggacggtatgttctccttttcagcagatttaggcgtacttatctcttctactatacactaatcatttgaaaaacataaagattgactagttttctgatccggaatagaactatagaagtctataattcaagttaagtctctagatttatgtatttaaggatttaattaaccattatgaaatcgttttttttttttgggaaatagcgtgatgggtaccgaaaaacgggatgctacaaccttctctgctcaggttttgttcaaacgagtaatcgatacaccgtaggtggatcaatcaccaccatgtcacgctaccgtggaactcaatatgatctctccgtacttatatggaaggtaataacgtaattatatttcacctcaacaacatcagattcaaatattcaacgtaacttcagtggcaagttacataccttttcgctcaagttacctctccatctatcttgaaatggatatcaggaccaaaaaacaggaaactggtggcttagagtcaatgaaaaagacgttattgggtactggccaggctcgttgttcaattctctaggaagagaagctacgagagttgaatggggaggtgaaatcattaactcaaagaccggtgggagacacactaccacagatatgggaagtgggcattttgcagatgaaggttttaagaaagcaagctatttcaggaatcttaagatagttgatggaaccaatactcttagagaaccacaaggactttacttctttgctgataaacataactgttacaatgttaagacaggaaatggtggaacttcttggggggctcatttcttctatggtggtcctggtcgaaacgttaaatgtccttgattaggatctgtgtgttcaaaagcttttataatctcacatacacatgtctatatttgaataagaacatttgcgaaaaccacgtcatcagagatgtttatatctgtcatttttcttaatttattaatgaacagtctgttgacagtgaaattgaaatatcgagaataataaatacgtacatattgataggtaactaaaatacagctggtttaaatcaaattgcaaaaatataaaacattgcacgtttaacaaatgtaaattaaaccgtgttcgttattcgttattctttgaccagttgaggaatcgtttggacggtagaatccgtcactatgcctctggaatatatataacgcatgaatccgttaaaacaaaactagaatgataaagaattatgtattgttttcaggtaaggcaaattatatagatgtgaatatgtgatatatataattgcagagctttaatgtgtattatatatacacaatgttttgccatgatgttatattattcataccaaacaatccacaagggaagtaacatgcgaaatggttagacgtgcaaaacattgcaaaaaatctataacaaattaactatgttgatcgaatcaaaggccacacaacataacagtgatttgcgatgacttttcgtttcacaataaataccaaacatgtgctgagtttctctttagataagaccaaatccttgaaattttgtgtatgtggttggttgatctaactcgaccaactatattgattctgtccccatttccctttaattctgtctttaccacaccacaacactaatcataaaacgtcactgtttgtctttgattttgaattcgtcaatatcaaa

SEQ ID NO: 11995 - DNA, 3000 bp, Unknown
  misc_feature (1)..( 3000): cDNA_ID_2708128_gDNA_ID_2214527_Annot_ID_134173 3000 nt of promoter + ATG
gcagagtagcactaacaagctcccgtaatgcgtttagcatggttagttctttccctttagtgttatttaggctctttaaaatgcctctttaggtttatatgtaacatttccatcgactgtttattcaggttgctaatttaggcttatacgctattgctttagttgtatttggtgttagcgaggccgtgacaaaagaaaataccgaatctcaggtttgtgcttctattgacttgtttatggtaatgccttttgatatatgattctaagtctgcctaagtctacagtatcgttggattgcttattcatccatcaccgttggctgctgctttgtggtcatatttcttatggggacaaaggaaccaaggtaatgcacacttttctctgaaatgcttatatcagtttttaccgaagttttatgccataatagatgagatatctattgagaatgagttgcttttatataattttcaaaggctgaggataaatctaagagaaactagtcgagcaagaataccatggtcttattggttccgtaaaattctatactatcaagttgctatggtttatctcctcactcgactagtattgaatgtttcacaggttagttagtttctgtatctgtcatgctttgcttcatttgtattccatctttatttacgtttcaggatgactttaatatttgcaggcatatcttgcattctttgttattgatgatttgcaaatggctcaatctgctaaagctctggtaaaagaaagagaaccactgcacttagctttcatctctatgaacatcaaactttttctgatcaatgtttaattttcagattcctgcaataatctacgtatgcagcttcgttgtatcagttatgcttcaggttgcaataagcttaaacgcattcttcttcgtttctaaactttttgttttgttttctatctgttatgtaactacatattccattcaatgtaggagattccttggaatggaaaacgcctcaaggcatattattgtgctggtggtattatttggatattctgcggtatatcaatactcttattgcccagaagcattaactcttacatgtatgcgatctctgtctttatcggcatcgcaaatgcagtaatgttggtaagacactcctttgttacagaagtcttcatgtgtttacatataactagaagatctttcttttgataatcacaatatgtacaggtgacatcaattagtatgcagagtgtcttgattggttcgaaactcgggggatgtgctttcgtttgtgggtcattaagcttcttagacaaaatgtcatgtgggcttgctttatatgttcttcagtcacatcaaggtaagtttttgtctttctttctaatattatcttaaaattgatggaagtctaatttggaaaatggtgcaggcacttcaccaaaggttgacgtaaacatcaaagaatatttttacttctcggtgacaagatatgggttaggacttgttccagctgtatgctcgcttgttggagttgttgtaacatattttatggaactcgatagcacgattctaaagcctctgtgtcaaccgctactactagaatgaacagaaagaagaaacacaatgcttatgatctggtaaacacatatagctcaaaacttggttactgtttgacagtaaatgtttcagtctgctaattttttgttcataagaataggtttatatcacactgcgacaggcaaaacatttgtacaagaattactgaaagtcattaaaaattaatgcaagttgatttttattttatgttgtctactctttaatcgcttccttcattgaatcttccttgtctgagactctgaagatgaataaagattgactctttgtgatatccttgcagaaagaatcatgaatatttctgattcttaccctttgtttttgttttcattagaaatttagaacatagatgatcgatgaacatatccacgtgagaatcaaaacttaatccaatccattaaatagtttctctattctacagagtctgagaaaggaaattttttgattcacaaagcaattgatcaatgtttatcttttattttttggtgtggtgtaatgttaagttctttcatttggttattcacataaacataggaaaatataatggagaacaatcagaattatgtctttttaagcagttactcatgcaaacctgttttgtgatcttccagcttatactggttgataaatggaggaaaggtttcagttttttttttcgccgactagatctagcaatgatgatgctctcagggtcagagagaaacatctgatccatttttaagggtcaagcagagtagcacataacaagtagagaaacagagccggtgaaaaacggagcacctagagaaacagagcaaaaagatagcagagcacagaaaacagagctagcaatgaaaagaaaacagaacactcgaacagagcaatcagataaacagagcaagtaaagacataggacacaaaaaaaacagaggacaaggaataaaatgagcctggatcaccaagaattgtttgtctcggctgattctttcatccttgcaaataaaacacagctgagtaaacatcaaaacatctatctaaagatctcaagtccaaacattttgttcagattcttgttggaataactaccaccgctgaaacttttgcgatggacatggaactatggaaggcaagtttttggcagtaaatttacaaagtagagactttaatacaaaataactgcgtcactgtctttactctttagcttaatcgatgggacaaagtcaaactctgcaacactgagtcactctgaatatacctccgcttaaacgatgccgtttaaatctaaagtgcgagttccgtcaaagcccatttatggcccacacacaagacgatgccgtttcacgccgacacttaggtttaggtcgttttccacctccgactagtaatcccggaaatcttctccgcatgagctccggtgaaaaatg

SEQ ID NO: 11996 - DNA, 3000 bp, Unknown
  misc_feature (1)..( 3000): cDNA_ID_2992390_gDNA_ID_2214527_Annot_ID_134175 3000 nt of promoter + ATG
tttcagtcggtgaagataagaatctctaaatattgggcccgtcagaaaccaaggttttaattttattgggcctttgaaaatatactaatggtccatgaatgaataacaaaaaattattgggttgatttgcatgagttaagactggctggcagtagacgctgaaattgaatctatgattgtagaaaatttggttgtatatttacgttttgattttataataagaatgcaactgtaatgttaggcaagccaactacgtcatagatgacgccatggtctcgtagctttttcaaagagcttcatagcctgcgccaactgtcacaatgcacacaaatctatagtcaatcattgagtggacactttctctcggtgggttggtgtagagtggtaagacactcccttttctcttttccactcccacaaatttttttttagcttcgcacatactttaatactttttgggaataatattgagaaatagctttgaagtatcaccaaccacggcttgtaggatggatggtaattagtatgtcgccgtattacaatctaataacttacatgtatgaattgtatatgccaaaagtgatagtatattttaaacctcattaacgatggcagtaaataaattaacgaatgtaacatttgtactatatatcaatcttatttattaatttttcattcataaaaacaaaattcagaacaaaatacaattgattcaataatatccatgaacttctcgacaccacaacgcatgcaatcatcacataaacttacataaacaataaaccatttttcatatacttttgaaagatactaaaaattgctatataaatggtaagagcgttaggaagcaagtggtagtggaaatcacaacaacaaacaacagtgaaagataaattcagcataacaaaacaaaatggagtcacggaagattaacctaatggcgacagcaatagctttaatagtggtggctatggtggtggcagctgctgatgataagacgaaagacaaggaggagtgtacggagcagctggtcggtatggccacgtgtcttccttacgtgcaaggacaagcaaaatctccgacgccagactgttgctccggtctcaaacaagttcttaattcaaacaagaagtgtctttgtgtgatcattcaagacaggaatgatcctgatttgggtctccagatcaacgtctctctagctctcgcacttccttctgtttgtcacgccgctgctgacgtcactaaatgccctggttcgtagctttttcactgttaaaaatctacctatacaatgttctgtgaagtaattattttttgtagttatgaatatagcacattaattaagaatgaaaacagagtgtatatgtatgaaaatattttagtaaacaagttttcaaaattaattatttattaaatattagcacaatcataattgttttggaatgggtgtttttcagctttgcttcacttggatccgaattctccagatgcccaagtcttctaccagctagctaaaggtttaaacaaaaccggcccagcctctgctcccactggctcgtcccctggacctataagcatttctccgacttcaggatccgatgatggtaacaacagtggtcgaacgacctctgtgccaggcaggaaccacgctcaaagcttctataaacaatggctggggctcgaagttgtgttccatttcttcgtaattttttatattttcatcctcgtatagataaataatgataacgaaaactgaaaagcatgtgatgttgattagtgaaattgcggtgacgctgatttttgcagttactgttttgattggtgtatttaattctagttcgagaactcttcttgatattttgtgtgacgcaatacgagctacagtttttctatgtctcgtatgtttttatcagttttatctgaaatactataatcacttacaaaaaacaaacactaaattttattatgtggttgtgctagccttagttgtatacatacatattttcacttacgtacgtacggtacgtcaggtatcaatttttctttctttcatcgagtatgtggacgccaagttacatttttttcgtttggttttagcgtcggtttagggattgaagttcaaaaaagagatgcttctagtaaaatatcttgtagaattgtagtgccttttagaagaattaccctttggtctcaactcatcaccgaaagcaagaatatttttctctaaattctatacaccataacatcaccattcactataactaaaacaaatggaatgaaatagtagcaagaattaatgtttttcttttcatttaaatttattataattgcaaaaagaaaagttttaccaaaaaacagtcgagtccaataatcaatatgagtaaatggttcgcatttttattttaaaaattgaattttttaagagcttgaaaattgaatttaacaaaaaaaacaaaaaaaggatcggtcaaacaaaacaaaaagggttgaaaattgacttaccaaagtctttataaagttgataaacttttgccttgttataaaaaaaatctactataaacagattgcgcgtctggagataactgatttttttttttttgatatttgagatttattatctcacattttctttaaaaaatcaaatcagaaaaaagaagaatggaatcaacaatcatggaggattgttctagctagttaaaaaatgacttacgtaccgaaatttttttaaaaaaaattaatagtctcgataaaatatactcttattaattattaattaaccgattgggcgaatggagataatgatgttgacattcgagaatcacctgttctcacaatttttcattaccaaataaaaaataaatccatgaacttgtctacacggcaatgcatgcaatttcacagaaacttacatatacaataatattttagaaaaagataaataatgctagatgagttaggaaacaaatggtagtgaaaacttaaatcagaacaaacaaaatg

SEQ ID NO: 11997 - DNA, 3000 bp, Unknown
  misc_feature (1)..( 3000): cDNA_ID_2711390_gDNA_ID_2214527_Annot_ID_134180 3000 nt of promoter + ATG
aaaaaatgaaactagtaaaagaagtgttttcaaatagaattagcatcatatttaattatttttctacagaaactatagggaagccaaaaacagaacagaacagacatgccgacaaattaaaactttcacacacacagacacatttgcgaccaaattaaagacatatatatggctcacgctatctgtttagatattctaactatatgatgtttgtataatattatagtttagatttatcgtcagttgattaatcacaaatcataaacacattattttattccgactgtaaattaaaaattaaactaaaatgtactagtgtaaaataatagtgatacacacataaaactttatttaaatcaagttgttgttgtgtgtcatggaggcaggtccatagctgtttcgttatacaccttctttgttatttcaatattcaagtttgttgttaatttaatgttattgactaaccaacaatccaatatatttataattatctatatataaataacccgccgcagtattattccacggcatacgaattattttggttcaaattacagatatctaaaaaaggatcaaatcttttctcaatcgtttatagtttcttcaatggagattactcaatatcaaagttttcatgaaggttcgagttctagggtttccatgaacaggaattcacaagtaatatccaagatcaaacccaagattcgcataatccatatatttgcaccggaggtcatcaagaccgacgtcaagaactttcgttcactcgtccagagtctaaccgggaaaccggcaccgggagaagccaaaaccggtaaaaagagagccaaatcaagaattacgactccccaagaaccggtttgcgatgatcatcagccggtcaacaggctttcgggtttcaccggtttactagcaaacggaggaaaccaccaggtgaaagaagagtggggatcaggtgatcagagtacttcgaacacaaacacgtactttgatctagaaggtttaattcaagatgtcggagaagattacttctcttcgtttcccatgagatcctcttcttcttcacaagtcgaaggtttcatcttcaacaacaacaacaacaacaacaacaacaacaacaacaacaacaacaacaacaccaacttcgatacaaaggctcataattcgtcttaattaataacagattaatttctagggttttcaatcttattgattctgcaaatcgcatttggtgagatgagatctaatcgcaacgataaggtcatattttgtgggagaaaaaaggcatagaagttgtatatagatataacaaatgggtatgatgagagacataaacttttggcgggactgactttgccaaggttgagagttgtgatgaagagagtttaatctacgtgcagcccttctaggagaagtggctgtatctaattaagatgtggtcggtcaaaaaagccctagttttattatgtaacttcattgatgtgctattattggatgtgtattaattctttggtgtgcagataaatgtgatgattgctgtactttaattttggggaaaaagtttgtatggaattagaacaaggatcgacttgttttcgatatagatactctgattgattgtgtatattgaatatcgatacttacataacggttattcggttaaagtacagttacactaattaaattaaactgtaagttaacaagaatattctggctcaagctaaattattttttttattattattgtttactaatcttttgttacaaatgttgaaaatgatatttattatacatgtagtacttcaactaaaataaataacgtgttttcatatttgatgtacgtgtataatatatcattttcaacagtgagtaatattaacccttttatcaaaataaagtaaaacaaaatgatataacctatcaacaaaatgcaaagaaaattgatccgaaccgaatatagccgtaacggtacaccaaaattgttttgagattttagtgtccgttgaccttttcatataaagccaaattattcggtctggtttccaaaagaacgaaaaggtatatgattacggtttactcccttgcttctgtgttttggtttagtttggtttaccttctcaaagttctcgaacgtcaacatttattttatcttattttgtaaggttctgcacatgttatacttattaattagtctactttttcaggcattgggattatttgttttagtctaaatcggttttggttgcataatattggatgaaaacattgtaaaggacaatttcaaacctgacttttctagatttggaaacgttccggctgcttgaaaagctcacataaatattagtatgatttcttaaaccaaaaataaatgatgattatcaacaataccgtaaataaggcaaaggaaataaatgatgattatcaacaattgccgaaaataaccacaccggtacaccgaaattgtttttgagattcataaaaccggaataatacgcctaaaggttattttctccaataccggtttagtttggtttgccttctcaaagtactcgaaggtcaaaattggaatttagtaataaacctgctccagctatatacaaatgtcatttgctcacctttcgccgattgattttgtacatcacacgcagacgcagcttttagtatttttttcaacaatcgcttttttttttctcgatctccgtgaagctctcgaatctctggtatgtttcttcgcttcttcatagtgtttctcatttccttttggtcttccataattttcggagaatctagtcctgtttttctcttcttctggaatctgaattcgccggtgaattccgctgatcgaatctctgagttttgttgaattatttgattcggcgataaaactttttttgtttgtttctgattttggtgagtgttgattgcttgagttttttcacggatcgatttgttttgagaattgggtggatactgtctgtcacaggttttgagttttggaga

SEQ ID NO: 11998 - DNA, 3000 bp, Unknown
  misc_feature (1)..( 3000): cDNA_ID_1807107_gDNA_ID_2214527_Annot_ID_184804 3000 nt of promoter + ATG
tacacttcaagatacgttgaagatgttatgttctacgctaacaccaatcttagttacacaacagatagtcgcgtaaatcaaacaagtaactaacaaaataaacttatttcccaaattattttcaccatttattaaaaagaaaaacggtttttgaaatgtattgttgaaatttacagcggagaaaaatggagttcctgtgggtgaaccggtaagatttttctttccacatgtagcttaaatttattaatttaaattgtgtaatagagacgagtaaatataattgatgtaagaaatgttttcattttcagacgagtgctgattggctctttatatgtccagaagggtttcaagatgttctattatacataaaatcgaagtttcaaaatccagtaatcctcgtcactgagaatggtaggtcaaagtaaaagataagttgggtttataggcgaaatgtataccatcaattgcaaccagttaatgatctctacttgctacattgctaaaaaaaagccaaaataatatatgtaattttagaaataaaaagatattaaaaaaaacatacaattataattttaggaattgataaacttttaatttgtaggtaaatcggatatattggtcaaacaatttgattgcaagtgttttattactttggccctacttattctgatatttacatactttgggggggcattttacctccttaattaggaatgcctagcgagaatgacaaatcattgtccgtgaacatagcactcaatgacgaggcaaagatcaaatatcaccaactccatctcactgctcttctagaagcagtcaggtaattatattaatttcatatacaaagaatttcaaatatccagacttctgtcatagttttacaaaaaaattaataatgttgatgactgatgtgtttttctttcatggaacattgaaacagtcaaggagcagatgtgagaggatattatatatggtcattaatggatgattttgagtgggaatttggttacaaatatagatacggattggtctacgttgattttcaagatggacttaaacgacacctcaagagttctgctctttggtaccatcattttctatccaactcatcctcctatcaaatggactagcaaggaatatctaaaattaatatcttcactttatacaactttcttatgtattcctaagaataaaatgaaacatgcaactttagcagtactgtttatcccagactgggacacgaatatatgtatcaagatttttttgtgtggccatcaaaacatattgggccgtggttctaggcttcaagcactcggttttcagatccgaaccgggttgaatgttgggtcttcagatgacgacccggagaggaatttacttggactcacccacttcatatctatgtactaatgaaaataaaaatatccaacaggccattacggatgatcatcacacaattattgcatgcaccaacccattatcaatatttttgttttttgtttgcaaaacacaattatcaaatcggcaagtagatgttagtcttaatcactggaataatgacgaaactattcgagtgattaactgattatatatatacttttctgtcagtgactatatttagtataaccaaagaaagtatttaaatagtgttgcaatttctttataaccgatctgaagtttgagctgttatgtgattttttatctttttttttgtttttattctttccgctttcgtaaaagctttttataaaccattgatagactgatagtgaaagaaattagtcgacgaaaaaaaaaaaggaaaaaaaatcgacgacaaagttgaccaattagatgccacgtcatcaagactaattgtaatttgtcaagtggtccccgcttcgtagagcccaaagacgaaatcttattcacgtgcttgtaaattaccaatatgcccttcttaagttccggtgaacgattcaaagtcaacgacgacccccatgggtcgatctaaaaaagagttgactggaggataaacaataaaaatatacaacattaggctatatatttgttgaacattaaaaaaagttataaaatttgttgaacaagaaaaggttataaatttagaatctacacacaacaaaacgaggacttgaagacctcgttgtttcctaaagactgaaatctgttgttcctaatgatatgaacatcattaggcgcaaagtatctaatttgaattgtgcgtgcatgttttttctttttaattattgacttattgtgcatgcatgttaatttacgattctaatttctaaagcattagcctctttcgtaacttagtggaactttaagttacaaaaaaaattatgaaaatccattcgattaattaggtgtagttggatttgggtcaccatggaactcatttatattattgacctgtccttttctcacttgatctattgtttatttagagaatatggtaactgttacaagatgtttggtaaattatagcctaaccaagctaacataaacgtaaataatatcgaataactcaattttgaaggtgaaaatggattattgattattatttatatactatggactatggagattggagacagacaatattcacggtaagaataatcgacaatggacaaatttaatatcaaattaaaaataaaaaaatatattaaaatatgctagtgtgctgaaaattttgaagttgaccggtcttcttgatattttttgtaacaaacaaaaaaactagctgcaataggactcaatcaatacgattgaaaaaataataaaaatcccataaaaaaataattgtaatcctagtttgacttctcaattctctgcatctctcaatcacgcatttatatatcatatcattcaagcctttttatcttagtgtctctctataaccagagaaattatttcaagatctacttctcatcatcgttcttttcttatctcttcttgtccaacttcttctgaatcaagacaagagaaaagcaaccaaag

SEQ ID NO: 11999 - DNA, 3000 bp, Unknown
  misc_feature (1)..( 3000): cDNA_ID_3023617_gDNA_ID_2214527_Annot_ID_184801 3000 nt of promoter + ATG
tgttaagactcccaattcgaaataaactatcattcatatttatgtaattatgttgcaaatgtagtgttggagccaatgtgaagggatttttcgcatggtcgttgctagacaatttcgaatgggcaatgggatacacggtccggtttggactggtttatgtggatttcaaagacggatgtaagagatatcccaagaaatcagctgaatggttcagaaagttattgaatgaaaagaaaaacgattgatgatgatgagatatgtatatttcattatattagtttctctgttactcttgagagatttatatattttttcccccctttggaaataatgagaaatggttttagctattttcacaacgaaacccgattgatgtatagctgatggaaatcatctttcgatgtaattacgtacgttttataaggaaacttaatattaaacttgttgaaaaagttaaaaaaaaaatagaatgtgaaaacgatataggcaaagagtatgtaacatctacaactttcagcatatatcaatttgaaaaaaaatgttcaatctttaaatttttgaagaatctcatggttttcaaagatcatcatttatggtattatgagttggattattgatatttttttaaagattgtgatggtcccattattgattatagcatgtgagatgttgacagaactgctataatgtgtaacaattattcgcttcgatgtgagaatattctattaatacgcattcaaatagaaaagcccagtgaatatgaaaccaccaaatataaaagcctcacaatttatttatttattttaggctctgaatttttttattttcttattatggtaaatcgtctttttttgttaactttgtctcacattcccttagatggcaaattagcatcttactttacctgaatcatttaacttgaactgaaatgttaacgttaatgtgttccaaactttcaatctcaaaaaccaatttagtaatcgttcaagcagaatttgtatcaaacttttcttgtgtatcaaacaaagaaaaaaaagaaaaaaaaagaaaactgacgttatttcttttttcgttttgaaaaagtaaacttacgatgacgtcatttcaggaggtttaagcttcaacttttccactaatttcgaatcattcgaaggtttaaccgtttaaatacatctttttctcacactaatttctaagttactactacaatattattctctacgaccccaccactaaccactattatccgaacttccgaaggaaaagttcgtcacgccgtctgactttagaaaagcacaaagagtaagatctcaactagtctctcatgcgtgcatagcaacaacgtaacaagaagtcagtaaaggcggactctatatgcgaacttagtacctgaatctgatccaaagacttatgcacggtttgatgtaaaatcagtagtctagtcgattatttttagtgagttttaattagtaatagctacataaatcctaagttcaagttacgactattggtttacgctttcgcatatattatattaaaactgatagaggaatatcaagatcgagaaaagtttgttagagaacaaaagcaacaaactcattctcattcattctcttaatcaaaatgattacatttccctctcttatatagtatgatagttaacgagacattaagccaatgttgaatacacggtttacataaaccgatcttaatcgattctatactctaatacattgcgttggtagctcacatgacataagattactttatattatttaaatcattctgaacattatcttaatgggctaagctttcccaatttgaccatgcccaactttttaagagaagatatgttttaaaattaaattgcgtatacagattcacttgacgtcactagccacgtatagtacgaacttatgaatgaagacataattgcaaccatatccaaactgattaactatactgtatccgtatgtataacacctacaacgcctgcttgtaaatcatacaggaatgaatttaagtattttttatatcttcgttaccaataccatatcaaatacattatgtggaaaaaattcaaggcacatgttcatccaccagcgaataaaaggaacaatatctttctttgtggatattcaaatgcaggataattcacattctttcatatttgcatttttaaatacatggaattaatctttgatgtcatttccttgtggaatcggaattggatgtttttgataagcatttcataatttcaaagattaattccagaagaaaacgaatttttaaaaaaaacatttatctaaattttcaataactaaaactccaattcctttgggataaaataaaattccaattccacaggaaatcaaaaacaaaatcgacaaaaagggtttggattgtaatgaatgttacaccgcaacagccacgatatgaacaaagtccgtaaaagggaacgtcagctttttcgaacgtgaaagttgtaagcgctccagagtgttttacatgcaaaaagggttttcgacagtactgaacatagccaattttaagaccacattcaatctccacttgtccaagtacaaacacacatgcatagacactaagacacacacttatttctatagattagaatgtaagcagtgatcccgaccacattcaaacacgaagatgaacagaagctaagatacggtctcatttgggggtaaaaagaaaaggaaaccaaacttgaattctcttccttatttaattatattactatacttctcttcattagggcaaatcattgtttaatgttaattaagttactttatgatagtaattacatactaatatgagtataagaacatacctttccacgtagaccaacaacgtcacgagactaagctctatatataggagaagagaaatgcttagtttgttacaactacaaatctcatctttgaaacagtttgaagaaaatacataacacttttaaattccaaaacacaaaaaaggaat

SEQ ID NO: 12000 - DNA, 3000 bp, Unknown
  misc_feature (1)..( 3000): cDNA_ID_1807359_gDNA_ID_2214527_Annot_ID_184800 3000 nt of promoter + ATG
agtgggatcagcttgaggatgaaaagaaggtgaagaactagcgaatggttgagaaggaattggctggtttggtttgtgcgtcttcatagaagctgaaacagaagggcttggcaatgtatcgtgaaccacttgagcagcattgcgcatacttggctgcattcctccagattgtctccattccctaataaccgaaaaagcatttgttattgataggaaaagagaagaagcttttcacttgctcatcggataaatgctcagatttaagatcttgccttatccttcgtattgtatcatctgagttaacacggcctagaagctctctatgctcctcattcgataaactcaactctttacgtaattcagttatgacactttctttttcctgaacataaaatacatgttattccacctaaccagacactaacacaacaagagaaatcaaagtagatcaaaaaatacccatgaaatagcatctccttgggctttaaaggctcttaaaacagagatatatgcttccttctcaatctggtgaatctgagcttccatatccgcagcaagatcatcatacatctttgggtaagatggcggaagattcaaaggtcttccattaccagccacgcgtcctcctcttcctcctcctcctcctcgtggaactctatgcgacggtggcagatcatcatcagttcctgaatacaccaccggtaaaatcaatcaatgttgcattctcaataatcaaacctttgtgaatcaatcattaccacacattacattcaaaaggtttcagcttaaatcaagaaacagcaagatccaaaatttcaactaaaaacaccaatccaccaaaataacacaatgtataacagtaatcgcacggagaaatcccaaaagttgtgaaaaccctaattttcagtgactgatagagaaggcgagagaaattctacacagttttcgggaactaaccactgctatcagacgatttgcagtccatgacgaagcttaaatcaagagacgaatctcgaagatgaaaattggagaagctagacgaagaatcaagcacaatttgccaaggttgatttcaatttgacttagaagaggactcgatttttggttttgagctcaattttgtactttgtcgagctgctataagaaagaagcgacggatcaatttcttgctccggtaacaaatctgagcttcactataagtgattcagcttaaaagattacagattttgcctaaagctcattatttgccaaaattagaagaactcagacgaaatttaattttataagaacaaaagtaaacaaatttgttgagaaaataaattttcgtagattcattctcattaaaattatcaaaatagttacgagggaaataaaacaccgtcgtttcgtccccagccacgtgttcacgtagagatttaaaaataaaaaataaactgaaaattagatatatcacaaaaccccgaagctgtgtaaagccttacccaagcccattagttttataagtaggcccaactatttgtatgttaaattgataaacaaacgtatgttattgcttcgatgtgttcaagtaagtaaaatacaacaacgtacgttagtacggtaaagaaagagttcaattttgatggatcctctaattctttttttatattatttgttattcttcaaatttgttgaagtgcaatagctcaccaaagatactacgagtctacgataaagaaagagttcaattttgatggatcctctatttttttttttttcttccaatgattctatgtcacattgtaattctacctaagcctgcatgcttatgtaaattgtaatcacgaggaaaatcagttttagaaacgagcaaaacctcactcgtatacttttagtttacgcggtgtctccgaagacgatcgattctaattataatcggcattacattgttgatatatggaaggttcttcaatgaacagtgtgagtttcctaagaaacagctaaacagttatcggtgatcgctaaaacctttcacagtttgataaagttttctcctgctctagtttaatttcatcaattttggaataaattttatttaaattatttttggcttacaaataaatttgtattggactgttcttgtaaaaattaaaacttttgtaatgaatagttgttaaatataaatattttgatagttaaattattactaactattaagaatttagtccatatttaatttaatatgaactaaattctttgtttttgatcaaaaaacttataaaattaaacgtggaaaaagatccgatcctctcaaaccaaaacaatgacttggttcgtcacattgaaaatcaaagagagtgttaattaatttattaaatatatcatgttaggtttgataaataaaattgttattctgaccgacagtccaaatcccaaacgcgttccagactacaccaacctgtgaaaataaacgtttaaaaaagaaagaaagactcaaagaagtaaaacaaaagtaattaattaaaatttgaaatagtagccgttacaagaaacttgtcgatatttgtatcaaaagacgtttttacacaaaatgacgaaaactggacttatcaataaaactaacacgtcttcacgtttccttgagaaattagcacatctaagtaaatgtctacacgacgtgcaatgatgcttttctttctctaattttttctttttaataatgactcagctactttagatttatttttgaaaaaattcactcacgttttatcattcttttcctattttgatataacttgataaggtcatttttgaattttccgtttactaattaagaaaattagaatattttatcatactctctttctctttccctctatcagatcatctttctcaaatagctctatttagatattcacatacatatccagttgtgattctcttccttatataaacctccacttaactcatcttcttaaaaacaaaactaagattgaataatcataaagaagaaaactaaga

SEQ ID NO: 12001 - DNA, 3000 bp, Unknown
  misc_feature (1)..( 3000): cDNA_ID_2708092_gDNA_ID_2214527_Annot_ID_184798 3000 nt of promoter + ATG
gagtagctctttttcattgtcttcttcatcgcaggtagatttctttttcttcgtctctcacgaatctctatctagttgcttaactaggatttgtctttatatgttaagtgatgtggttctagatctttaaacctggaattgattttgctcaatatgatgttcttatgttatctcatgataagtaatcattggtctatttcacagtttgtttgactttgaatggctacatcatttggtgaacagggaagtagcttgcttgttgatgtaatgagtcatcctgtgataacgttagcttctgattcctttaagaatcttgaggaaaagaatgtttctttcgatgaaagtgattcagagagctcaacaaaagacagatatgtttacatattccaaagagaatttgctgttgtgaatccagctcttgttgatgttagttgttgttacctcactagccccatcttaaaatggttacactctagtgtttccttgttgtctaatgattttgctcaatttttttattgcatgagaattagtttgttggcaccgatgaagcaacaacttgtgtaggccttgttatccgcaacagaaaatctggaatgtaagcatttgatccttttatatgcttattaagaggatgagttgcaaaagtttatgaccatctgaaattgcaggacgtctgttgcacacatggattcgccagagattgtggatttggggataagccagatgttgttattggttttacaggatgacgtagatgccgagttagatgtattatcactctcctttttacattaccaagtgtcttcgagtttatgttaatgattcagtattttattctgagtgcttttgaatatctccacggctttgtatgcaggtacatatggttggtggttatgaagatgtcgacataaaagtttgtctctagattttctatttctcagtctacttagttctaagctgtagagaggtctttagctgaatgtcttgaccgttatgtgcagaatgctgatggtgttggtgactatgccaaaccagagggttattcatttccgttgtgttgcaaattagtagaaactttgcagaagagaagagaaaactttcacattcaaaccctctttattcttgggcacaataccaagttggattcacaagcaaacacgtgccccatttttaatggatgcctggttagtagtctaatatgtctgcttcttctctactatgctaattagaagatgtactaagtcattctttacaaatagagaaatggaaattgaccctcattcatctaaacttgataggtgacatgtactaagtacacttttgtaattggttttcattgtcaaaatactgtctttcttccttagggactaactagacaatagaattgcttgaaatttgttcatatgaatcagtaatcagcgtaaccatgtttctttataacctttttatcaggtgaataccagcaccggtgcaatcttgccagccagtttcaacagaacatctagatgtccggatgagatcgttagaagaattcgagtttcatcatcgtttgaagattctagctggaagggaaagttacttgacacatatgacacaaaaactgatagattcatcatcgcaccatgccgctggtaaaaacaaaacgctacttctgtcacattacatataattgcatctaccattatatattgtctttctcaccagatttaatgtaattactctatccactactcctcattacagtttcataaatcgtgtttatgtttgtaatataggacaatgcgcttgattgaatatgtttgggaacttaatcagcttactgatgaagaaatcctcactaactgttccacctcaccttctgctgaaggtccagacttcgtaaacagtttaagaaggttagtcattttggaagcttccactggatcattatctagaacacaaacaggacataggaaaatttgcattctctttctttttgtgtgttttaggaattggggatatttactgaaatatccagaatggagcaaaacattcccaaggaggcaaccacgtgtgtttgaaagaactgtcgatggacactggaaaaaatgctgactttctcatctaatcatcatgacattatccagaaatctggctaaaaacaacggttagtgtatctaacattttgagatttatgtaaatggtcaagaacacatgtgattgattcttggacacagaaaatgtttgatttatctttttgactttttgtatcaaacgttgcaagtttggttcctatgaaaatatgggccggatcaggcccggtagacctatatgttgcccatggtagacattccaatctcaaatccaaaccagagacattccaatcgaaacaataatacacttaggccttagcatgatttcgtaaacgtagtccgacctaactttcaccaacaaaacgacggatataaggcattctgtttctagaaagtagaataaaccaaagagggccattcttgtaataccttatttccgaaagatgttgaactaagcctaaccgggctggatataataaggcatcgttatgggttttaaatttacaatttaactaacgaaaaggaaaaagggaataggtcaaaggataaaaagcagcggttaaaactagggttacttaatccacttttcggttttaattacttatttatttccccttgaattggtgtagtcgtatgctagtattactattagatctcattacttatagggaacaaatataaactcgatagtttgatttgatttgaatttatttagattagattataccgtaatgaaaaaacacagtagtatttaaataagaaaaaaaagcacaaaaataacaagcgagcgagttagacaagaagaaagcaacaatacaaatttaaatacaaaataaattatataaaaagagaataaaaatccctaaaactgcgagcgtttttgtttgtgagagagaagaagagagagacgagtctgtatggcaaaagg

SEQ ID NO: 12002 - DNA, 3000 bp, Unknown; identical to SEQ ID NO: 11997
  misc_feature (1)..( 3000): cDNA_ID_3023632_gDNA_ID_2214527_Annot_ID_184790 3000 nt of promoter + ATG

SEQ ID NO: 12003 - DNA, 3000 bp, Unknown; identical to SEQ ID NO: 11996
  misc_feature (1)..( 3000): cDNA_ID_2992390_gDNA_ID_2214527_Annot_ID_184785 3000 nt of promoter + ATG

SEQ ID NO: 12004 - DNA, 3000 bp, Unknown
  misc_feature (1)..( 3000): cDNA_ID_3023636_gDNA_ID_2214527_Annot_ID_184784 3000 nt of promoter + ATG
atgaaatagtagcaagaattaatgtttttcttttcatttaaatttattataattgcaaaaagaaaagttttaccaaaaaacagtcgagtccaataatcaatatgagtaaatggttcgcatttttattttaaaaattgaattttttaagagcttgaaaattgaatttaacaaaaaaaacaaaaaaaggatcggtcaaacaaaacaaaaagggttgaaaattgacttaccaaagtctttataaagttgataaacttttgccttgttataaaaaaaatctactataaacagattgcgcgtctggagataactgatttttttttttttgatatttgagatttattatctcacattttctttaaaaaatcaaatcagaaaaaagaagaatggaatcaacaatcatggaggattgttctagctagttaaaaaatgacttacgtaccgaaatttttttaaaaaaaattaatagtctcgataaaatatactcttattaattattaattaaccgattgggcgaatggagataatgatgttgacattcgagaatcacctgttctcacaatttttcattaccaaataaaaaataaatccatgaacttgtctacacggcaatgcatgcaatttcacagaaacttacatatacaataatattttagaaaaagataaataatgctagatgagttaggaaacaaatggtagtgaaaacttaaatcagaacaaacaaaatggagtcacggaagattaaagtaatggcgacagcaatagctttaataatggtggctatggtggtggatgccgccggagctgataaagggaaagacaaggaagagtgtacggcgcagctggtcggtatggccacatgtcttccttacgtgcaaggaaaggcaaaatctccgacgccagactgttgctccggcctcaaacaagttattaattccgacatgaagtgtctttgtatgatcatccaagagaggaatgatcctgatttgggtctccaggtcaacgtctctctcgctctcgctcttccttctgtttgccacgccactgctgacatcactaagtgccctggttcgtagcttggttttacctctcttgcattttacgatatattctttgttacgtgcggtttgattaaaacagagtatgtatagacattttaaacaaacaagtgaaaatttattatagactaatattagcagactagtaatatttttgggatgggtgttctgtttcagctttgcttcatttggacccaaattctccggatgcccaagtgttctatcagctagctaaaggtctgaacgaaacagtctcagcctctgctcccactggctcggcctctgagcccactagtatgtcttcgaccccaggatccagtgctggtaacaacagtggtcggacgacctctgtgccaggcacgaaccacgctcaaagcttctccaaacaatggctagggctcgaagttgttgcccatttcttcgtaattttttatattttcatcctcgtttagataagtgaaaaggatgtgacgttggttttgtgcaactgtggacatttgcggtgacgttgattttgagttttgagtcttttgactgatgaatgtagtttcacttcgtgacaactcttctcagctttttattttttgtatggcgcaacataagacacgagcaatagttattctatggctcgtttgcttttatcaattttatttaaaatcttttacttgagttcgttgagtctaatggtttggtttctcttaatttcatgcatacaaacgtaatttcatttacgttagtctattgatcgacagattaattggaattattattgtggctatttgaaataaataaagattttattaaaaaattttatgcaccaataaaaaaatcagaaaaagcaaagagaagagtgagggatcgaatccacaagaaaaataaaagaggtaaaccacaaagcaaaaatagaacatgatgatcattgaattgaagggcacaaattaagctgtagattcagtatccaagttgtaatatgtttacatatcaactgatattaattggtgcacttgacaaatggcaagtctttaataagtttctatgtaaacaatcaaaaccggactactgaacttcaactttatgattcatccaagagtaaggattacatgaagtcaggaacaattcaatataatttaacaaaacgtagttgaacatttcggcaacccgccgaatttagcctaactaattttatttgtacaaaattgctaaattattctcttattacataaatgttttgcaaaaatatattcgtttcaggcagacaagtaacagcacatagagaaccaaaatatattcaactacaactagatttcgaagaatctgttgcaaacgtttttattataccatccaaaaacttcccatgcccaaatccatagagcaatcacatgaccgcacagtttcccatattatcttctctatctgtctcttctcttcacgatcgtgtgaatgaattttcgattattcttttccttttgtggtcaagaatactaaattcgaaaagaataacgtgtttacgcagacaataataaaattagtgtaacgtattattaatacaaatacaatgatgcaagtttctcgttaagcagagctcacacaaactttctcattcaccgttacttttttcttttcttttctttttctaattcccgtactttgggacaattctaataaaaaggctttgttgactcaaattcgatttttcagatcgaaagtttcttcctttcgaccctacaggcagatacgaaagtttgttccttgctcgtttcgaaatctctcttctcttcctcaatttctctgataaaaaagttcgaatctttagatgcaatttagtctattccaggtgttgggaattccaaattcttgacgggttttgcatgcacgtctttgcaggttcgaattgttgaagaaaacaaaaacaaattttgtctcttttgaaaacgattagttgatg

SEQ ID NO: 12005 - DNA, 3000 bp, Unknown; identical to SEQ ID NO: 11994
  misc_feature (1)..( 3000): cDNA_ID_2708139_gDNA_ID_2214527_Annot_ID_184779 3000 nt of promoter + ATG

SEQ ID NO: 12006 - DNA, 3000 bp, Unknown
  misc_feature (1)..( 3000): cDNA_ID_3023651_gDNA_ID_2214527_Annot_ID_184778 3000 nt of promoter + ATG
ttaactatggcgacaagggttagtttcttcttagctctggtaatgacggtggtgattcttgctccttctgtcgtctctggagaaaatgggttttccgatcttaaaatccgtactcacttgaaacgactcaacaagccagctctcaaatcgattaaggtgaattccacagtgatattagagagaaaactccataaaagtttcattcttttgctgttttctgggaataattttgagtttcttaaacagagcccagatggagatatgattgactgtgttccaatcactgaccaaccagcttttgctcatcctctgctcattaatcacactgtccaggttctgtttactcttctttcttttgtttgattctctgttgtttttcttctgtatagttctgacattgttgttgtttatgggtgtattatagatgtggccaagtttgaacccagaaagtgtatttagtgagagtaaagtttcatcaaaaaccaagaatcagcagtctaatgctatacatcagctttggcatgtgaatgggaaatgtccaaagaacacaattcccatcagaagaacgagaagacaagatctttacagagcgagttccgttgagaattacggtatgaagaatcagaagagtatccctaaacctaaatcttctgagccacctaatgtccttacacaaaatggtcatcaggtaattatttttcttcacatatgaattagttttggccaatttttgttgtgtctattaacctcttcctttaccttttgttgttgatttagcacgcgataatgtatgtcgaagatggggttttctacggggctaaagcgaagataaatgtatggaagccggatgttgaaatgcctaatgagtttagcttagctcagatttgggttttaggtggaaatttcaactctgatcttaatagtattgaagctggctggcaggtatttttcttctttcggtttttgatagttctttcctgaaaaagaaactgtttttgattcaaagatttgtgttttcaggtcagcccacaattgtatggtgataataggaccagactcttcacttattggactgtaagtttcagactattcaatctagatttttgtttttgtgtgttttggctttcttgatgaatcattcttttgtctctcacttgtgaaaacagagtgatgcataccaaggcacaggctgctataatcttctatgctcaggatttgttcaaatcaatagagaaatcgcaatgggtggatcaatctctcctttatcaaactatggaaactctcaatatgacatcaccatactcatctggaaggtaaaccaacaacaaatatccatgttgttaccatctatttagtggtttagctatggtttgagaaatttcagttttgtttttttgttttttctcaggatccaaaagaaggacattggtggttacagtttggagagaaatacataataggatactggccagcttcactcttctcttacttatcagaaagtgcatcgatgatcgaatggggaggcgaagtggttaactcgcagtccgaggaaggacaacacacaaccactcagatgggaagtgggaggtttgcagaggaaggttggggaaaagcgagttacttcaagaacgttcaagtagttgatggatcgaatgaactgagaaacccggagaatcttcaagtgtttactgatcaagagaactgttacaatgtgaaaagtgggaatggaggttcttggggaagttacttctactatggtggtcctggtcgaaaccctaattgcccttaaagatttggtcgacttactcacattgcagatcattccaaatcaattgtataaaaaacatataatatatatatatacacattcttaagtatattattaatttcaggtttgaagagtggtatatggtatattcaaattcatctgcagaatttgtttgtttgtgtgtttgagagtgttttctctgtttccatggagtgaagagaagataaatttcttttaaagaacatggtcccatgtgtatactgaaatcaaatgatcccattattaatttatttgtatttttttttttgtatatgagtggtactttgttttcaatgacctgtgttaatagctttgtctgtatgtaccaaaacatggagatgggacttttggctttggatcttcattaatcactcatgtttaacagtatctatcagaattattggccaatcttcattacactaatactattatgtataaatctattaactatttttgtgatacttcatttaagactaacataaactttgttttttttttaattatcagcaagcttccattgtattggaactatgtttttgtgattgatcaacaaaacagaagcaagttaaaatttacaacttgaaatttttttcttataattatctcaaattaaacttataattacatctatgtgaatgacagatctatcttctcatgtccactgttatagtcaacgaaatgtttggggccataagccacaagagagttgactttgatcacgttgacgagttctcaatcataaaagcataatcaatttaacatagtatgagacttataattaatttaacaaagtattcaatggtgccaaaagaaagttcaataaagtaccgaccatattaaaattcatgtagagatttaatttaaaagtgaacatggtgcaatttacaagttcgtgacctctacgcggaatggttcatgcagagtaacaaacaaatgataatttaatttaatagaatgataattgatttatatttgcttcaaagagaaaaaagtttaaaactgaattatatccttcttgtcaatgtcacagatagtttaatactttatatagataacgtcgaagacgaggttacaaaaaaaaaagaaaaaagaattctggttagagttgagaaaaaatagtaagttatgtagcattccacttctataaattccaatgaatactgtctaaaagttttgctaagaactgtatagcc

SEQ ID NO: 12007 - DNA, 3000 bp, Unknown; identical to SEQ ID NO: 11992
  misc_feature (1)..( 3000): cDNA_ID_1014010_gDNA_ID_2214527_Annot_ID_184777 3000 nt of promoter + ATG

SEQ ID NO: 12008 - DNA, 3000 bp, Unknown; identical to SEQ ID NO: 12001
  misc_feature (1)..( 3000): cDNA_ID_2708092_gDNA_ID_2214527_Annot_ID_134188 3000 nt of promoter + ATG

SEQ ID NO: 12009 - DNA, 3000 bp, Unknown; identical to SEQ ID NO: 12000
  misc_feature (1)..( 3000): cDNA_ID_1807359_gDNA_ID_2214527_Annot_ID_134190 3000 nt of promoter + ATG

SEQ ID NO: 12010 - DNA, 3000 bp, Unknown; identical to SEQ ID NO: 11999
  misc_feature (1)..( 3000): cDNA_ID_2708084_gDNA_ID_2214527_Annot_ID_134191 3000 nt of promoter + ATG

SEQ ID NO: 12011 - DNA, 3000 bp, Unknown; identical to SEQ ID NO: 11998
  misc_feature (1)..( 3000): cDNA_ID_1807107_gDNA_ID_2214527_Annot_ID_134194 3000 nt of promoter + ATG

SEQ ID NO: 12012 - DNA, 3000 bp, Unknown
  misc_feature (1)..( 3000): cDNA_ID_3023761_gDNA_ID_2214528_Annot_ID_134197 3000 nt of promoter + ATG
tcaaatttaatttagttacttgaattttttttttgttaaagagttacttgaaaaattttcggatatcaaaacttcgaaagagaagtaaactttatatcaaatattattttatataaatatgtggcgataccaaagtaagataagtaaataacgagtacagtgatatattatagtaagcagggatgatgtagaggattgggacgtgtacgttggttgtttgaaaacatatgttccaacaaaagagagtcttgagtgaatctaagctttaaggatcttcacagtctcttggaagactctctctttgacactttacccaattattccattcctttcaagcaacataagacaacgatcgttggattcagcttcacttggcaaatctactgttaatctgtctcatctcctttttctctagatatttggtaactttagaattaagatggtgcattcaatgtttaaatttggtgagattactcacttcatttccatttatctcatctgactataagaaaacatcgaacttaattaggaatgtttgaaatgtaagttaagattggtgtcttgctcatagtaggaaaagaatgtaaaaagtaaaaaaaactatatgatttggaaaaatatctaattaataggtggcaagaaggttcttgcgaatttagcttcgagtaaattgttagacgatacttaaaaatcgattacttcaaatgaataacttgcacatagtttgtgatgaaatgaatctaagctataaaaaaaaaattgtgtgttcacgatgagaaaagtatagtaagtacaaataaacaaggcaccaaattcttgaggagtttcgatttctttaaaatatacttttttttggggtttttttacacgtctcgtgaatgtttactaaatttgctaacaaccaaatttagaaattaaaatataagttcagaaagtaactagtaaacaagagatggtattagttaaggctaaagtgatactggtaaatgatgaggaattagaaatttagaaacatggttttactaaaagtaagaaagaacataataatgttggtcgttagttgtagccttgtaggtttaccaacttcaaccctttcctttacttattacatatttttaacatttatgtttgtatccaataaacattaacaagttgtaactacataactttttgttttctgaaagaataaattactttactgtgcttttgtaaatcctcttgagattttttttgagagaaaattatcattactttatttggaaattggttttacgaaaaattgatcatacacaatttactaaccaactcatgattcgatcaataggtatatcacccaaaaaatatattctcttctagtgtttcagcgtgtaagtttagccattataataacgcttgactttgaatttataaaataatgtgattattagtcggtgacaagaataattcaactaatcataagaatggtggcttccaaaaggaccaaaaccatgaataccatacgtatacaaacgaataaattcgatttataaggccgaattcattgggccttataactaatcaaatttacaaaatggataaaataaaattgaaactaaagcccattatatgaatttaaagcctaacaaaatttcattttgccgtccttagaccaacaccgattcgcacgccgactcgtggacttcggagggcaatcatgaccaagcacgatcggagactcaaagatacctttcttaatttaatcgcattactctcattctaaccgttatggacaacattttaaccggaatagttacaaataatgccattaaattgatacatttaaagagagaggtttgactaatgaccaacttttaacctccaaattaggaaataaatacattaaaagatgaacagtgatagtaggtggtaaccaagtaaaaaaaaaacttccattttctgaaaactcacaatgtttaccttttggtatttgattttacttcaaaaaggagcatttataacaaagaaactatactattgcagagagaacatgcaaatcaaatggactttttgtttcagagtttcacaccttttatttatttctgtttttggtgaatcaatctgaatcatatcaaaaacagaaaaacagaaatagtatgattccattaatatctagtcagaaaaaaacacagctggactaaatagcttacattctaaagtttgaatgaaaacagtttgtaacaattcatgttttaagtattaaataccgaaattatgtcatttttaatccaatttaaatgatgaaaaattagattacaattttttttaaaaaaatttcaacaggaagatctttgagtatattttcttataaagaatattaacatttacgtatatatcttctctcgcgaaataagcatatatccaaaattataagtatatataaatagaaaaaataatcatagaatcttgaagtgttgtactttgttaaagctgtgtccttaaacccaaaactgaaacacacacagaagacagaagaactcgaaacagctccaaacgtgtgagtctgagattcctcagctctctctgaaacacaaaagacaatattaaagttttgctctgtttttttttttttaattaatgctttttataatttttcaattccttatgcaatcactaggtcagatcaacaacaacaaccctaataatgattcacagtaaattttttttttaaaattttttttcacaaaaaccctaagggtttcttacatcgccgtcgatttttttcttctaactctctataaaacccagtttcttcttaaagtttcgatttttctatttctcatcatctgatcattgtgtttagggttttttttttttttaattgaaaacgacagtaatacatggagattggattttgagtactagcttaaagttttgatctttgggtttagttttggggtataaaggtgtcatctttaggatttttagcgtaattgattttgggggtttcttgttgtttaggtg

SEQ ID NO: 12013 - DNA, 3000 bp, Unknown
  misc_feature (1)..( 3000): cDNA_ID_2708154_gDNA_ID_2214528_Annot_ID_134198 3000 nt of promoter + ATG
aggacaagaaaaatacaagtggctatgtctttacttctggatcaggtgcattttgttggaattctagcaaacagaagaacgttgctcaatcaacgaccgaggcggaactctttatcacatcaaggttcgaagttctacgagaagagctagacgtaacgatgaagccatgatcaaggaggagtgttggaagtgatcaagtcatcatcttattttagaagagatatattatatagtgaagtaactggtttatatatattcgtatcacacatcgaagagatacaaatataattgttaactacaaaacagttacatgtgtgtatgtgtctctacattaggttgtcttctagagacgtgtcccttagtcaaagtgtgtcatgtaaacctataaatacagtttgtatatgtaataaaagtgtgtggttttcgttttataaaaacagagtgaaatatagagtaagacaaaacagagtaaaatctgtgttgtccgatccttaacaactttgagagttcaaagttctacagtattgtggttgctttgggtctattataaatatataggtaaacaatgcgggaacgggtataacaaagccgaccacagagtatacagcacaagattactcatttctgatggctacaaatctcgactcagcttttcatctctcacagctcgcgcatcctttgttgaaagcatctggttcagggagcatcgtgctcatgtcctctactgcaggggttgtacatatcaatgttggttccatctatggagcaactaaaggtttatatatactttaatatatactcaaactattaatgatccttttacgttctgaggctaacatataaatgagtattgtacatatatctacgcgttgtaggagctatgaatcagctagcaaaaaacttagcatgcgagtgggcaagggataacataagggttaattctgtctgtccatggttcatagcaactcctttagctaacattgtaaggcaataaaatgagaaaaaaaatacaaagatctccttaatactaagaaattttataacagatgaatttaacttatgccaaaatctcttaattagtatctcaatgatgaagagttaaagaaagaagtggagcgtaagacaccaatgggacgtgttggaaacgcaaatgaagtatcatcgcttgtcgcatttctctgctttccggctgcttcgtatataacaggtcagacaatctgcgtcgacggaggtttcacggtcaactgcttttctttcaagccagtgctttaaagcattgattgtttgttttatattgcatctatgtttcttcgtttactgtgtatttttattttaaaataaactcgcaatctctagcgtctaaaagtgagttgaacttcatcaagttcgtaggtaagaccaaacaaaactctataacattattacagaaaattccatgattattttctttgataaagaaaaataaaatgtgttgcatcaactaatttgagtcaaaacaataaattaatattgttctttgttattatgatatttttataacaaaacatgaacaagcctaaattgtaacaaaggaacaaccctctttagtacttttcttaaccacaccctaccggaaataatgtctagatctgctagtggatacggagccgtcatcatccatcatcaggaattattttattttcttaaacatgtgatctccgttaagaaactactagccagggatacctaatacatgtgtggtccaacggtcaatgtgccagagatgacactcagcttaaagaacgcttacgtaaatggcaagcaaagggtttcaggtcaccacttctgtctgcgacgtttcttctcgtgaccaacgagagaaactcatggaaaccgtttcctctctttttcaaggaaaacttaacatccttgaaagtatatatatatattataagcttctcctcctcgatcttgggaactacaagaaccaaattatgttgtgtttatacatatataggtcaacaatgctggtacgtttatactcaagccgaccattgagtatacagcagaagaatattcgtttataatggctacaaatctcgagtcagcttgtaatgatatgggtctaaacttgagatttttgtttaaggggggtttcttgtaaagtggtccggtattgtaaccatcaattgaataaattggtgatgtccaaatatttccataatatcaagagacagatgagcttagatagactggtcttgacggttgtgtaaagtaaaattttactgggagaggagtttgcagagaatattgcaccgaatataccaatgcggtgcgctggagagacagaaaaagtggctgcaatgactgcattgctgtgtctacctgcatcttcttatgctacaggtcatgccttctaattaaacgcttccagccttccaccaagtcaatctcaaaccggacaagaatttacattcgatttttgttatatcggtttcttaaaatttagtttgatacattcgatatttcaatgttttgtttccaacattttgaatgagtttgatgaataattcaatgcaatttatctttgttttacgtttgttataataatgactcttattagacccaatcaaagaaatgtaatgaaaataaacgatctggtctcttttacctgtagtctgtagatggtagaaataatttaggaaactgacaatgaaatatgggttgactaattaggccaactagctaaaagaatgttcatgtagtaatatttaaggttctttacattgaacacaaaaagccactatcatatcgtgcaacgttttacaacataaaaaatcatcataatgtggaatttgagatgagacaaagttcaaaacaatcacgttcatttttttatttcttttttggtgttaaacattctcgtaacattctcatggtcaaacctgacacctagacttggtcatatgatattctctataagactatactcttcactgcagaaactgatatccagaaatg

SEQ ID NO: 12014 - DNA, 3000 bp, Unknown
  misc_feature (1)..( 3000): cDNA_ID_2711424_gDNA_ID_2214528_Annot_ID_134200 3000 nt of promoter + ATG
aaattttgatctatttgagcgtttagatcattccctcctccttgttcttctttttctttgaatgccgcatacacttcttctctagattttttccaacgaattggaaaacttctatccatcatcttgatgtccaagatcttctttccttttaagtcttgaatcacacacttgttgtcttcaaagatgactcgatatccgttggatatcatttgagagacactaagcaaatttcttgctagttcgggtacataaagtacatctttgatgacatgatctcctttgtttgtggatactcttatatctcctctgccttcagacacgacctttcgaccattaccaatccttatggtaattttcttgttgcggtccaaagtgatgaagtgtctaacatctttagacatgtgattggtacatccgctatctaccaaccacgtttcttctccaattgttgagatctctttttcttcaacagcactaaagagaatatgacactcatcttcttcttcatcttctgattcttcactacttagatgtgctctttcaccttttttaagtttccaatctctggctatgtgtcctggcttgtcgcacacatagcatcttctttcatagcttccacctctttgtgaaatgctttcactcttctttctgaaacagtctacctcattgtgattgttcctcttacacacgctgcaccacatgttggtcttcccatggcgatttttgtttgcttgttttctgctcttgagccaagcttttctccataaaacgcaccctcattgatacgttcttctcggagactcaagcgcttctcatgcgcattcaaagtacctatcatctctgtcatagagaaagttgatagatcctttgtttgttcaaggaccgcaacgatgctatcaaactgttgcggtaaggagataagaaccttttgaaccaattggtaatcggttttctcttcaccatgaactcttagttgattactcatattaatcaacttggttgtgaaatcatttatgttttcactctcctccatcttcagattctcatattctcttctcaaggtctgaagattaatcatctttacttgtgaacttccttggaactccatctattctcttgcgcttgatgccggagcgattctcggaaatattgaatcagaaactgcactttgaagaatctgaagagccatcatatccttcatcacttgatcatcacgctctctagttaacgccggtgagttttcagacgacgaactcaacgtaattccattttcgataacatcccacaacttccttgttttcaagatggttatcatcttgattttccaaaagccatacgattcaccattgaagattggaataacttgctgcattgttgtctccatagctctgataccatgtagaactttgaactctcaaagttgttaaggatcggacaacacagattttactctgttttgtcttactctatatttcactctgtttttataaaacgaaaaccacacacttttattacatatacaaactgtatttataggtttacatgacacactttgactaagggacacgtctctagaagacaacctaatgtagagacacatacacacatgtaactgttttgtagttaacaattatatttgtatctcttcgatgtgtgatacgaatatatataaaccagttacttcactatataatatatctcttctaaaataagatgatgacttgatcacttccaacaaatacacaacaaaaaaatcacttgatcttgctcaaaaccttatgcattatgctcttatacataaacttacaaggatgttgagttttccttggaagatagaggcaacgttttccatgagtttctctcgttggtcacgagaagaaacgtcgcatacagaagtggtgacctcaaaccctttagcttgccattcacgtacgcattcttgaagctgagtttcgtttctagcacatgtgtggactcttgctcctaacatggctagttcctccaccacagcttccctattcataacacagttgtatacatattgacacgtgcaaatatgtaatatgacatattaatgtattcaatattggattagtagggggactgacccgaggcctttggagccaccggtaacgagagcggtcatgcctccaaggctccatctacatttgtctctcaagttttcttctgctttagccatttctggatactattttcttcaatgaaggtcacatatttaaggccaagaggtggaagactagtcgtgagggtggccaaagatacttttacgtgaattgtttaactttgtcctttgaaacccctgtctgaatgtcttagccacctctgattatgagccacagacccaaagatattttcttggagatctgaatttatggttgagaaaaattcataatgaatgaatgaatgataataatgagtaatgacgttcgtacacagtaaggccttttgatgtttttcttaggttactcaaaataatgggcctcgattaagggttaagccccaactacatgggatcgactcatgtttcattgtttgagaaaaactaaagaccccatgtaacatgggttgagctctgttctgctctagccattgttgtgtaatgatgtattttgatgagaaatgataatgaaaaatggctatttatgatgaattaatgatacgaggctatgagattgtttgaagaaattgaggaaagctaacgtatctcttgacgttgtgactgttgtggtgggtagaaaaattagagatcaaagtaaacaatcttaagactgtagtttagtgatgatggcgtaactaatgatgcataatcaaaaactaatagaaatataaggcccacgaaaataatatattgggcttttcttggcccatcaataatctgttctcaatctcaagaaaacatgaaccgttggatgtaaccaaacagaagtgggttatgtccagaatctgaagagatcagagagtgtgggagtggacggaaag

SEQ ID NO: 12015 - DNA, 3000 bp, Unknown
  misc_feature (1)..( 3000): cDNA_ID_2708197_gDNA_ID_2214528_Annot_ID_134201 3000 nt of promoter + ATG
gctaacgcgtacttggggattttcatggcatgaccgaccagttcggatcaatatggaagccgctttattcagcagaaactcgagacagcaacaactgatgagaaaaacatggtctatgaggagatcatgccacaagctcttgtcctgatgactgacgtttttggaaactatgtgattcagaaggtaatttatttagtcttcctctttggttttattttgaagttaagccatagtaagatgagtgattcctgaattttgcttatcttcctacagttctttgagcatggactcccgccacagaggagagaattggcagagaaactctttgaccatgttttgcctcttagcttacagatgtatggttgccgtgtcatccagaaggtaaagtctagttcccacctgttttactgttctctccattctcaagaacagttaagagtttcattatttttcatatgtttacctttttaggcaattgaggtggttgatctagaccagaaaattaaaatggtgaaagaacttgatggacatgtaatgcgatgtgtacgtgatcagaatgggaaccatgtggttcaaaagtgtattgaatgtgtgcctgaagaaaacatcgagtttattatttcaactttctttggccatgtggtgaccctctccactcacccatatgggtgccgtgttattcaggttcttgctattggtgattgagaaagatgacaccttttttgatcttatgcttctatgtaaaactctttttcatctcctgttgcagagagtattggaacactgccatgaccctgatacacagagtaaggttatggaagaaatcctgtccactgttagtatgctggcccaagatcagtatggaaactatgttgttcaggtttgtaaaaagatatgagttttactccttctggtgattttttatactttgctcaaaactgatacatgttttgtggacagcatgtgctggagcatggaaagcctgatgagcgcactgtgataatcaaagaattggcggggaagattgttcagatgagccagcagaagttcgcatcaaacgttgttgagaaatgtttgacttttggaggtcctgaggaacgagaattgcttgtgaatgagatgctgggaacaactgatgaaaacgagcctcttcaggtctgtcaaacctttatttcagatgattgtcgggggaaataaagaaactattagctcatagcttcttcttcttggtatataggcgatgatgaaggatcagttcgcaaactatgtagtgcagaaagttttggagacctgtgatgaccaacaacgtgagctgatacttactcgcatcaaagtgcatcttactgctttaaaaaagtacacttatggaaagcatgtcgttgcgcgtattgaaaaactcgttgctgctggaggtatgtatatgttcctcttctcttctatgagcacattgcatttactgcatttatttgagaaagagagacaaaataagcatttttatgacatttcattgtctctaagtggttcttttcttatatgcagagaggagaatggctttgcagtccctaacccagccccagatggcttaagaccttaagtaatgtacagcttaactagggtggatggggctgccgtagcgttttgagaattaggtaagatctaaaccggaaataatctgcggggaaattgtgaaggagagctttgttttctctgctaaatctgtaaaattgtgtagtttgcttacggtttttctatacatagaacgaaacatccctctttaggctgatgagtgagagataaaaaggcagagaatggtgtaaagatggattttagggtttccttcacacaaaagagaatggctttttcattgccaaatgtgtagaagtgagaatatgtgttcatgcttttaggacaatcccagtttagagtttttttttctccatctatgtaatttgtttcatcaaactcttgtttcctatttcacgaggaactttttcgtttcggctagtttgcaatcttcttgtttatatcgatccagttgattggtaacgtatcatagatgtaacaatcacatagcaaccttacaaacaaaatcaatcttggtctctctgcacacagtggaatagaatcattcacaatcaatttttaatcttatgaacctcttggtccagttttggctcacattgccttcttttggccacctttcttagacttcttcgatgctttatctttctcaaacctctctctttagtctttactcttcccaagaaactcagtcactccaatgtacacagagatgagaagagtagagaagcacttgtataatcaaagcaacaccatcttgaccaccacttgacacaattgcttcagaagaagaagatgaaaagatgaagcaggaaaaacttctctttaagtcgctgaacaagcttaagtggcaagaagactcttgtgggaagagaaggttctcaagggagaaagagacaaagtgtgattttcttacattgccttaagtgttgtcgtttaacaagaatgtgtcatgtgtctctgtatttaagggactccgaaatgttagggtttccttatgcaaaacaataccaacaattattaatctcaattcttccttccatttctatctctctcactctctttctctctcgatcttcttcttcttcaactcttctgtcgataggctcagtatcggatttttcgtcaacactataaaacccatttttctatctctctgtctaaaagtctttactttaaaacaaacagtgacatgaaaaatcaaagcttcgatacaatctcaggatggatttgagtatcgcttaatgaagttttgatctttgggtttagttctacaacagagtatttcgaggattgtatatattgaggtataaagttttgatctttatgatttttatgtttcttttcctgaagagtttagtgtatatgagtacaatctgataaagtggttatagggtttttgttgtttaggtgataatg

SEQ ID NO: 12016 - DNA, 3000 bp, Unknown
  misc_feature (1)..( 3000): cDNA_ID_2708201_gDNA_ID_2214528_Annot_ID_134202 3000 nt of promoter + ATG
agtacattttaaatataaccttattttttgtaagtaattacataagtatgccattagaaataaaatttaaagagtacattaattcatctctttaataattaagtcaaatactaatttaattaattaaatttaattaaaaaacaaaatacattattaatttccaaaaaagtaaccaattaaaatcaacaaattagatttgatatctaaattatcatattaattttttattaattattatagttcacctctcatctttatatgattctattttggcgaaaaaataatatcatcgttataaaaaaataattagagttttttcgcatatgccataatttgaatttttaaaaactaatataaactgttcaatacatgaaaaaatattataacgggtcaaaaatagatttaagaaaattttctactgaatactgggtcataatttgaatatttatattcaatttcatacatattattttaaaaatttataatcttatatactacaataattaataacatattagatttttttatgtgtatgatgtgattcaatttttaatacaagatagaaaatcctagaattgacgggtttaaatcgatattaatacaagatggtatactacatgtgaaactctaaaattaacaatcaaaatacaagtgtataattttaaacactaaacaatataaataatatcaacaaaacatatacaactcgcagtttactatacatttaaaatcaaataaaataatatcatatatttataatcatctttacaataaaaatttttagtttaaataaaatataagcctacatgtggtatactgcaagttaaaattataaataagcagattaccatcacgatgtccgtaccttctcacatacacacttatcaaaaattataaataagcattttaaatgtaaccttattttttgtaagtaattacataggtatgccattagaaataaaaacttaaaactttttaaaacctcttggtatatacaaattaggattcttcattcataaaatcattattccaagggttttgggatgtcttatgaaatgattttggtagaagaggatgtacatttttttgaataaaaagtagtcagcaaaacatatgttttttttgggagtttttagataattaaatcagagaatagggttgggcatacgagtaacccattcgagttctggtagaacccgttcgggtttgggattaatgggtatatgatttactatccaatagaataattctaaatatttggttctggttcgggtcggatccagttgggtttgggtcagtttggataaaaagtttcagaccctaaaaatatccaaaaaaaaatagaaactggaaatttgtatgtacatagcgggtctccaaacaaaaaaaacttttaaatttgttaagttttaataaatttaattatatttgaatatattttacaaaattttgacaaacataacaaatcatttttgaatagtttagttgttttggatatttaggtccaaaattaattgacatatttaaatttataattataatcttagataattagataatattacgattaaatataattaatattttggatattaaattaatgtttgggtttttgaatactttgttttgtaccaggtaatttccagaccaatcggatatccacgggtttactaaaactctacccaataaggaaatttcctaaaattttaacccgccctaacccgtttttttggttcgggtattgagttggttattgggtccgttttttcgtcagccctatcaaagataatctaatataggcctcaattaggtccacaaatataatccaaatactatacaaagactaattctaagttaggccaaaaattagaccctttaatacaaaggaaacatgtttcttaccaaaacaacttgtatacaaattttacacatttacttaaaactacatatgttgtatttattataaaaataacatttttaaacaaagtcaattcaatgcagcattatatgcaaatagtaaaaacattgaaaaatattatggcatcacttttatattatactatttcttatgtaattcaaacaaagtatacaatttaatttatacaaaatattaatgttcgtgctgtacagcacgagttatgatctagttctcttttattattgagcgcgctaatttattcctttttaattatcataaaatctttaaaattttaaatagccccaaaaatgttgggtttaaaaagtgtataaaattttagaaacaagtcatatttgatttaggaacatttccacctaaaaaaattagaaacttttagtaaacataaaactttaaggtactttgagaaatgttccaaaattgtggtattgataaaacaaataaagttacacaaaaattaatctataatatactaattttgaactaaaataaaaacctaaagatccttgtcatctagaagtgttgtactttggtaaaggtctctgctctaaaacccaaactgaaacataaagccaaaagatctcaaaacagttccaacgagaaaaataaggtttgttatcttccaattttcataatgtttttttatattcctttgtgcaatcgctaagtcaaaccaaccctaatattatttcgccgtaatttttaatttccaaagataatcataaaaaaaaaggaacaaaaaccctaaggttcttgcatcgccgtcgtattattccgtcaacactataaaacccacattttcctatctctctcaatctaaagtctttgttagggttctttatttttaaaacaaacagtaaccagaaaaaataatcaaatcatcgaatgggtttgagtatcgcttaataaagttttgatctttgggtttagttctaaaaacagagaattttggggattgtatatatttgaggtataaagttttgatctttatgattttttttcgtaatggtgtgagtataaactattgaattgattttgggttttttgttgtttaggtgacaatg

SEQ ID NO: 12017 - DNA, 3000 bp, Unknown
  misc_feature (1)..( 3000): cDNA_ID_2708205_gDNA_ID_2214528_Annot_ID_134203 3000 nt of promoter + ATG
tgacccaaacccaactggatccgacccgaaccagaaccaaatatttagaattattctattggatagtaaatcatatacccattaatcccaaacccgaacgggttctaccagaactcgaatgggttactcgtatgcccaaccctattctctgatttaattatctaaaaactcccaaaaaaaacatatgttttgctgactactttttattcaaaaaaatgtacatcctcttctaccaaaatcatttcataagacatcccaaaacccttggaataatgattttatgaatgaagaatcctaatttgtatataccaagaggttttaaaaagttttaagtttttatttctaatggcatacctatgtaattacttacaaaaaataaggttacatttaaaatgcttatttataatttttgataagtgtgtatgtgagaaggtacggacatcgtgatggtaatctgcttatttataattttaacttgcagtataccacatgtaggcttatattttatttaaactaaaaatttttattgtaaagatgattataaatatatgatattattttatttgattttaaatgtatagtaaactgcgagttgtatatgttttgttgatattatttatattgtttagtgtttaaaattatacacttgtattttgattgttaattttagagtttcacatgtagtataccatcttgtattaatatcgatttaaacccgtcaattctaggattttctatcttgtattaaaaattgaatcacatcatacacataaaaaaatctaatatgttattaattattgtagtatataagattataaatttttaaaataatatgtatgaaattgaatataaatattcaaattatgacccagtattcagtagaaaattttcttaaatctatttttgacccgttataatattttttcatgtattgaacagtttatattagtttttaaaaattcaaattatggcatatgcgaaaaaactctaattatttttttataacgatgatattattttttcgccaaaatagaatcatataaagatgagaggtgaactataataattaataaaaaattaatatgataatttagatatcaaatctaatttgttgattttaattggttacttttttggaaattaataatgtattttgttttttaattaaatttaattaattaaattagtatttgacttaattattaaagagatgaattaatgtactctttaaattttatttctaatggcatacttatgtaattacttacaaaaaataaggttatatttaaaatgtacttcctaaataatatagtaggatttcttaattaggaaaatgacaaaaaaatattatatttacctcttaacttttgagattttatttaaatttatgaaagttttgcttttttttcagcggagatgttaggcgaaacttacattattttcttgtcagcaaagatttggtgaattcgttaattcgatgatgataacgttagtgacggttgcaaaaatgtttctgtttttacggttttttgattcatgtagaggcaaagtttgtttgtaattggaaagaaaaaataaattaaataacgaatcttaaaaagtcttccaagttgatttttttctttactgacataaattttgctttatatatcatacaaatacgtcaaagtccataatttcgatgatggtgatgacaaaagaaaatatgttattatcttttgcatgacatgccctcatatatgaaactgaaacacagagttatgagctcatctatatatacatttttgctgctactttgtgaaataaatactggagttgggatttatttacaacggctgccactggcatttaataattgtttttgataattagaaagaaaatcttctaattaaatatttgacatttaacaatcttcccaaaatctctcaaccttaactacacgattaattactaaaataaaacttctaaaatatttaatatcatttaattactacaaaattatcatttttgatattgcttttctgcatgattataatcatcaaaccgtagagatatttgatagcatttaattactacaaaattacaaaatatttagacaataattcataaacatatcataaataaaatcaacattaataaaataaatgagttttttttagaggacgggttggcgggacgagtttggcaggacgttatttaataacaattgtaaactatacaataaaaatattttatagatagataaaatttacaaacttttatatatattaattaaaaaaataaattgtttccgcggtgtactgcgggttaaaatctagtctaatacaatattagagataactatagtcattgctctcatttttccatttgcatacttatatgttctcaattctcatacctaccttatattgtgtgcccatacaccttccatgcgcacttgttgtccacacaaattacgatcaaacaactgttatatagtttccacccacactttcacctatggtttaagaaacataagttactctaatgtagtaggacgagttgaccaaacctaactccttcattttgttgcaccaacccatatttttaccgagtaatgcacaccccaaaacttataatcatagtcatcttcctttcacgtcccataaggttcacattgattactctaatctatttcactttcaagattaccaccacatgtaacttttccattccttttccacatttatctcttaaacctcaaacactttcaagtttcatcttctctctctcttattaacttcatctaccaaccctacttaacctaaaaccattttcaattgcttaatcagtccacacaatgcacataaatttccgtgaccacactgttcgttttagaagaaaaaaaccacttccaaaattgcatatgtaccaataagataaaatgttttactcattcaaatagacctacgagattaattaagactaggtttgctttgggctaaaactggcccataagct

SEQ ID NO: 12018 - DNA, 3000 bp, Unknown
  misc_feature (1)..( 3000): cDNA_ID_2708209_gDNA_ID_2214528_Annot_ID_134206 3000 nt of promoter + ATG
tagctaacatcaaaatctgaaaactatcaatggctaatacctataaatcgatagctgtatcaataatcttcctactatacttttcttgtgtctcaagtcaacaacaaaccaaatttcttaaccatggctttctggaagctaatctcctcaagtctggctcgtccaagatccacccgagtggccacttggagttgacaaacacttcgatgaggcaaataggtcaagcttttcatggctttcccataccattcttaaaccccaactcctcaaatttggtatctttccccacaagcttcgtctttgccatcactccaggacctggcgcaccaggccacggcttagcttttgtcatttcaccctcgctggactttagcggggccttaccaagcaattatctaggcctattcaatacctccaacaatggaaactccttgaattgcattcttgcagttgaattcgacactgtgcaggccgttgagttgaacgatattgatgataaccatgttggtatagacctcaacggagtgatctccattgagtctacctccgctgaatattttgatgaccgagaggcaaagaacataagtttgaggctggcgagtgggaaaccaataagagtctggatcgaatacaacgcaactgagacgatgctcaatgtcacattggctcctctagatcgtccgaagccaaagttgcctcttctctctagaaaactaaatctttctgggatcatctctgaagaaaattatgttggattctctgcagccacgggaactgtcacgagctcacattttgtgctaggctggagcttcagcatcgaggggaaagcatcagactttgatatcacgaagcttccctctcttccagacccgctacctccattgtctccatccccgagtcctccggtttcagtcatgaaaaattcgagtaacacgatgctgatcataatcattgctgcatcagcaatatttggaatcttgatcttaagcttcttagcggtttgcttttttcgtagaacggaaaacttcaccggaggcgcacggaaattctcccaccagacgatttccagcgcgacgggaggttttgacaactctaagcttttgggagagggaaactctgggagtttttataaagggcaacttgctcctacagagataattgccgtaaagagaattacttgcaacacaaggcaagaaaagacagccctaatagccgagatcgatgcaatctccaaggtaaaacaaagaaatcttgttgatctacatggttactgcagcaaaggaaacgagatctatcttgtttacgagtatgttatcaatagaagcctagaccggttcttgttcagcaacgacctaccagttctcaaatgggtacaccggttttgtattataaagggtattgcgtcagcacttcaacatcttcacgctgaggttcaaaaacctctcatacacggaaatgtcaaagcaagtaacgttcttttggacggagagctaaacgctcgactaggagactatggacatggaagcagacacagcactacgggacacgttgcaccagaactagtcaacacgggaaaggctacatgtgccacagatgtgtttgaatttggagtgttaatcatggagattgtttgtggaaggagagccatagagccgacaaaggaaccggtagagatcagtttagtgaactgggtgcttcgaggggtcaagagcggaaatctcttaaggagatgcgacaaaagaatcaagaaaaagaatttagtctctgaagaagtgttattggttctgaaaacaggacttctctgcgtgagacgatctccagaagataggccaatgatgaagaaagtgttggagtatctcaacggtacagaacatctccctcatgatgactacgtcgtctaaaagaggaaatggctaacgatgatctcgaaacgccgttgtacaaatcaagattggacccaagatgcataagcatgatatgaataatacatagaataacttttaaaaatggaaataagaatttctcgttttgagaaattaatttcattaaatattatcttcgattaaacaatcttcgtactcttccgagaaaatgaatattttaaaatatttgtgtttgattttaaattctaaatgatgtttgttcgtcgttttaggataactagtatgtattgttaaagaaaagataagcaaataaatagtattgttggcagacttttctagccctttcattgtaatttcaattatctttgttcaccagtagatttttatagtagcaacaaaatctagatttctatggaatttgggttcagtatagatttttttttttttttgttaaagggattagtttagattttggattggattcacctggttaatttaaaagaagggtatatgcactagatgaccatgaaatcaataataatatagaaactaactatgagtctatagtgtctgtcggagacgtatctgaaattacccgcaaccccctataactgtgttcttggttaggggacatataggtgtataggcgtatgattgcagaaatttgaattttgaaaaccttggtaagagcaatgctgtatgtggacgcaaacgatatagattttaatttcgagaaatcgatttattatcgaattttttgaaatatcaggagctccaaaaaaaaacctagcgccgcttcatttgctggttttccgagaggaaacgtcttccgttctctacccatagattctgcaaactctccgaatatctatttcaaatctatattgtttctcatacatatcgtttctttagattcaatctcgcagttaggcaatcaattccatcgggctacaggtaatttcacaaatatatgcggtttaagctattcaacgttctcgatcgccatcaacttctttatttctccaatctatattccgattaactgaaatcttaggtacatactgtttctgatttataaacttctattttgtgcagaaaagggttcgacttgtagatg

SEQ ID NO: 12019 - DNA, 3000 bp, Unknown
  misc_feature (1)..( 3000): cDNA_ID_1807300_gDNA_ID_2214528_Annot_ID_134208 3000 nt of promoter + ATG
cgtttcctttgctgcagtaaccatgtagatcaacaagatttctttgttttaccttggagattgcatcgatctcggctattagggctgtcttttcttgccttgtgttgcaagtaattctctttacggcaattatctctgtaggagcaagttgccctttataaaaactcccagagtttccctctcccaaaagcttagagttgtcaaaacctcccgtcgcgctggaaatcgtctggtgggagaatttccgtgcgcctccggtgaagttttccgttctacgaaaaaagcaaaccgctaagaagcttaagatcaagattccaaatattgctgatgcagcaatgattatgatcagcatcgtgttactcgaatttttcatgactgaaaccggaggactcggggatggagacaatggaggtagcgggtctggaagagagggaagcttcgtgatatcaaagtctgatgctttcccctcgatgctgaagctccagcctagcacaaaatgtgagctcgtgacagttcccgtggctgcagagaatccaacataattttcttcagagatgatcccagaaagatttagttttctagagagaagaggcaactttggcttcggacgatctagaggagccaatgtgacattgagcatcgtctcagttgcgttgtattcgatccagactcttattggtttcccactcgccagcctcaaacttatgttctttgcctctcggtcatcaaaatattcagcggaggtagactcaatggagatcactccgttgaggtctataccaacatggttatcatcaatatcgttcaactcaacggcctgcacagtgtcgaattcaactgcaagaatgcaattcaaggagtttccattgttggaggtattgaataggcctagataattgcttggtaaggccccgctaaagtccagcgagggtgaaatgacaaaagctaagccgtggcctggtgcgccaggtcctggagtgatggcaaagacgaagcttgtggggaaagataccaaatttgaggagttggggtttaagaatggtatgggaaagccatgaaaagcttgacctatttgcctcatcgaagtgtttgtcaactccaagtggccactcgggtggatcttggacgagccagacttgaggagattagcttccagaaagccatggttaagaaatttggtttgttgttgacttgagacacaagaaaagtatagtaggaagattattgatacagctatcgatttataggtattagccattgatagttttcagattttgatgttagctatgttcaatgctatctttttatagcttcaaagagctcaagacacattcatattcaaattttttgtttatgctgacaagttaaacaaacttagttgaagatttgactttctatataaactgctaaacaaaccctttttttttttgcaaacctttatattagtatccttgaaaaattctttcgaactttcctccacaatttcttcctaataaaattgattgcaaaataaacaagaaaatggttacatattttctgtataatttaaatgtgattacaaagtcataatggatcaaaaattattgaacaaaaaaaacgtcatcttttagctagcctttagggtgaatcacctttttttttgttacacatataattttgactgcctaacgatcgacgtttatccactatgactatgtgatacaaacaaatagaaaggtttctcttgagtcttgtaattgtgcaattatttgtattaggaagaaattgtggaggaaacttgcaataattatcaactatatgtcgcataaaaggcgttgctatgttaggcttttagccactatatatccaatataaaaataaaaaatggatgaacaattgaacattccttgaaattaaagtgttaactttaaatatgaatatttataataaaaaaatatcctaacttttttttattattattataaagacatacgttgtcaaactaagaaattcaatttgtaaacgaagaagaagaatacttgaccattcaaatcttagtcttgttctcactgaaaacttgtacaaaaataaataattacaaaatctagagaagttttcatgcaaaattgtatatgtagatgtagtcagatagagttccatatattctataaacgaagaaatcacaacaatacaatgtacaaattaacatcattagattagagtcaaagaatttttaaaaatatatcaactttctgagaagagtacaaagattgtttacgaacgaagaattctcaaaacataaaataattagtttccattttacaaaaatgatcttaggtaatctgcttatattggttaaagtatttctattttctaaccaaaacttaggcaatttattttgtcaccaacatacaatattatattaacaatctatatattactaatctatatgtttttttctttttggtctaaggtaaactttgtgatttaattgtagtattgtacctcttcaatagatactccgtactcgcatgtattaatagagcatcacatttatcgacttctctatggttagtttatgcatctactaagttttttatggacttttgtttttgttgttcatttatcgaaataaagcaaaaaactgcaacgatccagttaatccgcaaaaattaatgaattagagttttttttttttctcttcttcttgttgcattttctcctttttttttctattttttctaatgatattaactaatatcttccctactaaaatattgaaatgctttattttattttttaaataaagaaattgattatgattttttttttgttacagtttataaatgtgtctaataatttatggatattttataaagtttataagatatatatacagtaatttaaaatttgccgcaatgatgacgtcgtcatcgtcactaaaccaatcagaaccatgcttcgcataaaggtgactctgactcatttgaaaagctgaaacataaactctgctctgcataa

SEQ ID NO: 12020 - DNA, 3000 bp, Unknown
  misc_feature (1)..( 3000): cDNA_ID_2708217_gDNA_ID_2214528_Annot_ID_134209 3000 nt of promoter + ATG
tggcctttgtgttttaggagcaattaatcaacttacgagaagtctggcttgcgagtgggccaaagacaatataaggatcaatgctgttgccccgtggtatatcaaaacatctatggtggagcaagtatgggtttaaaagccttattatctattatgcggttaaatataagctcttgaggctgaaaatcaaaatgagaaagactaagctaatttgtgtgttccttgtttaagatggggttgtttaatggttctcgtcttttggtctcaggtccttagcaacaaagagtacctagaagaagtctactcagtaactcctcttggtcgacttggcgaaccgagagaggtgtcttctgcagtggcttttttatgcctacctgcatcatcatatattacagggcagattctttgtgttgatggtggaatgtcaataaacggtttcttcccacgacatgattaggccactctattgttttactagtttccttgggatcctttttgttttatctttagcatgtctcctttctcccgtgaaagacagttcatcgatatgagatgagaattgaagttgtgctactaagtctactgttaatgaaaaggataatttagcatcagacagcgtgattcagtttcccttgtcttttactgattatcttgattgtgcatgtgggggaaaattgctgaggaaccttttcatgttatgacttttatgaaaacaaaaactttatgtttcttgagttagtattcattagcttgtattctgtgtcatcctttctcggttttggctttcattgtgtcttgaacctgcactcatatccaacaaacaatggttgaggaagagagaagctgcatagaataaacgaggaacctttaatgaattaccgccacctgtgtctcgggtcactcttcttctgcccttgtatttacagcacattaagctctgcttttggttaatatcgctttgtctctgtgtttaataatgtttttggttcgatgtatatatacaggtaagcaatgcaggaaagtgtatagccaaaccgaccacaaaatatgcagtagaagatttctcgttgctgatggctacaaatctggagtcagctttccatctctcacagctcgccaatcctttgttgaaagcttcaggttcagggagcattgtccttacgtcctctgttgatggggttgtccatctgagagtcggatccatctatggagcaaccgaagctaccgtatatatgtctacatccttaaaacaatgttcccttgcgttatgatgctttcgtaacatatagatgcgtttcaggagccatgaatcaactggctagaaacttagcttgcaaatgggcgagtgacaacataagggcgctctgtttgtccttggttcattaaaactcctttaactaataatgtacggcgaaaagtaaaaagtctccttattattatgaaaatatatctatatcataacttcccaattttgatttgtatgaaatgtttcagtttctcaatgataaagatgcaaaagaaaaggtggagagtaggccaccgatgggtcgtgttggaggtgccattgtcaacgttttttccttcaagactctgccttaaaatacatatatgcatgtgtttggattatattttcctgcgtaataattaagaaatgtactttagataagttcctatctaaagtcgcttgtgatgccaaagggattgggtcccccttcttcttcttgttattctctatgttttgtttcctgaaatatttatgcttgtggtgaacgagagttcaatatctgaattcattatctactttggccaacgcctaatggtatcatttggtgtctcaacatgtgatggagtgtctaatttggtttgaaatcccaaaattcaatatccatgggtattctctagtaatttataaaagaactttggtccaaatcctacaagtggtcatatactgacataccacatagtggaagaactagctagctgggtttgaaataaactcaagataagacaagtggtcagaattgatgttgagagatttttttcctcagcatgggtgtcaaatgagggtccatcaaagtatgcagatgtcactaagggtttccatttagagtaatgagacatgaaatagtgggttttgggttttgagtatttgggttttgagtaagtattccaatataatatatgttcggataattttgatagctaaaatcattgtccacggtcccaaacgcccactagtttaggtaagatggacagccctagatgtaactatcaggagttgcccaatgtctatcatgtaattgtatcttttcttatttacaaagttgttagtaatctatctttatatacaatttaaagaagctcttgttagttatgtgatagataaagatggataacagccgatggagtcttcaaggtatgactgctcttctgaccggtggagcgggaggaattgggtttgtcttcttaccccatttttctacttctatttgatatccaaaatggtcaagaattcaaggagtttatgtttgtggaatgttttaggcatgccatagtagaggagctagctggttttgggccaaagtccatgtatccgacatatctgaaacactgctcaatcaaagtttaagcgaatgggaaaagaaaggatttcaagtgagtggtacaatctgtgatgtatcctctcgtccggagagagaaacactctgcaaactgtctcctcgttgtttgagggcaagctcaacattcttgtaagacgtttgtgagtgaagttaatggaaatgacaatgagcaagttttgctcaaatattttgactataaaatgtcaattttggttaggaccactatcttagatttttttcatcttcactcgtaaggctacgtattatttccaccacacatacaaagataatcactagattcatacttatccgttccacattcattgtatatacaaaatctgtggcatttctggtcacttcaagtaagatacaagaaaaa

SEQ ID NO: 12021 - DNA, 3000 bp, Unknown
  misc_feature (1)..( 3000): cDNA_ID_2711416_gDNA_ID_2214528_Annot_ID_134210 3000 nt of promoter + ATG
tcttcttgttattctctatgttttgtttcctgaaatatttatgcttgtggtgaacgagagttcaatatctgaattcattatctactttggccaacgcctaatggtatcatttggtgtctcaacatgtgatggagtgtctaatttggtttgaaatcccaaaattcaatatccatgggtattctctagtaatttataaaagaactttggtccaaatcctacaagtggtcatatactgacataccacatagtggaagaactagctagctgggtttgaaataaactcaagataagacaagtggtcagaattgatgttgagagatttttttcctcagcatgggtgtcaaatgagggtccatcaaagtatgcagatgtcactaagggtttccatttagagtaatgagacatgaaatagtgggttttgggttttgagtatttgggttttgagtaagtattccaatataatatatgttcggataattttgatagctaaaatcattgtccacggtcccaaacgcccactagtttaggtaagatggacagccctagatgtaactatcaggagttgcccaatgtctatcatgtaattgtatcttttcttatttacaaagttgttagtaatctatctttatatacaatttaaagaagctcttgttagttatgtgatagataaagatggataacagccgatggagtcttcaaggtatgactgctcttctgaccggtggagcgggaggaattgggtttgtcttcttaccccatttttctacttctatttgatatccaaaatggtcaagaattcaaggagtttatgtttgtggaatgttttaggcatgccatagtagaggagctagctggttttgggccaaagtccatgtatccgacatatctgaaacactgctcaatcaaagtttaagcgaatgggaaaagaaaggatttcaagtgagtggtacaatctgtgatgtatcctctcgtccggagagagaaacactctgcaaactgtctcctcgttgtttgagggcaagctcaacattcttgtaagacgtttgtgagtgaagttaatggaaatgacaatgagcaagttttgctcaaatattttgactataaaatgtcaattttggttaggaccactatcttagatttttttcatcttcactcgtaaggctacgtattatttccaccacacatacaaagataatcactagattcatacttatccgttccacattcattgtatatacaaaatctgtggcatttctggtcacttcaagtaagatacaagaaaaaatggataaaagatggagtcttcaaggtatgaatgctcttgtgaccggtggcactaaaggcatcgggtcagtctccattttagatgctcttttattgcattgtgatatttagttatggaagaactgactatgtttgtgtgtgtgtgcgtgtcatgaacagggaagctgttgtggaggaactgtcaattttgggagcaagagtccacacatgtgctagagacgagactcagcttcaagaacgtttacgtgaatggcaagaaaaagggtttcaggtcaccacttctatctgcgacgtttctttgcgtgagcaacgagagaaactcatggaaaccgtttcctctctcttccaaggaaaactcaacatcctcgtaagtgtatacatattagcttctcctccccgggcttgggatttacaagaaccaaaccatgttgtgtttttaattactttttttttttttgtaaagatgtttttagttgttggtctatacatatcttatatataggtgaacaatgtgggaacgttaatgctcaagccgaccacagagtatacagcagaagaattctcgtttcttatggctacaaatctcgactcagctttccatatttcacagcttgcgcaccctttgttgaaagcctctggctcagggagcattgtgctcatgtcctctattgccggagtcgtgcatgtcggtgttggatccatctatggagcaacaaaaggtactgtatatactctttaaaacaatatttctttacattatgatttatatgcaagtgtatataaaagcattttttttcaggagccatgaatcagttggctagaaacttagcttgcgaatgggcaagcgacaacataaggactaacgctatttgtccatggttaatcacaactcctttgattagtgatgtaaggacaatttccttagaacaacggcgaaaaaaaaataaaaaataacttttgattctaactttttaacttatttgaaaatccctcagcttctcagtgttgaggagatgaaaaaagaagcagaggaaaggacacccatggggcgtgtgggagaggcaaatgaagtctcaccgcttgtggcatttctttgtcttcctgcagcttcttatattactggtcaagtcatttgtgttgatggaggtctcactgttaatggcttctcctatcagccacatgcttgagctaggtctgtgttgtgtgtattgtccaatgaaaacagtaaaccaaacaataacatcggaaaatgaatgatttgaatatttaggttaagccttaaaactaaattcattttggtatgttgacatattgtaaaacgtaatgaacaagaaaccttaacagaagatgtttcttttaagagtacacgagccttgcagaaacagaacacaagttgaactcaaatgagaagatgggcttcgacactcatcaacttacaatgctcagttgatcaagcacaaagacagaatcatgcaatgatgactcaaaaggacagatggcttcactgttgaagattttgactatatgtcattttttgcttgggacacttcgatattttagtcatgttttctaacatacgactacatagtttctcaacatgccacgtacaaacaagacaacaaactcattaattcatacttatctggattctgatccacatttactgtatacataatttgtggcatttctggtcactgctagtaacaagcaagaaaa

SEQ ID NO: 12022 - DNA, 3000 bp, Unknown
  misc_feature (1)..( 3000): cDNA_ID_3593631_gDNA_ID_2214528_Annot_ID_134211 3000 nt of promoter + ATG
tatggctacaaatctcgactcagctttccatatttcacagcttgcgcaccctttgttgaaagcctctggctcagggagcattgtgctcatgtcctctattgccggagtcgtgcatgtcggtgttggatccatctatggagcaacaaaaggtactgtatatactctttaaaacaatatttctttacattatgatttatatgcaagtgtatataaaagcattttttttcaggagccatgaatcagttggctagaaacttagcttgcgaatgggcaagcgacaacataaggactaacgctatttgtccatggttaatcacaactcctttgattagtgatgtaaggacaatttccttagaacaacggcgaaaaaaaaataaaaaataacttttgattctaactttttaacttatttgaaaatccctcagcttctcagtgttgaggagatgaaaaaagaagcagaggaaaggacacccatggggcgtgtgggagaggcaaatgaagtctcaccgcttgtggcatttctttgtcttcctgcagcttcttatattactggtcaagtcatttgtgttgatggaggtctcactgttaatggcttctcctatcagccacatgcttgagctaggtctgtgttgtgtgtattgtccaatgaaaacagtaaaccaaacaataacatcggaaaatgaatgatttgaatatttaggttaagccttaaaactaaattcattttggtatgttgacatattgtaaaacgtaatgaacaagaaaccttaacagaagatgtttcttttaagagtacacgagccttgcagaaacagaacacaagttgaactcaaatgagaagatgggcttcgacactcatcaacttacaatgctcagttgatcaagcacaaagacagaatcatgcaatgatgactcaaaaggacagatggcttcactgttgaagattttgactatatgtcattttttgcttgggacacttcgatattttagtcatgttttctaacatacgactacatagtttctcaacatgccacgtacaaacaagacaacaaactcattaattcatacttatctggattctgatccacatttactgtatacataatttgtggcatttctggtcactgctagtaacaagcaagaaaaatggataaaagatggagtctacaaggaatgactgctcttgtaaccggtgcagccagcggtatcgggtttgtttttttctgttctctatatcatcttttgaatcattgttctgcttatgtttcaaggaatttaatctatgtctgtggaatgttttagttatgccatagtagaggagttagctggttttggagctagaatccatgtatgcgacatatccgaaactctgcttaatcaaagcttaagagaatgggaaaagaaagggtttcaagtgagtggttcagtctgtgatgtaacctctcgtcccgagagagaaaaactgatgcaaaccgtctcttcgcttttcgatggcaaactaaacattcttgtaagtaaatgatctttatatagaaacaactaagcatttcttttagcaaaattttctaaagagaaatcttctttttgttcaacataggtaaacaatgtgggcgtacttcgcgcaaagccaacaacagaatatgtggcagacgatttcacttttcatatctcaacaaacttggaagctgcttaccatttttgccaactttcacatcctctcttaaagacttcaggctatggaagcatcgtgttcctttcctctgtttctggggttgtgtcaataactgactgtggatcactttatggtctaacaaaaggtaaccacaattactacaaatctgactaatcaacaaagagtttttcacttccttattttttagtggtttgttgacttcttttgtaggagctctaaatcagctagctagaaatttggcatgtgaatgggcaaaagacggcataagagccaatgcggttgcacctaatgttgtcaagactgctcagtctcaattcgtaagaaataaattttaattttttttttacgttttggtgttgttgttgtgaatttaacaacctcaattcctcttattatctctaaatttttgtttcttaaaagtttcttcaagacgtcagtaaaaaggagggattgtttagtagaactccacttggtcggtctggagagccgaatgaagtagcatcactagtggtcttcttgtgtcttcctgcagcttcttatatcacaggtcaaaccatttgtattgatggaggcctcacggtttacggtttctcctctcaaccacaggcttgaaaatggtcttgtcgtttcttgtctgtttaaatattctctccctaataaaatctctcatcacgctatgagtttatgtcccttgtacaaaaacacacaatgtcaaattgttgctctttagtcttgtaagagaaatgagggacttatctatatgaaggatcaattaaactagtactattttatttgtttggttaaactatccttctctaattattgcaacttatgtgtctatatatggattaatgtcataagtactagatggaatcaaagataacactaaatagcgttagtcatagaatcatactcacaagaatgagtcctctaagttcaatggaccactccgaagtccatcatgagaacaagaccaatcaataaaaatgtccttttgttatctaaattagcaagtgtaccaaattttgttcaccattctaacttataatttcagttttcttttgtgagtgaagttattgaaaaagaaaaataagaaagtattggtcaaagattttgacaacaacaagttattttcttgaggaaccaccaacttagatattttagtcatgttctctgttataagtcctactgctactacataatgtttccaccacacataaaaaacaaactcaataattcacacttatctgatccacattcattgtatataatcttatggcatttctggtcatttagtctcaagcaaa

SEQ ID NO: 12023 - DNA, 3000 bp, Unknown; identical to SEQ ID NO: 12014
  misc_feature (1)..( 3000): cDNA_ID_2711424_gDNA_ID_2214528_Annot_ID_184821 3000 nt of promoter + ATG

SEQ ID NO: 12024 - DNA, 3000 bp, Unknown
  misc_feature (1)..( 3000): cDNA_ID_2708150_gDNA_ID_2214528_Annot_ID_134212 3000 nt of promoter + ATG
gtttcttcaagacgtcagtaaaaaggagggattgtttagtagaactccacttggtcggtctggagagccgaatgaagtagcatcactagtggtcttcttgtgtcttcctgcagcttcttatatcacaggtcaaaccatttgtattgatggaggcctcacggtttacggtttctcctctcaaccacaggcttgaaaatggtcttgtcgtttcttgtctgtttaaatattctctccctaataaaatctctcatcacgctatgagtttatgtcccttgtacaaaaacacacaatgtcaaattgttgctctttagtcttgtaagagaaatgagggacttatctatatgaaggatcaattaaactagtactattttatttgtttggttaaactatccttctctaattattgcaacttatgtgtctatatatggattaatgtcataagtactagatggaatcaaagataacactaaatagcgttagtcatagaatcatactcacaagaatgagtcctctaagttcaatggaccactccgaagtccatcatgagaacaagaccaatcaataaaaatgtccttttgttatctaaattagcaagtgtaccaaattttgttcaccattctaacttataatttcagttttcttttgtgagtgaagttattgaaaaagaaaaataagaaagtattggtcaaagattttgacaacaacaagttattttcttgaggaaccaccaacttagatattttagtcatgttctctgttataagtcctactgctactacataatgtttccaccacacataaaaaacaaactcaataattcacacttatctgatccacattcattgtatataatcttatggcatttctggtcatttagtctcaagcaaaatggataagagatggagtctacaaggtatgactgctcttgtaaccggtgcagccagtggaatcgggttcgtcttaattctctgttctctatatcatgtttttggctcattgttcttcttgtatttctaaattgtcaagacttaaaggaatttttgtgtagtgtaggtatgccatagtagaggagttagcaagttttggagctataatccatatatgtgacatctctgaaactcttctcagtcaaagtttaagtgaatgggaaaagaaagggtttcaagtgagtggttcaatctgtgatgtagcttctcggcccgatagagaaaaactgatgcaaaccgtctcctcgctgtttgatggcaaactcaacattcttgtaagtaaatgatcttataggaaaaggcgaaaagccaagcatagttgtttaaagagagcttcttaacataaatcttatggaaatgcctaatcatatgtaggtaaacaatgttggtgtaatacgtggaaagccaacaacagaatatgtggcagaggatttctcttaccacatctcaacaaatttggaaccagctttccattttagccagctttcacatcttcttttaaaggcttcaggatttggaagcatcgtctttatgtcctctgctacaggggttgtatcagttcaatgtggatccatttatagtctaactaaaggtaaccaaagttgctactagaggtagttcattgcaagactgactaatcaaatatgttttttttttaaattgcttttttctgttgatttattttacaggagctttgaaccagttaactagaaatttagcatgtgaatgggcaaaagacggcataagagccaatgctgttgcacctaatgttgtcaagactcctttgtctcaatctgtaatataaaaaaagtcaacatttacattttagtttttattttttatgtgaatgtaacaatctcaattatattcctctaattaattctcaattgtgtgttcttgaagtatctcgaggacgtcggtttcaaggaggcattgttcagtagaactccacttggtcgcgctggagagccgaatgaagttgcatcactagtggtcttcttgtgtctaccagcagcttcttatattactggtcaaaccatttgtattgatggtggtttcactgttaatgccttctcttataagccacaggcttgataatggccttgttgtgttttgtctaaatgtcttatgcaaaactatgctcaatcaacttttgtgggattggattttaattgtggttcggtatgtggttcatatctttgtcacgagagagaaacacatgcaaatcgcctaaattatatgtgtggcaagctcaacattcttttatgtaaatcataatttaaagaaactaagcatacaatgggttaagctggctttaagtatttgaacaagaagatgtttctgataacaaagagtaagccaaaagcagatcacaacatgctttaaaatccctatgaaataattggagaaatgtcacaaaccatctttatatatataattcaaaggtgaacgcaaaagcttgatagttctttcctttattgtctgtttcactaaagatatcattacaaattaagtcaagatccatcatctcttacatcactatttgtcacacgaaaagtatgagagaaacattttcctatttgcttgccattataataagcttcatatagggaaggaagcaaggaaaaaatgagataaagagaaaagaatgagtattgggggaagtagtatagtagtagagagtcgtagaagagttatcttctaaggtcattagtgatgaagagttcatagttagtttactttgttcaaggtggataagcaatagggtttaggcctttgttattatcagacttctacttttggaagacactaaaaagttgttatctagccataagaaagttttggccaaaggttttgactacaaaatgtcatttttgccggggccactaacttagatatttttgtaatgttctctcttacggctacataatatttccaccacacatacaaaaacatactccacacttatctgatccatattcattgtatatatagtttgtggcatttctggtat

SEQ ID NO: 12025 - DNA, 3000 bp, Unknown
  misc_feature (1)..( 3000): cDNA_ID_2708166_gDNA_ID_2214528_Annot_ID_134213 3000 nt of promoter + ATG
ttcaaaggtgaacgcaaaagcttgatagttctttcctttattgtctgtttcactaaagatatcattacaaattaagtcaagatccatcatctcttacatcactatttgtcacacgaaaagtatgagagaaacattttcctatttgcttgccattataataagcttcatatagggaaggaagcaaggaaaaaatgagataaagagaaaagaatgagtattgggggaagtagtatagtagtagagagtcgtagaagagttatcttctaaggtcattagtgatgaagagttcatagttagtttactttgttcaaggtggataagcaatagggtttaggcctttgttattatcagacttctacttttggaagacactaaaaagttgttatctagccataagaaagttttggccaaaggttttgactacaaaatgtcatttttgccggggccactaacttagatatttttgtaatgttctctcttacggctacataatatttccaccacacatacaaaaacatactccacacttatctgatccatattcattgtatatatagtttgtggcatttctggtatatggtcactagaaaaatggacaaaagattatggagtcttcaaggtatgactgctcttgtgaccggtgcagccagcggaatcgggttcgtagttcttctctattctcttaagtttatgttctgcttcgatataacaacctgaatggtcaagattacatggaattcatatttgtggaatgttttagttatgccatagtagaagagttagctggttttggagctaaaatccacatatgtgacatatccaaaactttgctcaatcaaagtttaagcgaatgggaaaataaagggtttcaagtgagtggttcagtatgtgatgtaacctctcatcctgagagagaaaaactgatgcaaaccgtctcctcgattttcgatggcaaactcaacattcttgtaagtgaatgatctttatatagaaacaactaagcaaactctacaaaacaaaaagataacttaagagagaatttttgttcaacataggtaaataacgtgggggtacttcgcggaaagccaacaacagaatatgtggcagacgatttcacttttcatatatcaactaacttggaagctgcttaccatttttgtcaactttcacatcctctcttaaaggcttcaggctatggaagcattgtattcctttcctctgttgctggggttgtatcactaattgactgtggatccatttatggtctaacaaaaggtaaattactccaaatctgactaatcaacaaagagttttttaccaaaaaaaacaaaacaaagagttttctgcttccttattttgtagtgttttgttgacttcttttataggagctctaaatcaattagctagaaacttggcatgtgaatgggcaaaagacggcataagagccaatgctgttgcacctaatgttgtcaagactgctcagtctcaatcggtaaaataaaaataacttttacatctttttatttttgtggatttaacgacatcaatttctctaattatctctcaatttttgtgttaaaagtttcttgaagacgtcagtaaaaaggagggattgttgagtagaactccacttggccgtgttggagagccgaatgaagtttcatcactagtggtcttcttgtgtctacctgcagcttcttatatcacaggtcaaaccatttgtgttgatggaggtctcacggttaacggtttctcctatcaaccacatgcttgagaaatagtcttgtcgctctcaaagttctatatctaataaaagttctcattctatgagtttataaacgtaaacatcaatgagtttgcaattccatattggagatactaatctcgcacatatacaagattcggttacacccgctacgccaacaactcacaccaatgtgatctctcattctctctcataaatgaaatgttatactattttttgagaattgtagcattgataggatagattacagtctatatgtctctgattttaaatgttaattgtaacacaagatgattatattgtacatatttttgttgttgttgttccgtctattttgctgattatacttgtttattgttgttcttccgtgtctgtcgtgttttatctgtttgtcttaaactttgtattttatatcttgtgatttttgatactacacgacaaaaatgaccttgtcgtgttttatcttgtgaattattttattctttcgctattagattaatccattttgtgaataatttgcgagcaaggccctcacacacataattataccttttgagtcttgaatcaaaaggctgtcaaaaaaaaaaaaaaaaaaaaaaaatcttgaatcaagttgatagatacatatgggcttgcgtgatcttgagtcttgaattcataataggcgaatttgaatcttgaacgactaatcgataacaaacaaacaaaaaaatattatataattggttagagtagttaactctatcacgcttaatgagcattttatatttgtctttgaatgacaattcaagtaaatactttaatttcaaaattgatggatcgttttttcattgtacttttcttcgaataatattagagataatcttccacacttaaaatagattaatctcattgtctctcatcctacataagcttcttactttaatttgtctacatccctcttgtctcaattaagtattattattaacgcttcaaattcttactacctaaacacgtgaacagtagtctttcagtagtcttttaatttgcgagtgaagttaatgaaaaaaatacaaaatggtaagttttggtcaagattttgactattaaaattaatatttgctcttgaccactaagtatatttttgtcatctctttattatggctaaaaattgacacttatctaatactcattcattggatatatatatataatgtgtagcatttctggtcagtgaaaattgacatacaaggact

SEQ ID NO: 12026 - DNA, 3000 bp, Unknown
  misc_feature (1)..( 3000): cDNA_ID_2708169_gDNA_ID_2214528_Annot_ID_134214 3000 nt of promoter + ATG
ttatatttgtctttgaatgacaattcaagtaaatactttaatttcaaaattgatggatcgttttttcattgtacttttcttcgaataatattagagataatcttccacacttaaaatagattaatctcattgtctctcatcctacataagcttcttactttaatttgtctacatccctcttgtctcaattaagtattattattaacgcttcaaattcttactacctaaacacgtgaacagtagtctttcagtagtcttttaatttgcgagtgaagttaatgaaaaaaatacaaaatggtaagttttggtcaagattttgactattaaaattaatatttgctcttgaccactaagtatatttttgtcatctctttattatggctaaaaattgacacttatctaatactcattcattggatatatatatataatgtgtagcatttctggtcagtgaaaattgacatacaaggactatggataaaaggtggagtctccaaggtttgactgctcttgtgaccggtggagccagcggaatcgggttcgtctagattctcactatatcaactcttttacccattgttctgtttctaaaattcattctaaattgttaaagttttaaggagttttattatgtttatcgaatgtttagtcatgctatagtagaagaactcgccggttttggggccaaaatccatgtgtgtgacatatcgaaaactctgctcaatcaaagtttatccgaatgggagaagaaagggtttcaagtgagtggttcagtctgcgatgcatccaatcgtctcgaaagagaaacacttatgcaaactgtcaccacaatatttgatggcaagcttaacattcttgtaagttaatcttaatttaaagaaactaagcatatctttaagctatttagaaatgacatgaatatatactcttttctgttcaatataggtgaacaatgttggcacaattcgcacaaagccaacaatagaatatgaggcagaagatttttcgttccttatttcaacaaacttggaatctgcttatcatctaagccaactttcacatccactcctaaaggcttcaggcaacggaattattacttttatttcctctgctgcagggatcgtatcatttgatgctgcatccatttatggtctaacgaaaggtaaccatagtgaaaagtttaatactagaggaagttcattgcaagaatgaccaaatagtattgtggatttatatatgtttcattatgtatattatatatttgattaggataattttcaatcccatttaataatttcaaatgatatttgagaagaattgttttttttttttttttgtgcgtgaaatcttattttagtgtgctatgctaacatttttggtttcagaaatatataattcagaaggtcaaatatagggcattcatattcaataacatacaaaaacaaaactaatttataactatgcatgttatttatggataataaatctttttatttttatttagatggttcataaatatcgcattatgtctccgaaagctgattctaacggctaattgattgccctagtatcattcgtttctatttctaaattggtctatctttctttgggaatcctaatagatgtctctcatagtcatagtattattttttcttgtttgtgtatatgttcaggagctttgaatcagctagcacgaaatttggcgtgtgaatgggcaaaagacggcattcgagccaacgcggttgcgcctaattttatcaccactgctctggctaaacctgtaaccaatacaccctctcttttttttcttttttttccttttaaaattaacatcatcacccactcttattcttgttttttacaatcttgtaaacattcagtttctcgaagacgctggttttaacgagattttgtcgagtagaactccacttggtcgcgctggagaaccaagagaggttgcctcacttgtggcttttctgtgtctacctgctgcttcatatattactggtcagaccatttgtgttgatggaggtctcactgttaatggcttctcatatcagccataggcttgagccatgtcttgtcttgtcttgtgtgttgtggagtatggtcatatggtcagtatctccataatctaaatccatagatatgtgagttgtggagtagacacaatttttcaataatggaatatctatttaccagttccgtattatgcatgcattctccatgacaacgcttctcataacgaatataattacgtggatcataatactatgaggattgatatcattgagatggagtagacacagttattttcttcttcccttgccattagcaatttcaattgtatctatgcttgaaatacttaaatggcatttacttcttaactaaaaagcgaaaggagggaaagaacaagtcattacaagatactataataattagaaattaaaagagtataattacatcttcccaaatgtgtcaaatattcagcaaaaactctgtcaatagaaatgaacaaacggtattttaaagtaatacaatgggtaaactttagatattttgtaaaaacctaattagaaaaaaaatttggaaatcttagttgaagataactacccaaattatgaaaaaaaaaacatttgccttcttgttacctaactaacacgttgaatgttttacaaaaattttgttcaccagtctaactgacttgtcgtttcagttgtcatcttttgaatgaaattaatggaaaagaaagaaacaaaaatgagtaagtttagatcaagattttgactattaaaagtcatatttgctcttgaccactgacttgtatattttgtcatgttatttattatggctaatatatccaccacacatacaaacatactcattaattgacccttatcttttatttttatggtaagaaaattgacacttatctaatactcactaggtgtgtatatataatgtagcatttctggtcattgaaagtaacttacaagcaaa

SEQ ID NO: 12027 - DNA, 3000 bp, Unknown
  misc_feature (1)..( 3000): cDNA_ID_1030432_gDNA_ID_2214528_Annot_ID_134215 3000 nt of promoter + ATG
ttcttttctttttttatgtgaatgtaacaacgattttatgtgaattaatctaaccctctcttaattgtgtttctgcaagtatcttgaggacgtcagtttcaagaaggcattgttgagtaggactccacttggtcgtgttggagagccaaatgaagttgcatcactagtggccttcttgtgtctacctgcagcttcttatattactggtcagactatttgtgttgatggaggtctcaccgttaatggcttctcctatcagccagaggtttgagtatggtcatgtctcgttctttttgtttgtctagaattttcagtgttctctcaaataaaatatttcaaactatgagtatatgaataaaaaaataaatatatcataattacattatggatatacttacaatgtatctctcatacatgaaaatgttctattccatcttgtgtttactactaacttactaagtgaaaagaagactctgtttttatgctctgttttgttgtaaaccggtagacttagaaaagttgggacctcatagttgaacccaaaataacaaaagtgaatttcaaaactagcatatatataatagagactcaaaataaagcaatcacagagagataaacccaaaattcaatggatggcaacgagaaaaccttttgtgaccaactacatgatacattgatataccattttatgacatactattaattaataaatgctgtggtgtgcccataccggattcatataaatgtttatacgactgcatagcatttccactacagtttaaactctaccacccaaataccaatttttttttttttttgacattggtttcaaggaggcattgttgagtagaacttcacttcgtcgcgttggagagccgaatgaagtttcatcactagtggtcttcttgtgtctccctgcagcttcatatattactggtcaaatggtcaaaccatttgtattgatggaggtctaactgttaatggcttcacctatcagccacaggcttgagaatggtcatgtcgcgttctgtttgtttgtcatgaattctcagtgttctcttaaatcaaatctctcacactatgagtatatgaacaaaatcatatacaatatcacaattccattatggatattctcccaatctatctctcatacatgaaaatgttctatttcgatcttgtatttaaataatgttaatactctgttttaatttgtgtatcctgatttttttttctttttgaagttcaacaaatatatcaaaataactcagaaccattactattttttcttagttcatcaattctttactacacatagaaacgtatttatcttgtttgatctactttgactctatatatgtcatgtggcatctctggtcattgctagtcacaggtaaaagtaaaaattgatcaaagataaagagtctttcatggtaaaaattctcttgtaactggtggagatagtagatgtcaattcgtttgcaataacttacatttgcaataacatgtcagccatatttatttaaatttccatgcatttgatattattttctctctaatacatatatgatgtgttacggtcattctaaaaatccagttgacagcataatgaagctggtacaccatacatgcacttgattatatatggatgttactgccatgattgatgttttgatggaattagtgttaaaggatggaccctcactaacgcggttggaaattatgatcaaactcttcaatgtcacttatcaagagagctaatgactagcacgtttagttgttctgttgtttcttatggctgcttaatgtctccatcaaatatttagacattgtggctagtaaaatgccatctaccttaatcctatatataagtataactagataataatccatatttttgctgggtttagtagctgatacgacgtttatggttgttattgagtttgaatacaaaatatagagtattgttggagttatattgatttttgttcatattagttaacaaataataaaaaaattaagaaaggtttttgaaaatgcatcttctagaatatatgtatattcgaaaaagtcacatctttaattgacatatgttttgtttgtttgttttttttactggccacacaaattgacaacaatggtcatgcatgaaatgaaatgtttgttgtcaattttttttactaacttgtaatatcattatgaaatgaaatagaaggtatatattacaaaatattacctaaaagtagagcaatcttagaaaaaaaaaaaaaaaaaaaaaaaaaagaaaaagaaaaagaaacaagattacaatgcatttaaaaagagatggaaagaatccgagctatcgaatccaaagaagcatcagcttcctccatctgttcttgtatcgtctaccagagatggtgttccggatctctcgatcaatattcttaaagatggttgttggagggatcctttggctattatggagaacattattcgtttatctccagatgtgatagacaaagggctgtgtggcctgtgagaccgatggccacttaattattggttttttgtcaatggttgtgtatgcatagaaattcccacaaccgtttgtggcttaacacaatttaccaggggtttaagtggttaaattgatacatgtagatctaaagttttatgctaatataaattagttttaattatataaattttaactacgctcatgacacgtaaatggtagaccaatatgtggtgctctattaactaaggggtcttcattattaattcataaagactttctttactatacaagacttgtcaaaaggaaaagtagtattttcgtactacgtctacccctctcacggatatgtgtggtcgagcagtcattatcataatgtggaattttgaattgagcgaggtttcaaagttcaaaactatcacaactagtcttgatcaattctatataagatctgtgatcttggttgaagaaaagaatcgtcgtaggttgatatttaacaagga

SEQ ID NO: 12028 - DNA, 3000 bp, Unknown
  misc_feature (1)..( 3000): cDNA_ID_4257514_gDNA_ID_2214528_Annot_ID_134216 3000 nt of promoter + ATG
attttcgtactacgtctacccctctcacggatatgtgtggtcgagcagtcattatcataatgtggaattttgaattgagcgaggtttcaaagttcaaaactatcacaactagtcttgatcaattctatataagatctgtgatcttggttgaagaaaagaatcgtcgtaggttgatatttaacaaggaatggcaaaggaagggggcttgggagagaactcaagatggagtcttggaggcatgaccgctcttgtcactggtggctctaaaggcatcgggtcagtccccattgtgaatcttgactcccattttctatgctcttttattgtattgtcatgtttagttatggaagaactaactctgtttgtgtgtgtcatgaatagggaagctgtggtggaggaactagccatgttgggagcaaaagtccacacgtgtgccagagacgaaactcagcttcaagaacgcttacgtgaatggcaagcaaaagggtttcaggtcaccacttctgtctgcgacgtctcttctcgtgaccaacgagtgaaactcatggaaactgtttcctctctctaccaaggaaaactcaacatcctcgtaagtatacatatataagcttcgtcctcctcggtattgggatccacaagaacccaattatgttgtgttttttgttgtggatctatacatatgtaggtcaacaatgtgggaacgtcaatattcaagccgaccacagagtatacagcagaagatttctcttttgtaatggctacaaatctcgagtcagctttccatctctcacagcttgcccacccattgttaaaagcctctggctcagggagcatcgtgctcatatcctctgctgctggagtcgtgcatgtcaatgttggatccatctatggagcaaccaaaggtaccgtatataagtacatccttaacacaatatgttcccatgggttatgatgcttacacatatattaactcgttttaggagccatgaatcagctggctagaaacttagcttgcgaatgggcgagcgacaacataaggacgaactctgtttgtccttggtatatcacaactcctttaagtaacgatgtaaggccaaagtttatatttctccttcgtactatgaaaaacaaaaaaaatacgtaaatatgacttcgggctttaatttatgtgtgaaaatctcttagtttttcgatgaagagtttaagaaagaagcggtgcgtacgacaccaatggggcgtgttggagaagcaaatgaagtctcaccgcttgtggcatttctttgtcttccttcagcttcttatattactggtcagaccatttgcgttgacggcggtgccactgttaacggtttttccttcaagactatgccataaaacacatatgcatgtgtttggatcatattttcaataatttaaacttacgggttatatacatcgtcaatatgtaataaatgtaatttagatgtgtccacatgttctgtttctaagagattcttagatatttatgcttgcgtggtgaacaagagttcactctccggatggaccgcatccataatctatgaatttgggaattatattaccaatttgacggcagactagttggccaaacttaactcttggttctttccggttatatatgtttgcagtgtctaatatttctcaataaaactttcaaagatgacgacaaaaagtgtctttctatgattctctccacatgcgtataatactattcgtcacacatcgtgacttaaaaacttgtcgactagtatataagtgtatggaaattctccacttttgaactaacttttcgtgtgagttaggcccacacttagttaattcaagacttacctcttccttccatgcctttggttagcaccggtgggttgtgttattggcatgcttggttgggacacataatggatattttcagttttctaaactaacatcaagcgcaaactggtataattctagggcttcagtcaagagtaatccttccatttcttatgagatagttgtaaaggtttcatcaaacgaaacttgtttcacacccaagaaatgaaaccaaaattaattacatgagacgaaacaaaaataaatccagaataaactactattatgaataacttttttgattatttaaacagatctgtttgattgaatccaaacctgttatgttatttatttttgtttttatgaataccaaaaagttttggctcagagcccgaatatcctcggcccgaaaccattatgtaatattacttactagattttcattaactttaaaaagattcatcataatatatagctaaaccccttttgttttaaattggaagacgcatcataagttacgtcattaactcatcatgatcactttcccaattaaatatgttaacctaaactaattcagtcttatcattactttgagatctctaatttgtctcagccacaaagtcattaattacgatatatatcattccacaacttctttgaagattctcttaacctcgtatcatttattctaacccattttcccattatcatttgtcatcaaactagaagtcaagaacagaaacatccagaacaatggctaaagtagaacagagcagatggattcttcaaggcatgaccgctcttgtcaccggcggaacgaaagacattgggtttgtcttccatcatcactttccaagtcatctttcttgcgttccaagcaaccaaagaaaataaacccaactttgcttacacatttatattcttgatgaatctctcacctatgcaactaaaattcaggaaacctacattgctctcaaacaatgaacatgtctcgatctcatgtagttgggcctaacccttaatcgaggcccatttgtttgattaacctaacaaatacatgaaaaggcctttcttacactgtcattatcattcattcattatggatttttctctaccagacattcagatctccaagaaaagatctttgggttctgtggttcataatcagaa

SEQ ID NO: 12029 - DNA, 3000 bp, Unknown
  misc_feature (1)..( 3000): cDNA_ID_2711408_gDNA_ID_2214528_Annot_ID_134219 3000 nt of promoter + ATG
tgaaattcgtcagctttgtgctgtctccaaagaaatatttcttcaacagcccaatctgcttgaattggaagctcccatcaagatctgcggtcagatttttgttccctttagtttagaaagagtgcttttttggattggggttttagttttgattgatttttagaagcgaatttagtgcatgtttagataaagtatcaagctttgttcagtagtaatgagttgaattcttaaagctatgtacatatctaagtgactgaagaaaaaatgtgagattttgattgtcttttgagttcagaacaatgaaatcaagctaatgggtagtataaagtttgaatttttattactaaaagtcttagataggcttaggagttttgactggttctatgaggtttgattcattttatcttaatgttgactagtcaagttatgtgttttgattgggtctgataaaacatttcctgcaaaagtttaacgttgactagtagtatctgatatgccatgttttcttagatgtaatggttatattttgtcttttactttataggtgatattcatgggcagtattcagatctattgaggctttttgagtatggagggttccctcccgaagctaattatttgttcttgggtgattatgttgaccgtggcaagcaaagcttggaaacaatatgtcttcttctagcttacaaaatcaagtaccctgagaacttcttcttgttgagagggaatcatgaatctgcttccattaatcgtatttacggtttctatgatgagtgcaaacgcaggttcaatgtcagactctggaaaatattcaccgattgctttaactgtcttcctgtggccgccttaattgatgacagaatactatgtatgcatggtgggatttccccagagctgaaaagtttggaccagattagaaatattgcacggccgatggatattccggagtctggtttggtatgtgatttactatggtcggatcctagtggagacgtaggctggggcatgaatgatcgtggtgtttcatacacttttggagctgacaaagtcgcagagttcttggagaaacatgacatggaccttatctgtcgtgcccaccaggttttaacttgagttatatctgccatttagtttattatgaaaactgtgcaaccttaatttgagtgtattggctctgtttataggttgttgaagatgggtatgagttctttgcagaaagacaacttgttacagtattttcagctcccaactattgcggggaatttgacaacgctggcgcaatgatgagcattgatgagagcttaatgtgctcattccagattctaaagccgtcagaaaagaagtcgccttttctgtgacaccgattatccagtgaccaccattgcttcaaattaacaattctacaaaaggtaaaaacttttttatgctatggtagcaccacatttgtgtaaccctgattcaacattctctgcttcatgtttagcttgttcaccgtatctagcttttactctgagtggtacatacatatcagcctcaggaaaatgaaatggaaaacatgtattcgttaagctagttataatgggtttttttgagttcctgtcacagagatgagttcaaaatcacacaatagttttcttctcttacatttctgtgtaattagctcatgttgcttataatttgtcatcaagaaacagtgttaatctttgaggtttggtcactgtatgctgaatgttcttatgtggctcagcttttgattatcattttgcattttgttaatttgctgcagttgtatactggcaagaggatctagagacggaaactgctcaattgggaccttaatggtactgataatagagcattagacatgtagctgttgacagtgatggcatcgagcagaaggaacaagtcaagtctgtactgtgattttagcatctctcacatctatgtttgtctaaaatgtgtgtgtgtttttagtcttctctctgaataatattagattctcatttgtactctctatttatttaggagaacccaaattcaaaactttttttagtctcttcaccaccataaagccataatcactacgtattgttcacttcaaaaatttaacatggggtgccaattgtcacatgtaaaactatatggtcctaaaattaaaaatatcaagtaattaaggataataatgaaacatgtgtgtgcacgtgtgatggagagaaacaaacaaatcagctttagaattcagattccttcttgtcacacagttttcgtttctctttctctttctctcacactctctgcctatctccgccgcggagatccatcgtgttttctacttctgttggtatccatggattctctcgttgaatccggttggaaggtacttcgtattcctctatctcgtcgcgttcctttgtatgcgattcctacgttttttttttttgttttgttttcagagattgaatcgtgttttttgtttctcggtctctggcgacttgagtgtactgcatttatgatacaagtgtaggtacgggattagtatctgccgtgttaggttgattttgtgtttgtcgtctgtggtccatcgtattgtattgttgtggtccctttatgttgagattgaattggtttcgtgtcgattgcgttgtggtttcagatctggatttgactgttctagttacagattattactgatttcgtatgtgatctctgtttgtgcttgtatttttttttggaatttgagtgggatttatgtattgttgttggagcttggactagcttagaggatctgtgattgtgatacgtgttgataagcaataggttttccttgaacgtcttcttaacttgcttttctgcgtgagtgactggatggatggtgtcaatgatatacaattgccttcagttttcgtggaattgaacaaattttatctccctttggcaatcatgtttagctctttagtttgacagttctagctgtgacactgacccttctttgtggcgatg

SEQ ID NO: 12030 - DNA, 3000 bp, Unknown
  misc_feature (1)..( 3000): cDNA_ID_1808479_gDNA_ID_2214528_Annot_ID_134220 3000 nt of promoter + ATG
aggagatcgtcggggtaaaggtggttccggtggagaagttcccggagatacatagatgggttaagaatttgttgggtaatgatgttatcaagaaatgtattcctcctgaagatgagcatcttaagtacattagagctcgtatggagaaactcaatatcaaatctgcttgataaggttttataaaaattctaatgctcacagtatgtctcttttgttcttgtctcagttgctatgttctgtcacttaatgtttgctatattgaaacacgaaaatttgaactttctttcttgttctacctaaagatgttcttaagcaaataatacagaagaaactctcttttgtgctactctgattcaacctgaacagttgcatgataaatcccataagacttcctacagaaatttctaacaccagtaatgatctctttaggactagctccaggctctggtaagatatgacaggacaatacgattctccctactgttatctcccatacatggagatcataaacaatcttaactccatcgattcgcttaagtcctctttcgagcttctctatgtccatatcacgcggtacgcgttccatcagtattccaaatatgttcttgagaattggtagagtagcagcaagagcaaaagcagagaaaacaagagtgcaaatcaaatcaaccaaaacccattttggttttacccaaatgatacctccaccaatcataacacctagtgactgaatcatatcagccattgcgtgaagataagctccttgtatgttaatgttcatctcctttgaagacgatttctcaccttttaaaggattcatttcctcctcctcctcttctgccaccacctccttgtgatgatgttgatgttgatgtttatgattatgatgatggtgatgatggtcgtggtggtggtggctatggttatgtcctaaccaaaggaccataaccaagttcatgaaaaacccgaaagccgaaatcccaaacatgatttctccattaacctctctgcttctgctaagtagtctttgaatggcttcatggattatcactccagagacaagccatatgagctgaacagacaagaacgccgctaaaacttcaagccgtttaaacccgaacgagtttcgcggattagcttcccagctcgagaccttgatcgccaacaaagagacacacaaacccgccacatccgacaacaaatgcgcagcatctgtcataaccgcaagactattcgccttaaaacctcccacaatctgtacggacataacgatgaggtaaagaaaaataaggctgcttagtcttctagtcgattcttcgcgttctttcgtctcggaaacgcaatgttcttgtctcgtaaacgcgcaagacagaggaaccacgcctaaattttcctctgttttcgatggtgatggtgactccatttcttcctcatcatcgggtttcaaaatgcagatttgctccaattccataagctgtttatacgttacacaaactttcattagagatctaaatcaacatttgatcctctttctttaagtatttttatgattaaaagattcaaataaacccattttgtgtttcttttaagacaagaaacaaacctgagaatcagatggagaggcaaaacgtatatgaattccagagctgtcctcttcagaaatcttgagttttatcttatggttagagatatgaagacatgaacacaggcaattaaggatgatccagcaaatatgggaggagatgttttatagatgtggaattttcttttttgtatgggaatctaaaataagtcgttgtggcttgtgacgggtgaagaagaataatcttttttctttaataaggagaatcaaggaaaaaagaaataaatataaagattttgttttggtgattttgtgtttcttttggtgtgtatgagatttgtatgattgtattaccatacaaaggtggcgtttgcgtttcaggtgaacaaaatggactgactattctttgttcaaaataaggattgattcaactaatgttctttgatctttagcatgttgtttttttcgtctttttgttttctttcattatagaaatcaattataaacatacatcaatattattttaaattaggttaggaccgttaggtgatgtaatttgtccatgttgatatagtttatttttttcttttgataaaaatgttgttgatatattaacttgttttatcaaactacatagttattagttagcacttagcatgtaattaagaatgtgaattggtgatttttaacaaaagaatggtatttgcatacacgcatatgcatgttaatttgacacatcaaccagatggtgattatattagattaggtattaccgatcaaacactaaatcttggttgttttgtagtttcatggtaacaaatagattgttgttttgtagtttttgatggcaacactaagttttcagtaactaatttgctaattcaaactttttggcgttttaatttattagtcgctaattaagaatttaagaattaagattgatctaatctaccacttaattacggaaaacgaatatcatactaacatagtaacatttgattgttataattggtcactgatcattaccgatgactgctaaacaaacaacaaaacatattgttgatcactatcccccatcattactactgaatagtgaatactatattactatcgccaatcgttattactgatcgcgtagagaggctagaagaactagttttctaccgtttggaaatttgtataaaggaatcttctagaaagatagcccatttacaggcccaataaaacgtgtacatacccattaggttgatttcactcaggtctcgtaaataaattaaataaataaaaaatgaaccaatcaatattgactaatctcagagcacacaccagtcttcgggtctctcctcctcgcggctcgaaacgcaagcttcacgcttgaaaatctccgttcgttttctacctcgtttagatcggagatg

SEQ ID NO: 12031 - DNA, 3000 bp, Unknown
  misc_feature (1)..( 3000): cDNA_ID_1023980_gDNA_ID_2214528_Annot_ID_134222 3000 nt of promoter + ATG
caaattttcacacctgtggtctgtagatatgatttaaatatactaaattatccaatttaattataattgtttatgcaaaaaatttgatcatccgctttctgcattagctcttcaacacattattgtgatttctgaagtagggagcatatggatatgtaattatgtaccaccaaaaaaaaaatgcgcgattgaaaaatgaatgacacatgtgacatgtgttggatcttctgataaaactccaacgctaaaatcaacaccaatgtgatttttttgacgtaaaaaggacaatgatcaaaagcgttaagatgtgattgtttatgtattttaggtcagtttttttttatattatattttactccgaattccttattgtgaagcatagaatgcttatagtttatcataacgagattcgaatacgagatcacaaatcttgttttaaaacatttgaaaattggagaaattagtggctcacacatgacggagaaagatgaaccgcatgcctcccattaccaacgtgtatggtatcaatgtcctaaagtgaaattattatattcaaatgtcataattgaacgtgattcatggcattggcatctatatttatttaaatatttaaaacctcattgcccagtggccggcaaaaaagttgataaatcgtcgtcgtttgcaaaaacgacatttaacccttgggctataaatagaaagtgagccaattcagaattctaaacaaccatctatctaagaagaagcagaaagaaagaagatctaactaatgggcaaaaatgaggaagtgaagcttttgggaatatgggcgagccctttcagccgtcggatcgagatggctctcaaactcaaaggtgtaccgtacgaatacttggaggaagatttggagaacaagagctctttgcttcttgctctaagccctattcacaagaagatccctgttcttgttcataatggtaaaaccattatcgagtcgcatgtgatcctcgaatacatcgatgagacttggaaacacaatcccattcttcctcaggatcccttccaaagatccaaggctcgagtcttagctaaacttgttgatgaaaaggtacattctcttatttagtttcgatttttatttttttaatcgtttagtacatggaagtagtcatttctaataatctcttatattttcttctctttttttttttttaatctgatcaaaccttaacatgtgttaaccagttttctacgagctcaatactttaaacagttgaagtcaacaactatatattaatcagattaacggattaatcaatgctactaatcatttttaatcctttactaaaccgttgttaattgtctctaatattctagatagtaaatgtgggatttgcctcactggccaaaacagagaaaggaagagaagttctgattgagcagacaagagaattgattatgtgtctcgaaaaagaactcgccggaaaagattacttcggcggcaagacagtcggattcttggactttgtcgccggaagtatgatcccgttttgtttggagagggcttgggaaggaatgggagtggagatgattacagagaaaaagtttccagaatataacaaatgggtgaagaagctgaaggaggttgagatcgttgttgattgtattcctctaagagagaaacatattgaacacatgaacaatatggcagagaaaattagatctgcttaattcagaagataatgcatctttcatagctttggttccatattttatttaatttactactgtaatgaaagataaatcaaggacaaaactttatgattcagaaaataattagaaaacaaatcctttgaaaaagggtaaaaaaatacgtagacaatatccagcagaatcaaattaacataatcctagatttggtccaacaaaccctagctaatccggcaatagaaggcgagttgcacctgattcgattataaaatcagcgttctttggatcggtcctaaacttcatctcatgagagccgttggtgcactggatctgaaacctaaagattttaatcccaaggtacgtctcgccaatgacgtcttctacacggctagtgaatttagtgcccttactcatgatattatcacaattgttgcattgaagtctcatcggaaggcttaagtcggcgttgcgtgctgccatagcttcagaacacaagaacacgcgagaaaaaagatatttgatctgtctttccctaagacctatatttataagaaacaatctcttcgtgatttcctttttttttggtccaataaattagggttttttctttttatattagttttgcatttataatttttatgaaaaaataagggaaaggtggaagaaaatattaaaactaatataaaagaaaaggaaaaagtctaatttgactacattcacgcttttggatataatttgactacacaaatcctaaacttaaaatatatatttatcagaatgattataaaatatcaatatttgttgatgtaaaaaccatcattacttaaaataaaaaatagaaaacaaaatatttgggggtgggagggtaaggcgaggaaacggttaaccgcagacactaatctagtttcaacagaaccacctacgaaccaaacccaacctcctggtctactttttggagacgagcctcttatgtagccatcgacgttttttcattatttttcgggggaaacgccggcctaagacccccagtaattaattcccatagttaacatgagagggttcagggtttagcaatcaataagcagactcatctcctaggttcccacaccccttaacttatttgaccaaacctttcttcatttaaacaactcaacttcaatctctatcttccgatgtgggacaaagtgctttcttactgaagcatttattgtaacttgttcgtcactggtgacgtcaccattctttcttataaataaatcataacctattaaccttagtccataaagaagaagaagctaacgaaaaataatg

SEQ ID NO: 12032 - DNA, 3000 bp, Unknown
  misc_feature (1)..( 3000): cDNA_ID_1833226_gDNA_ID_2214528_Annot_ID_134224 3000 nt of promoter + ATG
tagttaagaagacaattggtttacaaaaaaaagggttaagaagacaattgaattttcatttaaaagattacgtttttggacaaactttatcaaaaaaagtacaaatcagttataagaaaacttttagaaaaaattaaagaagaaagagaaataatttgtaatccagaagagctttatcagctttataagtttttctattgacagttgtggtatttttatggaaaaacattagtaacaaatttaataatttatatgatatttttacgtatttaaattataaataatactgctaagtttgtgctaaataaaaaatataaaaaatactgctaagtgtaaaagtttaagaatgagaatttgatttggcttcggatgttgaggtcacgcatgctaaatgcgtcatgcatgtggcgttatttttgagatcctcgtatacattgatgagacttggaaacacagtcccattcttcctcaggatcccttccaaagatccaaggttgagtcttagctaaacttgttgatgaacaagtacttcctcttatttagattcgatttttgtttttaatcgtttagtatatggaagtagtcattttaatttttttttgaaaactggttatgattttgataagggagttcaattcaattttaaatcaacaaaaaataaataaaaattgacttaatttgatcattaatctatttagcatgtgttaaccagatttccaaaagctcaataatgtttgttcttaagggtgttaaggaagccttgggacctcgaactgtgcagattactattgcaagagcaatttcaactgatattgtgaaagccattgaagtttcttgttcgcttctagtgcggttgcaaggactactcgtgtactctcatatgaaagtttcggtacatttttttcttcagaaaagaggttcaaaactttgaaggttggatataaagacctcaacgactacacctatcaaaacctttgagaaaggctatgtcaacaacattttttattgcgatgaactgataatcagcaatatcaatgaatcaagaaccggatcaaaatatttgtctccaatagtttttgttatgtggttgcaatggcaaggttgatcatcctttttcaagtcaacgttgatcatcctttttcaagtcaaggttgatcatcctttttcaaatcatctttggttctctctcgagattgttattttatcttgttccaattaaagttttgatagtgaatgttagtggcaaaattttattcaaatattttataattatttttttgtagcaaatcaattttaagttaaattcgatttaaaatgattttttcaacaaatttcattaaaaaaatttatagatacaatcgcaaagttgtataaaattttatttaaaaaagaaatttttgtagaattattcaaatatgaatgtttttcattaagatgtccattcaaaataatataagaatataataattttaagtacactcttaaaacgataaaaaaaaaaaaaacaattaaaacaggattttttttatttttcttgaaaattgatgtcacgcatgctaaagatgcatgcatatgggacatgactttacttttgagagccgaaaaaaatggtgaagagctggtattgttgggttccacatcgcggtttcacattacacaattggaaacagttgaatatcccttagaacttaaaacaacccaagttaaaaacaacaacccactaagtttatataaaagtaaatattcgtaagaaaaaaccacggaactacactaaaaagaaacattaatacaaaatttagttttttttttctgtcaagtactgtttatttatttctttttctatttcagtaccacattgacatacctacaaagtatgatactcgtttttttttgtcaaaacaaattacaatattcgattattaaattaaactaatttgtgggctggtcgtagagacatcttctatcttcttgcgaatatcatgataatcaaatcttgaaaacttaatttttgtatgtatgaggaataataaaacacgttgttttatggtttaaaaaaaaaaaagctaaaaaaaaaataaagaaaataaaacacgttgttttatggtcaaaaataccaccttgtcaccacaataaacaatgtgaacaaatttatgtcggtgcgcatcatttcttctgatttcttatgatttctttccattttttatgtgttacaaaattattgttttgaacaaattttcacacctgtggtctgtagatatgatttaaatatactaaattatccaatttaattataattgtttatgcaaaaaatttgatcatccgctttctgcattagctcttcaacacattattgtgatttctgaagtagggagcatatggatatgtaattatgtaccaccaaaaaaaaaatgcgcgattgaaaaatgaatgacacatgtgacatgtgttggatcttctgataaaactccaacgctaaaatcaacaccaatgtgatttttttgacgtaaaaaggacaatgatcaaaagcgttaagatgtgattgtttatgtattttaggtcagtttttttttatattatattttactccgaattccttattgtgaagcatagaatgcttatagtttatcataacgagattcgaatacgagatcacaaatcttgttttaaaacatttgaaaattggagaaattagtggctcacacatgacggagaaagatgaaccgcatgcctcccattaccaacgtgtatggtatcaatgtcctaaagtgaaattattatattcaaatgtcataattgaacgtgattcatggcattggcatctatatttatttaaatatttaaaacctcattgcccagtggccggcaaaaaagttgataaatcgtcgtcgtttgcaaaaacgacatttaacccttgggctataaatagaaagtgagccaattcagaattctaaacaaccatctatctaagaagaagcagaaagaaagaagatctaactaatg

SEQ ID NO: 12033 - DNA, 3000 bp, Unknown
  misc_feature (1)..( 3000): cDNA_ID_1009988_gDNA_ID_2214528_Annot_ID_134225 3000 nt of promoter + ATG
gagtgtgatacatgtatccacagtggtagtataatttagtttgtacgagtatctagttctatctaattattgatatatgatcatattttctcataacatatttttgttctgtaatttagatgataaattgataaccaatttgtattattacgaagaaaaagaaaacagtttgaactattcattaaaaaaagttattgtttaaaaggtattttattagattaaaatattaaattaattgtaattcacttttggaccacgcatttagcatcacacgtataactttaacaaatcaggtaaaaccaaatttctttaattaggtaaagaaacagaagactgaaagaaaaactagtttggaaacaaaaaatggtatttgcaggaattgtaaggaatttgggatactagaaatgtatggatctaagttagaaaaaatcaacaaaaatttgttgaatattatttataaagttggtatgtttgaggaaattgaaaaagataaaatatatttgaatatatggagagatgatataatgtgttcacggttcattggatatttagcagtgaatgaatcaagagaaagcaaaatagttattttcttctttcccgtcgttttagtatacttttcaagcacgagaacggaatcacaaaaactagtcaaaaaaggcgttaaatcctatagaacaaaaacatataagctatggtttcgaacgggaaccaaaccataatatgcgatgcacttctaatagcaatcaaaaatttgttaatatgtacatatatatttttgttttattaaaaccgtatcatactttatctgcagttaaaccgcacatctttattcggagcctatatatctacactgcctatatatcaaccgaccaaacattcacgaaaacaaaccacataaactagtcaaagaagaatagatgagttacattataaaaaagttcaagtgagagaaagagaggtccaatggcggagaaagaagaggatgtgaagcttctaggtttttgggcaagcccttttactcgtagagttgagatggctttcaagctcaaaggcgtgccttacgagtacttggagcaagatatagtgaacaagagccctttgcttctccagataaatccggtttacaagaaggttccggttcttgtctacaaagggaaaatattatccgagtcacatgtgatcctcgaatacatcgaccaaatatggaagaacaatccaattcttcctcaagatccttacgagaaagccatggctttattctgggccaagttcgttgatgaacaggtaactttatcaactaattgcataggtgatttctaaaatatgactaacacctagaaccaccgatgactgtatgtaatttcattacattttgaatagtaaaatcaagattctgattctgatcgattggtaagctaggaaaggcagaattctaaaatgattctggttccataagaatgtctatgcaaaacaaaaattaattgcggttaattttctgctgaaatggttactatcttgtaggttggaccagtagcttttatgtctgtggcaaaagcagagaagggagtagaggttgcaatcaaggaggctcaagaactctttatgtttcttgagaaggaagtcactggaaaagatttcttcggtggcaaaacaattggatttttggacttggtcgcaggaagtatgatcccgttttgtcttgctcgaggttgggaaggtatgggaattgatatgattccagaggaaaagtttccagagctaaacagatggatcaaaaatttgaaagaaattgagatcgtgagagaatgtattcctcctagagaggaacaaattgagcatatgaagaaagttgtagaaagaatcaaatcagcctaagagacaacaatgatactcttcgatcagtagatgttaactatatgtttgtgtaatcttgttataatagtttgtatgaacaataaatgaaacatttgtatgaacaattagtgtttttactaaattctaatgtcaattaattattataaacattttaaatgtagtagtattcaatttcttacaaatcataagaaattggttcataaacctggagttttcatatgaaagaaaagtagataaaagctataatttagtcaaaccatccttcttaataaaaccacaactatgattaaatgtgaacatgtatttcgacacgtaagaagttgtgtaaacagaggaaagtacaacggacatgtgggtctatttgttgcggcacaatataacaaatttctttagtatatttttagtatcgtgaggtggtgagtcttgtaaccatagaaaattcaccgatactttataacattgttggaaggaaaattcagcaaacaagttcgtagatggagaaacggaaaaaccaacgcctattataacaacaacatttttaatatatgccaaaaggaacatcaaataacagattagtactaattctttttttatagctcagactatagagttgtttgttttcttgggcgtcaatataacaaacgagaatgacaaatggttttaaagctgttgatgtttcatacacagacaaaatggatcaattatgaagaaccacgataaagtgatgggtataattggggaagcagaagaaattcttgacgaagcatggggttgtcttcagaaaatgaatggatcaagtcaaggtacacatgctccagggataaggcaaggttaggaattaggacacatctccacttactaaaaaagagataaaaaaaaattataaagggaacgttataaatatgttgtaaagtcaacatctgtttccttctagactcttcgcatttacatcacactgccgaccatataaaacggcaaagttcgtcgtcgttttatcacaagaccatcaacaccataaggctataaatccaagctaaaaggtagtgattaactccacaaaaccagaaaaaactacatttctaacatatagaagaaacagagaaaaagagagagagacccctaatg

SEQ ID NO: 12034 - DNA, 3000 bp, Unknown
  misc_feature (1)..( 3000): cDNA_ID_1808515_gDNA_ID_2214528_Annot_ID_134226 3000 nt of promoter + ATG
ttggacatggttgcgggaagtatgatcccgttttgtcttgctcgggcttgggaatgtttggggattgatatgactccagaggatacgtttccagaattaaacagatggatcaagaacttgaatgaagttgagatcgtgagggaatgtatacctccaaaagagaaacatattgagcgtatgaagaaaattatagagagagctaagtctacgttctaaattaatgataacttcataactctgtgttctaaaataatgactatgtgcagcttgtatcgttttgttattgaaaaatttgaaacaaagaatgaatgtagctgcattggtagtggaaatcaattaatgggtgcaaagtgaaatgttgaaagctacctattataactataataacaaatattgatttatggtttagggaaaataaattgcaaagatggtaaatctaagttcgataggatgatgagttaatttgtttcatgatgtgtggtattgattacatgatgtttgataagaagttaagaacattaacgtatggttggttagtattggtttattgtgtattgttggttagtatttcagtttagtgatattctggttctattagtctatccaattttgtattagcattggtaactcaatttcttcaagaaatgaaataacaaatatttaacatatctctccaaaactaatacatcggaagtgaaagatgaaagacatgttcaaagaatatttatcaaaaaaaaaaaaaagagagatggtcaaagttagacataaatattgacttttgaggattcttaatattttgaacacatgctgaaatgtttaggcgtgaggataaatgatgaacacatttgaaagtgacggcaatgatgaacaactaccttctagatgttcttggatgatacacatgaatgatgtacatacattgaacttgtaattaagtgttcctcacaactctaattagaaaagtatgcttaattattggagtaaatggcctaaaaaagacttttccttttcctttatgcctttataatcatgcacaatttacatgagagtatatataaagattagttaaataaaaaataaaaaagagggaaagagattgattattcaatggccgagaaagaagagggtgtgaagcttatagggtcttgggcaagcccattcagtcgtagagtcgagatggctctcaagcttaaaggcgtgccgtacgattacttggacgaagattatttggttgtcaagagcccgttgctacttcaactcaacccggtttacaaaaaagtccctgttttggttcacaatggtaaaatattacccgagtcacaactgatccttgaatacatcgaccaaacatggacaaacaatcctattctaccgcaaagtccatatgacaaagccatggctcgattctgggccaaatttgtcgatgaacaagtaattcttaagacaaattcgtttattaactcattgcagatgttatttatagaaattatgagaaacacttataactaccggtcacattgaatatatatgcacataattctagtcatgaaacgtttgctatatatcgctaccgtgtaggtcacaatgatagggctcaggtcactggtgaaatcagagaagagaattgacgttgcaatcgaagaagttcaagaactaattatgttgcttgagaatcaaatcacgggaaaaaaattattcggcggagagacgataggattcttggacatggtcgtgggaagtatgatcccgttttgtctagctcgggcttgggaaggtatgggaattgatatgattccagaagaaaagtttccagagctaaacagatggatcaagaatttgaaagaaattgagatcgtgagggaatgcattcctgatagagagaaacatattgagcacatgatgaaaattgtaggacgaatcaaagcggtctaagagacaacatgatactctttgatccagtgatgttaagttgttaactaaatttgtattgtcttgttatttaaaagttttatgaacaatctactaaataaagatgagtgtgatacatgtatccacagtggtagtataatttagtttgtacgagtatctagttctatctaattattgatatatgatcatattttctcataacatatttttgttctgtaatttagatgataaattgataaccaatttgtattattacgaagaaaaagaaaacagtttgaactattcattaaaaaaagttattgtttaaaaggtattttattagattaaaatattaaattaattgtaattcacttttggaccacgcatttagcatcacacgtataactttaacaaatcaggtaaaaccaaatttctttaattaggtaaagaaacagaagactgaaagaaaaactagtttggaaacaaaaaatggtatttgcaggaattgtaaggaatttgggatactagaaatgtatggatctaagttagaaaaaatcaacaaaaatttgttgaatattatttataaagttggtatgtttgaggaaattgaaaaagataaaatatatttgaatatatggagagatgatataatgtgttcacggttcattggatatttagcagtgaatgaatcaagagaaagcaaaatagttattttcttctttcccgtcgttttagtatacttttcaagcacgagaacggaatcacaaaaactagtcaaaaaaggcgttaaatcctatagaacaaaaacatataagctatggtttcgaacgggaaccaaaccataatatgcgatgcacttctaatagcaatcaaaaatttgttaatatgtacatatatatttttgttttattaaaaccgtatcatactttatctgcagttaaaccgcacatctttattcggagcctatatatctacactgcctatatatcaaccgaccaaacattcacgaaaacaaaccacataaactagtcaaagaagaatagatgagttacattataaaaaagttcaagtgagagaaagagaggtccaatg

SEQ ID NO: 12035 - DNA, 3000 bp, Unknown
  misc_feature (1)..( 3000): cDNA_ID_2708221_gDNA_ID_2214528_Annot_ID_134228 3000 nt of promoter + ATG
ccagtttttagtaatattctattcaattcagcacgttatacaattgcttttaaagcccatggcccataatactcagacagccttaaatgcttcagattaacaaagaaaatgttttagattttatggatagtgtgattagagtccaattattttggaatttaattcggttaaccagtcgaaccggataatctgtagaaatccagttttttttttggaagactacatatttgtctaaagcccatgaaggcccattaaacccaacgaacacaaacaatcttcaaaatgctcctagaattttctggattcacctgatttttctcatagacgtcctctagatgtttctgtattccccataacaactcgagaagctcgagaaatttcggttagtacctttaaatagcttcaaaaatccttcgtgtgttctatcagaaatcgaaaaatcaaagttctcaagaagatatcaacaaaaaaaaaagtaaattctttaaaatgtcgatgattccaagtttcttcaacaacaacagacgaagcaacatctttgatccattctctcttgacgtatgggatccattcaaggaactaacatcatcatcactttctcgtgagaactcagcgatcgtgaacgcacgtgtggactggagagagacgcctgaggcccacgtgtttaaagctgacttgcctggattgaagaaggaggaagttaaagttgagattgaggaggatagtgttttgaagatcagtggagagagacacgtggagaaagaagataagaatgacacgtggcaccgtgtggagagatcgagtggacagtttacgaggaggtttaggttgccggagaatgtgaagatggatcaggttaaggctgcgatggagaatggtgtgttgactgttacggtgcctaaggctgagactaagaaggctgatgttaagtctattcagatctctggttgagtaatgggttcgagttttatcatcggagttgcttgtgtttttgtcatggttatggttcatgttttacttgagtgtgtgagtactctatctaaattataataatctccgattgagctatgaattatgatgtatcggatacatttgatcctaatgaagtatggaataaataataattattaacctttgtctaaattcaaaagaagtttaaccgacgagatgatttcgcttagagttcgatttcggtttaactaaaccaaatcaaccgataccgtgaatcaagacggaatcaaacccaaaaactgaaaaggttcacattatataaatgttatattttgatttagattattacatcatttctttcaaaatgattaacattttgtttgataactgaatatttcttctgttttacaatgtcattcatttcaaatgtttggcagacaatgaattggccaaaaaatagactcttcaaaacaaaaaaagttgtgtgttttacaaatacagtcgatacattaatctctcagttttaaacttttcaacatatgaatcttaaaatataaattgtagaacgtaatcatttggagatttgttatttcttggtcggctaattgactggagattagaaacactaagtgttggtcaaatatcttaaaacactaagacgaatgacgttggcaatgacgtgcataccttaaaatataaatcagtccttttctggtgtgatcttcaagatatccttggatacaaagacaaagagaaagcaaaatggtccttttatttatttgtttatttcaccacccataacttcatttgtgtatagaatatagtaaactcaagtaatcaagcaagtaaacgaaacataaaaaagaaaagtagtgcaagaaacagaggagttagataccaaaaagtgagagatatcgaatggcggagaaagaagagagtgtgaagcttctagggttttgggcaagcccttttagtcgtcgagtcgagatggctctcaaactcaaaggcgtgccatacgaatacttggaagaagatttgcccaacaagacccctttgcttctggagctaaacccgcttcacaagaaagttccggttcttgtccacaatgacaaaatattactcgagtcacatctgattctcgaatacatcgatcagacgtggaagaacagtccaattcttcctcaagatccttacgagaaggccatggctcgattttgggccaagttcatcgatgaccaggtatactaatattgatttgcagattaattagttgattctatgcagaacaatattatattattcgcttgtttatatattgttctttacttgcagatcctaacactagggtttaggtcccttgtaaaagcagagaaaggaagagaggttgctattgaagagactcgggaactgcttatgtttcttgagaaagaagtcactggaaaagatttcttcggtggcaagacaatcggattcttggacatgatcgcaggaagtatgatcccattttgtctagctagactttggaaaggtattggaattgatatgattccagaggagaagtttccggaattaaatagatggatcaagaatttggaagaagttgaggcagtgaggggatgtattcctccaagagagaaacaaattgagcgcatgaccaaaattgcagagacaattaagtctgcctaaattaaagatacttcttgcctacgaaaatatttgatttatatgcttgcatcgttttttatttatatttttattttttaaagtttttcgaaaaatagaatgacctaatatttaagtaaaaagatcaaaaacctatttgaaagttacagcaatcaaataacgtggtgtgtctggagattgtaaaagccaagactagaaggaaataagaataaaataaccaaagtgacctcagcagtgacttggttaccttactgatgtctttttttttttttttatcttcaagataagcttgagagttgagactacaaaaaaaagcacaatattgtttttaaagtgacagagagagtcagagagagagatctaatg

SEQ ID NO: 12036 - DNA, 3000 bp, Unknown
  misc_feature (1)..( 3000): cDNA_ID_2708189_gDNA_ID_2214528_Annot_ID_134229 3000 nt of promoter + ATG
gtttatcgtctctaaacttatccggtgtaaatgcctttgagctttccttagttaataccttcttctcagcagctacaaatggtggtctatcacaagaacctttcttcaactccaaacgacactccatctgtttccaaagttccaaacgtttcactcaaatgactcctcagtctcccattaaactgcagaagcttgaaacgctcaacattttttttcactgtagaaacaaaaaaaatggtaagtcataacaaataccaaaaaaaaaaaaaagtacatctttcttatccacacacaatgtaatagaattacaaaacgaatcttcatagaccttatagatccttaagaatccgtaagatctgattagaagaatctctacaagattaaagctgaggaaaaaaagtaaaactaaagtatcaaaagaaccaaaacaaaatcacattcttctcaaactttcttaatttaccaaagaagtactaaaaaacaagattagtaacaggaaaggcctaaagcgtacacacacaaagcaggaatcgatgaattcacataacactaacaccaggactaacacgagagtgttattggcagtgtcagagagtgaaaaagcttggaaaaaaatcgaaccgtacctgaacggaatcagttcgtaacacagagactgaagcagattagagttgaatcagatcaggagaggaaaaaagaagaaggaagaacagatctcaaatcgtccgtgaaatccggcagaaatagcgccgacgaagctgaccctatcagctacagaggtagagagtaagagaagagagagattgagctttgttaattgtgtgtagattagagagtgacaagtagagagagatagagagttgttgaagcgagtgtgttttgttcgccgagtctttcgtcgaagttgttttttttttttcccaaaaaaaaaaaacatatctttttgtggccgacggatttagtaaaaaaaacagtataatttttataaagatgggcccaatagtagaatcgtacgctcaagattccgtaatgaacgcgggaagttacgtcattgtgaccctacttacttagtggagctcaatgtccaatatacaccgttggatttgtttaatcctcctttagatgggcccagtttttagtaatattctattcaattcagcacgttatacaattgcttttaaagcccatggcccataatactcagacagccttaaatgcttcagattaacaaagaaaatgttttagattttatggatagtgtgattagagtccaattattttggaatttaattcggttaaccagtcgaaccggataatctgtagaaatccagttttttttttggaagactacatatttgtctaaagcccatgaaggcccattaaacccaacgaacacaaacaatcttcaaaatgctcctagaattttctggattcacctgatttttctcatagacgtcctctagatgtttctgtattccccataacaactcgagaagctcgagaaatttcggttagtacctttaaatagcttcaaaaatccttcgtgtgttctatcagaaatcgaaaaatcaaagttctcaagaagatatcaacaaaaaaaaaagtaaattctttaaaatgtcgatgattccaagtttcttcaacaacaacagacgaagcaacatctttgatccattctctcttgacgtatgggatccattcaaggaactaacatcatcatcactttctcgtgagaactcagcgatcgtgaacgcacgtgtggactggagagagacgcctgaggcccacgtgtttaaagctgacttgcctggattgaagaaggaggaagttaaagttgagattgaggaggatagtgttttgaagatcagtggagagagacacgtggagaaagaagataagaatgacacgtggcaccgtgtggagagatcgagtggacagtttacgaggaggtttaggttgccggagaatgtgaagatggatcaggttaaggctgcgatggagaatggtgtgttgactgttacggtgcctaaggctgagactaagaaggctgatgttaagtctattcagatctctggttgagtaatgggttcgagttttatcatcggagttgcttgtgtttttgtcatggttatggttcatgttttacttgagtgtgtgagtactctatctaaattataataatctccgattgagctatgaattatgatgtatcggatacatttgatcctaatgaagtatggaataaataataattattaacctttgtctaaattcaaaagaagtttaaccgacgagatgatttcgcttagagttcgatttcggtttaactaaaccaaatcaaccgataccgtgaatcaagacggaatcaaacccaaaaactgaaaaggttcacattatataaatgttatattttgatttagattattacatcatttctttcaaaatgattaacattttgtttgataactgaatatttcttctgttttacaatgtcattcatttcaaatgtttggcagacaatgaattggccaaaaaatagactcttcaaaacaaaaaaagttgtgtgttttacaaatacagtcgatacattaatctctcagttttaaacttttcaacatatgaatcttaaaatataaattgtagaacgtaatcatttggagatttgttatttcttggtcggctaattgactggagattagaaacactaagtgttggtcaaatatcttaaaacactaagacgaatgacgttggcaatgacgtgcataccttaaaatataaatcagtccttttctggtgtgatcttcaagatatccttggatacaaagacaaagagaaagcaaaatggtccttttatttatttgtttatttcaccacccataacttcatttgtgtatagaatatagtaaactcaagtaatcaagcaagtaaacgaaacataaaaaagaaaagtagtgcaagaaacagaggagttagataccaaaaagtgagagatatcgaatg

SEQ ID NO: 12037 - DNA, 3000 bp, Unknown
  misc_feature (1)..( 3000): cDNA_ID_2708225_gDNA_ID_2214528_Annot_ID_134231 3000 nt of promoter + ATG
tcttgttgggcaaatcttcttccaagtattcgtatggcacgcctttgagtttgagagccatctcgactcgacgactaaaagggcttgcccaaaaccctagaagcttcacactctcttctttctccgccattcgatatctctcactttttggtatctaactcctctgtttcttgcactacttttcttttttatgtttcgtttacttgcttgattacttgagtttactatattctatacacaaatgaagttatgggtggtgaaataaacaaataaataaaaggaccattttgctttctctttgtctttgtatccaaggatatcttgaagatcacaccagaaaaggactgatttatattttaaggtatgcacgtcattgccaacgtcattcgtcttagtgttttaagatatttgaccaacacttagtgtttctaatctccagtcaattagccgaccaagaaataacaaatctccaaatgattacgttctacaatttatattttaagattcatatgttgaaaagtttaaaactgagagattaatgtatcgactgtatttgtaaaacacacaactttttttgttttgaagagtctattttttggccaattcattgtctgccaaacatttgaaatgaatgacattgtaaaacagaagaaatattcagttatcaaacaaaatgttaatcattttgaaagaaatgatgtaataatctaaatcaaaatataacatttatataatgtgaaccttttcagtttttgggtttgattccgtcttgattcacggtatcggttgatttggtttagttaaaccgaaatcgaactctaagcgaaatcatctcgtcggttaaacttcttttgaatttagacaaaggttaataattattatttattccatacttcattaggatcaaatgtatccgatacatcataattcatagctcaatcggagattattataatttagatagagtactcacacactcaagtaaaacatgaaccataaccatgacaaaaacacaagcaactccgatgataaaactcgaacccattactcaaccagagatctgaatagacttaacatcagccttcttagtctcagccttaggcaccgtaacagtcaacacaccattctccatcgcagccttaacctgatccatcttcacattctccggcaacctaaacctcctcgtaaactgtccactcgatctctccacacggtgccacgtgtcattcttatcttctttctccacgtgtctctctccactgatcttcaaaacactatcctcctcaatctcaactttaacttcctccttcttcaatccaggcaagtcagctttaaacacgtgggcctcaggcgtctctctccagtccacacgtgcgttcacgatcgctgagttctcacgagaaagtgatgatgatgttagttccttgaatggatcccatacgtcaagagagaatggatcaaagatgttgcttcgtctgttgttgttgaagaaacttggaatcatcgacattttaaagaatttacttttttttttgttgatatcttcttgagaactttgatttttcgatttctgatagaacacacgaaggatttttgaagctatttaaaggtactaaccgaaatttctcgagcttctcgagttgttatggggaatacagaaacatctagaggacgtctatgagaaaaatcaggtgaatccagaaaattctaggagcattttgaagattgtttgtgttcgttgggtttaatgggccttcatgggctttagacaaatatgtagtcttccaaaaaaaaaactggatttctacagattatccggttcgactggttaaccgaattaaattccaaaataattggactctaatcacactatccataaaatctaaaacattttctttgttaatctgaagcatttaaggctgtctgagtattatgggccatgggctttaaaagcaattgtataacgtgctgaattgaatagaatattactaaaaactgggcccatctaaaggaggattaaacaaatccaacggtgtatattggacattgagctccactaagtaagtagggtcacaatgacgtaacttcccgcgttcattacggaatcttgagcgtacgattctactattgggcccatctttataaaaattatactgttttttttactaaatccgtcggccacaaaaagatatgttttttttttttgggaaaaaaaaaaaacaacttcgacgaaagactcggcgaacaaaacacactcgcttcaacaactctctatctctctctacttgtcactctctaatctacacacaattaacaaagctcaatctctctcttctcttactctctacctctgtagctgatagggtcagcttcgtcggcgctatttctgccggatttcacggacgatttgagatctgttcttccttcttcttttttcctctcctgatctgattcaactctaatctgcttcagtctctgtgttacgaactgattccgttcaggtacggttcgatttttttccaagctttttcactctctgacactgccaataacactctcgtgttagtcctggtgttagtgttatgtgaattcatcgattcctgctttgtgtgtgtacgctttaggcctttcctgttactaatcttgttttttagtacttctttggtaaattaagaaagtttgagaagaatgtgattttgttttggttcttttgatactttagttttactttttttcctcagctttaatcttgtagagattcttctaatcagatcttacggattcttaaggatctataaggtctatgaagattcgttttgtaattctattacattgtgtgtggataagaaagatgtacttttttttttttttggtatttgttatgacttaccattttttttgtttctacagtgaaaaaaaatgttgagcgtttcaagcttctgcagtttaatgggagactgaggagtcatttgagtgaaacgtttggaactttggaaacag

SEQ ID NO: 12038 - DNA, 3000 bp, Unknown
  misc_feature (1)..( 3000): cDNA_ID_2711401_gDNA_ID_2214528_Annot_ID_134232 3000 nt of promoter + ATG
ttcccatcgcctaaggtgtctgacactgttgtggagccttacaacgcaacactatctgtgcaccagcttgttgagaacgctgatgagtgtatggttcttgacaacgaagctttgtatgacatttgcttccgtacactcaagcttagcactccaagttgtaagtattccaatgttcttcgattatgagtcaatgttgttactgtatctgtctctgtggtttattgtttcaggcttagttattgattagtattgaaacttcactcacatatttttttgtttgttttctgaattgtgcagttggtgatctgaaccacttgatctctgcaaccatgtctggtgtaacctgctgtcttaggttccctggtcaactgaactctgatctgcgaaagctagctgtgaatctgatcccattccctcgtctccacttcttcatggtgggatttgctcctctcacctctcgtggatctcagcagtaccgtaacctcactgtcccagagctcactcagcaaatgtgggatgctaagaacatgatgtgtgctgctgacccaagacacggtcgctacctcactgcttcagccatgttccgtggaaagatgagcaccaaggaggtcgatgaacagatgctgaacgtacagaacaagaactcctcctactttgtggaatggatccctaacaacgtcaaatcaaccgtctgtgacattccccctactggtctgaagatggcttcaacgttcattggtaactcaacttcgatccaagagatgttcaggcgtgtcagtgagcaattcactgctatgttcaggagaaaggctttcttgcattggtacacaggtgaaggtatggatgagatggagttcactgaagctgaaagcaacatgaacgatcttgtctctgagtatcagcagtatcaagatgcaacggctgatgaagaaggagaatatgaagaggaagaagctgagtacgagcaagaagaaacttattgaagaaacagatgataagaacacctcaacttccagttgctgtttacttttaaaactctcttctattaagttcttatagtttctgtaactatcgcttgcgttattagtagttatgatactctgcgtaggctaagaggatttatcaatcaatattcaaacaatctattttgctaaatcaaaatccatccatagtattttttttctttgtttcattatataaccttttgttaattttgactatgtgaattcggtgaagacttcaccatctttcaaatataagaagcagagtagtagtgacaatggttataagcaatataagaatcttcttggttaaattttggtgtggattatgaatttgacgagtcaatttgaaggacgaatctggatttaagataaaaatagtataaactccataggagaatacaatggttatcagttgttttcaatgtccatggacccaaatagatccctctgcctcttaagctcttcttcttcagcctcctccttacgcttttgttcatccttatactcagcaacagccttatcaaaaacgcttctcacatgtctgttcatttgcatgagctcttgacatgcatctttaaaaacctctcttgctggatcacctaaaagccacagagccaacacgttttatgttgttagacacacagacaaagaactcggataagagttatccaaaaagaacatagcttaactctgatgaacagagtttttgaaaaacagtacctgttgtctggacccggatattgacctgttcaagggaaggatgtgggatggtgtatgcagccacggttactctgggactgcagaattgaaaacagtactggttattgacataatcatcattgtctacacaccagcatatcaactccatcaacctcaaagataagataatgtgacattcattgaatacaatgagaatctctaacaacataacatgaatgtaaaccaacatttaatcgaactctcaagtttcacaatcacaatataatggcgaacttaatggaccaaactcatccaacgaaagatatcggaacaataatgcctcgtcactgctgtctctatctaagagctaattctagactatcttttctagtctctaaccacagaacatgaatctgaatcgaactcaaccttcacaatcaccttataatggcacaaacatacaatgtgcacactgattattcaaacaaaatttgattatcttcacaataattctaaccaaaaacaaaggtaaagacaggtaagagattcattcctaatgagggaaactatgaactcaataatcagaatttgagagtgtcacgaactaagtatgagattataaagctaaagcctttctctgtgaaagtgtatagcttcttctatatatatacataacagattcaaaaggattgaaagaagaagatacttactcttggtttaagacgaatctaacagcattagcaagtgtgtgatcttcttccgataaagtaaacgaagcatgactaacattcgtgaacgaaccgtgctccatatctcaccttcttgctactcaattccttaactcaaaatcaaaaatccaccaccaactagaaaacacagaaagagaacgacttcaattgaaagctttgaatagctaaacaaacccacaaagaaaaactcgaaattgaagaaaatttcagcaaaaaaagttgagagagtaagaaagaagatacctccaatagaaatttgctaaaaccctaaaagcttgattagtcggcgacttttagtcgtggagaagctcagatactttagcgtaattacatctataccctttcgtttgatgacgtggcgtgtaatgtctcttaaaccctaattcggctgtgtagcaaaagagaagcctttgttgtgttctttacctctcttcacgaaatcccatttgagaaagtaaggatttatgatcttcaaattcaagtatgaattataaagtttcgatttttacgaatcattaattttgtattcaggtactgctaaaaaaatg

SEQ ID NO: 12039 - DNA, 3000 bp, Unknown; identical to SEQ ID NO: 12032
  misc_feature (1)..( 3000): cDNA_ID_1833226_gDNA_ID_2214528_Annot_ID_184840 3000 nt of promoter + ATG

SEQ ID NO: 12040 - DNA, 3000 bp, Unknown; identical to SEQ ID NO: 12031
  misc_feature (1)..( 3000): cDNA_ID_1023980_gDNA_ID_2214528_Annot_ID_184838 3000 nt of promoter + ATG

SEQ ID NO: 12041 - DNA, 3000 bp, Unknown
  misc_feature (1)..( 3000): cDNA_ID_2990754_gDNA_ID_2214528_Annot_ID_184837 3000 nt of promoter + ATG
gctcatcattgcgccagcgttgtcaaattccccgcaatagttgggagctgaaaatactgtaacaagttgtctttctgcaaagaactcatacccatcttcaacaacctataaacagagccaatacactcaaattaaggttgcacagttttcataataaactaaatggcagatataactcaagttaaaacctggtgggcacgacagataaggtccatgtcatgtttctccaagaactctgcgactttgtcagctccaaaagtgtatgaaacaccacgatcattcatgccccagcctacgtctccactaggatccgaccatagtaaatcacataccaaaccagactccggaatatccatcggccgtgcaatatttctaatctggtccaaacttttcagctctggggaaatcccaccatgcatacatagtattctgtcatcaattaaggcggccacaggaagacagttaaagcaatcggtgaatattttccagagtctgacattgaacctgcgtttgcactcatcatagaaaccgtaaatacgattaatggaagcagattcatgattccctctcaacaagaagaagttctcagggtacttgattttgtaagctagaagaagacatattgtttccaagctttgcttgccacggtcaacataatcacccaagaacaaataattagcttcgggagggaaccctccatactcaaaaagcctcaatagatctgaatactgcccatgaatatcacctataaagtaaaagacaaaatataaccattacatctaagaaaacatggcatatcagatactactagtcaacgttaaacttttgcaggaaatgttttatcagacccaatcaaaacacataacttgactagtcaacattaagataaaatgaatcaaacctcatagaaccagtcaaaactcctaagcctatctaagacttttagtaataaaaattcaaactttatactacccattagcttgatttcattgttctgaactcaaaagacaatcaaaatctcacattttttcttcagtcacttagatatgtacatagctttaagaattcaactcattactactgaacaaagcttgatactttatctaaacatgcactaaattcgcttctaaaaatcaatcaaaactaaaaccccaatccaaaaaagcactctttctaaactaaagggaacaaaaatctgaccgcagatcttgatgggagcttccaattcaagcagattgggctgttgaagaaatatttctttggagacagcacaaagctgacgaatttcaccttcactgagatgaacttgcttccccgatccaggtctcgtgttccgaaactcaaccaaacgacgaataatatcgtcgagaactgcaggttccatcgctcgcttctgctcttgctcttgcgccggcttctccgccatctccgatctaaacgaggtagaaaacgaacggagattttcaagcgtgaagcttgcgtttcgagccgcgaggaggagagacccgaagactggtgtgtgctctgagattagtcaatattgattggttcattttttatttatttaatttatttacgagacctgagtgaaatcaacctaatgggtatgtacacgttttattgggcctgtaaatgggctatctttctagaagattcctttatacaaatttccaaacggtagaaaactagttcttctagcctctctacgcgatcagtaataacgattggcgatagtaatatagtattcactattcagtagtaatgatgggggatagtgatcaacaatatgttttgttgtttgtttagcagtcatcggtaatgatcagtgaccaattataacaatcaaatgttactatgttagtatgatattcgttttccgtaattaagtggtagattagatcaatcttaattcttaaattcttaattagcgactaataaattaaaacgccaaaaagtttgaattagcaaattagttactgaaaacttagtgttgccatcaaaaactacaaaacaacaatctatttgttaccatgaaactacaaaacaaccaagatttagtgtttgatcggtaatacctaatctaatataatcaccatctggttgatgtgtcaaattaacatgcatatgcgtgtatgcaaataccattcttttgttaaaaatcaccaattcacattcttaattacatgctaagtgctaactaataactatgtagtttgataaaacaagttaatatatcaacaacatttttatcaaaagaaaaaaataaactatatcaacatggacaaattacatcacctaacggtcctaacctaatttaaaataatattgatgtatgtttataattgatttctataatgaaagaaaacaaaaagacgaaaaaaacaacatgctaaagatcaaagaacattagttgaatcaatccttattttgaacaaagaatagtcagtccattttgttcacctgaaacgcaaacgccacctttgtatggtaatacaatcatacaaatctcatacacaccaaaagaaacacaaaatcaccaaaacaaaatctttatatttatttcttttttccttgattctccttattaaagaaaaaagattattcttcttcacccgtcacaagccacaacgacttattttagattcccatacaaaaaagaaaattccacatctataaaacatctcctcccatatttgctggatcatccttaattgcctgtgttcatgtcttcatatctctaaccataagataaaactcaagatttctgaagaggacagctctggaattcatatacgttttgcctctccatctgattctcaggtttgtttcttgtcttaaaagaaacacaaaatgggtttatttgaatcttttaatcataaaaatacttaaagaaagaggatcaaatgttgatttagatctctaatgaaagtttgtgtaacgtataaacagcttatggaattggagcaaatctgcattttgaaacccgatgatgaggaagaa

SEQ ID NO: 12042 - DNA, 3000 bp, Unknown; identical to SEQ ID NO: 12030
  misc_feature (1)..( 3000): cDNA_ID_3023716_gDNA_ID_2214528_Annot_ID_184836 3000 nt of promoter + ATG

SEQ ID NO: 12043 - DNA, 3000 bp, Unknown; identical to SEQ ID NO: 12029
  misc_feature (1)..( 3000): cDNA_ID_2711408_gDNA_ID_2214528_Annot_ID_184835 3000 nt of promoter + ATG

SEQ ID NO: 12044 - DNA, 3000 bp, Unknown; identical to SEQ ID NO: 12027
  misc_feature (1)..( 3000): cDNA_ID_3023719_gDNA_ID_2214528_Annot_ID_184832 3000 nt of promoter + ATG

SEQ ID NO: 12045 - DNA, 3000 bp, Unknown; identical to SEQ ID NO: 12021
  misc_feature (1)..( 3000): cDNA_ID_3023723_gDNA_ID_2214528_Annot_ID_184831 3000 nt of promoter + ATG

SEQ ID NO: 12046 - DNA, 3000 bp, Unknown
  misc_feature (1)..( 3000): cDNA_ID_3023747_gDNA_ID_2214528_Annot_ID_184822 3000 nt of promoter + ATG
atataatatttttttgtcattttcctaattaagaaatcctactatattatttaggaagtacattttaaatataaccttattttttgtaagtaattacataagtatgccattagaaataaaatttaaagagtacattaattcatctctttaataattaagtcaaatactaatttaattaattaaatttaattaaaaaacaaaatacattattaatttccaaaaaagtaaccaattaaaatcaacaaattagatttgatatctaaattatcatattaattttttattaattattatagttcacctctcatctttatatgattctattttggcgaaaaaataatatcatcgttataaaaaaataattagagttttttcgcatatgccataatttgaatttttaaaaactaatataaactgttcaatacatgaaaaaatattataacgggtcaaaaatagatttaagaaaattttctactgaatactgggtcataatttgaatatttatattcaatttcatacatattattttaaaaatttataatcttatatactacaataattaataacatattagatttttttatgtgtatgatgtgattcaatttttaatacaagatagaaaatcctagaattgacgggtttaaatcgatattaatacaagatggtatactacatgtgaaactctaaaattaacaatcaaaatacaagtgtataattttaaacactaaacaatataaataatatcaacaaaacatatacaactcgcagtttactatacatttaaaatcaaataaaataatatcatatatttataatcatctttacaataaaaatttttagtttaaataaaatataagcctacatgtggtatactgcaagttaaaattataaataagcagattaccatcacgatgtccgtaccttctcacatacacacttatcaaaaattataaataagcattttaaatgtaaccttattttttgtaagtaattacataggtatgccattagaaataaaaacttaaaactttttaaaacctcttggtatatacaaattaggattcttcattcataaaatcattattccaagggttttgggatgtcttatgaaatgattttggtagaagaggatgtacatttttttgaataaaaagtagtcagcaaaacatatgttttttttgggagtttttagataattaaatcagagaatagggttgggcatacgagtaacccattcgagttctggtagaacccgttcgggtttgggattaatgggtatatgatttactatccaatagaataattctaaatatttggttctggttcgggtcggatccagttgggtttgggtcagtttggataaaaagtttcagaccctaaaaatatccaaaaaaaaatagaaactggaaatttgtatgtacatagcgggtctccaaacaaaaaaaacttttaaatttgttaagttttaataaatttaattatatttgaatatattttacaaaattttgacaaacataacaaatcatttttgaatagtttagttgttttggatatttaggtccaaaattaattgacatatttaaatttataattataatcttagataattagataatattacgattaaatataattaatattttggatattaaattaatgtttgggtttttgaatactttgttttgtaccaggtaatttccagaccaatcggatatccacgggtttactaaaactctacccaataaggaaatttcctaaaattttaacccgccctaacccgtttttttggttcgggtattgagttggttattgggtccgttttttcgtcagccctatcaaagataatctaatataggcctcaattaggtccacaaatataatccaaatactatacaaagactaattctaagttaggccaaaaattagaccctttaatacaaaggaaacatgtttcttaccaaaacaacttgtatacaaattttacacatttacttaaaactacatatgttgtatttattataaaaataacatttttaaacaaagtcaattcaatgcagcattatatgcaaatagtaaaaacattgaaaaatattatggcatcacttttatattatactatttcttatgtaattcaaacaaagtatacaatttaatttatacaaaatattaatgttcgtgctgtacagcacgagttatgatctagttctcttttattattgagcgcgctaatttattcctttttaattatcataaaatctttaaaattttaaatagccccaaaaatgttgggtttaaaaagtgtataaaattttagaaacaagtcatatttgatttaggaacatttccacctaaaaaaattagaaacttttagtaaacataaaactttaaggtactttgagaaatgttccaaaattgtggtattgataaaacaaataaagttacacaaaaattaatctataatatactaattttgaactaaaataaaaacctaaagatccttgtcatctagaagtgttgtactttggtaaaggtctctgctctaaaacccaaactgaaacataaagccaaaagatctcaaaacagttccaacgagaaaaataaggtttgttatcttccaattttcataatgtttttttatattcctttgtgcaatcgctaagtcaaaccaaccctaatattatttcgccgtaatttttaatttccaaagataatcataaaaaaaaaggaacaaaaaccctaaggttcttgcatcgccgtcgtattattccgtcaacactataaaacccacattttcctatctctctcaatctaaagtctttgttagggttctttatttttaaaacaaacagtaaccagaaaaaataatcaaatcatcgaatgggtttgagtatcgcttaataaagttttgatctttgggtttagttctaaaaacagagaattttggggattgtatatatttgaggtataaagttttgatctttatgattttttttcgtaatg

SEQ ID NO: 12047 - DNA, 3000 bp, Unknown
  misc_feature (1)..( 3000): cDNA_ID_2708229_gDNA_ID_2214528_Annot_ID_184854 3000 nt of promoter + ATG
catattgtatgtttactgcctaagaacgacaaagacataatgtgcatacggtgatacaggtgaatcagattggtacagtaacagaagccattgaagtagtgaaaatggcaagggatgcccagtggggtgtggtgacatctcatagatgtggagaaacagaggactctttcatctctgacttatctgtgggtctcgcaacaggtgtgattaaagctggtgctccttgcagaggagaacgtactatgaagtataaccaggtctggatctttttccaaactaatatcctcagtaccccttatgcaattacactagaacaatctacattacgtggagtaacctgcattggaattttggatcatagctctttcatcagattatcatcagcttctttttagcttttaagtagctgagttatgttgtggtatgtgaatctttagcaacctaggctaagtttcagtttcttcaacttttggctaatgcagcctcagcttatagatccataatgattgagtttggagcagccatgtacatttagttgctagatagtgttctcatttcattgtagaaactactttattaaaaagctgaatcactgttgaaatgttcctgcagttgctacggatagaggaagagcttggggatcaagcagtgtatgctggagaagattggaagctatctctctaaacaaaatgcacatgtgatattaattgttacacttctcgtcttacttcattgttctcgagtctatttctcacgcagacaaattcttgtgtcttgaaagttcaaattttttgttgtttttgccaaatttaagaacaaacagaagtaaagagtgttaaacatgttttttacaaattgtaaaagcatccaaaaacatcaatcaacactagttcgtgaggttgcagaagccacaaacaaacgtgttttagggcttcgtgtcttctttttcttcaatgtttaacaaacagatgaaaagtgttataaacaagcttttccaaatttcagaaagacaaacatcatacgattatctagtttagcattgccttaagatagtaaatccagaaaacaactgaatcaagacagacatttcaacaaaggactcgaacgaagactatcaaacattcatcattattctggtttggtgtcttcttcttcttcaatcttaggcgccagatagtatcgaatgtaacccatctcagccaccttgtactccaccacgaccggtaactcagaggacaaactgatggtcacagtttccgacaatggagtagcctttgtgaaggagttcatgtacctcaatgcaaatgaaagcgaaacaggctcgttcatctctatcacaatagcatcttcaggctgcaaaacacacatacaaacataaggtcacttcaacattgtattggacagattattaaacaaatctctctagatgactagtgattgttcatactttgtcgacggtagtattctgcctgagcacaatgtttgctgtcccgatatcacctgctgttgaaaacttcaccccttcttttgttaccgagatcacaactgcaaaatcataacatcaaaaccagaatcatgattagagaatcctcgcagtgatacaccaaataaacaaacagttcatttacctgtgtcaccaatgctactgagatctttgcatatcctggaaaattcaccagaaggcattctcacaatcgagtggtactcagcatcaggaattcctaaatgctcactgtcgatatccatcagcttcatctcaaaatctgcaatcttgtcttgtgctgcatcatcaacaccatttaaataatgagattaacaccacatagtcaatatcaaacaaagttcctctgttaactttcactaaatcaagaaactctattcactttcaaactatagtctttaagctagagactatacctattctgaaaacaaaaatggaaggactcattctcatcaagcaagttctagtttctgtcaaatgaaacctataaataacagttcagatcactaataacatcattaactacacaaaaacaaagccatatcaaaccttattccaaaccaaaaaccctctattaacatagattttatcttctctttcatctcttacaaactaaagctttcaagaaatggactgaatcattctctacaatcatattctagcttctggcaaatcaaacctataaacacagaatcaggtcaccaatagcatcaacattgacaacaaaaccaaagccctaacaaacaaaaatcgatttgaagaacttactgggactctcaaacatgaaagtaacagtgtcgctaccatcatcagctttgatggtgatgatatcatcatttccagcacatttcagcatcttagacatattaccaagattcattcccatagagaggttcctatcgcatctatagtgctcgaaaccttcagatctaagcaaaagagacaccaacgcgacatggctcgaatccatagcttgaagcgagaaccctgtggtcgaacagtcgaagttcgcatcgttcaccagatctttgaccgcttctagaaccttcttcagtagagaaccttgaactaaacgaagctccaacatcttctgggaaattatcgaaaggttagagtgtgaatcgaaacggttagggtttttagagctgttgaaatttctgggaggagattgcaattgttagcgggaagtgatattataagctgagattttgtggcgccatttagcgattttagggtatttttgttcccgcctgtgtgtgacgatgaattatcatctgtgtgagtccgtattgtttatttcagtacaccaccatcactttaagctttcttatttcatgggtttaaattgggccaaacaaacattcggcccaacagcagctgtaatattaaagattcccgaaaaaatcgaaacgagagcaaatctgctcttcaaggtaatcttcgtgttcgagactgaagaagaaatccagaaatcattgaggaaggaagagaattaggaa

SEQ ID NO: 12048 - DNA, 3000 bp, Unknown
  misc_feature (1)..( 3000): cDNA_ID_2781831_gDNA_ID_2214528_Annot_ID_184852 3000 nt of promoter + ATG
taggtgatccagcaagagaggtttttaaagatgcatgtcaagagctcatgcaaatgaacagacatgtgagaagcgtttttgataaggctgttgctgagtataaggatgaacaaaagcgtaaggaggaggctgaagaagaagagcttaagaggcagagggatctatttgggtccatggacattgaaaacaactgataaccattgtattctcctatggagtttatactatttttatcttaaatccagattcgtccttcaaattgactcgtcaaattcataatccacaccaaaatttaaccaagaagattcttatattgcttataaccattgtcactactactctgcttcttatatttgaaagatggtgaagtcttcaccgaattcacatagtcaaaattaacaaaaggttatataatgaaacaaagaaaaaaaatactatggatggattttgatttagcaaaatagattgtttgaatattgattgataaatcctcttagcctacgcagagtatcataactactaataacgcaagcgatagttacagaaactataagaacttaatagaagagagttttaaaagtaaacagcaactggaagttgaggtgttcttatcatctgtttcttcaataagtttcttcttgctcgtactcagcttcttcctcttcatattctccttcttcatcagccgttgcatcttgatactgctgatactcagagacaagatcgttcatgttgctttcagcttcagtgaactccatctcatccataccttcacctgtgtaccaatgcaagaaagcctttctcctgaacatagcagtgaattgctcactgacacgcctgaacatctcttggatcgaagttgagttaccaatgaacgttgaagccatcttcagaccagtagggggaatgtcacagacggttgatttgacgttgttagggatccattccacaaagtaggaggagttcttgttctgtacgttcagcatctgttcatcgacctccttggtgctcatctttccacggaacatggctgaagcagtgaggtagcgaccgtgtcttgggtcagcagcacacatcatgttcttagcatcccacatttgctgagtgagctctgggacagtgaggttacggtactgctgagatccacgagaggtgagaggagcaaatcccaccatgaagaagtggagacgagggaatgggatcagattcacagctagctttcgcagatcagagttcagttgaccagggaacctaagacagcaggttacaccagacatggttgcagagatcaagtggttcagatcaccaactgcacaattcagaaaacaaacaaaaaaatatgtgagtgaagtttcaatactaatcaataactaagcctgaaacaataaaccacagagacagatacagtaacaacattgactcataatcgaagaacattggaatacttacaacttggagtgctaagcttgagtgtacggaagcaaatgtcatacaaagcttcgttgtcaagaaccatacactcatcagcgttctcaacaagctggtgcacagatagtgttgcgttgtaaggctccacaacagtgtcagacaccttaggcgatgggaacacagagaaagtcatcatcatacggtctgggtactcctccctgatcttagatatcaacaaagttcccattccagaaccagttcctcctcccaaggaatggcacacctgaaatcctgtaaatccaaacaaccaaaaccataagcaaacaacgaatacaaaaccgaatccgtattccacagttcaaaatcagaaatctaaacctaaaaacaatcatacactaccaatacccaacctaaatttacagatccaaaaacctaaatagacaaaaacctaaataaggaagacggatttcaaataccttgaaggcagtcacagttctcagcctctttgcgaacaacatcaaggaccgaatcaataagctcagcaccttcagtgtagtgacctttagcccagttattcccagcaccggactgaccgaagacgaagttatccggtcgaaagatctgaccgtacggaccagatctgacactgtccatggttccaggctccaaatccatgagaacagcgcgaggaacgtaccttccacaactcgcctcgttgtagtatacattaaccctctcaagctgtaactcggaatctcctacataccgtcccgtctgatcaatcccgtgctcgagattaaccacttcccaaaacttggaaccgatttggtttccgcattgacctccttgaatatgaagaatctcacgcatcttcgctcacagagaagaaaaccctaaaactggatctaaaaagagagagagagagagagattttgaaaaagggaaaggagaagcagagaggatcttttgttttatgagagagagaagaagaggagggtccatttataaagaaaaggaggttttaacggctaatatttggtaattcgaaatcgaatcgacggtttagataatgccacgtaaatcgaggtggcaacgggtggcaaaattcaaaaattaatggctcgtgataaaaagtttttttgaatttcgtaaaaaaatatgttcgtgtgaatgacagctggattccattaaggagagcagttactaaaacatcgtcgcactcgcacgtgctttatgagagataaaaaagcggttccaacctggcaatcgcacgtgagagacttcttattgggcctaaaatgggcttttactcttttcatttcaaatctgcatgacttaaaacggagtgatgtgcactagcaaaatcctcagacggcaagcatgtgtttgtaaagtgaaactcatcgttttaatgattgaatatgcttattggatcctgaaccggagcctgaaccggagcgtgaaccaaaaaatacagtcaatcggaaaatgaatttcagattcaaacttgttcatcgaaattttgcttgaagattcgaatcgagaagtccgtggaagaggaagaagaagaag

SEQ ID NO: 12049 - DNA, 3000 bp, Unknown
  misc_feature (1)..( 3000): cDNA_ID_2711397_gDNA_ID_2214528_Annot_ID_184851 3000 nt of promoter + ATG
atggcacgctcaactcgttttgaatttgacatcaacaaatcgtcacctaccacctacaagagtttaacactgagaatttagacaaggaaaatgattgtacaagaagatttaagggtctctctctttagatatttgactctgagaaaagaatcagaagacagtgtgatctgaaagaacacaaaatctatgtgaaccgttaatagtaggggaaccgagttggacctgacatattccaagactcgaaaaatacttggtgtgttcccagtcctccttgtcaaaagggtcttctatagacacaattggataatctaaacccacaaggagaccaaacagagaatctggtcgttacaatactgcaagagtactaagatagacacaaaaaatattgttcagacgagccagacataccattacaaatttctttgtacatatctatcatatcttccgctgacttgaaattttgcccagatttatttggagacttgatatctaaatcatacttggtacctgttcaggaaagaacagttccacaaggtaagaaataatacacaaaaacgtataacatagttgaaacttgcaagagcaagatattgataggctacacatttgatgatttaacatcttattcgtctcactagccaattgtgaatgacaatgccgagaaccaaaccaagactatccatgactacaagaagccgcaaaaaatcagttagccaggaagcagaaaattacctaaacaaaaattagtggcggcaatatcaatggctatctttatcttatcattgtaccctgttcggttgatagcttcttttacaagctccaaaccttccttgaggctgcatacagttgcaattacacatattaggcactaagccatcaaaccataacatggttttctcagtttcgacaatctacagatgcaagcagattagcatcagagaggaaaaatatatgtacctcgagatatctggagcaagaccaccatcttcaccaacattacatcccaaaccaccattcttttctgaaatgacagcctgccataaacagcaatagatcattctcaccttatacacaaatttacggatgcaattagaaaggtaacttctagaaagccatatatctttgaaaattgacctttaaatgatgatatgtctcagatccccattgcagggcctcctcaaatctacttgctccaattgggagaatcataatttcctaaacaaattatgaaaacacaacaatcattacatatgtaaatgaaattacttgaaaaccaaaagatttcttgaagaactttgagaaacagaaacgttaatagtgaacttaatgtagaatacctgaatggcaaaagtattcgaagcatgcttcccaccactcaaaacagtgaacgcaggtacaggtaacaccatgtttgctctgccactaagatcagaaagatgcttgcacaaagggacctgataataacttcaatcaaaatctcctaactaaagtaggcataaaatacataggataagagaaaatgttatcattcatacctctttctcagcagctccagccttgcatgccgcaattgacacagcaagtatagcattagcaccaagttcactctgcaagatattcaaatcaaattaatcatgaggagcaatgatatatgaacttgttacaatcctaataaaagttcccacctaccttcttttcagttttatccaaatctatcatagcctgatctatctgaccctgaagttttgggtccataccaatcaacgcctcagaaattttttcatttatgttcttaacagctttagccacactgtttccaagatacattcctttgtctccatcacgtagctcaatagcttcataccttgagaatcagtaaaccaatctcctcatgtcaggcttatcatattagagaattgtatatcaatcagagtaagaataattctcacgttccagaagaatcaccactgggaacagaagcacgaaaaacgcctttgttcgtgtgcagatcaacttcaactgttggaattcctctgctgtcaaggatctgtcgtgctttaaccttcgttatcacagatgatacagctttcttcagatgattagcctgcacttttccaattgaagattcaatgagtaatgtaacataatttcacttcgatacatgtaaatcaaaattcgaaggaaacttacgatgaagagaacgggatctgaggttttagcccttacggcggcattaacggcgtcttcgattttccgagaaagcatatgcttgtctaaatactcttgcacagacatcttcttcttcttcctcttccacggacttctcgattcgaatcttcaagcaaaatttcgatgaacaagtttgaatctgaaattcattttccgattgactgtattttttggttcacgctccggttcaggctccggttcaggatccaataagcatattcaatcattaaaacgatgagtttcactttacaaacacatgcttgccgtctgaggattttgctagtgcacatcactccgttttaagtcatgcagatttgaaatgaaaagagtaaaagcccattttaggcccaataagaagtctctcacgtgcgattgccaggttggaaccgcttttttatctctcataaagcacgtgcgagtgcgacgatgttttagtaactgctctccttaatggaatccagctgtcattcacacgaacatatttttttacgaaattcaaaaaaactttttatcacgagccattaatttttgaattttgccacccgttgccacctcgatttacgtggcattatctaaaccgtcgattcgatttcgaattaccaaatattagccgttaaaacctccttttctttataaatggaccctcctcttcttctctctctcataaaacaaaagatcctctctgcttctcctttccctttttcaaaatctctctctctctctctctttttagatccagttttagggttttcttctctgtgagcgaagatg

SEQ ID NO: 12050 - DNA, 3000 bp, Unknown; identical to SEQ ID NO: 12038
  misc_feature (1)..( 3000): cDNA_ID_3023706_gDNA_ID_2214528_Annot_ID_184849 3000 nt of promoter + ATG

SEQ ID NO: 12051 - DNA, 3000 bp, Unknown
  misc_feature (1)..( 3000): cDNA_ID_3023710_gDNA_ID_2214528_Annot_ID_184848 3000 nt of promoter + ATG
tgaagacaagagtgttaaagctggtggtgttattggttcacaggagctaaggaatatgcaagggattgataaactgatggataagcatacgaggtcttccttgtctaatacaagtacatcgtcttctctctggactgatgagtcatcgactgattccagtagaggtctttgtgcttctccttttcgtaaaaagatcaatcaccctcctttgcagtattatctcatgtcttctaagcctggagataattttcaagatttggagccacctcaagataacggtgatacttctcacagtcatagaagagatgggcagtttcatcagacccctcgtgcaactgcggtccaacagaatgagaagaaagatactgatgttaagattgttccaaagacaagaactctctttagtccatcgaagccagatagtccttcttgcacaaggataatatcaaagaatctagccgaggattttaagaagaaaggagagaagttggaagagagaatccgaaatcctcgtgttcatgatctctttggaaaagaaaagcctgctgctgtatttgtaccagggattgtttctcagaaacagtttattggtttgtccaagttctatgattcgaaagtgttactagctgagcgattggcggaaagtaaccgaaaggggttcacagagaggttagcgcatgggaaaactgcagttcttgactctgatgtaggtcctttccgacgtgaagctgatggaggaagtaagccattcttaaaacgtatcagcttcttatcagaaagatcatgttcagctccacgatcaagaaaggctgaatctagtccctctagaagcaggactctagatagaaggtcaacagaaacattacctaaacagtcagatcagaaaccagctaaagtcttatcagaaagagctaggagcatttcaccatttcgccgactcagcttcagcattggaaagtccagtaaaaactccaacaccgaagatgctaagactcctccacacttaagcacagcacttatttcatcacgagctggtttagacaatccatctgcctcttctttcagtgacagctcttcttttgataaaaccagtgcagcaaacagaggcaggtctagtccattgagaaggttactcgatcctttaataaaaccaaaatcaagccactcatgtagatctcctgagccatcactaaaggaagcaccttcaagtcaaccatcttcgtcatcctttctgtcgagaaatggaaaatcttcaactgttcaggctctatttcgtgtgacatctaagaatgatcaaccactcttcacttttgcggttgaaaaggaacaaagtattacagcagctacaataagaaaacagactctcccagagaaggaagactatggacacaagtatacttttttcactgttcaagaagtacagaagaaaaatgcaaaatggatgaacaacagcaggaaagtccaaagccaagagtacacatccaacattgtcgctcagatgagagtctcagatcctaagcctctatttctcgctggagaaagatctgcggaaaacctcttaactagagagtttgtacttgttgcatctgaatcgcagcggactaacgagctagctgccatggtgatcaagataccaaaacttacagacacaacaagctcaaccactcttggagattactttgcagaggttaacgcaacagtggtacttccaagtggagttcacagtctcccgcacaaaggagggccgtcatcactgatccaacgatggaaatcagatggatcatgtgactgtggaggctgggacacgggatgtaaccttagaatcctcacaaatcagcataataaacccataaacccttctccaaccacttcagatgccttcaagcttttctttcaggtttgttatataacatctcaaaactctgaatactaagaccaacctttggcttaaattatgaatctcactaatgtgagttttgttgcagggaggagtacaggagaataacaaccaaccatacttgagtttcactacatacagagaaggtgtttacgcggttgagtacaatacatcgctctcactcttgcaagcattctccatttgtatagcggttaacgagggacgaaatccgttaataaagaccaccgtggaacccaacacttcacgtgtagagaagaaagcttatggaggagagatgtcatcgattcaaaacgagaatttgaagtcattttcaggtcctattgaagctgaggctccggctaggtatctctcacaccacccacctttgtctcctgttgggagggtttagttgcttcttcaaataatcttgttatatatatttttttcttttcttttctcttctgatggggttcgtattttctgtgtaattacggcgtggaagtagattacgttaaatagagaaatttgtgaaacttgttgtaatcgaatatccacatttaagctaataaaaactcttatgttcttgacttctttcttcttcaattacaattaccatgatcatgtaacataaactctgtcgtgttagttgttactttagtagtttagttagcattgttaaaaccataaaatgcaaacattaagcaaaaaaaaaaaagaggaaaaagatggtgctgcccaggatcgaactggagaccttttgcgtgtaaggcaaacgtgataaccactacaccacagcaccttgctgttcaagattatcatttaattctatataaagtttagaatacagaattggctttggtttgcgtagattgcacaaaaaggtgagtcctttctccgacaacgcaaagactcatttgaatcggttccttcaaaattattgatttgggaatatattcttgtcaattcaggtgaatcaaactggtcggtgcaattcaagattgccctcgtatttgtgtcggggaatgaaactgttctgtctttcttacaaaagcagttgcatttgatcttgctgcagagattaatgttcattctcaatcttaacc

SEQ ID NO: 12052 - DNA, 3000 bp, Unknown; identical to SEQ ID NO: 12037
  misc_feature (1)..( 3000): cDNA_ID_2708225_gDNA_ID_2214528_Annot_ID_184847 3000 nt of promoter + ATG

SEQ ID NO: 12053 - DNA, 3000 bp, Unknown; identical to SEQ ID NO: 12036
  misc_feature (1)..( 3000): cDNA_ID_2708189_gDNA_ID_2214528_Annot_ID_184845 3000 nt of promoter + ATG

SEQ ID NO: 12054 - DNA, 3000 bp, Unknown; identical to SEQ ID NO: 12035
  misc_feature (1)..( 3000): cDNA_ID_2708221_gDNA_ID_2214528_Annot_ID_184844 3000 nt of promoter + ATG

SEQ ID NO: 12055 - DNA, 3000 bp, Unknown; identical to SEQ ID NO: 12034
  misc_feature (1)..( 3000): cDNA_ID_1808515_gDNA_ID_2214528_Annot_ID_184842 3000 nt of promoter + ATG

SEQ ID NO: 12056 - DNA, 3000 bp, Unknown; identical to SEQ ID NO: 12033
  misc_feature (1)..( 3000): cDNA_ID_1009988_gDNA_ID_2214528_Annot_ID_184841 3000 nt of promoter + ATG

SEQ ID NO: 12057 - DNA, 3000 bp, Unknown; identical to SEQ ID NO: 12013
  misc_feature (1)..( 3000): cDNA_ID_2708154_gDNA_ID_2214528_Annot_ID_184817 3000 nt of promoter + ATG

SEQ ID NO: 12058 - DNA, 3000 bp, Unknown; identical to SEQ ID NO: 12049
  misc_feature (1)..( 3000): cDNA_ID_2711397_gDNA_ID_2214528_Annot_ID_134234 3000 nt of promoter + ATG

SEQ ID NO: 12059 - DNA, 3000 bp, Unknown; identical to SEQ ID NO: 12048
  misc_feature (1)..( 3000): cDNA_ID_2781831_gDNA_ID_2214528_Annot_ID_134235 3000 nt of promoter + ATG

SEQ ID NO: 12060 - DNA, 3000 bp, Unknown; identical to SEQ ID NO: 12047
  misc_feature (1)..( 3000): cDNA_ID_2708229_gDNA_ID_2214528_Annot_ID_134237 3000 nt of promoter + ATG

SEQ ID NO: 12061 - DNA, 3000 bp, Unknown
  misc_feature (1)..( 3000): cDNA_ID_1383470_gDNA_ID_2214529_Annot_ID_134240 3000 nt of promoter + ATG
cttcggtatctcaattccgagctcgaaatgaacttggtgtcgtcggcaatgtttgcaagttaaaacatgttcgacactcctgaccttttgcgtgtattagcattatgatgtaatcgacatccttttcttagccaccaaccttgtagagttctagtctttagagaactgatcattttcagtagctgagacgtgaaaaccttctatatttgagctctgcgatggctttcttttggtcgtaaagccaaagcaacattgatgcaactgcttccggtagccatcaccgatgcaggataagacttttggtaattgaatagaattgctcagacaaaggtaggaaataaactctagttctcatttctcttcaaagtttacatttttttttttttatgtttttacatttttgtgatagcaagtttgagaatgaacatcataaagatacaaagttacagatttttgttgtggaagcaaatactaaaaattacaaaggtacagtggtggctaaagatacacagaccgaactgctctgacttctctgactagttaacaacatatctcttcagcgaggctggtggatgtttctcggagcagcagcaaccctctggtttccccatttcgctggcttttccgcatacttagctggttccacaatcgatctcgggctcctgtttccacttgatttcttaaccatctcaccattctttccaaagcctgatgatatatataaacaacaattagcctccacaaatctactgatcttggatggttctatgtatcaggggaatgaaaccgacttaccaaattcggaaggtgcttggtaatacattcttccatcgaatccttgatcaaactcagcagcatcagtgtcaaagaaatcttccatatcatcaaaatcaaatgattctggaagaagatcagctacatcgatatgacctccaccattctcattctctccgttgtcatagaaaccatccgcgccttgctgctgctgactgatccagtaatcagggtaccaagtcgaagttgtcaccaattgccaccactccggtgagaaatcttccacttgtcgtacagctgccggaataaaaagaggtgcgtcggggtttagagtagatcgtcttcctgataccatcgccattctcaaaactctagatctgcacacacaaacaaacaagctcagttcaaattcaaattcaaatctaacaactcaatcacaacatagcttaatccttagatcaatagatctgtacgatcagtaaacatagcaacaataagtttccgattagatcacttgaagtaggacaagtacaagtttgaaatcgagagaactgaagataaatcaagttttaagatagatcaacaaccatcacagagatctaataccatggaaaccaatcaaatccttcaaaatccacgaacttcaaatatagaaattgatcgagtagagaagaagacaacatcagatctttaccttggccgaggaaaatatctgctgcaacttgctcaagttgatcaagttgataaatatgtcttcttatttttttaaaagctaaacggattaggatcattcaccagaacctacgttgcgagaagatgagaagaagaaggactaatatataaagtaaggttcggtgacgaagctggggttcgtaacgtcgaggcaggattaaaggtgagacacaagtgggtaggtctggacccatagctaacatggttctgagtaatcaaccgtccacgtgtagacgcgttactgttggcttttattgactttctttttcgttccaatcctgttggctactcacactaaaaagttaaattattattctttctataaaatatcttaaatttggtcggaaagaggataaggtaggaggaaactaatccaatataagcccatttatgaccgtatgggcctaacccactcatgattttgttttacatcatcattttgggcctaatcctagaatctacttttggtacttacgttttcggtattgtatcgtgtaagtaccaaaagtagattctaggatttacgtaatgtctgagatgtgcatttttataggacatcaagtttgaaaagctaaccaatgacaatgaagaaccaaattctaaggtaatctatacaaggacaccaagatcattaaggtgtcgaacaactaggattatcgaaatgaacatacataattttctgcttcattgttatgttgcaaaacggaatgactgatcatattttcttctttgcatcaaccacttacggtcagttttagaatagcagtggcaaaactagtagatgaagtagctcaaagagaacgatgtgtaattggcgggaaggaaaatgttgtagtgaagtccaggccattgctactttcacaatgtgattcagcaagccttttcaagagattggaaaccttaaaatgtatatatgtacatgaatatctcctcttttttagtatacattggaagtaggtaagtggggtttagaatgtagacacttttactttatctattgtgtacatctatttatcatatgttgtaatgtgtcttaagtcaatcgactcgataaaacaaaatgaatttctatattctaaggaaatttgaagtaagatacaaaaagaaattaagcatcactagatttcatacagaacattagaaaaaacaacagaataaacaaccaatcaataatctttgttctccaattaattaagttctattaaacaaaaaaaaaacagaaataatatcgctgcaaaaggcagaaaccgcgtgaatcttgttttaatttaaccttttttattggtagtttcattttaattcatcgtattgaacgctagcctaaagttatggataaaaacaagaaaaatcaaataactgcaaaacgcgttatacttaaaacactctcctcttttccttgtccttctctatcgcttctataaactttttcgatctaaggttcgtgatctccttcttctctacgaagtttacactttttcttcaaaggaaacaatg

SEQ ID NO: 12062 - DNA, 3000 bp, Unknown
  misc_feature (1)..( 3000): cDNA_ID_2708249_gDNA_ID_2214529_Annot_ID_134241 3000 nt of promoter + ATG
accaaaaccctcttacaaataaatcccgaagctttatgcagagagagagagactccaatcagaagcaagcatccaagagacagcaacaacacagagcagcaagactgcaaaagcaaaaacagtgtttacatttcacaatcagtattaaaaacaaatccagttgctttaagacatgcaatgtagtaagcagtagctagatcatgcaaacaatcaaatcctaaaagatgcacattcatcaaaaacaacatccgattcacactgttaagtaaagccatcaaagaacaacaattatcctgtattcagtgaaggaacagagaacacaaaaaggatccatcttgctaagccaatttacttatcaaaacttgtacaagtatagtttcaagtactcataaacagttaaacactaccaaaccaataacgacaagaacacaatcacaattctagtttctttaaagcatgcaatgttgtagtaaccagtagctagatcatgcaaacatgttaaatcctaaaagatgcaaattcattaaacacaacaacaattgtcctgtgatcagtgaatgaacagagatcacaaaaagtcaacctctacagaggaatattctagctaaaaccacatgaccttttgttcaaagaatctctagaagaaatatttaaaataaggaatatagtcaaattcaaactatacacaaaatctaattagtaaaaacagattaaatataatggagtgtgtttattgactaaccatccttctagaaagccaggactgctctgttgttgctgatgctgcggtggtggaggatattgaggcgcgtacggtggaggatatccttgctgaggataaccttgttgaggatatccctgaggtggatagccttgctgaggatatccctgaggaggatatccttgtggtggataagcatcttttggatatccctccggtggataacctattgatacaatttcagcacaaacaaaattcagatccgtcgtacaaaaacaataatcagtaccaaattaagcagatctaagaaaaaattacaaatctaaaaaccgaaacttctaaaagtaatcgaaaatagaaggaaagaggaccttgaggaggaggaacaccaacgggaggttgattgtactggctcattgtttcctttgaagaaaaagtgtaaacttcgtagagaagaaggagatcacgaaccttagatcgaaaaagtttatagaagcgatagagaaggacaaggaaaagaggagagtgttttaagtataacgcgttttgcagttatttgatttttcttgtttttatccataactttaggctagcgttcaatacgatgaattaaaatgaaactaccaataaaaaaggttaaattaaaacaagattcacgcggtttctgccttttgcagcgatattatttctgttttttttttgtttaatagaacttaattaattggagaacaaagattattgattggttgtttattctgttgttttttctaatgttctgtatgaaatctagtgatgcttaatttctttttgtatcttacttcaaatttccttagaatatagaaattcattttgttttatcgagtcgattgacttaagacacattacaacatatgataaatagatgtacacaatagataaagtaaaagtgtctacattctaaaccccacttacctacttccaatgtatactaaaaaagaggagatattcatgtacatatatacattttaaggtttccaatctcttgaaaaggcttgctgaatcacattgtgaaagtagcaatggcctggacttcactacaacattttccttcccgccaattacacatcgttctctttgagctacttcatctactagttttgccactgctattctaaaactgaccgtaagtggttgatgcaaagaagaaaatatgatcagtcattccgttttgcaacataacaatgaagcagaaaattatgtatgttcatttcgataatcctagttgttcgacaccttaatgatcttggtgtccttgtatagattaccttagaatttggttcttcattgtcattggttagcttttcaaacttgatgtcctataaaaatgcacatctcagacattacgtaaatcctagaatctacttttggtacttacacgatacaataccgaaaacgtaagtaccaaaagtagattctaggattaggcccaaaatgatgatgtaaaacaaaatcatgagtgggttaggcccatacggtcataaatgggcttatattggattagtttcctcctaccttatcctctttccgaccaaatttaagatattttatagaaagaataataatttaactttttagtgtgagtagccaacaggattggaacgaaaaagaaagtcaataaaagccaacagtaacgcgtctacacgtggacggttgattactcagaaccatgttagctatgggtccagacctacccacttgtgtctcacctttaatcctgcctcgacgttacgaaccccagcttcgtcaccgaaccttactttatatattagtccttcttcttctcatcttctcgcaacgtaggttctggtgaatgatcctaatccgtttagcttttaaaaaaataagaagacatatttatcaacttgatcaacttgagcaagttgcagcagatattttcctcggccaaggtaaagatctgatgttgtcttcttctctactcgatcaatttctatatttgaagttcgtggattttgaaggatttgattggtttccatggtattagatctctgtgatggttgttgatctatcttaaaacttgatttatcttcagttctctcgatttcaaacttgtacttgtcctacttcaagtgatctaatcggaaacttattgttgctatgtttactgatcgtacagatctattgatctaaggattaagctatgttgtgattgagttgttagatttgaatttgaatttgaactgagcttgtttgtttgtgtgtgcagatctagagttttgaga

SEQ ID NO: 12063 - DNA, 3000 bp, Unknown
  misc_feature (1)..( 3000): cDNA_ID_2711427_gDNA_ID_2214529_Annot_ID_134243 3000 nt of promoter + ATG
aaaaaaacatatttacaattattaatttatatagttaatttttaattttcttaactaaaatagaaaactaacaataagatataaattttaagatataaatttatttaaatatttattgataatatttaaaataatatggaaaactaacaataagatggaaaacatatatatatatatatatatatttcgaaacaaatgtaaaaaacagaaaaaggaagtaagtgtaatgtaactttttccgttttccattacaatttggggaatttttttatttttttttgggttaaaaataaggtttgccttggataacaagaaattgcttttgctttctatcagatattaactttgggtttccttcgatccgattagaaatctcgagaatggggagaggaaggattaagatgaagttgaaagggaggcgaagagatttgacgaagaagaaggtgagagagctctgcgattattgcggattctctagcggcatcattaggtaaactcgctgaatcaattattattattagcttcgcttcttgcggaaagggttctattttatagggttttgttgttgaaatagttcttaattaggttattgagatgtagaacacgttggttatgagttacataccctagccatcgcaagatctggttctgcaatttttgattcatcgtttcgtttttctgggctagagctattactgttgggtttggtagaattatttggatctcatattaatatctcttttttctgcaacataactatgcttgtaatcacctaaacaacagtttaaaccaaagccctgactttcttctgtgtttgcaaactctttctaggtatgatgaacaaaggccacacgaacgagatcacgaagcagtggtatgtatcttgtatggactttgatctctctgtatatcttatttttgctcacaaattgtttttcacacttcttctagtctatggagaatgaactcaagagattacggcttttaaccaggtctaactcattaacatttcccatttcttgttctgaaaagttatccctctcctctctttgctttgtgattcttatgatgtatatcctttattcccaggagaatgacttgtaaggatctcgatggtctgactttccccgagctgctatcacttaaaagccatctacagactgccttgctcattgtgaaggaccaaacggtgagtaaccaaaatttaaaatcggggaaaaaataagaaataatgcatcttacttctttcttctatcattcaaagcgttaaacaaaccacctttttttttatttattttttaaactgttacagaagaagatagagcagctgcttaaagaagatgatgggtggatgcttatacgggtaaacatttcctaggcacttcatctgccctatgaaattattgtttgtgaatctgctaggagctgctgttcatgttgattcttgtaatatcttccatgtttgaagctttcttacattttttgtagaggaaggacgcagaggatggtatggggagagaggtttctgttccctgcaaattctctaccagcaggttgtctcctccttcctagcttaagtaggaatttttggttctaagttgtagttgtctggtgccccattaaagcctgatttggtcttggtatatctacagcacgggtgagagacaaggtgatgaagcaccagcaccaccgctggtatgtatattaatattctttcacagtcctgcatgcctctctctttaccccacattgtcttgttatacttgtgcatcttttattgcagtcgcaactgcagctacaattcgagagacgaaatgctgaacccatgatgatcgaatacgggagattatggctgttgaaggagtaaatgcgtcgccatcccacttgttgctctctacagagtcgatgtcagtttcactttgtttctgatggtttgtttctttttccttcttttcgtgaaaactgacaggagaatgaacggtagacagctcgacggtatgaacaatgccgagctggccttacttcaagctaagatagtacatggattgcaggagttgcacgagcatatgtatgcaccaacaatggaaaaaatcgctaagaagcgcagatatctgttaagagaggttcccggccggagctgagcgcgagggacgatgaaagctcagaaggccacacccggccatcaaatctttctatgagactcttaagtgacttctggtttctctatttctattttagtttatcgtcaatcctgactttcctcatgtcgggcctctcttagttgattttaatatgtcttaagtaaatttactaatctattatcatagtcgtggcatgttacagatttctgttatatcatttttttgcttcatacttagaactttccgacctcttctatcaacatcaccttgatcctcaaaattaggcgtgggcgttcgggatcggttcttttttttcgggtatcgggtctattcggataggaggttgagaactattcgggtattctaaaaatttggttcagattcgggtcggtttagttattttagtaaaaatataaaaataaccaaaaatatccaaaatattttcgggtttgggtcggattcgggattttttactcacatatacttaaatctacccaaaatacccgattatcagtaaatatattggttactttttatccaaatgtaaccaaaatacttaaattacctaaaaaaacctataacattcgggttttttcgtttgatgcgaaaagtctcgtcttgactcttgaagatttggttttttgactccacaagtcgtcgatttgacattcgaacaaatgattagtcagacgatcagaaacgctccaaaacgcagcgctttggctagaacagagctttaagacacctatgttaatacgaaaataccctctgataaacttatttatacactcgacgtttcgtttttttttccagttttctgaaaagtaaattatttgaaatcccgctctgaatttttaca

SEQ ID NO: 12064 - DNA, 3000 bp, Unknown
  misc_feature (1)..( 3000): cDNA_ID_2708245_gDNA_ID_2214529_Annot_ID_134244 3000 nt of promoter + ATG
aagtcaaaggtctgaaattagattaccaaatatccccattcccaattaagtaacaatcctccattattcttcaataaataagcgggaagcttgagtagattacaagaatgacccaactgataaaaaaaacggctcctttaaatgcaaaaaaactcctttcagtttcaaaggtatcgtctccctcaaaatcacaagctctacatacaattcctgctcacatcatcacatggcttcatcagattcgtcttactctcggaaattcttactcatcacctttcttcctctttccttggcctgcttggccttcctcctccaatggcgaagcggagtcaacgattccgttacgcagtggtttgatgataactatccgttcccaggaatggccactgtctccgagaaacgttctcttcgttctgattcgagctgcgtttctcttctgggtcagagccgtacgcaagcgtttccttatctccgagatttgaagcttgatcacaagcccgatcttaaacctagggttagaaatcttggttttcaatttgatgggttttgagaaatgttaagacttgattcatttgatgatgtaaaaatcgatttttttttgtagatatgtataacgacgagcacttctgctgggttagagcagacattgccatggatattctatcacaaggtcattggagttgaaactttttatctatttgttgaaggcactgctgcttccccaaacgtttctcgagttttggagacaatccctgtgagcttttacgagtcttgttttgttatagttgctctgttcatgaatcctgatgtttggctttatgttaccttctaattctcagtgatgatatttgtttgcagggtgtaaatgttatatacaggacaagagagttagaagaagaacaagctaaaaggtattcttgtgttttgtctgtcattaagttatggatttagagccatgtagattagaaaaatggaggatttgaaggaaccacctctggttatttagacatacctagatatattggtgtctcattggtgtgctcttgtgttatgcttctttgcatcttgttcttcaaaactgaaatggttctttgcatcttgttctttcaaaaaagatcatttcatttgaagttttattacattttctttggtttatagccggatatggaatgagacttggttggagaagtttttctacaaaccgtgtaattacgaattattcgtcaaacaaaacttgaatatggaaatggctatcaccatggcaagggtacctgttacattcagttagtcactagaaagataaattatagaattgccaacttttttcacattctctccttttgcttggtatattataggatgctggtatggactggatactgcatcttgatactgatgagcttgtacatccttctggaacccgtgaatattccttgagaaatttgctcagagatgttcctgcagatgtggatgaagttatctttacaaattacgtgagttaaaagtctttgaagacattggaattggggtttctttctttggtttgacgatggtgatgactcgcaaatgttcctttttcaggagagcagcgttgagcgagatgatatcaaggaacctttcactgaagtacagaacattatcatctagagcttgctatcttgggacatatcttcatatgagttttatcatcaaaagtgtttgtttttgaacttttaggtatcaatgttcaagaagaattttaaacatcttcctagagaagtttactatggaaactataaagaggcaactcgtggcaatccaaactattttcttacctatgcaaatgggaaatccgctgctcggattcaagaccatcttcggcccaatggtgctcatcgctggcacaactacaagacgtatccaaagtatgttcttttcctcacttagcttaaacatagacattcattcttttgcttttgtaatctgacattgattccatctttgttgtgacagcatcaaggaactagacgaagctgcgattcttcactacacttactcgaaattttcagatcttacttcaagacgtgatcgatgtggctgcaaaccaacaaaaaaagatgtcaagagatgtttcatgctagactttgacagagccgtaagctagttttgatttgtttatgtcgattagtatagttcttgttcatcacattttgtatttgtttttgtttctgcaggcattcatcattgcttcaacttcaacttcagaggaaatgctccaatggtacagagaaagagttgtatggactgacgataatttgatcctaaaacttcttaggaaaggaattctgactcgcatttatgcaccaatggtcagttagttttactactaaatctacatcctcttttaaatgcttttcattgaacaaagctatcatctatctcaggttataatccaagagctaagagaagccggtgttttcagctcagtggtaacttcagctcatatgtctctctcaaagaatagaagcaactcttcaacctcaagcaactactaggaaggtgttggagtttgatcttgttggtgaatcttaagcagtatcagcgataccaccgaaagcatctccaggcttggaaaaaatccaaaatgtttaattataactttcttgaaaatagacttcaaaaacttgcagagagatgaaacagagattttctgtacattttcgacaagattttttttttgcttaggtaactatacaagaagaacattagagcaggctttgtggatctacttggaccattaatatacattctatgtaaaatgcttggatttttctgttggtcttgaatcttgatatgaagaaggaatcatagtatgatagtgtctgtgtttaaagactagtgttatagagtgaccaaaagacagtggagtgggcgcgtgtcatatacgcgcgtacgagctttttttttggcggttctttgcctctccttcctctcgagtctcgagtttgtgccctttattcg

SEQ ID NO: 12065 - DNA, 533 bp, Unknown
  misc_feature (1)..( 533): cDNA_ID_2708241_gDNA_ID_2214529_Annot_ID_184883 3000 nt of promoter + ATG
ttttcttctatattcgatctcaattattagattcttttttgtagtaaatataaaaacaatgatttcgattgagacaaaactacaagtgaggctgatgtgaacggggaaaaatagtgacggcttatatctgaattacgttgtgaacacgtttgtttatttcatggattgctaaactttgaggatatagcaaagaagctttaagtaaagcaaacgaatcattaatattttgggaggatgtatatatatatttgaagttgttgttgttgttgtttaaaactgttttttttttcttgtaattaaggttgaaacagattttgaaaggacgttagcacgaaactcgtaaataacgcatgtttattttccaaataaatttataataaaactattatacatcaaaacccattaattcatcatagtggcaaccaagtgtatatagcaatataaatcaattttttaaaaacaacttctgtaaacaaaaggaaagtgaaggcactatgtgtccccacacggttccattgagacaaaggcatatg

SEQ ID NO: 12066 - DNA, 2981 bp, Unknown
  misc_feature (1)..( 2981): cDNA_ID_3023777_gDNA_ID_2214529_Annot_ID_184882 3000 nt of promoter + ATG
ttttcttctatattcgatctcaattattagattcttttttgtagtaaatataaaaacaatgatttcgattgagacaaaactacaagtgaggctgatgtgaacggggaaaaatagtgacggcttatatctgaattacgttgtgaacacgtttgtttatttcatggattgctaaactttgaggatatagcaaagaagctttaagtaaagcaaacgaatcattaatattttgggaggatgtatatatatatttgaagttgttgttgttgttgtttaaaactgttttttttttcttgtaattaaggttgaaacagattttgaaaggacgttagcacgaaactcgtaaataacgcatgtttattttccaaataaatttataataaaactattatacatcaaaacccattaattcatcatagtggcaaccaagtgtatatagcaatataaatcaattttttaaaaacaacttctgtaaacaaaaggaaagtgaaggcactatgtgtccccacacggttccattgagacaaaggcatatgtatgtgtgtgagtataaatataagttggttcttgaacatcattgcatgttgattaatcacacagcacaaataagagttagaaaaatgggagtgtacttaggtaagtattgttatataatgataataatgttagtgttggtgttgggaaaagaagtgagaagccagttgttaaaaaatggttattattcaacttcatgtccaaaagctgagtcgatagttagatccactgttgaatctcactttgattctgatcccacaatttcccctggcttgcttaggcttcatttccatgactgttttgttcaggtttcaattttaatttttcttttgctaatctcaatctcctttctatcaattatgcaagttaattaattgttgaatatgacctattattagggttgtgatggttcggttttaatcaaagggaaatctgcggagcaagctgctctaccaaatcttggtctaagaggtttagaagtgatcgatgatgctaaagcccggcttgaggcggtgtgtccaggagttgtgtcatgtgcagatatacttgcacttgctgctcgtgactctgttgacttggtacgcaagattactaaacctagttagggtacttaattcctttgctagtgttaaaattactgatatcagctgagctatgtatatgtatgtatgaaaacaagagtgatgggccaagctggcgagtaccaacgggtcgtaaagacgggagaatctcgttggcaactgaagcatcgaatctaccttctccacttgactctgttgctgttcaaaagcaaaagtttcaagataaaggattggatactcatgatctagttactctactaggtatatctatctatctcttttataataggaaattggagaacttttaaggaagattattttctactttattgttgagtttgtttattttttatattataataaaaagttatacatatgctcaaaagaaacataaagagtttcctcaacaattgaaagtaaaatatgctagctgctgcacacatcacataccaacatgaaaaagtgcaagtgattaaaagttggagtgaaccctgtttcattttgttgatacttttttgaaacttttgaaaaaactagttataaaagtaatagccgtagctagcttttgtcgccgtcgtactcaaatagatcaagaatactaagaagttgagacatgaatttaacaaacatttgacacaactcttgttttgtaagggaaaatataagacacccttgcgattagaccatcttaaagagtaactaaattgtacttgttgtttctgatgaacataccaggattttgtttctttgaacaacaatcaattaccttacctaaattttatgatcaggtgcacatacaattggacaaaccgactgtctcttcttccgttaccgtttatacaacttcacggtgaccggaaactccgatccaaccataagcccatcgtttcttacacagctcaagactctttgtcctcccaatggagacggttcgaaacgtgttgctcttgacattggtagcccctcaaaattcgatgaaagtttcttcaagaacttacgcgacggaaacgctattctagagtcggaccaacggctttggtcggacgccgagacaaatgccgtggtgaagaagtatgcgagtcgtcttagaggtttgttagggtttaggtttgattatgagtttggtaaagctatgattaagatgagttccattgatgtaaagactgacgttgatggcgaggttaggaaagtttgttccaaggtgaactagtttgaataaagacatatagtatatgtattcggtttctctatgtttcagatttctaatcactgaatgcatgttacgtaattgtcgtctttcaatatttatttttcagttttttatttctctagaaaaaatagtgagtttgttttggatggtaaaacagtatatgctaatctttatatacacattttttttccttcagaataatttacaaaggttagtattcatagtcaacaaatggacaatcaaattagttcctttttttttcttatcaacaaaataacatagtcaaaaacaaattaataatgaattttctgttaaattaccatttttactaattaataatgaataaaaaattaataatagtttccatttttaccaataatactctttttattaaattacctttctatcaatgattgttttccattttatagtgatttagcaaaactatgcatatataggacaaaaaaatcgtggttggcaaaagaaaaccaattagattctgacaaactaacaaagaatatcaacttctctcatttattaaaatacgcgtgatcctcgtgtcggtctcttagagtaattgtttggtttgatccaaatctccaaaaaccactaagatctgaccattttgttcatcgactttttcaactcaaaacaaaatg

SEQ ID NO: 12067 - DNA, 3000 bp, Unknown; identical to SEQ ID NO: 12064
  misc_feature (1)..( 3000): cDNA_ID_2708245_gDNA_ID_2214529_Annot_ID_184881 3000 nt of promoter + ATG

SEQ ID NO: 12068 - DNA, 3000 bp, Unknown
  misc_feature (1)..( 3000): cDNA_ID_3023785_gDNA_ID_2214529_Annot_ID_184879 3000 nt of promoter + ATG
aagaagctgaaaggccgcacaaacaggtaaagtattctaattcttaatttagctgtcttctttttttttgccctgtatccaaattttttttgttgaggaaagtcagttttaccctttccagtctaaaatctctcacaaggccattgcttttgcctctcctttttttcttcttaaagttccttgttgaccttgcaagttcttaagctttctcaccttttacttctttctttcttttttctgtcttctcgggtaattacgtatctgacatatatcacaatccccttcgattttgcagaagaaggaagcagagcatgatgctgacggtatgaggagaggggttttggttccttgcaaattctctgccagcaggtaatctctctgctaaagaattgagttattttttgttgggtttggtcacaacaatttgtgtgtctgtgcaaatgggaaccattttttttctagggtttctttctgtcgaagtgagtgtatatgaaacctgccctttttttttttttttatgagctatataaaccaaaatcagttgtagtttcgtccttattagctactattggactcaacagtgggagttgaatccttcatctctcagaatctgagggagatcacttgtttttttttgttcttcttttcaaagttgtagctgtcttggtgcagcatatcacgttatgatgtcttgctttttgatcatcgaaaccaattgtgtaaaaggaaaggctgacttgacttgttctgcatatatataatacagcttgggagaaagacaggaagatccaaatggtgaagcaccactggtgcgcgtatattctcttctcttccttatctcttttctttcctcagactgtgtctttaaaatcctcattttcttgcagctgcaaatgcagagggaattcgagcaacgcagctctgaatccttgcagagcgagttcgacaaattatggctttttaacgagtaataactcaataccatttcccacttcttgctctgcagaagtctctgtttctttttttcttttctttcattttgggttttctttcatctcacaggagaatgaatggtagagagctcgagggtatgacttccttcgacctgtccatacttcacattcagatattacgagctctacgggctttgattgaccaaaagttgggaccaagacaagaacatagggcatggcagcgcggagaggtaaaaatttatctatcagtgtatattatatgtttttagtaactagtgtatctgaatcgtttcttctattcacacattttcttagcttgtttgccacaccgacaaggaatcagtctctgggttagctgagcccgggagatgttcgtcggataatgacaaggatgctgactcttccttgcaatgtagacttcttctcgtttcaagaaagctcagaagattccataattcttatcagcggaagagcatgccggagaccaggtcggtctgccagagtcgagtgacttccgattgaccttatctgccctggttgctgctttctctgtttctatgttgacatatcaacttgccactttatttgtcttagtcttgaagtctacgcatcttggattgtaaacttagaaataccaattagagtttaatttattaccaaggtaagatgttgttttaagactcgaggggtttcatatctcaccatgttaggacttgtgggtttcatagagcatcaatgagcttcttttatttgtaagagattctctaacacatgacgatcgattactctataaactagataaattaatccgtatgttattctagttaataagggattacgtttctttttaccgcatttctgattaataaaaaccattgttttcaagcttgacccagatcattcgatccgaccagttaacctacgacccaaacatttttccgatttagttttagtgctaatatccgacaaattcaaaaaaaaaaaaaaaatcataaaaattcaccattgatccgcaaccccaatgaaccggttgaaccatctaaacttattcagttatctttagaaaaaatttcagtttttaaactcatttgatgtttttttttttggtgaagacttcacaatatcaccttaagagaatgaatggaattatgagagagacaaccaaaattatttgtttggattcgcgatgttttcttagtttatttttgtcattggtgattttttactatatttgttatggttttaaacttatagttagaattaaaaaatttaatcactttattattattgtttgatttcatgtttttgttaaacattatatgattatttgttgtttttctatttatagaagctatataatctttataaatattaagtatattaaataaattataatcaattgatatgtggtccagcaaggttgattatgtgaatcagaaaataatctggtttaccgtcacgctcggatttaaaaacattgataaaaatacattatatatatatatatcttattatataatgtacggttttaaaagttactaactcaccaaattatgacacgtgacagttttatcaatttaagattttgacatgtgttagagtttttttttttacttttttccttaaataaaataaaggaaactaaaaaaaaaacatatttacaattattaatttatatagttaatttttaattttcttaactaaaatagaaaactaacaataagatataaattttaagatataaatttatttaaatatttattgataatatttaaaataatatggaaaactaacaataagatggaaaacatatatatatatatatatatatttcgaaacaaatgtaaaaaacagaaaaaggaagtaagtgtaatgtaactttttccgttttccattacaatttggggaatttttttatttttttttgggttaaaaataaggtttgccttggataacaagaaattgcttttgctttctatcagatattaactttgggtttccttcgatccgattagaaatctcgaga

SEQ ID NO: 12069 - DNA, 3000 bp, Unknown; identical to SEQ ID NO: 12062
  misc_feature (1)..( 3000): cDNA_ID_2708249_gDNA_ID_2214529_Annot_ID_184877 3000 nt of promoter + ATG

SEQ ID NO: 12070 - DNA, 3000 bp, Unknown
  misc_feature (1)..( 3000): cDNA_ID_3023793_gDNA_ID_2214529_Annot_ID_184876 3000 nt of promoter + ATG
gtaatatttccccctatttcaccttttgctccagcacaatggatcggacatccataaggtgactttgaagagctagcagctcggtgaagctgacaatatcttccttcccagtcattctcctggaatcatgaaagaaaactcatcaaccaaaatgaatatgcagaacaagaaagtgggaaacgcacgcaggcatacttgatcaaaagccgtaatctctcgacttctttccgcagctgcaaggagagaagttgaatgtaagcaaaaacacaggtataacatacaaagagatagatatatgagtacataagtaattacataccactgcttcattgtcttgctcctgcagcttatcttcagagctgcatccatatctggaaaaaggccaaggggtttaggtttaagtttattgtctgattcaatcatatcctcagattcagattcagattccgagatccaactaagccgagtaaatagctaatcaataaacctaataagcagattttgtgatggttcccatatcctaaattacttcaaagacctaaatcaacaatgaaaaccctagaaaatcgaacccttgtttgccatctgtgagccaagtacctgctgctggagaattcgcagaaattgcagggccctctcgtcttgttcgttagatctcttcgcttcctcttcatctgatcgccctctctccccatcgaatcggatcgaccgaaacccaatttttctttttttccactttggaaattgcgaggattgttgttacatgtatagacggagttttttgccaaaaaaaaaaaaaaagtacagacggagtttttttggtccaatattatggaaaatttcctaaagtaatttagggaaattgagttgtttgaccacaaaaagaaaaattatggacattgagtttgttacacattttgctagtagccgcataacatcaatagatgaaattgaattagataatcaaatcatagagcccaaaatgactaacaaccaaattagagtggaaaaaaaacagaaccgcaagaacccaaattctagacgaacctgagattttgactgtgtagtttctgggaaatttgatttgaatgcttttgggtccggattcacaggtgaaattcttaccatccactgcaacctcgtaatcacctggagaaatcgaatcaaaacacacgaagattcatttgattgatcggagttttctgaataaaatcaagggctttccgagttcttaccgatagagtacagagaagactgcatcggcgatgctctctttggcgccattgtaataattcagagcgggatttcaaataatttacttttcagaaaactggaaaaaaaaacgaaacgtcgagtgtataaataagtttatcagagggtattttcgtattaacataggtgtcttaaagctctgttctagccaaagcgctgcgttttggagcgtttctgatcgtctgactaatcatttgttcgaatgtcaaatcgacgacttgtggagtcaaaaaaacaaagcttcaagagtcaagacgagagttttcgcatcaaacgaaagaaaagtctcattttccccatttttgatggggaatttactaagtccggtttaaatttggacatgtcttcggtatctcaattccgagctcgaaatgaacttggtgtcgtcggcaatgtttgcaagttaaaacatgttcgacactcctgaccttttgcgtgtattagcattatgatgtaatcgacatccttttcttagccaccaaccttgtagagttctagtctttagagaactgatcattttcagtagctgagacgtgaaaaccttctatatttgagctctgcgatggctttcttttggtcgtaaagccaaagcaacattgatgcaactgcttccggtagccatcaccgatgcaggataagacttttggtaattgaatagaattgctcagacaaaggtaggaaataaactctagttctcatttctcttcaaagtttacatttttttttttttatgtttttacatttttgtgatagcaagtttgagaatgaacatcataaagatacaaagttacagatttttgttgtggaagcaaatactaaaaattacaaaggtacagtggtggctaaagatacacagaccgaactgctctgacttctctgactagttaacaacatatctcttcagcgaggctggtggatgtttctcggagcagcagcaaccctctggtttccccatttcgctggcttttccgcatacttagctggttccacaatcgatctcgggctcctgtttccacttgatttcttaaccatctcaccattctttccaaagcctgatgatatatataaacaacaattagcctccacaaatctactgatcttggatggttctatgtatcaggggaatgaaaccgacttaccaaattcggaaggtgcttggtaatacattcttccatcgaatccttgatcaaactcagcagcatcagtgtcaaagaaatcttccatatcatcaaaatcaaatgattctggaagaagatcagctacatcgatatgacctccaccattctcattctctccgttgtcatagaaaccatccgcgccttgctgctgctgactgatccagtaatcagggtaccaagtcgaagttgtcaccaattgccaccactccggtgagaaatcttccacttgtcgtacagctgccggaataaaaagaggtgcgtcggggtttagagtagatcgtcttcctgataccatcgccattctcaaaactctagatctgcacacacaaacaaacaagctcagttcaaattcaaattcaaatctaacaactcaatcacaacatagcttaatccttagatcaatagatctgtacgatcagtaaacatagcaacaataagtttccgattagatcacttgaagtaggacaagtacaagtttgaaatcgagagaactgaagataaatcaagttttaagatagatcaacaaccatcacagagatctaataccatg

SEQ ID NO: 12071 - DNA, 3000 bp, Unknown
  misc_feature (1)..( 3000): cDNA_ID_1031965_gDNA_ID_2214529_Annot_ID_184875 3000 nt of promoter + ATG
cgattacttttagaagtttcggtttttagatttgtaattttttcttagatctgcttaatttggtactgattattgtttttgtacgacggatctgaattttgtttgtgctgaaattgtatcaataggttatccaccggagggatatccaaaagatgcttatccaccacaaggatatcctcctcagggatatcctcagcaaggctatccacctcagggatatcctcaacaaggttatcctcagcaaggatatcctccaccgtacgcgcctcaatatcctccaccaccgcagcatcagcaacaacagagcagtcctggctttctagaaggatggttagtcaataaacacactccattatatttaatctgtttttactaattagattttgtgtatagtttgaatttgactatattccttattttaaatatttcttctagagattctttgaacaaaaggtcatgtggttttagctagaatattcctctgtagaggttgactttttgtgatctctgttcattcactgatcacaggacaattgttgttgtgtttaatgaatttgcatcttttaggatttaacatgtttgcatgatctagctactggttactacaacattgcatgctttaaagaaactagaattgtgattgtgttcttgtcgttattggtttggtagtgtttaactgtttatgagtacttgaaactatacttgtacaagttttgataagtaaattggcttagcaagatggatcctttttgtgttctctgttccttcactgaatacaggataattgttgttctttgatggctttacttaacagtgtgaatcggatgttgtttttgatgaatgtgcatcttttaggatttgattgtttgcatgatctagctactgcttactacattgcatgtcttaaagcaactggatttgtttttaatactgattgtgaaatgtaaacactgtttttgcttttgcagtcttgctgctctgtgttgttgctgtctcttggatgcttgcttctgattggagtctctctctctctgcataaagcttcgggatttatttgtaagagggttttggttaaacaaaaaccttaattgatttgtggggcattaaaaatgaatctctcgatgattctctttcgttttatgtgtaatgttcttcggttcataacattttaactattgtctatcgacgttctgccttagtttgtatttgattatgggaatgtaaattggttgggagacactattctatgccatagtttattgcttggatcttaaaatctttgtgttcataattcgtatggtcacatctcaatgatccagttttcgtccatctattattgattctttcaatagacaagtattaggtttgatattgaacgtcattgaaagaaataatttcgttctcttgggattttcacgaaatgtatggtcttctatccacatgggttggtttccattattgatgttaggtcatggttttaatctgggagaataatatgttaggtaatggttcttttgtcaataagaaggatttcgtacacttttattatcatggaataaactaatcacgaaatcatgcacagaaagaaaagtatatttcattaccaatattgcgtcaaaatcatgcgtctgctcattctattacaaatttacaactatagaagtatcaatggcagagatctatcaaaatcccaacaacataacatccaaaacagttaagactaaagaaacgtagaagcatcagtcgacccacaccgctttgtttcgtcgttgacataaagaatcaaaccactttggttcttttctgcgacaacaatcgccttctctttcttaaatgcatatgtcgtcgaaactgattgaacacaaggcttggtcttctcgacacactctactcgacttggcttcggataatagaaatccgttgggaaaaaattgaactgaagaagacccgacattgaattttgtagatcaaatcgaaactcatacaactttgtctttgtgaatgtgtatataaaaatgtttatgttcctttaggttcagagtgattttggacattgaagtttcttgggctctacgagttttgcttgaggaaaaagtctaggttggttagggtttgaaaggtctttaatctgcctttgacgctttgacattaaaactcatctagaaacaactagaagaataaagcaacgatgatttccaattacgatggtgttttggctctttggagcatgtcactggtttttacatctgtttggcaacgagggtaaacctaattacaaaaattgggcacaagtcacatcgcacccttcttgaggtttaacaatcgtgcgagagcgtcttgaggaaaaattgttgcaatggacggttactttgtttacaagtaatatacttaagatctgttttaatgttgttgcgacttgcgactgaatcatttgatgttgatagatccgaatcactaaattcatgatgttcacaagagagttgtttacttagaagcttgaagtaagaggtgctctgttgaccaactctaatatctagcttgcaaaatgccaaaatgttcaaactactctaaagaagttcaagatattaacgaaaatatctggaaatctcaaagagtgtgatcggaaaaaaagatgtgtaaatatattatcttaaaaactgtatcacctaacttaagcttctctatttcctatatatatatatgtagactacgctttggatgttacaacaactcacaaagataactaaatagcacatattcatatcctacaagacattcaaaccatgaaatcatcccatgcatatctcgtctgcatactgttgctctctctattttctctacatcaatgtatgtacaagttctcttatatataatatttaccaaatatctctttgttttagagtcatcaaagttgagttgggttgatgtgtgtttcaaattaatgtgtaggtgtgaggttagaaagatcgaacaaaatcgatatgtctgtatgcgtccatg

SEQ ID NO: 12072 - DNA, 2981 bp, Unknown; identical to SEQ ID NO: 12066
  misc_feature (1)..( 2981): cDNA_ID_1808920_gDNA_ID_2214529_Annot_ID_134245 3000 nt of promoter + ATG

SEQ ID NO: 12073 - DNA, 533 bp, Unknown; identical to SEQ ID NO: 12065
  misc_feature (1)..( 533): cDNA_ID_2708241_gDNA_ID_2214529_Annot_ID_134246 3000 nt of promoter + ATG

SEQ ID NO: 12074 - DNA, 3000 bp, Unknown
  misc_feature (1)..( 3000): cDNA_ID_2707132_gDNA_ID_2214530_Annot_ID_134247 3000 nt of promoter + ATG
ttcagttaataactctattcggttttaattcgtatttgaaatccatttttgccacaagttttcctgcatgatttccactcttttgcgatttcttcatcttacatttaagttgaacgaagaagagaactttagagtttacgttttcttttcaaagcaagagtggtttgatacaaatgcatcatttgtttgcagtatgactttccaaagcaagaggcggtaatacagtttgttgttgaggctattcaagcagaagcatttaatcccaagacccttttcttaattggaagctacaccatcggtaatatgttcactcttctttttccgtttcgatatatcatgttgagatctaaattcttccatctcttctcttttgaaaggaaaggagaggctgttcttggaagttgcacgtgtgctacgggaaaagatatacatcaatcctgcgaaactaaaactcctcgagtgtttgggattctcaaaggatgatatacagtggtttacagtgaaggaagaggaaagccacattcacgttgtgcctttgtggacgcttgccagtttcaaacggctgaagcatgtagctaaccgatacacagtaagaaacacatccattcggtttgactgtcaaagaaaaacaaaagaagtgataatcttattggctgatttcgttagaggttgagttctaatactgttttctgtcctgcagaaccgttacagccttatcgttgcattttctcctactggttggacatctggtaagactaaaaagaagtccccaggaagaaggttgcaacagggtacaataataaggtaaactttttgcctatcttcatgtcctgtggcattgggctcaaaatcatgaggcggagaatctttatatatatttcaggtacgaggttccttacagtgagcatagcagcttcacggagctaaaagagtttgtgcaaaaagtgtcacctgaagtcatcataccgagtgtaaacaatgatggacctgactctgcagctgcaatggtgtctttgttggttacgtagaactgtgtttacatctgcgataagctttgcaacaaaaaggcagcctccttgactaccaattgagcagagacgtcaaagatctacaacgaaaatggatatgttatgttctatctaattgtagttatgtaaccacatgattatgtagtgtttttcatcacaaactccgaatgcatttgttatatcaactactttggtctttacttatttccactgaagaaatgcaagttgcagactaaatccgtaataagagaccaagctcatggaattgttgagtttgctgcaattcaatgaggaatatagaaaacagatatgcagattcgcataaagtatctgttagaaaggacacttaaaattgataaatactctaatatcaatcttccagtaaacaaatacataaagtttgggtagtcgtagagattacaaacaacaagtatcaaaatttgttacaaaatcctagacaatcagatctttttatccaccatgcaaagtggaaatgaaaactacaacatctttatcttcgattactgtatcgagctgaccacttagctcccaatcacagtcattcaccagcacaagaaccccaggtctcctgcacaacagttattaaccttcattgagcttaataaagaagtcttaatgaaatcttaacctacaatgagctgataaagaagaaaaatagtcttacacagtatctcctttcatgaacatctcaggtctctctttgatcagatttgtacgaacccatgaaagcaaatgcttcatggtaaactaatccaggaatcagaaaagtggaatgagtgagagaaaaattgcgagctttatgatccaaaaacataagaactcaagcttacatcatcagagtcagctccattgggcaaatcaacgtttactttatgaatcttttcagaatcacagagcagctctaacccacccctacacatcacatgtcaagtttcactcttctcaatcattgaacaacaactaaaacacacacatggttcaagttcttaaatttcagtattacatacaatcaatcaggaaaataatctcaaaagacaccaagtcaaaatcagaactttagtgaggtaaaaactaaaaacgctacgaataacaaaactccgattacgaaaagattaagtgataatcgtacccgaattcaagagttaattgcatcgtcgttgatgtttgcaggaggaaccaaattcaaaacccagctcttctagggttcgttcgtgtggtgttgttgttcactgtaaaacgacatcgttcaggttgaagacatgttgggctatttaattgggcctaaaaatatactacaagataaggcctattacttttcccgatgaatcatcatcttatgttaaaaaattacttatcgcatcgtaaccgttgattacaggaactgtaacgtatcaacggacgatattgattcctagtttgtcactgaaaatagaaaatagatggtgcctgatatttttccagcgaccggcaaaattgcaaccaggaagagaaagaaaatcagagattgatttaacgtgaatggaattttgttgtttcccaatttcttctgagaaatagcaaagttcagttttgtttctctctatctgaagctcaatggaagcttataagcaatgggtttggagaaatagagagtatgtacaatcctttggatcctttgccaacgtaagattcatttttattactcttctccttaatttattttccagtttgattatgttctgattctctgtcgatttgggtttgttttcgtctcgtcgttagtgtcaatttctaagtttttcatcgtctgcttgtttgaatattttttgcttgaagggttgtgttttaaaatcgaagcttttatttattgggtttaagaatgaaaaccctttgaaaaaatttaagagttgaatcagttcgatcttttaattcgtagttgtggaattcatcagctgatagttcgtcaaatatg

SEQ ID NO: 12075 - DNA, 3000 bp, Unknown
  misc_feature (1)..( 3000): cDNA_ID_2708265_gDNA_ID_2214530_Annot_ID_134248 3000 nt of promoter + ATG
tctggacgatagaatccctctaaagaattagttgcagaactttgaatttcgaaattgaatcaaaaaacaaaagcagaagacactctctttcacaaagagaagttagctgtgtcagagtcgtttagtcagctttagatttgttccgacagagccgtaacgcacgatttttatcgtatcgcgagaattttcgaattcctccgatcgaacggctctagttccatcgaacattcgaacggttggtatacgattggaatttgaaatggctcggtgattagctgacgtggacgtatgagcctagtcgtctcgggagcgtcacgtgtgccaatcgataaaattgaccttacgtgttcgttgaattaacggaaatgccattggttcaagcatcatcggcttttgagggccataaaggggagaaagtgtcgaggggaccgaggcgcgtgaggctttgtgggccttcttaacgtgcacgaaacggcacgcacttgtcggcttttgtgattaattaattttatcatttagatcattaatgtaagggtttattgagctaatcatcctccaattttcataatcgttttaaggtaatattaacacgatgaaataattagcacctacatttatccttcagataaatccatccagtactcccaaaacccagtttcactatgattttcacatttcacaattatttagatcaaatgataagtaaatgactattgttttcctcctcctgttcatagataaattttgttagtttcatcaaacttttaattggacccaaaatatcaatggatcaaaacgcaacgtatttgactatttgtcatgttgtaatgatgggcctaaatttgaagcccaatataaaacgagaacttcctattctacgccaatacccttatccttgtttgttttcgtctctctggaagacagttctcgatccgaaattgaaattctggaatcgcaaaatttgcacgaatcctactaattggaagatctagaatctcggggtttgatccatcaggtttgcttctgcttcggcttctacacatctcagagagattatgatgtcttggtgctttctgttagagtttccgcttcttcttgatattcgtcgtcatcgtggaagctcgggtttcacataaaaaattctgctgtgtacattgttggagctagagatctcttctttggttttcttttgttgttatttaggattttatatgcattgactatgaacgcgcggttatgaaatcatcgaaacttttggatttgacttttgatggtttttcactactgcgagtggaaactccgaagatcgtctatggattgtcatgaatattcaagaaaatacataaccattcataaaagaggaacgagcttcgctgattaaaacaaaggataatcgacaaagaagggttactactagctcaaatatcaacaaaaattcataataaacgaaaagaaaatttgtgggtgagtgaatggaatggagtcatatcttcttcttcagtctcactttttcctgaaagagcatccttcagtgagctttgccttccctcctgtgggtgtgcagagcaaagtctggcagtttccacacatcacaacggtctgagagtggctgaacacagtcgtactgcaccaaatccaaacccatcatttcttagttatttcatatagatttataaccaaaaacatttacagattcagactttaaaaaaaaagcttacatgttaaagcagccttgacacttgacatcctacatcaaccacataacatacaaaagatgtaatcagaaaccaaatctaattgacaagaagattcaaagtgaataggcagctaaaaggtttgaactttcaagaaatgaaggaattaacaaagaatagttcttaccatgaaaaacgaattgggtgattgaacaagacgcttgagcttgtgcttcctcttctcgagctcagcaggagggttaagcagatcaatatcgttttgaaggacctgaaatttacacagatttttttaccagaatcagtcaattatctcacttgtggacttgtggtgaaggaatcaaatcaagaaatcctaattcaaaactcttaaaacctaatgattgccctaagaaaagacaaagcttgaaacctaatttgatatgttctttgtttttcgccacataaactatcagattcgacgatggaaaagaaattaaggcagtctctaatgttctaaacaagagaatcgaaacgagattaaagattgagaaatgagtactgaccattttcgttagcttcttagagattctgcaacgacaagacttggagatcgtatggaatcaaccgacaaatgatcttgggagatgtaaaaccctaattcgcacaacaatgccgacttataggttctggtccgaaagcccactgtcaatatttcttcttttcaactttgtcaacattaacgttttgggctgaaaaaaatattagatccggtccatcatagatttactctattgggctaaataatggaccaattttcttctcccacctaaaattttagtatttcacaatcccacattattaattttgaaaaacctttgtctaatttaaagcaagaaattaaaactaaaggaaaaaaatcaacacataaaaaatgtacaataaataatgatttttttttcgaaaaataattaatggtctgacttcgagtattggtgatgaaaaaactagtatattaatagtaagaaattttaaaaaaatattgtaaaacttgtgaccatttttgctcttatcctcttcacaatttattttccttttccctcttgtttattaaaatggtcacaagtttttgccgcaatttttttaaaaattaattttgctccatttaaaacaaatgataaaaatgcgacttatcctacttttgaaaccgaaacgtcgtcgtttctttctttcgctttcgtcgttttaacacttaacactcaaacgaacacggagcttctatcacttttgcctcgccggtatctaaatg

SEQ ID NO: 12076 - DNA, 3000 bp, Unknown
  misc_feature (1)..( 3000): cDNA_ID_2685948_gDNA_ID_2214530_Annot_ID_134249 3000 nt of promoter + ATG
aaaacttgagctttctttatgctacaaagtattgatggatgacgaacctgggggttacagtatgtagtatcaagaataagagagctgatatgcgatccaatcaaccaatttgacatctcttcactatagcggaaatcccccgtatgtagaacagcctatacaaatcaacagagtccatggacaattcctttgtgaatggaaagttaaacataggcttacgactacacactgaaagtttctaatttaagaacgcaccttaccgttggctggttcaaagagtatcatgatggatcccggacagtggtttgcatcaaagcatgtcacatcaatgcctgaaatattaaccttctggccaaggtccaggacttgcagtctctcccaaggtatcccaatcttcatatttaccaactttgcggtaactaaggaacagtatatcttcccatgactaaatgactttgtcaaaccttgataatctgtgaatgagaatacagagactttaagcattgattccacgatatgcaggcttcttctgtgtagtaatttataattagacatacagctgactacttacgatcgagatgaaagtgtgtaagaaaccagtggcaacaatcgcgtgtgaggtacttgaatgcgtcctgcatacatatattaaaccagaaaagtcaccaaacataaagattacttaaaagataaatattcagcatcagcatgacgttttaaatctaatttcatgagcatatttgacttgaatgagaaggatgcatatgtaataaggttgttgcattcatgcggagaagttaaaccatgacctagcttgttatgtaacattaccactcgaaaaggtgtccccggaatgcaattccaatgtggaataactttagattttccgttgttgccatttcttctcacagcacgtctagagctagaatctgatggactcttttctgcgacaggtttaggggctgtccggatcttagtgccctcggtagcctgaccagggaaaaactctgtaatcaacttgtttgcagttggttttttgggctcacttgccttacgagtggttgacttatctctctgtctctctgtaacatggccacttgtacaatgagactgtgcctgcacttcagcagaagatgcaaagggatctctaactccgctaagtgcattcacaatcttctttctgggaccaagtgacgtgatacctatgcttagaagatcctgtggaagtataaccttgtcaatactcaattctgtttctctgtgtaaataaataaataagtaaactttagttccattacctcctcagtgagtgactgaagggtatcccagtcgatctcttcacgaataaaaacatcttcatatttagctaaacctagactcctaagccatttcagcactggagacaagtcggtaactagctgaggaagctgaactggatcatcaatcgattcttttataagagaagacaaattttcgcatttcctcaaggagtcctacaataatcatatttacaaatcagcagtcaatcaatggcgtaacgatgtaacaattgaacacagtatacttcattgtattaacctaaattgaaggttgatatcaattccagttatgagataacaaagaagcttacttgctcagaaggctgattatatgacttatcaagacaagtattgctatgaacttgcctctgctcttcactcaaagatgaaatatccatggaacacaatgggcattgaattgaatcatccttgcctaaactaaactctccactcctaccctcagactcagagcaaaggtttatcaacacatcaagctcagagttagactcaacaaaaccttcatcatcctcatggattccactatcaaacccgagacaaattctcgatttcaataacctagcctccatcgaattacacaaataaccttcacgattcacctttatacagtcgtccttatcctctttatcttcttcaccaagagaagaaattggaccattgaaatctcctagagagcaatcaacactagatgggatacaatctaagatacagtgaggagtagaagaggagcagaagagatccggatccggagaaggaggcggagtcacattttctttacccgggtaacggcagagtctgggctttttgttaggagggcggtgagagatgttgttagcgttggttgggtgaagaggttttcgaatcgaaagctgtgaggaaggagggatctggaagtcgtcgtcgtcatcttcgacggtgttcgacatttagataccggcgaggcaaaagtgatagaagctccgtgttcgtttgagtgttaagtgttaaaacgacgaaagcgaaagaaagaaacgacgacgtttcggtttcaaaagtaggataagtcgcatttttatcatttgttttaaatggagcaaaattaatttttaaaaaaattgcggcaaaaacttgtgaccattttaataaacaagagggaaaaggaaaataaattgtgaagaggataagagcaaaaatggtcacaagttttacaatatttttttaaaatttcttactattaatatactagttttttcatcaccaatactcgaagtcagaccattaattatttttcgaaaaaaaaatcattatttattgtacattttttatgtgttgatttttttcctttagttttaatttcttgctttaaattagacaaaggtttttcaaaattaataatgtgggattgtgaaatactaaaattttaggtgggagaagaaaattggtccattatttagcccaatagagtaaatctatgatggaccggatctaatatttttttcagcccaaaacgttaatgttgacaaagttgaaaagaagaaatattgacagtgggctttcggaccagaacctataagtcggcattgttgtgcgaattagggttttacatctcccaagatcatttgtcggttgattccatacgatctccaagtcttgtcgttgcagaatctctaagaagctaacgaaa

SEQ ID NO: 12077 - DNA, 3000 bp, Unknown
  misc_feature (1)..( 3000): cDNA_ID_2708272_gDNA_ID_2214530_Annot_ID_134253 3000 nt of promoter + ATG
gatcactctctctctctatctctgttcacacatctctcccaaaggtatttcgaatcgaaattcttttgatttctttctatgatttgtttacattttttcgtggtgttcttgatttttttctttgatcaaaactagtagaaattttccaatttcgtcctgccttgtgattagtagtagatattttggaatttgattagtaggtagaagaagatggggacgacgttagatgtatcaagagcagagctagcacttgtggtaatgtatttgaacaaagcagaggcaagagataagttatgcagagctatacagtatggttccaagttcttgagtggtggacaacctggtactgctcaaaatgttgacaaatctactagcttagcaagaaaagtcttccgtcttttcaaggttaatccttttgattttgattagagtgtgtttttacctctttgtttaattaactaaatattatcattgttgcagtttgtgaatgacttgcatggtcttatcagtcctgtgcctaaaggaactcctcttcctcttgttttacttggaaaggtaggtgctttagagatcaaagctcagagttcgtttcggttttatatctttgttctgtatcaatctttgttgttattttcagtcgaagaacgcacttttatctacattcttgttcctggatcaaattgtctggcttgggagatcaggaatatataaggtgagagagagagagatcatcaagtttatgttccactggtgtattctagttttgtgtgtttggctaatgtcttatatgtgttatctcaacacagaacaaagaacgagctgagttacttggacgtatatctctcttctgctggatgggatcttctgtctgcacaactttagtcgaggtccgcctcttctttcacttttccgatcgattcctcatgtcatcttggcctttttcgccagcttatgtatcggttttcactgttatcaggttggtgagatgggaaggctttcttcatcaatgaagaagatcgaaaagggactcaagaatggaaacaagtatcaggtaaagttttcttctttgttaagaaacttctaattctacaaaatcttattataagagactcaattcaaattgtataaaaatgtaggatgaggattatcgtgctaagctaaaaaaatcaaacgagaggtcacttgctttgatcaaatcagctatggacattgttgtagcagctggtcttcttcagttagctccaacgaagatcactcctcgtgtcaccggagcttttggattcatcacctccatcatttcttgttaccaggtaacacttgtttcatccacaagacctcactttccaatttcgtaactttcttcttctgaattctgatatttacatgattctcattgttctccacaaacacagttgcttccgacacgccccaagatcaaaacaccctgaagtcaatcgaggaagctggtgttaaggagaaagtcatttcagaaagtttctgttcttcttattattaaggaaattcactgctgttataaaacatcgtataaaatacttatttgcaggaattacggttattataaatttatgcctcagattcttgatacacaagtttcaatactcaatagtattgcattattatgagatgttgtttctgctacgcaataactagaggcaaaatccaactacatatatgttttgatctgattattataatagactttgggcttcattccgcctaaagctacaacttggagtctgaagagcatccatgcatcgtggaacgctcattttacactgaatgctattttttattaaatatgaaaatcctcgatatttttctataaaaaaatatcttgaaagttgttgataggcccatgcatggatacgaagattttgggaatttaattccgaaatgtaagatttggtttgatttttttgttacatttgttcaaattagttttagattaaactctaaatttaaatcataagaaatcatcaattttacctggataatcttaacaacttatcattaagatctgttataattattaatttgtaaacttgagttaagttcgataaaatcacttcggttccattcgtttcaaatgtttccagtccaatgtcatgggtattgtttaggttaggtgtaactgtgtaaggtacaaaatgttgtttggatcaattaacgcaaaccaaactctcactgccttttacgattccaatggcaatatacattgcttctttgggatttcttcacaatcccgcaaggtttaaacttcctctgtccagtgtccccccaaaaaagtgcatattacattcccataactggcgtatatacagagcaacagagaatatcagttaaaaacggtgtgagcaaaaagtgcttcggttaagtattaaaattggttcgaaccggtgaaaagtgcaattgggattgcgtctctttgcatccaaaggacccaaacggacccctcatcacctatgtatcaaccttcactcgcttcaccggagcgtgcactttcacaaacgcggattctcaaatcaattttacttctttttaaaataatgttaaaagaataaaagatatatttctcataatacaatgcatgaatatactacaaaatccttaattttcctaattttctaaaagataaaatctaataattcgctgaaaatggaaaagaataatattttgaacaaaataatttccccattgttgcctatgactagctcgcacgttttaagcctaatctctcacgaatacataaaaataaaattaaaactcattgaccctttgaccttaaagcgcgtacctaacactcgcttctattttctctcttccctttatattacaccatcgaaccacttcatatcaacccttgaaaacttcactcgtcacacattcgattctttcatcgttgtgtctattataaatatatgtcaatttggtttctaaaaaattctaccattgattgattgatttttttttctttaagag

SEQ ID NO: 12078 - DNA, 3000 bp, Unknown
  misc_feature (1)..( 3000): cDNA_ID_2708280_gDNA_ID_2214530_Annot_ID_134255 3000 nt of promoter + ATG
gtgcggcgtgactacatagatgcgtgttattaatttgatttgatgacgacatcactacataattaacttatttgcttaatttccttaaagtcagaattattaatggtttgttttaaaagattattcagtagcattttccaaagaatagacgcctctccactacaaaagacatcttcatattcgctttgttcaaatactttttgttttccgaaaaagaaagaaagaagagaaaggctctcaggccttagaaatttcacggatgtctttttttgttatacaaagttttgtcaacaagtgcaatttgttataatacgcatgcattcacgaaattagaaccttagtttgaacagaattatgaaagtagtaacttgaagaatacaattgtgtacgtaatgttttgggaaaagtcaatggagtcgttgatacggcacgtgtcgaacacaagcgattaagttgacttgtttctgaaggaaactgtggcgacaattcgaacgaagtttcaggtattttttgcatcattcttgccaaacgtcgacgggacgcgttttttttttgtctgcaccaaaataatcgacttttaaaacctgtgatccatagccagttaataatttcaataacaattttatcacaaaatgtaacagactatatataaattaatcgtatatcttcacttttgagactaatgtaacaaacgtgctcttatcatatagtgattgaaacatttaaggagcaattaaaccccctcgttaacacgaaaagctgtgatggccattggcattgcacgaagaacaacttaccgtcccagaacacactagagccgctgccgcgctttctcacatttgcgtatatatataattttgatcaattattttgacgtaacagttaattacattaatacaaattggtattgtagtcgtagttacgtgatttatcccaattcaaagtggatgtaggtaatagctgggaaaggtaaaaactgaaaaatcttggccaacaaacacatgcatgcatggctatacattgtaaattacatatgtcagcagcatcgtgtcgtgagctaagctaaatagctgtggaaatgttcatatatttaacaatagtttaaaactgcaacgatgtggtcgctcactctataatgtatttttgcgagatattattatatgtatattatcatatgacccaagatgaccgatgggcttagcttgcagtactgatgaataaatcattacagactgtttctggaaatttgttgtttgttgcccagttatttcatggcacatggattaggcactcatatcaactatgtagtactttttctacaatgttgtcgtgttgacttgataaaagtatacagtcaatctaggtcaatatctactagttctttcttataccgtttttggtggatagcgggaatggaattgctaattctaacttacaaggtatggtttacgaatattgtaagtgtttttttttagaatgccaattcagatattcaaaaaacggagaacatgtactagtcattaaatatagagtaatagagttaaaaatctataaattttgaccgaatacatataaaaatataaaaaattagaataatcaccaagtatttctcggtgcttattaatataagaagatagaatttaaaaatggctaccaaaaacaaaaataataaaaatatttattaaaataagcaaattgttaattagataattcaacagatttgaaatttataatcggccacttgttttttcttttataattagagactctcaaaccaaaatctaaagtaatttacacgatatgtatatataaagtcaggtctaaaccactgaatttagagatccgatccgttgatgggaaaactcaacccacattatcaattctgtggaaaaaagattgtgatttatttatattttttgtgtggaacacatgtatgtactataactgtgtagtacatgcatatgtaatttcaagtactcgttaaagaaaacagaccagcaaattgtcttagtaacatttttccacataccatctaatcgttcatgacatcgttttgcttatgtcacgtttatgacgcttgtatgaatgtgttcggctgttggtgtaccaaatatacgacaaatgcgaaacataagagaaaaagataagttaaacgttatacctaaggaaacaaatttggagtcttcacttttggtcgtcctcagcaaacaaatttggtgtatataataatcaaaataggcgaagtcctataaattgtttgccaacaaaatataaattgtcaaactagtattcgccacaaatgcacttttgagttaaaattgaatcacgtgtgaagaagttgttggactttgtttacatcctttggatcaagtcttaaagtcgttctatggacatttgagaaatctacgggaaatagaggcaaaagaaaaagaaatcaaatatagtagtaggttttaaaacatacatactttgtaccaaagcttaatggcgccatcaatgaatgaaatagttgatgtgattgtagctgaatgattgctagttacttgttgtgctcgtttgaggataaatcttatgatttcaaatttccaatatctttgaaaatcgttcaaagtaagatataaacatacctttgaaagagaaattagtatataaacaaataaaactaattatagttttcaaaatgataactgtagatgattaactattttctctcactaatttactaacatatccttgataaaacttgtaatctagatagatagaatataaaaagacgtaatctattatatacaaaacaaatttgtatttgaggattttttttatttataattataattaatagttttcaaaaaattaagcattaacgctgcgtttttcattattcatttttttgcagattggttcattattgggaaacaatagaaacgtaaaacgcagcgtataaaaaagattattatccagtaagtcagtaacttacacagattctctagcacaactgcc

SEQ ID NO: 12079 - DNA, 3000 bp, Unknown
  misc_feature (1)..( 3000): cDNA_ID_3434945_gDNA_ID_2214530_Annot_ID_134257 3000 nt of promoter + ATG
cttatcctattctgttatcttgcttatattattacactctgttagtctccaatttcgatcatgcgttagctaaaaataatattttacggaattgttaggagatcctacttgtccttgatggaaacactggtttgaacatgcttccacaagctagagaattcaacgaggtaccatacgaaactacctaaacctagtgattctggctccccaaactagaatttcttcgtaaaatcttgaggtttctgggttacatttttttcaggttgttggtatcaccggtttgatattgacgaaactagatggctctgctagaggaggctgtgtggtaaatatctcataaaatttttgatctcattcaaagctcttatttttcattagctctgtcattgaaactggttctccatgtcttgcaggtcagtgtggttgaggaattgggcattcccgtaaagtttatcggtgtaggagaagctgtagaagatctccaaccttttgatccggaggcttttgtgaatgctatattctcttaagccataaaacctcgtcttcttcaaaaagctatcatcttcaacgcaggccagagccaagtggaaaattcacagtgaattcgccggagatgcaaatggaagcattccttattttcttggagatcttaggttgacaagctttttctgcaatggatgcaagtttcgatttttaatgatgtgacaaagctcgtttgcacactgatagtgatcacacaagaatgtaacgagtcataggaactgcttgtgtctcgtctcactactattttgtatattgttaatgttgtatttgaaaggaattacaaagattgataaaagaacaatgaggggaggaaaaccgtaaaaaagaaagaaaaaaaaatgaaacttttttaaaaaatattcataacttgtatataatccacaaaacgatgcaaaggtcaaatgacatgatccataattcgattagttttcatatcattttgtaaaaattaatattcaaatttaaaaataaaaactgtaaaaatgaaagaataaaaaacaaaaatttaaaacttttgaaaatatattaatatgaaacttgtatattaattctacaaaacattgtgaaaacaagttgaattagtggtatcggcatacgacttcaaatgacaagatccaaaatccggttaatttttattttattttgtaaatctaatatccaaattaaaagttaaaaaccataaaaaagaaaaaaaaacaaaaattttaaaatttttcgaaaatgttaataatttgtatattagatctacaaaacgatgcgaaaacaagttaaattagtggaatcggctaacgatcaaaaactgtaagaaagaaaagaacaaaaataaaatttataaaaaacctcttagaaaaatattaataacatgtatattaaatctataaaacgatgtgaaaaacaagttgaattagtggaatcggctaacgatcaaatgactaggtcaaatgacaggatccaaaatccggttagtttccatatcattttgtaaatttaatatccaaattaaaatttgaaaaccgtaagaaagaaaagaacaaaaatcacctttaaaaaaaatatattaataacttgtatattaaatctactaaacgatgcgaaaacaagttgaatttgtggaatcggctaacgatcaaatgattaggtcaaatgacaggattcaaaatccggtcagctttcatatcattttataaatttaatatccaaattaaatttgaaaacccttagatgggaaaaaatcaaaattttaaaaccttataaaaaaatattcataacttctatctcagtttgtaaatctaagtaatttaagggctaaaaagaaaatagggctaagaattgacttttatggcgggctgaaattgatattgttgggctttgaagaattgcaccttagtcctgagcccaaacgacaccatctctaatcttacggcaaagcagtcctccaccagaccaccaccgttatcggaaacgaattccccagtctctccgtcgcgatctccgtcgctgattgtcacgaattacgattcacgaagccgaatatttttattgaaataaccattagaacttagaaccgccaaaacagatcctagagcgagtatcttcaccgccatagcgttcatgcaagtcttcgtcaccggatcttcactagcgccgacgatataattagaaaaaaccataaccgtttctctgaaccgctgatcgattaggttatatacaaagaagacttttgaagatcctcaacgtaaagaggattcgattctagggtttttttcttctccttagtgcgagattttcttatctcttaatgatgaagtaagtccgtatttatagattggtgtgagttaattaatttcctttttttataaaacaaaatattaccgttacattacatattctccggtttaccgttgcatacaaccgtttaatataaacgttgcatacaaccgtttaatataaacgttgctgtgtgaagtgcacgctcttgttcctcttatcatttgtgtgaaaatacatcaaatatcaccttgtttttttgtcaagtgctctcgtttgaatttttttttggttataaagtcatatttcccaatttgcataatgatatacaaatataaaccggatggcccaaaaaggcgaaaaccattagtagtactggcccaaattgcttcttcataaaattaattgttttcggcctcaatactatttcatgttttttgggtcaacaacgtccaagtaccctttatataacataaataaggattgttagaaaagaataattttgatgtgtcacgattattttatcaaccaatcactgatctctaggagaaaaagtgaggacccatagtttaagcgacactctttggttaaagaataaagattagatcggtccaatttatatatttacatgttccgccattatcatcttctaatttgaaaactcttcatcattccctaccaccggattca

SEQ ID NO: 12080 - DNA, 3000 bp, Unknown; identical to SEQ ID NO: 12075
  misc_feature (1)..( 3000): cDNA_ID_3023874_gDNA_ID_2214530_Annot_ID_184891 3000 nt of promoter + ATG

SEQ ID NO: 12081 - DNA, 3000 bp, Unknown
  misc_feature (1)..( 3000): cDNA_ID_1808010_gDNA_ID_2214530_Annot_ID_134258 3000 nt of promoter + ATG
aaaatcggcttcccttaacataccctatgtagatacgactcagaagtcctaggaaaatcgaaatttatcaccacattcacagcttgaatgtcaatcccacgtgtaaacaaatctgcaacagacagacattccccgtgaaacataaacacatttgtcaatgttcaagcacatgaaatacacaaaacgtaccagtgcaaacaagatttctgcatgcaccattgcggaaatcatggaaaaccctgttccgatggtcttgaaccatctttgcatggatatagaagcatgagtaaccaagttctgtaattttcttggccaacagctcaacacgattaacagagttgcaaaagataatggattggtttatttggagctgcaatagataaaacaatatttcctttaaaagatacatcaagtagccagaaaataaaacattggggttttaagactgtaacaaaactctgaccttagagaatagcgtgttaaggcagtgcaccttctgtctctcttcaacaaaagcataatattgggtaacacccataagtgtgagctgatccatgagattgataatgtaaggcttcttgagataccgatccttgaaagacttcacagtgacaggaaatgtagctgaaaacatcaaaatctgccggctctctggcaagaactgtatcaactcctctatagaaggttgaaattctacagacaaaagcttgtcggcctgaaaaaagatgtttgcgagttaagaccatgagctcatgaggaaaagaaaattattcaatcaaaatctgcaaatatgaagcataagaggaatcgattttgttttaactttagagaaagttatgttcagggaaaaactagaaatgtccttttgggcaaaaatccaacaatgtttgttaataagaaaaatctagctcaggggtaatagaattaggaactcacctcatccattacaagcatggcacaatctttcaaaacacacacaccctttttggcaagatctaatattcttccaggagttccaaccagtaaatggacaggttgatacaatcgcatgatatcatccctcagactggtaccgccagtggtgaccataacctcaattttcaaatatttggaaagctccttgcaaacctgggatgtctgaagggcgagctctcgggttggaactagaattacggctgcataagaaaaaagatcaacaaaagtactgaaaactcagtaagaaagtagggtttcactggaagttccactgatcaactaactcactacagagaaaggtaggagatcttttaacagagaaaagttctaaaaggaaagtaaaaaaccttgaatgacattgttctctggatcaattttctcaagggtaggaatgcagaaggcaccagtcttcccagtaccatttttggctctagcaagaatatcactaccagtcaaagcaatgggaatgctttcttcctgaataggagatggtttttcaaaacccttctcatatattcccctaagcagatccctcttcaaaaagtaatcttcaaattcatttcctttagtggcagtcacatcctgaagacaagatatggaaaaactaagttctaagggaactgctgtcttgtcaaaacaaaaatcatataactatgcaatcattcatacctctgtctggtaacgattatctcgtggtggcagctttaaggttgctttccagtcttcattactgataagcataagaaaacacataacccgttaaacatcacaacaagagcaccattcataataaccattcttccaaacgagcacttacttagaatcgctaatagcttcagattgaaccgttttttcgacctcatctatgtaacttggatcaccaggaagctgagcccgtcgagaccattgttgttcttgctgctgctgttgttgttgttgttgctgctgcagttgctgttgctgttgaatctgctggggataacctcgctgaacgtactgctgagcatcagattgagactggagatactgaggaggctgaggctgaggttgctgtggaaacggagtccgtgactgaaggtactgttgaggctgaggtggattcggattccgtgactgaaaattaggatccggaccaggacccgccgcaccaatccccggtggaaatcttcctctattattattattattattcatctcgatctcgaaacagagaactctaattctaccaagaaatcttcacaagctcacaaatcgtaaatctaagaagaggctataaacaacaatctggagaatgttaggtcacacgtagcttcgtaagagatgattgattgattgattgattggactctctctctcgggggagggcaagatcggaatatgctaacaattatccacaaaaccgtttccgccagaaactaatcgagcttagctaagatgaataattttcttttgtcgtctggttggttagtgagaaagtgaaagatacatacactcgccggagtcgttgttgttgtttaggtcgtcaagtggattttcattacacggacaggctcttcttcagtttcactcactcttatccacatttatttcactaaattagccttgtacgttcgtataattatgaaataacccccacatttctttgtatttatcattattctctcgtaatttttaaaaatagatcttcggatcttccgcaaacagagcgtacggctgaaaacgtcgatacccttcattgtgctcggagtctaaaattgtaaaattgaaattagaattttgatgatcgacaatgattgaatggcttctcctctttcgaatctctaccactagaaccaaaattaccacaaattctcatttcttcaagaatttttgataaataagacagagaacttgagagatgaaaagaaaaaaacacaaaacctggtgttttttctctcgtcgtcgtttggtcgtgtcctaagacaagaaccggcgaacgaagaacaaactttttgaatctaacatccgaaagaaagagagaaaatg

SEQ ID NO: 12082 - DNA, 3000 bp, Unknown
  misc_feature (1)..( 3000): cDNA_ID_2708284_gDNA_ID_2214530_Annot_ID_134259 3000 nt of promoter + ATG
gatagtttctgatagcgtaaattgatgatgcaggagttgataaatttcacgctgcactacattgcagacctggatattccaattaagaggtataacgtggatccaactgctagtctctaatcatgtttgcaaagtgataagatgatttattttcttgaaatttgtatacataggggaacatttattgaattccgaaatggaatgctcaatgtatcacccattggtcgcaactgcagccaagaagaaagagatgaatttgagagatatgataaggtagaagaaactatatttagtttgttcaatttcttatagaatatattttgagcattgtcattcaacactttttttaaaaggttcaaaacatccgaccaaagatggtagctgaacttcgtgagcggtttgcacatcttaaccttactttctcaattgggggacagataagcttcgatgtgagtagaatcaaaatgtggattataacaatttcttaaatccattttttgagtcactgagtctaatcaaattgttatgacttaggtcttccctaaaggttgggataagacttactgcttgcaatacctcgaggacttcagtgaaatccatttcttcggtgacaagacctatgaggtataagactcatctcaactctgcaaatctattcattagagttgttgtatggtttccgttgagcttgatgggtaaaaatatggcttttacttctgcagggtggaaatgactatgaaatctatgaatcaccaaaaacaattggccattcaggtcagctacttggatatattatcgtttaatctctgtatgtttgtgttgcgagatattttcatgacaaataggattgtttctgttgttgcagttacgagtccagatgacacagtggcaaaatgcaaggctctgttcatgtcttgaaacactactcatctcaagaacacagtgtcaagagtttgattcttctttggcgaaatctcacaactcttgattacaagaaatggagagaagtgtgtttgaatgctatctataccgtatgttttgaattttgattcatcaaataaaatatcttgttataaccttttgtttcagaacatggtcctcaaagttttaaaactaaaggttaaaaatatcctcttcaaaaaaaattggatgttaaagattttgtttacaacagattctctccaaaaagagctttaaaactttacaagaatttacaagaagaaacaacaacaatttgtatttatatattcattaaacagaaacgcatataaaaacttcaaacttgagaactgataagatcattcctccacgacattttcaagactcaacgaccggctcaggctcctcttctcctgcagcttcaggggcagcgtcatcttcttttgcttcgggaattgaggcggtgtcgtcaggtttgtgatcatcagaaggaggagaagcgccaccagaagaggcggatcgacggtggttagcagcggcttgatggacgtgattgtaactgcctttctcgagaaagagctgattgaagtggactttacagtagaggacgccattaagagaagcgtaagaagagtgagtcaaaggacaaccactgtgtgtgcacctgaagcaagtcttgtggtaactttctccttccattgttactttctcaagtgggtaaaccgtcttcttacaagtcgcacatttgtcttgtgttccactgaagaatgatgataacttgcttggagttcgagtcttgcagtatccatcaattgagacaaatcagatgaaaaaaaagaggaaataaaaacaagatgatgaatctttgaagacattaccagatgatcattgggcttctcggtctttcctgcctgaaaattcttgctgtaattgccagattctttgaaaagctgttcgaagtgtggcttacagtaaagaactccatccattgatgagtaattgcttatctgtgttaagaaaagatgtggtcttttaaaacaatgaagcattgtcgaaaaacagagtaacaatggaggaagaagaagaaaagagaaataccacgagagtgcctttgcaatgggtgcatctgaaacatgatttgtgataagtattaccctctaatgttaacaaatccatcacgtacacggttttgtcacaggccttgcatttatccaatgttcctgtaaacgacattttctctctttctttcggatgttagattcaaaaagtttgttcttcgttcgccggttcttgtcttaggacacgaccaaacgacgacgagagaaaaaacaccaggttttgtgtttttttcttttcatctctcaagttctctgtcttatttatcaaaaattcttgaagaaatgagaatttgtggtaattttggttctagtggtagagattcgaaagaggagaagccattcaatcattgtcgatcatcaaaattctaatttcaattttacaattttagactccgagcacaatgaagggtatcgacgttttcagccgtacgctctgtttgcggaagatccgaagatctatttttaaaaattacgagagaataatgataaatacaaagaaatgtgggggttatttcataattatacgaacgtacaaggctaatttagtgaaataaatgtggataagagtgagtgaaactgaagaagagcctgtccgtgtaatgaaaatccacttgacgacctaaacaacaacaacgactccggcgagtgtatgtatctttcactttctcactaaccaaccagacgacaaaagaaaattattcatcttagctaagctcgattagtttctggcggaaacggttttgtggataattgttagcatattccgatcttgccctcccccgagagagagagtccaatcaatcaatcaatcaatcatctcttacgaagctacgtgtgacctaacattctccagattgttgtttatagcctcttcttagatttacgatttgtgagcttgtgaagatttcttggtagaattagagttctctgtttcgagatcgag

SEQ ID NO: 12083 - DNA, 3000 bp, Unknown
  misc_feature (1)..( 3000): cDNA_ID_2711463_gDNA_ID_2214530_Annot_ID_134261 3000 nt of promoter + ATG
ctcgatcttcctaagttgagcttctacggctgctttcttgctattttcccaagcatgcacatcagagatcttcttttgtgccctgtccatttcaagatcatcagagatctgtaagcaatagtaatctttgggtgagaagatgatgaaagtttacctgttctcagcctttgacttctcactctcttcccatgctttgatgaatgacgttttcttctctttttccaagtcggcaagtatcacatctgaccaaacacacacaacacacatttgaagtaaattactgaactaagtaactaagaaactggacatgagaaacaaagtgttgttatcagctgacctctatcggccgaaccagatgaagctttcttaggtgtatgctcctcgatgggttctgcaagaagcacacttataagtataacacatggatatttgttgcaagaagctcacttttaactaagttaaattttgttgctctaattggctaataaggtcatcaaaatagtagtttataaaacgaaactccacacagaaggaattacagatagtaaataaagatgaacaaatgaatgttcaaggattataaaaactgctggaaagttagtacttaattgttattttccaagagttaagcaactttaaaggaaggaaaaaatgtaggaatattaagaaagtaacccactttccttaattcatagctgtccacaactaatttgtcatgattccatacactttttgataacactaattacagggaacattgctttactattaatcatattttaataatatcatcctcgaaaaacataattctcttgaaaatgccatgatgaagttgtaaattctaacagcgatggatttcacctaaacaaatagagtatagaccaagtcatatgcaaaagaactcacaaaaaccttaggcatcttaagaaaatccatttgttaattgtaaattgaaaccttagttccaaacgtaagaattctgaattacatactataataattcatcgtaaacatgaatgaatcctcctaagtagaagattaacatatataaaacacacacgtatgtaaatagaaagcttactttctacaacggcaagagctttggactcgacgggaggtggattatgaattttctcatccgcgacttccaccggagcaggagtcggttccttcgccggagctaaaacagccggagattctacgtcaaccttactcgtcttttgctcctccgccattgtctctcagccgaagaagaagaacagattttatgttttttccgtgaaaatggataaaattgagattttaggacaataatgagttaaagagtttttatatcctccgttagcttataccggtggagcgtactacgcgcgtttaataagtgtgagactcttgttttgcttcgccgttgatttttgtacccatgtgatcgtgcggctgtaaagctctcatacgcattggatgcgttacacgtgattaaacacacctcactgccgacaagtaaagtggttcaatgatgccacgtcacctctgtagaaaatttgtcctccccttcttttttcctgatattcaacaaaacttaattcttccaattataccgaactaaaattttgtttaccatataaattggtttaaaattgaaaatcagattttagctgggatttttttattatgagaaaaacaacaatcaaactacaatcaagaaaataaatgatctatattattgctaatcttggcttaactaaaaagttcgtattaaaaaactgaatctaaatttggagtgagctcgtatgcctatagaattgacagagtgtcgggtgtgtattaaatctataataaaatatcaatcactcgaattcatttaaacaattattttagttttaaaatttaagtggatcaaagggtgacgtggagcctcactgactcgacacgctggaagacagatacaaaaaggataatgtctgtgtctcgcgcgtgtacaaaactttccggttatgtggcgcgtggtatatgcaatttaaactggtttaagcatgtggtatatggactatgagatggagacatctctttttgtaggtgttgggcttttgtgaatcctaatggcccaacgggtttttaaatttcctgcccaacttgttttaatttaaagaaaggtgtaattttttttctaacaaagcaataaagtaaattaattaaggctaatcactaatcacagactcacagtttcgaacagcctgtgaaagatgtattaatgtatttgtataataataaaaagtactctacaacatggaattatttacgattaattatctgtcttgtatgatgatgagtggtcgaatatggactatgatgtcactgacctttatttaatgggttaaggtttatcttctttcttctttcttcgaagttcggattcttttattcagtttaaagcacttataacaaactttcccaaagaggactttaattaattgaactcttgcagttttatttttgtagtaagcagattatttttctaagaacatcaaaggtcttgtatttagttatttaccaataaatacaacgttaataagagacgattatttgggaaacatttgtgtatcacatatcaatgtccatatgtgatttgagcataggaataccaaatatggatgaccaaatgtctcctactaattaataaaatattatctatttaatatttaaaaacattttaactcttcgaaaaactaaaaagtaaacaagattcacacaaaaatatgaacgtcattaacacaaaagatgtgaactctggttagtgttgaagataacgtgaaacaagattcaaatcctcgtggaagagcaccaatcgatcaccagaatcaaacctttgagcttcctcctagcttcggtaacgtttaatctcacctgattctcgtttttcttctcttcctgttgaatgtttgtgaacatagatatatataaagctgagatagatatagattcatgcttcaacggaaaagc

SEQ ID NO: 12084 - DNA, 3000 bp, Unknown
  misc_feature (1)..( 3000): cDNA_ID_2711459_gDNA_ID_2214530_Annot_ID_134262 3000 nt of promoter + ATG
aacatagatatatataaagctgagatagatatagattcatgcttcaacggaaaagcatgaagaggaacaacaacaatcttctaacgaacaagaataagtatgtctatcttaaaacggcgtcgcatccagcaaaaagcatcgctaaagctactctgttcctcgtcacctctctcttcatatctgctggtctcttagacttattgggttgtttcgatttcgtgagttcgaatctgaagtaacttcttttttagaaactttttattcaatcaagtgaatcttgaacttgaagagttaataaattcatatctctctgtacttcagacaacttttacaggtctgaagcaggtaacaactagtatcagaaaatcaccaatcacaagccaaagattccctaaccaatgcggcgtcgttcagaaccaaactcaattatttccccaaaatggctcctcgagaaacaacgacaaacccagaagcagccattcaagaatatccacgtgtccttcttacttccgttggatccacgaagatctacggccatggaaagagacaggtgtaacgagagggatgcttgagaaagccaggaggacggcgcatttcagagtagtaatcctcgacgggagagtgtacgttaagaaatatagaaagtcaatccaaacaagagacgtttttactctgtggggcatcgtacagttactacggtggtacccaggtaggttaccggatcttgagctcatgtttgacccagatgatagaccaaccgtccgatctaaagactttcaaggtcaacaacacccggccccgcctcctttgttccgttattgctctgatgacgccagcttggatattgtcttccctgattggtccttctggggctggtaagggcttaacacacatgttaattctattctgttctctatttaatgggcttgttattggacctagctaattatattattattgggctagggctgaggttaatataaagccttgggataaatcgctagtggcgatagaagaagggaataagatgactcaatggaaagaccgcgtggcgtatgcttattggagaggaaaccctaatgtggctccaactagaagagatcttctcagatgtaatgtctcagctcaagaagattggaacacacgtctctacattcaggttaggatttctcaaaatatgtataatttttatatattgcaatttttaaataatctaaatgatcaaaaatgtttattattgtgaaggattgggatagagagtcaagagaaggattcaagaactctaacctagagaaccaatgcacccacaggtttaacttaagccacactttttgtacttaggaaatatttgcaaagattcgattttaaatgtgtgataatgatggaataggtacaagatttatatagaaggatgggcatggtcagtgagtgagaaatatataatggcatgtgattcaatgacattgtacgtgagacctatgttctatgatttttacgtacgaggaatgatgccattacaacattactggccaatcagagacacctctaagtgtacttccctcaaattcgccgtacattgggggaatactcatttggaccaggtttgtatttttttttttacattaagacccaaaaagttttgttttgtaacaaattaacacattgagtgtggttttttttttttatataggcgagtaagataggagaagaagggagtaggtttattagagaggaagtgaaaatggaatatgtgtatgactacatgttccatttgatgaacgagtatgcaaaacttttgaagtttaaaccagagattccgtggggagccacggagattacgccggatattatgggctgctcggcgacgggacggtggagagatttcatggaggagtctatggttatgtttcctagtgaagagtctccttgtgagatgccttctccttttaaccctcatgatttaaaagagattcttgagagaaaaactaatttgactcgtcaagttgagtggtgggaagatcaatattttcatgatttagccaatatcaagaagccttgaccaaaaaggctcttgtgtttgtttagatgattgagttgtattcatatattgaaattagtgaaaagtaaacgagtaattttttttccgactagtatgtgtctctatctccactagcgatcttttttccgactagtatgttaattgagttgtatattctaatgttttagtaaatgttataagtttagttctattttttttaaaaactttactaagatatttatttaggttggaattttttaaaattaaattcattaaaattataagaacaaaaataaaatagtatgttctaaaagtataatgatgtttttatagtatcagaccttgttaattttcaaatcatataaaatgtaaagatttatattctaatttaacttgcattaaaaaatctatagcattgaatatataggcaactgaaatagttcattttggtaataataaggtaaattaagaacatcaaaatttggtatctgtagatattagaaagaaaaaaatgtgtgtttggtaagtggttcaaagagaatgaaaataagaaaaatatgtgtttgataaatgtgatggtagaattaaataataaaaaatataaagttgagaaaaatggagtttgccacgtaatcactataaacatacaggataatggcaacaagaaatattggttagtttcagggtaattaatttcgcagagtccatatatagttttaacttattaaagtgggttgcttcggttctgaagaaacaaccattaattatctattttcttcataaaatttcctcagaaaacatgggtctacacatccaacatactacaattcttagatacaaatgaatcaatatctgtaatcctcttttccttctaccgtcacaaaactaatgtgatcctcttatctttctctctctctcgttcatttttttttgtcttaggttgaattaaacacataatatct

SEQ ID NO: 12085 - DNA, 3000 bp, Unknown
  misc_feature (1)..( 3000): cDNA_ID_1807725_gDNA_ID_2214530_Annot_ID_134264 3000 nt of promoter + ATG
ctactgtacaagcttacaaagaaaattcaaataatatgggctttattattattgggctaacatcaagaaaaagagatcagcaccgacatagctcacgaggcattcttcctaacgtagaaaaccaaaaggtcccacatcgacaagcataaatcagatgtttgtgtatatatgttttataaataatcagtaccaccaaccaatattcactcaaggattattgggccttttaattttgtttgcttttttcaacggtttttttcttttgtttcttcattttcctttaatttttgtttatagatattttttagttttttttcaaatactaggttaatttgacgttgtgaaatctaagcggatttaggatccggctaattaattgtggtcattagcgattccacaaatccaacatatttttcacatcttcatgtatatttagtatttattttttttattttattttcttaaacggttttcaaattcttttttttgtttaccttagtttttgttttgattattaattttattttaaagttttataaactaaactaatacgacgttttgaaagctaactggattttagatcccatcatttaaccataatcattagcgattccacaaatccaacatattttttgcatcttcatatatttttaacatttattttttatttttttattttaaaggttttcaactctctttttatatattattttttaaggttttataaaatactatactaaaaatacggtgaaacgttcatgattttgtattttggctttggctaaactgtcttgatttttgtttattagccatactaccaacttctacagttgagattaatttatcatcattactcaacgatggaagtaagcatcttaatatatatggtttgttggctattttggtttattctgtgtcagaaaattactgttgaatttttaataataagaacctcaaaaataaccaacgcacgtaaacgtcaccgccgtagaagcaaacactgcatatctacaatcacaagacacaaggaactaaggaagatacacttaatgaccaaaagtctattaatcatacattagaaaacctaagttagccatcacacagagtatattggcatccattacttcaagatttatgccaaccatttgatgagtgcttaatttcaaggatccttttctttgcgatgattcgattgcgtatgacctctttggattcaacagcttcatcactgttactaagcaccatagcacatagctcatctaaagctagcattgaaaatggctcctctataagaacacccacctgcagacatttcaagcaccaacttaaagagtgataatgaggcaagaaaaaaaaaatgtgactaatctatgaacgagaaaaagttaggtacttcttcaatgcagaagagagaggcagcactgatgaaagtagcagggactacattccagtggcaatcatcccagagaataacagggagtgttagatgccataagactaagaacctcgacgttagtcgtgtgtaggaaagtggaatcggaattcccattagttgttcacatacaccaattccttcctgtaattgcatcatctttgtttcctgtgaaggagaacactaaacattatagtgcatatccaaagtctatggaaagagaattacattcagaaatcacagtcaaatgaatgaagatgcttaaaagattcaagaaagataccaacatatctatctttgtactatccaaattcagcagctgaaggctctgagaaatgaattgaatgacacaacgtggacgatgcttggattgaagaatcaaagacagatcatctacttctatcacattcttgagatcactagcaatatctgaaccataaatcacatggcactgcacatgaatagaatcacaatcacgaaccttcctctacctaactcaacataagctaacttcacaaaacaaaccttaagcgccacagggaaagcaacaatgtaacgcaaaagcgcatctctgatgatcaattcatcaccggagccatgaacagaagaaataactagcctagctaaatcattggttccactaatgatcttaacccaagctttccttccttgttcaaaccttgaataagaagcctcagtgcgaaacactagaagcagagctaaagccggagccgtaagctgatacggtagaggagaagctcgaagtacagggaagaaatcaggcaaccagtccaaatccacggcggagttatagccggcgatcaggatcgcgacggtggtgaagaagaaaacaggcggaatcaaagacagtataacgcgtgaagatgggctcgaggatacgtgacggagatggcgaagagagcttctgtgtctgacccaattctcgtgagtgtagagagatcgtttctgctgcatccgtctctctttgataccgtcagaccagtttgggacagctttaagcagcgaaatgagcttctcggatagaggtgaatcgtcggatttggggccggaggagacgcaggaaggattgaatttgaaatgtagggatttgggagctctggcggagattccggagtataatcgtggtttgagaaaggataggttggtaaagttagaagaaaaagataggttcattgactgatacattttgggcgggaaaatcgaggtttagggttagggattttggtggagacgacgatgaagaagaagaagcagagacaacaataaagacacatgcaaaaattgcagagtgcataagtaaagagagacaagtgtgacttggagaaaggtagttggaacgaacagttgtgcgctcgacaacgtttcggtttctaagcttttatctgggcttaaatgggcttatactgaaacttctattctatcttctaaatgggcttatgtcttatctcagcccattaaagttccgtaccctttgaggtcagttgaaatttagggtttatagagaacgcctatctggttggagaggtgaaattggaacggaaaaaatg

SEQ ID NO: 12086 - DNA, 3000 bp, Unknown
  misc_feature (1)..( 3000): cDNA_ID_2711455_gDNA_ID_2214530_Annot_ID_134265 3000 nt of promoter + ATG
aatcctggttcttgattcaatatataatggagctttcttttttcaagattgcaagtttcagagatagatagttaattaccaacggaagccattctctgtttcttgccggagcccggaggtcgaccacggccgcgtttgttagagttgttgggagtaatggtcgaaacagaggaagacgacagagccaaagaaacagagccgtcttgaccgtattttctaggccgtcctctctttcgtttcatcggagtttcactgggaggtggaggaggagcaatcatattaacgccgatatgatgaggaagagctccggctcctccggctgctgttgccagagaaggatcaccgtgtaaagaaggagatccgaaaccagtggagcctgacccgaatggagagttttgattaggtaagtgacgaagaccttgctgttgctgtggtgatccatgaaacgttggaggacccgacccggataatcctctatggatatagtaagaacctgacccggataatcccattgcatctcttcgatccatttcgcatttacaatagttgaagaagaaagactcttttcaactttttaagtgaacttgtgaaaccctaaaaagattgtggctagaattatgaggagagagagaaaaagaaagaggataaatggataagaggaaaaaacagaatcaaaggttgagagactttacgatgaagatataaacttggagagaaaggaacatgcaaagctctaaacactttctctgcttcttacttctcctcctctctctctttcattctttcaccataagcaacaagaaaagaaaagctttctcttctatcaacaatggttaggacttggttttgaggctatctctctctctctctcttcttgaatttgtttgctttttagttttctgggtgacagaaggaaacagaaacaaacaaaaaacctctaacagactctctctcaagcaaaagcatttactgtgaggataacaacaatgggatcttttaattcttttttttctgaaaatgtatttggaaattcaaaatcctaatgaataaactgactttgactgtagctctatatagcaactaggcatctgtatggcacatgactcttatggccacactctttattcaggcgcgtgcaccaacatgtcactcttctttcttctcaaccagaaatcttggtgaacagattcctccttttcaagctgatgctacttcttactagtctctctactgtttctatagactgattgatctcttcggaatttgatctgagacggaagaatctgtagagacagtggaggccacgcgccggagagtgagaaaagatttgggcctgtctggtcagagacttgcccactggcttccactttgagaactattttgacgagagagagaggctgatcagaagaaatctataaaatatctcgcaaggacccattgatgggatgatataacctctcaaagcctttgagattttttcctattaggattcaactttaaatgtaccatgtaatgtgtgacactgtttgtataagacttttgattatgacaaacataatttgactttctaaaagacagtttttttcttcaaaatatgtttagtggaatactggaatgtactaataaactagaaaagatcttgggtctgactaatgcaccatgaaagtcttatgccaattataaacatacttgtgtctttgttttgtttacctaaaagttgactttttctcagagaaatcagaatctatgctgaatttgaactttagaagcaattaggaaccatacacatttcacttcatcaatagctacattccacaatgatcccgatccggttagatagcaaaatcttgcattcaaaagagagagtgatacataagagtttaacctataagaagaagctagcttcaacatgatttctccaaagtaaagacgaagatcaatgaagaacaattttacatacaagtgaaaaaaaacgaagttccttgtcaattgtctagctccattgcctgagcagctttagctttagcagttggagtcagttttgtctttaatttcttcttgccaacagaaaatccacctttcttcttcttcccacttccatcaacctagacaacaaaatcaaccaactcacagatatcataaactactctagacttcatttaaatgatttggaaaactcaaacttattcgtcagatgttctactaagaagattcaatattattatttttaccccacataagcttctgactaacactatcgaaatcaaattgaatccaagcgaattcaatcatttcaccattggtaaccaactagagtaatatatagctagaaaagaccattctctgcaacagaatcggtttgctacttaacgaacaccaatgtatatgaactaaatatcagaattaagagataagagagacagaaaaggtccttactttcatcttattcttgttggcatgaagcttcttgatcttcttgtcctgtaactctttctcttctgcaaatcgaaaaaattccaagttttgttgagaaacacatgcgtattgaattgaaagcgtttaaagagatttaaagaaacctactttggagattgtactcgtgctgcttctttctcttggctaaattgttcttcttcgacattttttccgttccaatttcacctctccaaccagataggcgttctctataaaccctaaatttcaactgacctcaaagggtacggaactttaatgggctgagataagacataagcccatttagaagatagaatagaagtttcagtataagcccatttaagcccagataaaagcttagaaaccgaaacgttgtcgagcgcacaactgttcgttccaactacctttctccaagtcacacttgtctctctttacttatgcactctgcaatttttgcatgtgtctttattgttgtctctgcttcttcttcttcatcgtcgtctccaccaaaatccctaaccctaaacctcgattttcccgcccaaa

SEQ ID NO: 12087 - DNA, 3000 bp, Unknown
  misc_feature (1)..( 3000): cDNA_ID_2711451_gDNA_ID_2214530_Annot_ID_134266 3000 nt of promoter + ATG
aactttcacattacatttatatggaagtcgcaagttatccttttatacctttggaagagtggtgaggtaagaatcaggaatatccatgtcattaagagtggaatcgttaatggccaatgctgctttatgtatctgactggcacaatcgcgtttgtgacgcaaatgctttcgttcttcttcagataaaccttcagcaggaacacatggcaccggaagccaccatttctcgtctttccgttgaaccaccactttcctaaacgttcctgaatctctaccaccaccacccgagttcatcgatgagcttcctctttcaacataccagaactcgttttccgtaaaactatccaatatttcctacaaaagtcaaacaagtcgtgttggaaatcttttgaatcttgattatctatcagtctaattcgagtcttatacttaccattagcatgttatcgagttttctcaaagcaggaagactcatgagaatatcagatcttagctttgtttctgttatctgaaattaaaacatcaacgcaccggttttttagcgttttaaattgtgtgtgtcaaaattaagatagtgttgaaatagtattttacctcaacgttagtaccaagagatcttggaataacttcgacaatgtaatcacaaatagacatgaaacaattcatctctcgtttccataagtctttcttctctgtactcaatggttgtaaccttaaactctgtccaaacacagtcgctgcaataacacaacaaacacacgctacactataaatactctgttttgaaaacagagcatatttgaaaagagaagaagaagacaaaccatagagattggttatggagtttgacacagtaacagcagtacaaactcctttcccacttcctgacatgtcttcaccaagcaacagcttcgcaaatctttccctcatcatctctagctctgcactagaaaccccgatttaacgaaatgacaaaagaagaaagttacaatcttaaacactttacctgcatcttctgcagaatcaatgtcgctgtcttcttcgtctccatctccgtggacgtcgttgacgacatcatcttttggttcctcggcgtcttcggagacatcttcttcatggccactcaagacaacagcgttagtgtttgacggccggttataaaagctctgaacgtcgaaccggtgagataatccggagatatctgagtatgttctccggtacggcgaagaaacagagctcgtcggagttccctcattttggtcggaattcgaagaactctccatcacgattgtgtataatgatcaatgtttttggtgagtttcaagttcttctctttcgttgttggctcctctggctctgatgaacgtgacaaagattaatacatggagtctcttcctcttcagcttgagttattatttaatgactaaaaattaagttatgattgtctccgacgaatgatggccgtccgatctgattgtgggggagagacgtgccttccacatttggctaatcaaatctcataatgaacgttagttgctatatatgcgttaggtgtataattaataagtaaaggttgtcccattcatttctaattaaattctaaatgacatttacaccatgttattgcaattttcagagagtaatgttactattggaattattattttcggttcacatgtttttagttacaaattattaatgtagacataacaattagaatcacatcgtataaatgtcatttactaatttttttttgtagacattaaatatttttagatcattttaataataataatctcaaatttgtaattgtcatcaaaattaaatcggatttacaacatcttttaatgacatttgagtttgttttgtaacgaatgtttttggtcaacttttagttgacattcaacgtaaaccctcgagacaaggaagaaggttcaagccaatgaagccatggtcaatgtctaagactttactttggttttaaaaccgggatgaagtccacgtctacaagagtaaaacggcacgcagtttgtgaacactgttttcaaacgaccataattagacatcacatcatgcgaactgtgtctggtcaggcaagtcacgtgactatctccctgccttgccttgtgcgccgcagagtgcatcgtaatctcgtgatggtggtggtggcacgtgcttcccttcacacgtttaatgagcccgtctctactcttcaattggtttacgcacacacgcatagttcgtgccaagccttagcttcacacactcctctttctctcagacacgctcgagcgctacacacgcgcgaaagctcgtcttccaattcacgctgcacgctccttcacgcgcttcctccatctcacggccagatccgcctcttttcacccgccggagatccaccgtcttcttctcctctctcttggtttcgctgacggcgacagagggggaaacctttgatcggaagctccatttatagggttttttagtattgctcgatgattcgcccagagggccgagaattctgaccaatttcgagaggaggcttgtgattgttgaaagaattgtgcttagtgtctcttactcacagaggtcaatgatatatggttaggtacttaatctcaattgtgcttgaaatagtctctgtttggtttcgttagtcacaaaagttttccattttaatgtctgcaaatatgtttgtagttgaaaatgctgtttatatgtttgatttttgtcttgtaggatctttgatgaagttaaactgagagcagcttatgcacattgagagattgaagattaatttcgttgatactaaaattatctccaattttctaactaactgtaagcaaggaaatatcatagaatatttggctgcattgtccagaaggattacacgtggagtgttaaaaccagagaagtaaagatggaacatttcatcataaagggcaataacgttcttaaactaacagaggtttgggtggttgggttataagagaagtaatg

SEQ ID NO: 12088 - DNA, 3000 bp, Unknown
  misc_feature (1)..( 3000): cDNA_ID_3023822_gDNA_ID_2214530_Annot_ID_184915 3000 nt of promoter + ATG
cgcacctaaaagacatagggacacctcatttaacaaattatctacaacattttcttacttaaatactttataacattgctaattttagttatgagtgataattttacatgctccattcccaacaattactttattttatagcattgctttcttacttttaattctccaacaattttagttattattagtgtcgagtgagacgaataaaaaaactaatgactttatatccttttattaatcaaaaaagaaatgagattcttctttgtgttctgttctttttgttatcatcttcactatttttatccatgacaatatttttttattatgaaatcatctatagatcaatcaagcatgacagccgaattttgtttgtctataatgcaactttaatgtaccaactacaccaagtattgatcaataaattgcctatatgcaaaatcaaacgccatgtaccatccacatgcatattcatttgcatatatataccaagtagtttcaccatgaatgtgtaaaataaatgcatgatgaatagtgggttttaatgaggttaaagaagaagattggatagtgtaatattcggcagcaatccactatttgccaaaaaggaaagacaacgtttaagccaaaagaaagaaaaaaaggactaaacaattatggttgcttcgttgctttgttgtctttttgggtgtaacactatgtcctacccacgtgctgttttcttctagtcccattaccaaatttcgttatgttctatcgcttgccttcttttattaccgtccaagctctcatatggaccaaatttgatctgaccatgcaccaaatttccctggtaaattccctctttaaacggtgtatagtgcagaagttatgttatcgcctttcccgtgtcccaaaccatgtacatgctccataatgaagttaaactcacatccataatgaaattatttattgaacggcctatatttattttggtatgagtttgatcttgattagtaaattctgtcgatattagaatagtcttttatattttgcaatttttttggccattcacacaattctgaaaagttcatttacaattcaataccattttgtcatgtattcacaaaaaaaaaagggaataaaataaacctatgttacaattccattcaacctatgtatctaatttcaactactggtgttccattatagtactatcaatcaaaatcaggattgctacttttccaaatccttttagtatttcttggttttttaagcaatggcttttagctttttgtgaagggaaaaaaagggggaggttgtaatatatttggactttggtatgagaataaaatattccacgattccaagccgtccaatccatggataagaggacacgtggcataaacttacgtatacaaaaaccgaccaagccacccaaacacttgtcaccttcagccaaatagtaaaatcatttttagttttatttttcatgagtgcaataattgcatgcccactcccaatattcccgttgcgttacagtccccacttccacctctcttggattatttaattttgaaacattttgttctcttttttctttttttgacaaaagagttctgaacaattcacaagtacaataccatcaatactagtatgaatcaatagtttttaaagttttgaaataacatcatggataaaaagattagacaccaaattttggatatatcaattaaaatttacatttcaaaacaaaatttgccaagacaaattgctcctcaaagttcctacaaatttaaattcaaatgtattcaacaaaagttttggaaaatcaaattccttagaaatttcaaatgaggaagattcgagcctttttaaaaaaacagttgggccatttatcacctatataaaagcccatacttattattgggccaacaatttttaatctacaagcgcctcggctttttaacaaattctccaagcatcgccaactcgaaccactctcgctactagagcccaccgactcgagcctagtttccttttttacctaacgatgccgttatggttgataccaccactagccattagccaacatgatcatgacacctggacatgatcggtcctctcattttcttgtttttcctcctcctcatttgatttttatttttatttttaataaaattaattcctaaatttagtccgctttctctcacttatccgctcggccgcttccacatcgcttggccgcagccgccgccgtccgccgtcgctatccaccaccagattttaaatccccgccggaagttcaccttcaatacccaatatctgttataaggtacaacgcgccaattcgcataatagactctccttggttcaaaagagcttctcggtggttacgtgtatgtatctcaatgtgtttgcttttgcttgtttgatatattgtgttttggacaattcgaatatctgtattatctccaaacgtatacggctgtttctgcttttttttttttttttttttgctgcttcattggatcagttttaagatacctcttttgttttgcgtttccattttattctatgttaaatgctcaaaatttgtcataaagagagaagctttttagtatttctttgaattgagagtgtatattgcttaatgcttattggtttctttaagacacggttcttcattacatgttaagattcagggttggctttctgagcgttcattatcttttgttaagtggttagtctccgttttatagatctctcttcttttttccagtttggtggatgaagttgctggatattgcttgagatcgtcatctgacctcaaaactcatagtcctgagtactttgctacttggcgtatttattttatctggttggccatttttgtcctgaaaagcttcaggatttaaggaaaacagagactttgtatagtagggtttgtcctacttattggagctgatggtgtaataatacatataatagcagaagactgcgtcatcaaatctattatcaatg

SEQ ID NO: 12089 - DNA, 3000 bp, Unknown; identical to SEQ ID NO: 12085
  misc_feature (1)..( 3000): cDNA_ID_1807725_gDNA_ID_2214530_Annot_ID_184906 3000 nt of promoter + ATG

SEQ ID NO: 12090 - DNA, 3000 bp, Unknown
  misc_feature (1)..( 3000): cDNA_ID_3023854_gDNA_ID_2214530_Annot_ID_184904 3000 nt of promoter + ATG
tgtatcacatatcaatgtccatatgtgatttgagcataggaataccaaatatggatgaccaaatgtctcctactaattaataaaatattatctatttaatatttaaaaacattttaactcttcgaaaaactaaaaagtaaacaagattcacacaaaaatatgaacgtcattaacacaaaagatgtgaactctggttagtgttgaagataacgtgaaacaagattcaaatcctcgtggaagagcaccaatcgatcaccagaatcaaacctttgagcttcctcctagcttcggtaacgtttaatctcacctgattctcgtttttcttctcttcctgttgaatgtttgtgaacatagatatatataaagctgagatagatatagattcatgcttcaacggaaaagcatgaagaggaacaacaacaatcttctaacgaacaagaataagtatgtctatcttaaaacggcgtcgcatccagcaaaaagcatcgctaaagctactctgttcctcgtcacctctctcttcatatctgctggtctcttagacttattgggttgtttcgatttcgtgagttcgaatctgaagtaacttcttttttagaaactttttattcaatcaagtgaatcttgaacttgaagagttaataaattcatatctctctgtacttcagacaacttttacaggtctgaagcaggtaacaactagtatcagaaaatcaccaatcacaagccaaagattccctaaccaatgcggcgtcgttcagaaccaaactcaattatttccccaaaatggctcctcgagaaacaacgacaaacccagaagcagccattcaagaatatccacgtgtccttcttacttccgttggatccacgaagatctacggccatggaaagagacaggtgtaacgagagggatgcttgagaaagccaggaggacggcgcatttcagagtagtaatcctcgacgggagagtgtacgttaagaaatatagaaagtcaatccaaacaagagacgtttttactctgtggggcatcgtacagttactacggtggtacccaggtaggttaccggatcttgagctcatgtttgacccagatgatagaccaaccgtccgatctaaagactttcaaggtcaacaacacccggccccgcctcctttgttccgttattgctctgatgacgccagcttggatattgtcttccctgattggtccttctggggctggtaagggcttaacacacatgttaattctattctgttctctatttaatgggcttgttattggacctagctaattatattattattgggctagggctgaggttaatataaagccttgggataaatcgctagtggcgatagaagaagggaataagatgactcaatggaaagaccgcgtggcgtatgcttattggagaggaaaccctaatgtggctccaactagaagagatcttctcagatgtaatgtctcagctcaagaagattggaacacacgtctctacattcaggttaggatttctcaaaatatgtataatttttatatattgcaatttttaaataatctaaatgatcaaaaatgtttattattgtgaaggattgggatagagagtcaagagaaggattcaagaactctaacctagagaaccaatgcacccacaggtttaacttaagccacactttttgtacttaggaaatatttgcaaagattcgattttaaatgtgtgataatgatggaataggtacaagatttatatagaaggatgggcatggtcagtgagtgagaaatatataatggcatgtgattcaatgacattgtacgtgagacctatgttctatgatttttacgtacgaggaatgatgccattacaacattactggccaatcagagacacctctaagtgtacttccctcaaattcgccgtacattgggggaatactcatttggaccaggtttgtatttttttttttacattaagacccaaaaagttttgttttgtaacaaattaacacattgagtgtggttttttttttttatataggcgagtaagataggagaagaagggagtaggtttattagagaggaagtgaaaatggaatatgtgtatgactacatgttccatttgatgaacgagtatgcaaaacttttgaagtttaaaccagagattccgtggggagccacggagattacgccggatattatgggctgctcggcgacgggacggtggagagatttcatggaggagtctatggttatgtttcctagtgaagagtctccttgtgagatgccttctccttttaaccctcatgatttaaaagagattcttgagagaaaaactaatttgactcgtcaagttgagtggtgggaagatcaatattttcatgatttagccaatatcaagaagccttgaccaaaaaggctcttgtgtttgtttagatgattgagttgtattcatatattgaaattagtgaaaagtaaacgagtaattttttttccgactagtatgtgtctctatctccactagcgatcttttttccgactagtatgttaattgagttgtatattctaatgttttagtaaatgttataagtttagttctattttttttaaaaactttactaagatatttatttaggttggaattttttaaaattaaattcattaaaattataagaacaaaaataaaatagtatgttctaaaagtataatgatgtttttatagtatcagaccttgttaattttcaaatcatataaaatgtaaagatttatattctaatttaacttgcattaaaaaatctatagcattgaatatataggcaactgaaatagttcattttggtaataataaggtaaattaagaacatcaaaatttggtatctgtagatattagaaagaaaaaaatgtgtgtttggtaagtggttcaaagagaatgaaaataagaaaaatatgtgtttgataaatgtgatggtagaattaaataataaaaaatataaagttgagaaaa

SEQ ID NO: 12091 - DNA, 3000 bp, Unknown; identical to SEQ ID NO: 12083
  misc_feature (1)..( 3000): cDNA_ID_2711463_gDNA_ID_2214530_Annot_ID_184903 3000 nt of promoter + ATG

SEQ ID NO: 12092 - DNA, 3000 bp, Unknown; identical to SEQ ID NO: 12082
  misc_feature (1)..( 3000): cDNA_ID_3023858_gDNA_ID_2214530_Annot_ID_184901 3000 nt of promoter + ATG

SEQ ID NO: 12093 - DNA, 3000 bp, Unknown; identical to SEQ ID NO: 12081
  misc_feature (1)..( 3000): cDNA_ID_1808010_gDNA_ID_2214530_Annot_ID_184900 3000 nt of promoter + ATG

SEQ ID NO: 12094 - DNA, 3000 bp, Unknown; identical to SEQ ID NO: 12079
  misc_feature (1)..( 3000): cDNA_ID_3434945_gDNA_ID_2214530_Annot_ID_184899 3000 nt of promoter + ATG

SEQ ID NO: 12095 - DNA, 3000 bp, Unknown; identical to SEQ ID NO: 12078
  misc_feature (1)..( 3000): cDNA_ID_3023862_gDNA_ID_2214530_Annot_ID_184897 3000 nt of promoter + ATG

SEQ ID NO: 12096 - DNA, 3000 bp, Unknown; identical to SEQ ID NO: 12077
  misc_feature (1)..( 3000): cDNA_ID_2708272_gDNA_ID_2214530_Annot_ID_184895 3000 nt of promoter + ATG

SEQ ID NO: 12097 - DNA, 3000 bp, Unknown; identical to SEQ ID NO: 12076
  misc_feature (1)..( 3000): cDNA_ID_3023870_gDNA_ID_2214530_Annot_ID_184892 3000 nt of promoter + ATG

SEQ ID NO: 12098 - DNA, 3000 bp, Unknown
  misc_feature (1)..( 3000): cDNA_ID_2711447_gDNA_ID_2214530_Annot_ID_134267 3000 nt of promoter + ATG
aattcacacttcatattgataaccccaagctgttgacagaacaggatatgtagttagtaaggatgaatttcaggatattattggtaaatgctaagattaaagtggcttactggtaacatcacataaaccggaacataaggagtgccagagaaatcttgctccgtcagatttggaggaatctcgagaatctaccaaataccaaaagtggaagagagtcatcacaattgaacccagatatgtgtatgcacgtaaatcaaccatgcagtgaaaatctgacaggttcttatgagattttcagattttgaaaatgtttttctcaagttgaggaaactatcaaattcattaatttcaaataagctatgtaaatgcaaaggactgaactgttacaagatttattttctatgtactagtaaagtgtcgttacttgtttagagttgataacatcgactgaacaaccaacaagcccctcagccttatttacactgccaaccagttctggagattggattgggagcatatcatacggtgatggagcgggtgtgaaaacacctttcatacggcaagagctgagttccactgggcttctaagcccagatgataccactctaagagcaggaggtgaggtttgctgtgatgcaatgtgagaagctgatgaacctgccgcaaccgcagaagaaccaccagtaggctttgtcccctaaaaggttgagcagatcaagaagatgatttagctttcactggtaatggatatgtcaggagtttttccccaaccgaggatcaaggttactgctaatgatttctgacaactaagagtagaagaattttgcagcatacaacaaaagacataacacagggacagggtatataagtacctgagatttggatggaaaagtagttccatcaggaagaacaacccatccagcttcccttgccaaagccgcgataacatcgttaatatcagctctaactctcaggttataattcccatgccttcgtaacccgcctagtatccttgcagttatagcccttcgatggcgctctctcaacttagttcgctccttctcttcaagcggtctacttctgcgacttcctcctcccccaggagtgcccacttgatcttgcattgactgctgaaacataaactcgtcattactactactgcctgaagctgcgtgtttgtctctatttcgtcggtctccatcatcttcttccttcacatccatgtccatttcttcgtcatcatcctcttcactagttccaagcagtttatgcatatccgtcgccattacttctcttataacccaaccacccaaacctctgttagtttaagaacgttattgccctttatgatgaaatgttccatctttacttctctggttttaacactccacgtgtaatccttctggacaatgcagccaaatattctatgatatttccttgcttacagttagttagaaaattggagataattttagtatcaacgaaattaatcttcaatctctcaatgtgcataagctgctctcagtttaacttcatcaaagatcctacaagacaaaaatcaaacatataaacagcattttcaactacaaacatatttgcagacattaaaatggaaaacttttgtgactaacgaaaccaaacagagactatttcaagcacaattgagattaagtacctaaccatatatcattgacctctgtgagtaagagacactaagcacaattctttcaacaatcacaagcctcctctcgaaattggtcagaattctcggccctctgggcgaatcatcgagcaatactaaaaaaccctataaatggagcttccgatcaaaggtttccccctctgtcgccgtcagcgaaaccaagagagaggagaagaagacggtggatctccggcgggtgaaaagaggcggatctggccgtgagatggaggaagcgcgtgaaggagcgtgcagcgtgaattggaagacgagctttcgcgcgtgtgtagcgctcgagcgtgtctgagagaaagaggagtgtgtgaagctaaggcttggcacgaactatgcgtgtgtgcgtaaaccaattgaagagtagagacgggctcattaaacgtgtgaagggaagcacgtgccaccaccaccatcacgagattacgatgcactctgcggcgcacaaggcaaggcagggagatagtcacgtgacttgcctgaccagacacagttcgcatgatgtgatgtctaattatggtcgtttgaaaacagtgttcacaaactgcgtgccgttttactcttgtagacgtggacttcatcccggttttaaaaccaaagtaaagtcttagacattgaccatggcttcattggcttgaaccttcttccttgtctcgagggtttacgttgaatgtcaactaaaagttgaccaaaaacattcgttacaaaacaaactcaaatgtcattaaaagatgttgtaaatccgatttaattttgatgacaattacaaatttgagattattattattaaaatgatctaaaaatatttaatgtctacaaaaaaaaattagtaaatgacatttatacgatgtgattctaattgttatgtctacattaataatttgtaactaaaaacatgtgaaccgaaaataataattccaatagtaacattactctctgaaaattgcaataacatggtgtaaatgtcatttagaatttaattagaaatgaatgggacaacctttacttattaattatacacctaacgcatatatagcaactaacgttcattatgagatttgattagccaaatgtggaaggcacgtctctcccccacaatcagatcggacggccatcattcgtcggagacaatcataacttaatttttagtcattaaataataactcaagctgaagaggaagagactccatgtattaatctttgtcacgttcatcagagccagaggagccaacaacgaaagagaagaacttgaaactcaccaaaaacattgatcattatacacaatcgtg

SEQ ID NO: 12099 - DNA, 3000 bp, Unknown
  misc_feature (1)..( 3000): cDNA_ID_2711443_gDNA_ID_2214530_Annot_ID_134269 3000 nt of promoter + ATG
attactatatcattttattcctaattaactgtacttctatttctaattaagattagtattcaaaaattcggcttaaagagattaagatacctttaagtagctgtatagacagacaacccctaattagaaagcagctactcttttttttttttatatagtagtaccaagataaacgacaaaagcaattaacaaatgttcgcaatgtcgacctcatcaaaaacaaaattaagaaaccgacaacgtttcttgtatttttactcagcatataacaacaagagaaacgacgacatagtggagaatacgaagcatatagtttcttaggattcttctatcacaggtcactgccttttttgtctacgtatcttgtcctaatttgcatgtgaagatttgatgggctttttgtgcatcgctttcagcattcggaacccgatcatattcgttttatccgactccgacccgagggttatatgcaagcaattaatatttcgttgttcttgttcgttcctgaggaccatcgccgaattctaagacttgtgattacttaaactggaatttaaaagattagaaagctaacaaaagtatatggtaacgtcatgtgtaattaaatgcatgattagtttttgacttttaaatatcatatagtttttgtttttgtatgttatacagaattctttcattatgttctacctaacagaaaagagatataaatttagtgtaatcttataaaataagcatggctgcggttgccatattacaactctgtctaatcaccacaatcattttagttaagggttttggtaacatataattatcatggaaattaaagacggtgatagcgtaaactaattaagaaaatcacatcacatacttgatactcctaaaagaaaacattaaagtagaaagaaagaaactaaaagccaaaaatgcgtgtgtaatcgtatgagtgatatttggtgtactacaaagcctgcaatttgaaaatgttgacacgtacgtccttaaaacatttgagactattggattcagacttttgaaaagcaaaactttggattcggaaaccaggcaggcttatatggataccattaaggcccgtgaatcatatattgcccatttaaggaggtatttatttttgatatattttatttttaatttattataagttcatcattatcccggttatcgtgaagactagtcatatccaattaacgttattgctctaacggaaacgtgcacaaacaaattcaaattgcagtttacggtgaagcttttgacgaatgaataaagagatgctacatccccaaatcgtatatcctaagttgaaatattccatgataattaaactcagttatatatataacttggttagttaacaaactggtgtggatgtgcttagcctgtcttcatatcctgagacaactttttctttatttttaaaacctgtcaattacaaaattaacgtaatattcaataacaaataaaattctatttcgaccccggaaacatatatatatatatatatatataattcaaatgaaaatgacaagggaataagcatttcggagaatatgcctattaatttacattatataacatagtacaaccacacacgccacattaacaattcaactagctagtttttaatttatcagaaaatgaacttgaaaatatgttataatctacactaaatgttaatagaagactttttctcatctattttcaggaaaaaaaaaataacaaatttcttgaaccaactaacaaaattagcaaattaacgtacaatgatccattttttaacaatcattagagtgatatagtagtaatccgataccagatcctcaaaatatatggagacatagtcattcaactgctggtttttgcataatccatgtgtattagcctaatactattaggtttgatgcatccagtctttctaaaacacgtcattataactcacgcgtttagtttgatagacatataatgatgcacttaatactttcatattcgttgtcatctatgtgtagcagcatagtgcacttgttcgtctcagactttatagaattttagattcgtgagtagaaaatggcttttcgcttaacttttcataaatcttatgtcacacttaattaaaaattgactagcaccttaaaattaacatatatgtgtaacatgaagaatattgatatcttgcatgatactaactcttttggggtcttctgaaaaatagattgcatgcatatctgatcaaatgcaaatagattatgttataaaaaaaagtcatttattctactgattggaatggaaataagttttcaccggcgggaacaaaaaaggtgaacacgtcggcagaaatagagaattaagaaagactgcgagttggtgtaccaaatctcatccgtgcttctcataatcaggtacacgtgtcattaatcggttaaggtggaccaccccatagataagtactactgtgtgtgtgtccacagcagataaataaacctcttctttcatgttctcgaccacgtcagattttttagcagcaaagcacacaaatccccaagaagcttcgttttggtatgttaaagtaaaatcgaataaattttgcacacaaatctcaattttaattgtctttccctcttctcgtgaaattttccgacaaaatatcagtttcttcttgccgtgagttttggttggtctgaccaagagtccttttatttggtcaatacgtttcgaaatttgataatcaaactctttcttcctcttcttcttcttccttatccgtagactctagggtttcaatacgattcgagtgtgtctgtttgctctctagtcaaaaatttcactctggttagaaactttcccttttggattgtgaaactgctattttaaatcactgcttattgattcgtgttccggagtgatcttggtgaatattcttaatttgtttcgttgttttgtggttttagatatcaaacgatctggtttgtcggatttgatattggagca

SEQ ID NO: 12100 - DNA, 3000 bp, Unknown
  misc_feature (1)..( 3000): cDNA_ID_2711439_gDNA_ID_2214530_Annot_ID_134270 3000 nt of promoter + ATG
aatattatagtatactgatattataggtaattattataggctaaacaatcagaaagtgcctattctgaggaattgaagcgaaggaaagatacggagatagcagtagcgaaagagaaagagagatttataacaataaaaaacgagcaagaggtgatcatggaagaacttcaaagtgcaatggctcagaaagcgatgcttgagagccagatagcaaaatctgatggtacaatggaaaagctaaaccagaagcttgatatagctgtgaagttgttgcaaaagttgagggatgaacgagaggagttgcagacagaacgtgacagagcactcagagaagctgaggagttaaggagtcacgcagaaacctcaaccctacagttgcctcagtacttcacggatttctcattctccgagattgaggaagcaactaatcactttgattcgaccctgaagattggggaaggtggatatggaagcatctacgttggtttactgcgtcatactcaggtggctataaaaatgttgaatcctaacagttcgcaaggccctgtagaatatcaacaggaggtattttcttgacatattattagtgaaatttcttgtttagtttcatcatcattgtttactggtttattgtgcacaaactgctgcctctacgaaaaaggggactttgaaacacagttctactgtagttttgattttatagtgttcgctgtggaggagctttgacttattcttgcggcattgcaggttgatgtcctaagtaaaatgaggcatccaaatatcattacgctaattggagcatgtccagaggggtggagtcttgtctatgagtatcttccgggtggaagccttgaagacaggcttacttgcaaagacaactctccacccttgtcgtggcaaaatcgtgtgcgcattgccactgagatatgtgcagcacttgtctttcttcattctaataaagctcatagcttagtacatggtgatttgaagccggcaaatatcctactcgattccaatctcgttagcaagttaagtgactttgggacctgctcactacttcatcctaacggaagcaaaagtgtgagaactgacgttacaggcacagttgcctatttggatccagaagcttccagtagtggagagctaactcctaagtcagatgtttactcgtttgggattatcttattgcgcttgttgaccgggagacctgccttacggatatcaaatgaagtgaaatatgccctcgataatggaacattgaacgacctcttggaccctttagcaggggactggccctttgttcaggctgagcagcttgctcgcttagcattgagatgctgcgagactgtcagcgagaatcgtccagatcttggaactgaagtgtggagggtacttgaacctatgagggcttctagtggaggatcttcatctttccatcttggccgtaacgagcaccggatagcccctccatacttcatttgccccattttccaggtaactaatctgtatatttgagtatggatttccagtattattatcaatctgagaagacttcgatcacaaagtcattaaaatttgcttatctgaggtctcaaaccgttatgttgcagtctaatggtactcaacccgttcttcctctgctttgttttcaaatatttcaggaagtcatgcaggatccacacgtggctgcagacggtttcacatacgaagcagaggctataagagcgtggctggacagtgagcatgatacttcaccaatgaccaatgtcaagctttctcacaccagcctaatagctaaccatgctcttcgttctgcgattcaagagtggcttcaacatcatttgtgaaaataaaatccttcaaaccctcaatccctgttctcttatgaaaaaacgtttttgccttttctgcgggaggcaacagagtaagtgagtaagattagtgttttcagtcttccttatacatatacatacgatctaatcatggatagcagcatatttgtttactttttcaagcatagtgtaagtcctccatatcagtcatatatgaaaagaagaagctggtgagatttgtatgtggatatgtatatatatatatatatatatatatatatatatatgttctgtatgaaaaaaaaagttatatgcttattcggtttgtgtgagaagaactgccactattttgttcttccattatgttcggctctcttaagaacaaagattagcctctaattattggacatgatctcactgatgatgcctttgcttagctaaaattaggatgagtcttacatttttagtcaagactatcgtgtaagacttgttttccacctggaagaagttaccttggattgcctatagtgatttttaatgaactcttaaaattcttgtgattaatcttacttaattagcagtggggtcaggtcgttttggcggctagtggcataactgtataaaaattcaggattgcactgaggtaagccaacctaacgcagcctttaaagacaccaacctggaaaatgctgagagtattcttcaggattttctcaaaagtcttgtgaaattcgtgtatttgtgtcaatatgtcgacatttctcttcatacacagatactgtcgcttttgattcctggtttggcttgttgaaagtcaaaaagccttcattattttaatacatgattcagcttctgcgttaaggctaggtttcgtcattggtaccgtggttgacttcgtgtgcatgttataacataagaaaatgttcttgcttgttgattgctccctctgttagataagtcatctcttttctcgtattgcaaattttaagtttgttcttgtttattctcttgagtgaattagaggtatgttttgagtgttctcatatggagtgtgttggagataggagcttcgatccaagcaaaggggaaaagtgttggcttcatgaggcttcgatgcagccttaaacgctaaaatccaggccaagcaagatggagatagagagagatg

SEQ ID NO: 12101 - DNA, 3000 bp, Unknown; identical to SEQ ID NO: 12088
  misc_feature (1)..( 3000): cDNA_ID_2708291_gDNA_ID_2214530_Annot_ID_134273 3000 nt of promoter + ATG

SEQ ID NO: 12102 - DNA, 3000 bp, Unknown
  misc_feature (1)..( 3000): cDNA_ID_2711495_gDNA_ID_2214531_Annot_ID_134278 3000 nt of promoter + ATG
gttaccaaatttgggcgagatgctgtgctttacgtcgagtctcttattgaatcaataatggggggactggagggcctaattaatattcttgattcagaaggcgggtttggcgctctagaatctcaggtcggatatctttacccaaaatcaatattataacaaaagcaatcttctacttgagactgtcctcaaactgatgtgttgacctttctcagcttcttccagaacaagctgcagcgtatctgaataatgcatcaagaatttctgctccttcagtgaaatcccccagggttgtaggcgggtttactttgcctggccatgagagctatcctgagaataataagtctataaagatgtgagcgcccaagtctggctttaagttttgttcttgtattcatgtaatcagtgctccttagatactgtttatctaaaatatctcctcgtgatggcaggttggaagctgcaattcaaaggttgactaatttgtgttcaattctgaacgacatggagcctatttgtgttataaaccacgtatttgttctaagagaggtgagtctactagatttcaaattcggtagaaaaacatatatatggctgaattcttttagaatatatgctcgaatcctatctggaaaattttcatgttttctcagtgtcctgtgaataaaacaatatcttatggaaagacctcatgaatttctctcatcgtctggtcctgttaagcttttaaactttttgattttatcctgccgattggatacttgcagtacatgagagaatgcatccttgggaacttcaagagaagatttcttactgctctacaaaccgataacgatctccagcggccttctgttttggaatctcttatcaggcggcatatgggcatagttcacttggcagagcagcacgttagcatggacctaacccaaggcatcagagaaattttactcacagaagccttttcagggcctgtgtcatctttgcatacattcgaaaaacctgctgaacaacagcaaaccactggatctgcagttgaagttgtatgcaactggtacatggacaatatcatcaaggatgtgtctggcgcaggaatcctcttcgctccgaggcacaaatacttcaaaagcactagaccagttggagggtattttgcagagtcagtcaccgacctcaaggaattacaggcgtttgttcgtatcttcggcggctatggagttgaccggctggataggatgatgaaagtacatacagctgccctggtaaactgcatagaaacttctctgagatcaaaccgggaattgattgaagcagctgctgcaagtatgcattctggtgacagagtggagagagacgcatctgttaggcagatagttgatttggataccgtaataggattttgtattgaagctggtcaagcgttggcttttgatgacctcctcgctgaagcctctggtgctgttcttgaagacaatgcatccttgatacactcgatgatctctggcatcgttgagcacatacctgaagaaatacctgaaaagaaagaaatcagaaggatcaaaggcgtggcaaatggtgttggcgtagcaggtgatcacgactctgaatgggttagattaatcctagaagaggtaggaggtgcaaatgacaactcatggagtttgttaccttacttttttgcctctttcatgacctcaaacgcctggaacactactggcttcaacatcgagactggcggattcagcaacaatattcattgcttggctcggtgtattagtgctgtcatcgctggaagtgagtacgtaaggttacaacgtgaataccagcagcagcatcagtccctctcgaatggtcatcactctagtgaaaatctcgactcagagtttccaccccgtgtaactgctgaagcaagcattaaatcctcaatgttactctttgtaaaattcgctgcatcgatcgtgctagattcatggagcgaagccaacaggtaagagaaacctggaattattttactctctctctcgcatttttatccgcatcatcatcatatcatcctttttgttcttcagatcgcatctcgtggctaagcttatcttcctggaccaactctgtgagatctcaccatacctccctagaagctccctcgaatcacatgtcccgtacaccatcctcaggtcaatctacacccaatactactccaacacaccttccacaccgctctcaacagcatccccgtaccactccccatccgtatcgctcatccacgcttctccctccatgaaaaactccaccactccccagcgtggtagtggtagcggcagtagctctacagctgcccctgattcaggctacttcaaaggctcatcatcttcactatacggtcaggaacactacaccgaatccgaaactggaaactcaagaaacaatgagaacaacaacaacaacaaacaaaggggaagttctcgtcgttccggaccattggattacagctcgagccataaaggagggtcaggatcaaacagcacaggtcctagtcctcttcctaggtttgctgtctcaagatctggtcccatctcatataaacagcataactaagtaacaacactcccacattctacaaaagagacaaatttgtttctttttccccaaaagaaaaagacaattatgtagagagattagatttgtacaaatccctcgcaacagtcttcttgttatgtattggattgtaattcagaaaacctattatgcatgtctttatcttgggtaatcgactaatttcataattcattaacataaatcaatcatttataatcttaagattgaacaaattcttaagataattaattactttataaatttattaaaaagaaaaaaagaatatctgttgggggcacgaaatgtaacgaacccaaaattagaaccaacagtcatcttcgtcattagtgagctaagttgttcaatctctcacctgaaaaccctaaccttcttcttcaatctccaatg

SEQ ID NO: 12103 - DNA, 3000 bp, Unknown
  misc_feature (1)..( 3000): cDNA_ID_2711491_gDNA_ID_2214531_Annot_ID_134279 3000 nt of promoter + ATG
gtgaaagcaactagcgatatcaattctccagtctcgggtaaggtggttgaagtcaatgaggagctgaccgagtcccctggattggtgagtactcatctcagactcagaatcatattaccattgactccatgtgttgaaccaaaaagaacttcattggcatgatcaaatccgaaatcttagttttgcgggtgtcattttcatgtgatctaacaaattcattcctcgggtaacattctttgcataaatacttgattattcaacagctgttaaaatgtaagtgtcttcaagattcgtaggtctagatcaaattatttacataagtgagtgttggaaagttttaggcttttagctgatgtgaaactcttgatctttgagaaccaatatagatttgatttatcaatagcttgcttaaatatcgttaacttggagattcttgattttgtggtctcgagctgagagattcttttgttggaattcacaggtgaactctagcccgtatgaacaaggatggatcataaaagttgagctgagtgatgcaggcgaggcagagaagctgatggattcagacaagtactctaagttctgcgaagaagaagacgccaagcactgagctttttctattttttccagcatccttctccaagcttccaccgcaacacagattgttgttttctcaatcgaggatcaaaacgagatttctccatctttgtcccttggactgaaaattcccatctctcgttctccttttttcttttcatgtttttcttttaatgaaatgaaattgtttgaataatggtagagaataatgagctttggcgttgaaattgattggatctttcatggagttatgcctttttcttcttaactgcaaaaagtttcggacagtacatcttcgtggaccgaaaaccataacccttagcgggttgaactagtgcttagtgcttagcaagctccaactcctttggagggaccaaatcaaatgctactggaccaccatccatctatttataaacaattgtacaccggattggtaatgttcatactatataagataacatgttgacaagaaaaatgcttctcttcagatggaccttacctccgtaggtctaggcacggcagcaactacacttgtagactcttgaattaatttggagttcagtaaaataactgcccagtcctgagatgaagaaattggaatccaagataatagccgagtacaaagaagaagctaatggaagattcatgcgaataaagaatataggttcggtcatattgtagcaaccgtgtgaaaaccgtttttttgttattttctggttcatagggacctcaaaagataatgtgaaaggaaacaaaatctgtgatgcaatgatatgtgcacagagggaaaagattttggaatcattgttgcttattgtgaaggccaagcttgtttagccacagttgtccaacaaagttacaagatgtgccttgtaatacaatattcctgcgttgtcaaccctactttattatatgaagttgtttttgtgtgtcatggtttccactaatttacttattaatttgattgtttgattgttttctattagtaaaaaagtaatatcaacattatgattaaattctcaaatcaaataattatgttgaaaagatgaaatgcttggatagcactgagctttggacacgcaacaaaaagtgagggaggggcaaattcatcatcagaaacgtcagaaacattatttattagtcgaatcatactaaagtttaacacagtaattctaaaataattgacaattattacacctaaaagctactccatatgtagagataatgataattatatactacaagttagtatttgtcgacgtcaatattgttctcttggttaattgtttttaaatattaaaaattaccggttaagggacttgttctcattttgtcaaagcttcgaaaacttacatttcaaccacccaactagaacgtttgttctttttctaacagaaattttccttttaaatactaaaaatagtacttactacataatataccaaatacttttttctattttagctatcctcattattgaaatagatgtcgtagatttgaatttaccttctgttaatgtacatatgataaaagaacattggtttgttatgctaaaatctcaatagttggagctaatcctatagttttgctaaaaaaaacttgtaatccaaataactacaatcaaaccaaaacaacacatgatttgaaatatcattttttctagtgaaaaaatgttgtcttgcactgctcaaattcaagtagacaattccgattcaatataactaaaaatctcatattttattaaaattttataaacaatttattttttgaaagggataaacactttcagctgttcaattgttcataattttcttctacttacattgtttcgtttcctatggaaatgtttagatttacaggtaaaaagtaaaaaatgtgcttgagcaagaaaagagtaaaaaaaaataaaaaaatctgcattttagttgaaaacgaaagaaattctactgactaattttgtcttaaatgagagagacccgaatttagcaactctttatttctcggctcacacactccgattaagcccgacgctctctctcctctttgtcgtcgtcatcatcgtctccggagtaggttgcagaaattcagatctgaactctcagacgaagctccgatcttactgagacatttttgctcgatttgactttcgcctttaaagcttctcaggtaactttcaatcttcacgagactcttgcttgacttggttttagctccttgtttggttgctgggaaattgacgaggggatatctattctcactcgtcactcgttgttgagtattactgggtttttggaagatgaatgcaagagtagagagctaagtaaattatgttggacgagattgtgtaacgtgattttgaaatacattttcctttattgtagagattattgtactgaattaatg

SEQ ID NO: 12104 - DNA, 3000 bp, Unknown
  misc_feature (1)..( 3000): cDNA_ID_1807221_gDNA_ID_2214531_Annot_ID_134280 3000 nt of promoter + ATG
ttgagcctctacttaaacggatactctgcttgtgttatctatccatcctctccatttacataaaatttatctcctcaacaaggacaagactgtgaatatctccggtcatgtaagaaccatatgttcttttagcggttttagaaaatgagtagttgagactacccatctgcagaatttcttcaactctgttagttagcggatgttcgttcataaagtctattgctttggacattaaccgttgcctatttttgtatataactgattatctgtgtcaacttagctcaggtgttattatggttttctgctgaaacattttgagaattgcttgctttggtacttactaccttagtgttttgagtaacattttcatgaaattgggtttttgatttacaggttggtagctggaaacgctttgaattgcttattcattgattccagtggcttccagagatatttgggttttggagtcacaaatctcaatggtgccactgttaaaagctataagcaagaggggtttgtcatagatgaacgtgggaaattaaaaagatttaacaggaagaaactctccaggaaacgatgtaagactcaaaaactaagaaactttcttatgaatctctgtaagatttggagttacgaatgttttttttttctttcatataggtggctctttgagagggcgaggatggaaatatggatccgggtttgtcgatgggatatttcctgttctgagtcccattgctcagaagattctgagctttattcagaaagaaactgatcctgacaaagtagctgatgtccttggagctcttccttctacacatgcctcatgggacgatctaatcaatgtttctgtgcaacttcgtttgaacaagaaatgggattctattatcttggttagccttcttagaaaagtttcatttttgtcaatcattgttacagtttctttaagtttttaactgtctgaagctacaatcttgtcttaggtgtgtgagtggattttaaggaagagctcctttcagcctgatgtaatctgcttcaatttgcttatagatgcttatggacagaagttccagtacaaggaggcggaatcactctatgtacagcttcttgaatcccgctatgtgcctacggaagacacatacgctcttcttataaaggcatactgtatggcagggctcatagagagagctgaagttgttttagtcgagatgcaaaatcatcatgtttctccaagtatgtctttgcatctcctaagctttttatatgcattggtaccaaacactggctcatagttttcagtcattcttgtaattaacattttcttgttttgagaaactataggtgtaactgtatacaatgcctatattgaggggttaatgaagagaaaaggaaacaccgaagaagcgattgatgttttccagaggatgaagcgtgatcgatgcaaaccaaccactgaaacttacaacttgatgataaatttatacggaaaggtttatagtctaactttgtttgctatgaatacattggggtttcggaaatttcatattcatgtcattgattttcttgcaggcaagtaaatcatatatgtcctggaaattgtattgtgaaatgagaagtcaccaatgtaaaccgaacatctgcacatacacagcgcttgtgaatgcatttgctagagaaggtctttgcgagaaagctgaagaaatatttgaacagcttcaagaagatgggcttgaacctgatgtatatgtctataacgctctcatggagtcatataggtgattaccctaactctcccatagaagaatgattgcaggcaatcgatgaagctgaaatgtaacgccctcaaaatccggagacagtcgtgcaggttatccatatggtgctgctgagattttctctctaatgcaacatatgggatgtgaaccagacagagcttcctacaatatcatggttgatgcatatggcagagcaggtcttcactcaggtaaccaaaaagcttatctcgccagggatgtccattggctacatacattacattctctgtttttgatatatgtgagaaccagatgcagaagctgtgtttgaagaaatgaagagactaggcatagcaccgacgatgaaatcccacatgctgcttctatcagcttactctaaagccagagacgtaacaaaatgtgaagccattgtgaaagaaatgagcgaaaacggagtagaaccggatacatttgtcctaaacagcatgctcaacttatatggccggttagggcagttcacgaaaatggaaaagattctagccgagatggagaacggtccttgcaccgcggatataagcacatacaacattttgatcaatatctatggtaaagccgggttcttggagagaattgaagaactttttgtggagctcaaggagaagaatttcagaccagacgttgtgacatggacctcgaggattggtgcttactcaaggaagaaactgtatgtgaaatgtctggaggtttttgaagagatgattgattcaggttgtgcaccagatggaggaacagccaaggttcttctttcggcttgttctagtgaagagcaagtggaacaagttacttcagtgcttagaacaatgcacaagggcgtgactgtgagttctcttgtcccaaagctgatggctaaatctttaactgtaaactgataaagatagcatttttagatctgccttattaataaaggttggatttttatgatcagaatccttgtatctattgaacagtgttataatatatggttttatgtcattacccacgatgttgctttagtggggtagttgatgcgaaattggtctacgagcaaatgatttcagaaagtgacattttttataagcaaaaaaaaaagcaaatccaccaaaccctttgtcgtaagaatataataataagccgttcggtgagtgcactctttctctctcactgttgttgttgtgtatctgtgcgagatctctccaacgaaaaaatg

SEQ ID NO: 12105 - DNA, 3000 bp, Unknown
  misc_feature (1)..( 3000): cDNA_ID_2711483_gDNA_ID_2214531_Annot_ID_134282 3000 nt of promoter + ATG
ttagaaaataagaaagaaaaacagcatttcaagtgaaacgaaatgctgaccttctgaactaatagaagatattcaaccattgagctgcattaacattttaatatcttacagacatagtatatatatatacataaaacataataatatacaattaattaaatatctgcaatttattaaaaataacaaaactaaataaaatcaacaaccaaatatatacaaatattaaatatgtttaccctaaataaatatttggaaatttcaattatttagtttgctatgttagtttcttctatattttaaaaattattgatttctaaattatataaaacaaactgaaacttggataaattaatttgtatttatattataatatatataagataaatataaaacataattattctaacttgaaattgatgtaatattaatagttagatggaaaataaataaataaaaattattttagttacattataagaaaaagtgataattgtattaatggtatatatatttaaatgaaaaggattgtataaacttaaactcacatatttaatattatatattctaatggtttctgttatttttttatattatatatatatatatacatgctctgtttaccataatacaagaatattaatgtagctcaatggttgagtgtctcttataagtccaaaaattcagctgttcgattctccttgttagcaaatttttcttcttatattctaatgtccaaaacaacgtcgttttgatttcacggagattctaacgaaaagttaacaccgtgattgttttgttgacggaaacttaacgacaagccctaattggccaggtcaacaaaacttaatcattttatcaaaagtcaacctaaactttaggatttaaatgtctttttgaaagttcatgttttttacgtcccaaatttgaaagttcacgatttttttgacatttttccccttctaaaatacacaaccttttggtgtttctacattgaccctcaagataatcttcttactcattttcattatcaaaattttaaccatatactatatatatttatttatttattttaccacctatacgaaacagactttaaatattaattatgtaaaatcttcatttaaaaattaatcatggttacaagttaaccacatagattacactttacttgatttacatgatgattagatatcttacacgtacgtcttttatctaaaaaacaatgaaaacctcttaattttctaaaaagaaattatcttattatcacaaaccctaaatcgattatacgagcgaagtcgacatcgaatcggagaattaagggatatatttcattgttttcgttttctcgatataaatccaagttgattccagcgaaagcaaataagataatgtacgaatttttgccatataatatcgattatgaataaaagatgcaaattgtctaatgtgctatcgattatgcatattgttgagttcctctattttgattgcatcgtctttgaatgatctctaactattcttatccaattctgattaaaaaacattcatttgtaagtttgtttttcttcgactgtgaactctatactgcaaatcgatttagaacatatgggctatgatcaataaataagaaaacatcaaaacatattgacaaaactattgttcaaactagtgttccacactaaagattactactagttagatgtttttgatgcaatttggtagattggaggtttgtaaaaagagttttttttccttgatttatatgatgaaaatgagtcaacatttcactgtttttccgttgaaaacttagtgggtgattgattgggctataactgtagagtttttgctgtagagattttgttgtaactgtgttggcggtagttgtaacttttattgctgtaagttttttattttaaataatttataaaaaaatggattaataaaatataatagttataataaaaaaaattatagtaaataaaatatcttgtattactaatttaaataaatatattatgatgatataaaagtaaaatataataaatattttttttgttatatatttatgttgataattttaactttttgtatttatttaatgaattaaaatttctacagtcaaaagaatatgactttgagaatttactctcctacaaccttaaaaataaaaataaataaaaattaaactataagttttaaaaaaaaactacaagtacgtaatcaaaactttaaaaaaaattaaggttgtaagtctgacttacaacctaatcaatcatttagggttattagtgtaatttgacggggagaaaaaaaaagattttgtttggggacctaccaacaagaataaaagattcgagtaattcgcattgcaaaatccggaatatttaagagagaacccatacgaaaactgcaataaacccactctccccctcgatctttgcgtttaatatctatatcctcctccgatcttcgtccccctccttcgccgtttcgttttccggtaatactccaaaaaaagtataaataaaactcccgatcgttcgtgctttctcttctccttcattgatttcaatagatatctatcttccttgcttactattttttctcgtttatggtttttttttcttttcatgtatgtttgtgatagaagtcgaatttaaaaaccaggaaactccaagccgtgattttttttcccaggtttgattggttcttctgcattgcttttcttaaaaattctccatttaatgttcatggctactgtttaattatctgtgaatatgcttgagagattagttacgtcgccgttttgatttatctgtggatgttcaatagcgtcactaacttctttcttttcttcggtatttgttgctttatttgcttacttgttctaaaactttttttaaattggaatttggggttttactgtttacattattcagtttgctctgtcttagttcaacaaatgaaggaaagttgttattttagttttctgtaacagca

SEQ ID NO: 12106 - DNA, 774 bp, Unknown
  misc_feature (1)..( 774): cDNA_ID_2994444_gDNA_ID_2214531_Annot_ID_184951 3000 nt of promoter + ATG
acaaaaaccaaagcaggatcaggagaaatgggttttaattgatggcaaaatgattaatcaatcttacagattatagatacgagtttagaagtacttactgatcggcagttgtatttctcagctgagaagaatcaaacttcggtagagaagagaggagaagagaagcgaagggtcatgcaagagaaaaaaaacaagctttcttcagtttctggtggtgtgtgtgactgttgaacataatgggcctttaattgggccgagagctaaattatactaaacgacgccgcgtggctcgctgtttactttcgtctgtgatctttgaaacacacgcatcgtcgtcacttagctccggagctctctatctttggtcatcctcctatcggaatcggcagcgcaggtattgttttttaggttttgaactttgtgttatctgttatcaatcctcgtttgatctgaaagttctcatttttgttaaattaaattcacctagaatcgttaatcgtaatttcgtaggttttgtttagtgaaattagtcatgggtttgctgaaaagtttgctctttttgggagttttatcgcttttgtttccgccatgaaactcaattcaatccacatgctcctgattgtttcatcattgaattagtagccaatgtagatgccgtgaatgagttctcatcgattctcaattttgttgctcctactgaatccttttgtcgattgatgtaagatgtgatctctggttttaacttgttatattcagggaagagggcagattatg

SEQ ID NO: 12107 - DNA, 3000 bp, Unknown
  misc_feature (1)..( 3000): cDNA_ID_2708329_gDNA_ID_2214531_Annot_ID_184945 3000 nt of promoter + ATG
atatatatattatcaaatcatcaaaaaccacaatttccacctggtcctccaaatgaaaaggcttctcctgtagatttggtataaccccaatatgtcgccctaaaacaattataggaatcgacataaagtcgtattttcctaccttcaatgtaaactcttttatagtccgagtttataacaacgacgttattaaaatgtgccgtctttttaaagtccgcaactggaaaaaacccattgcccattggaggactgattccatcgggagattcaaaagtatttcctccatatcttactagagaagctccattattcaaatgtgaaaataactctttaggccaataaccaatgacttcatcaaacattttaagtgcccaatttccgctgaagccatcctaatacatataaaacaaaagaaaaaatgaaaactaaatactccaacaagtatggtgtaatatgataagttcatctaaagtctaaactaattatataaatctttttcttaaaaaggataaacagaaatttacctgaaaaacttgcaatttaaacgtaagacttgttttaccatagacagatgttccccaaaatccgcttccaattcttgaatttcgacttacaaccacaaagccagggcattgtgtattatagcacccagttttctgataaccatctccctacatataataatatttgttacacatgtaaaataatgaaagacgttttgatctcttattttatttttttactctaagctgattaataatgttcttaaaagaataagagtagctaaaaattactcacagtccaatatattgtaaatcgtgtgacactatcaccgtacaatcttggatgtacctaaacagaaataaatataaaaaagattatgtatgttaaaaaaaaaacagattatggaacgcaaaatctttagcaagtttgatagaactgacttactgccaaaccagcttgtatactattgagttgacctggaggtccattctctaaccatatttgacttttactgtattggttattttgcagtttcaaatcatgaatacttatatcagcttctgctccccgatatatacttccatctaaaatggtctcaattgttgcaaactgcaaatttcatcaatatgttagtttaattttcatctataatatatattttgcatgaataacaatcggatgttttgatgttctcctttaattttacgtaaaacgaatagattattagaatgtcttaacaactagatgaaattttgtaactcctttcaaaaaccaagattaggagaagacatacatgttgaccagaatactcggcggtattcaaatgaacgcccttggatacatttctttgtctcaaaattgcaacggttccttttggacaatgctcttttgtattatatttgttgcttctttcaatttttccatctaggctgaatgtttcctacattataccacaagtaacaaaggaagaataagattcgtcagttttgatgtctcccgaagtcctattttcatatttgattaaccacaactattttattcacattttataaatttataaactaacattaacatattcatccaaaagtttcttaggaatacccatccttgactataacaaaagttacttatcatacataaactttgaactctacttttataaaataaatagaatatgcgagatctaattctaatatgaaaaaatctagataatttctaggtcggattagatttcgaaactcaaatattttgcccaacgatatatgctacgttacctggatcttgtgatctttcaacaatggatgttggaaagctggttgtttgtatatttccacacaatcaaaatcctataaaattggttgaacacacaaattagagaaaaattctaaatataagaatggaaatctttagaggatagaacaaacaagcataagcaagggtctcacatcagtgtttccctgtgcaccttgtgtaaacagcagataaacacatagacttaaagctagacgtaatgccattgctaagttatttttagtttacctagtttatatcaatgatacttttcagtataaataaacgaattcgagtcaaagactatctaaactattcatattaattgtgtttttaatgttttaccaaaattaacatatgtatatattttttggtcaacgttcaagtgtatatatagggaaatatggatacatggcttttagtttcccatatgtaaacataacataccaaaaaagtttcaaagttattcaaaatactttcatacgtatctttcaataaagagattcctaaaataactttaaaatagtcaaaataaccaccaaagtttatgaaaatctaaaaatattattttttaatttaaatatctttgtcacattttctatttacttcttatgccaattattgtttaagataatgatttagattaaaatattaacgaaatatcattgcttaaagtgttaattttactgtttttcgagtatacatatattcaaaaataaaatcaaaacattaaaaagaaattgaatcaaaaaagggtaatctattcaaaagaaattgaatacaacataaatgaaaaccattgtcattctttttccctggatttcacaattattaaaattaaactttatattaataatatcttaagataatataataaataaaaagtttatgagatggcagttaccccgttgggaacagattttctgatcccgccaatgttatctccacgtgtcaaataaatattggtcgcagagatatgcttcatctaaaccagatatcctcctaaccgtacgataaaaatccaacggaccagaataaaccttatctctccagttttagatctcgtataaattcaaagaacccaaaaccaaacaaaaagcacaagcacttagcagagcaaatgaagaagacgaagcacactgagaattcaccggccagagatcaccaataagtgttgtagtttccggttacttcgaataaccttca

SEQ ID NO: 12108 - DNA, 3000 bp, Unknown
  misc_feature (1)..( 3000): cDNA_ID_3023903_gDNA_ID_2214531_Annot_ID_184943 3000 nt of promoter + ATG
gaaatccagggaaaaagaatgacaatggttttcatttatgttgtattcaatttcttttgaatagattacccttttttgattcaatttctttttaatgttttgattttatttttgaatatatgtatactcgaaaaacagtaaaattaacactttaagcaatgatatttcgttaatattttaatctaaatcattatcttaaacaataattggcataagaagtaaatagaaaatgtgacaaagatatttaaattaaaaaataatatttttagattttcataaactttggtggttattttgactattttaaagttattttaggaatctctttattgaaagatacgtatgaaagtattttgaataactttgaaacttttttggtatgttatgtttacatatgggaaactaaaagccatgtatccatatttccctatatatacacttgaacgttgaccaaaaaatatatacatatgttaattttggtaaaacattaaaaacacaattaatatgaatagtttagatagtctttgactcgaattcgtttatttatactgaaaagtatcattgatataaactaggtaaactaaaaataacttagcaatggcattacgtctagctttaagtctatgtgtttatctgctgtttacacaaggtgcacagggaaacactgatgtgagacccttgcttatgcttgtttgttctatcctctaaagatttccattcttatatttagaatttttctctaatttgtgtgttcaaccaattttataggattttgattgtgtggaaatatacaaacaaccagctttccaacatccattgttgaaagatcacaagatccaggtaacgtagcatatatcgttgggcaaaatatttgagtttcgaaatctaatccgacctagaaattatctagattttttcatattagaattagatctcgcatattctatttattttataaaagtagagttcaaagtttatgtatgataagtaacttttgttatagtcaaggatgggtattcctaagaaacttttggatgaatatgttaatgttagtttataaatttataaaatgtgaataaaatagttgtggttaatcaaatatgaaaataggacttcgggagacatcaaaactgacgaatcttattcttcctttgttacttgtggtataatgtaggaaacattcagcctagatggaaaaattgaaagaagcaacaaatataatacaaaagagcattgtccaaaaggaaccgttgcaattttgagacaaagaaatgtatccaagggcgttcatttgaataccgccgagtattctggtcaacatgtatgtcttctcctaatcttggtttttgaaaggagttacaaaatttcatctagttgttaagacattctaataatctattcgttttacgtaaaattaaaggagaacatcaaaacatccgattgttattcatgcaaaatatatattatagatgaaaattaaactaacatattgatgaaatttgcagtttgcaacaattgagaccattttagatggaagtatatatcggggagcagaagctgatataagtattcatgatttgaaactgcaaaataaccaatacagtaaaagtcaaatatggttagagaatggacctccaggtcaactcaatagtatacaagctggtttggcagtaagtcagttctatcaaacttgctaaagattttgcgttccataatctgttttttttttaacatacataatcttttttatatttatttctgtttaggtacatccaagattgtacggtgatagtgtcacacgatttacaatatattggactgtgagtaatttttagctactcttattcttttaagaacattattaatcagcttagagtaaaaaaataaaataagagatcaaaacgtctttcattattttacatgtgtaacaaatattattatatgtagggagatggttatcagaaaactgggtgctataatacacaatgccctggctttgtggttgtaagtcgaaattcaagaattggaagcggattttggggaacatctgtctatggtaaaacaagtcttacgtttaaattgcaagtttttcaggtaaatttctgtttatcctttttaagaaaaagatttatataattagtttagactttagatgaacttatcatattacaccatacttgttggagtatttagttttcattttttcttttgttttatatgtattaggatggcttcagcggaaattgggcacttaaaatgtttgatgaagtcattggttattggcctaaagagttattttcacatttgaataatggagcttctctagtaagatatggaggaaatacttttgaatctcccgatggaatcagtcctccaatgggcaatgggttttttccagttgcggactttaaaaagacggcacattttaataacgtcgttgttataaactcggactataaaagagtttacattgaaggtaggaaaatacgactttatgtcgattcctataattgttttagggcgacatattggggttataccaaatctacaggagaagccttttcatttggaggaccaggtggaaattgtggtttttgatgatttgataatatatatatatatatatatatatatatcaaccaaattgtatcaaatttcaaataagaataaaatcatctaatctattcatattttcttactgaaaagtatgtaaataataaaacatgatcatcactaaaaccaaaactttacaagagaaggtggaaacatcatcaacgttttggtctgagactctgagtgataccaatggtatcataccataccaaacgaattatcatctctcattcaaatgggcctcatatttagacatgataaggcccattaataacaaattacaagcccaatttgttttactctctttcgttttcttcaatcgtatccataaaccctagtctcgtcgtcttcgtcgatcatcgccgggaaaccacaccagtctcaatg

SEQ ID NO: 12109 - DNA, 3000 bp, Unknown
  misc_feature (1)..( 3000): cDNA_ID_1394178_gDNA_ID_2214531_Annot_ID_184938 3000 nt of promoter + ATG
tatccttcatcctctcgatctctctcagattcgctcttcctcacttaacatcaattcgtctttttgtcgcacgcttgctgacatttatccctgccagattctcttcctctcagccgagcactgaccgagttgtttggtccattgggtcgaagccagttgcggagaataataagacaaattcaggatcttgggttcagaagtatggcactaatgatatgtatgaaggagagtttcatagaggaaagtgttcaggaagtggagtttattactattctatgaaaggcaaatacgaaggagagtggattgatgggaaatatgatggttatggagtagaaacatggtctaaagggagtaggtatcgaggtcaatataggttaggtctaagacatggaattggagtttatacgttttatacaggagatgtgtatgctggtgaatggtctaatgggcagtgccatggttgtggtgtatatacctctgaggatggaagtagatatgacggagagttcaagtggggtgtcaaacatggccttggtagttaccatttcaggtcagcattgttcttttttactctgcatagtcatttgagtttctggaatatggttgtgctttgacctgtaatggtggtgcattagatccctgtatatgttgctcgtctaagtgtgtttgctatcttgagttccattgtttttgaagggtcgtgtagttgtctttctctttattgttgcccttgttcacttgggtgtgtgaatctggaggacctctgaaaggttttcaatttcgatttctgacatcagatggataactgggttttgtttcctgcttcttgtggttatcctcaccttataagctagtctagtgaacatcaaagtttaggcttttgtgttactctcagttagcattgatcttaagcaattgcatgaagcactggtggtccagtatgctttagcggtaccatggctttaaaactacatttaacttggagttatgctgctgttgcagaaatggtgatgcgtatgctggggagtattttgcagacaagatgcatggttttggagtgtatcactttgcgaacgggcataagtatgaaggagcttggcacgagggaagaaggcaagggcttggtatgtatactttcaggaatggtgatacacaagccggtcattgggaagacggtgtactcagttgtcctaccgagcagactatccgtcctggatcatcttttaccataagccattccaaagttgttgatgctgttgaggtaaaagttaactagtagtttatctttagtactgcaaacaccatatatgtattaaactaagcttgttctctctttctccttcagcaagcaaggaaagcagctgagaaagcacatgaagttgtgaaagtggaagagaggatcaagagagcggtgatggctgcaaatagagcagcgaatgcagctagagtagcagccgtgaaggctgtccaatcccagacctttcacaggaatgatggcgatcttgaaaccaattgttgagcataggttagaagagatcttccttaacaggttttcttgttcctttatgagcaaagctagtttgaaactgtagataataaactagagatgatctttgtatatcaacaagaaaaaaattgggtctgcttcatagaatgcaactgacatacatgtagccaaaaatccctatcttgattaaacaattagaagaatctggtatatcagtcttataacaaaagatgaatctggtcttgaaaagttgtgtatgagtagaagaagtctagctctcagtttgttctctgagccttctgatggtactcctaacagttacagcactagcagtattcatcgtgtaggcacctccagccttaactttcccacagtccttacatccccaaattccaacagccttccgtttaacagcatacttgccacagaactagcagaagtatttgctgtgctgactcacttccatcttcttgatttgcttcctaagactggcaccatatctggtcccttaacagacaacatttcaacagattcagaaacaatgtaaaatgggctgaaaatctgaaatcaaaagagggatcttatgattcacacagcagacaacatctcatgctatgaagcatttatttgaatgaactaaaagcaaggatttaggccgtttttatttgggccaagctagatgacattatacacttcccttaattagttgaattcggtttttcttaagtacactttttttttttctttgtcctaatttttcttattttcaaatttagtttggatttcgatttttgcatttaccggtttgtataataaataaacgattctaatttaatgaaggactgaaagttttgtttcgttttcgaattaattattatgatgtgctctttattttaatttcatttaaagtcaattatcaaaattaagctaatgtaaagagtgtggatcgtcagatctggagaggtgaccaatcgtacgtcccaggttatatgagttccaacactgacaaacgatgtcgtggcgggtcccactggttttcggtaacgcagtttttcaaaatctctcattttcgtcccttcgagccaaatcaatggcaaaaaattagcttttagaattccccaagaacaaaaacaaaaaatgtccgagagaaattagggaaaaacaaaacaaataaaatctgggtgtaggggagagagagctcgtgctcgtgattttgatatctatctcttcgttatcgattttgaacatccacattgttcttagatctgaagaaaaaaaacacgggttctgttattacgatttgctcggcgattttgacaccaggctttcaattcttttcgttggaggtgattcgatttcagatccatcggatctaatctcggcgagtcgattcgtggtcgacatttttcaaaaactgctcgcgtggatctgaagaagagacattgttgtcttttgtatatcggcactgaatttttctgggaatctgtgtaaag

SEQ ID NO: 12110 - DNA, 3000 bp, Unknown
  misc_feature (1)..( 3000): cDNA_ID_2708303_gDNA_ID_2214531_Annot_ID_184936 3000 nt of promoter + ATG
agtaaagggaaaaatctttatagtggtactcagattattggaactgtgcctggtgttgaggttggcgatgaatttcaatatagaatggagctgaaccttcttggtatacatagaccaagtcaaagtggtatcgactatatgaaagatgacggtggggaactagttgccacgagtattgtatcctcgggaggttataatgacgtgcttgataactctgatgtcttgatctacacgggtcaaggcggaaatgtggggaaaaagaaaaataatgaaccacccaaagaccagcagcttgtaacgggaaaccttgcgttgaaaaacagtataaacaaaaagaaccctgtgcgggtcataagaggcatcaaaaatacgacattacaatcatcagttgttgcaaagaattatgtttacgatggattgtatctggtggaagagtactgggaagaaaccgggtctcacggtaaactcgtcttcaagttcaaactacggcgtattcctggacaacccgagcttccctggaaagaggttgcgaaatcgaaaaaatctgagttccgggatggtctttgcaatgttgatatcacagaagggaaagagacattacccatatgcgctgtgaacaatttagacgatgagaaaccgccaccgtttatctacacggctaaaatgatatatccggattggtgccggccaattcctccaaagagctgcggttgcacaaacggctgctccaagtcaaaaaactgtgcctgcattgtgaaaaacggtggaaagataccttattacgatggagccattgttgaaattaagcccctggtctatgagtgtggcccacactgcaaatgcccaccttcttgcaacatgagagtctcacagcacgggatcaagatcaagctggagatcttcaaaacggagtcaagaggttggggagtgagatcgctggaatctattcctatcgggagcttcatctgtgagtacgcaggagagcttctagaggataaacaagctgaaagccttaccgggaaagatgagtatctttttgatctcggggacgaggatgatccgttcaccataaacgcagcacagaaagggaacatagggaggtttataaaccatagctgctcgccgaatctgtacgcacaggacgtattgtacgaccatgaggaaataagaatacctcacattatgttctttgcactggacaatatacctccacttcaggaactctcgtacgactacaattataagatcgatcaggtatacgactctaatggtaatatcaagaagaaattttgctattgtggttccgctgagtgtagtggtaggctctactaataagctgttgttagcacttgtattcttcttcattttcccccttgatgttcagttctgtctgaataagcaaattagaagacagctttagccaaattttcaacacattgtatgacataattggtgtcaattagtgttgtcatgttttagctgcattgtttcattattatgttattcactgaacctcaccataatccaagtatttcatagttattttcatacactttgttgcgttattgcaactatgggttcttttgtgtgtgtgtgtttttcttgcatctacaagatttgttacttatgatgacacctgaaaccccagaagccaagtaaattacatgagttcactatctgtctgaaccgaattcaaacttgatcatactgatgttgtcttagtgattactaagcaccaaagaagtagctagcttctttgtttgtttgtccaaatctcagtcgctgatttggtttgatttgaaattgggaaaaggaagatattactgttactattacttaatttatagctatgggatccactatgtcacttttcattattctttattgttgattccaaaactatttatttcacattgttttttagcttttaaagtacataaaggttttgaagatccataaagattactcttgaattaggatagagataacaattgtgtacatagataggatcatgatgtgtatatatagtatgggtggccatgaaatttttggataacaaatgttaaaaaagctataacttatccctccattgagatattcttggtgattagactgctttggccttatggtagtctctaattttccatgaccatctatcgtttatatcagccatatctcaggatttttgactagctgtttaatttcatgtacaaatgtctttttactagttttaggttagattacaagagtttttttttttttttttttactattgttaaattaattatgggtttttgtaaatagattaagaaaattagtgattggatattgcttttatgaccttaaacttgtctttatctgaaagtagtcttgtccaatctcaaaccacttcttaaaaatattgatgtgtgttttgttttttgatgaaaggctttacaaaattctaaccgggttcactggattttatgttttggaggttagctcgcaattgtaattataactcactaaaataaacatacaaacaattattggttggtaattaacaaccaaaccaccaaataaattaaatagagaaaaataaatacaccatataataaaacaccattactttaaaatcacctgaagtttttgcaattagagatacacacaattttggaatcttagagaataagctctcttaataatttgtttaatcattaagtaaaaattgtcatcaaggactgggtcaacaagtggcaaatggatggcattttagtaaataactgaaactaagaggtgtttattgtgttctcacgtggatctcttaccttagtttcaaaagttcaaaattgagctcttctcttcttcttccttcttcttcttcttcgcgaaaacttggaaactgttttaggaacaaaaaccagaggctttgatttggaaaaaaccctaattttcaacaaccctaaatcccctaccatttctccccaaatcctctttccaagttccatactctttatgtaa

SEQ ID NO: 12111 - DNA, 3000 bp, Unknown
  misc_feature (1)..( 3000): cDNA_ID_3023916_gDNA_ID_2214531_Annot_ID_184934 3000 nt of promoter + ATG
ctggtgaaggcattacaacccctttgtctgtaattatccaaacctctgatttctcaagttccaaaacctctggtgatggacccaaatggtctccagaatctgacttctccagaaccaagttttcctcttccaccgatatagaacgtttagcggtctttccattctttgaaaacttgctccccatatttggagataagtctctcccaacagagatcgttcttccgtgaagctcctttgttccagtgatgcttttcctgcaaacagaccccatcatatcttcctctggcaggcttatgcttggaggatggacctccaccatattttgctcacttgtgttctctggcatattcctatctttcataggttcttgcatgttaactccaagagattcagctccttcggttaacccaaccgacatgtcattacaatcaaccgacttaaagctatctctttctgcaacaatttctccaggaatcaactcaacatcagcttgagaagagagaacacaaacatcagaaacattcctggtctcgtaagtctcaactgtgaactccttctgcattcttctcgatctgagctgcctggtaatcgatccaaaatcaggtgaaaactcactttccgcagcaaccttaaaccgcttggacttcctccgccccataggatcggtgtaactaccatttattgctagttcatccttagaacaaggaataccaccgccatcaccaccgcgcaaggaactaagtattgatgactctgaatgtaccatgatgcccaacgcctactcaatgtaatacaagaatatgaactaaaaacaccatcctagtaagttacaacaaagcatattaattaaaaaacaccatcctagattcctagtagttacaagaacgcgtattgattagaaaagattgcaatcaattaaattgaatatctttggcaatgcatgttatgatgatctaagttcatcatcacaattaaccaacaaaagaagacatgcagatcttcaaaacccatgatacagttttgagtaacatgtgaacgaatcagtacgcattaatccatgaatcataagaaatccttatccacattttccagaaacagactccaaatctcgaaattatcaacttttaaaattgttaatcaatcgagagatggaagcgattgataagatcaatttcgagtctacaagtaacaaaaaataaaagaatgaagaatagagaagaagggtacaaagatttaccagaaatgaaggaaggagtagtgataatggcggagatgacgagtcgattggccggagcgggagatatgtgagtcgcctactcaaattgggttaatttggcattgtcctgcaaaacaaaactaaacaatcaattttaattaaattctgttttctcttttcaaggattcaatttttaataactcagtcaaataagtcactcacataattcttatgaacagagtcctagcatgcatctttggctctggctctataacttcttcaattcctattttatacaagttcatcaagattaatttatattgatgatgatttagggttttagtggatctcttttttttttttttttgttgatcaaagcttttttagtggatctatgaatgtttttttttggaaatataatctttgaaaatattataaatctagagatttggtagttttattaagtaatattttttggaaaagtaatatttgaaaatattctaaaaatcttctattcttttcttttagaagtttctaaataatgatctccagaataatataggaaaacaaaagtttaagtatatgtgattcaatgttgcatgatctagggttttaatgaatactatttttattaaaaaacaacttttgaaaatatcataaatctttagatttttctccggattaatttatgtttggttttctcgacattatttctaacattatttattttctatctttttaatcgttttgtttgttttacgttatcacccgttcggcttctatatcaaaaaagttcgatatactattttctattataatcgtttaaccttaaatgaagaacatattacgctaaaaataaatcataaaatctgaataaatcatagtgagttgatgcatttttcattctattttttcgtacttatattatattaatttagtaatttctcatttaactaacaaataaaatccttatttttgtccttttccataatttctgtaatcaaaatctaaaaagagataaaataataagataaaagcaaaaagaacttataaagtagtagaagaaaaacaatttaaaaagagatttgtattggttgacattataatgtgataaattaattcatgcgtcgacaaaacaaagaaaaaggaagataattctcgctctactgtattcacaaccaccatcaacagtaactccagattattatgcagctcctattgctcttctctctctggtcttcttcttcttcttcctcctccagttttctctgcaatcctcactttctctctctccccatctctctaaatgcagctacttctctttcatcactgctgattctccgtcttagctcccatttctccatgaagttctcgcagctactccgacgaattgtgctgtcggtgagtttttcgcgccttcgagaatcttcgctggattatctcaaagttgatttctttaggcttcttacatgatgttagattctgggttcgtttatgttttcttccttcttttgaggcgttgcgtatcatcttgttttccgattgtaatttgaaaatttcaaggtaattctataggttacttgacttgtagggttcataaacgaagtttgggatgatttttctcttataaagaatcaaagatgccatttttaagtttatatcatcagttcaagtgttgtaatttaggaagctgaagtctcttctatctcttgttttgcgttgtgacagaggtgaaaaaggtacggtggtgttatctttaataagtagcattgtaaaaggagatg

SEQ ID NO: 12112 - DNA, 3000 bp, Unknown; identical to SEQ ID NO: 12105
  misc_feature (1)..( 3000): cDNA_ID_2711483_gDNA_ID_2214531_Annot_ID_184933 3000 nt of promoter + ATG

SEQ ID NO: 12113 - DNA, 3000 bp, Unknown; identical to SEQ ID NO: 12104
  misc_feature (1)..( 3000): cDNA_ID_1807221_gDNA_ID_2214531_Annot_ID_184931 3000 nt of promoter + ATG

SEQ ID NO: 12114 - DNA, 3000 bp, Unknown; identical to SEQ ID NO: 12103
  misc_feature (1)..( 3000): cDNA_ID_3023924_gDNA_ID_2214531_Annot_ID_184930 3000 nt of promoter + ATG

SEQ ID NO: 12115 - DNA, 3000 bp, Unknown; identical to SEQ ID NO: 12102
  misc_feature (1)..( 3000): cDNA_ID_3023928_gDNA_ID_2214531_Annot_ID_184929 3000 nt of promoter + ATG

SEQ ID NO: 12116 - DNA, 3000 bp, Unknown; identical to SEQ ID NO: 12111
  misc_feature (1)..( 3000): cDNA_ID_3023916_gDNA_ID_2214531_Annot_ID_134283 3000 nt of promoter + ATG

SEQ ID NO: 12117 - DNA, 3000 bp, Unknown; identical to SEQ ID NO: 12110
  misc_feature (1)..( 3000): cDNA_ID_2708303_gDNA_ID_2214531_Annot_ID_134285 3000 nt of promoter + ATG

SEQ ID NO: 12118 - DNA, 3000 bp, Unknown; identical to SEQ ID NO: 12108
  misc_feature (1)..( 3000): cDNA_ID_3023903_gDNA_ID_2214531_Annot_ID_134290 3000 nt of promoter + ATG

SEQ ID NO: 12119 - DNA, 3000 bp, Unknown; identical to SEQ ID NO: 12107
  misc_feature (1)..( 3000): cDNA_ID_2708329_gDNA_ID_2214531_Annot_ID_134292 3000 nt of promoter + ATG

SEQ ID NO: 12120 - DNA, 849 bp, Unknown
  misc_feature (1)..( 849): cDNA_ID_2994444_gDNA_ID_2214531_Annot_ID_134298 3000 nt of promoter + ATG
acaaaaaccaaagcaggatcaggagaaatgggttttaattgatggcaaaatgattaatcaatcttacagattatagatacgagtttagaagtacttactgatcggcagttgtatttctcagctgagaagaatcaaacttcggtagagaagagaggagaagagaagcgaagggtcatgcaagagaaaaaaaacaagctttcttcagtttctggtggtgtgtgtgactgttgaacataatgggcctttaattgggccgagagctaaattatactaaacgacgccgcgtggctcgctgtttactttcgtctgtgatctttgaaacacacgcatcgtcgtcacttagctccggagctctctatctttggtcatcctcctatcggaatcggcagcgcaggtattgttttttaggttttgaactttgtgttatctgttatcaatcctcgtttgatctgaaagttctcatttttgttaaattaaattcacctagaatcgttaatcgtaatttcgtaggttttgtttagtgaaattagtcatgggtttgctgaaaagtttgctctttttgggagttttatcgcttttgtttccgccatgaaactcaattcaatccacatgctcctgattgtttcatcattgaattagtagccaatgtagatgccgtgaatgagttctcatcgattctcaattttgttgctcctactgaatccttttgtcgattgatgtaagatgtgatctctggttttaacttgttatattcagggaagagggcagattatgaataatgatacatcaaaaaagctgggaactttggtttctgatgatggaccagtgaatgtatatgtatgggacatg

SEQ ID NO: 12121 - DNA, 3000 bp, Unknown
  misc_feature (1)..( 3000): cDNA_ID_2708387_gDNA_ID_2214532_Annot_ID_134300 3000 nt of promoter + ATG
gcgaggtagctgagatagaagtttttccaaccatttcaggtttgcttgcagttctgtttttggaagaactagaagagtaagattgaccaaagtcaatttcagaccgcactgactttgtcttttctctaacgccggttctatccacctcatccctgaacacagtaccaatgctttcttcactatcatcactagatgcagaagagatccttgcattgttccgggcatcggtcaagcaactgatagaaagttagaaaaagagtaaattccagctccatgaaacctctaaaactatttgcctgatgtaagaatttatgttaggatatgcaagcaatcatgccagttctagatatttgaaaggagaaccaagattcttttacttttcaaaagctcagctaaaagagatattatctagcaaagtaacattagcagtttcacctgctaggagtttgctctgaagtatctaatgatcttcccatttcttcacagggctcattctttttctcattcaagtgaaacactacttcagagttacaggaaggggaagatcgtaaatgttcaccacctttaggagtttccagttttttggatgtgttcctaacttcaattggtgtcgctggtatttcgcaggaaactttaagaaactgtgcctgtaattccataagtaaagcaaagtgagattaggttctcattgaagaaagtggtaatctaattctgttgttatatgcaaacaaatatatctgccaagctctagcaggattttcaacttgagaagagtaacgcacacaaatttcagataatttcccaagtaaagataaaagacgcagacactaatgcaagttaagcatatttccttccacacacttgcacaataatgcatggatacataagctacattcatcccaaaaaaacatctgtgtgtataatgtatatattttctttacaaagaattaagttctaaaaccaacacctcaaataactgagcacaccaaaacagagaaaaggaaaatcaaatataaggacaaagccaaaggctgtggtatatacaatgcaaatgatgcattcctaatggagaaaaaaaaagcactagtagagtctagaccacctcttcaataacataagacataaaaaaaaacttcttctcattacgggagaagagcttcagctcaagtatcacatatcaagcaaaagaagaacatgtctcaagcaaacataattattgtctcccaagtataaatgaatgacagatgcttaactctagaattccagtcaaatcgaaaatgctaattaatttcaatggagccaaaatcttaagcgtgagttgttaagtataatttcgatatgaacatacgtcatccttgagatctttatcaatatgcatagaattcaaactagatccctctctgtcatcatggcaaggcgacgaagctgcgtcaaaaaaacaataaacaagtaagaccaccgtttaaaactattaagtgatataacatcaaagaagagatttatcaccttcagatagaaacaaagctgacaaacgattcttcgactcatgacctctctgaaaatcatcaaaccaaagatgttaacactgaaacagctgaattgaacactgaattgcaaatcaaagatctggaaaaacagaaggaaacgattagaattacgttatgtttggcttgagaaacggaatcagtagtagattcgtcgtctttagcacggaagcaaccgaagagacaacccatggctctctactcaacaagccgatccgtcggtaaaatccgagcgtctcgaatttatggctcagtcactcaattatgaagcgtttctgtaatgtcgtgatttgaattatattggtggtaaaaaaggaacagcgatggaggaacctacaacaaccaaacactctcaatgaggagggaaaaatagtttcccgagaaagtgagagagaaagagaatgttggtggtggtggtgggtctgagtctctgtgagtcttttgttttcaaatttgaaaatccccaaatagcttttgcgagagatgtgtgtgtgtgtgtgtgagcttcgattttgaaatggcatcaaatttcgaatttgttattaaaagattcataatttcgtacgtttttacactcgcgggcgcgtgtgatcctacgtggcccaatcctcttcattccttctaataatattttttagctaattacagtatctgtgactgttaatgtgagtagtttctattgaatcttagtgttagattaggacgaattgatgtctaaatgttgatgtttagtgttgaattttcttagattgggtttggtgttagactattctagtattcttgaacattcttatattgaatttagattgtttgttgcacttaaaatgtttgtgaattttttttgaaccgaacttaattgagcatttttttcatttgctaaagagaattgatgtgaagatgttttgtgagcacaatggagtttactgctattaacctatactaagtatcaatagcttttatttgtttgtgaaaaaaaacaatagcttttatttgtcctaggaattatttaatagattaaataacagctatttttctcttatttcttagtgattaaaatatttaaaatacagaccaaaattaattgtttatgttaatatatttactccttaatcctttatattaaaattgtataatgcatgtagttaataaattgttttccaaaattcattcataattttattcctaaattattttggtcaagaaaacacatctttgaataattaaatgcttccttgtatttgataatttcttgatattttaaaataccttctatactatgccaatgttattggttataaataggtttaacattgatcctgaaatatatcataagaaaatcaaaagtgaaataagagatcaaaatgatgaagctcatagttgtctttgttatatccagtttgttgtttgctactcaattttctaatgtaaaaattattattattttcttcatattatg

SEQ ID NO: 12122 - DNA, 3000 bp, Unknown
  misc_feature (1)..( 3000): cDNA_ID_2711538_gDNA_ID_2214532_Annot_ID_134304 3000 nt of promoter + ATG
tttcaagtggttaggattcagccctaaagcttctgataaaagctcaaagattagttcccctagtttcatcactcgtttcgcatattccaacatgatttccctaaaacattcacacaactagataagtcttctttctttctttctttcttctatagactaagaaataaaggaaatttgtatttcgtacccacaaatatctggtaagtcctctgtttctggaacatcaggagccataaagcaactcaaggtatctctccagttcgctgaaggagagctataaagatcaaaattactgttatacttaactgttttggtgacgtcacgagtataaaactttttcctaacgtctgagtcttgctcatgaaacccacgaatcccatctttcatcttctccataacatcattactaatcccatggttaatcacctggaaaaacccgaatctctcaaccgcgtctctgatcatcgcgatgacgctctctcgcgtgactgtgtactcgtcgaacacgcctcctttaagatcgattgttggtataaccatcgttgtagaggaaagaagtagatttgagtcggttaaattaagatgtggatgatggaagatacgtgggatctgagtaactccggcgtctaggagaccttttacgccgatcttcaactcgtcaaaagcttttacctcactagcacgatcgtatgttgcttccatcttcttcttcctttgtgtcaagaaacagaacaaagagaaaacgttttctaagacaataggtatctgcctactactgttgaaatttggtacctctgtgtatattataatagaaaatgaggtaatcgaataaaagtcaatggaattaaatttttctgattagccaatagatgagaaaaggcaaaaagattcttcgctcaagtctatatggctctgttcactgtcggaaaatgagtgaatttgaaacggcagctgtttcttttcatccaagtagctgccgggaaaagaaaagaaaaaagctcaggtaacttgtgggtcttgcttgagactcacggagttttcacctatctttcaatagttgactttttcactaaataacaaaactgttttaaaatagtaactaagtggagatgcggggtatcgatccccgtacctctcgcatgctaagcgagcgctctaccatttgagctacatccccacgatgactatttattaaaatattacaatatttaatactttcaacgtgtaactgatgcaaaatacgagcggtgtgtgttgaaaagggactaatgattgagagaattggagataatgactaacgatattaatagagaaatcagaaactaaagtcggatactatctaatcagtaaagtagagatgtgtgtgattgactaaattttagaatagttatgttggaaagagaataaagaaaagttaggaggatctagggtaaaattttcagtttgtattaagtaaaataagtttttactcttactatctcaattggagggatttttttttctttctttcagctgattagtgtagtatacatcaagctaaaacaaaagtaatttgtttttcaatccactattgttacgtcaatagacattaatagttacactctacatgtcatgaatttttgtcatttcatgtatagcttccatttatatattaaaaaaaaaaaacatattagaagaagtaaatacctaatagataatctttactttgtttattatttatgattggtgtattcagcttataaaataattaatatgcatcatatttgtttttacaaaaagtacattgaatatcatatgatttttagttttttttttttttttcatttaccctcgatcttacaacaaataataagtccagtcatacgcacctaccaaaagaaccaattgaggcatgtggttcagtggttagctaaacggatgggctcattctctcacgttttattttggctccacctacccacttcaaaccactaaccatctttgtttcattctctacgtctttccttcatttgattttccttttctcataaaaaaaacaaagcatcatcaatcaattttatttttattatgggatccctttttattatattcaacgaaacctagttctttttcttaaacgtcaaaaacaatgagttcttttactaattgactgtttgagtttagaatctagttttgaacccaaaaaatgatacttatataacttcatggaaaactttgattctaaatattgtatgtagaagtatcctcaatatacaaagtagatttgcattgttcgacttcaatgaaatgacatatacttctaattgagtgagatagaaatatctaaatgttttattttcatcggttgaccagatattacgacgttcttacaagagttttgaacccaaagatgggttagggtgggtgacatggatagatattgacctgtgggctctggccaatcaactccgacaagatagaaatatctaagttattattatttggtaacaaaattgtatattatccacacaagagtagcaaataatttgtgttctacaaaatggtgacaatattcattttcaaagtaacaactaacaagtgttcagttcacatttttaaaaatcaacattcaaaaaaataaaattcaacagattgagattttgatttcatacaacattaaaattcttaatatagaaaataaaaattatatgcaaagaggataagtaatattaatgttggaaaatcagttttcaataccagtaatattttatgtaattagttttccgaaatagttatatctgataaattttgtcataatttttttgattgtatggatttgataataacacacgtttccaccaatcaacaacggaaacgcaacgccacgttccgccacgagtcgcgattctctctcactctctctcccatctttctctataaaacttgtgtcgtggacactcttaaaacttcactcaacaaagcttaaccataaactgtgagtaaaaaagagaagaaagaaaa

SEQ ID NO: 12123 - DNA, 3000 bp, Unknown
  misc_feature (1)..( 3000): cDNA_ID_1014113_gDNA_ID_2214532_Annot_ID_134305 3000 nt of promoter + ATG
cgacgttcttacaagagttttgaacccaaagatgggttagggtgggtgacatggatagatattgacctgtgggctctggccaatcaactccgacaagatagaaatatctaagttattattatttggtaacaaaattgtatattatccacacaagagtagcaaataatttgtgttctacaaaatggtgacaatattcattttcaaagtaacaactaacaagtgttcagttcacatttttaaaaatcaacattcaaaaaaataaaattcaacagattgagattttgatttcatacaacattaaaattcttaatatagaaaataaaaattatatgcaaagaggataagtaatattaatgttggaaaatcagttttcaataccagtaatattttatgtaattagttttccgaaatagttatatctgataaattttgtcataatttttttgattgtatggatttgataataacacacgtttccaccaatcaacaacggaaacgcaacgccacgttccgccacgagtcgcgattctctctcactctctctcccatctttctctataaaacttgtgtcgtggacactcttaaaacttcactcaacaaagcttaaccataaactgtgagtaaaaaagagaagaaagaaaaatggtgctaaaggtgtacggacctcactttgcttcaccaaagagagctttggtcacactgatcgagaagggcgttgccttcgagaccatccccgtcgatctcatgaaaggagaacacaagcagcctgcttatctcgctctacaggttccttccttcttcttcttcttccttcatcttctctgatttcttccttttttctccgattctgatggtttcttgattcttcttcctatgcagccttttggtactgttcctgctgttgttgacggtgactacaaaatcttcggtaagatctttaagaaaatttcagtatctgttttgattgtttctataataaggtcaatttcgtcacagaacaaccaagttctgttttaggtcaagttctatagttatgatttgtgttggctcatgtttgttttggttgtatgtatctatagtgatgctaagagatggtttttgatcttttgacagagtcccgtgcggtgatgaggtacgtagctgagaagtacaggtcacaaggacctgatcttttggggaaaaccgttgaagacagaggtcaagttgaacaatggcttgatgtggaagcgaccacttaccacccaccgctattgaacttaacgcttcacataatgttcgcatcagtcatgggattcccatctgatgagaagctgatcaaggagagtgaagagaagcttgcgggtgttcttgatgtctacgaggcacatctctcaaagagcaagtacttggccggtgacttcgtgagcttggctgatttggctcacctcccgttcactgattacttggttggtccgattgggaaagcttacatgatcaaagataggaaacacgtgagcgcgtggtgggatgatattagcagccgtcctgcgtggaaggagactgttgccaagtattcattcccagcttaagatgtgttcatcttcttggtgatgtggtttgtgttttatgagaggtttaataaaagtggaactaaatgtacctcttaatgtaatgttgccacctctgtgttctctttccttttgtagtttaataagtatctttatggctttgtgaggctttcaattttaaggaaatgatcttttcccctagttctactacttgaatgatttaactagcttaagaaaattaattatgaatgaaaggtcggattagcgcgcgagacgggagacctagtcgatggaatctatcttattgattgcatatcgactctcaataatggataggtactgaagtatgaaataattgatgataccttcaaactagtttgcggtttaggttggaacatggtctgataacaaaagaacttccacaactataaaatctaggttggcttcttttactcggccttttgattcataaccaaagattcttggttttgtgaccaagaccattcgaatattggaagaagtgactgatctagcaagaaacactctaccagtaaaacaaagtagagagaggtaccctaagaataaaatcttgattttcatgaagctttttgagagaagcctctcagcttatttatggataataaagtgcatcatcagacgatacactgatttttttttaacatctctaccaaatttgacaaaagtgaaagaaaaaaggtttattggtctttcggggccaatgatggatagtataaattaaagtatagacactataatgaaagttggtttcgataattagatcactaatttttgtttaaggcatctaataattgcgttgataaagtaatgttatctgtcagaacataaattacaaaaataagagggctcattcgatcacgttttataaatactttcttgtacccaccaacctaattttaatcggctaacttaggttttccattgcctgatcattttttttttataaccaaaacaaaacaaagtgtaatcaagtctcgtaactattttattaaaatgtgttgattcaaaaaagtgagaatcattttggcatcttattacaacaaagtggggaatatctttaatcaaatatacttacaacaagtggtctctctctttattaggcttattaaaaatgaataaataacattgttaaaaaacacacacatgtaattcataatttgatgggacgttggaaatttcgtgctgagaaaagtcaaatatgacgtgaaacgttgccgccactagctagccgccacctataccgacacgtataaataataatatactaataagtgcgactgcgtttagcctactaccgcaaacgcagctaaccagatccctttttctctctcttttctttccctctataaaatcgcgtcctgctatagtgagtttagaaagaaactgatagtagaaaaaaaaagagagaagaaaa

SEQ ID NO: 12124 - DNA, 3000 bp, Unknown
  misc_feature (1)..( 3000): cDNA_ID_2708371_gDNA_ID_2214532_Annot_ID_134306 3000 nt of promoter + ATG
taacttgattagaatgctgaatgctcaaacggccaaacctaatcctcaagacactcatacgtcagagacagcatgaaaataggtagtgttccttcgtcaattcctcggaaaatttgggacatttcttctcattcttgatacacatgtagctaaaatttaggttacgacttaatcactgcctatgactatgagcatgttacacttgaaaataacaaaagaagaaagaaactcgaaagttagtcaaatcattaccactacaaatcaattcaaatacctttgaaactctttttgtctcctagaaaacaatctctcaaagtaagaccaaattactaatagcttcttagcttggcgcttttagcatttctctaactccggtttactctcttcgacctcgtatccatggccagtctctgcggttgagatgttgctgttatgatcaacggattgatttctgttaaaggtagcttggctttggatataagaccatttatcttgaaaaagatagaccaaggcaatacaagagagttgtgcagtgaagagtatggtccaaagattagcactttttgatgtctttttggcgtaagcgtgtaaacctgtgtatatgtttattatcccaagaatagcaattgatgttcctaatatccaatgtcctacaaaccacttccttctagctttttcttctctgcaatgcgagtaaatcaattaaagattgaatataaagtactagacgcatttcgtagttctcgtcatcataacatttgattaagtctaactaatttgcattcaagatttttcttagaaatattcaagaacaaaataatgagtgttattaatcttaagctagcttaattttgtcacaaagaattatcggtgtaacagcttattttattgaagagaaaagaaacagaagtaccttggaggtcggaggaagccaagaagagcttggaaccatacaatgacgtaaagtccaattccaagctgttggtgatgattactgaaggaattgttgaagtttattactgacattactgcccctattgtcacaagtatcactgcaaccatctgcttcataaattaatcacattgttaattgctcacttaatattccaagtaaactatgagccgcttgttgatagataacaatagttaaaagtacttgctgctgtttaattatcaaatattgttttgtaacaaaattgactagctagtaggtgaggtttcttagttaagtatcagaatgagagaaagagaaagtcagaaagtcgttaaagctaaaaataaagaggaagaagatagatgctttagcttggccttcaagtttccatgattatcaatgtgattaacaatctagaataacctaaaaggccctactaattactaatggagtactaattaaaaatcacgaaaaagttgttaattggatgcaatctttattgtttagatgaagagagaagcatctttgctttactctccatccacctatcttctcgcaccgaccattaaatttcattttcaacttatacaatactttcaacatacttatgatttagtttgttgaattgtaatatatatttgatatatataatttaaataagagagccaagaaaaatgaaacatgcctgagaagtgacatgaagaaagaagagtcgtcgaagagtgattataggttggtctttgatagacattaatctgatggagattataccaattggcatcaaaacacccatcgctgcccaaagcataaagccatgcactttgatttcgtacacaagctttggatttagtttctgttcaagaaaaataaaaataagagcttcataccaatatatattcagagtttttgattaaagttattaacacgcaggcattttatacagagagtaggaaaaaaaaactataacctttaagcatcatggaataataatatgtacatgacttacatacattataatcatgcgatgataaataaactcaataggttataagatcagaaacaaaggaaatgcctggagcttcattgtaaagatttatcagctatatcaatgagattatgaagagtttgagattattagattttaattaggataagcgagagagaaagaagagcatacgaacctcggagataggagaagtttcgactggaccattgacatcaatggccaagcttctggtgttttcttgggaggagcataggggaaggaggaggaagaggagagagactaagagttgatgatgaatctccatgacttcatgtggtttgaagttgaaacaataaatacaaagtttagaattgatgataatcaattcatgagttcatttcataagtataactgttaaagtttgtgtgtatctagctctttgtaaagaattggatgacggtatatatggaacttgaatacttgatccactagtttcttagctatagatagaagaagagaaaagaaaagaaaagttttagaatttgcttttagagtgtaaagaaatgtgataaaaagaaaaaaaaaaaaagttaagctcgcaactttgttatataatatggttttgcatggaggttgatggtttattttactagtatctctgaatttaaatgaagaaaagcaagtggaggaatgggcaatcgatttgatataacgaacttcatttttgtcaatcttaattagatgttaataatgatgttttatatctaaaaaggactatatatatataatttgagtattgaatttaattaatgaatgtaagaaaaaacagaagaatattcaagtggatgtcactatctctgcgactctacagcacttttggttttctatgaaaaaaaaaagaagaaactgaaactgaaaattccttaaggtcagattcatccaaaagtagaattttaatggacttttatgttttgtggaagaatgtcagattttgcaagggaaagtgagtcatggcaggttgcactagctcatagaccactaacaatatgttactgtcaacaaacatcatgatttcactatg

SEQ ID NO: 12125 - DNA, 3000 bp, Unknown
  misc_feature (1)..( 3000): cDNA_ID_2708360_gDNA_ID_2214532_Annot_ID_134309 3000 nt of promoter + ATG
ccacaaacgttgacaacttgtgtgagtttttgcaatgatgagaggtgctgctcccaccggagtagtatcggtcatggttttaatgatacttgtgttgttaaaacaaatagagagtgctagtgcgaatggttcatcattagggctaccacctagaaagttttgtaatatttatcaaggaagttgggtctatgacaaatcttaccctctctatgattccaagaattgccctttcatcgagagacagtttaactgcaagtccaatggtcgccctgacagcgagtacctcaagtatcgatggcaaccttccggttgcaatctccccaggtgattccatcttttctttatggtatttataacgtttttcgatatgtagatctagtgcgttttaacttttaaggcatgtaactagtcataggtgaattgctatgagtaccactatacttcaggacgacttgggcatcaactagcattgtatcggaaaatttcattttcaaaaacgtctttagtatttcttgagggggattaataggtttttaattaggatttattattggattcaaatccccttttatgtcgcatataagttcatatgtaactatgtaagaatgttatagaatttagtaaccgaagcagctggtacataaatccataactatcatttattggaataaaactgttacaaagacaataagtcacaaaatgttacaaattaacggaagtacccaaccattttgtggtaaattattaaacgtgaatattttctcctatgaatgatatagaagtgttaaattgattaatgatgaatggtgcagattcaacggcttagattttctgggaaggataatgaaagggaagaaactgatgttcgtaggagattcactgagtctaaaccaatggcaatctctcacgtgtttgctccacaacgccgcaccaaaagccaattccacatccacacgttccccttctggcctctccgtcttctcattccccgtaacgttttctaactttatcaaactcgttccggtattgatccggtttaataattctggttcggttcgtatttaaatgcatgcaatgcaggcttacaattcttcgattatgttttcaagaaacgcgtttcttgtggatatagtcggagccccaccgaagcgagtgatgaagcttgactcaatctcgagtggttcgttgtggaaaaccgcagacgttttggtcttcaactcttggcattggtggcttcacacagaccgaaaacaaccgtaaaatcatctttatgtcgtcaaacatattttgctatggactatggacttattagtatctaactaatgtaatcatttggggttgcagatgggacgcaattatgtccgggaatgtaacggttaaagacatggaccggttagtggcatatgagaaagcaatgatgacttgggctaagtggattgatcaaaatattgatccttccaaaaccaaagtcttcttccaaggtatttctccggaccatggccggtaagttctacctctatataacttcttttttattcgatacatacattaaatcaacgataaaaacttaacacgattgatatatgttggattagtctataagttttcgttagaaccaaataatttcatgttgatattgttaacaataatggtacataatgttacagggcaagggaatggtcgaaacaaggtggcaaaggcagttgcataggagaaacaaagccgattatgggatcgagttacctggctgggccgcacgcagccgagatggtggtggcgaaagtgataaagacgatgaagaatcaggcgcggttaatggatgtgacattgatgtctcagctaaggaaagatggacatccttcagtatacggttttggcggtcacagaatggcggattgtagccattggtgtctctctggagtcccggatagctggaaccagctcttgtattctgagctgtttcattcttaaaattttgatggttttgacacaaaactaaattcattatatgatttatacatttatttatgacctaaccatgtttgtgttgttttacacatttattttatgtcataaacatgtttatttagaatttcaaattcatttgtcaaccaaaatgtttaaatgagaacaagattctttgactggtcgaacaatttataagagaagaatttgcaagaatataaccttatgatctcgttataattgaatggactaaatatgtgtcctgaatctctaagtgagagattagaggaagaccaaaactagaagtaaaccttattccacgagaggggataactagcgtagcttatataataactttgtacaatgatttggggttaagttatttttggattatgctaaatcaaaatctaatatagtggtgcaagccccttgacttgggtcaatgattcaaaagcttatacaaaaaaaaaaacgaaaaaactaatagtaaaacattactttagaaaaaagttactaatcaatatttttttaaaaatttcagattactttataagttactctatactcatagactcatagtgagatatagttctatttttacatggatgaattggatcgaatccatttatctacattaatgtatttaactaatgcagaacttaagccttttatcggaaaaaacaaaaacaaaactaatgcagattacagaactatagatttaaaaataaaaataattcgattttttccttattattatgctggtttgcccaaaaataaaggtccaagtaaaactgaaattgatctggtcataaaaattggggctttagtaaaaaaaaaaaaaaaaaaaaaaacatctgtctctttcacttcacgtttgcgactgtgtcgtcgtccacctccggatctcatcggcgtttcatcataattatctgtccatctattcaccgtacgactccgttttaggaatctgtggatgtcaatttgagagaaaagactgtcttcattacaacacatttgggacaacaaggatcactc

SEQ ID NO: 12126 - DNA, 3000 bp, Unknown
  misc_feature (1)..( 3000): cDNA_ID_2708354_gDNA_ID_2214532_Annot_ID_134311 3000 nt of promoter + ATG
acatgaaactccctctccttcaaattaaaagcctggtctaccatgcattatagctaagtaactatcaccagaattttaaagcgaaggagacgaaccaggtatcagcaatggcagagaatttggcaagttcatcttcattcaaagatgttgttgacgatgtgcttcggcttttattagaagctttgccttcaagcgtttgtattttcggatgcgaagaagaaaaagatgcagccgaagcatcagtgtctgaagtcgagaatagccgctggtgaagtaaacgcgacggaggtattattggtgaagaagataatcgacgagcagagagaagaagtctttgcagctgattcacccgtaccgacgccaacattttcgaaagagaaagcgatcacgagtttcggaaactgcggtcggaagttactgacgtcggattcgtcgtcggcgaaattgaagaagacaagtgagtgagggcaaaagtggaatgacgaattctcgaaggatgtaattttaacgggctacatattaaactatatgggcctataaactatagtaaggcatattaaaaatttagattgatgataatcagtaaaacaattagagaaaaagaaatttagattttagggttaaagttatacgctaattttcacgattgagaatttagagttgagggtttctattttaggttttagtgtatttctttttattaatttctaaaatctattttcctactttcggtataaaattttggggctattacgagaatgagtattttctaacccaaaaactaaaaattggacatttttacaatggacttatggggaaaggtactttggtgagttgggttgacgaaattacccctgccctacaatttcactcaatcaaaagccatcttcttgagtcatcttctccgacaactcacggcatctaaatgttggttctgataaactcaaaaaatcaattaaaagttttttaatggaataatattaaaccctaaggagataatttatagggaacccaaagatttcaattaaaaaaataatcaaatcaattgaggaaattagctcttaaaattttcgtttgaatcaattgagcagattagctctcaatcagaattcgtttgaatcccaaaattcgttcgattcgagaaacccagaattcgtttgataatctcgtcattatcaatctctcaaatttaagaaataagcttagatttacctaattcatttgaatcaagctcgaaacccagaattcgtttcaaattcgcgatcttatctcaccacattctcttgcttctcagcctcaccaacccttctctttacagtttgatcggacttttatagagaaaatgatgaaaattattaatgagattaggttgtcaacgtctctgcaacaatgaaatcggaaaagaaaaaagattttgcaataaaattttagaaaactgtgaaaggtgtgaagggtgaaaacgtcaaacgacgaaaatataaatacctaaatctataagccatatgagatgtacctattttcacaaaaacatagacttaattgtaccaatcccataattgatccataaaattttagtatattttataatttttccataaaatgagttcattaataggatcgcacaaagttcaaaagagtagttggatttggatatgttggtatcagtttgtttcactttcagcttgtagtatttttctaacaaaggtcccacgatcaaatgagaaatctcattcttgtatataatcattataatttaaaagatccaggtaggctttcattatagtgtgtatataaatatatcacatcggcacatacaaaaactaatatattctggatacacaaaatattagagagcaaagacattggtaataaatcttatttgaaaatttgatatggcgtgtccacaaaatctttcttcttactagagattagcgatccacaacaattagttcaaagattagcgatcccctaattcattttgattgtgtttggaagcgtggagagaaaaattgtattcgaagcattaaattattttcttgccaatagattatgagttaccacttattaccaattgattttgagttgaaattccttataaaatttgatttaagctttagatgagatgtgtgtttgtgtctacggtgcactcgaaatcagaatatattcatttctaccatcgttcatgatagctcgggcattcgaactcttaatgccctaaaaatttattttcttcatctatttattatgttggatttagtgtgttcgatgtgttttgaatgagcgatacacatgtgtaccatcatttacggaaacttgaacgtttggagtgattgattaggtaagaatcctagaacaaaatgactactacaagtaacttttttgcaaaaaccttattttatgtatttcatcttaatactaataacaacttgacttttgttctaccttttcaatttcttattcactacaattttattacaccacactaatcacaagattcacaactaatggtgtatgaaccgttgtttgtgcttcaaactttgcagcgaatattcaaactttttatctatagaaaaagaagagtgtgggggcattaaaaggagctgtctcatagttggtaatgtcaattaagaagctggcaatacaatacatgtaggacaattcaatcatcgacccatttgaatagataatgcaacccaattatttcaccttattacaaagaaaaaaatacaccccaaaatatctcatcaataagcatattatactcatgatgacttttgttaattataaaaactaatgatgctaataaccaaaatcaagagttgataaaggaagtcacgtttggagattctgtctatagtgtttcgctggaggcgttgaaacagccctctttaacagctcacttcgtttcacattcctaaattcctctcaatcttcttcttacttaacttattatataagtctctgtttctctctgacaaaaatattccaccacaaaaaaaa

SEQ ID NO: 12127 - DNA, 3000 bp, Unknown
  misc_feature (1)..( 3000): cDNA_ID_3023988_gDNA_ID_2214532_Annot_ID_134313 3000 nt of promoter + ATG
gattctttggggatttgaacttaggttgtgtgttaagtatgctcagaagaaacatttgaaatcactttcttgataagcctcttgcgttgttatgcactgcttaattatgttaaatccttcttattccacaggcatctttcatgaaaccaggtcataatcatcacgccatggaatcgtgaaacccacatggttatctgagacttgcgccaacaaactcctatgttctgctttgcttgcacctccttctttgccacgattcctgatcatgtaaactgttcatagatcatttattcctatggttattttggaatggacatcctttgttcgattctatttcctccacttcaaatttttgacacagggccaaaccatattacttgcatcttttgatgtttagagtccataacctcaaagtttccaggtgttttctcggtactgttagtaagagaccatgtccatcagtgtttctaatgggtttctaatctaaaatcctaaagaataaaagtccaaaaataaaggaaaacccaataaaattgttaggatcgttcctattttaggatttttaggattttctgaagtgtttagaaacagtgacgtggctagaaatgataggatgaaaatttagacaaaaaaaacaaaaaagaaaaaagcgtgtttctctttcctcttgtcctttctcttttcttttggttctccgacgaaaattaggtgattccaatcgatccctttcgattacaaacttcggcgtatcgaccatgaaatcgggagacaagagccacatgtactcaattttcaaccgctatgtactcaattttcaaccgccgggatgatgatcgacgacgaggttgttcactaaattgattcttcgaaccaaatcgaaaggagtggcaaaaagcttcagaaaagagtagggtggaggctgcttggattaaagagaagtatccagatagaattccggtgagtgtctctcttgtcattgatcgatcatacaataacttgcttaactttcacaacaattatagccttttctctacgcattgtttggaattgtggtgttctctacgcattgttttaaacttctgttgtttaagaaattatagaatatctgcataaagtatgttaaggtttatacgtttattcacatgaacatgaccatgcttctgctatcgaagaagaattgcaattctcatggaaaagcctctgttttttatagtgcttagtaagtatagagactagtaactagaatattattagattggtttatgcatttcttttatggcttttgatgaacaattggtccatatgccattattttcggttatatggtccttatgtgacacattactgttaagtgtttctttctcatctaaacgttgaagagtagtttgattgttgtattgaccgttaagcatttgtactcttactgaaatcttgagagctgtcattttcaggtgtatgtagaattgcagactacattctttaagttcttgagcttggaacaatacttttctcactctacttgtttctgcaattaaatggtaataacaatttctaatgtcagttaaaaatctttcaagttgatttttgtttagctttttctattgaggttcaaacttgtaagcacgcgattgaaaccaactgtagaatgacagatcttgtttgttattctgtctttatgttactttgtgtcatcttctatatacttttacataccttacagggccgcttagtgatcttgaaatggctttaaagaacaaacttatcactgacatgttgtcaaatgcttgaatggtgccttttatgtcttgaaagttagtctttttgtgtcggttaatgcttcttcacttgtttttgttctgttcggttatgaatcttattatcttaagttgtttgtgttctgttctaaattggtttcattgtgctctgttctaattggtttgtgttcgtgttcaaacttcaatagattggtttgtgttctgttctaaatgaatttcaacttcgttttaaggatgatgtccctgtcgagatgcaagagttcaaggaagcataaatagcaagcacatgcaagtgttgttctgttctgtgtataagtgtataggctatggtcgtgtgaagatgcacttgagtttgtgtgtcgaattttgtgagtgtatcaagttttgagagcgtagagtctgtgtcaagttttgagagtcaaatgtatcccaaacactttcacatttttttcaaaatttttttttagttttattagaaactcacttaaggatttttttaatggaccaaaaatttttcaaaaactctacaaaatctctaaactacaaaaatatcaaaattaattaataaaaaatacatagaaaccttacttagaaactaaccaatgtggttgctctgagagtactacaaaaataaaataaaatgtgtaatatacaaattgcaagagaatacataacataacagagaaattcatatgtacagtaattgaaaatcgtcgagtaaaccaattttggtttggataccaattcagtttttggttagattcgggtaattaaattaaaccactcaatgaaggacacgtaagttcttcacgaaccacatctgttcccttaaaaaaaaatctccaagtcccttgcactattctcctctctttctctccatcctccatatttgcagagctcgagattctccttccctatacaactctcatctgtaatcgatacaggtttgtcttctacctcttctctttggttagattcttttataatctccgtcgctgcataactctgactgggttttcttcggcaaattctgatttcgtcgctttgtgttagttttagttccttgatttctaattcactgaattaagaactcgaagtatgtttactgttcctttgatctgagggttaggttcttgtacttgtaagaaacttgcttgttctgtctcatcgttcatgggatttgatatatcatctaattaatttttcttctttgatgaattttcag

SEQ ID NO: 12128 - DNA, 3000 bp, Unknown
  misc_feature (1)..( 3000): cDNA_ID_2708350_gDNA_ID_2214532_Annot_ID_134315 3000 nt of promoter + ATG
taagaagttcgacaatgatgtttcacttgaaataatagcaatgagaacacctggatttagcggagcagatctcgctaacctcttgaatgaggctgctatattggccggaaggcgagcacggacatcgatatcatctaaagagattgatgactccattgatagaatcgttgctggcatggaaggaacagtgatgaccgatggcaagagcaaaagcttggtagcttaccatgaagttggtcatgcagtgtgtgggtaagtgagaaacatattaaaagcctgtctgtatattattactatcaaaaacttactttaaagttataaactttggttttttacagaacattgactccaggacatgatgctgtgcaaaaggtaacgttgataccaagaggccaagcaagaggtctgacttggttcattccatcagatgacccgacactcatctccaagcagcaactctttgcaagaattgttggtggactcggtggtagggccgctgaagaaatcatctttggtgattccgaggtgactactggcgcagttggtgacttacaacagatcaccggtttggctagacaggtacgcgacacgttcagcttcacattagttatgctggagcctgatgataagtttgatcttttactagttgatgaaactgagtgtttgagactgttgaatatttttactttgcagatggtaacaacatttggaatgtctgatattggaccatggtctttgatggattcttcggcacaaagcgatgtcatcatgagaatgatggcaagaaactccatgtctgagaagcttgcagaagacattgattctgcggtgaagaaactatcagacagtgcatatgagatagctctaagccacataaagaacaatcgtgaagccatggataagctcgttgaagtgcttctcgagaaagaaactattggcggtgacgaattcagggcaattctttccgagtttactgagatccccccggaaaaccgagttccttcttcaacaacgacaactccagcatcagcaccaacaccagctgctgtctaagtaatcaatctgtatacttgtgatacttataatttttctgtaaatttatcttcaaacttacactctagaaatgtgatactatctcaaaatttagtaacaagtaaatgtttaaaaaattgaatttgtaggcttgtttatgatattgtccagatttgcaacactcaaaccgaaattcaaaagtattttcaagtagcacaagcagaacaccaaaaactgttatggaatcatgttctttatacttacaaacttatgtacatttgcttacaattaacctcaaaccattagtccctaatgcttcagagtctttaatccaacaccatcatcatctctctgttcaatgaacatccaagaatagtagcattccagagctaagcagaaaacctgaaaccaaaatattctaaaagatcaatgtttgattccaaatcagtaaatagaaaccgtaaagaagcaacatttatcaaaccttaaaggaaacgttacgcattaaatggcttcacgccacttgcaattccatcaccagctctctcgttctgctctttcttcacccacaccattgtagaagaagaagctcctctcggcattggccgattacgatatctccatttggtttgtgtcttgagagttttggcttctcctctattgatagagaagttctcaaactgtgtttctatggccattgatttggtaatctctttagatttggtcgctttcatccaataaactggaaccacatctttcaccggagtattattctccgtcacgacggactcaggcggcacgattgatgatacacaaccgcaatcgatgacatcctcaaccacagctccatcttgatttttattcgtcttgctattatatcgtttcctccaagctcccttattcttcttcttcttcttcttcggtaatccatccgccgcatcttcacctccaccgctctcgatcgccaccgtgacttccggtttctccttctcaacgaatcgtgcttctccgccgtctatagattccttttttctcccaaaatgcttccgattacttcgattcatacgcttctcctcctccgctttcttcagatcttcttcctctatctttttctcttcctcagcctgtagtttccgtcgtctctcttcttcttcctttcgcttcttctctttctcattgagccaacgctcctggagctgaaggatgctgatgtagttagccggaatcagaggaacagtctttcttttgccgtatgtgttcttctcctccattgaaatcatttccttcacacgcttcacaaacaaacctcgtcgaagctgaaatagtgaaaagcgtactgtagtaataaaatgctgaaaggaaaagtaaaaaaagagaggtcctacgcaatagcattaactttttataccgcacttccttagaggcccattggctggcccgtaacttcctttacttttttgagattttctgataattttgttgtaaagttcacaaaacataattaagttggaagcacttaagttcacaaaacattctaatgaaatcatcttgttataattgactcaagttacaaataatatgataaaacagtcaaaattaaaaaattaactaccataaacatgtaagattctaaaataaatataaatgttttattactagattcaggtgttggaagactaactaaaagggaaataaatcagacacatagagccaagcaacatttattactttttatagtatttatcattagagtaaagcttattttattaaaatcaaaccttatctctcacacacacacagaccaaggccattttctaagcaacttgtgcgactctccttcgtcctcatctgccaaaaacttcgtacgagtcgctacttctctctctatatataaactccttaccactctctttttctgattttttgacgttaagagatagaaacagagagagatagagagatagagtt

SEQ ID NO: 12129 - DNA, 3000 bp, Unknown
  misc_feature (1)..( 3000): cDNA_ID_1807538_gDNA_ID_2214532_Annot_ID_134317 3000 nt of promoter + ATG
aactaaagtttacagaaactcttaacaaaataaatatcagaaattctggaaaatatattttcatacaacttattggtaatgaaaataaaactatgaagtaaatatagttttagtttgggccaaagagcttcagttctaagcctatggcccatttgtaaggtgattctcaaacacatgtgatatagtttttttcatcaatctttatttaattttagtccgtaaaaaactaattgtgattctatataagcaactacagtataatttagattaattattatttcaaacatttaaaattctccatgtagtagaacattttatttgattttggggtaccatgatatggtatcctttactataagctactatatatgaagcaacatacacgttaagataattcattatttaatcaattaaaagataagagaaaccggtcaacaatagaatcgttttacggttctgcttgctcagttctcctactatattactacataataacgttggcattccactgaaaaaacattaggagaatagaaaaacaaaatgagaagaaggattatataagagagacaggccaaagaatgtgacgtatattattgtcgtcatctcatttatttctatgtgtagttattgcttatccgtggatgcttagtccacttaagttttataggattccagtgctatgctagcttgattttcaacagtacacacacaaccatatttggatttaaaaaaggatagtaatattttggtctataatttataacttgaattcaaattgtatatatgattagtttgattttgaacatcttataagattcacaaaacccaatttacaaagaaaataatcagtgatacatttgaaaagaaaaacattccagataaatgttaattaaaggctcggactacgaaagatattttgatgtaataaagtggaccaccagaccagatacgtcggtcggtcatattcgatactagtaaatgtttttttctcaatagtgcaacttacttaccatcacgaattacgtacgtcaataaataccaaactaattaatgttaagtaaccgatgaccaccccctcacatgattcacttactgaccaaagaattgagatctgatgactctgtattaactacccccaagtctttgcaatttcgtaaaatcaaaatagagaaaaataaaggatattttgttttatagcgtcagtagatcttgactaatttacaaaaaaacgttacagagacaaatgagtttttaattatttttatcaaacctttgactcgtatcatttgctaaaacgaagaagtgtaaagtaacgtatgattagttggaaaaataagtaacgtatcattatctacactccaaatgttagaaaaaggttcctttctttcttgttttggtcactactgtctattttatttgtttataagtatatattttctgacaacctagcagcagatttattcttttattttgttccccactactatatagtatatactgtactctctccttttattctttaataattattttttgttatttgttttttatcttactcttgttagttggattaatttgttcacatatttgatttatcggaagttggatttatcaataataccaatgtttgtttgtcaaccaaaactattaaattaaaagatgattcattgattgacatccaatttgaaggaaaacaaatatacaaaatctttgatgaaaatatgttatatatatatataaatataaatatacatcttattttaataatatcgaattaagaaaaaaatataaagtctgaagaaatgtatagatctcactgccaaaaccttacctttagagattagtatatacttatcgtcccactcccatcttgtatcatagaaaagttcaaatgcaccaccatgtggtaacttatccatatcattcattgtttttagcaactgttcttaattaatcatagaaaatctataaattttccaactaattggtatactatttaatgtcttaaattatttcgacatataaatatttgcatgcctactacattctccctattaatgattacatgaagcacatgaaatggacgtaaaagaaaaaaaattatgttgatagagacataaggaaaggcaactagtgtgaacaaacaaaaaaagaagaaaaaataaatttccattttaagcattactaaattaatcaacatgcattataaaaacaattatttcactaatcaattttatatataaaaaaaatcaaagaaagggacaaatcaaaatgacgcagcctaaagagaacgaagtaggaagaatatgacaacctcacatatattcgttttcaccttcctctcttcattactatttttttctcttctctaatctcttcttctttctctatctgcaatcccgcgttttctcactggtatttcacttcctctctctgtatatgtgtatctatatatctgtgtgtatagttcgtcttcttcatcttcctctatttttactctgtttcttttaaaagaaacacaatcttgagctggttttttccaattctatgttcttctgcttctaattcttatacacaataagtacgaatacgtatctgtgtatacagatttagattttgattggaaaagaaaaaaaaaaaaattcaatatttttctttgcgtacataaatgttctcacgcgtatacatttgaatctgtatttcttctgtgttcttaactattgtggggttttagataagttttctaagaagcttgtgaaaattccatcaaggcggctaaagaaagactttatctctctctttcaagtttttggattttgaatctgatggctctctgacacattagtgaatagtgataatcttgacttaagagttttgacatggaagaacaaagctagttgaagaggtttattatgaaaattacatgatgtttgaagttattgcaagtcttcttaatgatgattttgattatgcagaatgttaatggggagcttaatgatg

SEQ ID NO: 12130 - DNA, 3000 bp, Unknown
  misc_feature (1)..( 3000): cDNA_ID_2711515_gDNA_ID_2214532_Annot_ID_134319 3000 nt of promoter + ATG
gaatcaagccctacacaccagggatcagaacttgcggaaagggtgaagttgctttcttttgaatctcaaggtgaagctttgagtaaggactcccctagaagtgttgaacaggattgctctccaggtcaaagagcatcacagcatctttgggatactggaatactctctgaacctattcctaatggtttctactcagttgttccggtgagcttttcagattttttttatttctttgtcatttggttagtaggaagatgcagtttctgaaatttgaaatcttgctccaggataagagagtaaaggagctatataatagactacctactccgagtgagcttcatgctttgggagaggaaggtgtcagaattgaagttattcttgttgattttcaaaaagataagaagctcgcaatgcttaaacagttgatcactacacttgtcagcggcagcggcacaaatcctgctttggtgattaagaaaatagcaggaacggtaggatttctgtaatgactcttccctctttgtcacagttccgcattgcatattctcctagctcgacatttatttctttaaccgcgtccattgttatgttctattgcactctctgccagtgacttactctattacctcaatttcggttcttaaaaaaaagaaacgggagttgatgtcctcatgcaatcttttcagcactgacttgtcctatactcacaaaattcattctcctcaaacaggtctctgacttttacaaacgtccaacactagaaagcccttcaaaacttgctctagaggaaaatgcgttcttgtttgaaaaccatggtgctcagttgcttggccagattaagcgtggttgctgtcgagctcgggcaattttgttcaaagttctagctgatactgtaggacttgaaagtcggctggtggtggtaagcctcagtttctcatatttcaatttttttctttacctacatttatgatctagatgattggatcttatgctatttgtctcttacaaatcaacttggtttcccttttgattcacatgtgcagggtttgcctagtgatgggactgtgaattgcatggactctaacaaacacatgtctgttatagttgtgctgaattccgttgaactactagtcgatcttattcggtttcctggtcagttggtaccgcgatcagccaaggcaattttcatgtcacacatctcgcctgctggagagagtgattctgcagaaaacgactcttgtgactcacctttggagccaaatagtcctttatatgagagaagagatcctgagaggtcggcttccgttgtgtgatttttctttctaaagcatattacagtaagatcattctaaaacaactcttgtgataagcgtcccctagagtgatatcgtttcctctgctacagtacagaaaaagatgaaaatcttcaattttatcggaagttagaaggatatccaaatgcatctggttcatcactgcgtagtttgatgctcagaccttctacagctattgaaaggaaattgaggtaaatattacatatatatttctgacaagttgtataatggaatcagtacaatgattggtataatagaaatgtgcttttcttccttcagcaacacctcgcatagtgaaccaaatgttgctactgtattctggaggcgtagccgcagaaaagtaattgctgaacagagaacagctagctcaaggtttttccgtaccctttctggcttgtattatagttaatgaaaaagaaaataatacattggcacgacctcttgttgtctttagatacagtaatgagatggaacatataaaattatgtttctcttctttttgctgattctatatttaaatctcttgattagcgattctgttatctgaagtgtgcctttcaagagctaccctttttttctctatacctaactgatgatagttggccatttgttacatttgcagcccagaacacccatctatgcgacgtggacgatcaatgttgagcactggtaggaattcttttagggattacactggtgaagcatcatctccttcaaggtaactcatttttacattagtgcatgcgaaaattttcagtatgccgctcctatcatatacattccagtattagttaagttgcttatacaagtctgcatgtatatatttgattggctgtgcaagcaattttttaatattctctagctttcaaacagttcatccacatcagaaattcgtaaaactagacggcgaagttttaggatcacaccagaaattggcgatgacattgcaaggttggtattctcatccatgtgcattgtttctactttcatcgtttagcagtttttttctatcattttcaccttgcatttaaagagctctatattggagtttattctgtaaatctagttggtaaggtatttttaaaatctacaatcatctgagcagctgctagatcacatgaaagtatggcatgagtcatctcgaatgcaaaactgctatctccaaacttctagatgcttaggttaggtgtctgtaagatggttatatgataaacatggaactatatatttactttgatagtcatagaagctgtaagccatttgatggtactccttttaattttgtaataatgatactgagattcgtgagaactaattaagaacagtgattttgtgatttgcttgtgtattgactctgatgttacaaattattgaagcgctgtacgagaaatgtatgagaaatcaaagcaaaaccgtctcttgcagggtcgagaggatgaaaacagctcagttatcgataacaacgtaagttttggctctgttagtaagagtgattgttttgttgtgttagttcctttctcattgtataaccagtctaaaagttctgagtttcttctgaagttcactgctctattagctcttacctctaaatttcttgtgatttttgtttgtgctttctcaggtgtctggtctccatcttgatgatgagttaaattctaagaagaca

SEQ ID NO: 12131 - DNA, 3000 bp, Unknown
  misc_feature (1)..( 3000): cDNA_ID_2711511_gDNA_ID_2214532_Annot_ID_184982 3000 nt of promoter + ATG
tttatcaagtaatttgcggagacatgtctgatattgttatctttatttacttttgtcagataattcgtgacttgtaatctatgtatttgcagttgtactatttttgggtgcatgcacaaaacctccacgcttatccatgatcacggagtacatggagctgggatcgttgtattatttgatccacatgagtggtcagaagaagaaacttagctggcacagaaggctcaggatgcttagagacatctgcaggtatttaagctaccctgcatagctcccttgattatatgttttaagctacatatgcttatctcatgctgttttgtatttcttatgggatgcataaggggtttgatgtgcatacaccggatgaagatagtccaccgcgacctaaagagtgccaactgtctagtggacaaacattggacagtcaagatctgtgattttgggctgtcaagaataatgactgatgaaaacatgaaggacacttcatctgctgggacaccagagtggatggctccagagctcattcgcaacaggccttttacagagaaatgtgatatctttagtcttggggtcataatgtgggaactttcaactttacgtaaaccatgggaaggagttccacctgagaaggtataatatgctgtgccatgatttctctagagatgtgatatctttagtcttgtgattacacttaatgaaatttgcttcttaggttgtctttgctgttgcacatgaagggtcacgtttggagattcctgatggtccactcagcaaactaattgcaggtttagtgttgttgaataccatgtttcttgaacttttttgtttattctcttatatttctcaactgcttcagtctgagttaaagttaaccacaatttctgtgcagattgttgggcagagcctgaagaacgcccaaattgtgaagagatacttagaggcttactcgattgtgagtacacactgtgctaacaacacttctctttcggggggatatgagccggaagatgttttagctcagaaaacatcccagcttcttttaaatctcggctcttaaattatcaacctgagtggcataattttttaagatcatgagaacttagaggctataatgagacaagttcatagttcagttttgatagctgtggaacaggcagagacaccaaatgtaggatacaaacaagcatgtctattaagctgccactggtgtgattcatgttctcacaggcaatacttcttttgttggctattgaagagcattttggtctatcttaagaaaatatataatacacactattctttgttgggagaataaatagctcttcgatttctcttgtcttcatgacttcatccattattctcttgtgtctagccactttctttcttcttttctttcgtgtcaagcattcgataatccgactttatttatagactcatatcatatcccaattaaattttatgaagaagagtttttttttttctttttctgtcatataactttataaacttataaacgtatatgtggattataaactaaaaacaaaatatttttattacaaattatctgcatcatgttaagaaatttgaatcaaaatttattttgttgttatgcattagaaaaatctgagatgatcgggtcaaactatctaagactatactataatgtaaacgagattggtcggcaatcagctctagtctgtagtagtgtcggaagacgtgaacccaagtcaaaagaatatttataactatttagaccaattaagaggaaaaattagcctttattttaaaattataattttgtgtccaatgtttttttttttaaattatatctatacgtgaaattacttatcttaaaaaggtgattacaactaatcttcaattttctagtgcaacagtatttttaaattttggaaaaatctttggcagcggagaaacagatcgtgactttttatttttaataataaaaccattttatgccttttcatattccgcttcaaaacttttcttttgttatttttttttccaggaaagatttagatttgtccatatggtttcagtcaaacgaataataaaaaatagattagaatagaggacccatttaatttgtagaatagatataaaaatgaaatcaaatcttagagggctccacgttaatttgattgatagttaaattccaatgcactcatacttaatcattagggggctaatgggggtgtaaaagcacagtttggttttatataatatactctatattatacttaaatctcttgggttagataaggacttacggtcatacatatataatttcttttacttggatgattggatccattaattccctatacttttatcaaaaaaattataccaaaccaaatttcaaatcactcaagtgaaaatgttttgtacattttaaaacgaatgtagtaatgtacaatgtgtcccacatttcccattggaaccctgaagcggtaaagcctataaatattcgtgataaaaagtaattatattctcaactaaaattactatatattgtaatattcatatgggcatttttattcgtcatgtaaatctttgtgctttgtttattcgcattttacatagttgtttctgattacatcatgataagcactttatataataaggccttacagttgttacataaatacaacgaaatgataacttttttaatattggataaatataaagtctctcataagataccgttgaccataattaaagtccttaatgatagagacaaaatttataaattcaaacttggcttctctccggtgaagtcctcctctctgtttctatccaacttcttctctctttctctataaacttcctcatccgccgcaactgtaaccgtaaccgccatcatccgccgcaatttcctacaacatttccatgtgctctttcttgttgtagaagattgttcttcacatgcatcctttctgttgtgtctccgatcactccccttccacgccgtcgttctcc

SEQ ID NO: 12132 - DNA, 3000 bp, Unknown
  misc_feature (1)..( 3000): cDNA_ID_3023974_gDNA_ID_2214532_Annot_ID_184981 3000 nt of promoter + ATG
aaatcaaactaatcatatatacaatttgaattcaagttataaattatagaccaaaatattactatccttttttaaatccaaatatggttgtgtgtgtactgttgaaaatcaagctagcatagcactggaatcctataaaacttaagtggactaagcatccacggataagcaataactacacatagaaataaatgagatgacgacaataatatacgtcacattctttggcctgtctctcttatataatccttcttctcattttgtttttctattctcctaatgttttttcagtggaatgccaacgttattatgtagtaatatagtaggagaactgagcaagcagaaccgtaaaacgattctattgttgaccggtttctcttatcttttaattgattaaataatgaattatcttaacgtgtatgttgcttcatatatagtagcttatagtaaaggataccatatcatggtaccccaaaatcaaataaaatgttctactacatggagaattttaaatgtttgaaataataattaatctaaattatactgtagttgcttatatagaatcacaattagttttttacggactaaaattaaataaagattgatgaaaaaaactatatcacatgtgtttgagaatcaccttacaaatgggccataggcttagaactgaagctctttggcccaaactaaaactatatttacttcatagttttattttcattaccaataagttgtatgaaaatatattttccagaatttctgatatttattttgttaagagtttctgtaaactttagttagtttgaagaaaataggtacaagttcaaaattttctaacaaaaaacagagcttttcaaaaatttacaaagctttcgatatatattttttttttttaggtttcgatattttgttttgttgttgttgttgtaagttgtagataattttggataataataaacatgttatcggagacttgaatgttaattacgatagtatgagaaacactacttcttttttttttggccaaaacatgagaaacattacttaaaaaagtatttccattcaacatcttttcaaaaaaatatgagaaacattacttaaaaaagtattgggaaccaccgaaaaatttaacatttcctcgtcagaaactgtcggttgtgccaaatagctagtgaaaataagaatatacaattcgactactggacaatgaatcataaggtcgagttttacgcaggcagataagatatgcttcttggtagtaactagctaggaaatcgactatggttttctttcagcggtaataacatgaccaaactatctggtcgtatggtttataggtttatgtttggtcgacatggtgtgtgctttacgtgctaaagtgctgacatgactttgtacctatgcaacaagccaacaaatatcttagtggctcaacagtccaagtcttaaaaggagttcacgaaaatggttttctaaaatgcgattccgctggtcaaaagcttgctacggtctgatattttcagaatgctgaatatgtcaccgactcgctttattacattttcgacatgcttatcacgattgtattgggcctattggctgacgaaaaattatttgtaacagtgcaacaaaccactgttatttgatacttttttaaaaaagatacttaggtaggatctatgattctcagctacatttgtgacagattaattaattatcgtataaattactatgtatccaccaaattagtgaagatgaaagaagatatttgtaaaagacgcgtgacgaggtctcatctatatatcacgtgcatcattttgttttatgtcctttgccgacagtgtctgtgtggtccgtcttagtcgtacactcgtacagagacctgtacctttcattttttcactttgtttatttttaggaatctctaactcctactactactactcttatactattattattatccacacatatctatttcataactggtaataacataaatattttagatcttttttttcgatttcactaagaaaagagtacaaacattatgtataaataaaaattaaatatatttaaaagaaactagtaacgtatgaataaataaagtagggtccaataggaggagccattgacttggaagcatatgagacagttgagaggcccaacagcccatcgccagctggatttcccctaaaagtcacgtgacctctctccccatctttcttcactatctccttccttcccacgtgaccttcctctctctctgtccctcgtccttcttcttcttcttcttcttcttcttcttcctcctccttcctcgatagagccttctccgattatgctctgtgtcctcattgttatctccggtacaatcatttctcttccccgatccttttctattccacgaatttcacatctttcgcatttgatcgtctttatattttatcttgttgattcaatcatacggatctgccggagtaaatgccgttgctctcggtcattgaatttgatatctgtaatgtgggtttttattggttttggtgattatgaggtttcattagtgctctcttgttaaagtttgcattttggagatttgagtttggctctttgatgtgagaatgtacattgaactttttgtgttgttgaatgatgaattgtaccttttgtgcggattttttgaggttactctcttgatattaaattctgtgggccaataacgaattgatgacataaagttgtttttactacagagaacagaacagagtcttcttattttgctcattttaaccaatgtcaaacaaaaacctcgttttaatccatgttacactttcagctaacttctctgtctaacaaaggttaacatgtctttctctcatttagtgcagaaacaagagcagatgggtctaattctacaccaatcaaagctttgttctcgatttagaaagcctcttttggggtaaagagatggtgagaaaataagttatacaaattatctggaag

SEQ ID NO: 12133 - DNA, 3000 bp, Unknown; identical to SEQ ID NO: 12128
  misc_feature (1)..( 3000): cDNA_ID_2708350_gDNA_ID_2214532_Annot_ID_184976 3000 nt of promoter + ATG

SEQ ID NO: 12134 - DNA, 3000 bp, Unknown
  misc_feature (1)..( 3000): cDNA_ID_3023988_gDNA_ID_2214532_Annot_ID_184974 3000 nt of promoter + ATG
caatatttaaaaatattttagaccttcattattaaagtttgtatatttatttgcagtggatgcggaattaccttgttgaaaagttgcggtaataattgcattattataaggtaaaaatgtgcatttagaaaaggataaagtaaccaaagatacaactttcggtgtcgcaaagtaatgataagaaaagaataaaattggttcactgtttcttctctttatttgagtattaataaggtacggaatgaggaacacatgattatgagagcaagtgggggcacatatttgttagcaacaacataggaaatgaaaaatagattcatgtctataaatcttcaattattttcaattttatcttagtaaataataagtcaagagtactgatttaagatccctattatccaatactaacaaaatgtgttaaatcgtaagccctaaaaactctatgatatttgttatagacagagtcaaaacaaaagttcttaacctcttatgctacatctttggattctaccaaatcttcttgcactctttaaaaacgtattacaaaaaaaaaaaaaaaaaaaaaaaaactcaaatgagaatgcaggagtggctagagattttactgattcacactcttattgattcatcatctttatcaccacaaagactcagagtaatgaatagaatcatatcatcacaaggatcagatttgatcaaacaaaaactctctcaacacacttccttcttcggcatcaagctatggatcctcatcacagcttctgcctccatagccttcctcttagttctgataatttctgtcctcctctgtttcatatttcacaggagaagatgtagccaagaaccattcagactaagatcaaagctttgtctacctttatcacacattcccttaactaacaaacaacagattccttataaccgttgcggcgacgatatagagagccagagaatctctcaggttggttggtcctctgctcgtctttcctactacacacgcagcttctcctctaccggcagctttggaagcttcaatgtgtttacgttcatggagatcaagaacgtgacagatagttttgcagatgataatgtgattactaaaggagattcttcaacggtgtatcgcggaatcttgatgggtacagtcactgttgctgtcaaacgattccttccaaggtttttacatttttgcttgatgtcctcgtatatcttagaatcttaatattttgatctgagataaagagtaatagcaggtatgaagataaagatttcattacaaaagctgagatgattgcaaatgttagacacaagaatgttgtgagactccttggatactgcatagaaggagatgagaggtatatagatatataacctatgatgtgtgacttacgttaaaattaatttagactcatacttaagtctgtataaattttagggttcttgtatatgaatacgctgagaaaggcgatttgcacgaatggcttcatggatctgcaggaagaaatcggcctctgacttggagaaagaggatgaagatcattcaaggagtagcaaaagggtttgatgatcaaaccacattttggttttcttgtcttcttttatgcatgaatcattctgatggttaattattaagtttatgttctgatcagccttgcgtatattcacgaggacatcgaaccaaagatcactcatcaagacataagaccaagcaagattcttcttgattatcaatggaaccctaagatacttgatgttggattcattggtcacagtgatattccaactttgattccttcacctggtaatatggatgagaaaatcgacgtttattcctttgggaatatgataatggagcttgtctctgggagagtctctgtagaccaaagttcaccacatgtgagagtgtatacacaatacataatttaccaataaaaaccatttttagctaactagaaacactgttgttcttggcaggtttatctagtggactggatcaaagagatggtggcaaatcatatgatagtagatgttcttgatcctagtcttcccgaatttcctacaataaaggaactcaaacggattgtgttgatttccctgcgttgtgttgatcccgagctaaaagagagacctaaaatgggagatgtgattcacatgctccaaccacatgacttgctgctgaataacaatgtaataaaactttttgacattcagtttcttgttccccaagctaaatagttatccttactttgttctttctctgtttccaggcaatacagaaggctcagaagattacccggtcacatgaggtttctgcaataagtatcagacaatgagtcctaagcaagcaataaaatgattgttaatataggatcttctgctttgtattaactaaattaagggttccttttaatttaggtcacagcaggctcagctgtattgattgtgttttgcatcctttccaactttgttatatgacttccctatatatcacatgtgttgctattgatgcaggatagtaatcaggaagataaatttcttgaaccaaatctgtataggaacactgataaaatagaaacaacgattttcacaatcttggtttccaaggaacttgaataacaataaaaactagggatagtataatgaagttacaaatttattactttgacccttcttttacttaaatttccactgttgtttttctttttggaaaattatcttttacaagtttttttgcgtttcattaattctatgttacgaacacaactttttgaccaatttataaaatcggtgagttacaataaccggtagacgagtaaaccgggattttataagtgctctgaagatcaccaaacaatctctcctcacgaagatcttcagcttcaaggacttttaaatcatcgaatctctctgtaagttacgatctccgactgactcttactgggtaaatttcgaaaacttgaaactgggtgtttccgaccgtcgaatcggattcgactagat

SEQ ID NO: 12135 - DNA, 3000 bp, Unknown; identical to SEQ ID NO: 12126
  misc_feature (1)..( 3000): cDNA_ID_2708354_gDNA_ID_2214532_Annot_ID_184971 3000 nt of promoter + ATG

SEQ ID NO: 12136 - DNA, 3000 bp, Unknown; identical to SEQ ID NO: 12125
  misc_feature (1)..( 3000): cDNA_ID_2708360_gDNA_ID_2214532_Annot_ID_184969 3000 nt of promoter + ATG

SEQ ID NO: 12137 - DNA, 3000 bp, Unknown; identical to SEQ ID NO: 12123
  misc_feature (1)..( 3000): cDNA_ID_1014113_gDNA_ID_2214532_Annot_ID_184965 3000 nt of promoter + ATG

SEQ ID NO: 12138 - DNA, 3000 bp, Unknown; identical to SEQ ID NO: 12122
  misc_feature (1)..( 3000): cDNA_ID_2711538_gDNA_ID_2214532_Annot_ID_184964 3000 nt of promoter + ATG

SEQ ID NO: 12139 - DNA, 3000 bp, Unknown
  misc_feature (1)..( 3000): cDNA_ID_3024018_gDNA_ID_2214532_Annot_ID_184959 3000 nt of promoter + ATG
ggagggaaaaatagtttcccgagaaagtgagagagaaagagaatgttggtggtggtggtgggtctgagtctctgtgagtcttttgttttcaaatttgaaaatccccaaatagcttttgcgagagatgtgtgtgtgtgtgtgtgagcttcgattttgaaatggcatcaaatttcgaatttgttattaaaagattcataatttcgtacgtttttacactcgcgggcgcgtgtgatcctacgtggcccaatcctcttcattccttctaataatattttttagctaattacagtatctgtgactgttaatgtgagtagtttctattgaatcttagtgttagattaggacgaattgatgtctaaatgttgatgtttagtgttgaattttcttagattgggtttggtgttagactattctagtattcttgaacattcttatattgaatttagattgtttgttgcacttaaaatgtttgtgaattttttttgaaccgaacttaattgagcatttttttcatttgctaaagagaattgatgtgaagatgttttgtgagcacaatggagtttactgctattaacctatactaagtatcaatagcttttatttgtttgtgaaaaaaaacaatagcttttatttgtcctaggaattatttaatagattaaataacagctatttttctcttatttcttagtgattaaaatatttaaaatacagaccaaaattaattgtttatgttaatatatttactccttaatcctttatattaaaattgtataatgcatgtagttaataaattgttttccaaaattcattcataattttattcctaaattattttggtcaagaaaacacatctttgaataattaaatgcttccttgtatttgataatttcttgatattttaaaataccttctatactatgccaatgttattggttataaataggtttaacattgatcctgaaatatatcataagaaaatcaaaagtgaaataagagatcaaaatgatgaagctcatagttgtctttgttatatccagtttgttgtttgctactcaattttctaatgtaaaaattattattattttcttcatattatgatttatgaattcagagaaataaagtttttttttttatgtgtgtatgtacagggtgatgaattagagagtcaagctcaagcacctgcaatccataaggtatatttaaattataaaatatcaaatactgaataataaataataaatatattacaacaagaatatcaatgttatttttcaaactacataattttaaaatattttattgataacacaaatgtatattattatcgtctccattgatttgcattctaaatttgtttttgttatccaaccaatttcagaatggaggagaaggctcacttaaaccagaaggtaaattgtttaaaagatattatttttatttatatagtaaatgattgatcaaatcacaacttaaataatttaattgttgatttatatttttctgaagaatgtccaaaggcatgtgaatatcgatgttcggcgacatctcacaggaaaccatgtttgtttttttgcaacaaatgttgtaacaaatgtttgtgtgtaccatcgggaacatatggacacaaagaagaatgtccttgctacaataattggacgaccaaagaaggtggaccaaaatgtccatgaaaacaaaaaattgtaaaagcaaaataaaatctatcgttgttatctctcaataaaatctatgtttgtaatccttgtttttcaatatagaatataatatggagttttcataatttcttctattacaaaattaaagttaatgcacaaataaattgaagggacttggaccttttcgtgtaagttctttctttaaatcacgaacaatttagatttatattttcactcttacaaacacaaaacatggatgctctttaactctcatccaaacaaaatgcatttctctctttctttttctaaacatttcacaacaatatcccatattatatctaagatatatgatctttttaaattgaatttatttaggccatgttttaaaatcgtgtttggttagattgacccatgaaatgttgacatattttaacattcctaaatatgactaaaaatgattaaagatatttaataatatatttgctctattaaaaatgattaaataaataataataaaaagtatttccaaataattttttaaaaaacatgtatttataatatctccaaataaaacataatcatgatcagaaaatccaattaaacacatatatccataaaaattaaaatagtttcgtcaattcaatgttaaatcattttcatctaagttaggaatgaatgttttaagtttgacaaagagacgagaaaactttagaaatctcctcccgtttaatgaatcaaaattatagtctttgtactttttggatgatctcctaggcgatgctccagatccggatcggtccacaacagtccatcgtctcacctcgataagtttgacaagatctcattcattctcctggagttggttagcattccaaactaccatttaccatctatacattttcttatacattttgttacttaacctgcacaattatagtagttacgtcactttttagtacttgtaagattttgccactagtttatagtatatacattacatataagtacaatataacattccttactcataagattttgcttatcaactacagacatacatagaagttggaacatttttagagcccaaaggaatgggcctagtatgccgaagcattaatttattttattttcatcaaaaaaaaaaagaaaaaagagaaggcggtttataatgccagcaaactctgcaagggcaaaaacgaaactcatcgaacaaatttcgaggctttgcttcttgaatctcacaagaagccgtacagtttctcagctttctagtgttttctcgggtagaagagagatagagagacagagcaaagcctaataagcgatg

SEQ ID NO: 12140 - DNA, 3000 bp, Unknown; identical to SEQ ID NO: 12131
  misc_feature (1)..( 3000): cDNA_ID_2711511_gDNA_ID_2214532_Annot_ID_134320 3000 nt of promoter + ATG

SEQ ID NO: 12141 - DNA, 3000 bp, Unknown
  misc_feature (1)..( 3000): cDNA_ID_1807419_gDNA_ID_2214533_Annot_ID_134325 3000 nt of promoter + ATG
gtctcaacatcgcacactgtacgtgaaaatagcttctcatctatatcatgtcttattgtgagagtgtagtaggtatggtataatgactatgcttggaaaaactaagaacggtatgaccgcaataaatgatcattcattgatacttttagtacaacacaataaataatccttttttgtatcatcttgaaataatatagtatatgccaaatttattgtttaaaagtgtagttcttaggattaagacatgcaatctaaaattagttggtactaataatcgttgataatcactacttggttttaatttgagaatgcatgttgttgacatataaatgtgtagttgagaatacatgcttctggttaaaaaggcattagaccttttggtttgggagaacctacaaagggtatatatagttaatccggaaagaagagatcagaaatattttcaagttttcaacagtcacgtttcgacataaattttggtcaagaacattgacaaagattttgtgtactggtgtaacttttcatccacacagactacttttctatattattttaggcattttctgacttgaacgtcgaaaagttttcgaaaaaacacaagttacaacaatgttacgacagtttagattgataacttaaggaatgtgagctaggtgtacgatcatctatagcaataagcaaaagtgagagatttctttaacaaaaaaaaagtgagagattttcgacattggacatgtgattgcgaatagaattaagacacgaagattttttcttttgccaacagacatgtggatcaaagatgagacgtagcatagaggattgctacttgatcgatggaagagaaatgtgtattcagactcaaactctcgacaccacagatgactcgacaagacagcagtagtcgaatctaatttaaaaggtattcgatttgacccttacttttctctattattcttttcttgaaggcatcttattttcgtttcagtcaatcctttatatacttttccaccatccactgattaataaaaagaaagtagaatctattagtttcatctctttggatacgcaaatgtgctagaatctattaacgagcactataattcataatttatctagccagttattttgaaactcttaagatattttggttcattatggtttaatcttgtttaaaccgattaaaaccgattaccatgcaatattataacgatcagttgtatgtaaaactcaacccgattactgtaaattcaaaataaatgacatgattttatgtgtttacataattatgaatatatttaacgtttgagccattcatattgcatgatgttaatctattgcaatttatgcagaattcatctcaaaatattaagtttatagcttcaaactagtagagatattttctatggtgaatttgtgactgcatatatccttctgaggttaacatatcatgtgaatgttgaacttacaagaaaagacacaaaatgtgaaaactagttgtctttataaggattgcaaaccctttgtgtcaattgtcaaaagataacgcagatgttttatctttctaaaagtagcctgttttatattgaaatctaatgactttttttaatgaatacttgagtgtgaaggctccagcgattacggatgaaaagtgaatgtttcaaaagtatgtggatcaacatgtaattatgttagaattttgtatatatatattccaagaacatattgtcctgacatgcgtcaagtacttagtgatttagaattaatatggaaaataaaatgacgcaacgatgattatgtttagtagagactagagagaggtggaacttttgggtgatgtcgttgtcgtcttcgtgacaccaccacgacaatgtttgtggtaactggtcaattatggtgacctacttttttgtatgtttttcctaacgagtcaaaacccgatattaacacattcctctaaaaacaactgatattattaagctttcggctttgattagaagcatatttagaaatggttttcgacgtgaatatccttatcgtttatttatcataccgatggataaaacgaatagttgcatgaaacacttggtctaaataaacatacggttatagttttaacaaagtggttgtaaagacaaatggtttacaacaacacttggcttttacaacaaatggtttacaaaaacaaatggtttacaacaaatggtcattggtctagtagttttgtattttcatttgagaagaattgtcgctggagactagtgatcaactcctctcaaacacaaaattatcaaaatcattccatttagtcagtcgaaatggtatcacgatccattagaaaattcagttagttagatattcgactcagttataaaaaatccagtaaaaacggcttacatacttgttataaaaaaacccctcttttttttggagaaatatagaaaatattttaaattttcaaatgagtgaaaatattttaatctttgaaattagcagtattttttgctactaatgcatactgatatgtatggaatattaaacacagctaggaaaaaagtgaatgaacctatgttgaaaacatttacctctgagctataatggtcagtaagaaattaagagttattctctcacggattcacagtacacccattataacaaaagactagtcttctctgaccttcttttgttgccacaagaaaaaaaaaggtttcgtcaaaaaatttcaatttcatgatgatgaaattgaggaattacctgaataaattgtataaagaaagcattatgattttgatattttctcaccataaaaccaatactgtaaaaatgatacaagttgttctggataaaagggtccacattaaatttaaaaagcccactaagaagtccaataacaactccagcgtatgttagcattggatcgtcaaacataaacatttcctttcttcaactactactctgttttcacttttcgatttgagaaaaaaaaaaacgatcacgaagatg

SEQ ID NO: 12142 - DNA, 3000 bp, Unknown
  misc_feature (1)..( 3000): cDNA_ID_2992396_gDNA_ID_2214533_Annot_ID_134326 3000 nt of promoter + ATG
ctattttatttatgtgacagtttggatttgttgagagtatgattctaatgaatttgataattagtatcctcttactgcaatagtaagaggtatccttttttttgtcgcaaaggtagattacttgttatattagatattagcacaattacaactgacttgcagaaagtcagaccaaaaaatgagatcaaggggcacaagaaacacccactaaaaggtcaaccctgagaatccaaaaattaacagggcaacaaaagaataagcctcccaaaaagcaaggagcctaaaagcaaaaagacttcagtccacagaggttagaactctctcatccctaaagacaccaagaagccaagcaggaaaacttacggccacgtacgattgaagcctacactccttagtaacactttgggcaatgagattagcacctctattcgaagacaccgattcaagcaccactttccaaactgcaatgccatttaaagctaacaagatctccgaagactgaaacctaaaagaaggccaagcttgcggcctgtttaacaccccaacaagcaccgcagcttccacaccaaaaaccaccctattcacatgatgactaaccatactctcaacagcccaaacaatgcttagaaattgagcctccaaaaaggaggaaatattggagaaggctcttctactgtgcatcaagacattgcctctgtcattcctcaacacccaagcaacccctgcaagtctagtaagaggtatcctattttgtacaaaaaaactattatgattttgaattaccaatcgaattaaatttaaatcatacaagcgatcaaattaatatttgaatcaaaatttactaatttataaattagctgaaaccaaaaatataattaaattgaaaagcagccggtagtccaatgatcaatgtttgtttgtctttaattggcctgaaaataataaaactattttatggtaataatgattggtcattgagtaaatttccttttcctaaaggggaaatacaaaaggagacctttgtggcggagaatataaaatgtggaagataaaagtaaaacaaaaaaggaagtttttttttttcttcttcatgattattaatgaaagactttttgaatgacaatgacaccaaaaacaaaaaagcatataaatggtggtggtggaatttataaaggagttggggcctaatcacttactcatgcttttattctttaccatatcacatccatctaatctcttaaaagtaaaattatatcactgtctaccactgaatatatgcttagttataattaagttgacttgttgttaatcatttctattatcttcaagttatacgtctcaaaatttaaataattgaattttcacaaaaaaaaaatctatttgtaaagtatcagtcagtatgcaaatcaattcattttaactttttctgaacaaaaatatttctatcatcatcattgtgtttaatttttttccaaaacactcgattacaatctttgtatagcttttaaactcttaacatagccatatgtaaatagatatccgacattttaaaacccgtaagtacacagattatctctctgaactgattctgtttagaaactatgcatcttttactagttaacttgttgtgaattctagcactatgcatctttattggcttaatacagtgcaatggccaatatatatttttcttttgtaacatagtgtatcttagttttatatttcgttgaatgaccttctagatgattgttacactgattcatctccattctcagcgtcttgtgataaatcttcaatttataatgtccaacatttaaccatctataaaagaactaaacacatcgaaatagacttctagctatatatgtgatttagaaaaagattcattgtttatgttccaaaatattcatatcatattgttaatatacgaacaaagtctttgacatttcctcttatagatcatctcttatccaagatttcttcgtaatatactaaaagaagtaatcatcattctagtttattatgtcgccaatgttttcaaacttggataattaatctgtttgtttggtaccgtgaaacaaattttggtttatttatcaaattacagtaaaattcttaatatttttttttccaacaatcaatataggaataaagctaacagaagttggttgaacaaaactaacaaaagctcaacacaattaaaatgaattacttggtctgaatcgaactattaccttttggaatatagttagttaatgttcacaatacgaatacaagttggaaaaaacggaaagaagaagatttggcatagatactcactcactcatacacttagatatttttctgtctagctactttagataagaataagagaagagagaaaatcaaaaacaataaaaagaagaataattgtgaaaaacaatgtggattgtcaaatccaaacttaattgaaaatttgaagagtttaagcgaatggaagcaaaggaagatctttgagttgggccatagagaatctatgctcaccacatgtgcctttctttgcctttcctccttcaatatacacgagtatttggggcaacacataacaacacataacaacaacaacaacaaaaattacacaaacaaaaacatttcataataataacaaataatcattcaaaatataaatataaaatatattagtgggttccatcgccaatagaccaccaaacagcgactcttctttcttacatatctatcttcacaagcttctgaggattgaaaccaaagaaagaaacgtacaaacataaaacataaaaactatatattataaattaaaaacacttctttttcataaaagcgactacacggttttcatttctttgtcgtaaaaatcccatttccagctttaaaaatttcacgctttgtttttgtttatagtttcttgtatgaattttattgattggtgttgtggtttggtttacttttaatttcgaattttttataactaaaccggcgacg

SEQ ID NO: 12143 - DNA, 3000 bp, Unknown
  misc_feature (1)..( 3000): cDNA_ID_3024056_gDNA_ID_2214533_Annot_ID_185000 3000 nt of promoter + ATG
cacagtttcaataaaaatattcaaactttggatacaaaacaatcaaacatagagaataaaacaaacctagattttggataaagcccttgacttgaagatgtaataggaagaagatgaagattccaatctttatcaatcgttggaaacctctcaatcagcttcaaatacgtctcattactcgaaacacttccaataaaccaaagtttctcacggtgaagcttcaacaaatcagcgagcttcaacacaaacttctcaatcacatcaacagagaaaacatcactagctaaaacctttaactctccaaggttcaaaaccatccctgacttcaatctccctaaatcatcaaactttatatctattcttgatccatcaactaaaacttcactaatctttatactaactacacttaacccactaatctccaaaggtaaaaaaccaaactttcctctgtttatagaatcagtaaacgttttaagagcttcaacaccacaaacaccaactagtaatggattcttcttatctttcctcgctaaaacttcaccgattcttctacagttctcgtcgagatcaccaaacggaaacccgaatctaacccgacccgagtcagattccggtaagttacataaaaacagaggaggaatacgagatcttgacgtgaaccgtgaagagaattgagacgtcaccggaggatgaagcacgtcgagtttaatgtcggtgcttctaaacccggcttcaccaaagacccgactcacaatcgggtcatctaaaatggatagtataaaatacttcaactcaactttcaaaaccgacgtcgtttccgtgttgttgtttccatggatttgatgaagatgataagtctctggatgacgtcgttgagtcgcttgagatcttttgatcgccgccatgagagagtttgagaccggaggatcttcttccaccgtcgtcgttggtgttgatttcgaagaaggtaatctgtctagagaaacgccgacgcagagctcaagcgcgcgaaactggagacgtgaagagtacggtgtgttgtgggcggcgcgtgagatacacacttctcggagaatcgatgaaggcattgttaaaagacctgaaacggcgtgaagtgacgtcgtttgtgcgtggcttcgacgacgcgcgacggagactgcgtcgtctaatgcacgcgctgtttcttccgttaaacattgtctcgccgtggttactggtgtcggcatcgtcgccggtttagttataaaaaattcgaaattaaaagtaaaccaaaccacaacaccaatcaataaaattcatacaagaaactataaacaaaaacaaagcgtgaaatttttaaagctggaaatgggatttttacgacaaagaaatgaaaaccgtgtagtcgcttttatgaaaaagaagtgtttttaatttataatatatagtttttatgttttatgtttgtacgtttctttctttggtttcaatcctcagaagcttgtgaagatagatatgtaagaaagaagagtcgctgtttggtggtctattggcgatggaacccactaatatattttatatttatattttgaatgattatttgttattattatgaaatgtttttgtttgtgtaatttttgttgttgttgttgttatgtgttgttatgtgttgccccaaatactcgtgtatattgaaggaggaaaggcaaagaaaggcacatgtggtgagcatagattctctatggcccaactcaaagatcttcctttgcttccattcgcttaaactcttcaaattttcaattaagtttggatttgacaatccacattgtttttcacaattattcttctttttattgtttttgattttctctcttctcttattcttatctaaagtagctagacagaaaaatatctaagtgtatgagtgagtgagtatctatgccaaatcttcttctttccgttttttccaacttgtattcgtattgtgaacattaactaactatattccaaaaggtaatagttcgattcagaccaagtaattcattttaattgtgttgagcttttgttagttttgttcaaccaacttctgttagctttattcctatattgattgttggaaaaaaaaatattaagaattttactgtaatttgataaataaaccaaaatttgtttcacggtaccaaacaaacagattaattatccaagtttgaaaacattggcgacataataaactagaatgatgattacttcttttagtatattacgaagaaatcttggataagagatgatctataagaggaaatgtcaaagactttgttcgtatattaacaatatgatatgaatattttggaacataaacaatgaatctttttctaaatcacatatatagctagaagtctatttcgatgtgtttagttcttttatagatggttaaatgttggacattataaattgaagatttatcacaagacgctgagaatggagatgaatcagtgtaacaatcatctagaaggtcattcaacgaaatataaaactaagatacactatgttacaaaagaaaaatatatattggccattgcactgtattaagccaataaagatgcatagtgctagaattcacaacaagttaactagtaaaagatgcatagtttctaaacagaatcagttcagagagataatctgtgtacttacgggttttaaaatgtcggatatctatttacatatggctatgttaagagtttaaaagctatacaaagattgtaatcgagtgttttggaaaaaaattaaacacaatgatgatgatagaaatatttttgttcagaaaaagttaaaatgaattgatttgcatactgactgatactttacaaatagattttttttttgtgaaaattcaattatttaaattttgagacgtataacttgaagataatagaaatgattaacaacaagtcaacttaattataactaagcatatattcagtggtagacagtgatataattttacttttaagagattagatg

SEQ ID NO: 12144 - DNA, 3000 bp, Unknown
  misc_feature (1)..( 3000): cDNA_ID_3024052_gDNA_ID_2214533_Annot_ID_185003 3000 nt of promoter + ATG
attggtgactagtttttcttatattcttttctcattaacaatatgcagtggtttgttgatatttgaataagttcataaaataacatttttaaaatttttgttaaagttaattctaaagtatttggggggtttacgtcaatcttggcatacctaccaaatgtaaatgcatcatgttgttaaaaaaaagcaaaatatgtcttaaaatgttataaagttatgcgcttgaagcaactataataaataaaaaaagtatatataatttaacaaagtcttcgagactaaaggccggtgtgagacgttttgtggcgtctataaatatacaagaggtgagagagaaagaaaaaaagaaagagtaaaacaatgggttattcatcatcctcaagaattgggttatgtttgttcctcttcttcacatttgctcttctctcttctgctcgcatcagtctttcattttcaggtactttttctccctctttttatttttctgtatactcagtttcaactatttacagttttgtataaatatgttcttggttatccaattttcacgaactaaatttattgcctcaccagaatctttatccgttatctcataagaattttttttttttttctctggttttactcaaaaaagtatcgataacatatactagttcatatcatatctttcctcacataagaaaaagtgaaaatgtttgatactacatttattggccggtgatgtggtggtgttcacatgatccgtatgtaaaacagtgtttgtcttaaaagatcagctccagaatatcaccaaaagaaaaagaaaaaaaaattaattctccaaaacactaagaaaaaaaccttaattacacaaacaaaataaaaactggtatatttatcatctttatatatttcgtagatactaatgatatatttttggagattataaatttatagaggtttactgtatatagatgtaatatataggttgtaaaagattctttgtacactaaacctctataaatttacgacctatatattacatttacatacaataaacctctataaatttataatcgtggaaactaatgtattttactaaatttgaataatttatcttgtttaataatttatagaaatgatatttgggctaaatatcaatttctgattggagaaaattattaattcaacaagatattaatttatagagtattaatttatagaagtttcactgtacatgtatgtatgtaaatgaattaagggcagcgaataacacatgaacccataaaaaaaaaaatttgctctgcaggtgaacattgttaaaaagacatttcaatttatttgcttggcttaaatatcgtttttgaaattatatgaacttgaccaattcgatttacatgccaatcgccaagtatccttacatttttacattagtgcatgtcatcgtaattattccatgcaaatgaaattgcgagtttcacttctatatatatatataatagtcagttttaaaaatccccataaaaaaagaatagtcagatttaaaaatataaaagtaaagtaaattgacaataaaatgatgaatatgtatgactgtatgagccgaggaagcctatttttgctgaaaatacttgtttaataagagttgattctttaaacaagttgcaaatatctaagttttatgtcctctgtttccagcttgtatgtatcaaatttctctctatattcaaatcaagcgaacatgaaacacgaccctcgagattgtcttccctagtccccccctttcgccgatgactttttcacacggccaaatcttatatcttattaaaacaatatgttcatattttattacgctaataaaagcctttttttttttctgatgccgacgaatccgatgagaaagtagtgtacgtcacataaaagttataaactatgaaatctggagataaaaacaatattagtattaaggcttttattagcgtaatataatatgttcacacttcaaaagcgttgacattacgacaaaagaacaaggacagatcatactacgactaattaatccaatctaatatatctttttaaactacataaattatcaaattgaaatggaacgtagtccctcgtatttgtaagaaatccaagcaaagatttcgattttaaaaacctccaaacagaagaaaaaggtcgattttgttttacccgagttcgtgtgttttacataaactttgatggacaaaacataattttttgttttgtttaatatacaaacataaattttgaatgagtgtcgacattgttcaaaaacaaattggaaacgagggtattgagagttgaggtttatcttaaatactctagttgttaataatacgatagttcttatatacaaaagttgttagtattgtttaccaattttatctagtatagtactatgtttaaatgtatataaacaaccaaatatggacatgacagaaaatgaaatgacggtggtgccagaacggtcattgatggtgagcaccaacgactacagtgaccctacagctaacggtagacatgatccaccccgtggaggcagaggacgcagacgttaagagagaggataattttcttaattttccgactcctcttgcaagcttgcaaataatctatatatatagaaaacagtaaaagtagttttaaaaacgagttatatatgtgatatcagagtgtgtgtgtgtgtaatatataatacttcatttgcatttgtgttctctacatcgacttcaacttgttattcttacctagattaatatatgtgcagtgtgctacatgtaattttatgaatatttgtttttgttaatgccggcatattccaatcgattttatatatagaaattgttgtgtattgaaaaattgttaaacatctacttttgaacctacaaaaacaaaaaaacatttgaataagaattgatattgatgtgtgtgaaagcataggtctgcaaacaaaagaaagtgacatagagcgacaaaaatacgaagaaaatg

SEQ ID NO: 12145 - DNA, 3000 bp, Unknown
  misc_feature (1)..( 3000): cDNA_ID_2708406_gDNA_ID_2214533_Annot_ID_185010 3000 nt of promoter + ATG
aatgaaaatcacatttcaatacttttttaaaaatgtattcttaaagagaagacgcaaaaagtatttaagtgtacagtgaacaaataagattttgttttagtggtgaaagagaaaaattacactatatttctaaattagttttttttctttcttttcggtttttgaggtcatttaatcagataattcgaaaatatttaaataacttatgtactaggataaaaagcaaacatttttttttggtatgaattagtagtagagaatattacgtgattagacacttttttaaaagtttgttcctaattaggcactttaaatggagaagtcactttagataaattattttacttatttaccctttaactacattttttccatcggtcatttcttctctctccttttcccatctcttctctattttttttttttctcactttatcgaagaaaaaaacatttcccagaatatcttcaattccaaatctgcaattaatctccaaatccactctacgcgatggctttcttttttctctggactaattagagaatatgaggtcttggtttctttaagattgtaatttattttgcaatttaaatatttgttttgatataaatttgagattcaattatctaagaaacatcttcttcttcaacaatggcggcttgatttgatttttgctctctctcatgtgtcaaactcgtttcatctatgtagcatcgagattccggttaatcgaatttcctgttattatggacatgatatacaaaatggatatagaacagtaaaaaggtttccgaatggatatatttaaatggactcgttattatggacaccaaaccattgtttgttgatttttctttcggtttgcagagacctctaccttcaaaaccttatggacatggaactttggtttctttacaaaacacggttaatcgaatctcctgttattattgacatggtatatagaatgaatatagataagtagaaaggtttttgaatggatatatttaaatggattcgttattatggacaccaaaacattgtttgttgatttttctttcagtttgaagagacctccacttccaagaccttatggacatggaactttggtttctttacaaaccacggttaatcgaatctcctgttatatggacatggtatatagaatgaatatgaatcagtaaaaggttttctgaatggatatatttaaatggactcgttattatggacaccaaaaaattgtttgttgatttttcttacaatttgcagagaccccacctccaataccttatggacatagaacttttaccaaattcctgagataatcgagatcaaattgtttaagaaacttctccaaaagttatggagacgtggagagagagagagagaggcgctacaaatcatggagagagagagagagagattttatttattttgggtaaggatcgtggaagaggaataacaaaaaagagaaattaagaattaaaaacataaatattgaattgagggtaaaaaagtctttaaaaaaaaagaattaatagaaaaagtgtctatttcctataaactgcctcaaacggaaaaacattctctaaaagtgcttaatagtggaacattaatcgcatgacaatataataagacgtaaaatttttggtcttatcatatgcaaatacttattaataaggaaattttggtcttataatattgcaaaaactgatttttctttgtttactattcatccctatcacaattcacaacattaacaaaaactttctaatggatttttcttcaactctagaacattgcaattccttttcaactctagaatatcaaataccgtttaaaagacaaaactatcagttaatgatgtcacaaattactcaaaaaattaacactctcttaataagaagaagacttgtattttaataataagaagacctcgtgtgaaacgagatcaattacaactttatgtattagactttttgacaaattcacaacggtcatcaaatggaaacaaacaaaacgaaggctcctcttcaggctctcaacggtcacttgcttagaagctgcgactacgacaagcaaaaatactcatccaatgaaaacgacgacgtatagaacctaacggtcgttttaaattctttaagattctatttttcatttaatttaaaaaggagaagaaaaaaaaagtgagtcatcaatgaaacacttctttaacacagatacgttacccacatgcccaattattagcattcgtttccttttagacgtgtttttgacttcatttgaaatgtctgttttaacctcacagagcaaacccaataaatcgcttacttcatcgttttagctattttagactgtgaatgaccgttttaccctccaacattctcttttgtactatctgctgtgttttattgaattttattctacgttacaaagggcctttcttcttatttgcaatactcctctttttgtttatgatagttctagtctactagacataatttgtttttattattaaattgacataaagttaccaaaaattgaatgattcttattttggttatgaaaaaatattggaataaaaaatctcatggatatatacatttttcattattaagaaaaaatgatattttcctttattttgccaacaaaaaaaaactggtcaacaagagtaggattcaagctaattttgttttcctcaaaataatatccattttgtagaaagtaaaaggacaacataaataaaggaaatgaaagttgtaagggcataaatgttatttacaaagtcaaagagactgaaaaactttgaataaagctcgataaacacggactctaattcattcaatattcattaccttcttctttcctttatatttaaaaaccttcttcttctctctctgtacatcgtcacaacaaaaaaaaaacagaaggagaagaaacaaaaacaataatctcagcaaaaacaaatctctactcatcgaaatcgaaatcaaaatatagaaacg

SEQ ID NO: 12146 - DNA, 3000 bp, Unknown; identical to SEQ ID NO: 12142
  misc_feature (1)..( 3000): cDNA_ID_2992396_gDNA_ID_2214533_Annot_ID_185001 3000 nt of promoter + ATG

SEQ ID NO: 12147 - DNA, 3000 bp, Unknown; identical to SEQ ID NO: 12141
  misc_feature (1)..( 3000): cDNA_ID_1807419_gDNA_ID_2214533_Annot_ID_184999 3000 nt of promoter + ATG

SEQ ID NO: 12148 - DNA, 3000 bp, Unknown
  misc_feature (1)..( 3000): cDNA_ID_3024052_gDNA_ID_2214533_Annot_ID_134328 3000 nt of promoter + ATG
aagaaaaagaaaaaaaaattaattctccaaaacactaagaaaaaaaccttaattacacaaacaaaataaaaactggtatatttatcatctttatatatttcgtagatactaatgatatatttttggagattataaatttatagaggtttactgtatatagatgtaatatataggttgtaaaagattctttgtacactaaacctctataaatttacgacctatatattacatttacatacaataaacctctataaatttataatcgtggaaactaatgtattttactaaatttgaataatttatcttgtttaataatttatagaaatgatatttgggctaaatatcaatttctgattggagaaaattattaattcaacaagatattaatttatagagtattaatttatagaagtttcactgtacatgtatgtatgtaaatgaattaagggcagcgaataacacatgaacccataaaaaaaaaaatttgctctgcaggtgaacattgttaaaaagacatttcaatttatttgcttggcttaaatatcgtttttgaaattatatgaacttgaccaattcgatttacatgccaatcgccaagtatccttacatttttacattagtgcatgtcatcgtaattattccatgcaaatgaaattgcgagtttcacttctatatatatatataatagtcagttttaaaaatccccataaaaaaagaatagtcagatttaaaaatataaaagtaaagtaaattgacaataaaatgatgaatatgtatgactgtatgagccgaggaagcctatttttgctgaaaatacttgtttaataagagttgattctttaaacaagttgcaaatatctaagttttatgtcctctgtttccagcttgtatgtatcaaatttctctctatattcaaatcaagcgaacatgaaacacgaccctcgagattgtcttccctagtccccccctttcgccgatgactttttcacacggccaaatcttatatcttattaaaacaatatgttcatattttattacgctaataaaagcctttttttttttctgatgccgacgaatccgatgagaaagtagtgtacgtcacataaaagttataaactatgaaatctggagataaaaacaatattagtattaaggcttttattagcgtaatataatatgttcacacttcaaaagcgttgacattacgacaaaagaacaaggacagatcatactacgactaattaatccaatctaatatatctttttaaactacataaattatcaaattgaaatggaacgtagtccctcgtatttgtaagaaatccaagcaaagatttcgattttaaaaacctccaaacagaagaaaaaggtcgattttgttttacccgagttcgtgtgttttacataaactttgatggacaaaacataattttttgttttgtttaatatacaaacataaattttgaatgagtgtcgacattgttcaaaaacaaattggaaacgagggtattgagagttgaggtttatcttaaatactctagttgttaataatacgatagttcttatatacaaaagttgttagtattgtttaccaattttatctagtatagtactatgtttaaatgtatataaacaaccaaatatggacatgacagaaaatgaaatgacggtggtgccagaacggtcattgatggtgagcaccaacgactacagtgaccctacagctaacggtagacatgatccaccccgtggaggcagaggacgcagacgttaagagagaggataattttcttaattttccgactcctcttgcaagcttgcaaataatctatatatatagaaaacagtaaaagtagttttaaaaacgagttatatatgtgatatcagagtgtgtgtgtgtgtaatatataatacttcatttgcatttgtgttctctacatcgacttcaacttgttattcttacctagattaatatatgtgcagtgtgctacatgtaattttatgaatatttgtttttgttaatgccggcatattccaatcgattttatatatagaaattgttgtgtattgaaaaattgttaaacatctacttttgaacctacaaaaacaaaaaaacatttgaataagaattgatattgatgtgtgtgaaagcataggtctgcaaacaaaagaaagtgacatagagcgacaaaaatacgaagaaaatggatttcgatacgttaagtgatgctgcattggccagaagaaacaaacacgagatcgaaagctcaaacaataacctaagcccatcaaacaagatgatagtactatctaacaaaatttgattttttgcattcattatgttagcgtgtaatcagtaattcagacataacctttgatctcctaatcatgtaatagttttatctaaccaatgaaccataataaattgggttttgatgtggaacactttctacaatgtttttagaacatttatcttagacctaattttctgaaaacaaatcatataagtttgttgtaaagtaacactcaattcatgtatatttcacatgcttaattatttcattttctaaaacatgatcctagcacatattttttgtttgaatatataattgattaatcaaactgaagagttatgtacaaatagcctaaaggtaagactttttataatgggacaaaaaagtagggttaataataataaataacatttttatgtgattggaagaaataaacaaaataaataggtcaatttgattattttttcatgaattaatttgtgtatgggccgtatttattcattaaacccaacaatcattaaacagataggcccaaatacttattaagaatcttcttcatcgagaaatattcaaatgctcccaaaagctcaggaggccaattcctaaacggaatccatcactttgactgaagaagattcttcaattcaaacacacacacaacgaagaagacgaagacgaagaagacgaagacgaagaagaagcgatg

SEQ ID NO: 12149 - DNA, 3000 bp, Unknown; identical to SEQ ID NO: 12145
  misc_feature (1)..( 3000): cDNA_ID_2708406_gDNA_ID_2214533_Annot_ID_134331 3000 nt of promoter + ATG

SEQ ID NO: 12150 - DNA, 3000 bp, Unknown
  misc_feature (1)..( 3000): cDNA_ID_2708468_gDNA_ID_2214534_Annot_ID_134335 3000 nt of promoter + ATG
aggtgagatcaaaagagatggtttttgtggagtttccggagtgatctaggttacgtgggggagaagattttgattttttcacaacggaagatctaactagaagaaaagcttctttcaaacaattttctttatataggaaaactcttgaacagtctaaactctaaagattcgacttcagttgaacagttgtgtagatcactcaattaatcaccaataaccataaagcttctccgctatctagatcttgaatctcatcaatagctcctaaacctaggattaagctaaagtatatattgtaagatagtgaaattctccttgaggagatagctttgcattgcactcaatatatacacggtttagcaacgatctttcctagattctaggtacatgagatattaacaaagtctaacaaagtcttatctaaacttgtaacaaacatatcgagacgaaatattgaatggaatattctatctcctaatatatataggtaccataaagataaggtcaacacaatgggctgaagttaaaaacataagtttaagatttcggattttaagaataataaagcccatgaaataaaatatatgatagttttcaaatccttttgtaattagaggcccaaaatgttattaatctcttcaaatctctaatatattaggtccgactcacagtcacacttaatcgagctagattcggtaaaaatagtgtgacaacgactttttcttacaaaaggatctaattaaccacataaacttctgaaatcagcaagaacgtcttctacacaagtacgaaaactatagctttttaattttgaaataaggaaaatgtaatgaaaaatgatatattgtacttttaaaagtatttctatattactatattaaagtaagaaattaatatagtaatatggtcaaatgaacctggatatatatggaaagcacttcaaggtaaggtgcgttaatgtgaaagaatccaatggatgggcaaaatcgagggaattgtatgacaagttacaacaattcattgaaaatgttcaacaataatatattaaagggcaaaccatattattttaattaaaaaaaaaaaaactgaaaatcactaataggtcaaagttgaaaactaattattatatggcccgatagtttttatcagagttaacaacttttgatcaattctattgacactcttcataattgaattacatataattaacgtacgaggttttgagctacaacttaaatgtatgtaacaaatttggtgggacttagatcaatctctctatcataatcaagaataaacaaattgcaaatatcaattagtgatataattcaactgatgtaggaaagactaagaaagtttaatttaagtttataggttctagtgttctactaatgtggtataattttacacatcctgaaatgaaaattaatatatttgaaaacatattttatattgaaatacatatttctaataaggaatagagaaattttataggcgaatttttctatgtaactaggcaattattttagttaaaaatttaaactaaaaatatttacaccaaatacatgtggttatcattcaatttttcaaataaagaaaaatttaagcgtattcaacgtcatttaattctttgttttgaaaagtaaaaaaattgcaagacgcgttgaactcgtgaatacatattatgtatatacgacaaattcattaatttgccttatttttgtcaacaattaacattttcaattagtagaactgtaatgaaaaaagttagggaatcttttaagaggagtgttctaatacaatttgacactttggaacaattttgctcttaaaaagaagtaattgcttataagactcaaactcttatgataaaaatgttgcccatatgaaaagtgatcatgccaacgtaattttgcatgaaatatcgcatacaatgacttctgatttatctttctttccctctacccttgaatatagaataaagaaaatcattacattatatattttctagatttaaaataaatgtttttttttaaaaagagcaagaagaaagacataaaaggcgtgtgggaaaaagaaaaggagtaagacaagtaaataagagaaaaacgcgtctttgaagagaacgtccccattccattaggcatgctatgcgcggccgtgaaagaagctcactcctctcctttttcttttcttcttctttaatttacaattttaaatctctaatcatatattgtcaagattcaagagatatataaactgatcaatttgagatgttacttccatttcttagtttttgatattcttagcttagttataattcgagtgtttgtctattgtttcataaaagtttataagtaggtggaacaagtcattttcaattggattctctgttaacatcaaataaaacggctttgactaattactatggattttattgagaacgacttgtaaacataaacttatctatgtcagaaaacaaaagaagattcaaacaaatataagactgagacaagaagaggtctttgatcaaacaaaaaaaacacaataagaggtgataaaagtaagagatataatttctcataatgatctcatcacaatttttatcaactctaatatatataggtctaaagacagacaattatctaagtctttctgtaatttcttaagaccactctgtcttttctctaaggaaagaccaaagagacgagaagaagacaaaacaaggcattaatagtttaaataaagcacgtaataacaacaaattattacgtaataatttaacacaaaatttatatttcttccaaatatacaccaaacacctctaaaaaaaaattcacccttttcttctttttctctatatatctaaaatcacaacacacaaaaatactcatatatacaaaaatatatacaatatacaaacatcgtatatatcaagtaacagagagaaaaatcttttttcttcctctccttgatcggagggtcgccgtgttgaaaaggatg

SEQ ID NO: 12151 - DNA, 3000 bp, Unknown
  misc_feature (1)..( 3000): cDNA_ID_2711567_gDNA_ID_2214534_Annot_ID_134339 3000 nt of promoter + ATG
gataaaactcgatgttaccaaaagtatacactatctaattcacaaccaaaaaaaaaaaaaaaatcgttcacccttatataaagcttctgttgaataagcagagtggaaaaaagcaaaatcaaacaaacatacaaaaaaaaaacatttctttttataactcttctctagtcttctccaaatggaatggactagaggaagaatcctaggccgaggctctacagccaccgtatacgccgccgcaggtcacaattcagatgaaatcctcgccgttaaatcatctgaggttcaccgctcagagttcttgcaaagagaagccaagattctctcgtcgttaagttctccttacgtgatcggatacagaggatcagaaaccaagagagagtcaaacggtgtcgttatgtataatcttttgatggagtacgcaccgtatggaacgttgaccgatgcggcggcgaaagacgggggaagagtcgacgagactcgggtagtgaagtacacgcgcgatatactaaaaggattggagtatatacactcgaaaggaatcgtgcattgtgatgtaaagggtagtaacgtggttatttcggagaaaggcgaggccaagattgcggattttggttgtgcgaaacgggttgacccggtgttcgagtcgccggttatgggaacgccggcttttatggctccagaggtggcgcgtggagagaaacaggggaaggagagtgatatatgggcggttggttgtacgatgatagagatggttacgggttctccaccgtggacgaaggcagattcgagggaggatccggtttcggttctttatcgggtcgggtattcgagtgaaactccggagcttccttgtttgcttgcggaagaagcaaaagattttttggaaaagtgtttgaagagggaagcaaatgaaagatggacagcgacacaactcctaaaccatccttttttgacaactaaaccagacattgaaccagttctggttcccggtttgatttcaaactcaccgacaagtgtgacagatcaaacgttttggagatcagtagaggaagaggaagaagaagaaacagaggaaatacagaaggattcgagagatcttgatcgtttaagcttgtggggttgttactcggagaggatcggacggctgaagtgtgttggtggtttggatgggaccagatgtgatatggagggtggggattggattatggtgagagcgaggtgtgaaggaacaatgattagtgggtcacaaaaggaattgattattagtgaaaatgtattggtgggggaattgtaaatttgatttggggtcattttgggtgaattgtagaaagtttaggggttgaaattagtgaagatctccaatttaggggagatcaatgtagctttattagtctccgaatcttcgattgatcacatgtatattattataatcacgatatttataaaccaaacccaattttttaagcttggacaagagtcgaatacttgaattatatggagtttcaacgtttgttggcctgttatagagaaaatagttgaactattacattcgaatcttagtattccatgtttttcactgtttctgttttgactaacgatagtcttggaaataatatagataaatcataacttttctaatgtcccaaatgtcaaattttctcaatcatataacaaataaatgaacttgttaaatcaaatttggcatatatttgagagttatgggtgatatgatatcaaaatatgttagaaaatagggcatggtaccaaatctaaacttgtggggaaaatgagaagtggagtaaacaaagtatttaagtgccaaatcggccgaattgggtcgttggttttggttgggcactttgtgtttttgacaaaacctaaagattcctttcgaatcataaaagatgatccgtgtaatatattcatttgtgtaatttggtagcttcgttaggccaatgtgacgattcatcaagtctttgcttccacttattaaatgtgtaaaaagttgacacacctcacataattagttaatcactattggatcttctcttcagaatgatttattttcatctatattttttgttgtcaaatatgcatttagaattgtatttcaacttcattatagttctatatattgatcagtcatatatttgattttgtattatacccattttctcaaacacaacaatagatttcacataattgttgtaacttgtcttaagtttcattttagaaacttccgatcgttaaaaacattataactacaacaacaatcttagtgaagataaggttaagtaatgggaaataatagatgaagataagaatactttgcttgcaagataagttcatgtttggagagttatcttttttacttagaaggtgaataacgaatcttttgttttatggttttgactcgtgttttggataaagttgtaaccataaatagtatgggcacttactacacgaatgcttaacttcaaagacgattatatgtcctgtgtatatttatctctttggaaattgaagagtaaattaactcatgtatacgtgcctaatctaactttgggatcgatcttgtatattaagtttttgagggttcaaaaaatattaaaaatcaatataactggcttggtacgattttaatttagattgatatcacaatatatctttagtttcaaattatttattttgttcattttttatttcgtacatcacctggttcgtataagagttatacaataaataaatgatcagattcagatgtgtattttaaaactatccttagaaattaattacaaaacatttttaaaaaaaagatcaaaaatcaaattagataataaatagagtaacgaattttgtggcgcaaaaaggattgtattacaaaactattaactaccacaaaccccaaaaatcttattcccttgttaaatctctctatattgggaagtgataaagaggcaacaatgcgagagacttagtccgccacactcgataatg

SEQ ID NO: 12152 - DNA, 3000 bp, Unknown
  misc_feature (1)..( 3000): cDNA_ID_2708443_gDNA_ID_2214534_Annot_ID_185036 3000 nt of promoter + ATG
aacctctcgaatgtattccgatactcgtgtttaaatcttccgccactgaatcatataaccagccgatctgcataactttcaatattatagaatttttcgaaacaatataatattatttggttaaactgaaaagtgaattatacggtgtttccccagctggtttggtactcgtactgacaatgtcccacttctcgagccgcttctatggagtttgtaagtatattttgtggatttggatttctttgtattgcatcaaccactgatttcatcatctctttagaattaccaaatcttctcgctaaactatccttaaccaaaaactccccttgatagcaacagcaagggtcaataaaaaaatgttttaaataacgctttgaagatttttatgaaagacttacttgtagcaactgaagaaagacttccatcaacttcgaaatcgtctggagataaaccatacataactcttctcgtgtggacgcatcctgatcctatatatatcggtccttggattcccgcgattcctcgtcccaaatgctaaatttagcaaagaaaacgacatatcataaataacaatgtattgattagaattatagataaacaaaatttaaaagaagaaatcacactgattgtaggacgactattagctcggtgcttgaatcatagaattcttgacggaattgaacaaaagcacaatgtttcatatttaatgattcttgcagaagtatacacattgcttgtcggactacatctgcatcattggcatacatgtcgcaatccacgttcaagatgtatggtgcgtttgtcatcaaccctgacactcttgcctgttcaaattcatcatatcatatgcttatcacattttcggtacaacaaaaaaaaaaaatacactatataagatgtgaaacttcagaaaaaaataagaagaaaaagagagagatgtgtaagaaaattcattaaccagaaagttcatggctccacatttttgattatgaacataatttggtcttttctctcttgatatgtatatgatatgagggatctctttctcgtctcctacacctcccttgttctcccataccaccttcacatatatacacataaaacaattaacgtgtgcgtatataactatagttagaaacttgattgtttttacttaaggaattttttttaaataccttaactagagttgaatgatcatttggttttgtgtttgagaatgcttcaaaatcatcttctacatccaacatatgagaatctccggtggcatcttccactttccgcctcaacttctcgtactccctctttgtatttacacaaaaagaaaacatcaagaaatttctcaatacataagatgaaagactaagaacaaatcttcagatcatgtgcaactttattaggtatctcaattgtttcaaaacaagaatttaatctgtaaataagcacaataatattatttgtaaacataaaaatgtcatacacctaaaaaataatcaaaccctttttaccttcgtcttttcccagtctctattgaattcataatcctctgttgcgacgcttataggtttcagaaaatatctagaaggagctctaactctagtgttgtactttttgcagaacggtacccaaatcttggcgaacttagaagcttccttgagagagaaataagtgagaggtgagcatccatcgtccgacacataacaagctagtttatttgccggataatttacagctaacagcgaaagcacggtgtccacaaccataatcggtggctctcgaaccggatctgctgtgggcacgaacatatccaccgaaggaaggtcatgaaccctgaaattacaatattttatatgccaggttaatgaattacgtaaaagataacatagaaatgaatattatcttgatgattaaactaaggctaggtagcaaactagctcagactttatacaaagttaataacaataatgattgtatatatgctaaaaataatatttgtatatatgatttatgtgtaaaacgaaaatgatacctttcatcaagtctatcaggaaagggtttagtatcagcaggactccattttaggcaagtaataagcagacataccaagaagaaacaagattcacaaaagaaagccacgagccaaacgttgtcgtattcgctcgtatgtcggattcggtgcaagagaagagaaaagaaaaggcctagaaccgtgagatatacagctcttagaaaatagttcgtgtatgagatcctttcacaaagaggaggaagagaaaagcttgaatccgccatgggaggagctttcttgcagtttttggatatgttttcgaacttcacatcgatgaatgcttcatgcttgtatataaatacgcatgtgggaaactcctaattaatgtgctaagagttaatgatgattccctataagcagggaagcttcaccttcgtgaagatcacgagaacaagaaacctaaaaagtcaaagtcttacttgtttcttgtggaagaagtaacgtaagacattgatgttcatgttttaaagcaatgaaattagttacacgcatttatttgataattaataataattttaaagtaatttatatcattcttattatattatcaagtagtgatttagcttgattataaattccaataagtgaaagcagaaattgtctgtctatctaggattttaatttaatcagtttatcattataatgaatcatgtatgaaataaaacctgatgacgttattttctctttaacacattgatgggctgatattgggccttaaactgtctcatcttattcgaaacccaacccacattagggtctctgataaaccacccaatctcccccatctgtgctttttttccccaatcttcataagtcataagaaaaatctcagcaattgtcaaaattttccagcaatcgagagagcagcacaagagagcatagaaggaccgattggggattagttagcgtgaaaggagatcctagtagcagctatg

SEQ ID NO: 12153 - DNA, 3000 bp, Unknown
  misc_feature (1)..( 3000): cDNA_ID_3024096_gDNA_ID_2214534_Annot_ID_185035 3000 nt of promoter + ATG
tatgttttcgaacttcacatcgatgaatgcttcatgcttgtatataaatacgcatgtgggaaactcctaattaatgtgctaagagttaatgatgattccctataagcagggaagcttcaccttcgtgaagatcacgagaacaagaaacctaaaaagtcaaagtcttacttgtttcttgtggaagaagtaacgtaagacattgatgttcatgttttaaagcaatgaaattagttacacgcatttatttgataattaataataattttaaagtaatttatatcattcttattatattatcaagtagtgatttagcttgattataaattccaataagtgaaagcagaaattgtctgtctatctaggattttaatttaatcagtttatcattataatgaatcatgtatgaaataaaacctgatgacgttattttctctttaacacattgatgggctgatattgggccttaaactgtctcatcttattcgaaacccaacccacattagggtctctgataaaccacccaatctcccccatctgtgctttttttccccaatcttcataagtcataagaaaaatctcagcaattgtcaaaattttccagcaatcgagagagcagcacaagagagcatagaaggaccgattggggattagttagcgtgaaaggagatcctagtagcagctatggatagagaatggggttccaagcctggtagtggcggcgccgcctccggccaaaacgaggccatagatcgccgtgagcgtctccgtcgtcttgctcttgaaaccatagaccttgctaaagatccgtatttcatgcgaaatcatcttggaaggtatgttactgtatttatgtatgctttgttgcacgagtaagtagcagattcaattgttggatgatcaacctgagatttatgaatactgtgattttaccaacttcatctacatttttgctccgttttgagtttgattattcatatgtgtgatagctcttgagtttgtttggctgttgtttctagaattaggttcttttttttaattttcccctcatgccactaatttgatttttggtgtgtttttatgttgtgcagctatgagtgtaaactatgtctaacactgcataacaatgaaggaaactacttggcacatactcaaggtaagaggcatcagacaaacttggcaaagagagctgctcgagaggctaaggatgctcctactaagccgcagccactcaagcgcaatgtctcagttcgcagaacaggtaataagttgttttattttctataattataatacagctttattcccattgttgatatcaaatctgcctaggcctggaattggatataatgggaaagtgattgtctagaagtaatagcaaaattgtatatctttgctattgagtacatagattttacttaattgattgctttaaagggtttattaataactccattttatgtatggtcttgcagttaaaattggtagaccagggtaccgggttacaaaacagtatgatcccgagctgcaacaaagatctcttctgttccaggtaagcatctaattgttattgttgaacttcaatgatcatcattagagacttagccagagtaaaatctcactgtgtctgtttactcctcaaacaatgttttacagattgaatatcctgagatagaggacaacataaagccaagacatcgtttcatgtcatcttatgagcaggtgagtgttacaactccttgtctatgtatctcataaactctttcttttccttcatactgaatagttttcttcctttttttttgtgtgcagaaagttcaaccttatgacaagagctatcaataccttctatttgcagccgaaccatatgaaatcatagctttcaaggtatgtgttttttttttcttttattcgtgacatttacattctacaagtcatctgggattatagctctagtagcccaacatatcttggtcgaattgtttactgatattgatggttgtgttttcgcattggtttcaggttcctagcacagaggttgataaatcaaccccaaagtttttctctcactgggatccagactccaagatgtttacagtaagtgcttctcatcataattctcataaagccataagcttagtttcttttccgagattggataagttttgtgtttggattaatcaaaatactgacaaagaatgtaataaaacagctgcaggtgtatttcaagcctaccaagccagaaccaaacaagcctcagtcagctgttggagcaaatggtcttccaccgccaccaccacccccgcctcatcaagctcaaccgccaccaccacctccatctggtttattcccaccgccaccacctccaatggctaacaatggttttaggcccatgccaccagctggaggtttcggacatcctaacatgtgaaagagaatccagcgaagcagtttaaaaacacagtactctgatcatggtttactaagagagacttgctctttgactgaaaaacaaatctgttttgacatggattctcaaagctgtgatctctacggatgtattagctctctagataccttctttgagtttcttctatctgcttctcgtatgtaccattttgacaagattgttttccgttaatagtacaattagcgttggcgaaacaaaattcatttgttatatatcggttaactcttaaccaagtcttaacccaatctatcagtcctatgaccggccatggatatttcatatttaaattatttctaacgatgatcaaagtggagtataccacgtcactcacctttcgacgggggtaatcatgtatttacacattctcatcagtgtctctgaaattcaaaagggtaaagaagagggaaaatcaaaatattaaaatccctaattcccaaattattttgaattttctcggatccacaaagctccggtgaacccaacaaacgcattttctctcattgagtttatacaagcggagaagttctgtcatg

SEQ ID NO: 12154 - DNA, 3000 bp, Unknown
  misc_feature (1)..( 3000): cDNA_ID_3024106_gDNA_ID_2214534_Annot_ID_185031 3000 nt of promoter + ATG
ctgcaaaaatcaatggattcaaaccattgtgcttttgttcaataccctcaagatttctatgattctaatgtcggtgaactcaccgtcttacaattagtaagatttatctctttactttttctttggtttatttctaatgttaatataataaatttcagtcagctcgatgatttatatttgttataccaatccgtacttaatcttagttccttttatttattaaaaaattaactagtacttgggacgaggaattgcgggaatccaaggacctcagtatgcgggttcaggatgcttccatactagaagagttatgtacggtctttctctagacgatttaggagacgatggaagtctttcttcaattgctacaagtaagtacaaccaacaaagacataaaaaaaccaatcttttagcatgcaaaattctgatgttttcattaattatactaacatttttgttattccatcgttctactattcacatgtcaaatcattcacggttctcgttgtaatttcattaagggaagtatttagctgaggagagtctaacgagagaatttgggaattctaaggagatggtgaaatcggtggtcgatgcgttacaaagaaaaccatttccccaaaaaaaccttaaggactctctagaaacggctcaagaaatgggacattgtcactacgagtaccaaaccagctggggaaaaaacgtaattctcttctcaaatgaatcactatagtattttagacaatattaatgtgttttcttatatataaatcatgtagatcggttggttatacgattcaacaacggaagatgtgaacacgagtatcggaattcattcgagagggtggactagctcatatatttttccggatccaccggcgtttcttgggtgtatgccacaaggaggaccggaggtaatggttcagcagcgacgatgggccacgggactgctcgaaatccttttcaacaaacaaagtccgttgatcggaatgttttgtcggaaaataagatttcgacaaagcttggcttatttatacgttttcagttggggtctaagatcaatccctgagctcttttactgtctcctgcctgcttattgcctactccacaactctgctttatttcccaaggtgaccctctttctcctttgttatgatactaagacaacaaaacaagaaccactagattacatgtctctcggtctctctttaactatatcataagccttattaatatttatctacttattttatagaatttctttaggggaaaagtctaatgtttttcttttgttttttgctctagggagtttacttaggtataatcatcacacttgtggggatacattgtctttacactttatgggaattcatgaaccttggtttttccatacaatcgtggtatgtcactcaatcatttgggaggataaaaacaacttgtagttggttatttagcgtccttgatgtcatactcaagcttcttggaatatcgaaaaccgtcttcatagtcactaaaaagactatgcctgagaccaagtcagggtctggatccaaaaaatctcaacgagaagttgattgtccaaaccaagattccggtaaatttgaatttgatggctcgctttatttcttgccgggcacattcattgtgttagtgaatctagccgctctagccggttgtttggtgggtctacaaagtcgcggaggaggtggttcgggtttggcagaagcctgtggctgtattttggtggttattttgttccttccatttctaaagggtatgtttgagaagggaaaatatggtatcccattttctactctttctaaagctgcctttttagcagcgttatttgttgttttatctgtgggaaactagtatagtgtggtaaggttttgttatgcacctatcgttaagtgtatcatgacattttctctattgataatgctatttatgcaatttgttttattgatcgtacgtaaaactaactaatgtgaaaccattcaaagcgttgaattacaaatgaacgttattctgacatacagcgatctagaattggcaagctagttttgtatgtggtatatatcaacacaagtatcacaacgaaagaagatgaaactaataaatgttttcttggttatttttttgttgttgttgattagagtcattttaatcaattgaacaaaatgaaatacatcaaaacttttgttaaccatatataattagatcattcagccattccagtgattcgataaatctttctctcgtaaagtctgtttgtaaatatggattatctactatggaaggtccttaaaagagaagaatatgaattttctgaattatctactcatctgaattttcttttggctagttttgtgtatttctaacaatatgtatacaccattttgtcaacaaatttatggattttactagttagtactttaaaatatattttttcgcatttgttcaatagtacaacaattaaaaaaaattgccgattgaaatattaaaaatactaaaaatagtaaatattgcttactcacaattacatagaaaaccacaatatatattaccaggtctaaaagtgtcataattatagattaagaaattatagctcactgtaatataattctcaattaacatcttacacttgtctgtggataagataacttcatacaaattaagctttttctctggtcagaatacagatttagatttctaacacaaaaataatatttaattaaaatccaacaaataaataaataaattaatttttctttctttggaagtattattactttttcacattgacaattaatactatcttttctttatatttaacttaacaaataaggtctacatagggtactttcgtctaatcacaattttaaagccatgcgtgcattgccttagtctatataacttattctcccactcatcgactgccacaacactcgtaaagaatctgcgacagagattttctccgaccaatccatgtcggaaaac

SEQ ID NO: 12155 - DNA, 3000 bp, Unknown
  misc_feature (1)..( 3000): cDNA_ID_3024110_gDNA_ID_2214534_Annot_ID_185030 3000 nt of promoter + ATG
acgtaataggttgttttctttatgttaaatttagtatttgggacgaggaattgcgggaatccaaggacctacatatgcaggttcaggatgcttccacactagaagagttatgtacggtctatcaatagatgatttagaagatgatggaagtctttcttcacttgcaacaagtaagtactacaggcgaaaacaaaaatgcatatatcattaaaccaatattttagtattgaaaattctatttctcttttttttttttcaatttattctaacacttaaatctatgttctgttattcttctaacatgcaatgtatagtacttttgtgattcatcgttatataatacgttcagtaattttattattcaaataaatcattttaatggtattgttgttatttcattaagggaagtatttggctgaagagaatttagctagagaatttgggaactctaacgagatggtgacatcggtggtcgaggcattacaaagaaaaccaaatccgcaaaatacccttgcaaactccctcgaagcggctcaagaagtgggacattgtcattttgagtaccaaactagctggggcaaaactgtaattagatttaaactatatcacagtagactattaatctaaactcaaattttcttcttattcatagtaatgtcatttgtaatgcataaaatcctgcagattggttggttatacgaatcaacagcggaagatgcaaacacgagtatcggaatccattcgagagggtggactagctcatatatatctccgaaaccaccagcgtttcttggggctatgccaccgggaggtccggaagcgatgctccagcagcggcgatgggccacaggactgctcgaagtccttttcaacaaacaaagtccgttgatcggaatgttttgtaggaaaataagatttcgacaaagcttggcttatttatacattttcacttggggtctaaggtcaatccctgagcttatttattgtctcttgcctgcttattgcctactccacaacgctgccttatttcccaaggtgactctctcttagttctttctgtctcttcaacttcaacaaattaccgaaactcaatttggattatgacatggtgactgaactagcacaaccactaaattcttaatttgtatcattttctcattagtatagtttctatttatttcatataattgattaaaagggaaatgtctaatgttttattttgtttgtggctctagggagtttatttaggtatagtcgtcacacttgtgggaatgcattgtctttactctctatgggaatttatgagccttggtttctcagtacaatcgtggtttgcctcccaatcattttggaggataaaaaccacttgcagttggttatttagcatccctgatatcatactcaagctacttggaatctcgaaaactgttttcatagtcactaaaaagactatgcccaagacaatgtcaggatctggatccgaaaaatctcaacgagaagttgattgtccaaaccaagattccggtaaatttgaatttgatggctcgctttatttcttgcctggcacatttatccttttagtgaatctagccgctctagccggttgttcggtgggtctacaacgtcacagaggaggtggttcgggtttagcagaagcttgtggatgtattttggtggttatattgtttcttccatttctaaagggtatgtttgagaagggaaaatatggtatcccatggtctactctttctaaagctgcctttttagcagttttatttgttgttttctctgtgggaaactagtatactgatatggctttaatttgtagctaaaaactgctaatatgaaaataattattctctaatatacctctggctaaattttagtttctttgatacaaaataaatctaggactataaattcgtaaatagttgatgtacattctgaagtagtgagtagcgtattacttccaaaacaactgcatcgcctcttctacggctttgtctcgttctcacaattattagcttatatccatataagacactatttatttgactgatcaaaaaaaaaatacactatttatctttgtgggttttaaaactatgacaggacctgattgattttgtttttgtaagattcgtggtttttcgatttcatgaaaatgactcaatgatttcatcctttctacttttggggtttgaagtcaactgtttatgtggacgttatttttttgaaaatttaagagataaaatagggcatacgaagccaatatctagataagtgatttaggaacaaaaaccaataacaaaatgaagaaacattacttgacttcattttgtgtgtgacgagtggcgactagtcatcattcaccacaaagcgcaaacttgaatcaggagtaagaagacatactttatcgttatcctaatttgaatcggaccacacaataacccaccacaaatagacaaagatacatatattattgacaatcttttattatataagataacgttctatataattgaattgttttattaataacgaaaaaaaaacgacttcgatatgagtaattaattcgttgaaaaaagtttcttcgggtctagtttttttaaacttctaatatgatattaaaaaccaacatgatagctttcacttgatggtaacttaggatcagtatagtggtggtatctatctacaagtttaattccagtttacgtgaagttcataaattttattggtcatatcaatgtgtacaataaatatacgttttataaataaataatatttgcattttttattcatgtatctaaataacaaactagtccaatttcacttgactatgacctctttgttcttttttttgttaatagttttcacaaaaaaagcttactcaattttatatcttctcatcactcctttttattataagtgtatacaaattatatatatattttttacttaattcttagaaacatatccaaaaacctcaagaaatctccttcc

SEQ ID NO: 12156 - DNA, 3000 bp, Unknown
  misc_feature (1)..( 3000): cDNA_ID_3024114_gDNA_ID_2214534_Annot_ID_185029 3000 nt of promoter + ATG
atgcacattccagtgacaccaacctgtcacaacaattataattcatctgcattttcctcaagaattttatgcgaactgaaagaactttgtttaagtttagcaccttttttgagccattggattttagccaattaacagaagcgcggatatctttgatagcacctggccaatcaaggccatccattagatgctgtgcctctgcagtatccaaaccaacctttcctcgatacaagctacaaaatataatattgtgagacgatactcaatgaaccataatttacaaaactgaatcttgcagttaaagaagcactcactcaggtataagggctttgaatccaggctcaagttgtgagattttaatagcatggttcttgatctcaaagtcaacaccccaccattcttgaatcaccacaatcccaggcgcatcatctttaccgaccacataggcatcaaatgtctaaccaacagaccacagtgtataagttttctttagagtaaaatcaagattatagaagaatcatacacaaaaaaatagctaaatcaaatgcatttttcacaatcctaataatcaagaaactccaatgttcaagagaaaccagtctatccatggagagagttacaagcaaagcataacatcgccgaaaactctgaccaaaacaatacctaaactgtttatcactatactgatcatttgtgaactgaaacctaaactcacaatcttccttcttaaatcaaccagttctataaccaaacctgataaggactatgattatacggagatcttcagaagtagctaagcaataataacatctcttactctcattcccagtttctctaccacagaacaacactacacaatcctgaagcagaaacgccattgaaatgataaatcaaatataatccatacatcatacacaacagattccgagatttgggggatatcaaaagaaatgatgattttcattcaacggaaaggataaccaaaatttttttttacttcaaaatcaggcactacggatacagtcgaagcttatgatacaccaaacacaaccataaaaatggcactaagtagaaaaaaaactcagggagagacaaaaaagagaagctcttacagtgtcatctctttggatctgaattttcctgaaagctgaatccgccattgatcgcactgataagcgagaaaacgaaggaatcgaggatctatagagcgaagaagtttttccgattgaagaagagaagaatctggatgaggatgacactagtgtacttaacattgtttttgtgtcttgtgaggaaagaaattcttcagagtcaaccccaaacgacacaaaaacgacgacgtatctgtgagtgtgaatctgggcccggtatatttttaaaaatatatgggccattaggcccaaataatcaagtccttttttgtatttgtatttgtatttgcgacgacgataatacgtaaatagtagtttggtaatatccaaaaagccagcatcgcctctgctacggcgttgtctcttttctcccaattattagcttatatcaatataagaaattattttttttgtggattttgtaaccatgacaggaccagcttgattttgtttttgtaagattcgtggtttctcgatttcatgaaaatgactcaatgatttcgtcctttctatagtattttgggttttaaagtcaactagttgacttcaaaacccaaacttaacgtccatatatatacacatacacagtactgtattatgtgtatatatatggacgttaagtttttgaaaataagagatatatagggcttacgaagccaatatctagataagtgatatcggaacaaaaatcaatcacaaaatatctaccaagagatgtcatatgtgatacgtattaactttatatacatatgattagttccatgaatttgaatttaaaaggtatagtgcatgtatcaaagggcatatatagccacatctcaattgggataaatgaaagagttcatcacgtttcttttcaattcccaaaatggcgatgcgaggaaataaaggcaagttattgatttcgctttctataataattttaaatttttgttgtataacaatgataaagaaacgttcttcaacaacaacaaaaaaatgttacgtacgtgactttaatttgcgtgacgactactcatcattcaccacaagagcaaacggaataaaaagacaaactttatcgttatcctaatttgaaccaaaccacaaaatagccaccacaaatagacaaagatatacatacagcgagacacatcatgcaaaaatgtatatatgtagcttagtggatcattaataatgtttagagaaacgatcgaatttaatgagacttattttcgttgaaaaagttttgatagggtgtaacttaatatatagtatcagtctagtgctaaacatctataagttcaaattccaatttctgtgtatattttggcctccattctacaaatctatatttatttaccacaatgtataatctagacatacaatacgttttacaaaaaaataatatgtagtacatacaccatttgtgaagtcatgtatctatttgacaaactagtccaatggaatttgactatgactaatttattattgtcctttctcttgtgtatctttttttttcttcctaactaaacactactacacattatgggttgattggtatccaataccgctgtagtatggagtatattgctttgataataatcaatcaaaggatgctactaaaaacgatattttaagttttatgatttttttttctttcgtaccgctactttatatcgtttttaaactatttttgtatctcttaccgttttttctacttgctaaaaaacttatacgattttgtgtggccaatcggtcctatattttatatatacaagcattcatagacgtgacgacgcattattttacttaaccctatataaacatatccaaaaaccgcaagaaagctcacaagaaatctcctccc

SEQ ID NO: 12157 - DNA, 3000 bp, Unknown
  misc_feature (1)..( 3000): cDNA_ID_2708446_gDNA_ID_2214534_Annot_ID_185028 3000 nt of promoter + ATG
aattcctaataattaatacgaaaatttggaacaattaatatcaaaagctaagaacaaattttgatcttcgtcccaattgttttaaacgcaaaaatctgattgtgctaattaattgattttgtttttctttatctttctataaatcacagcattgtcataatgttttaaagaacacaaattcgaaacatcaacgatttcttctactttaccttctacaatttacaaataatgtttgattgaaaataaattatgtgttcttcttgaaagtaaacgaaatcatttaatttgtaaacacaattgcaaaattaaactcatacgccgaaaaaacaattaaaccctttaatttaccttggttatttcccagtctttactgaattcagaactttctgttgcggctggagggttcaaaaaatatctaaaaggagctctaactttaatgttatattttttgcagaagggaacccaaatcttggcgaacttagaagcttccttgagagagaagtaagtgagaggtgagcatccatcatccgatacataacaagcaagtttattcgctggataattcactgctaacagcgaaagcaacgtgtttgctacaagaatcggcggctcccgaacaggatccgcagtagtcacaaacatatctaccgatggaaggtcatgaaccctgaaattatttaattactaagagtcttatattttcaaatttttactagctagtccactaaaatagaaagataacagaaaaaaatgaatgatatttcgtgaggaaaaaaaaacttaagagttaggtttcagctagctaggacttaggttttatacaaaattaaaagaacatatgcttttaatatgcatgattgtatatataattgtaagtgtaatataaattgatacctttcatcaagtctttcaggatatgatttatatgaagcaggactccattttatgctggtaataagaagccatatgaaagagaaaaaggattcacagaggaaagccacaacccaaacggagttgttttggttcataagtagaattcggtacaagagaagagaaaagagaaagcctagaatcgtgagatccacaactcttagaaaatagtttttgtatgagatcttctcgcaaagaggagggagagaagaacttgaatctgccatgggaggagatttcttgtgagctttcttgcggtttttggatatgtttatatagggttaagtaaaataatgcgtcgtcacgtctatgaatgcttgtatatataaaatataggaccgattggccacacaaaatcgtataagttttttagcaagtagaaaaaacggtaagagatacaaaaatagtttaaaaacgatataaagtagcggtacgaaagaaaaaaaaatcataaaacttaaaatatcgtttttagtagcatcctttgattgattattatcaaagcaatatactccatactacagcggtattggataccaatcaacccataatgtgtagtagtgtttagttaggaagaaaaaaaaagatacacaagagaaaggacaataataaattagtcatagtcaaattccattggactagtttgtcaaatagatacatgacttcacaaatggtgtatgtactacatattatttttttgtaaaacgtattgtatgtctagattatacattgtggtaaataaatatagatttgtagaatggaggccaaaatatacacagaaattggaatttgaacttatagatgtttagcactagactgatactatatattaagttacaccctatcaaaactttttcaacgaaaataagtctcattaaattcgatcgtttctctaaacattattaatgatccactaagctacatatatacatttttgcatgatgtgtctcgctgtatgtatatctttgtctatttgtggtggctattttgtggtttggttcaaattaggataacgataaagtttgtctttttattccgtttgctcttgtggtgaatgatgagtagtcgtcacgcaaattaaagtcacgtacgtaacatttttttgttgttgttgaagaacgtttctttatcattgttatacaacaaaaatttaaaattattatagaaagcgaaatcaataacttgcctttatttcctcgcatcgccattttgggaattgaaaagaaacgtgatgaactctttcatttatcccaattgagatgtggctatatatgccctttgatacatgcactataccttttaaattcaaattcatggaactaatcatatgtatataaagttaatacgtatcacatatgacatctcttggtagatattttgtgattgatttttgttccgatatcacttatctagatattggcttcgtaagccctatatatctcttattttcaaaaacttaacgtccatatatatacacataatacagtactgtgtatgtgtatatatatggacgttaagtttgggttttgaagtcaactagttgactttaaaacccaaaatactatagaaaggacgaaatcattgagtcattttcatgaaatcgagaaaccacgaatcttacaaaaacaaaatcaagctggtcctgtcatggttacaaaatccacaaaaaaaataatttcttatattgatataagctaataattgggagaaaagagacaacgccgtagcagaggcgatgctggctttttggatattaccaaactactatttacgtattatcgtcgtcgcaaatacaaatacaaatacaaaaaaggacttgattatttgggcctaatggcccatatatttttaaaaatataccgggcccagattcacactcacagatacgtcgtcgtttttgtgtcgtttggggttgactctgaagaatttctttcctcacaagacacaaaaacaatgttaagtacactagtgtcatcctcatccagattcttctcttcttcaatcggaaaaacttcttcgctctatagatcctcgattccttcgttttctcgcttatcagtgcgatcaatg

SEQ ID NO: 12158 - DNA, 3000 bp, Unknown; identical to SEQ ID NO: 12151
  misc_feature (1)..( 3000): cDNA_ID_3024118_gDNA_ID_2214534_Annot_ID_185026 3000 nt of promoter + ATG

SEQ ID NO: 12159 - DNA, 3000 bp, Unknown; identical to SEQ ID NO: 12150
  misc_feature (1)..( 3000): cDNA_ID_2708468_gDNA_ID_2214534_Annot_ID_185022 3000 nt of promoter + ATG

SEQ ID NO: 12160 - DNA, 3000 bp, Unknown; identical to SEQ ID NO: 12157
  misc_feature (1)..( 3000): cDNA_ID_2708446_gDNA_ID_2214534_Annot_ID_134341 3000 nt of promoter + ATG

SEQ ID NO: 12161 - DNA, 3000 bp, Unknown
  misc_feature (1)..( 3000): cDNA_ID_2708458_gDNA_ID_2214534_Annot_ID_134342 3000 nt of promoter + ATG
aattaacagaagcgcggatatctttgatagcacctggccaatcaaggccatccattagatgctgtgcctctgcagtatccaaaccaacctttcctcgatacaagctacaaaatataatattgtgagacgatactcaatgaaccataatttacaaaactgaatcttgcagttaaagaagcactcactcaggtataagggctttgaatccaggctcaagttgtgagattttaatagcatggttcttgatctcaaagtcaacaccccaccattcttgaatcaccacaatcccaggcgcatcatctttaccgaccacataggcatcaaatgtctaaccaacagaccacagtgtataagttttctttagagtaaaatcaagattatagaagaatcatacacaaaaaaatagctaaatcaaatgcatttttcacaatcctaataatcaagaaactccaatgttcaagagaaaccagtctatccatggagagagttacaagcaaagcataacatcgccgaaaactctgaccaaaacaatacctaaactgtttatcactatactgatcatttgtgaactgaaacctaaactcacaatcttccttcttaaatcaaccagttctataaccaaacctgataaggactatgattatacggagatcttcagaagtagctaagcaataataacatctcttactctcattcccagtttctctaccacagaacaacactacacaatcctgaagcagaaacgccattgaaatgataaatcaaatataatccatacatcatacacaacagattccgagatttgggggatatcaaaagaaatgatgattttcattcaacggaaaggataaccaaaatttttttttacttcaaaatcaggcactacggatacagtcgaagcttatgatacaccaaacacaaccataaaaatggcactaagtagaaaaaaaactcagggagagacaaaaaagagaagctcttacagtgtcatctctttggatctgaattttcctgaaagctgaatccgccattgatcgcactgataagcgagaaaacgaaggaatcgaggatctatagagcgaagaagtttttccgattgaagaagagaagaatctggatgaggatgacactagtgtacttaacattgtttttgtgtcttgtgaggaaagaaattcttcagagtcaaccccaaacgacacaaaaacgacgacgtatctgtgagtgtgaatctgggcccggtatatttttaaaaatatatgggccattaggcccaaataatcaagtccttttttgtatttgtatttgtatttgcgacgacgataatacgtaaatagtagtttggtaatatccaaaaagccagcatcgcctctgctacggcgttgtctcttttctcccaattattagcttatatcaatataagaaattattttttttgtggattttgtaaccatgacaggaccagcttgattttgtttttgtaagattcgtggtttctcgatttcatgaaaatgactcaatgatttcgtcctttctatagtattttgggttttaaagtcaactagttgacttcaaaacccaaacttaacgtccatatatatacacatacacagtactgtattatgtgtatatatatggacgttaagtttttgaaaataagagatatatagggcttacgaagccaatatctagataagtgatatcggaacaaaaatcaatcacaaaatatctaccaagagatgtcatatgtgatacgtattaactttatatacatatgattagttccatgaatttgaatttaaaaggtatagtgcatgtatcaaagggcatatatagccacatctcaattgggataaatgaaagagttcatcacgtttcttttcaattcccaaaatggcgatgcgaggaaataaaggcaagttattgatttcgctttctataataattttaaatttttgttgtataacaatgataaagaaacgttcttcaacaacaacaaaaaaatgttacgtacgtgactttaatttgcgtgacgactactcatcattcaccacaagagcaaacggaataaaaagacaaactttatcgttatcctaatttgaaccaaaccacaaaatagccaccacaaatagacaaagatatacatacagcgagacacatcatgcaaaaatgtatatatgtagcttagtggatcattaataatgtttagagaaacgatcgaatttaatgagacttattttcgttgaaaaagttttgatagggtgtaacttaatatatagtatcagtctagtgctaaacatctataagttcaaattccaatttctgtgtatattttggcctccattctacaaatctatatttatttaccacaatgtataatctagacatacaatacgttttacaaaaaaataatatgtagtacatacaccatttgtgaagtcatgtatctatttgacaaactagtccaatggaatttgactatgactaatttattattgtcctttctcttgtgtatctttttttttcttcctaactaaacactactacacattatgggttgattggtatccaataccgctgtagtatggagtatattgctttgataataatcaatcaaaggatgctactaaaaacgatattttaagttttatgatttttttttctttcgtaccgctactttatatcgtttttaaactatttttgtatctcttaccgttttttctacttgctaaaaaacttatacgattttgtgtggccaatcggtcctatattttatatatacaagcattcatagacgtgacgacgcattattttacttaaccctatataaacatatccaaaaaccgcaagaaagctcacaagaaatctcctcccatggcagattcaagttcttctctccctcctctttgcgagaagatctcatacaaaaactattttctaagagttgtggatctcacgattctaggctttctcttttctcttctcttgtaccgaattctactt

SEQ ID NO: 12162 - DNA, 3000 bp, Unknown; identical to SEQ ID NO: 12155
  misc_feature (1)..( 3000): cDNA_ID_2708454_gDNA_ID_2214534_Annot_ID_134343 3000 nt of promoter + ATG

SEQ ID NO: 12163 - DNA, 3000 bp, Unknown; identical to SEQ ID NO: 12154
  misc_feature (1)..( 3000): cDNA_ID_2708450_gDNA_ID_2214534_Annot_ID_134344 3000 nt of promoter + ATG

SEQ ID NO: 12164 - DNA, 3000 bp, Unknown; identical to SEQ ID NO: 12152
  misc_feature (1)..( 3000): cDNA_ID_2708443_gDNA_ID_2214534_Annot_ID_134349 3000 nt of promoter + ATG

SEQ ID NO: 12165 - DNA, 3000 bp, Unknown
  misc_feature (1)..( 3000): cDNA_ID_2711549_gDNA_ID_2214534_Annot_ID_134350 3000 nt of promoter + ATG
actcaatgagagaaaatgcgtttgttgggttcaccggagctttgtggatccgagaaaattcaaaataatttgggaattagggattttaatattttgattttccctcttctttacccttttgaatttcagagacactgatgagaatgtgtaaatacatgattacccccgtcgaaaggtgagtgacgtggtatactccactttgatcatcgttagaaataatttaaatatgaaatatccatggccggtcataggactgatagattgggttaagacttggttaagagttaaccgatatataacaaatgaattttgtttcgccaacgctaattgtactattaacggaaaacaatcttgtcaaaatggtacatacgagaagcagatagaagaaactcaaagaaggtatctagagagctaatacatccgtagagatcacagctttgagaatccatgtcaaaacagatttgtttttcagtcaaagagcaagtctctcttagtaaaccatgatcagagtactgtgtttttaaactgcttcgctggattctctttcacatgttaggatgtccgaaacctccagctggtggcatgggcctaaaaccattgttagccattggaggtggtggcggtgggaataaaccagatggaggtggtggtggcggttgagcttgatgaggcgggggtggtggtggcggtggaagaccatttgctccaacagctgactgaggcttgtttggttctggcttggtaggcttgaaatacacctgcagctgttttattacattctttgtcagtattttgattaatccaaacacaaaacttatccaatctcggaaaagaaactaagcttatggctttatgagaattatgatgagaagcacttactgtaaacatcttggagtctggatcccagtgagagaaaaactttggggttgatttatcaacctctgtgctaggaacctgaaaccaatgcgaaaacacaaccatcaatatcagtaaacaattcgaccaagatatgttgggctactagagctataatcccagatgacttgtagaatgtaaatgtcacgaataaaagaaaaaaaaaacacataccttgaaagctatgatttcatatggttcggctgcaaatagaaggtattgatagctcttgtcataaggttgaactttctgcacacaaaaaaaaaggaagaaaactattcagtatgaaggaaaagaaagagtttatgagatacatagacaaggagttgtaacactcacctgctcataagatgacatgaaacgatgtcttggctttatgttgtcctctatctcaggatattcaatctgtaaaacattgtttgaggagtaaacagacacagtgagattttactctggctaagtctctaatgatgatcattgaagttcaacaataacaattagatgcttacctggaacagaagagatctttgttgcagctcgggatcatactgttttgtaacccggtaccctggtctaccaattttaactgcaagaccatacataaaatggagttattaataaaccctttaaagcaatcaattaagtaaaatctatgtactcaatagcaaagatatacaattttgctattacttctagacaatcactttcccattatatccaattccaggcctaggcagatttgatatcaacaatgggaataaagctgtattataattatagaaaataaaacaacttattacctgttctgcgaactgagacattgcgcttgagtggctgcggcttagtaggagcatccttagcctctcgagcagctctctttgccaagtttgtctgatgcctcttaccttgagtatgtgccaagtagtttccttcattgttatgcagtgttagacatagtttacactcatagctgcacaacataaaaacacaccaaaaatcaaattagtggcatgaggggaaaattaaaaaaaagaacctaattctagaaacaacagccaaacaaactcaagagctatcacacatatgaataatcaaactcaaaacggagcaaaaatgtagatgaagttggtaaaatcacagtattcataaatctcaggttgatcatccaacaattgaatctgctacttactcgtgcaacaaagcatacataaatacagtaacataccttccaagatgatttcgcatgaaatacggatctttagcaaggtctatggtttcaagagcaagacgacggagacgctcacggcgatctatggcctcgttttggccggaggcggcgccgccactaccaggcttggaaccccattctctatccatagctgctactaggatctcctttcacgctaactaatccccaatcggtccttctatgctctcttgtgctgctctctcgattgctggaaaattttgacaattgctgagatttttcttatgacttatgaagattggggaaaaaaagcacagatgggggagattgggtggtttatcagagaccctaatgtgggttgggtttcgaataagatgagacagtttaaggcccaatatcagcccatcaatgtgttaaagagaaaataacgtcatcaggttttatttcatacatgattcattataatgataaactgattaaattaaaatcctagatagacagacaatttctgctttcacttattggaatttataatcaagctaaatcactacttgataatataataagaatgatataaattactttaaaattattattaattatcaaataaatgcgtgtaactaatttcattgctttaaaacatgaacatcaatgtcttacgttacttcttccacaagaaacaagtaagactttgactttttaggtttcttgttctcgtgatcttcacgaaggtgaagcttccctgcttatagggaatcatcattaactcttagcacattaattaggagtttcccacatgcgtatttatatacaagcatgaagcattcatcgatgtgaagttcgaaaacatatccaaaaactgcaagaaagctcctccc

SEQ ID NO: 12166 - DNA, 3000 bp, Unknown
  misc_feature (1)..( 3000): cDNA_ID_2706673_gDNA_ID_2214535_Annot_ID_134352 3000 nt of promoter + ATG
actccaaagttggttcgtcagatgatgaacatcaaagggcttagtattgctcatgtcaagagccatctacaggtatttgatctacatacatctaaaacgtacctatatatgtgttgtattttcgatttcgtttcaaataatctctgaaattagaaaaaaaaagaaatcactaaattgtgtattggaaaattttagatgtacagaagcaagaagatagatgatcaaggtcaaggtattgattctttctatttgtgttcattagttagttatcaagttatacatgtataggccaataaagtggggtttgaattgttggcagctatagctggtcacaaacatctcttcgagacttccacagatcgaaatatttataaactaagtcagctaccgatgttccgaggctataatcataaccatgattctccattcaggttgatataacttttttttttgaaaattttagattttatgtgttccttaatttgaatgatattccgttttaattatatttattcggaaactaaattaattgtcttcttttgtttttggtagatatggaagtaaaatttcaaatgcttctttgtggaactctagctctcaaggaacagaaaggagtttgatagaccaaattaggcccggtttaatccgcaacgcgtcggttagcaataacatccgtggtagtgattattggactaacaacaagtctttccaaaacatctactcttcttcaatttctaatcactttccgaaactacgacacgatcatcacgaacggaccaattcagtcacattcaacagcattcaaggacactcaagaacttttcaaaagttccataacggtgttgaggagaacactaatcattcttattgtagcaagacaaatggcaaaagagacgcaagtaggagcattgatcttgatctatctcttaagctaagacaaccggagaagacaattttggaagagacagaaacagcagcaacaacaacggatcaaacgttgtccttgtcgctatgtccagggtcgtcttcgtggaaaaagagccgactgatgaaagatgaagaggatcggacggttaagattggtcaggagagtactctggatctgactctatgaattatatttaagaatgagacaaattctaagtgagatcttgaggtacttaccgatatcttaatattcagtgtcgttgttgtttatcattaatcatgtattttctttattattagaaaggaaacaaaaatgtttgattatattaacggtcttgagtttgtttgataccgccaatttgtatcatcacatatataaacaaatattactagccacatcataatgattcgatcttttgtcttctcatagcaatatactatatgaaaattacatatacatataacaacaaatttacatcgattagagtatctctgctggtgagcttcattcatttgtagatgagacttttacgtaaatagtacaaaaattttggtttcgtatttatccgaacagtacatggacaattttgtagttccaaaacatgttatagttaatagtagtgttttcaataatttccaaaatccatcttcactcatttttcccttttcagagacatagtgaaacaattttacactatgcaaatccgaagccaattatttttgaggtttttactatatgtgaacaagattaatacttaaacaacaagacacacctcgttctttgtaaatattaaagaggttaaagatcataatacaaaaaaaaacatagaaaaagttcacaaatcatcaaatcttttgagttcattattctatataaaattttatctcgtgaaatgtttattgtataaggatgtgattagttgcaaaccaaaaattaatgtttaatagtatttgatagggaacttatttcaactgtgtaaaattttcccggtaaaattttcgttcaatcagtcgattctaagaacatgaatcttattgaatctctaataatttattgtataatatggtggcacctatacgtcaatacgataatgacgtcgttaatagtaacgttgagagttgagactgttgtataattttgattcgacgtgccaaatactacgttcgaccaagtatcaattttgattttccaaaaagaaaaaacaagaaacttaggatctccgttagtttgattggatacactgatactgtttcgatatttagacaaacaaatggaatctttgcttcttaaacattcgatgcgtgtgtgtacctggtcaacttcttcagacttcattatcaaacatggccgcacgatcagttttattttgctactggagaattaacttatccacctcagaatctaaactaatttctgaaactatataagtgttttttggggctaaaaataagatgcatgaagtgaaagtatcctagtggttaaaaaggggtgtaaacataacgtttaatgttgtatccctttatatgtacctctaatgtccctctttatttacttttaatgatttttaagactaaatatcttcagttgaagtaggtaatctttttgccaaattagtcttcgcaatacacggatcgatttccttataagatattaaatttaactcattcaaaaaatattaaatttgcaatgacttataagataaataaaaaccaaggtccatatcttatcccaatttgttttttttttttgtataccaaatttgtctcctatattgtttttatatgtttatattctttctcctagtaatttacacaaagaatttaagaagcttcattgaaatatcaagactagaattgaagaatgagaaacatatctatcaaacctcgaagacttttctccatcaaaatgtgcaaacaaaacaccaaacccaacttgtgtcttgtctattctacacacattattataattaaaggctttcacacctacacaaaaaaaattcgtaccattgactataaacatcacaaacccaacaaaaatttcatcaactccgggaaagatagaataacaaaatg

SEQ ID NO: 12167 - DNA, 3000 bp, Unknown
  misc_feature (1)..( 3000): cDNA_ID_1807810_gDNA_ID_2214535_Annot_ID_134355 3000 nt of promoter + ATG
cctctgcccaaatttccgatcgttggagaaaaggaaaataaaaataaaaatcgaatataagtgtatatgaatataattcacaagttgccacatattagtatatcgcttcttgttatataaagaggcttcatgtgatgcttctagaccgaaccacctacatcggcgtatggccataattgtagttggggtcgggttaaggtaatttatcatttgtactaattcataattctttttattttctgttataaatatcatctggaaggtccaaggccataagtattgacgaattgtttaagaatctttccaatagcctttttaatacatggcttttttgtatcatggagttgagtcatccgtgttataggacttttaaaataccgattgcagcatgttttcgatgtgaaaaatctgcattggtgtatttgttgatttgttataacgcgtaaagcatgcaatgtatgcttttagatggtaagttaacttgtaaaaatatcgatctgctaatgttaagttgtgtacaagaaatactatccacaaaagcgtatagagacaatcgtacctaacctaacacaatgtaacaaaatttgaaattagttttgtaacttaaaataaaccccccaaaagaaaggtttaaaacttctttttatgggcctatagcatccgcctgtatgcccaactggacccggtcatttctaagaatcgcaatcccaacctacgtgtaataactaatagtatgaatagtatgaatttcacgcatgcacgacgcatttttattttcttttacgccacacacgacacattaataaggtttagacaactttttttgattcgtgaatgccttctttgagaaagattgtgttaactatgtgtatatcgttccaaggttattagatgtagtccaaaatagatcacataagttatgtatttgtttaaggtttgcgcaccaatgatattgttgcatatcgaaccagttggtgagccggaatggaacttaattctcatcaactccactatggttatataaaagaaattgcatatgtaactatatgtaaattaatgggtgagattgtgagactcttagtgaattgagagaattttagagagagaacaaaattgtgttagagaaacatatcaaccaaaaagacatttgaaccaaaaatacaagtgactggtttccatatgtgatagtctccagtatatgcatctaaatcaattatgaaccaaattcatcattaaaatgggcaaaaatgtgtttggtcgcgggaagacccgtctgtcatccctattctaaactttcaatacaattcgttaaaaaaaacttaattctaactaattcagagtaagatagttgaaaactatacaacaaaaaatataagaaaatgatgaatttctacaattaacaaactaaaacataaactatcaaatagaaatagatgtatcatgtcatagaatgagataaatggttcactatttgattattgatttttttttttttaacacgactatttggttattgattatgtcaaaaacattaaaataataattttataaaataatacgatatataatgttttattagttttatctatccccctactataacaaaaacttatagaaatatataaacatatagaagaagaaaaaaagacagaacatatagaaacaagaaataaaattatactttcaaaaactacgaagcaaggaaaatcgaattttgaggtaacttgaaggcaacgaatagtatgaatgtggaaacgtcaacaacttaaccttacgtttacatattatattatttgaccatctctaaccatatttggattatgaaaatccaaaagggcgctcgcaaataccatagtgaccccctgtggccacacctttctcagatgtctattatgctttatgaagaatgccaagggggtttctcggtaacaccaaattaatcgatagtcgccttcacttgcaaaccaagaaagatacgaaactacaccgagaaagtacaatcttatttaaataaccaaaacaaacaacttagttttgtctgacccactaggccactacttctattcgacaactttaaagttgacgatacatatacaattcctgactcaactgagaacgacaatgtacaatcacacaacgctggtcgaacttaggagccaataaaacacttgagtcgtgacatgaaacacacggctacaatacaaacttctctcaattattttttgtaaagaccgattatttgctaagcaagtcctagacaaatatttacacacaatcgctataatatttaacaagagatcacggtcagattaaactacaggtcgaatgattacggtcagattatagacgcagcgtcggatttctatctcatagagtcttgacataactttgtttcctagagtcacgaccttatttcacgtctattggcgaaataacttcaatatatcgcattcacaatggacatactttttgtttttgttttttgttgggagtgaatttcttcttatccaagagcatgttaattaatgttttagagtgactttgacgacaatagtttcgcaagaattaataattaatgtttagtaacttaattttccaaaacattagaatcctactttgtatatgtttcaaacaaagcacaataagtattcaaagttaaatctcagagttcaaattaagcctttaagattttgtcttgaataattagcttacctctctaatcattaatcaacttaggaaaaatattatttttcaagtagtgggcaattgcttggcaaactgtcaacacaaaaagttttagaatttatattaggaaaatgattcataaatgtatatatagacagctacagaaaattgattgaccaccaaacaacaaaataacttcaagaaggctggagttaaaaggcaagtaagagaaagacacatcaatataacccaaaacaaaacatcataacagcaacaataacagacacataaccaatggcaaagcgacaactgttg

SEQ ID NO: 12168 - DNA, 593 bp, Unknown
  misc_feature (1)..( 593): cDNA_ID_3437550_gDNA_ID_2214535_Annot_ID_185070 3000 nt of promoter + ATG
tgttatttgctttttttatctagacgtccttgttttatataaacagtctatgtacgttgtattgtacaatgtttaatatcaataacaacaccctttggcaaaaaaaaaaaaattacatatcgtgtcaagcatagtagtgtaaattgtaaatcgtttaggtatataaaagtgatcagtttcttattgcacgatatgtggtatggttcttcacgtggaacctaaattaaacgtcatggattttgtgtcgctttaccgtgcaagttgcaaactatgcagtgtttgttgatccgatgacagtttctttcttcagcccaaaagcccaaaaggcccaaagtaaaatagcctcttgctttaatacacgtcggtatctctacagctaacacgtaaaacagacgtggcaagagttgcttccagaatcattaatagttaaaaaaaatcatcattggcacaagaaagtgagatatttcctagtcttgctttcaagtttcaagcaatctatctatctcgaaaaagcagcgatgcaagacgccgagacatcacgacagccggcgaagtctttgtccgatcgagtgaagactaactgtttatccatg

SEQ ID NO: 12169 - DNA, 3000 bp, Unknown
  misc_feature (1)..( 3000): cDNA_ID_3024137_gDNA_ID_2214535_Annot_ID_185067 3000 nt of promoter + ATG
caagactttcgaagtagcttggttctgtttgttcaacgttaattgcaccaattgttccactgctatcactgaaacttacctttaaccttaatgtatacaaagttgacacatccatcaaacttgactgtgataattgggaatctttcagtgtattgtgtactgcttggattccgattatagcttttaggtaaaagaaaatttcagtatgcaatgagtcattcatacaccatgttcacataaatgaaaggactggtaacaaaacttaacttctgtttttcttgacacacacaagtacaatccttgataaccttaaaacaacattattgtaccaaaacacagtagaaagtaaaagaaattaaaaagaaacttgatagaacaagcaacatcatatggttcttcatcatgtaagataggcatcgcaatgcaagaagtcccatatagttccaagagcatctcgtagcatctccaaaacacaacccctctcagtgttctgctcctgcagaccacaagtattatcaccataagcctcgcacttccattagagtttctaaaatagtacaagagcacaataatttacctgtattttagtgtcgatgtctttaagcgtcaaactcacctccctcttggtttcccctgttccagtcgtctcattgaatctatcagtctctcttaccctaagccttagagttttatttttgtagatagtagctctaacgtgacaaacttcaaattctttgtatccatcttcagataaagctttaccaaacggccaccttaaaccgccttttacatttggatcaacagttgctgattccaatagcgctttaatgtcacctatctctttatcctgccgatcaaagaaagatcacacaacctaagtctaagaagagcatattatttatccatatattgtaaaatatatataccaaacttgaacttacactgagatacgttatttccctcttagcggtgagcgttagtctcatgtcgagattcttatcaatgcatgacacatcaacaaccaaatgccttacaggattaaggtcgacctatataaaagcaaaactcaagattcaaagttagatattaaaggaagaccaagtaaaaatgtgacatctatcaaattcttgtttgtttttcttgctagtccgagaacaataaagaagagattttactattggttgtagtcactacacacataaaactcgagacttgccttgtacatactgagccgtccatcttccttacgggtacatttacagttgatggttgcattaggacgagaataatgcgatacctaaaaatagaagccaaacccaaattagcacattcaaatgacattcgaagtatagatctaaatctaagaaaatgaaacgagtaccttcacagtgtatgtttccttctccttatcaatagagaatccatggcttggtacaacattagattttatgtgttgtaagtaagacattgggagatcagtagagaacatcttattcaagttttttagtgaacattcagccacaggaccagcttgactcctggtttaaagttgtatatgttagaaaaaatataaacccattcctgaaaacagcaaaatgtgagatcagacggtgaatcgcttacccatagaagaaaattttaccaaaccgagcaaccagtctcgatacatgatgatgctccttcatttcagtcttaactcgctcatatgccaacacaagatcctccataaccttctcagctactaatagccactgagttctctcatccttcctctctccaatattcatattcactgaatataaacatataaaaaaccatactcaacatagatacaatgcatcttcttttggcaaaaacgataatagcacaaacaaaatagttaatagtattgtttatttcagcatctagatgatattcattttgtcaaacacatagccaaagtctactaatagtttcttaccattttggacattgttgttcatcagtattgaaggcttttctccttttctacactcgacagaatctgaggacaagggcacaaacttaacatacgaaggaacatcgtcctcaattccatttgaaccaacaagaaaccatttggaaatggaatctcctgaatagataatcttgttgcgtttaacactgctagtgctactcttaaagtcaaggttcttcttgaattttgtaacaagagaatctggaacaggggtaggctttgtcggatccttcgaatgcctcttatgtggtggaatataagacatgtctaaacctgaaactcacaacaacatcaaccaaaaacgatttcaagataaaacaaaaaaatctcaaacttggagctcaaataagaattgctttacaacgagcgaagaagaatataaagacagaaactttaaggtgagaagagagaagtcgaatcatacctgtaggctgtagtcgaaactcaacgtcttttaatattcctgcagagaagtaacagtgacactcaaatagactcttcgctccctttttaatctttcaattaactctcatccgtttctcaaaaatgactttaattagattgtgtttggtttcgatagggatcacaattggacaaacctcaagcctgaaactatcaggttcccgaggggtttggtcttaaatgcaggttttattgcaacaaggttttggttttgtaagaatttttcactaaaagtaacaattttttaagtatttctggctatcgaaaaatagaaaaagaaatgttttcttaaaaagtcttttagcgttgaggttctcagactctctctctctctctttgcccctacctatatccgccgtcttgaatccacagaaagtccgttttagtttccagctaagtgatgtcgtcacatatctaatggtggtcggtcactacttaaatgaagacagagaagcttttctagtcttcttctttctaaagttcttacctttagaatttgaacaaaagtatcagcgagctgatcagacagagaagctcaaaca

SEQ ID NO: 12170 - DNA, 3000 bp, Unknown
  misc_feature (1)..( 3000): cDNA_ID_2708489_gDNA_ID_2214535_Annot_ID_185066 3000 nt of promoter + ATG
ccttggacttgaacatgtaccattcgaacttaatgatgtctggccatctacattgctgctactaactgattcctgaacattcaagtcatgagacactttgttggcttcaggagtaacgtgagacatagaatccaccaactcactcttaaaactagaagtagaaggtaaacatcccgaaagtttctctccatcagattgatcatcaatggatatgcttgcagtgtccgagtaagaataactagtgctctttttcccaaacgagcttcgcccattttccgaaactggtgtgtttccatttgaatgagaaaatgaaaactgaggtgggtcctccattctctcttcaaccgcatcagaatatatatgatggttcccatccttcaaagtatctgatctactcttaggtctacactcatcgtctgtttctgtttccgactccatggtggctggtgcgtccacataattgtcagcctcactggttaaatcttcagaataactcctctgttgaaaaaatcctggcttcccgttcaaaaccgtttgtgaatcctgtgtaatagttgttccacggacctcattgtatgtagattcaggcactgtctctatatctttttcaataaaacccccattcatgttaacatttgccacattttcctgctcacttgggaatgaaacctctgctctgcttcctccatgagacttatccatagcacccaccatactgatttcaggtatatcggttactacatctctagcactatccatattccatgtcaacaatccggggttttgggtaattatttcataacttatcttactatctacacgtgtctgcacaaatttctccatgtagctttcccctgattttgaaataagggaacacccatctagctttctggttttcaacttcacaacgcgcgctggatctgaatgatgagcctctaaatgctcctccaaaaacaattcatgcaatctgtgccagttgaataattgaaaccagccatttttagtcacagtcagataccaatataggaactacatatatatcataacagaaatgacaaacacacaagacataaaatagataatactcacttggcatgtgatgataatgcattttcaggtgtccctccattcctccactgagatgctctcctctacaagagaatagaaggaaaactatgagaatcacaaaatggaaggtaagattacacattcaaaacaccatgagcataagaaaatctactattcagaaaatctaccatgtaatggaaaccaaaatataaccaagaaggatcacactgcaacccataagctacaacctgaactaagaagctagtacctttgctttctgtgattttttctctctctgaatatcatcccatgattcttcatatgaagacgtttcaagcctaacaaacgatggatcggtgtagcgtttcaaacaagccccagctccggaaatatcaaacctaatcaaaaccatcagaagatgttacatatatccttctctaacaaacgactaaagaagaagtcctatcaaacaaggctaaatcatacttgtccagaagaaatagccttggaggacctcgacattcctcataagaatccatcacacaacgaggtaagtcaccacttgtaaccacactctgttccaattgtagattcggatgccattccacacctgaaatagagtcacagaatcatgttgaaataatccaacatcatagtagctgaccagatcatgaatgttcatagcaatctaacctttgttagagaaaaacggcgaatgatcggtttgacacagtaatgccttctctatagaaggaaactctgcttccaactgttgcacacgagccattaaaccatggcttctagaagcagtagccattacttcttcgtgcaagtcatgaaacatctcagcagcaaaccttcatcacaaattacatgaatttaaagacaattccatcaaaaaatcaaaactttttccacttccacaaccaaatccagattcatcaaaattgtcgctttacaacaacggattccaaaacttcgaattcgatgcgcttagagatcaattagagaaatttcgattggagagaaacttactcagcgagatcaccgagttgacgcaaaatgccaacgagaccagccatagcgactccttcaagcagagcttcagggtcatctttatcagcagcttgatacagatccggatctgctaatccatactcgttacgagattggtacctcgtcaacggcattgtttgagcttctctgtctgatcagctcgctgatacttttgttcaaattctaaaggtaagaactttagaaagaagaagactagaaaagcttctctgtcttcatttaagtagtgaccgaccaccattagatatgtgacgacatcacttagctggaaactaaaacggactttctgtggattcaagacggcggatataggtaggggcaaagagagagagagagagtctgagaacctcaacgctaaaagactttttaagaaaacatttctttttctatttttcgatagccagaaatacttaaaaaattgttacttttagtgaaaaattcttacaaaaccaaaaccttgttgcaataaaacctgcatttaagaccaaacccctcgggaacctgatagtttcaggcttgaggtttgtccaattgtgatccctatcgaaaccaaacacaatctaattaaagtcatttttgagaaacggatgagagttaattgaaagattaaaaagggagcgaagagtctatttgagtgtcactgttacttctctgcaggaatattaaaagacgttgagtttcgactacagcctacaggtatgattcgacttctctcttctcaccttaaagtttctgtctttatattcttcttcgctcgttgtaaagcaattcttatttgagctccaagtttgagatttttttgttttatcttgaaatcgtttttggttgatgttgttgtgagtttcaggtttagacatg

SEQ ID NO: 12171 - DNA, 3000 bp, Unknown
  misc_feature (1)..( 3000): cDNA_ID_2708481_gDNA_ID_2214535_Annot_ID_185064 3000 nt of promoter + ATG
agcagaacactgagaggggttgtgttttggagatgctacgagatgctcttggaactatatgggacttcttgcattgcgatgcctatcttacatgatgaagaaccatatgatgttgcttgttctatcaagtttctttttaatttcttttactttctactgtgttttggtacaataatgttgttttaaggttatcaaggattgtacttgtgtgtgtcaagaaaaacagaagttaagttttgttaccagtcctttcatttatgtgaacatggtgtatgaatgactcattgcatactgaaattttcttttacctaaaagctataatcggaatccaagcagtacacaatacactgaaagattcccaattatcacagtcaagtttgatggatgtgtcaactttgtatacattaaggttaaaggtaagtttcagtgatagcagtggaacaattggtgcaattaacgttgaacaaacagaaccaagctacttcgaaagtcttgccaagcaaactaatcactcttctattaagttctaacaatcatcaataagaccaaatacatcaattttacaactatttagagatgctccacattgcttaaaccaggtgtgctaaaagttcgactgcttgatccatcaaacctttctcacataatctgctaatgacttcctcaattctcgaactcttaacgaacacgttcatgttaaatgcttcttccaataaaccatgagcacaaacaacctcgtctacctcaatatatgcactaatcataatatcaaatgtgtggctgttccggttaactccattcgtctccatctctttccatagagtcttagctcgactcagatctccagcttttaccaatgccttgatcaatatattgtatgtaactacattaggctcagaacctagcttgttcattgaagacatcatctttaaggcgccttcaatatcgttctgcttgcataacccattgatatacacattataggtataaacatcaggagccaaacctaacaagagcaactcatcaaacaacttgtctgctttcgggtaatcctcatccgcaataacgccttgcaacacgattgtataacaaacaagatcaggctctactctgtcacatttcatctgattcagtacacttacaacttctttcccccttcctccttccaccaagaacctcatcacaactgtataatcccgcaaacctggcgaaaaccgagtctttcgcagatcttccaaatatccaattacatcgaaacatgacgaatccttgtgtttacatacagaactcagtaaccgagagtataatcttggatcaacaataacactatcctgactcatgtatctcactaactcagtagcacaatctacctcacctattctacaaagcgcatcgatcaatatcccgaaagtagattcctctaacctaacacccattctacaagctttcaccaaaatctcaggaaccaattcaagactctgtctttttctcacaagaactaagagcaaagcattgagcgtgtaagcagaaggcacgcacctgaaattagggattttgaagaaaacctcaatcgcctcttcgattctaccggagaagccataagcagcgatgacatctctgaaaatggattcaggtgtatcgaacttctcagagacttcaaggtggtaaagaacagatgaaatattctcaagctgagaggatttagctagggttttgataacgaatctgtaagcttgaggagtgggctcacagttatggagttggaatgagcttaagagggttcgcataacagaagcattctctgaatctgtgagaaggttgcttcttagctcttccatggcatacttctgcttgagattctcgttccatttggttttgaaagacgaatgaggaatttttcgatactttctcatgaaatttgacattcggtgccatgacgaagatcttgccatttcttcaattcgataaaactggaagacatgtcatatacgatcttgtcggtatataacatctgtaaaagcccaactagattcaaaagcccactactggcccagcttcatttagggtttttatgtatcttctattgttacgtgtgtatacactcccttcaccgcagaaatacagaattaaaaaaaaaaagttttgaacgatgatgatctcaatcttccaaagatttgatagaggagattctttctaggcttccctcgaaatctatgaaaccagtgagattaacttacaagagttggaacaatatatcaaaaagtaagagctttacaaagatgcacattttaaaatgttaactaaaatacacaaatttaagtctttataaaattggttatatgatatcaaatagagtacacatatctaaagttataagagaaattattttaaactatccttttcatctttttctaatagtatagcaccaatcaaaaacaacgtgtcaatcaattgtagataaaatgtatcccaccttttattatataccctttttatcatacatcttcttagataattctcatccaacacgtaatcgtataaatatagtattaaaatccaatctcttaagaacaagataaacaacattagaaagagaattattatccacgtaaaaaaatcattagtctttaatagttttaacgttgactacataatacaaacgcgtggtttcacgcactaaagaaagagcgtgcagcgggaaaatttgccgtcattaaaaactcagaacaaaaaaaaaaaacaaacagatcgatcagaaataaatagaaaaaaaaaagattttcccttttttaaattaaaatttctttgtttcatcctctggagatagaaaaggaaagaaacaatttacaaaaggccttaaaaaagcaaagattcttcgctgacttcgttctctctttcgctggcgaagaagattttctagggttttttgtttgattttcgtgaagtcggaaaaattattattattaatcgtgttgagctgtttgatcggtgaagactatg

SEQ ID NO: 12172 - DNA, 3000 bp, Unknown
  misc_feature (1)..( 3000): cDNA_ID_4378596_gDNA_ID_2214535_Annot_ID_185062 3000 nt of promoter + ATG
ggacaaaactactttatataccatttacatatagaatttgctaaaagccttttttttttttaatgtaaaatatatggtttttgtagggttgtgatgcatcgatcttgcttgacaattccacatcattccggactgagaaagatgctgctccgaacgcaaattcggctcgagggtttaatgtcatagatagaatgaaagtagcccttgagagagcttgcccaggaagagtctcttgtgcagatattctcaccatcgcctctcaaatatcagtgcttttggtatataaatatacatacatgacgtatcttttattaaactaatcgaaaatgttatcaattaaaagtctatgttttatatagtcgggaggtccatggtggccggttccgttggggaggagagacagtgtagaagctttcttcgctctggctaatacagctctgccctctccgtttttcaatcttactcaacttaaaacagcctttgctgacgttggcctaaaccgcacttccgatctagttgctctttccggtaaaaaaattcatgttacatcatctaactctaattaagatatgcatgtgtttaaaatgcaattcctttttatatattgatagctagctaagctagacagacacattcctagactaagtctagaatttacatagtaatttgtaagtaataaaattacaatgttaactcaatgttttagattattttgttagagtgatctacaaaatttactttttatgtattttttttctttcttatagatatgatttggtttgagctttgaaattgtcttataatatttaagggttttatttttctacaatgtttgagttcgaattttagcaatatttatttattagaaagtttttgaaggtatatgaattagttaacatgagttaaagatagaaaaacattttcttggaatacatgaccaaatagctgttaagaaaaacatgaccgaatgtaaatgaaaaaaagaaagaaaatctaatcaaatacaaatcatctagcacgtgatttttcaattttaactgagttggtaaacgacaaatcatgtttatctttaaataaaatcactaattccatttatctaaaccttaatgttttgtcaaaacgttttaggtggtcacacatttggaagagcacaatgccagttcgtgacgcctcgtctctacaacttcaatggtacaaacagtccagacccaagtctgaacccaacttaccttgtcgaactccgtcgattgtgtcctcaaaacggaaacggcaccgttctggtcaacttcgatgtcgtgactccagatgctttcgatagtcaatactacaccaaccttcgtaatgggaaaggtcttattcagagtgaccaggaactcttttcgactccaggagccgatacgatccctttagtaaaccaatacagcagcgacatgtccgtgttctttcgagcattcattgacgcaatgattaggatgggaaatcttagacctttgactggaactcaaggagagattagacaaaattgtagggttgtgaatccacgaattagggttgtggagaacgacgatggtgttgtgagttctatctgattatgcatgttgccatgttggggatatatatatggatatgtaagaaagtataaaatgcgcacgtgagaacaatttcgactaataaaagttttcacgagttatgagatttatgaaattggtattaagtacacttacaatgcatatatacgtggtgtttataacacttcaatttctgacatgtattcaagtagcttttgatttaacatcacgtcgaaatttataatatatattcaagcaaattgttgaaataaaatgtcctagtttttgtcagctttcgttacttataaatgagaagaaaagacaaggagctaaactgctaaagtattagattaggttaacttttgttaaccacaaaatctagcacatggacgcgtatgaagttgataaatcatatatgtattaggtaacattgttatttcagattaaattgttttgagcaagaattgtataaaaagtttatcgatttgtgaaggtggcttctgaggctacatttgcgggattcacggggaagagaaggacaaaacataaggaattctatttttcataaaatattaattaggaagatagtttgaaaatgtttgccaattaggaaggacaatccttttagaaggttttccgagatttttttttttgtcttgtatccaattataaatgtacgtacctcgtgtataaattaaaaaaaaaaaagtttaaacattcctttgaaactacaacaaactcatttatacaaatatccgtcccctcaaaaattcagatatatcaacaagaacacgtcacaaataaaacgtaattatggtaacatgatgatattatattttcctacatagacataacttgtgtctaacatgaatcaacaaacatatcttttacgaccctacataatccaaaattgatatcaaatatcgtactaatttcattttccgtaccactgttgaaatttgtgtcgtttataaattatttatcaaacttgaaaaatatctaagaataagaatatattggcggaattgagaaacattagatacgtacgtcgatttgtagtaagtaaaaaatgtaggggagacggttctaaaaagttgtaattgaagttaaaatgatcaatcttacttgatttatcacagcgtcggacaaatacagccaaacactacgagcaagtttaattctgtccaaagaatatatagcacgtcgaaattagtttattttaaattctaattattatttatccttcaaccactctagtaaaacacatggccttaaaaaaagacctaatagtattttttaagaacacaatacctaatagtctaaaataccattaaagaaagactcgaacatctctatatagtgttccttctaggcccttagttaatacacacactcacaactcaaatcatctttttgtctccctcctgaaaaa

SEQ ID NO: 12173 - DNA, 3000 bp, Unknown
  misc_feature (1)..( 3000): cDNA_ID_1807757_gDNA_ID_2214535_Annot_ID_185061 3000 nt of promoter + ATG
agactgtggctttagtcgcctcaagctccttcaacacctctagcgtttcgcgttctttaacaattagttctctttgtagctcgaaagcttgtgctttgagtcccatgatatcaggttcttggatattttcctgccaccaatatcagaaagacaaactttaccttacatatcctaatttgaacaactatgatactttaatatatgacacacaacacaaaatcttcactgatgtgatgaatcaggttgcaaaatgtaggtaatgaacaattccttaaaatgaggtttaagttttcttcatcattgatgctaaacatgaaagggaaatcaagtatcgtcatcatcattatcttcatcataatgtcgtttaaggcataaaccaaacatcattaaacatcaatttcaaagtttgatgatatctttttgttgtttcagacaacaacagccaaacacgcttaatctaacaacagtaaaaccctaaatcatatttttcagagagaatttaaagaaaagactgcaagtgagggagatagagaaagggaaagaaacctgagaagcatctgggagtttattgagagaaggtctccagaaaccaaaaccgccgaaacgagtggctgcttctctcactgactcgaacggagccgaagtgtctatctcaggcttctcagctcgaccattcgatagatccgagtcagggtttacagtgcccggttctggaaattcggccattgaagcagaagaagacgagtcttcgatggggaagaagagagtgaagtgaaaaagagagagagagagagattagggaggaaccaaagtcttgtgtttgtgaattgaaactggtttgataaagacgtgtcggaacacgcgccacggtcgtctcgtgaacagtgttagaaagtcatgttttttttttgtctcaatttaaatttgaaattagcaaaaatttcgcgtcttttcccctcttggatcatataattgctaatctcaattcttaaattgggattaaggaataacctttaaacggctaaaactatctgaatgttttgatattttatcagattgttaaaaagtgatcaaaaaaaaacaaagcaatatatttatcttcacatgcctattcaatttaagtgacgtgttgttatttatcacaattaactgacagaattttgtaaaacgttaccatgtgactgtttttttttttttcttatcacaaacagaaaattatttccgttccaatctttcttgccatggaagaagctatgttagaaaatgagctctagcttaccggtaatagggaaaccagtcttgacaaccatcgagaagagggtgacaacgatacatgagcgatggatagcacataagaataaaatgatgaagggttcaagcaaaaaaaaacttggtaagagtttgaacccaaaacatcagatttgtcatcttttaggtgagacaaaaaagtcttgataacaatgtgtgccggacacagtttttttatctagaagattaaactttgatttttctcacctaaaaggtgacaataaagtgagctatgtagagtgtcgtcaattatttgtccatcttcttgtttgtttttttaatttcttctttttgtccaaccattagactaatattttcattttgtttctttctcttttgtcttcgctttcatcttgttttcaggaatgactaatgcattcgaatgttttttcttttccttttatgtgcattcctactttatgaaacaattagttttcaattcaatttcggtgatagttttagccatttctgtccactttggttgtcttagttagtttattgatgagaagaaaagacaaggagcaaaagtattagattaggttaaccaaaaagtctagcatatggactcgtatgaaattgatatttgtatgtattaggtaactttgttttctcagagattattgagcaaaatgtttataatttatcgattagtgaaggtggcttcggaggctacatttgcgttatttacgggaaatggaaggacaaaacacaagtgctttctagtttgaaaataaaatcaaagaaatattggttaaaatagaacacactttataatcactgatcacataatattacattattatgacttatacgatttacaaaaacaattcaggtcaaaggcactcgtcgatataacataaagttggacattgaaactgagaatacgttggcgttcgcggatttaacatatatttttttgtccatatttttataccgtatcgtctcaacaattctatcatcaacaagaacatgtcactgataaaaacatgtttatcgcagcatgatgatattatacatagacatatcttacgtttaacatgaatcaacaaccatatctttagcgaccctacacgaattcaaatttgatatcaatttcgtacaatttctatcttactactttgaaatttgtgtcgtttataattatttatcaaactcaatgatgcgtattctattctcagaaggagtcatgtatgtcttgaaataaatctagaaagaagtataggcgaaattgagaaccatctcttcatagaactatacgtcgattcatagtaagtaaaaagtctacatctgcaataaaaatgtatggagttagctagttttgaaaaatactatatacaattgaagtgaacatgaaaatcttaattgtttaattaaagcgcgcgaaaaaacacaataataagttaaattatgtgcacataatagatagcattgtcaaaaggatcggttaatttatgatttcactaatttttattatccttcaaccactctagtaaaatacatattgccttaaaacaaaacctactagtcttaaaacgaaaaaagaaaaaaaaaaaaaaaaaaactcaatacctaataatcaaaaatagtactcaagcttccctatataatgttccttcttggctttagctaattcaccatatacccacactcacaagtcacaactcaaataatctttgtcttcctcctacaaat

SEQ ID NO: 12174 - DNA, 3000 bp, Unknown
  misc_feature (1)..( 3000): cDNA_ID_1807810_gDNA_ID_2214535_Annot_ID_185054 3000 nt of promoter + ATG
gtttcctataatttgattggacctctgcccaaatttccgatcgttggagaaaaggaaaataaaaataaaaatcgaatataagtgtatatgaatataattcacaagttgccacatattagtatatcgcttcttgttatataaagaggcttcatgtgatgcttctagaccgaaccacctacatcggcgtatggccataattgtagttggggtcgggttaaggtaatttatcatttgtactaattcataattctttttattttctgttataaatatcatctggaaggtccaaggccataagtattgacgaattgtttaagaatctttccaatagcctttttaatacatggcttttttgtatcatggagttgagtcatccgtgttataggacttttaaaataccgattgcagcatgttttcgatgtgaaaaatctgcattggtgtatttgttgatttgttataacgcgtaaagcatgcaatgtatgcttttagatggtaagttaacttgtaaaaatatcgatctgctaatgttaagttgtgtacaagaaatactatccacaaaagcgtatagagacaatcgtacctaacctaacacaatgtaacaaaatttgaaattagttttgtaacttaaaataaaccccccaaaagaaaggtttaaaacttctttttatgggcctatagcatccgcctgtatgcccaactggacccggtcatttctaagaatcgcaatcccaacctacgtgtaataactaatagtatgaatagtatgaatttcacgcatgcacgacgcatttttattttcttttacgccacacacgacacattaataaggtttagacaactttttttgattcgtgaatgccttctttgagaaagattgtgttaactatgtgtatatcgttccaaggttattagatgtagtccaaaatagatcacataagttatgtatttgtttaaggtttgcgcaccaatgatattgttgcatatcgaaccagttggtgagccggaatggaacttaattctcatcaactccactatggttatataaaagaaattgcatatgtaactatatgtaaattaatgggtgagattgtgagactcttagtgaattgagagaattttagagagagaacaaaattgtgttagagaaacatatcaaccaaaaagacatttgaaccaaaaatacaagtgactggtttccatatgtgatagtctccagtatatgcatctaaatcaattatgaaccaaattcatcattaaaatgggcaaaaatgtgtttggtcgcgggaagacccgtctgtcatccctattctaaactttcaatacaattcgttaaaaaaaacttaattctaactaattcagagtaagatagttgaaaactatacaacaaaaaatataagaaaatgatgaatttctacaattaacaaactaaaacataaactatcaaatagaaatagatgtatcatgtcatagaatgagataaatggttcactatttgattattgatttttttttttttaacacgactatttggttattgattatgtcaaaaacattaaaataataattttataaaataatacgatatataatgttttattagttttatctatccccctactataacaaaaacttatagaaatatataaacatatagaagaagaaaaaaagacagaacatatagaaacaagaaataaaattatactttcaaaaactacgaagcaaggaaaatcgaattttgaggtaacttgaaggcaacgaatagtatgaatgtggaaacgtcaacaacttaaccttacgtttacatattatattatttgaccatctctaaccatatttggattatgaaaatccaaaagggcgctcgcaaataccatagtgaccccctgtggccacacctttctcagatgtctattatgctttatgaagaatgccaagggggtttctcggtaacaccaaattaatcgatagtcgccttcacttgcaaaccaagaaagatacgaaactacaccgagaaagtacaatcttatttaaataaccaaaacaaacaacttagttttgtctgacccactaggccactacttctattcgacaactttaaagttgacgatacatatacaattcctgactcaactgagaacgacaatgtacaatcacacaacgctggtcgaacttaggagccaataaaacacttgagtcgtgacatgaaacacacggctacaatacaaacttctctcaattattttttgtaaagaccgattatttgctaagcaagtcctagacaaatatttacacacaatcgctataatatttaacaagagatcacggtcagattaaactacaggtcgaatgattacggtcagattatagacgcagcgtcggatttctatctcatagagtcttgacataactttgtttcctagagtcacgaccttatttcacgtctattggcgaaataacttcaatatatcgcattcacaatggacatactttttgtttttgttttttgttgggagtgaatttcttcttatccaagagcatgttaattaatgttttagagtgactttgacgacaatagtttcgcaagaattaataattaatgtttagtaacttaattttccaaaacattagaatcctactttgtatatgtttcaaacaaagcacaataagtattcaaagttaaatctcagagttcaaattaagcctttaagattttgtcttgaataattagcttacctctctaatcattaatcaacttaggaaaaatattatttttcaagtagtgggcaattgcttggcaaactgtcaacacaaaaagttttagaatttatattaggaaaatgattcataaatgtatatatagacagctacagaaaattgattgaccaccaaacaacaaaataacttcaagaaggctggagttaaaaggcaagtaagagaaagacacatcaatataacccaaaacaaaacatcataacagcaacaataacagacacataacca

SEQ ID NO: 12175 - DNA, 3000 bp, Unknown
  misc_feature (1)..( 3000): cDNA_ID_3024157_gDNA_ID_2214535_Annot_ID_185050 3000 nt of promoter + ATG
ttaaaattatcataaaaatcaaaaactcgcacaaaggacgggttctaatatagttgatatatatgttttacatcttttcttgctaacattctactaatatctatatatctacataaaagtactagagagaattacctgcaagtgagatttgagatatacacagatgagtgtataatatggtcagcgggtcaggatatgtaacttttgtttgattatgggtttgaaaatgtgcaaatagacagacattacttcaactaattgagaataatgttggatccgtatttgtaggaataaaaaataactgttaattagaggttgacttcacagttcacaagtcgggttcgggtgtacaagaatcttgtcaggtcacacctaactcttatgatcgtctcttagttttttttttctttttttttcacaggcttaatggacccttttgtctaatttgatggcatatctcacaaaccatccagttccatgtttttataaacatgctttttaaacctttaaaatgaaggacacaaattaggattctcggtgcaaaattgcatgtggacgtgtagaagcagaaggaagatggaaattaagtgtaaagaagaaaggagtggtgacgagaagcttgtgaaggatcgatggcaagtctctttacacgtggggggaatgacaaagttcttcttttttctacttcatcaaagcttacaatttcctctcctcaacaactttttttgttttttttggtagggaacaactttttttgtttggctagcagaattttatttactaactggaaaatatgaacttaagcctatagtttaatctcatgaactcataatctccatttaattctgcaacgaagttttattggatggcatgtacccgaatctatagtagatatatacaactggaaaacagtattgtatattgttttcgtgatgcaccaaaaacttatgattgaaatttacgtagaaataaaacagtacaatttgttagacatgttaatagaactgatcttgtgagtgctcatatttcttggaattccaagaggacttcgaaagcataattggatctaaaatatattatatcataagcatatatacgtgagaatgtatttatcttattgttttcataatagaagtggtaaaggtaaatattcaaactaattgtcgaaatatgcggaagaggtagtattcaatggcttacgatgactaaaatcgtaattacaaaaatcaccataaactcgtctaaaaagactttctttgcaattaaaattaaaccatataggacttcgatttatacggtgtcaaattttataactatgtatgttaatattacatatttttggaacgaacgatgtaaaaaaacggctcaactaacaacgctattcatcgcttcacggggtcggatgtgtaacgtaaaccaagcaaggaccactttacacataaactaattctctcatacgaatctacaaaaatacatataaagataatatataattttggggtaagagaggagcattgtcccgtgattctcgtcgaacaaaaaacagaaaaagaaagaaagaaagaggtatgtgtgatgatgtggtctacatcaaagacagctgagcagtcacacgccttgtaatcgtaatttattcgtctatctaccactctcgctcttccattttttgcctttagcattcaattccacgcaaaaccctaaacctcataatctcatcaaaaagttttaaagataaatatatatgaatctacccattaatcaatatattagttagtattgtgatttatcactttctaaatactaaaaagtactcagaagattagaaggttgattttaaaaataaattttctaactaatttgatcgctatatcaatagaaatgagaggatttaaaatccatcaagtatagttcacttcgataaattaatattttgtataaattgattcatgtcacgtactggatcttttaaatcgttgaggatcaaaaattattttgcaacaaaaagaaaaacagaaggaaaagaaagtttagttaacattaattttaaaccaaatgtcttaagaaaaagacaatgatctcgatcatcaatgatcctaattccgacaaaactactctgaggtatattataattttgtgaattcgattttgtatttaattatttttcctggaaactgcatcacggtatcaaaaaatttaaaattcttcatttttttgttttcttctaaactcaaataacgtctcaactatactaatatctttcttattttcttataattattaattttttttttttttttttttttgttgttgttgtaaatagtcttacttatactaactaattcattcatagactgttagtcccgatacatgaattttatctatatcgatctttgtaatcgaaatgtttgtttgacgaactaaggcaatctaagactactaagaatatgctatatatagagcctaatttctatcacactcatcttagcctttggtgaacaataatatagaataagtgttacttgtaatttgttggcatgttaagggtataaacaacaatttatctcatttataggagtaatagttttctccctccatggttgatattaatatgcatccacatattaaaatatacaactatttatatatagagctgtctatagtagaaaagggccgaaatcaattagctgtgaacagaaaagaaaactttttaacatatgcaacaagatttaggtgagggtttgtctacatgttccgggaagagagagagagagaatcagaagtgtatcttgatctagggttcacagacaaaatctccatgctttgaactaagcagaattcatctggtcttttatctctttcatatcaaaccaaaggattgatctatccatatcgtccaaaacctatatctagctaagcctagaacttctctatcgtttaccactttctttctatatttcttctgaatttgtaacatcagaagtaataatgattccaagtatg

SEQ ID NO: 12176 - DNA, 3000 bp, Unknown; identical to SEQ ID NO: 12166
  misc_feature (1)..( 3000): cDNA_ID_2706673_gDNA_ID_2214535_Annot_ID_185049 3000 nt of promoter + ATG

SEQ ID NO: 12177 - DNA, 3 bp, Unknown
  misc_feature (1)..( 3): cDNA_ID_3024161_gDNA_ID_2214535_Annot_ID_185048 3000 nt of promoter + ATG
gcc

SEQ ID NO: 12178 - DNA, 3000 bp, Unknown; identical to SEQ ID NO: 12173
  misc_feature (1)..( 3000): cDNA_ID_1807757_gDNA_ID_2214535_Annot_ID_134361 3000 nt of promoter + ATG

SEQ ID NO: 12179 - DNA, 3000 bp, Unknown; identical to SEQ ID NO: 12172
  misc_feature (1)..( 3000): cDNA_ID_4378596_gDNA_ID_2214535_Annot_ID_134362 3000 nt of promoter + ATG

SEQ ID NO: 12180 - DNA, 3000 bp, Unknown; identical to SEQ ID NO: 12171
  misc_feature (1)..( 3000): cDNA_ID_2708481_gDNA_ID_2214535_Annot_ID_134364 3000 nt of promoter + ATG

SEQ ID NO: 12181 - DNA, 3000 bp, Unknown; identical to SEQ ID NO: 12170
  misc_feature (1)..( 3000): cDNA_ID_2708489_gDNA_ID_2214535_Annot_ID_134366 3000 nt of promoter + ATG

SEQ ID NO: 12182 - DNA, 3000 bp, Unknown
  misc_feature (1)..( 3000): cDNA_ID_2711571_gDNA_ID_2214535_Annot_ID_134368 3000 nt of promoter + ATG
tcccaagccatctctggatcaaaggaacagggacacagaaaccaaatctcctggtgagagcattcttgatgataattgcatagattccacacaagtgtataatctgaaccttttagagagtgaggctatcgaccaggcagttagagagcaaacatcttatgcaagccatgaagttgcagatgaggaattgctgcagtcaaatgttttcaggggcttagagtttgaaccacaatcagcaggcttagaatttgcaccacaatctgcaggtatagaattgaacagacctaagcaagagttgaatctggatcctacttttcctagctttggttttatccctgagactattccgcccaatccagaggacatgccaccccttcctcctatgcaatggcttattggaaaggttccacattcttttcctaccttcatgggggaatcagtcgaaaccagtagttctgctttatcagcggcaccacccattggttctagcttgaatgttcaaattgggtctccaccatcagagctatctgtatctttaggaagtgacgaatcagaacgacttcctggagggtttgttcacaatgcatcagaaaagccattgcaatcatccattcagttcccaaccatgagcactgatttgaatagtcaatacgacagttctgagctccctacaataccttatcaggagtgcatagaggattttggttctgaggagaacaatcttttggctgaccatgcagctcagaaccacgagctcgtttactctcaagcgtcgtcattgcagctgcctcaggttaaacacgaagatttcaaggacgatgctgatgtgcatgaatctcaaagttcaagcgatgatcaccattgtcctgaaaccaaatccctgacgccaactcaatcaacaaaggtagaagataagggtcattcggttcctgatgcttcaaatgcagaaactgcagaatcatcaaacacgtcagttcagaagataaatcctgtttcagtgggagatgctatgtggcctgttagctgtttctctgtggcacctaccttggacacatataagacagaagtggtccctacggttaggcttcctaggccaagaagtccgcttgtcgatgctgttgcagctcatgacagacgcaaggtacaaaatttcatcttgtctgcaataccatgcctttgctaagattatgtctctaatcacttgttctgatgatttgccagatgaagaaagtctctgagatggtccatccaccaatcaaatcaaagcaagatgacaaagattcgttgcttgcacaaatacgaaacaaggtagcacatgttgatcatgtaaaatcccagatggtcctgtgaacagaattttgtatttggaattttatgagttgtgttttgtttatgcagtccgtcaatctaaagccggcagtaacaacacgacccagcatccagactggtcctagaacagacttaagggtagctgcaatcttagagaaagcaaatacaatacgcatggttcgttactctctttccatctccttcaaagatagtaaatgttttcaagttttttcacctttttctgtggtccttgctaatcgtagaggcttcatgtcaaagcatttcaatttgacatgaaaatctgaggagtttagtctcacattatgtcttagattggatccgaagcagtctcttaagtggaaacaatgaattataagcctgatcatagaccaaataaaatatcactttttctctatcgcacacacatctaaaaccggttgaacactggtgcaggcaatggctggaagcgacgaggatgaagattcagatagttggagtgattcttgaaatcgatgatcgttggcttttccgtggtgttcgttcttgtatcatgatgagtgcgcaagcacttggagtcaggtaggttatacaatctctatttcagacatataacattaaatacatacagtcattggttatttatatatgtatgtatgtatattgtgtactgttttataggtgtgtgtatgttgtaatgtaagtagattccgaaatttgcagtagttttacggaaatttgtgtgtaggaatgtttcgttcttttttttagctcatagaacattcttttagtaggctatgtatgtgtatttgaatacatacatagatatgtattgtgtgttctcaatcatttgcagtgtcctttgactgtatatttggtcatttggataacgaatatctatgagaatcagctagttagtgcactgcacacacttcaaaggtaatatttggtttctagaggactgaaatgatatgatggtttgcttgcttagtaccaataggatgatcttcacaaaaatcatttgcaggcataactgagtttcaatttgaacccaaatagagtagttggatcgagaaggaggattggaagtatggcaatcctcaatcctcatatgtaaatcagttggaagcctacttaatacttgatctctattctcggctggcaccacctgtatcctgtctgaatacttgattatcgggatcagaccacatcgtccgcgcaaaataccacccggaacagcaccaccataagcaacagcctcgaccgggttcacacctgagacgttagggctaaaagaaactatatgagagtgaaaaatcctgagatatcattcttgattaccgttatagtgtctgaactcaaaaccttagacgaactcatgctactaaaaaaaacaaggagacgagagcgaaagaatgcaattgtgaagaatttatgatggcctttatatagacagagctctttattcagtaaccgttatgaaatagcaaggagctagtcttaatttctagtgggctagggaaaaaaataaaaaaattctagtgggcttaagagctaggcccataagatattttaatattattttatacaatgagaccaaaccaaaaccaaacaagagattgagaagaaaaccgattttttccttttatttatttttatgtttataaattaaaa

SEQ ID NO: 12183 - DNA, 3000 bp, Unknown
  misc_feature (1)..( 3000): cDNA_ID_2709684_gDNA_ID_2214536_Annot_ID_134371 3000 nt of promoter + ATG
ccaggtcattttctgttgacgaatctgcttctggacaaaatgaaaagtaccgcaagagaaagtggagtccaaggaaggattgtgaatctgtcatctattgctcatacttatacttactctgaaggtatcaagttccaaggcatcaatgaccctgctgggtaagtttgttattcaattttatgctaatgaaacgagactaaatatttttaactgatgtaaacactaattctctatcctatgcattatctagatattcggagagaagggcttatggacagtccaaactctcaaacttgttgcactccaatgcactctctcgtagactacaggtaatatattatttacacattgatatactttaattaaatcaaagtttgatgccataaaatgatgaatatgattttgggatgtaggaagaaggtgtgaacatcactataaattcggtgcaccctggtcttgtcaccactaatctctttcgctactccggttttagcatgagtacgtataccaattctccaatggtcattcaaacacttaaattttaatattttcttatcttaaaatcgacatttacttgcatattcagaggtcttcagggctatgactttcctcttttggaaaaatatacctcaggtgaatttaaaacccttttcaaataaatgttcttatgagattttagtttttattttacaaatataattcttttgggggcattttcagggagcagcaacaacatgctacgttgcacttcatccagatctcgaaggcgtcaccggaaagtatttcggcgactgtaacatcgttgctccgagcaaatttgctaccaacaattctctcgccgataaactttgggatttcagtgtctttctcatcgattctatctctaaataatctatcatcatcaagacaaattcttagacattcaaaatttatttatccttcttgatattgttacattaatgccatatctttttcaccaccacatatttctttatggaataccataatttagaaatcattatccatattttttcttgaataaaattataaaacacaatttgtttgtgtaagaaaataacttttttcatctagtaatctatttatatctcccaaatgaaataacaaaggttatatcataaccagttcatgggcctaaattaatgggcttcgtcggcctcccaaaggcccatagtccttacgacgacggcggaaagagccacaacaattgctgcaaaaaccggcggcacaacgaggtccatcttcgacctccggaaaagattcgccggtaaacacaagacctccgagggaagatccagcggaaccaatatggctgcataagaaccgcaccgccgcgagaacacctcagaagaagacgggaaaatcgccgacacgaaagcgaattccggtgcaagcgagatgatagccaccgttaacgtcagaaacaacgtccacgttgcgccgtagacgaagtgtggaatccgccatgcgaatctgtgagtcagagaggagaacatatggcgaatcattggttttaagttcttaaaagtgttcttcgttctctttatatatttatagttccatcgatcgtaaagagttccgccataggaattggagtagcttcgatgaaaaagagaagtagaaagagaagataacctaatctcttacctgctcttggtgacgaacgaataaggaaaagtgaaaaatacaaaaattatgttatcaatcctaaaattccaaaatataccaagttactagtaaaatttacaaaattatcttaaatgaatttacaaaccttacttaaaagttaaattaaaccgttttagttattaaaggcttgtataatttgtgttttgggttgtgatatatattgtaggatattttattcaagttaaaaacactaaaaaacatctctaacacaaaaggtcccacatatacatgtggatattcacttaaacagaaactgaaatgatttgttctcttctcgtactttcttccaagttgtcatcactcaccagcaactgccacgattttcttcccctttttctttcgatttacataatcactccaaaggttttaatttattcttaaacagtctccatacttttaattatctcatattttcccctcggttaactacaatatccaattttactctcataatttcgtgtaaccgacttaaactgatatttaatatcataaaattatacatagaaattatcatcgcaaccaaaattaatacttactcgaatcaacatttttttttctaaaagcagattgaaatttaagagataaagtaatccggtcaaaaagttacatttaaaaacaagggccagtttgtattttctcacgattcggatattattttccttctttttatctcctaattactattttttccaaaaatataaaaaaatatctgttttttttttctgttttcttttttctttcttcatctctctctattctttgctttgaaaagtaatctggaccgcgaacaaagctttttcgttttctggttcgttgccgccttgcacgttccttcttcttccttctctcccccccatcttatctctttccccccctttaccctaaccctaattttcttcgccgtcctctcttttctctctatctaatttcgttcccatattcgaaatctcttaccttttatctccagatcttttagatccgtaattccctactattgattatacccaaacttttactcttatcttcctcgtttgattcttatgcttccttttatgaattgatttcttcataaagtcatcatctttggattgaattcgactcattaatcaatccgttaaccaataaccaccttgacagtttcttctccgaggattccagattacaattctagtggagctgtaattggattcagatctaactcaagttagtgttactgttgtgtctattggatgcaatcgtgttgtgatattgaatatatttctgatgggagaaggaactatttgtttggagatg

SEQ ID NO: 12184 - DNA, 3000 bp, Unknown
  misc_feature (1)..( 3000): cDNA_ID_2708534_gDNA_ID_2214536_Annot_ID_134372 3000 nt of promoter + ATG
actgcagcagctacatactataccacttccttgcttgtaaccctgtagtagtttctgtatgggaaaaaatgtaagcaaaactaaagttcgattcaaatttcacggaaataagcagtacgagttatttgtctgcaataacgaacctgcgttttcacatagtaagccaattcagtcccgtctggaagtccattaggcataaacagcaaccgatgtaaatcattatccctagaaacagaggattgtatcttttcatcaatatcggatagaaattagagattcaaaggctaacagaaaaaacacaaatgatgaggttgatcaaaaagtaacacaaacctttttctattgcttccttcagaaactttcttatggcaacccgtaccagatacatgagaagtaagcctacaggattagcgaccaaataaatttcttacctccatagataattgtccataaggaccataagtaatacttagattactacagtgattaatttgtaaatgaaaacatcaaatatgcctacttctttgctatccgcttcggctcatctaatgtgtcctttgcatatgttttctctgaaaaataatggttctccacagagcatggagtaaggctctgactctcatcaagaccaggaccaagataactgcagctttcacaggaatcagtttcagatagtaacacaaaatggtaacttaatagtgcattaactaaaagttatacgaaacggaaaaggtacgtcactacagggtccaagtatattactgactatctactcaaataaaatccctaattagtaattacagatcaagttctaaaccagaagtaggaggtgatagtacctgacagtggaatgatccgtaatataattccggtcagacatgctattactctgttggaaacttgctgcaggaaataacaacatatcaggctcagcagtactaatcaaaactacggaaagcgcatagatgcaccaacaagctaaacacctggccatcacctttccaagctcgtaagccctcctcattcagagcagaaccagctacattccttatcacttcctcgagaacaacacgaggagcagtcttcagttcttgaactatgttataaaccgcccttctattctccaaaaatatgtgattattaggatgtctagtttttgcaccagcatgctgctcaaactcatacgcacttagaacctttatacataaacaaaatatcacatcgttaaaatacacagaataagaaacaagaaaaccataaataataaaataacaatcgcaaaacaactcactttcgagaaattgcaagttgtacagccacacaaatagccacccgaatggattatccccagaagctgtctctatcagccatcaaaagtggtataagtcagatacaaaacaccctaaaggaaaatatcgaaacacaaagattcaaactttaccacaggtggggttgaaatatacttcactcgagctccttcaagtatacccgtttccaatagcttcttgacattagatgggtagctcaaagaaacaatctttttcttcggcatcttcacaacaccagcgtcccaagtatgatcctttatcaaaggcaaatcatcaaattccttctttggtttactcaacttaaacgtgatcttcgtgatcccagtcgagctaagatgcttaggaatctccaacacaaaacgagatggtaaaacatcactcgactgctctgtttgtgagctacctacaacggatgcatcgtcacttacagtctcttcggacccaaaatcactcccggagcactcaactaaaccggatttaaccggctggctagagacatcacgaaaaagagacgtgctttcaaccggagaagcgactggatttgaaatctccgatgtaatgtcatcattagaagcttctttagcttgtttcttactgggaaagtgatctcctttattaccttcatcagtatcatcatcaagcctatctcttttcaattgaccattctcttcctttggcatctccaaacaaatagttccttctcccatcagaaatatattcaatatcacaacacgattgcatccaatagacacaacagtaacactaacttgagttagatctgaatccaattacagctccactagaattgtaatctggaatcctcggagaagaaactgtcaaggtggttattggttaacggattgattaatgagtcgaattcaatccaaagatgatgactttatgaagaaatcaattcataaaaggaagcataagaatcaaacgaggaagataagagtaaaagtttgggtataatcaatagtagggaattacggatctaaaagatctggagataaaaggtaagagatttcgaatatgggaacgaaattagatagagagaaaagagaggacggcgaagaaaattagggttagggtaaagggggggaaagagataagatgggggggagagaaggaagaagaaggaacgtgcaaggcggcaacgaaccagaaaacgaaaaagctttgttcgcggtccagattacttttcaaagcaaagaatagagagagatgaagaaagaaaaaagaaaacagaaaaaaaaaacagatatttttttatatttttggaaaaaatagtaattaggagataaaaagaaggaaaataatatccgaatcgtgagaaaatacaaactggcccttgtttttaaatgtaactttttgaccggattactttatctcttaaatttcaatctgcttttagaaaaaaaaatgttgattcgagtaagtattaattttggttgcgatgataatttctatgtataattttatgatattaaatatcagtttaagtcggttacacgaaattatgagagtaaaattggatattgtagttaaccgaggggaaaatatgagataattaaaagtatggagactgtttaagaataaattaaaacctttggagtgattatgtaaatcgaaagaaaaaggggaagaaaatcgtggcagttgctggtgagtg

SEQ ID NO: 12185 - DNA, 3000 bp, Unknown
  misc_feature (1)..( 3000): cDNA_ID_1807383_gDNA_ID_2214536_Annot_ID_134373 3000 nt of promoter + ATG
aaaaggatggctgagaatgagtctaagcctgagggacttcctccttcacaaggtggtaagtatgttgggtttggatctagtccaggtccagctccgagaagcaatcaacagagtggtggtggtgatgttttctctgttatgtctgaggtaaatttggaagctttttgagagtgatttggttagatgcgacatgcgagtgacttctctgtttatcctgtaaatgaatgtgtttgttttacgcgtatatgcttatagggttttggaagattgtctcttgttgctgcatcagctgcaaatgttgttcagactggaaccatggagtttacttccaaggtacttcttttatcatttctgcttcgatgttgtggttgattcgtttgcatcgtgatcagtaagctcactccttggtaacattctgtagtctagttgttaagtttatattgagatcgtgactattcgcttggtgtctgtctaattgccgctatgctcattgctctgtttgttagattatcccatttttgacattgttatgtaacacaaaattagagtcttttctagctgcataatcttcttactttaattgcagtgttaaagctctttttttttttttttgtctttatgcccctgcaaaatctctagggagatcctctaaaacgctgaactgagcataatgccggatgctcgtccttcttttcaaatactgctaacattagaaattatagaattttgaagacaagtgagataagaaacctttgttcattgtgcaggtcaaagaaggtggcttagatcagacggtcagtgagactgttaatgttgttgcgagtaagacaacagagataggacagaggacatgggggatcatgaaaggagtgatggcaattgcctcacaaaaggttgaagagttcactaaagaagaagcatcaacttggaatcaacagaataaaactgagggcaacggttactaccagaactctgggattggaaacaaaacagcaaattcatcttttggaggatcacaatcatcatcaagtggtcacaacaacagttatcgtaactcgaattcttgggatgactggggagaagagaacaatagcaaaaaggaagcagcaccaaaggtgtcgacttctaatgatgatgacgacggcggttgggctggttgggatgataatgatgctaaagatgatgatttctattatcagcctgcaagcgataagaaatctgtaggtcacaatgggaaatcagacactgcttggaccggtggaggttttctctaacggtaagcaccaaatcaagttaaacgaatcgaatatgtaaacgtctatataatcaccacaaaacactattccctaaatcgcaggtgttacaggataatggtgaatgaagtttgtacaattaaggaatagcagagcctgtggtcttctcgtgctctgtcacaagagagagcagagtggtcatctcaaccattaagccaccactggtctttcttttcacatatcaattgcttggcgttcaatcaaatcgatcgtcactatttgttcttctacaatatatatagtttttttttttatttgtacaagtttcacagtcacagaggattgcttgctaaactattcgggttagtcttcagctctttttttgagattcaaacttttatttttcttgaaatttgtaatgatcacaaaagacaaattttccgttttattgtcttctttctcattcgcatactacttttggtcgggttgctatcgtttcttacttcactgaatttctagtttaccgggatctgatcggattacggatttacatattcagaatgaattttcagtacgtcaaaaagaaaatgggttataacgtttttctcagcttatttcatacataaatttcttcagtaccttgaggaaaagaagtagataaatagaggtgttatgtccgaaaatggcggtgttaagcggagatgaaacattatggaagaaatactatgacttcacactaactaaatctcgatataccaagcaatgtctctttggaatgttgaaagtttgaaacttaaggaaggctaagcttgcttaacgtatacgatgcaaattggttaatgaatgcatgtcataatttcatttcacgtctcatttcatgtttgtattttaaaattttaattataacgaagagaagttggtcaatgaaggatgacagagagagcatgtctctgtcacgttttatgttctatcgttcaaaccggaccagttcacacttccattcaataatccgacatcctgaaccaggccaggtaaactcttaaagcacttaaaagagcaagagatatatggcaatccattggagtcaatcgatggaaagatagttaaaagacaaatattcgtaccaatctaaccaattctcttaattataaaaatcaagaatcatctaatgtatacgtaccaactcaaatgttttatttgtctttcttttttattagttgtaaaagtctatttcaagattacaactttacaaaatataatcccttgtacattttaatttttagtatgcactttacgaatataaactataaaagtctctagaagtttaacaaatatatagtcaagtcaatttgaatatttgagaaatcattgtccaaataaacccctttacagtaaaatccaaattttaagatttctgtggattgatgtttactatatcagtagtaactttcttttctagtcattcaacgaaaatctaaacattgattataattagctgtcatataaaaacttaattaattactacctgtcaacagcaaactttctctactcacgcgtgagcctatttaaagccacacagttttcttcttcgttccttaccatccatccaacttgtaactctctttctctatttcttctccattctgtttgctctgcaacatcttttagggtttattattgttggtttcttcattttctttctctaaaatatttgcagaggaagagagagagagagagagagatcatg

SEQ ID NO: 12186 - DNA, 3000 bp, Unknown
  misc_feature (1)..( 3000): cDNA_ID_2708530_gDNA_ID_2214536_Annot_ID_134374 3000 nt of promoter + ATG
tcgggatctcttagagcagggccgtcaatgttatgaacaacaacgcatatgaagcagtctttatctccagactgtggaccatgtagaaaggaaagaatatcatccatggagcgtgaaggaaatgtttcttgacctttagacaaactcccggaactctttcttttacatttcaaaagctcggatagaagttcagctaatgccaaaagaacctaaatttgcaacacagaaaagaacaattagtcatcatttaaaactacttcttttccaacctgaagaacatagagctgcgcaagagaaaaaattgctgcatccaaactgacaaaagagtacctgctttagatttacggaagggaggtagccattgatgaccacaacagaatagtcagtcaaagaagcagaagcaaaatcttcaactaaagctttcttagatccaaagccatacattagaaggccaaagccacacctggaagcagcaacaagaattgagaacaccagaagtatatagacaaactaaaatattcaggttctagcttcaaaagtaagagcttttctcacctgagctcaaagacccactttgagtacatagtcttgtaatcactcataagctcagatatctctttcgagtgcttcatttcaattgtagaagccgtttctctaagctcctgtaaacacacaatgcttctccatcaacttgtcaaggaaagtatctattaccaaaagcataatttaaaagagcatacccaacaaaactcacctgctcatcaacaatatgtatatcagagagcttgtgggcagaacgcttactcgccccacccaattcttttgccaagaagtagtttcttgaaaacccatactcatcttcttctatgttctcaatgtcctccattttcgtgcaacaacaaaataacagaagaattccaccttaaactcaattcctatgtaggaaagaatctcctgagacaacagtaataagagaatcaacactatttctgttttcactttgaacaatggtatgaagctggtaagaattggatcagacccaatcgccaaaagctacacagaaggggaattacggtaattccgaaaacacactttaacacacggtaattcagacccaatcaactgttgttatcctgaagagcttatagaaataggaaagtgcacaacatacataggaaaagaaacacacatcagttctcttattctctcataaatatgagattctaattaatcaatcctccctgaactctgaattcccatggttccatcacaagattgatgccatcaatcaatatgttattgctgctataagagaactgaactaaacagaatgaatctcgcaaacagaacccaactatgatgatgttggagttaagtaattaaagtttaaagtcccaaagagaaagacttttcttcccacaagtaaaccaatacaaacaccaaagctagattatattcttacatgaaaaaccgaaaagatagatctcgaatcgccattttctcaattcagaattgaacaaagaatcaaacgaaacatagaaatgaattagatcgtaaagaagaagctgaaatacgcaaaggggcactgagagaaatgaaagaacatacctttaggaagaggcaaatcgtttggcgacgacgacaccgttacaatgtccctctagccaatgaaagtggatgataagaaaaaattatgacaaatcggtttggttttggttttgacggagaatatatgaatcgatccacacagtttaacctagatttatttgagctgagactattaaaccccaaacatatgaatcagattccaaaaaatagagaatccctacgatgattaagatgcagtctctcaattttcccgcgcgtttttcttcgtctttcccggttaacaactttacgtcgtcgtttcacaatcataaaaattaaacggttccgatgtgatgatacggatgacaacagatccaacggtctatatgtgatgttcacaaaatcacatggctgtgacagaaagactgtgacggctatggcctattgagatttgttaattgggggagttgagatttctcagctgttgttagggatttgtatgaaatgttctaattgtttgaatgaatgaatcaaatgttataatttgtgcattggaaaataatatataactagagttgaaaagcttctaatgagcattattgttctaaaaagatagtcaacagggagataacaaggatttgagttcaaaagaaaagaaagaaaaagatacaacaattcagaatgaaagagtaaattctggtaactgtgactttgctgggatttggctactctaccgtaccagacacgtggaccggaataatgtgaagctgaacaattcctcaagtccatgcttcatgaagtgttctgccgctttttggcctttagttatgttaataagactctacattaggttcacctgttggacaattccagtaccaatctttttttatctgcttattagtgaaaaataaaagaatatcatcaaagacttatggtttaaaacagtgcaatgcataacaatcaatgaacaagaaacaaaccttgacactcagaatctgtccctgcttcatcacttcagttaattccttcttcagacccccatcagttgttctcccgttcatattcacagcaaggacatttggtgtcttaatgctcacctggactttaaactgacttccacaagttagggttgagcggaagaagaaaacgagagtagttttagtttttttggttgttccttccagacccggcccgatatcgaagcgaccaaagcccatgctttttgagcaaacacgtttttagcagagaccttggaaatattgagtgaagctctcacgtgacaaaaacacgcacaaaattattcaagttaccacgtttattaagcaaaacgattgagccaaaaaaaacgcatcagaatctggaacctggatcagatctagtcaggggtcagatcggagagccggcaatataatg

SEQ ID NO: 12187 - DNA, 3000 bp, Unknown
  misc_feature (1)..( 3000): cDNA_ID_1011470_gDNA_ID_2214536_Annot_ID_134375 3000 nt of promoter + ATG
agcatatacgcgtaaaacaaacacattcatttacaggataaacagagaagtcactcgcatgtcgcatctaaccaaatcactctcaaaaagcttccaaatttacctcagacataacagagaaaacatcaccaccaccactctgttgattgcttctcggagctggacctggactagatccaaacccaacatacttaccaccttgtgaaggaggaagtccctcaggcttagactcattctcagccatccttttcgcaaagaaactctccttattcgccgccgacgcctccagctgagaccgtgaatatatatcctcagacgatttcgacttcgccggagcaccacgacctcccgatgacctaaaatcacccgccgattgattcctcctcatatccgtagatctaaacgaatcatcgttatcccaattatcccatccaccattaccagaatctctaccaccgccttgagacaacggaggcttcttattcatcaatccaccaccaaccgattccttaacaatcggcggatctctccattgtcttccctcagctaaagcttggatccgatctcgatacacagacgcggcgttggaattgtacttggagatgatatcagtctctttcgagatcccgtactgagcgagaaaattgttgagacgctcgttgcctccagcgtccattttcttgatctggatctcggaccatgaatccatggtgacggatctgacgaatgagatgtgaacacctaaaccacggtgcttaccggagcattccaagcacatgaagattccatatgaaatcgatgcccattgtggattcttctgggagcaatcgacacagaccttgttctccggctgagattggagcgtccgtaatcgtctcgccgctgccattatattgccggctctccgatctgacccctgactagatctgatccaggttccagattctgatgcgttttttttggctcaatcgttttgcttaataaacgtggtaacttgaataattttgtgcgtgtttttgtcacgtgagagcttcactcaatatttccaaggtctctgctaaaaacgtgtttgctcaaaaagcatgggctttggtcgcttcgatatcgggccgggtctggaaggaacaaccaaaaaaactaaaactactctcgttttcttcttccgctcaaccctaacttgtggaagtcagtttaaagtccaggtgagcattaagacaccaaatgtccttgctgtgaatatgaacgggagaacaactgatgggggtctgaagaaggaattaactgaagtgatgaagcagggacagattctgagtgtcaaggtttgtttcttgttcattgattgttatgcattgcactgttttaaaccataagtctttgatgatattcttttatttttcactaataagcagataaaaaaagattggtactggaattgtccaacaggtgaacctaatgtagagtcttattaacataactaaaggccaaaaagcggcagaacacttcatgaagcatggacttgaggaattgttcagcttcacattattccggtccacgtgtctggtacggtagagtagccaaatcccagcaaagtcacagttaccagaatttactctttcattctgaattgttgtatctttttctttcttttcttttgaactcaaatccttgttatctccctgttgactatctttttagaacaataatgctcattagaagcttttcaactctagttatatattattttccaatgcacaaattataacatttgattcattcattcaaacaattagaacatttcatacaaatccctaacaacagctgagaaatctcaactcccccaattaacaaatctcaataggccatagccgtcacagtctttctgtcacagccatgtgattttgtgaacatcacatatagaccgttggatctgttgtcatccgtatcatcacatcggaaccgtttaatttttatgattgtgaaacgacgacgtaaagttgttaaccgggaaagacgaagaaaaacgcgcgggaaaattgagagactgcatcttaatcatcgtagggattctctattttttggaatctgattcatatgtttggggtttaatagtctcagctcaaataaatctaggttaaactgtgtggatcgattcatatattctccgtcaaaaccaaaaccaaaccgatttgtcataattttttcttatcatccactttcattggctagagggacattgtaacggtgtcgtcgtcgccaaacgatttgcctcttcctaaaggtatgttctttcatttctctcagtgcccctttgcgtatttcagcttcttctttacgatctaattcatttctatgtttcgtttgattctttgttcaattctgaattgagaaaatggcgattcgagatctatcttttcggtttttcatgtaagaatataatctagctttggtgtttgtattggtttacttgtgggaagaaaagtctttctctttgggactttaaactttaattacttaactccaacatcatcatagttgggttctgtttgcgagattcattctgtttagttcagttctcttatagcagcaataacatattgattgatggcatcaatcttgtgatggaaccatgggaattcagagttcagggaggattgattaattagaatctcatatttatgagagaataagagaactgatgtgtgtttcttttcctatgtatgttgtgcactttcctatttctataagctcttcaggataacaacagttgattgggtctgaattaccgtgtgttaaagtgtgttttcggaattaccgtaattccccttctgtgtagcttttggcgattgggtctgatccaattcttaccagcttcataccattgttcaaagtgaaaacagaaatagtgttgattctcttattactgttgtctcaggagattctttcctacataggaattgagtttaaggtggaattcttctgttattttgttgttgcacgaaa

SEQ ID NO: 12188 - DNA, 3000 bp, Unknown
  misc_feature (1)..( 3000): cDNA_ID_2711609_gDNA_ID_2214536_Annot_ID_134377 3000 nt of promoter + ATG
aacttttatgattccatgtgtgagagtgttcctccaggagactttaacgctgttcaaatccacaaaaggaaggctgattatgatcaagtagccttcttcgtcctcatagatcgtttttgcagcagtaacaggtccataaacgtttttcatggccccagtaaactcgtttgaccaagtaggtagctcattctggtgagcttcgataacaggaggttgtgggtttacagttaagcaacactcctcctcatgaatcccatttgagaacaagtccttcctcttcttgtggctcgaaggagataaatcggttgcttcaccattagaatggttggatggttgagtcgagagattgagccccgagccattgagtagtttcttagagtggtttgcagtaggattcttcaaagaaggtgtaggcctctcaagctcaaagtcagtgttgggaaggtttctccaagaaccaaagtcactagcttcaggtggaatggtgaaattcaaatcacgacccgtaagctccatccaccttttcctctcttcttcatctagacacgtgaggtttggcaaaggaacaagctcaatcccatgaacgcactgcggattcgacaaacctctgtagtgtttcctctgcattctgtgagacctaacaaaccctttctcaacactaaatggaaacaaacgatccccttgtctagaatgaccattcatgtaactcctcaactgcatcttccctagtgcattctcaggtctttccttaaacacccacatatacatattctccatatcatgctgaactaaaaacacatcaagcttcaaatccgacttgtcaaaaccagatatcccattactatcccggacgattttcgcctttgatttctcgtttaacgcaggcttgaagtagaaactgaagaaaaaccaagcaccccagatactatcaacacgtttagcacatttcctcccaaccttaggtacaacactcatgtaattctcagtctcataagcttgtgaacctaacccaacatccaaaatatcacaagcatctaaattccacggcggaggaggaggacttctctcagctgagagaggtaaattgatatcaggagggccagagagcagagattgcctgttgttattcatctccaaatcaagctcctcatgagaagaagcacttgaatccatagacaatagagtagaaggatgatgattctccatagccaagacgttaaaacaaagtatctaccaccatctcagctcacaccagagacaagtctcatagccaataaccataacaacacttgtaattctcatcttcctctcccaaagttaaacacttgctaagaagaaccaaaccacttacagatatatctaacccctattttcccaattccaaattctccaattgttaacttctagattctaataaacaccaaaaaaaaacgaaactttgaagaagatatgaaaaaaggagcactctttttttgccttaagcacagataaacccagaaagaggagaaagctaagatgagcacgatgcagatggtatcgtcatcatcattagcaaacaaaatcgaatcgattactcagtctctgtggcttcgccaacacaacaaatcttgatttttcttcttcttcctctttttttttctgtagagagagagagaagaagatacggacccgacggagaaaacgcctgccctggatggaaccgtggagacttcctccgttacttaacggtgacgatgtttttttttttttttaataagaaacgatgattgtatattggtcgcttctcttgcttcgtataacagttttttctattaattatgaaatatgttaaatttttggtgataagaaagcatataaaagattgatttttcagccaacgttgtttggatttgtggtaaataaagaacaacaacatatttgtgtctacatcattactctaaagtgtctttatctttgtggtgaattgtatgtttcttatcacattttcttccatcaaacaacacttcatgaaatttgattattctggatttcttttttagaacatgtaattcatgtgactatttatgtggttagagtctctactatattttggagtatcccttaggtcttagctgtacatgactacatcatgttaccttggatagagatagctagagttttagatataaacattgtataatctttttatatgattctgataccgatcataaaccaattatgagaagtagcaaaaaaataaaattatctagtgattatatccatcattttaaaatttaaatcttcatttatgatcaaattagggcaaagatcttcactctcttttttttgtcaataaagatcttcaccctctttagtttcaaaactctcatgtaaaaccaaaatttagatatgagaatcgtgtaccgctaaaatccatcgttagtctccaatatacctcaaagctgaaaaaatcactggcccattgagtttacgacccaaaccaagagtcccaggtaaataaataaccaaggtggaataaagaataaaaatcatttttggtgacaccgacaaagcaccaaatttccaaccactacttccatgtacccatcataacaaaacaccaaagaagatcctacttcatatctcactcattcatttattaataccaaaattaattatacatgatattttgattacgaagacatgctgaatgaaagaaatatactatattgttttacaaaaagaaagaaaaaagactttaaaaagagttatgtaataccgaaagtgattgttgcatttgagattatcaaattatacactgaatactacttaattatcgttacaaataacatttggaagacctattggccggttttatttttgaatattccactcagtttaacaaatatataattttgacctttcgccggagaaaaaacaaaccaaacttacttagtaagaagcactttccattattattatctctgttcccccaccacatttcatattcacataataata

SEQ ID NO: 12189 - DNA, 3000 bp, Unknown
  misc_feature (1)..( 3000): cDNA_ID_1976286_gDNA_ID_2214536_Annot_ID_134381 3000 nt of promoter + ATG
tttcgggaaaaaaaacgttcagatattttccaaacgtgacctaaagatggtcatcaaaataaaaatcataaaaactaaagttaaaaatctttctctctctcattaatcttatttcttgatcgtcattgttgtcgtcctccactgcaaatccgttataaacgagttgacgtcatcttccggcaagaaactcaaccgtctccggcaatacattgttctacctctaaacatctccgacgaacgtttcatcggcgccggtggacattctctaactatagggattctattctccggacgagtcggtgtcttgaacccatcattctcttcctccacaacttcttcttcttcttcttcatctaatctcttccttttcagacaaatatccaacacaagtttatcgtcggaacattcttcttctctcgtctctttaacaccacctaacgttacctcttcctctttcaagctcgtctccgacatacctaaaaatctataaaaatcaagaaatggcacccaaaaaaaaaactcttgttcctagatagagagagagaagagaatgagaagaataagaagaagaaataatgattgatcgatgtagatagatccaacgtggtaaagaatattaatcaagaaaattgtcagcttttgtttttttattaaattatttttcaggtttatttatagtcggagattagagcgagtttgttgtgtattgttggatgtggtaaggagagtctaaaggcatacataacgtaaccaaaccctctgattcattgagaaggagacattattcgacataataccgttacgataaccataatatctcgtcgataaagtaatcaaaatatcgccgatgcctttctgcttctcgcaagttaagcaccaaattgacatctgcctttacgtttccaatctccatgtgcgcttttttttcttctcaggaggaaaaaaatatatttgttgccgttagactttaattacgtatctaactcatatttattaccacctaatcttattgctaataacttttgtgtatttataaggaggagacccactcttatagttttacattaatgacttctatgatcagtttagataaatatttttcctcaaccggactaaatgtattcttctatatatatataattaggataaacattttatgtaagaaatctaaatattgtttagttgaatgtaagaaagttttttggtgtaaatgttaagaaatgaatgtaagaaagttttcttccctattcatttttttgtcttaactttggtgatttcatgatatttatttcatttaagaataggaaatcgcttgtgaaattggaagcaaattaagaaaatacatgatagagcttttaaaagtgtggatgacctttcaatacatatttgcttggaggcgatggtgaaaaactgaaaatgacatcagatacacgcttgtgaaccatctttaaagtattgatggactcttcactatgaaagctctctttaaaattaattttctttgtacatgtctctaagcaatgtcaaattaattagaggtccaaattcaaaaaaatgtcgtattgaatcattccattactaaattggttcaatgtcagatttaaacagcctagggataatttagtgagatatgagattctactttcaacatatactaatcctaaatctctagcaactttttatataagctataaatatcatgaaaatgtattttaatcgtttcataatttatgcagtcacactaatggaaaaaaggccaattattattattttcttcagactataaatgaaaacataaattaaaatgcagattagtttaaaattttaataagtaagtaaaatgcttatagccttatacaaaatcatatttggaagtttctaacattgttgcaatttgttatcacaaatcacagtaatatttgtatactaattagtaattacaactatacacaaatttaaatgggtaatcatatatttgtgtccagtggattgaacaaatatgctcggcccatgcggaagtaatgccaattttgggtgagtaaagcccatgcgaaattttcacataagaaatgcatgctttttgttttcaacgacatgagttgcatgctttttatcattgcttatatagttgcaagtttgcaactccttgatattttttttatgtagacactactaccaccaaaaacttttggtctgcttattcttgtttactatgtaaaaaaaataaatgaattgtttatttactccgatttgatggagtctggtttatgaggttttatagcctttacagaaaattgatagttacaaaaatatttttcaaaaataaaagggtaaaaccgtcatttcaagttgttattgttttgggggactggatttgaaatgaaatatagaaccggaaaacaaggtgagccgaagtcgaagcctttggacccgtttttatatttactcctcccattcccttctccttcaatccttccttcctcctcctcccttcttcttcttcccctctttcattttccagccactacaaacttttctatctctactttttttcctctcgatttcaggtactttttgagaccctttgttgtgattttcgaacacacaccccaattacgtttgatttttgatcccgcatcgatttcaattcatccgtttctgagtttcttttggatctgggtgtcttgagctaatcttttcgatctgttgtttatcgattttactcatgcgtatgttcattacaccatttgttatttgtttaatcaaccaaaagactcatgtttttcaaatgtctttaatataatttttctgattgaattttataatatttacatgattctggatccagaatatccttcttcttcttccattttgtcctgtattgatttgtctttgaaaaaggattgttctttgtatctgtattggtgaaaaaggattgttatttgttgataaaaatttgatctttaaacaatgtttggttttgcataaaggtagaagaaa

SEQ ID NO: 12190 - DNA, 3000 bp, Unknown
  misc_feature (1)..( 3000): cDNA_ID_1808260_gDNA_ID_2214536_Annot_ID_134383 3000 nt of promoter + ATG
ggataaaaactgaattctccggcgctgctacaacggtgtttatatgatcggaggagagattgtaattgaaaccgtcgtatagtgttaccggagtgaagctatgcgaagaaggttgatcgggtaaaccggataaacggttccgattaaccatacctgaaatcccggttagacttggttcagtaatcatttctcgattgagaaattattaaggaagaagaagatgattaccgaaggaagaagagaagacgacgtttagagggtgaagagaggaatcagaataaatgcgtttttaatttttaaaataattaaaataaaaaggtcctaatctacgaggtagggaaaagcaaatcagagccgttggatcatatgcgttttgtggggacctgtcgtcgtcgtgctttatcatttttttgacaatagctaaaatgtgcttttcttatcggttcattgttcgccacgtgtcgtcattacagtaagtaaagcttacttaattattttttaatatgcaaattagtacgagtagtacagttttattttattttgggttagtggcaagtacacatttaatgagatttatgtatagtttttttccccaacttggatggtactaaaatcaaaccttaattagtttttaagaaccttaaatgttgacagagttctttaaactttttaataattttcttagttaattaagacccatttgattaagataatgagagagtctctcgaccttcccccaacggcacaatggctataaaattcgtttccaactttaaaatagaatcatatttttagggtattgcttgtgttaatccatgctccatgctatgtgttcagtagcaatcgaaaccagattttatacccaacaaaaatccatgctaagtgccattcaaaatttatcgatttatgtttcatacaaaaatgtttttgtgtttattgcttgcttaaaggagtaagatagtaatgttcgtgcaaacatttttcaactttcatattggttgcgtcttagtaatacgatggttatatgctcacgtgaaaaaaccgtaaaaaaaaaaacagatagctagaccacaactagtgttagatcaagcatgtaaaagtccttaacattttagcaagaccgcaaacgaactctcgcataatctttgcgtatgattcgtctatgatctattctctggatgcaagtattcatatatttgctgacttttctccctaatataaattcaatagttcattgtcattttatgcatccttctttctttatctagtttagtttattttagttacgtttgtaatgcttagttctttataaaaacacaaacaaaaaacttactcatttcgttttagctgtttctaacaaattaagcggccaacatctccatcttttgtagatttgaatcgtactgagatattacaaccctccatttgtagattacaaagatattgcatttgcgcacatgcgaccaccaactaacattaacgcatggattgcaaatggaattctagagtttatggtttccattgacgcaaacagggcagcaccgacatccacccatatgccggtggatagtcagggttaaagacttgattcatcacaggcttgttacatagtagagagcatgatctcaaaacttattagaccgtttatatagtagatctatctagtaattttttgtggagaaaattgtgatattctaatttgactaaatgctacatagagaaagattcaaagattttcatttttttagtccaaccgttcttttgcttctctatccatgtctttctattcccatatttctgcaaatgatttgctatacattatgtgtgaatagttatataaattcaagtaaatttctttgaacaattacaatgatcgaaacaaattgattggttcaacaaatttcttttaactgttgaaattatatatgtctttttactttttagtttctacatatgaagttggaagtgtttggaataatgtatttcaattattgtaaacagtaaaacaaagctgctctaaaatcagccattcggagccttggaacttataataattcacatggaacataaaccttgtgtaacaattatatcacagacactccacatgctcatataatatacgataactctcgagaagcttgtcattcaacttttgcggccctatgagaatgtgacaatgtcatccatttaatacaacttttattattgttcagaaaaatcataaataaacaatattcatatgctgatgctgcaaaactaatttatttatttgtatgtcgaccttagtctaaccacatgctcttaatgtgatgctcgattcgtttggttcatttataagatatgttcacaagaaaatatagaggaaaacttcatacatgtttttacgtttgtttaatacatttatatatgttaacaacttaacatgctctgtgactaaaaaaacttatacatgcgtgcatgcgtagataatggcaaataaaataactataacctttttacttcgtgaaaaggaaagacaaacatacgtgactgtgtttggcatataattttggtttgttttaccaaaaaaaatattatatttataattttggtttgattcggttatacgaaattcgagcttttggttttttcggttttcaactatgaataccgaaattaaattttgggttgagagctgtttggtttcggatataacataactaaaacaacatctatttttcagttttggtttactaatttatctgcactaatttaattttggcacataaccacaattgccaccttcggtttagtctcagaaagtgaaagccaatcaaaccaatgagatgggcagcaattaatttacctaccaaaacctataaatctgaaaaattacagaaaactttaactggaaggttaaaaacacccaaccagcatcagtccccataaatactcgtagtccttcccgctttctctcgtccctatccaatacacatctctctctctcttattaactcaatg

SEQ ID NO: 12191 - DNA, 3000 bp, Unknown
  misc_feature (1)..( 3000): cDNA_ID_2711601_gDNA_ID_2214536_Annot_ID_134386 3000 nt of promoter + ATG
tggtttcagcttttcttcttacgagttgcaatgatgaatgctaccaaaatcatcagacagcgccatatgatactctcgtctaaacatgcgatgcacgtgatccagtacattatgacgtgtcaattattataaattattagtaagatatttttttgcttagctagtagaccagaccaagtaaagaactaaaaatactattttgtcattatggtaccaagctaatagtttatctggaaaaagaacaaattgtccaaaaaaataattaccaaatagttgagaagtttttctaaaaatttttgtaaaaaaaatccaaattcttctaaaattaagtttttaatagaaatttaaaaagacagttctacatcatattattttctttaaataatgatataaaatttataaactattatctttgtaagataatgaatatttatacctatgtaagggaaaaattgataaatatttatacatcctcatccaaaagcccataaaatcgttatgggacaatagtaaaaaagattgcaaaatcgtatggagcgaaagataaaaataaaaaacggtcccgtgtaagaagatgggtcacctcgccaacacgtagactcttttcacgcgccaaatcaaacaccatgtcgacgagatcaacggattcaaatgtttcgtgtaatacacgctccaacgtagcgcgtcgtacacttgatgcttaatttatgtattttaagttacgcagtttccagattttcagaccctctgaaagtggaaagagcattttttaaaagagtaataagaaaaacaattatctttgaactctctctatctctctctctctctctgcgatctatgcctgaagtggaagtggataacaacaacgagaagccatctgagattaacaggtttcagtttctcaatctattcctatatattatcattagagatcaaatttcttattatgcttcttctcagtttctttaagatacagaggattgactgattatgtatgtattcatgtcaatggttgaccaaaaatcatagctgcagaggatgattgaagttttatcttgattttagcttatttaatcgttgagattaagaaagttttcctgttattctttcctaaacccttattaagttcaagattaataaagtcaatttcatatatttggtgattaagatccatccactatcttaatatgtgttgttctttttttttgcagtttccatcacatgatcataagtagtagtaaaaatgtgttgaaaatggaagaagttgaggtgagcaagaagaggaaatttcagacagatcaatctgatgagttatcgttattacctctgtcaaaacacacttgttttgccaatgttgcttgttcagagaatacaaatggtaactcggagattgatacagagtattcaatgtcttcttatgtgaactcaacaacttctatggagtgtaacaatgatatagagatgaaagaggaatcatctggatcatgcggtgaagacaagatgatctctttcgaaagccatctagattacatctatgggactcagaacttagaggatttttcagagaaagtcattgaaaacattctctatctcgatgaacaagaagaagaagaggaagatgctaaaggatgtagtagtaatgctgctaagtttgttctgtcctctggaagatggactgttaaccaaggtaaagaaaaccggattttggtttgaccgtattgattcaatgaaccggggattcactaacttggtttcatgtgtacagatgattctactctacatgagacaaagaagcctaccattgatcaagaatttgaacaatacttctcaacgctaatgctgtaacaaaatgatgttgagactcaaaacatatatgaagagatgtatgtacatagaactgtactcgttctgttttgattcttgtcaaccttaaaaaaacgttcaattcaaagtgattagagagcttctttgaaatgtttgcaactctagtcttcaacttttaagatttttattagcttgcaaaactaatcttgcttatatatcttgttctgcctggatcagaaataaaagttagtataaaaaaattctgagatgattatgacactctgatccttcatatgaaccaatcttgtgttcaagagtatccctgatgtatttcagtaccaacttaactgagaaatgagagtcaatgttctttaataagtttgttcagatgatatcttcttctttttttggttggtcacctatattcaatctgctctctccaaattatctccaatacactctcttctgaacataatacaaaaattcataactttttcttattatggtcaaaagtcttgttaatattcaacttgttcctttctaatgtaaaatctaaactgatttaataaagaaaaagatgatagcttattgatattcttcctagtaaaacattttggcatgatggtcaagactcaagatttgctagaatgtggttccctcgcattatcagtcttcttggtcaatgtctagtagttttaaattcgctataaaaatagcaaaaaaaaacaaaaacaaaaaattgttgattaaaaagaaattaacaccaaactttaaaaatagttatccttagtaattttatgtaagtatctttaacacgtaaagtcgaacatagtatatgattttgttcacactaatagtcgaacaaaacgtaaattaaggtttgaattataacgaaagcaaaacatgcttccacgacctttggttttgacttaagatcttaattaacatcatcaaacatttttattagttatggacttatggtaatgaaattgaacgtgaagagatcgatgtgtcttacaaaaagacaaaacacgtcttcaacactttcctccataattcccgatttgcccatcattccataacggtgcctctgaatcatcaatgatcggccaaattttctgatttcagatttcaatcaccattttcaaattcggtggagctagttggtagatgatg

SEQ ID NO: 12192 - DNA, 3000 bp, Unknown
  misc_feature (1)..( 3000): cDNA_ID_1833613_gDNA_ID_2214536_Annot_ID_134388 3000 nt of promoter + ATG
ttatcttacaaagataatagtttataaattttatatcattatttaaagaaaataatatgatgtagaactgtctttttaaatttctattaaaaacttaattttagaagaatttggattttttttacaaaaatttttagaaaaacttctcaactatttggtaattatttttttggacaatttgttctttttccagataaactattagcttggtaccataatgacaaaatagtatttttagttctttacttggtctggtctactagctaagcaaaaaaatatcttactaataatttataataattgacacgtcataatgtactggatcacgtgcatcgcatgtttagacgagagtatcatatggcgctgtctgatgattttggtagcattcatcattgcaactcgtaagaagaaaagctgaaaccagatcttccttcgttaactgttttcagctccagcttctgaaacggactgtccagaaacaaaatatcatcaggttttatctcaaacaacaacagattatatagtttgtatcttggactaacctgctgtttggatcataatagaaaccgctgatggaaccatcgctgcaggagaagcatacgtagtaaaatccagctattgttagtccacaatctgtgccaacgtttacaaagtattgctctttccatctctgcaccaccacaaaaataaacccgagttgcaggaattatggaatacttgagagaaaatgatgattggattcgataggaaaaactgagagttataccataaatatataaggataattgttaagatccaattgcctgccaccatcagattcaacttgtccctgcagtattaagtccagaacgttgcttaggagatgttactgactatacaaacaatgttactcgagtgttacctgaagaggcgaaaaagacgggaactttgaccaatgtctcatatcatcttccctcctgtgacaaacaaactttcaaaaatttattcacgataagaaatcatcagtttcaaatctacaagaatataggaattgggacatacgttgcttcccattttccggtgtaaaaggtataattctttccatcaacgatttccccttcccagaatgttatgacctgacactcacagaatcaagaatcgtgtcccctattagaaattcaaggggaagcaatatgaagaaaaaatgagtaagagtgtaagggcttacaggagtgtctgccatgggaacgtttagagcttccatggtgccacaaagataaccatgttcaaggtcaataccctgtatctggacgttgactctccaagcttcctccttctgttgattagagacattttgcgtaccagaaaatgcctgcagcacagcataaaaacatgtgtgttcctcatctttaggttcattatgaataaacaatctctttgagccaatgaatgttatacaatcccaactagatacaaatgcacttgaattaagcatacatgtcaacatgaaaaagatatgaagccaatcaaagcagacaaggccaacttctaattggtataacaaaaatcagcattactagagaatcgttatgcaaccagaacacttgaacaagttgcagatctaatgggaagaaagtaactagacccatgatgtttgttgcctgcctatgaatgatgctttgtgcctgaacaacgagacacgagatctttaagttcttttatgctaacctaagtagctaaacatcatggaaacttataactttccttctcatcttaccatagcctctctctcacaaatttcacataaagtatactagcaaacccttgtgaagcaaagtttcttctataactaccacagccaatcgacagaatcaacaataaaaaaattagctattcttgtgatttcaagtattcataagtaagaacttgtcaagtttgagagaaaattcacctttacacataaaaacccctaagataatgtctttataggtatactcagattctgcttacacataaggttatgttcataaaaagagtgtgcatacataaccacagatgcacaagcataactaataaagttctttctagtcctaaccaatattcccaagacctctatggtcagacacttgagagaaaaacttgtaaaaatccaagtatcatacgaatcctagaaataaatttctgcaaaataacatgttttgttaattcattaatcgttgtacctggccagcgccgagaagtgaactagggggaagtggtgatcgattcccaggatcagttcctaaatggcaacaaatctcaacaaatgagcgagagagccacaaagagggaacataaacaaacaaacctaaattcaaaacttgaagaagcgatcaaaaacctgaaacttgagcaggcgtgttgctctcaacaactctcaccggcattttcttccgtctcctcctttccgtctgataaaaatccgatctttggtgcgaccaaatcaaatcgtggagcctaatcaaaaaccacatctcatcatacccggttcggttttcttaaccgaatcaaattatacataaaacggattaggcttctccggttttcgactgcgttttgtataaaacctctcaaaaaccttttcttctctccccgtcagaccgatcttctctctcctcgccgccgcctccaaatccggaagaagcttttttccacctctattatcgaacttgctttataaaaatctaacctttggacctgactttccgacttctctctctgtctagctgcttctctcacccaggtttgccttcctctcaagttgaagctgcggctttattagtttagctattgactctaagaatgttacttgaatccattcacatgagcttcttacgtcgttttcattggtttagctattgacgttgacttgggttttgcttgagttcattctctattgtggtctaccatactttttcatgttacttgattgcatatttataaaacggtgctaaaagtattccgttttgtatagcattctag

SEQ ID NO: 12193 - DNA, 3000 bp, Unknown
  misc_feature (1)..( 3000): cDNA_ID_2708511_gDNA_ID_2214536_Annot_ID_185103 3000 nt of promoter + ATG
atgattgatttttgggttttatttctattgttttattttgggggataaattgtatgaaaagttcagctaaaaaaaaatggaaaaatctaaaggaagtattgagtagtatatgtatgtacacttgaggcttgagaacaaaatttcatatacaattaggtatattgacaccctaagtcattttgttataattagtagtacatgtttagacaatgtttccaggagtgaatcatacatatgctaccacataccattcatttctcagcttctagtttacgacgttgagatatctattcacagagaaaaaaataaagattggttaatggggtcagatgagcccatattatgattcattttctgggtaaagttttcgatatatatgatttagcttggatatgcaaatgactatatgaactctgtagtatattatttagtaatagtagtatttgaaatgataatgtacatgaaaatacgaaaccatgaaaacgagcaaaatacttttgtatatataaacaagagcaaagtattttgtatagcccagcttcactacctaggcgatcgtttaaatgcgctttaaaatctcagcttaattcgaatcttaccggaaaaatgactaactaagttgttatggtttccataataagaatacggggtcttaataactcttaagtccgaaacctcttggttaaaaattaaaaaaaaagtattgacacgtctatacttccttgagtgatttgaagcatgttgtgtaacaacaatccaaaataaaatcacatgaagatggaatattttctgtcacaatttccaagaaagagatcgaatgatgaataattctcccatagatcttagttagtaatttattaaaggaatttcgatagctataatataattaatatttacgtaaagtagaaaaactcggaagcaactaattattgttctttttcctatcataattgcaggaactctggcaaataagttcgtaactaattttgtaaaacaataaggaaatagtttaataatgactaattcctcgttgttaaacgtcgttataagctcgtttccacatacattcgcatctcagtacgtaacatgccattctgtcaaaatcataaaaataagcataagaaagagcacaaaaatccaaatatgtcacaacacatattccctttcgcttgttttgtctcaatagataattgaatagaataaaattatatactactccaaccatttagagtctctaccctaactttttagccccatgggttaccaactcttctatcgcttagacttaacttaatctataaattttcatatcgtatctgtaaactaggtttgcactgtttctatatatcaaaaacccataacgcattggaagaatctgtttatacttaattatatattacacatttacattacataaaccatagtattttcattcttaatttctatcaaccatccggtttctattgatacaaccaaaaaaactttttgaatacaataagtgaaagtttttacattagtggaaaatgtttacccaagttgcttcccaatcccactacgtagtacattaaataaggtggtgagctttataggggaaactatatatagatgcatatacgggcaagtatatatgatatatctacttgtctaaagaattttggagctaatctattagtgagattttactagaagtctaaaaatgaaaaacaattagtatagtctcttagtgatttgatttgatatgattttatagtgtaaaatatatatgttgtatgagattctaagaaatgatacagtgaaataacatagaaactttcttctttttgtgcaagttgattttgaaaagaatttaaaaacagatattttctcttgaatgtttttcgattcgttcatgaacccattggcataaacttcaaagctatcaactaattcttggtttacctagctagggtttggttattagttagatacgctctttagattgctataaatataatgaagtggtcttctctgtatataacaatacataggtggaagtgaagtcttcgaataaaagcagagcttccacatggggaatgaatctcattctctgtaactcacatatttcaatagttaaattaataattcaaatatgacaataatcaaatatatacaatacgtgaagggaatttttttttggattctaagaattaaagtgtcacggaattttggacgattctttagataataatataatgcatcaattactggacaaaaattggttatcaattatttcccaatagcaagaccagtcgacatatgtctgtttgaaactaatcaacaactagacttcgaatactaacagaaatataatacacacaagtacactggtacatatgtaagcgaaagttctacagaggatcctgacaacaagaaaagaccaaaaattcttggttggtccgctttaccagtctggtttcttttattttattctcagttttaaagatgtgagtgaggttatgtaagtgatgttttgtcaacgactcaaaagagtaaaatatacctttgattcaagtttgttactctcttagtcttatggttaagatttttggacatttccttcactccaccatgcttggcccaataacatacgtatgtgcaacagcttagggtccataacttttttaaaaaaatttggtggtcaacaaaggtccattactctagtcatacagtatctgatagtcatcctatatgcttcaaagttaaaaccattcctatgttttagaagatttgttttctcgaaaccatatatttcatcaacgaaaataaaggagtaggaatattcgtcgaatataaactttctcaatttgtatcgcaatatatgtaaactttagctgcaaaaatataaaaataaaaataaaaataaatgtcaatcttatttccactaaaccctattcgtacagtcgtaacatatttgtacaaaataaagttccacagaccataaacatcaaaaaaaaaaaaatg

SEQ ID NO: 12194 - DNA, 3000 bp, Unknown
  misc_feature (1)..( 3000): cDNA_ID_2711593_gDNA_ID_2214536_Annot_ID_185099 3000 nt of promoter + ATG
attaagcattaatcttggaagttgtaacacatatcacctaccttcataatctttctcaatcacgagtatatccccacacaaggaaaaataaaagagctagtgacgacttttccactctcttcacaccataaatcgtctctctttctctcttcacaactaaaaacaaagcaaaagaaagaacaacacagagcagagaaaaaaaagaggtagccatgttcttgaagcttttaaccatcttcttcttcttcttcttcaacctcatctttcaatcttcttctcaaagtctcaactttgcttacaacaatggctttaatccaccgacggacttatccatccaagggatcacaaccgtcacacccaacggtctcttgaagctaaccaacacaaccgttcagaaaaccggtcacgccttctataccaaaccgatccggtttaaagattctccaaacggcaccgtttcatccttctcgacatcgttcgtcttcgctattcactctcagatcgcgattctcagcggtcatggcatagctttcgtcgtcgctcctaacgcaagccttccttacggcaacccaagtcaatacataggtctcttcaacctcgcaaacaacggtaatgagacaaatcatgtctttgctgttgaattagatacgatcttgagtacagagttcaatgatacaaacgataatcatgtcggaatcgatatcaatagtttgaagtctgtgcaaagctcgcctgctgggtattgggacgagaaaggtcaattcaagaatctgactttgatcagtcgtaagccgatgcaggtctgggtcgattacgacggacgtacaaataaaatcgatgtgacgatggctccgttcaacgaagataaacctacaagaccgcttgttacggctgttagagatctttcttcggttctactccaagatatgtatgtgggtttctcctctgcgacaggctctgttctgtcggaacattatattctcgggtggagtttcggtttgaacgaaaaggctccacctttagctttatcgagactcccgaagcttcctcgcttcgagcccaagagaatctctgagttctacaagatcggaatgcctttgatttctctgtttttgattttctcgtttattttcctcgtttgttacatcgtgaggaggaggaggaagtttgcggaggagctcgaggaatgggaaaaagagttcgggaagaatcggttcaggttcaaggatttgtactacgcgaccaaagggtttaaggagaagggacttcttggaactggtgggttcgggagtgtttacaaaggtgtgatgcctggtacgaagttggagatcgctgttaaaagagtttcgcatgagtctcgtcaagggatgaaagagtttgtggcggagattgtgagtattggtcggatgagtcataggaatttagttcctctcttgggttattgtcgtaggagaggtgagcttcttttggtgtatgattacatgcctaatggaagcttagacaagtacttgtacaacactccggaggtaacacttaattggaaacagaggattaaggttattctaggtgttgcctctggcttgttctatctccatgaggaatgggaacaagtggtgattcaccgggatgtcaaagctagcaatgtcttgttggacggagagctcaatgggagacttggggatttcggtttggctcggttgtatgatcacggatcggatcctcagaccacgcatgttgttggaacattgggatacttagctcctgaacatactaggacaggacgtgccacgatggctaccgatgtttttgcgtttggggcgttcttactcgaagtcgcatgcggtagacgtcctatcgagttccagcaagagaccgatgagacgttcttgctcgtggattgggttttcgggttgtggaacaagggagacatcttggctgctaaagatccgaatatgggttcggaatgtgatgaaaaagaggtggaaatggttttgaagctaggtctcttgtgctctcactctgacccaagggctagaccaagtatgagacaagtgctacattatctaagaggagatgcaaagttaccagaattgtctccgttggacttgtccggaagtgggatgatgtttggggttcatgacggatttagtgaattaggaatgtcgtattcctcctccgtattcaaagggtttaccggtggatcttccatcgctgattctcaactttctggcgggagatgaatagaatgttttgaagttatataaagtatatgttatttaatggcgatagttatgttttaaatatatttgaacctttttgtgtgttttgcatttcatctgtagagactatttgggcgagatatgggaatgggactatgtatatatacttcagcatatgttgaaaattactgtctaaagaatattatggccacatgataatgacgttacaagattgtgaaatgattcctctatttccttcatttcaactctattccattcataatcatgtgggcataataagagttgaaatggttgtatgaatctaccctgtgaataagtactattgacaatatcttttaggaaaggtatacttatagatttttcagtcctctaacatggttgtatgaagatgtattaaacaaagaccccagcttcgctggaaaagcagctccttaaattcccaacaagaaaccaattaatgaaaacagtaaggcaattgtcaaatgattaacatagtatttgggaagcgtgtagattcaagagaatttaatgaagaaaaggcctcgtaaagtcgaccgataaaacgggatctcttatctgttaaacttaaatattaggtttagaatcttttttgactttcggaaaaaggaagtctcatgtgcctcacatgtgaatgtgattccctctattctaactatgcaagtatttgtatatatatagagcattcgtacatacaaaaagttggacggacgtgaccgagtctttgtgcggaagaaaaatg

SEQ ID NO: 12195 - DNA, 3000 bp, Unknown; identical to SEQ ID NO: 12192
  misc_feature (1)..( 3000): cDNA_ID_3024200_gDNA_ID_2214536_Annot_ID_185098 3000 nt of promoter + ATG

SEQ ID NO: 12196 - DNA, 3000 bp, Unknown
  misc_feature (1)..( 3000): cDNA_ID_3024204_gDNA_ID_2214536_Annot_ID_185096 3000 nt of promoter + ATG
tttatacaaaacgcagtcgaaaaccggagaagcctaatccgttttatgtataatttgattcggttaagaaaaccgaaccgggtatgatgagatgtggtttttgattaggctccacgatttgatttggtcgcaccaaagatcggatttttatcagacggaaaggaggagacggaagaaaatgccggtgagagttgttgagagcaacacgcctgctcaagtttcaggtttttgatcgcttcttcaagttttgaatttaggtttgtttgtttatgttccctctttgtggctctctcgctcatttgttgagatttgttgccatttaggaactgatcctgggaatcgatcaccacttccccctagttcacttctcggcgctggccaggtacaacgattaatgaattaacaaaacatgttattttgcagaaatttatttctaggattcgtatgatacttggatttttacaagtttttctctcaagtgtctgaccatagaggtcttgggaatattggttaggactagaaagaactttattagttatgcttgtgcatctgtggttatgtatgcacactctttttatgaacataaccttatgtgtaagcagaatctgagtatacctataaagacattatcttaggggtttttatgtgtaaaggtgaattttctctcaaacttgacaagttcttacttatgaatacttgaaatcacaagaatagctaatttttttattgttgattctgtcgattggctgtggtagttatagaagaaactttgcttcacaagggtttgctagtatactttatgtgaaatttgtgagagagaggctatggtaagatgagaaggaaagttataagtttccatgatgtttagctacttaggttagcataaaagaacttaaagatctcgtgtctcgttgttcaggcacaaagcatcattcataggcaggcaacaaacatcatgggtctagttactttcttcccattagatctgcaacttgttcaagtgttctggttgcataacgattctctagtaatgctgatttttgttataccaattagaagttggccttgtctgctttgattggcttcatatctttttcatgttgacatgtatgcttaattcaagtgcatttgtatctagttgggattgtataacattcattggctcaaagagattgtttattcataatgaacctaaagatgaggaacacacatgtttttatgctgtgctgcaggcattttctggtacgcaaaatgtctctaatcaacagaaggaggaagcttggagagtcaacgtccagatacagggtattgaccttgaacatggttatctttgtggcaccatggaagctctaaacgttcccatggcagacactcctgtaagcccttacactcttactcattttttcttcatattgcttccccttgaatttctaataggggacacgattcttgattctgtgagtgtcaggtcataacattctgggaaggggaaatcgttgatggaaagaattataccttttacaccggaaaatgggaagcaacgtatgtcccaattcctatattcttgtagatttgaaactgatgatttcttatcgtgaataaatttttgaaagtttgtttgtcacaggagggaagatgatatgagacattggtcaaagttcccgtctttttcgcctcttcaggtaacactcgagtaacattgtttgtatagtcagtaacatctcctaagcaacgttctggacttaatactgcagggacaagttgaatctgatggtggcaggcaattggatcttaacaattatccttatatatttatggtataactctcagtttttcctatcgaatccaatcatcattttctctcaagtattccataattcctgcaactcgggtttatttttgtggtggtgcagagatggaaagagcaatactttgtaaacgttggcacagattgtggactaacaatagctggattttactacgtatgcttctcctgcagcgatggttccatcagcggtttctattatgatccaaacagcaggttagtccaagatacaaactatataatctgttgttgtttgagataaaacctgatgatattttgtttctggacagtccgtttcagaagctggagctgaaaacagttaacgaaggaagatctggtttcagcttttcttcttacgagttgcaatgatgaatgctaccaaaatcatcagacagcgccatatgatactctcgtctaaacatgcgatgcacgtgatccagtacattatgacgtgtcaattattataaattattagtaagatatttttttgcttagctagtagaccagaccaagtaaagaactaaaaatactattttgtcattatggtaccaagctaatagtttatctggaaaaagaacaaattgtccaaaaaaataattaccaaatagttgagaagtttttctaaaaatttttgtaaaaaaaatccaaattcttctaaaattaagtttttaatagaaatttaaaaagacagttctacatcatattattttctttaaataatgatataaaatttataaactattatctttgtaagataatgaatatttatacctatgtaagggaaaaattgataaatatttatacatcctcatccaaaagcccataaaatcgttatgggacaatagtaaaaaagattgcaaaatcgtatggagcgaaagataaaaataaaaaacggtcccgtgtaagaagatgggtcacctcgccaacacgtagactcttttcacgcgccaaatcaaacaccatgtcgacgagatcaacggattcaaatgtttcgtgtaatacacgctccaacgtagcgcgtcgtacacttgatgcttaatttatgtattttaagttacgcagtttccagattttcagaccctctgaaagtggaaagagcattttttaaaagagtaataagaaaaacaattatctttgaactctctctatctctctctctctctctgcgatctatg

SEQ ID NO: 12197 - DNA, 3000 bp, Unknown; identical to SEQ ID NO: 12191
  misc_feature (1)..( 3000): cDNA_ID_2711601_gDNA_ID_2214536_Annot_ID_185095 3000 nt of promoter + ATG

SEQ ID NO: 12198 - DNA, 3000 bp, Unknown; identical to SEQ ID NO: 12190
  misc_feature (1)..( 3000): cDNA_ID_1808260_gDNA_ID_2214536_Annot_ID_185092 3000 nt of promoter + ATG

SEQ ID NO: 12199 - DNA, 3000 bp, Unknown; identical to SEQ ID NO: 12187
  misc_feature (1)..( 3000): cDNA_ID_1011470_gDNA_ID_2214536_Annot_ID_185082 3000 nt of promoter + ATG

SEQ ID NO: 12200 - DNA, 3000 bp, Unknown; identical to SEQ ID NO: 12186
  misc_feature (1)..( 3000): cDNA_ID_3024225_gDNA_ID_2214536_Annot_ID_185080 3000 nt of promoter + ATG

SEQ ID NO: 12201 - DNA, 3000 bp, Unknown; identical to SEQ ID NO: 12185
  misc_feature (1)..( 3000): cDNA_ID_1807383_gDNA_ID_2214536_Annot_ID_185079 3000 nt of promoter + ATG

SEQ ID NO: 12202 - DNA, 3000 bp, Unknown; identical to SEQ ID NO: 12194
  misc_feature (1)..( 3000): cDNA_ID_2711593_gDNA_ID_2214536_Annot_ID_134389 3000 nt of promoter + ATG

SEQ ID NO: 12203 - DNA, 3000 bp, Unknown; identical to SEQ ID NO: 12193
  misc_feature (1)..( 3000): cDNA_ID_2708511_gDNA_ID_2214536_Annot_ID_134392 3000 nt of promoter + ATG

SEQ ID NO: 12204 - DNA, 3000 bp, Unknown
  misc_feature (1)..( 3000): cDNA_ID_2711585_gDNA_ID_2214536_Annot_ID_134395 3000 nt of promoter + ATG
tggctacccgcaaatgaacgtaatatttttccttgaatatacagtaatttatagtattgtaattaatgtagtacatatatctgttttaatttttttttgaaaccaattataaatatcctcacggtaaaatggattatatatatatatatatatatatatttgctaaatgaaatatcatttcaagaatttagtttattagaaatattttattaaatgaaatataatagtttattattaaactaaattgtttcatttaaccaaaatattttctatgatgctatttcatccctgatttttgtgattatggatatattgttaactttataacaaaacaagagaattcaagggactgaaacgttttatgacttttaaatggatgactatatacaatggctgatccaaaaaaacaattttgggtaaggcatattcagtgagctctaggcttagcgccatatatgttacatcaaaatttattttgtagagtaaaaagctttttagaacaaaaaaacaacaccttaatttatgtctattttcgttgtaaatgtgtaatatataatacatttaatgaattacaacaaatggtaaaactcatgctgataaaatactgcaaactagttcataatcgaactcaatagaaaatagaaaaaagaatttatacttttgtaaaaaaaaaatgctactttgtttttctgttgtatcggtaaagatgagaacaacactgaccaagcgaggttttgggctttaaccatacaaggcccacatgaatacaaagtatagagtttagttgtccactaaaaacctagttctataaggagattattgccttgagaacaaaatgattttattcccaatgaacaagcaaacaagaagttcaatattttcttgtcgaactttttgtcttcatacctttacaataaagtgattaactcattacaaataaattgtgaggaatactagaaacttggatttattgacatatgtttattgttttagacattttatcttcatttgtaacatcgtgataatgacacatgttctagtttttttttttttttttttttggacaaacagatgttctagttttatctatcaaatttgaggagaaaatattttagtgttacaaaaatatatagaaaggtcttttgtttttcaatgttactgttaaccttaaagtcaagtttcaatcagataaagaactatatgatataatcacagtcatcatacaggcagatgaagataaccattaaatcaagacgatagtcaatcatactcaattggcttcttcaataccaacggattaattaattcctcaatagctaatatatatctttttaatattttgactatacccaaatagtttagtgggcacaatttcgtaaccttctcttatttttttacacctcaaacagtcaaacgtcatcatatatataacaaatcttttgacatcatacgttattttctataataatccaaacacatcccccacctttataaatatattatgatacacttcccattattcaaagattttatagcacaattttgttttttaaaagcaattaattaactactatagtatactttactaacaacatttgaaaaaatatacaaaaattaaaattttatcattatcaaagcagtccagctgcataccattatcaaaattggatgtggataaacttaatttgataaatttctgtataacttaacaaatattaaatatgtgttaatagttatgtcaacttatgttgaagataaatccattggaccggccgtggtttttatattagtttgaatgtagctttcagattcttcctatacccaaatttcacattcaaaggttgcttatctttttaacattcaaactcatttaatatttaaatacactaactaatgacgtgagaaaacttatggatgcagcaacaaatcataagacgccacgtgacaatcttgatcgctctataaaaaaccaaacctgctcttctttggtcgctacagcaaaaataacaataaacaagataaatggagggtctaattccgttagtatacaaagccgtcatgcaaatccgttacggtaacgagtcgcagcaactttcttcttcttactacgttcgtcttcccggtgattcgggtcggtttgtaagatccgatttagatgtatcgggtcctggatctaattcctccaatagggcgtcgtcgtcgacaagcacaactacgtttgctgtttacgcgggagtccagtcacctgtttctcgtcaggttgtcacgtgattcacacgcgctttttgaaggaacctgaagttgcgtgtgagggaagggttcgtgacttttgttttgtgcgttttttttttgtaagttaggcttggaccggtttaataaacctgatgtaataattcggtttggaaaattgatttctctaagcgtagactttaacccaaaagggtggtctcgtggcttttgatttgtcaattgtgtgttttcttttaattgtataaagtttctatgaatatatttagtttattcgagaacaattgtatgaaatgtttagttaatgttttcatggtatataggttgtaaaacaggttaattacgttacaatttcctagttttggtattaatatgcaaaaatgacataatatcaaacttttaagtaaattgatatttttcactaatgttaataatgaaaccaactaacaaaaaaaaaaaagaacaaaccaatttctatttgtttaagactttgacagtacatcacttttagaaataaatgccataattatgttatgtgcacactgcaaaagaaaatgaatacgcacaattgactataaagaaaacgcctttagtggccatacgatttttagcattttatgcggaagaaacaaagtgctatttctccgagttacgtatgtttcttttcttctgcatctagttttttttttgcatattcatcaccttctctcagttttcttctttcaatagaattatccagaaaacttttaagag

SEQ ID NO: 12205 - DNA, 3000 bp, Unknown
  misc_feature (1)..( 3000): cDNA_ID_2711582_gDNA_ID_2214536_Annot_ID_134396 3000 nt of promoter + ATG
gagttacgtatgtttcttttcttctgcatctagttttttttttgcatattcatcaccttctctcagttttcttctttcaatagaattatccagaaaacttttaagagatggcagctccgattcgattctttgaactgaacactggtgccaagttaccttgcgtcggtctaggaacctacgcaatggtcgcgacagcgatcgaacaggcgattaaggtatcaccttcggatcaaacttcgaccttattattatgccattggatataaaatttaactttgacacttttcttgtcgattattttagattggttacaggcatatcgactgtgcttcgatttacggaaacgagaaagaggtaaatttgctatctacaatatattttaatttatctctctttaaccatagatgtcatttgactggtcatcaaatgtattctctacaagagtgtatatttattatagtttttgagggtcatggtggaacaagaatctcacagtaagtgtagcctctatgcttctaatgaaagagttttttttttggtatgatgcttctaatgaaaaaggtatatgaatgtttagtttgtgggaactaaatgtgttctgctttcttcctattttcgttgttctcacactatgattgatttccatttattagattggtggtgtgttgaagaagctgataggtgatggttttgtgaagcgtgaggagttatttatcacttccaaactctggttggtgttctgtttctaccaagattctctctggtctgcactgcacacacacacacatgttcatgttttttgttttgttctgtaggagcaatgatcatttacctgaagatgtgcctaaggcactggaaaaaacgttacaggacttacagattgactatgttgatttatatctggtacataacttatagcaaatgaatcttgtttacgtgtaattttttccattttgatgtgtttttgcttttgttgaagatacattggcctgcgagcttgaagaaggaatcactaatgccaacacctgagatgctcacaaaacctgatataactagcacatggaaagcaatggaagctctctatgactctggaaaagctcgagcaatcggtgtaagcaatttctcgtcgaagaagcttacagatcttcttaacgtggcacgtgtaaccccggctgttaaccaagttgaatgtcacccagtttggcagcaacaaggtcttcatgagttatgcaaatccaaaggagttcacttatctgtgagtatacttacaaattccaaaatttactctgtttttgcaagtatgaattaacgaagatgccttttcatctgttttggattgatgatagggttactctcctttgggttcccaaagtaagggagaagtcaggctaaaggttcttcaaaacccgattgttaccgaggttgctgagaaacttggaaagaccaccgcccaagtggctctccgttggggactccaaactggtcatagtgttctaccaaagagctcgagcggggctcggctcaaggagaatcttgatgtttttgactggtccataccggaagatctgtttaccaagttctctaacattccccaggcaagttctttcatctttctttttttttctcgatgaatcaaacgacaatttcggtttggtttcttgtcattattgatcttccctcctcttcaccatcttgttttcctcgaccccatcatgttgattatagatcgtcaaataatggattttaccaatccctataaatcttgcaggagaagttttgccgagctactgagtttgcgcatgagacacacggcttctataagaccattgaggaattgtgggacggtgaaatttgagataatgtccctcctttctacttgtttaaccataaaccattaaggacattgaaataaatatgttatctttttatatttaatctttctatgagaaaacactaaacacatgcttgggatttcatgatgtttggcaaatgttgttattctgcattcttcaaacaataaaatgttttcaactagttacaacttcaacatgacatagtcgatagaacctaagactatttccttagttcgcgtcgggaattttctacataccgcaaaaaaatacgtgtatgataaaaagtaaaattcaaaccttatttcaagactagggaattgccttcttctttttgattctataacctacttactgaatccaaggatcttgatcaaattagttatttctcatgaaaacttacattaacatttccttaaataaataaaaacttacattaacaatttaaaacatccattgtgaagggccggaatgaagcattatagtaagtgttcccaattattctccaattttttctcttcaaaatgaattactacaagctctcaaccgtcgattctgcatttcgctcggcgcaatatatatgcgttcacccaaaaacgtgttacttggacgttcacactcgagataatctaaatgaactcatatacactcgagatgttatataaactcatctacaattttgttgttgttgtaaaaccacataatttttcttatcacaaagatttttgaaaaaccaatcacaatgtataatattctactattgctacattatttatgaaatatataaaacttttttcataatatgaaatgaattataaatcatgtacgaattgtcttggttgtttgagagttctgtcttctgtgatacgtgtgaattgtggacacaaaaaagtgtcagtcacactcgagattagcaaagaggaaatctaaatgaacgaatttaactcagatacgtccaccgtccattggtccatgtaatgatcaatatctgacgtgacaatatactaactaagaaagtactagtattacagaaagaagaaatcaatttggccacgaatctcccgcctctgtcgctctctcacttcttctcaccctttaatagctagtgccgagtgcagtgtgcgttgaacaaccaccaccacatctgata

SEQ ID NO: 12206 - DNA, 3000 bp, Unknown
  misc_feature (1)..( 3000): cDNA_ID_1397750_gDNA_ID_2214537_Annot_ID_134398 3000 nt of promoter + ATG
attaatacagaggagaggaagatcgtcctcacaagtatttgcaaaaatgatacacaaatcaatgccaaaatgatgacgcagtgaaggtttagacagctcaagaatgatattgcacatcaatcactgattcaatgttttatttttgtcttcttcttttttttttttgttgaatgatactcattgtcaacataatatcataagccttttatcaaaataataataatacataatgtcctgcattttgtctttttgtgatgatttttgctcattatataaattgcaagtaactatgttttgcaaggttttttctgttcgtgacataaattgcgagtaaccatgttatgttattatatatgtacctatggtgcgaaggttagattttacatatggagataataagtattggatttggagataacataatgctacgactttatactgtgtatgttgggatttcataccaaacaaaaaaaatgaaaccaactagccaagaatatgtttacgttttgagttttacagagttcacattatagttgattttatttgtgcaaattatatttactctgcaaaataacatcttactctcctacttcaagaaactttgaagagaaagatatggaatgcaacgagttacacaaatctgttacaagatttctaattaagaacttacaaatctgctacttatcatcttttgaatacgtcttttggtggttaggttctaatttgtctaacagtatatgttttccaacaaaatttgatccttttgaaagcattactcttttttttttttttttttgtcaattttgaaaggattactcatattccttaaatcatgttactaaactcacataaatacgtattaagccaaagacgactcttgacgtgctctaaaatccaattcattctttatagattttaattcttggctctttatcctatttaatatttcgccgaaaaatctttgaaatgattatctgattgtatttttttataaaaaatttgtcataaccaaatttagaattatattttaaaatttaggaatgagtttagttaagaagttggtttgaaggtatagttttttctggaatttaaagtttaactttaaaatttattaacgatttagtattagattagtttattaatttgttgaaaaatctggtctattttgttacttttttcaaaaatatggtctattttcataaaaatccctaaaatatccgaatttatcggataaacccaaaccccctatcgggaaaacccaacacaccgtctctctctcactctcacttcccatcggcgaaaatggcgtcggtggcggcatcatcgtcgatatcattcgctgcatcattcctcaaaatcaaagcattccctctctcccctcgcttcttccccatccgtacactccgttgctctgtctcctcctcctcctctgagcccattgaattcgacatctccttcgctcctcccaaacccaaaccctcctccactcacggcggcgtcacccctcaacaactcttcatcccttggatcgtccgtagtgatgacggcactctcaaactccaatctcaacctcctgctcgtttaatccacaacctcgccatcgatgccactactcaaaaccctaagaagaaagataaatctaagaagaaacaacctcaagctacctcctcttcctccgccaccaccaccgcctcatctccagcttcacactcagaggtaaagccaaagctatccaaagcggcgcgtaggttttacaatgagaattttaaagaacaacctcaacgtttaagcaaagttctcgctgctgctggagtggcatcaagaagaacctctgaagaacttatttttgatggcaaggttactgttaatggtattctctgcaacactccacaggtaaaacaattctcattgtgggaatcaaattttgatgttttgatgataaagcttagcaattttgttaatgcagactcgagttgatccatcaagagacattatttatgttaatggaaatcgtattcctaagaaacttcctccaaaggtttattttgctctgaacaagcctaaagggttagccttcttcatagctttttctcatacctagcttcaggattactatcacagacttgtaacctttgtttgatatttcttgcatcatcctgatggcagatatatttgttcttccggagagaaagagatcaaatctgctattagtttgtttgacgagtacttgtcctcttgggtaagacattttgttttcctgtacataaaacgttgtcttttaaagtatgttagattagaaaacttggtttaagaatcttgtctttgcaatgtaggataaaaggaatccggggactcccaaacctcgcctttttactgttggtcgtcttgatgttgccacaacgggattgatagttgttacaaatgatggtaattgtattaattgaactccatgtgttatgttatatatcttggtttgtacattttggttcaaggaactatgtttctcttcccttcttctaaaaagaatttcaacttcttgctatgcaggagatttcgcacagaaactttcacatccttcatctagtttaccgaaagagtgagtttacatattccttttatataccgttatcactcatgattaggtgatcataattggtaggaagaacctttggttaagtaaggtaaaagaaataggctagttcgtgccaaatatttcttaatgaatacaattcagatagatgtttactgcagagttattttttgagctttggttgctggtagtagtcgccaattccagaaattgtggttttaggatcctctcagttttataaattcaagcagtgattctttccttgaagatttatgttccgtctaagtagttcaaaggttttgtatatttatactgctcttattatctttcttttttgaaattgcagatatattaccacggttgtcggtgatatacacaaacgacacttaatggctatcagtgaaggcaca

SEQ ID NO: 12207 - DNA, 3000 bp, Unknown
  misc_feature (1)..( 3000): cDNA_ID_2711640_gDNA_ID_2214537_Annot_ID_134402 3000 nt of promoter + ATG
aggaaaggaaaaaaggctggtgtcgtgcaaattagagtacgggcaaaaggatttaatagttgactttgcatttaatcatatgttcgaatagctagcacatgcctttctccacgtgatattagcttaaacagtgccgttaattaaaatattcgtcatagcatttacttgttgtcaacattcgataatattagctataaccagtgtttttacgcccgaccggttaacctgtgacccgaacacttttccggtttgggtttagtgctaaaacccaacaagttcaaaatcgaaaaaacccacaaaaactcgcaattaacccgtgacccggtgaaccggttgaaccggccgggtgtgggttttaaaaagttctcttgattttacaataaaatatgggattttagactttattcaattatttttaaaagttttttcagttcttaaattcatttgatattttagattttggtgaagactttacaataccgccttaaaattgaatcgaatggtgagagagacaaccgagattagttgtttgaattcacgatgttttattaatttatttctgtcattgatgatctcttaatatatttgttacggtgttagacatttagttggatttcaaatttttaaccactttattattattgtttgattttttctatatatttgggtataaataattttatattttattaaacataatataattttatatttgattaaatatgatatgattatttttgttttatatttataaatactaaattttttttatataaaatactctaaaatttctattaatattaaatttattaaataaattttaactaattaatccgtggtccaacccggttgacccgatgacccggtgacccagaatgtagtccggttcatcgtccgggtcgggtttcaaaacatgttgtttcgattttgtaggattggattcaattgtttataaggtagttccaagggaccaaacactaaatcaaatctttgatgttatatgatttgcctaaattacatgaagttatacatggagtaagtgattcgcctaaactactttacatatgatgttaaaattaaatgattcaagttggatgacaatatttagtcgaaacagtagttatcactggtattttctctgttccaagttatttgatgttttgagttttgttatttgtttgatgttttggaaaactatcattatttttttgtaaccaatagtgaaaggagagaagtaaaattaatattattaaattaagccaaatattaatcatcataaattcaaaggtgactaattaggtagactcctttctgtttttaccctcttgattttattttttatttttttgttaagagaggatgagctcaactttctaaagcatatattgtaaaaaaaaaaaatcatgatggaaagactcgaattcttattcttcaattcttatcttcaacttaaccactagctaatagatcacggtaaattaataaattgattgtttttttttttgggtcaaatgtaatttgattgttcatttttaacactttatgcattaaaaataaattactgataagagaaaccaaaacattactagtgcgcaatataaaacctgaatactactcaacatattcataaatttccaataaccacattatgatagtagtcaacatttctcaaattgctcgcctaagtgcgtttacccatactttcattgaaaaaatggtttgttcagtcatcagtgtatgtataaagtacagatatcaaacacgagtttgtgaataatgttggtgcgttccgaatttaccgtgaaacgaacgcaccaaacgtggtcatatatattgttgatagtcgaattaaaaacttatttaacgtcaagtctccgattatgtgcttaattaaggttacgatctgtacattaaacgccaacgagaaactacgtaatagcatgtgagcattgaattaagaattaaacaaaatcaagtgtttaaagataataatataagaaaatcacacacaggatcacacaagatttagggcaagcttaaagagagaacaatgtttggaagggagagaacatcggcttgtgttaagtgggtcaagtagatactgtcttctctgtcttttactccaactcatattcatacatgatacatgcataaaattatttataatacatttatacaaaccacttgtcttttttttttttgatatgtaattgagttacaggttgttcttacatatttttgatttaatatatatatatcaataagacaaataaaattctcgattattaggaaataatataatgaacatttgatttaatttcacacataggtgggttgtgtccggtcgtcacgggacgagttagaagaatcgtaggttttgtaggctaaacatgccgcagattgcagactgtagaagtcattgtttcatacaaaattgcagaccagaccagaccgtgaaccttttgtatttgataataattgaagtacagatgttaaataatatattgtctatgctatatttaacttctataaagcgataaacaatgtaagacatatatatgtttatcaatataaaggtgataaaatatattattcggtttgatatgtttgtgaatgtccaacatatatcataatcatactattaatcaaagcgtatacgttttatgatttggtttagttggaatggttagggtttactatggtttggttacatattactcttttaattgttttgtttggtttagaaattgggccgataggcccgatactgccatattcttactgctttgacccatttatatatgagtgtcaaaattttcaaccttatcgcgacgactctttgaagcttccgttgctgacgtggatcactcctctccgccacaaaaacaaaacagaaaaacaaactcagacatgagcaagagctagccgtcactctcactctctgatgtctcacgaattccgatttcaattctaacttaaaccatatttctccgatcaaac

SEQ ID NO: 12208 - DNA, 3000 bp, Unknown
  misc_feature (1)..( 3000): cDNA_ID_2711636_gDNA_ID_2214537_Annot_ID_134403 3000 nt of promoter + ATG
tatataaagagtcaaccataattatttttatttccctaagcaatgtaaacgatatttcatgtcatgaatgaaatccataaataaaataatttgctgtaaatatttacatcaatatcatgcatagttttaagatattcaaaaaaatcatagagaattttggaatattaaaactgatatgatacataaatgaatttcataaaatacaaaccgtcaaaaacaaacatatatcgtgtacatttagttttcattttttatggacacaacgtacataattgcagatgatttttaattaaaatttatgaggagaaaatgctaaccttgtatatattttcctgtttccgtatactaattgacttgaaatgtaataacttccgtgttctgttttttgatttttttcttagttaggctatgaaagctcttaaattgttacctttttttgttcaataaagctcttaaatagttacctaaaattagaaacaatacgtaaatttctatgttttttcttcaaagtaacttaagtggcggtcaaccaagaaaaaacatcataaattttattgtccatccaacttggagaaatattaaactgttaatctatttaattaaagattaaatatgaatttaattaaaatttaatctgaattgaatacaactcattattaagatttgttcaacttgcagaaaaaacaagggaacaacacgttttcagggatgactttcaaaattttatattggataacgatgtggcaaagaatacaaaattcaaagaaggaaaccatatgagatcggttaagattgaaaaattggagctatgggtcaaaacaaagatggacacatggatgattttacaccacaaccttaccaataaagagtcaacgcttaggaagtttagatcagtacatatcatagaatggcaatgtcaatatgatttgagttgactctaaccttctttttttttaaatgacaaattatttaattatttcaacttcctgatgaaacggttgaaatattattttatcaatttgagtgaaaatgtggaaatccactattctatcgaagttccaactctaacttggtggaaataagttgtataggataaaaccataatataatgggcattgtattaataccaaaactgatcccattccaaaagaaaaaatggaattttacggtggtattggctatattgatactttacttggagaaaaaaaaaaattgattgaaaatatgactaatattattagtcggacagtcatatcaaaatggagttgaaaaacaaaaatggctaatttggtaaatgctccatcgagattggaagtaagaaagaacatcttttcatgatttttaaattgtaaataccgttagtgagtgttttctttgtttagtcaccttgtgttacaagtcctttctataagccactgatcgttttgtataaataatcaagaaatgcaaggcagacccataattattttaataaacaattatcatagtcaacccaaagtacttccaattccagctatggttaagtttgacttcacgataagtttcacctcacgcttaaatatatatttccatctatcttttctttttgttaaaggataccttcattatgggttaaaaaagtgtaactgtcaatctgtaaattttttattggatacaaagaaaatttatattaacgacaacaggtatgtttaacacatgagacgataatcaattccaaatttccggtaacggcaactatgtcctaagccacaccttgattgagtccatttaccacaatttgattttttttttttttttttggtttgatatttagtaatatcaattcacaataatatttatgaaaatatcttaacatacttgttatcaatgctgatccaacgtcttaaccaacatacctaactgataactagttccagatgaatagtcgtccaacccatagcacacgatattacatgtacaacacatgattcaaaataaatcatactggattttgcgaaatgtttaccacgtatagctagaattttccaaaagtttttaaaaaatttgtactttggagatttaaatcctgatatggcatagaaacatgaattctttttaggccaccaccaaaccaaaatcgttttaagtttttatgtaccgttttcgtcagaaattaactcactgagtaacatgttggctctataattgtttagttaaaacaagaactgatgagaatggaatatcaatcattaaatgaccgcttcaattttacctcggtttatcgcttggccactattttatttccgaaacccaaaagtagataaactagtttcttttgcatggaaattttttccaccttactttggttagagattcttttacttcgtttttctttaaagaagattttacataatctcattcaataaatttatgatatattaaaaagtatctttttcagttcaacatcgcagacattcataataactgccaaaacccatttctttgatcgtaccgtaaaatgtgaatgcgaggcatgaataaatttcggtcttttaaaaataaaaataaaataaaaaatttcagtcttcatcagaacgaccgaacactacatttagtttttaaaattgaaaaaatcgttttaaggtatgcatgacccataagaagtggtagctaagttcacacggcattaccagtctcctcatgccacttcatctcaagtcgttatctttgaattagtcaaagtcttcgtttcccttattttttaataaataattgcggctttcacttgtttgactttctttttattctctttacaaagaaataacaacaactcatgtataggcatcttgtttttaattgaattatgtatatatagagacataacaggaacaaagtccatatcactttctttctccttttccccttatcgataaacttgcgaaaccctaaaagctaagaaacttaagagtttaaagtttaacaaaaacaacttaaaaagagttttgagcagtgaaattaatg

SEQ ID NO: 12209 - DNA, 3000 bp, Unknown
  misc_feature (1)..( 3000): cDNA_ID_2711632_gDNA_ID_2214537_Annot_ID_134404 3000 nt of promoter + ATG
catatcttcatttatttattttcattaaaatcaaaataacttaataaatacattattatatagggttgactattaagataaacctaaaagtacttgaaatgtataactttgttttacaatttcttttaaaaccatatattaaatttatggatccaattatttacttgatattttacaagttaaaaattttttattaaattttgaaaagattttattttgaattttaaggtatttgagtggtttaagaaaaaataaaattgggatgctaaattaggctaattaaattgaacctaatggactggaataaccaagaatttcaaactgcatccgaatttgaattaaaaacttttaattttattttacaaattaaagcgatagataatcaaaaatataagttcattcaattacaaaccataaaaaatactatttatagaagattctgttttatataagtagcaacaatttttctaaatcgaaaacccaaaaacctccaaagttgaccgtttagaaagagaagatcccgatattagacgcagatttaccgtacagcaatacttattaagatttggtttttagctcttttttgtcaacctacatattaagattaaatgcaccgcaatttaatgtcttgattctgtgattcttcttcttttcgtcttaatattctttcgccgaaaaagaaaacatattcttgagctatgtcatggaaactaatatttgttccaaaagaaaaaaaaaacaatagtcaaaataagatgttgaaaaagaagagtcaaattaagagaaacataatattggagaatctttttgatgattcatgtcacgcgttgatctagacatcaattgaactaacgctgatatcaattcccaactactaaagattttaaaatttgggacgatgttattatcatgaaaaatattaattcttataaaatttgactgtttatttgcgtttgaaaattataagttaaatagtacttttctattcagagacaaaaaaaataagtttctgtcaaacgttatctgaaatgtaaataaatatatacattttttgtactgtttgtaacatggaaatgatatgtgattacgaaaataaaaactatcatgtttttatatgtaggtatactacttaaacgttttttaaaaaacaaatatttcgaggaccctatttaaacgtatttgagattggaaaaaataaacaattagaatgtgagaacatatttcattaaaaatagagtcctcgaaaactcttctttttttacagcacctcgaaaactcattttccataacttaatttgcattgaatatagttcgaacttctacacctaattttgtgttgcctatgccttttctgttaacgatcactctacttccatttactatgtttattgatacaaaaggtacactaattttgcaagatgaatgtttgtccaacataattgaacacttgttaggtgcattatttattatttaaaaattttcataaataattcaacaatgtgtaggttaaaactggaaatccgctcatcaatcggtgttcacatctgtctgtacacctagatattctatagaacattattgatcatgtaactgtatttacacgtggttaattactgaatttgctggtgacatcattctcgtattgtttgtagcttaagatacaaggaatcagacgtcagggttttcttcgaaaccactttcataatttaatcgtttttgaaacagaaatgagttatttacagtaagtaaattttactgtttgattagaaaaatgaataaaaaaataaccattcgaatataatttgaaaaagaaaattgaatatgccgcataaaagaatctcatacctgaccagaattttcaatacgaaaatctaggttatagatctcgttctcggtaatgcttgcttcttcgtctcaccacctaggtttttttctatctggcctctaacaccacggggcaaccacaccgttagccaacaaagaaacttatcatagtcttgtttggaccttgactgatagatcatagatccaaattctctcataatatgcatacgacgagtcgacgacatataattcaatcacattagaggggtgaatttatcccaaccatgttatattcttccactattttacactagttttactatgcaagattttttaattaataattgtaaatttcttagaaatatacatttgtttctttttggtcgggaagtatacatttgttttgaatactgttaaagtttatattttttggtcaaccctctaaaaatttctaaagcattccaatagtaaggatatttaaatggctgatcacttattaaaatttaatataattcatttgtcgtttttaaagacatatttctaacaatccaattgtttccaaaaatgaaattaataattatctataattaagaatgtttattataattgtttctttgagaaaaatcatagagatgacatcatggatatacttacgtatatgtctagatacatacgtatatatgtccatttacatacacattcacactacggattccttctaagttctagcttagtccactcacccacttaatatgggctgtctttatgaatatatatcttatcttattttttgaagaactatctatattctatactagctagctaccataaatgtaatagtcaaaatcttttcaaatttttctacttcttgtttctatgaaaaataggaaaaattgaaaatcatccattcttgggttgaatttcttgacatttttcttttaatatatggacaaatcaatataatattttggtactattatataatataggatgaaggatagcttccaatgccaaccttcctctccttatcactctccaagtcaatgtcaacggtcttcgccctctaactcctctctcttctctcacacacacttcgtggctaatatattccaccaagaacacaaccaaagagcatccctctcgacacacacacttctctcctaaaacccaaaaatg

SEQ ID NO: 12210 - DNA, 3000 bp, Unknown
  misc_feature (1)..( 3000): cDNA_ID_2708550_gDNA_ID_2214537_Annot_ID_134405 3000 nt of promoter + ATG
gagaaaagtgtctattctccctatttctaaaaaaactacctactttgcaaattatttgtgaaaaaagtgtctagtttccaacttatctctaaaagatttgatagcctatagtggctttagttcctccttgtcattcccagctgtgtatatatattaacccatggatgggtgattaaatggtgatatagtttacgactaaactagaagacaacagaaaaagatgcagatttggagttggcgacaaacatagataactaaatggttataaaagaaaaagagagaagaaaatcgaataaggccaataatatataaagtggggatgggaataaacatttttatatttgtcttctattcccttcttgtccgtatcaaattatcaatcttcaaacacaataagtatatgttattgttaaaacaagtaacgagcaacataaaattagatatttgtaactttttgtacaacataaaatttggattatcctttactcgttttactttttttgtatgcttatccgtttatcgtttttttctaaattacttgtatagttatttttactatcttaccaatgtaacaagaaaaaagttatactacatgcagagactaaacaaaagaaatttaaaaattaggtatatataccacgagtgagagtaccccttccttatctcataccacgagtcccattcgatatatgatctcacgtaatgaaacgggacaaataacatgcaagtagacaatttgttaacgtgtatataaaatctcgaaatagccgttttgaacaagttaaatacggatagacaaaatttattactcaactaagttaagtaacaaacccaaaatcacgggcaaagtaaaccacactcttatattatgcttaaaataaagaagatcccatatttgtttggcaaatagatcatcaatgtagtcgaagggctccacgcgcagcgacaaaaacggaacaagaaagaagaaaaaatcaaaagattcaaaaacctttcttcatctttattaacatcaactattcagatttgtgtaagacaaaagaaagaagcgaagattacggggaccaacagtgacgtggacctctccccgtcggtgcccataccaccaactttactactccagtactggtcacttgcttgttcgaattaaccaaatccaattattcgtaactatgtttcagattgttggctaactgatgatcaatcctacaataatacttaaaacgtttattagtatattgtttggaagatggtataacaattcattggttactgatgcttgttgccaaaaaaaaaaaaaggaaaaagaaatgattaaacgcttgcatctgtttgatttggactccatagattcctttatatagtcaactataatcaatacacgtgaatcatttcgtcatttgattactgttgagacaagagtcaattaccaccaaacatattattttaaaacattaaagttccgataacttcgggtgatggccgcaaatttgagttttggtttgatattgtatatggtattatggtttgagttaacattattattattgtatcatcaattcatcatccgaatttagacctacataataaatgcaagatgttatatacaagaaattccaactgccacaatatagaaaaagagcagcaaattttatttttttctcattggctttcataaatgttacttaataagacacaagacgttgggaaggactgaatgactttactgatatgttttcatgctaccaaatttcgtttttcatcattctaccatatcaatttcgaagtagaggaataatgtcgtgcacaaccaagtctcggtcccagctaccattttcttcaatgaacaccgcaacacgtaaacgcaagtgataccgcaacctagctaatgaagttttggttaacatgaactcgcactatatgacttccaaatcttttgtcttcaactcttttttaccaaagattcaaaaccgtaggctcttactctataaagctagaccttgtcatttttaatgatattacacagaacaaaaaaaaaaatataaatccaaacctaaaatcacaacccaactccgaagataataaacggcattgaaaatcacacaacaaccttaaaggctataatcgtcactgaatgttacataccgactctgaatataacataacttataggatactaaaattatgtcaattcagatgtaaagttgtatcaatttattgaaaatactagctactatatgaaaaagtttagaaatgtattggggaattaagttttccgaaagagagtgtttaactaatattgcctcaactcgttttatgaattttcaaattttagtcatgtggatatggaaatggaatagaactgaaatacattcttctaatcaatcataatccatacaaatctgtatttttactcatttgtatttaaatgtaacaaccacatacataatcccaccttaagtacatgattaaggaatgacttttcagcaaaacacacctcaaaattctcaaattcttgtcagttcaataaaacaatttccttgaattattgtcagacacttaaaagatttgtatgcatgtaactgctggtcccgtattaatatttattgcttcattccttattactaagcaacaaaagtcacgcgtgagatataaaagaagatcctttgcagtttctctgttcttgctccttcttcttcatctccctttattgatactgtctgagtaataataaaaattcactctttttgtcttctcaagacagatttcaaaatagaaatcattctccttttttctttttgaaaatttcgagtgatttaaggagggaaaataaagacagaaacaagaacaaaagcatcgtttgcgaataagacttctcgtactctgttttcttttctcgtgttcttatgacagatttataaaaaagattaggtttttgtcttgtcttggcgataatgcctagagagtgttttaaagatttgatttaaatactcttttatg

SEQ ID NO: 12211 - DNA, 3000 bp, Unknown
  misc_feature (1)..( 3000): cDNA_ID_2711628_gDNA_ID_2214537_Annot_ID_134407 3000 nt of promoter + ATG
cgacaacttgtctttgattacatttggaatccttaaacgaaacgtcgaaatccttcctcctccccctcctcctcctcctcctcctcctccttcggaaaatgaactctccggccccggaaatgagtggttggatctttcgtcgatgcaaagaaataaacaagaaacgttggtgatgaagaaaaaaagtcgacgtggcccaagatcaagaagctctcattatcgtggcgttaccttttaccgtcgaaccggccgttgggaatctcatatttggtattcattcataaactttaagttataaaatatattttaattagttttgagattaacacttggttttgggatttatgtgtagggactgtggaaaacaagtttatttgggtaattagatgagattttctatttctcttactattatattaaggtttaaaaccttcttggataagagaattctgaaaagagtaaaccaaatgatgaaagattttcactttttcagttttgtcttttgtttggttaaaaacaggtggtttcgacacagcctacacagccgcaaggtgtaagaaatagtaacagatgttacatgacataacattcgtcctttcaaaaattcttcattttttcttttttggacattttagtttatatctttagagaaatattagttgacttatatattcaaatacatatcagagcgtacgaccgagctgctatcagattccggggactccaagcagatatcaactttatcgtggatgattacaaacaagacattgaaaaggttttttttttcatataacttattgcttcctataaagagacagagaagttggacgttcgaatactataatatggatattttgaatgatgtggtagatgaagaatttaagcaaagaagagtttgtgcaatctcttagacgagcgagtgcaagcttagcaagaggaggttctaaatacaaaaacacccatatgagaaatgatcacatccatctcttccaaaacaggttcgattcgttactcttctcgcgggtacaatttcattcactattaaccgtgaccagttgattcctatcgcgtatatgattcacacatataatgcatacgatttgtaaaagtgtttgtatgaatactcataggggattgaatgcagcagcagcaaaatgcaatgagataagaaagatggaaggggatattaagttgggtgcccatagtaaaggtactttataaatgtagggtcacggctgtaaatatacatactaaatcattgttatcatttaggtgaaagctaaaaaccctaaccacaacttcactttgacacatgttgcacacctttgatttgatcaaccaaaccctagctagctagccttacctttcagaatcattctcgttcaaaattcaatgcatattagtttatagattttaatcaattttttttttttttttgaaagatttaaactttaatgcacaacgacaacagtaacacaaaccactaaactatatcttattcaacttgatcaatattttaatttaagacattacgacatgatttacgaaaagcttttaacgttttcaggaaatgagcacaacgatctcgagctaagtcttgggatatcttcatcgtcaaaagttagaattttggaaccagcagattattacatgggtttgaatcgatcggtgacgagtttgcatgggaagccgttgccgggatatctaccgatcacagaaattaaaccgttaaagacagttgtagcatcatcaggattccctttcattaccatgatcaatccttcttctttgtccttatcttgttttgatccatgaggtgatcactatttacttttaaaattttcccctttttattgataatctattgaatgacggaatgattatgtgacttatatctttttataaaccatattcttgtggaatcaggaattttgtgccaataaaaaaagacaaagaaccatcatgtactatgttgtcaacgatgataattcccaagtgtgtgaaagttatagtgtaagtactagtgagtactcgtgaggttagtaacataagacacgtgcataattgcaaacaaacaactttgccgaaaatttgtacaatggttaagaaaagaaaagagagtattgaatgatcaaagaaaaggagatgaatgggacacgtcgtcgtttgtaattaaagtacaatgtcgtattgggtcgtataatatccgcttgcttcaccacattcacttatttcttatccccacttttccaacttttcgaccctttttttttgggatttcaataaataaactaacaaaacagaagatagagaaaatttactatccttacattgcaattttatacctaaataacccaaaacagtggaagagacgaaaaaaaaaggtgtgaaatcttgtggtgttgccatttgccaatgcttttgcttcgatgtgccacactcaatccaagcgagcaagggtaataagacctaaagtggcctcgacctttgttttcttgggccttagccgtaggcccaaacttctctcgagtcgttcatggagatccatcagggacacgtgccattagtctgtttagttataaatttttatgtatagtttgcatttaggttagtttggaattagattaatggtataattaatttatgttatatataatgttaatttttgagggcctcgcgggatccattcgaacttcctctgccgacaaaaaagaaaagaagaagacgacgtttatatgtgtatctccccagctaagtggaatcagagcgtgtaaaaattattcatcggtgcgagttctctctaacctttgtttgtttgttcatggtgggctctggtttcctcttttagaagaaaattgttagggcgagaagaaaaaaattgaatatagaatgaatatctctttttaagggtttatggttttgctgctctaaccttggattttagtgtattgtttttgttcttcagtagttgaaatttcgaagcactagcataagagaatg

SEQ ID NO: 12212 - DNA, 3000 bp, Unknown
  misc_feature (1)..( 3000): cDNA_ID_2711624_gDNA_ID_2214537_Annot_ID_134408 3000 nt of promoter + ATG
tcctttattaaattataaatggtcctctttgtgtggtttagcataaaaattataatcataagtctcttctcgtgtttaccaaaaaaaatgtctcttctcgtgttactttcttttatacattcctcatgatatacagatttaggatcattgctttacgattaattctcactccttcttttccactgaattgctgttgtatatacttttatgatgttagcaagaggtgctggatccaccagaagattttttccgtgtcaggatggttatcattcttctggaaacctgtgggcactactttgatcgaggttcttcaaagaaaaggcttgatcaatttttaatacacttccagagatacatcctgagcaagggccaccttccactggatattgaatttgacttgcaggttagtcttgtgttttattatagtggacatgagattggatttttttagtagaaattatccaattttcacttaagggttcagtgtatctgtaacaaataatgtgtcttaacttcttctcaacgcaggatctatttgccaatttgagacctaatatgactcgttactcaaccattgatgaggtcaatgccgctatacttcagctggaagagcgtgaacatgcttcttcaggagacaaagtcagtatagaaagacactcagatacaaagccttcaaacaagtcgtcttctgatgttatctcttctaacgggaaaagtactgccaaagatattagagagaatggagaagctcacggagaagaaagcgacagcgattctggtagtggctccgtggttcgtgatggacagaacgaagagttggatgatggaaatcatgagcggggatctgagagtggtgatggggatgattatgatgatggcgatggacctggatctgatgatgataaatttcgtgtaaggcaaaaggtggtaaccgtagatcttgaggaacaagcggacttcgatcaagaactgaaggccttacttcaggcaagttcagaatccgtctttttttgtttatgtagattgatgcatctattttctctaatttagtttggtggaaaaaccagtttacactgatgcaagagggaagttatttttcggaatttgaacatgattaagtactgatatgttttgtggatgcaggagagcatggagcaaaggaagctagaattacgaggtagaccggcattgaacatgacaataccgatgagtgtttttgaaggatctggaaaagatcatcatcattttgggcgggtagtaggtgaaaacggtgaagaagtgttggatgaagagaatggagagcaaagagaggttcaagtgaaggtcctagtgaagagaggaaacaaacaacaaacaaggcaaatgctaatcccgagtgattgtgctctagtgcagagcacaaaacagaaagaagctgcagaattggaagagaaacaagacataaagaggttagtactcgagtacaatgagagggatgaagaggaagcaaatgggttaggaacacagatattgaattggacttctggaggaagcagaggatccactcgaaccggggaaggcagtgggaagagtggtgggtctcgtcaccggttttattatcatcaaggaggtggtggttcgtatcatgcccgacgaaagtaacttcatccggtttagggggaaaatttgataatcttgcctgtgtcaaaagcggtaatagttggctttttgctacggctgaaaaggacaattcacaagaaatctcatgagtttctgtgacaaaagttgatgtattcgacttcacattctgtagtgttggttaagtaaatctctgtgtgtgaccctttttgtccagcttggttaaatcttgcatttaatgattatttagcatcattctcatgtgaaaaaaaaaaagaagaagaagaagaagaaattactaagtaaggaaagagaatgatgacgagaagaaaactttttaagatttggtcttaccatatacggaaaggccagatttagtgtgcagaggacggattaataaagattccttaacaaatctagtttttgtactttcatcaaatcatgagaaaatggacggttgagatatgcacacgaacttatcatccaacgtttctaaattattgatatctaggtgtccatataaacatgtacttggtgattgctgaattgtttatacaaacgaatgacataataagtcacactctctcttcattaaggtttctaattctacctctctctcccctccacatacaaaagtggtagttggctttattggaccgacgcttaggtccccaacacgttccatttcactccattattgtattcattgacatatctattcaaaaagagattttgtatggtttttattgtggtgcagaaaaattgatacccgatttggtctaccaaaataattttcctcataatgcattcatgttcgggtgtccccactcgtgatataaattcataattttctcaatctgtaagtaatattcgaaaagagtaatagtttatacaaattacattgtgatagtattattagactattagtaaagaatatacacacacatatatactattcatattcccgtatatcaaattttcagtagtcatatattcatacgaacgcgtacttactattcagactatatatacacgaatctccgaatatcttgaaaacgtataagaccgagctagtaatagatattggctaagatatattttgggtaagtcgttcttatattttttcgagatgttcggaaattggtttatacacatgtttaaatataggaaaaagaaaaaaaataacgcaatcaataaattaataaatagagatgtctgaaaagtagccaaaaactaataaatcagtgtgtagacaatcgcactgaacaacacgtcccacgttctttttcttccctgttttagatagactcttagagtctctctagagtcaccggaacaatcacaaaagcgacgacatattactcattcctacaaatactcatg

SEQ ID NO: 12213 - DNA, 3000 bp, Unknown
  misc_feature (1)..( 3000): cDNA_ID_2708536_gDNA_ID_2214537_Annot_ID_134409 3000 nt of promoter + ATG
ggacatgtatctcttttattgactatcttaagcatatatgcacgaggaggattactcgagcaaagaatgtagtacaagttgtttgattcaatcataaaatgcagagagagattaggctattgcagactgtttatcgtcttcaaggtgtaatgccctaaggagccttgcccatgactctgggattccaccgggcaattcaaattccaacagcttcccgcgtttcttgtagaattcctccactggttgagtctgtgaacgaggaaaaacatataaacattgttaattctacgagaatttgaatcatggaaaaagatcgaagaagtatttttaccattttgttgtaaatcctgagtctttccttgacaacttcttcagtgtcatcagctcggcttataagcttcgattcacagtttggcggaggaagaagaggaggcatatacattctgggagtatcatcatcacctttgatatcaatgcaggcaacgttatagtttccaccacactcgctgcaaattcttcttcctaaacatttcgcaagcaatgcctcttctcgtagcttcaggttaatcaccagatcgatattagttactccctccagtatttcctagaagacaaaaaaagaaacagagctgtcaaacgaaagagtcctccattagcctgaaatctacacaagcaataaattgctcaccgcttgagtcacggtgcgtggaaaaccatcaagaatgtatccagattcacccttgtctttgccagcttggagacgctttgataacaaacttattatgaattcatcaggaactagttttccatggttaacaagctccttgagctacacccaaagcagcaaacgattaacaagcataaataggcgctcaatgattcaacctctgttctagttatagacaagagatacaaccccaaattcgctatccatcattggattctatttataccaaaaagaattctcatttcaaaggaaaaatctgatcatgttggtgacattagtgacctagcaaacaaaatgcaacatttacatcaaaaaaagtttcactgagaccaattttagaagcagactcaattttaagatgattgaacacacaattaaaaatctcaaaattgatctctatgtcttcttcactgagcatcgtgatttcaacaatcaacagctacagaaaatgaatcgagaattgagaattgtaacctgagaggagaggaggccagaggaggagagctcttcacgaacgagatcaccagtggcaatatgaggaacgccgaggagagaagagagacgagaggcataggttcctttaccaacaccaggacatccaagaaacacccagtggaaatttctgcctttgtatggagacgttgacgtagacgaagacttcccgagctgagccgcagcctcctccagatcgattttggggtctagcgaggacccagacgaagaagaagagagagacctaataaagagagaagaaaaagtattctttatcgtcgtcgtcgccggcctgaggagacggtgagaaaccgccatggagagaagaacacggtgaagaagaagaaataatgattgttttagtaggctcgtgaggaacacgtgtcatgtcttttatgtcactgtccctctctttgcttccatggctttacctattcagacataggttcctttaccaacacgatgggtttttttttcggttccggtttggtaattattttggtaactgcttagtcctgccgggtaaaacccgttggtattgggtctttttgacccgtttgggctttttccctcaattctctttttgtgttaattgaaaaattccttggccgggttctatcatctctttctccgggaacacactaaacctaagtccgatcgaaaaagcgatcacttgactcgaaatcacacgactttatctccctgaaccctaatggatcatccagaagatgaatcccacagcgagaaacaagacgacgaggtttgatttcgagattacggatttgtcttactcgatgaaattgaaactatgatctcattcttcaattcgaaaattgttttctctggttatcgcaggaagctcttgctcgtcttgaagagattaagaagtcaattgaagctaaactgactcttcgtcaaaacaatctcaatcctgaacgacctggttagtttttgttttcatggaattgagtatgtaggatttccacaatgcttctgttagtaatcgagtacctataatagccattcaggacttgagagcacacgattttacaataattcttttctagtttagaatgtgtagttttgagttgttactgatagtgagtccttccacgttacagattcagcatatcttaggactctagattctagtatcaagcggaatacagcagttattaagaagttaaagcagatcaatgaagagcagcgagaagggttgatggatgatctgcgaggtgttaaccttagcaaattcgttagtgaagctgttactgccatttgtgaggctaagctcaaaagctcagatatacaagcagctgttcaggttatgtttccctgttttgttcttttgtatctgtatttacaccttgtttcttatgttttttcatgcgactctcgtcatcaacttgtcacattgagattttcagtagttgttatctttatatttagatagtttcttaatgctttccaccacttggtatggcaaatcctctaccacagtttaggtttctgttgaacgatatcttttcctcttagtttagatgatatttgggtctcttttctgtttgtatttcttatggggcatagaaagtagcatacgacaatactctctgttcagaatttgtttctatgctgatatccatgtattttgacagatttgctcgctacttcatcagaggtataaagaattttctgccagtctaacacaagggctcttgaaagtcttctttcctggaaaatctgccgaagatttagaagctgataaaaactcaaaggccatg

SEQ ID NO: 12214 - DNA, 3000 bp, Unknown
  misc_feature (1)..( 3000): cDNA_ID_2708558_gDNA_ID_2214537_Annot_ID_134410 3000 nt of promoter + ATG
aaacaatgcatctgacataagcaattgaaaactaaaagaaaaaagttgacgcaatacagaactagatagtcaagactcttctaggaaaattaaatgctttctgaatgccacttgcaaactacacattttcccatatctttgtttgttatgaacataaatagaagctgacctcagatcaggcaagcactcgtaaaatgtcttggtgtcttcgtcgtcccaaataggttccgggacagatgtatcttttacagtaccagagggtgaagcttcgtcccctgctgtgagcctagttgtaccatcctctggcataacaggaggttgcatatcaagtgcttcggccaaactgcaacaggacacaaaaattgcataattaatgaattagatgagaatattgttactgtagatattcctgtgccagatatccattccagccaaagatgtgggaagaaaggagaaacgccatatatctaaaatcacttccaaacttcagttcataaatattatagggttccagtgaatcggtaaacacatgtcacaatcatcataaaactattgcaaatgaactgatgcatgaccaagatctaagcaatgaaactatatgtataaactacaatgacagcaacttcaggaacatattaagaaagaattgagagctcaataatagtatgtgttataggtattttagttaatggccagtgagaagaaagctacgacgctaccaatatcctcattgatgaaacgtttcctttgtgcaattaactccacaacagctagacccaacaagaacaggaaaacctatgttgagttataggaatggtcaacttacgatgagatatttcgatagagatggtcgtatgatttcctcagcttttcataagaagatgcactgtcttcactaagctctcctttagcatttaccagctttgcattttctttctccatttggagaagtaactgtagaaaaaaactattacgaagatactacagaaagggaaaactagcaaaatgaaaagaaaagaaaagggagaggaaatgtttcatttttcaggcaagaaaaatcaaaattcctgcacataagctcatgggtaaacaattaaggatctaaccttgtgctcagactgaaggagatctgcaagagcatcataatatgtgttgaaagctttcttaaaactctttttctgatctgcagtgacgtcgagacccttgaaaaactagagaaaaccttagtcacatttagctacgtaccggaaaatatggggaaggcacagacaagagctcatcaaatatggaagtaaaacttcagttgatcttgaaacctacttacatcttcgtcttgtccagagataggaagccccagaaaaattcttccttgccgagcaaaactggtgagaagtgtcagatttgtttgggtcgtatctctgtctttcagttgttcaacactggtaagatccttaataatattgataaagatgttactatcttctattactccaacatagtagagctccagaagaagttttagggtactgcgctttttcatggcctttgagtttttatcagcttctaaatcttcggcagattttccaggaaagaagactttcaagagcccttgtgttagactggcagaaaattctttatacctctgatgaagtagcgagcaaatctgtcaaaatacatggatatcagcatagaaacaaattctgaacagagagtattgtcgtatgctactttctatgccccataagaaatacaaacagaaaagagacccaaatatcatctaaactaagaggaaaagatatcgttcaacagaaacctaaactgtggtagaggatttgccataccaagtggtggaaagcattaagaaactatctaaatataaagataacaactactgaaaatctcaatgtgacaagttgatgacgagagtcgcatgaaaaaacataagaaacaaggtgtaaatacagatacaaaagaacaaaacagggaaacataacctgaacagctgcttgtatatctgagcttttgagcttagcctcacaaatggcagtaacagcttcactaacgaatttgctaaggttaacacctcgcagatcatccatcaacccttctcgctgctcttcattgatctgctttaacttcttaataactgctgtattccgcttgatactagaatctagagtcctaagatatgctgaatctgtaacgtggaaggactcactatcagtaacaactcaaaactacacattctaaactagaaaagaattattgtaaaatcgtgtgctctcaagtcctgaatggctattataggtactcgattactaacagaagcattgtggaaatcctacatactcaattccatgaaaacaaaaactaaccaggtcgttcaggattgagattgttttgacgaagagtcagtttagcttcaattgacttcttaatctcttcaagacgagcaagagcttcctgcgataaccagagaaaacaattttcgaattgaagaatgagatcatagtttcaatttcatcgagtaagacaaatccgtaatctcgaaatcaaacctcgtcgtcttgtttctcgctgtgggattcatcttctggatgatccattagggttcagggagataaagtcgtgtgatttcgagtcaagtgatcgctttttcgatcggacttaggtttagtgtgttcccggagaaagagatgatagaacccggccaaggaatttttcaattaacacaaaaagagaattgagggaaaaagcccaaacgggtcaaaaagacccaataccaacgggttttacccggcaggactaagcagttaccaaaataattaccaaaccggaaccgaaaaaaaaacccatcgtgttggtaaaggaacctatgtctgaataggtaaagccatggaagcaaagagagggacagtgacataaaagacatgacacgtgttcctcacgagcctactaaaacaatcattatttcttcttcttcaccgtgttcttctctcc

SEQ ID NO: 12215 - DNA, 3000 bp, Unknown
  misc_feature (1)..( 3000): cDNA_ID_2708540_gDNA_ID_2214537_Annot_ID_134412 3000 nt of promoter + ATG
gaaaaaactaacccaatttaggaaatctctctcgaagtaactcctccagaactcgttggtcaacctggggaaagtaaaatgttttatgatgagattactagtcggccataaaggataggaaaatactgtaacaaaaagattactattttacctgggactcgagcatctcttctgaataataatcatggaagtagtcatcaatgattcctgtaagcgaccttaaaatccgaagtaatatttagttaacttacatgtttgttaagaagagatttgaggaatgggctaacagtagttaatattcaaccaaaagaaaaggaagtcatagatacacgaacttcacacagaaccaaagagttggattttcattgacaaacaataatacaatattaggagttagagagtagtttccgaacataccaaaaagcattctcttcgggcatcagaagtaataaaagtgcagcgaagaaattcattgcctgcacatgatttattgatacaagataacaaataactgagatgttcatttttgtgagcatgtaaccatactaggatacagaagtgacagtattaaataaccgaatacctgacagtatccaacagagggattatgcctggcataagcagttagcaatcgcctcagagcatttctgaaatcatcatctagggcaggatgacctggaaatgtccggggtaaatcctgtaattgaaataagcaacagctgagaaaaatgaccaagatcaacaggagtccagtactgcaccattagttagaaaatgctggatgccaagtaatgtacagttgctaaccttttctatctgacctttccatttttccacaacagagagggggtctgtacttgaacctttctcatctgtatgctgcatgagctcctgctctatgtcgtttcctagactatctgcagctaatagattttggtaataattcttgacccgacgtttcttgactcccgcaaatgcttgccagagctgaatatttgtatatatattttcagattattgagcagaaaataaggataataagaactaactatcaatagcaggagaatgctagaaaagagaatgacaggatttattacctcacccctcagagccataggtgcaccgccatgaataagaacttcaagttcgtctttccaggggcatgcagatactagggaagctgcatcagcagcagcagacatgctggagacacttgtgccatctgaagaaccatcctgaattggatctgatctctccgcatcatagaactcgtcttcggaatcattctcacatactccctttgaagactcggtctcatcagttgaggctaaggaattcaatttctgagcttcttgctcgccatttgtggaatcccccttcattttgacacggacactcatcaagtcctcaattgcttgaagagatggcctgatctcagcccataactgaactttgtgcacattcttctctctattgggaacttcatcttcctctctcgcattcccaggagttaaatcagaacctggcttgtcagcattcagatcttttctttcagcacccttgtttaattccttttcttttttcttgtcactttcacttggattgacatgagtattttcagacgatccattcgtaggtgacacgccagattctgcatgaaattccaggaaattgctccaccttgccgacctctccacttcttcctcctgcagtttatcagtaaaaaacagcattagaatgttaaggtgaaacatcgagtgacagtgactgcgtcaaccatataagaaccaaaaaatgacttatgatatatgaagcctttcgatattgattaaaccaagaccactaagtaaacttctaagttaagtccacttctgaaatctttcacacagctgtaacaaagctactttaatggatcaccaaattttagacaaaccttccttttttcctaagaatgccagtgtgcactcaatcatgtaaaagaattttccgagtagaaaataaaagttatggagatagaaagaaccttgtagatattaacatattctcggtatctttgcacatgctgaggcctcacagaaaatccatatgcatccctgttcataaaaccaacctcattaacttccctaagtactaagaatatagatgaaatcaagatcaatgatcactagattctcaactagtgatctaaaaagacaacattttgctcagcaaatcgagagcagagagattaactgagaaaccgcaatttcaaaaaacaaattccatcaaatgtagtaaattagaaacaaaaacacaacgagataagcaatgtagcaatggagaagctcgaaaggcgataccttttgtggtcagacttagaaacggcgtcggcgatcataattccttagttggagaacgagatctctccgaatagaggcggtgatagttgaaagagatggctgagcgcagaagaagaagatccggtggagcaagaagcaatactactaattgaacatcattacaacacgcgactgaagttgaaaaaaaagatgaaaagttactacagtgtcggagagagagacgaagaaaaaggtccgagattgtagaggacgttattgcatcctttaattaatttatatacttatcatcaaatactcgaaacctttgtccttcttttgaaataaacttatactggaaattaataattttgggcctaaatcaactagagcccatttgtttcatgtttgattaaaagggatttatataccctattgagtccacgtcacaccgtcgtcgttaatcgtggattaatttgttttgggcctaactgaactataaatccacttgtttagtttttacggtaaagtcacttttgccctttagaatccaccaaagtcgccactgtctttcccaatttctttgaacttttcaggtacccttaaacttcatcttcttcgatttttaccatttttttcaatttgcaatcagaaatcgaagcgatccaaattagtaagctcgccc

SEQ ID NO: 12216 - DNA, 3000 bp, Unknown
  misc_feature (1)..( 3000): cDNA_ID_2711616_gDNA_ID_2214537_Annot_ID_134413 3000 nt of promoter + ATG
attatcctaaacctatcaatattaaatactataaattttattgaatatatgttactattacatacagtttgtaattcaatacccggacgaacacatcatagcagtggagggaagttaccaccaagtggctctcattgccacagaggtgattacgtccctcgtcttcaagacctcaaagggtagaaagtctccattgtttggtccaaacttacttggaattacgaccggtacaaagtttgtttttgaggatgagggaaagaagatcgtagggtttcatggacgggcaggtgatgctgtcgacgctcttggagtttactttgtattggataccacgccgttccctctttacaagcttgatgcccaaggtggtacagacgggcgtgtttgggatgatggttcttacgatggcattaaaacgctgcgtattgatcaagataattctcgtatcacttatttagaggttgagtacgagaaagacggggaagcaaaaacatgtaaccatggggggaaaggagatacaccatccgaggtaactttactagttcttcttatacacgactagttcaataatttctcaaaaatgttataaattgttaaactctatttatatgtgatcattagtacaacgacataaattaggttccaaatatcaatgattaattattgtgtttgtagattctttgcagtagtatgaagtataactctcacacactccggttcaaatttttgtagatataattgacacatgtatttagatctcttaagacaaaaagtcttcttattttgttgcttcttgttgcagtttgtgcttggttacccagatgaatacatcaaatcggtggaagcaacctatcagaagccaaacatttttagcaatacggcaattacgtcacttaagttcttaacatcaaaggggagaacatcattctttgggtataatgtgggtaagaagtttgtgttggagcaaaagggtcataggcttgtcgggttccatggaaaggaagatgcagctattgatgctcttggagcatattttggacctgttcctactcctactcccttgattccatctaagaaactaccagcgataggcggcaacgaaggagttacatgggatgatggtgtctacgacggtgtaaggaagatacttgtaggacaaggtaacgatggtgtatcctttgtcaaatttgagtacagtaagggcaaagaccttgtacccggagatgaccatgggaagaagacattactcggagctgaagaggtcatttaaaaacaacaatttttttttttttttttcaattcattctagattatttacacttatcctttgttggttttgaatctttgcagtttgtgcttgaagatggtgaatatctcatgaacatagatggctactacgataagatcttcggagttgaggaaccaataattgtatgtcttcagtttaagaccaacaaaagggagtcaatgccgtttggaatggattctggtaagaagttctcgcttggagaggaaggccacaagatcgttggattccatggacaagctagtgatgttgttcacagcatcggagtcactatcgtgcccatcaccaccaccgagtgaaaaccagttagtcatatatactacatgaaacttccaataagattggagtgtgtgtgtgtgtgtgttctctttactatgttacttttaatacgtggttgtaagttcaagtaacttactgtgtgctaataattccaataagattggcttgtgatttcttgttatttactgccaaaaaattaatctggttctaaaaatctacatgcctattaatttcaataaatcccctaatcaattctagttattttattagttagcataaatagaaaaaaaataccacattattattacaaatcactaagatttattagtccacattatattttactgataattatcaaagcatggtactatttaaaacctcaaacaagttagcaattaaaaatctcacagagactgattatcttatttgttttaattaagagaaaggcaaaaacaaaattgagtaatgcttgcttaccaaaatatacagctaaaaaagacaattttaggcccacaataaaaaacaatcaaaaaggcccgctccttcaaaaagatttaaaaagtgaacggactcaatttcccatattacccttcattgctactcgaatttacggagaaaccctgtttctctgtccttacgcctttctctctccgttacactgccgccgtaacgctttcttccttcttgtaaaaaaagtctctccgtttaactaaacgccgtaaaaaaactcagctttgataatatcggttttgatttttgattgagtttccctccatatctcctcgatttccgattttgaggaatcaatctctctgtttatacggtaaacttcataactccatcgattttttggtttctctattttgaatttcaaacaaaaaaactgttactgatccatatttgtatttgattgatcgtaaatcctctgaaaattttcttctttgttttcttcgccactgagagactcaggttcgatgctctgcttcgttttttaaggtttttttagtggaaaggtttaaagggtagttatgtctttttgacttgtgttacgactcacttcgatgtttatggatctgtcagaaaagctctgacattttcttcattttgatcgtaatttgtggcgatcttgatcttgttttctatttttaaaccattatatctaaatcttcaaagctaaaaataaagatgctcttgaattattctcatcgagcaagtgtttaagtaagacttcactttagaacactctctgctctgttaaacctttgtgtttcatgattactgtctctaatcaatgtccctttctatgcgctgttttgccttttgttttttgaacaaagaagaaacctttttcttattttgcttctttataattttgattccagctgcacaactctagtgaacctttgttaccaatg

SEQ ID NO: 12217 - DNA, 3000 bp, Unknown; identical to SEQ ID NO: 12216
  misc_feature (1)..( 3000): cDNA_ID_3024252_gDNA_ID_2214537_Annot_ID_185138 3000 nt of promoter + ATG

SEQ ID NO: 12218 - DNA, 3000 bp, Unknown; identical to SEQ ID NO: 12215
  misc_feature (1)..( 3000): cDNA_ID_2708540_gDNA_ID_2214537_Annot_ID_185137 3000 nt of promoter + ATG

SEQ ID NO: 12219 - DNA, 3000 bp, Unknown; identical to SEQ ID NO: 12214
  misc_feature (1)..( 3000): cDNA_ID_2708558_gDNA_ID_2214537_Annot_ID_185135 3000 nt of promoter + ATG

SEQ ID NO: 12220 - DNA, 3000 bp, Unknown
  misc_feature (1)..( 3000): cDNA_ID_3024260_gDNA_ID_2214537_Annot_ID_185134 3000 nt of promoter + ATG
tgcttcaggttagaaagtttgcattgactaatgactacaactattgatgaaagtgtgttgcctatctgtttaacctctattttgtgtgtgtggtcaactaagtgtctaatttatcgactgacttatctacttgctatagaaatagttatgcctattgattccttcctagaaatttggagcttactggttcttctttagtatgataccttgtggcatgtttatattatgaggatgtcatcttgttagagtttctttgtctcagtatacacttattcgaggcgacacaaaaagttatcctcagtatgataatgctaatggtgtaggaaaagtatgaagaggctgttgcagctctcgcggagatggaggagagggcagttatggcagagtccatgttggaggcgactttgcagtatcaatctggccaagttaaagcacaaccttcaccacggtctgtttctttggcatatatcaagtgaacttggtgtagaaaactagattttccattgggtgcattaagtcaccattatttttctgaaacttttcaggcaactgaagcaagatttgccggtcatggtcagtccctagaatcttatccaagtcagtcttcttctttctctcactctcatatacagtatagtcaagagttcagtgcatgtaacaattggagtttcttttcaaaaccaattgtgaatattacatctgaatctggtgctgagcattaacaaggtctctctgatctgcgattgcagaagactacatatgaaagacctaaggagcaagttaacgacgagaagtcatcaacagaaggacaaacacaaacttcatagcagaagaacacgaagctctaagacacactccgtaaggtatataattatacaaattgccgattagattgtcgagataactagtagatatattgaattacataatttctttggtaagcatatataaacaattcgttgtaagtcaaacctctgttatgacaaagagttttcaactatctatagtggaccagaagccacaaagaaacttcactatataatatatgcatcaaataaccatagtgggacatgtatctcttttattgactatcttaagcatatatgcacgaggaggattactcgagcaaagaatgtagtacaagttgtttgattcaatcataaaatgcagagagagattaggctattgcagactgtttatcgtcttcaaggtgtaatgccctaaggagccttgcccatgactctgggattccaccgggcaattcaaattccaacagcttcccgcgtttcttgtagaattcctccactggttgagtctgtgaacgaggaaaaacatataaacattgttaattctacgagaatttgaatcatggaaaaagatcgaagaagtatttttaccattttgttgtaaatcctgagtctttccttgacaacttcttcagtgtcatcagctcggcttataagcttcgattcacagtttggcggaggaagaagaggaggcatatacattctgggagtatcatcatcacctttgatatcaatgcaggcaacgttatagtttccaccacactcgctgcaaattcttcttcctaaacatttcgcaagcaatgcctcttctcgtagcttcaggttaatcaccagatcgatattagttactccctccagtatttcctagaagacaaaaaaagaaacagagctgtcaaacgaaagagtcctccattagcctgaaatctacacaagcaataaattgctcaccgcttgagtcacggtgcgtggaaaaccatcaagaatgtatccagattcacccttgtctttgccagcttggagacgctttgataacaaacttattatgaattcatcaggaactagttttccatggttaacaagctccttgagctacacccaaagcagcaaacgattaacaagcataaataggcgctcaatgattcaacctctgttctagttatagacaagagatacaaccccaaattcgctatccatcattggattctatttataccaaaaagaattctcatttcaaaggaaaaatctgatcatgttggtgacattagtgacctagcaaacaaaatgcaacatttacatcaaaaaaagtttcactgagaccaattttagaagcagactcaattttaagatgattgaacacacaattaaaaatctcaaaattgatctctatgtcttcttcactgagcatcgtgatttcaacaatcaacagctacagaaaatgaatcgagaattgagaattgtaacctgagaggagaggaggccagaggaggagagctcttcacgaacgagatcaccagtggcaatatgaggaacgccgaggagagaagagagacgagaggcataggttcctttaccaacaccaggacatccaagaaacacccagtggaaatttctgcctttgtatggagacgttgacgtagacgaagacttcccgagctgagccgcagcctcctccagatcgattttggggtctagcgaggacccagacgaagaagaagagagagacctaataaagagagaagaaaaagtattctttatcgtcgtcgtcgccggcctgaggagacggtgagaaaccgccatggagagaagaacacggtgaagaagaagaaataatgattgttttagtaggctcgtgaggaacacgtgtcatgtcttttatgtcactgtccctctctttgcttccatggctttacctattcagacataggttcctttaccaacacgatgggtttttttttcggttccggtttggtaattattttggtaactgcttagtcctgccgggtaaaacccgttggtattgggtctttttgacccgtttgggctttttccctcaattctctttttgtgttaattgaaaaattccttggccgggttctatcatctctttctccgggaacacactaaacctaagtccgatcgaaaaagcgatcacttgactcgaaatcacacgactttatctccctgaaccctaatg

SEQ ID NO: 12221 - DNA, 3000 bp, Unknown; identical to SEQ ID NO: 12212
  misc_feature (1)..( 3000): cDNA_ID_3024264_gDNA_ID_2214537_Annot_ID_185133 3000 nt of

SEQ ID NO: 12222 - DNA, 3000 bp, Unknown
  misc_feature (1)..( 3000): cDNA_ID_2708550_gDNA_ID_2214537_Annot_ID_185130 3000 nt of promoter + ATG
tattctccctatttctaaaaaaactacctactttgcaaattatttgtgaaaaaagtgtctagtttccaacttatctctaaaagatttgatagcctatagtggctttagttcctccttgtcattcccagctgtgtatatatattaacccatggatgggtgattaaatggtgatatagtttacgactaaactagaagacaacagaaaaagatgcagatttggagttggcgacaaacatagataactaaatggttataaaagaaaaagagagaagaaaatcgaataaggccaataatatataaagtggggatgggaataaacatttttatatttgtcttctattcccttcttgtccgtatcaaattatcaatcttcaaacacaataagtatatgttattgttaaaacaagtaacgagcaacataaaattagatatttgtaactttttgtacaacataaaatttggattatcctttactcgttttactttttttgtatgcttatccgtttatcgtttttttctaaattacttgtatagttatttttactatcttaccaatgtaacaagaaaaaagttatactacatgcagagactaaacaaaagaaatttaaaaattaggtatatataccacgagtgagagtaccccttccttatctcataccacgagtcccattcgatatatgatctcacgtaatgaaacgggacaaataacatgcaagtagacaatttgttaacgtgtatataaaatctcgaaatagccgttttgaacaagttaaatacggatagacaaaatttattactcaactaagttaagtaacaaacccaaaatcacgggcaaagtaaaccacactcttatattatgcttaaaataaagaagatcccatatttgtttggcaaatagatcatcaatgtagtcgaagggctccacgcgcagcgacaaaaacggaacaagaaagaagaaaaaatcaaaagattcaaaaacctttcttcatctttattaacatcaactattcagatttgtgtaagacaaaagaaagaagcgaagattacggggaccaacagtgacgtggacctctccccgtcggtgcccataccaccaactttactactccagtactggtcacttgcttgttcgaattaaccaaatccaattattcgtaactatgtttcagattgttggctaactgatgatcaatcctacaataatacttaaaacgtttattagtatattgtttggaagatggtataacaattcattggttactgatgcttgttgccaaaaaaaaaaaaaggaaaaagaaatgattaaacgcttgcatctgtttgatttggactccatagattcctttatatagtcaactataatcaatacacgtgaatcatttcgtcatttgattactgttgagacaagagtcaattaccaccaaacatattattttaaaacattaaagttccgataacttcgggtgatggccgcaaatttgagttttggtttgatattgtatatggtattatggtttgagttaacattattattattgtatcatcaattcatcatccgaatttagacctacataataaatgcaagatgttatatacaagaaattccaactgccacaatatagaaaaagagcagcaaattttatttttttctcattggctttcataaatgttacttaataagacacaagacgttgggaaggactgaatgactttactgatatgttttcatgctaccaaatttcgtttttcatcattctaccatatcaatttcgaagtagaggaataatgtcgtgcacaaccaagtctcggtcccagctaccattttcttcaatgaacaccgcaacacgtaaacgcaagtgataccgcaacctagctaatgaagttttggttaacatgaactcgcactatatgacttccaaatcttttgtcttcaactcttttttaccaaagattcaaaaccgtaggctcttactctataaagctagaccttgtcatttttaatgatattacacagaacaaaaaaaaaaatataaatccaaacctaaaatcacaacccaactccgaagataataaacggcattgaaaatcacacaacaaccttaaaggctataatcgtcactgaatgttacataccgactctgaatataacataacttataggatactaaaattatgtcaattcagatgtaaagttgtatcaatttattgaaaatactagctactatatgaaaaagtttagaaatgtattggggaattaagttttccgaaagagagtgtttaactaatattgcctcaactcgttttatgaattttcaaattttagtcatgtggatatggaaatggaatagaactgaaatacattcttctaatcaatcataatccatacaaatctgtatttttactcatttgtatttaaatgtaacaaccacatacataatcccaccttaagtacatgattaaggaatgacttttcagcaaaacacacctcaaaattctcaaattcttgtcagttcaataaaacaatttccttgaattattgtcagacacttaaaagatttgtatgcatgtaactgctggtcccgtattaatatttattgcttcattccttattactaagcaacaaaagtcacgcgtgagatataaaagaagatcctttgcagtttctctgttcttgctccttcttcttcatctccctttattgatactgtctgagtaataataaaaattcactctttttgtcttctcaagacagatttcaaaatagaaatcattctccttttttctttttgaaaatttcgagtgatttaaggagggaaaataaagacagaaacaagaacaaaagcatcgtttgcgaataagacttctcgtactctgttttcttttctcgtgttcttatgacagatttataaaaaagattaggtttttgtcttgtcttggcgataatgcctagagagtgttttaaagatttgatttaaatactcttttatgttaactacgatg

SEQ ID NO: 12223 - DNA, 3000 bp, Unknown; identical to SEQ ID NO: 12209
  misc_feature (1)..( 3000): cDNA_ID_2711632_gDNA_ID_2214537_Annot_ID_185129 3000 nt of promoter + ATG

SEQ ID NO: 12224 - DNA, 3000 bp, Unknown; identical to SEQ ID NO: 12208
  misc_feature (1)..( 3000): cDNA_ID_3024272_gDNA_ID_2214537_Annot_ID_185128 3000 nt of promoter + ATG

SEQ ID NO: 12225 - DNA, 3000 bp, Unknown
  misc_feature (1)..( 3000): cDNA_ID_3024248_gDNA_ID_2214537_Annot_ID_185142 3000 nt of promoter + ATG
gtggtgactttctaccctttgaggtcttgaagacgaggtttgtgatcacctctgtggcacatagagccactccgcgatagtttccttccaccgctatgatatgttcgtccggatattgaagtacaaactgtttatgaattaaatatcatttcttcaatcaagaaattaaaatttctaaccaaaaaaatcaagaaactaaaattcacgaaaagaacttataattgatcggagcttgtagtataatagtttgttatagtgttgtagtgtgagttttagatatttgatgtagaaaatttggaatgtgatgagagggtaaatgaagtgaagaacctctttgggttgttgaatgattttcccatattcagttgttacgacttggccgtcttccttcacatactcgaatttgacgtaagtgatacgattgatatcttgtcctacatacacttttcttacaccctcatatacatcatcgtcccattcacgccctccttcaccaccgtagcctgtcaacttccggtagattttcgccattttgtattttttcaaatactgtaaaatgaattttttaactaaattatccaaatccaaataaagtgtatattcaagctttataatgtttactaagccgggatcccggatctgtgattggtgatacactagcctattgaattgcatagcaagacatagagagcaatgatcaactaatgagtacctatttacgaaactaaagttgtaatttgtataaacaaatcagaacttgagagagagagaagagagaacctgtaaattcttgatcttattcagaatgaaattaaggaactatcaactatgtctatttattgatacaatttggaacacgtttttgttgattccaataatttagttatacttgtaagttgtaactaaatcatgattgacctttttctgttccctttacttttccttcaaaaagaatatgagaaggaaaacattttacaaggccaaaccaatccccataatttgtaatttaagtcatattagaagagaaatagccaaactaacccaaaatatattagagatctcaagagcatcctggctgcatgttatcattctggacgatatgtcacgagacgagaggttctaacaaataaagcaatagatgattttgataagagtccaataatactagcatattacaagttgtcagatggagacatccatgattgtaatgaacagaggaacaaaacaattttgtttcacaaagaaattttgttataatatttttcatatactgtttacatcgtcgtcccattcacgtcctccttcatcaccgcaaagtgccaacttccgctagatcctcatccattttgaatcaccaaattaatccttaaaaatgaaaaaaaaacaaactaaactatttgttagtccaagtatgaatgcatagctttataatcatttcctaagctggatatgtgattggtaataaactaatactaccatgacaacattgtaccctattcatatacatcgcaataaaataccaaaattttccactaatcgcagatagaggaatcaactaatgcatggtagggtaaatatttatagtgtgatgttgatagctctattataggtgtactatataaatcaatgacgatataagtatactgtatagtattaaacaagccccacacaacaaactgaaattgcatccacatattcatttctcacgtttatttcatctatatatcctaccctacttgctcataaactttcctctcttgtcttaaacttttaacgttacaaagtcacagccacaatattctatcctcaccgatataataatcaccgcaacagtataatcttaccttgatatctattatatggattaaaacccgatttcttactaaacatttgacactttcgcgtagaacataatctgtacatacgaatttcgaattcatatatatatatatatatatatatatatatgttggataatgattgttttctcgaatattgtgtcgatttatagtgtagtcatattttagatagctactccgttcatcaccaatagcttgtttctatggttaatttctttcacttattagatttatctcaaccaatcactcaattagtttctagagattgttgtgattgctatactacatgttaagcactttttatttttgccggatttcttggccaaaagggttggcgatagaagcaactacattaaattcatgacctaagctaaattacatgtaacgatatacaatacaagatttgtctaaactaaacattgattcaaccaaaacttatatagactatatatttaacccaaatacttatcatataaatgttttcttttttgacgtcaacacaaccgtaaacattcgaaatcttatatatttaattatttactatgcttgttatttcatttgtcgacgttgttttttttttttgcattcttcagatccactaagaaaaggcaagtccgaaagataatgggcccaattagtggctatataaaaacccgacccggaaagactaaacctgatccgcaaccgaaccgacccgacgacgctagtataccgtaaaaatttgacaatcttcgtctccggcacaacaaaattgttcttcttcggcaagattcctcgattttctccgtgttctgtaatttccgatagattttgacaactctctttgattgtttccctttagctttttatttttatctgccttttttttttttgttgttgttccggttctattcgtttccttttgttaccttgtttttggttttgatctcaaatcctgctctgctctactatcttcaattcgattcttcatccgaacgaagaagacacaaattggagcttcactggtacatattcttgacgctttatctctgatttgctatttagggcttttcaatgaatgaatttagtttttctgctatgttcattgggaagtaagttcaatcgtatgtgtgatgatttttcaggacgttgatgataaagc

SEQ ID NO: 12226 - DNA, 3000 bp, Unknown
  misc_feature (1)..( 3000): cDNA_ID_2708545_gDNA_ID_2214537_Annot_ID_185141 3000 nt of promoter + ATG
aactgcaaatttccatgaagtaagtgatcagcagctaagtttcgtaacaatacctaacacctaatagaaaatgttgtactttgcatcattgagctgtattcataacatattactagtgaaaatcatacggctccacagaattgatgataggtctattcttaaagcagaaactgattttctgaaatgttccaagagttcacatacggagcctagaatcaaagtcactttttttctgctgcataaacatactgacatgcaaaattcctctaaccattacaatggtgaactaacaacaagcataactttcatatctaccaagttaaatctggagcaaactaaaataaacaaattcaattcgcaaaaattgaaccaatgcacgaaatttcacttgcatataaagactaaataaatctgcaaattggaaaaatttaagcttaaaagaaagagaaggcgcaagagattgttaattacctcaatggaattagggtccattggtgctacggcctgagtgttccctccgtgattcatgctttatcatcaacgtcctgaaaaatcatcacacatacgattgaacttacttcccaatgaacatagcagaaaaactaaattcattcattgaaaagccctaaatagcaaatcagagataaagcgtcaagaatatgtaccagtgaagctccaatttgtgtcttcttcgttcggatgaagaatcgaattgaagatagtagagcagagcaggatttgagatcaaaaccaaaaacaaggtaacaaaaggaaacgaatagaaccggaacaacaacaaaaaaaaaaaaggcagataaaaataaaaagctaaagggaaacaatcaaagagagttgtcaaaatctatcggaaattacagaacacggagaaaatcgaggaatcttgccgaagaagaacaattttgttgtgccggagacgaagattgtcaaatttttacggtatactagcgtcgtcgggtcggttcggttgcggatcaggtttagtctttccgggtcgggtttttatatagccactaattgggcccattatctttcggacttgccttttcttagtggatctgaagaatgcaaaaaaaaaaaacaacgtcgacaaatgaaataacaagcatagtaaataattaaatatataagatttcgaatgtttacggttgtgttgacgtcaaaaaagaaaacatttatatgataagtatttgggttaaatatatagtctatataagttttggttgaatcaatgtttagtttagacaaatcttgtattgtatatcgttacatgtaatttagcttaggtcatgaatttaatgtagttgcttctatcgccaacccttttggccaagaaatccggcaaaaataaaaagtgcttaacatgtagtatagcaatcacaacaatctctagaaactaattgagtgattggttgagataaatctaataagtgaaagaaattaaccatagaaacaagctattggtgatgaacggagtagctatctaaaatatgactacactataaatcgacacaatattcgagaaaacaatcattatccaacatatatatatatatatatatatatatatatgaattcgaaattcgtatgtacagattatgttctacgcgaaagtgtcaaatgtttagtaagaaatcgggttttaatccatataatagatatcaaggtaagattatactgttgcggtgattattatatcggtgaggatagaatattgtggctgtgactttgtaacgttaaaagtttaagacaagagaggaaagtttatgagcaagtagggtaggatatatagatgaaataaacgtgagaaatgaatatgtggatgcaatttcagtttgttgtgtggggcttgtttaatactatacagtatacttatatcgtcattgatttatatagtacacctataatagagctatcaacatcacactataaatatttaccctaccatgcattagttgattcctctatctgcgattagtggaaaattttggtattttattgcgatgtatatgaatagggtacaatgttgtcatggtagtattagtttattaccaatcacatatccagcttaggaaatgattataaagctatgcattcatacttggactaacaaatagtttagtttgtttttttttcatttttaaggattaatttggtgattcaaaatggatgaggatctagcggaagttggcactttgcggtgatgaaggaggacgtgaatgggacgacgatgtaaacagtatatgaaaaatattataacaaaatttctttgtgaaacaaaattgttttgttcctctgttcattacaatcatggatgtctccatctgacaacttgtaatatgctagtattattggactcttatcaaaatcatctattgctttatttgttagaacctctcgtctcgtgacatatcgtccagaatgataacatgcagccaggatgctcttgagatctctaatatattttgggttagtttggctatttctcttctaatatgacttaaattacaaattatggggattggtttggccttgtaaaatgttttccttctcatattctttttgaaggaaaagtaaagggaacagaaaaaggtcaatcatgatttagttacaacttacaagtataactaaattattggaatcaacaaaaacgtgttccaaattgtatcaataaatagacatagttgatagttccttaatttcattctgaataagatcaagaatttacaggttctctcttctctctctctcaagttctgatttgtttatacaaattacaactttagtttcgtaaataggtactcattagttgatcattgctctctatgtcttgctatgcaattcaataggctagtgtatcaccaatcacagatccgggatcccggcttagtaaacattataaagcttgaatatacactttatttggatttggataatttagttaaaaaattcattttacagtatttgaaaaaatacaaaatg

SEQ ID NO: 12227 - DNA, 3000 bp, Unknown
  misc_feature (1)..( 3000): cDNA_ID_2992400_gDNA_ID_2214537_Annot_ID_185140 3000 nt of promoter + ATG
aataggctagtgtatcaccaatcacagatccgggatcccggcttagtaaacattataaagcttgaatatacactttatttggatttggataatttagttaaaaaattcattttacagtatttgaaaaaatacaaaatggcgaaaatctaccggaagttgacaggctacggtggtgaaggagggcgtgaatgggacgatgatgtatatgagggtgtaagaaaagtgtatgtaggacaagatatcaatcgtatcacttacgtcaaattcgagtatgtgaaggaagacggccaagtcgtaacaactgaatatgggaaaatcattcaacaacccaaagaggttcttcacttcatttaccctctcatcacattccaaattttctacatcaaatatctaaaactcacactacaacactataacaaactattatactacaagctccgatcaattataagttcttttcgtgaattttagtttcttgatttttttggttagaaattttaatttcttgattgaagaaatgatatttaattcataaacagtttgtacttcaatatccggacgaacatatcatagcggtggaaggaaactatcgcggagtggctctatgtgccacagaggtgatcacaaacctcgtcttcaagacctcaaagggtagaaagtcaccactgtttggtccaaacttgcttggaattacgaccggtacaaagttcgttattgaggatggaggaaagaagatcgtagggtttcatggacggtcgggtaatgctctcgacgcgcttggagtttactttgtacatggctctctaacaacgtctccgcctgtttacaagctggatgcccaaggtggtacagacgggcgtgtttgggatgatggttcttacgacggcgttaaatcgctgcgtattggtcaagataattctcgtattacttatttagagttcgagtacgagaaaggcggtaagttagagacatgtcgccatggggtgaaacaagaaagatcactgaaggtaaatttctagaaactgtgagatatagtagaacaaccaaaatttaggtcttaaatataacttttgatatcttgcgacagaagtattcttaaattttgattttgttgcagtttgagcttaacccggatgaatacatcaaatcggtggaagcaacctatgataaaccggacattttccgcaatgtcgtcattacatcgcttacatttgaaacatcgaaggggagaacgtcattctctgggtataagggaggtaagaagtttaagctagagcaaaagggtcgtaggcttgtcgggttccatggaaaggaaggttcagctattgatgcccttggagcatattttgcacctattcctactccgactcctataattccagccaagaaactaccagcaataggcggcagcggaggagttgcatgggatgatggtgtctacgatggtgtaaggaagatacttgtaggacaaggtaacgatggtgtagcctttgtcaagtttgaatacaataaaggaaaagatcttgtatctggagatgaccatgggaagatgacattactcggaactgaagaggtcagttccataaacaagagttatgttttttcttttttcagctaattttattttaaattatacacttatccttgttacttttgagtctttgcagtttgtgcttgaagatggtgaatatctcacggccatagatggctattacgataagattttcggagtcgagacaccaatgattatctgtcttcagtttaagacgaacaaaagggagtcaactccattcggaatggattcgggtgagaagttctcgcttggagagaaaggccacaagatcgtcggattccacggacaagctagtgatgttgttcacagcatcggagtcactgtcgtgcccattaccaacaccaagtgaaaaaccttttattatataagtaaaaccagccagtgccatgtcgactaaatgaaaacattcaataaggattggtgtgtttactctactacttttgatgtgtttgtaacttactgtttctgtcaaatatgtccaataagaattggtgtgctctcttcaactattcaataaatctaccatgagccgtgtcagagtagctaacattgaacacacagccccactgatgtaatgaaactttttacccactattttaattgctccttgtaacatttcaaagacatagacattagaaaaagaagctttctcattgttgtcttcctcaaagcccagatctctaaagtggtcttacaagatttgattatgcatatgttgcccaaatgactaaaagtaatcttaacaaaaaataatattaaaagtaatcgaaaatgagtcgtcctatatatttaagaaaataaatatatatttttcctacatatgaatctaatcatgactaaatatgttttttttctccggattttcagattggagttgcacaatttcaccgaaatcaagatgaaaagtgatggaaattgccatctaattaatatttctaattccttttactcaatatatcaaatacttgatgtcattttttatcgtactcatttattcgaaaattttcggatcaaagcaaataataaaattaagtattcgattaaaacgaatcgaataacaaatatccccaattttccggatattcgattcgtgcccaggcctacgtggcacatatacaagtgaaaatgaaatcatacgcaaataaaacaataccatcggtataaacataaagaaatgaactatttatttttccttaagataattgtaaatttcgtttatttttttaattatggaattttttgctttttctttttcgttcttttagtatattaaaggataggatcatcataattcacaattaactgttggagaaagatttttttttttgagaaacgttaaacctagcagccctaatcttttctaagagaggagatcgagactctgttctgaatcaataaccatcgatcaatctcaactctaaaagatg

SEQ ID NO: 12228 - DNA, 3000 bp, Unknown
  misc_feature (1)..( 3000): cDNA_ID_2708542_gDNA_ID_2214537_Annot_ID_185139 3000 nt of promoter + ATG
atctaatcatgactaaatatgttttttttctccggattttcagattggagttgcacaatttcaccgaaatcaagatgaaaagtgatggaaattgccatctaattaatatttctaattccttttactcaatatatcaaatacttgatgtcattttttatcgtactcatttattcgaaaattttcggatcaaagcaaataataaaattaagtattcgattaaaacgaatcgaataacaaatatccccaattttccggatattcgattcgtgcccaggcctacgtggcacatatacaagtgaaaatgaaatcatacgcaaataaaacaataccatcggtataaacataaagaaatgaactatttatttttccttaagataattgtaaatttcgtttatttttttaattatggaattttttgctttttctttttcgttcttttagtatattaaaggataggatcatcataattcacaattaactgttggagaaagatttttttttttgagaaacgttaaacctagcagccctaatcttttctaagagaggagatcgagactctgttctgaatcaataaccatcgatcaatctcaactctaaaagatgtctaatactcagaccaagtcgttgtgtttggacggtcttagtgatcgcgaaatacttgagtataggtattgatcgattcttcttgtaaactttgttccaattatttttttgcctgataatctctgactatatatgttatttcttattcttcctggattttcagattggaatgggaaaattacaccgaaatcatgatgaaaagtgatggaaattgccaggtaattaatgtttctatatcaaacaatcaacttgatatatatttttgatcgtattatgaataaccctttttcatgtttttgtcaataattctatttcagttccgtgctttggcggatcaactttatcaaaattcggattgtcatgaacttgttagacaagaaatcgtaaaacaggtaatatcaatcttcaaacttttgattgtttttttcatacgtgtattaatgtcatatgatgattgattgattgatgactctcagcttaaaactcatccgaagatttacaaagggtttgttgatcatatggacttctcccataaagaacatgtcattgtccactaattcccaatggggcgatgaagtgactttgagagtggctgctgatgtgtatcaagtaaaaataatactcattacatcaatcaaacttattccatttatggagtttttgcccaagtctcaaaaggaaccggacaaagtcattcatatgagctatctagctgggatccatttcaactccatctacaaaaaaaataaagaaaaaggttaacgttctcttccttctccattgtatatacatctcatctccttactcttgatttgaggctttgagcaatattgtatcattcttattcttcgtcttgttggctgcttcaggttcacgttcatcttcatcatcgagttctgcagtctggatgaagctacagaggaagaaggagaatgaggcgaagaaaaaggaggaggaggagaaggaaaggaaggacatggagaaggaggagaagaaaaaggacaaggaggataagaagaaggataaggaggataagaagaaagccaaggtgcagaaagagaagaaggagaagaaggagaagaagaacagaaatcaccactttcactattctgaatgatttgttttgataaattaagtgtatctgcatttgacaagttgtatgttattattgggatcattgtggttgttttgactcttttatgttcttttcgagcttattctagttttgagccttagatactgataatcataaaacacaacatgataatgtgaaagagtcatcatgacataacatcagcgtcccaaaataacttgaccatcgtctccatggtatccaaccgtcgatcctcaacgactccaaaaagcaaggacatgaatatatgatgatgataagccaaacttttgcatgaacacagtttatacaaaatttaaataactgttaaattcatttgaaactttaatgaatgatatttctgacagtaacttaggaaataaagcttatacaccgttttagtttgaagataataattctaaatctgttttcaaaatgtgcagtcaaaaagattcttaatactaaataggagattttggtgggaatcgcaacattaacatcatcaaatttgttttagttaacaatatattgaatttggtttatgctgttttgatgaattgttttgttcatctgtcgtactttaaaatatctctgcatctagaaagttgtatgctattattatatattgcactcgtaatggactctaattatttgttgcatttgtgagggagtctctcgtgtcacacgagttgattattaaaatgattaattaaagacaatcaagaagaccttgtatgccaaagattgtcaataaatacacacaattcaatacccataagcttcatctccttccatcattcagagctcaataattaactggttatctctctcccttcaatttttttttttttttttttttttaaagtaactcctagtttccactactatgtatgttgcttcacaaaatgtttttaaaacaagaagtagctctttatatgtagatatgtattcttgaatatattagatttaacaaacacttttaaacctaattgattgatttatattacaccacatcaccaataatagagctatcaacatcaaacagtaaatatttacccatgatcagttgattgttctatttgtgtttcttggatcattttggtgtttttgctatgtatttgaataggctatacagtgttatcatggtatttatgtattactaaccacaaaccagctttaaaaactatatataaagctgtacatatatactttcgtttttggattatctatataagaagtaatttttgcattttacaatattttttagattcgaaatggcgaagatg

SEQ ID NO: 12229 - DNA, 1864 bp, Unknown
  misc_feature (1)..( 1864): cDNA_ID_1397750_gDNA_ID_2214537_Annot_ID_185121 3000 nt of promoter + ATG
aacaagaagtgtcatgagaaacacaaaaatcaaaaccacatatgaatgagcgattcatctcatttagctagcaacaccttttcagagtatatatcacatatgctatggagtatctagattggtgaatttaaattgcatcgtcataaaacaagagggaaaaagccacagtaatcaatcaaaagattaggtcaatatcaaatagctaatttttcaaaatgaaagttgatatacgataaaaaggtcagattaataaaaacaaaatggttcattgaacatgtatgtatcagattgtaagtatgtcaaatcaaagtatatatctatctcactttcgaaatctgcaaaaatgactagttaattgaggtgaaccggcaaaaaaatcacaatcgtaagaacagaatcacatgatgtgtagatctgttggtcgttcatttggacttttcttctgaaacgataactcaagagcatgtgctcatttgatctctctttgttgattctccgcttccttcaacatatccccacatgcttcattgttgtattttatttttattttcgaaactatattaatacagaggagaggaagatcgtcctcacaagtatttgcaaaaatgatacacaaatcaatgccaaaatgatgacgcagtgaaggtttagacagctcaagaatgatattgcacatcaatcactgattcaatgttttatttttgtcttcttcttttttttttttgttgaatgatactcattgtcaacataatatcataagccttttatcaaaataataataatacataatgtcctgcattttgtctttttgtgatgatttttgctcattatataaattgcaagtaactatgttttgcaaggttttttctgttcgtgacataaattgcgagtaaccatgttatgttattatatatgtacctatggtgcgaaggttagattttacatatggagataataagtattggatttggagataacataatgctacgactttatactgtgtatgttgggatttcataccaaacaaaaaaaatgaaaccaactagccaagaatatgtttacgttttgagttttacagagttcacattatagttgattttatttgtgcaaattatatttactctgcaaaataacatcttactctcctacttcaagaaactttgaagagaaagatatggaatgcaacgagttacacaaatctgttacaagatttctaattaagaacttacaaatctgctacttatcatcttttgaatacgtcttttggtggttaggttctaatttgtctaacagtatatgttttccaacaaaatttgatccttttgaaagcattactcttttttttttttttttttgtcaattttgaaaggattactcatattccttaaatcatgttactaaactcacataaatacgtattaagccaaagacgactcttgacgtgctctaaaatccaattcattctttatagattttaattcttggctctttatcctatttaatatttcgccgaaaaatctttgaaatgattatctgattgtatttttttataaaaaatttgtcataaccaaatttagaattatattttaaaatttaggaatgagtttagttaagaagttggtttgaaggtatagttttttctggaatttaaagtttaactttaaaatttattaacgatttagtattagattagtttattaatttgttgaaaaatctggtctattttgttacttttttcaaaaatatggtctattttcataaaaatccctaaaatatccgaatttatcggataaacccaaaccccctatcgggaaaacccaacacaccgtctctctctcactctcacttcccatcggcgaaaatg

SEQ ID NO: 12230 - DNA, 3000 bp, Unknown
  misc_feature (1)..( 3000): cDNA_ID_2708542_gDNA_ID_2214537_Annot_ID_134414 3000 nt of promoter + ATG
tacatatgaatctaatcatgactaaatatgttttttttctccggattttcagattggagttgcacaatttcaccgaaatcaagatgaaaagtgatggaaattgccatctaattaatatttctaattccttttactcaatatatcaaatacttgatgtcattttttatcgtactcatttattcgaaaattttcggatcaaagcaaataataaaattaagtattcgattaaaacgaatcgaataacaaatatccccaattttccggatattcgattcgtgcccaggcctacgtggcacatatacaagtgaaaatgaaatcatacgcaaataaaacaataccatcggtataaacataaagaaatgaactatttatttttccttaagataattgtaaatttcgtttatttttttaattatggaattttttgctttttctttttcgttcttttagtatattaaaggataggatcatcataattcacaattaactgttggagaaagatttttttttttgagaaacgttaaacctagcagccctaatcttttctaagagaggagatcgagactctgttctgaatcaataaccatcgatcaatctcaactctaaaagatgtctaatactcagaccaagtcgttgtgtttggacggtcttagtgatcgcgaaatacttgagtataggtattgatcgattcttcttgtaaactttgttccaattatttttttgcctgataatctctgactatatatgttatttcttattcttcctggattttcagattggaatgggaaaattacaccgaaatcatgatgaaaagtgatggaaattgccaggtaattaatgtttctatatcaaacaatcaacttgatatatatttttgatcgtattatgaataaccctttttcatgtttttgtcaataattctatttcagttccgtgctttggcggatcaactttatcaaaattcggattgtcatgaacttgttagacaagaaatcgtaaaacaggtaatatcaatcttcaaacttttgattgtttttttcatacgtgtattaatgtcatatgatgattgattgattgatgactctcagcttaaaactcatccgaagatttacaaagggtttgttgatcatatggacttctcccataaagaacatgtcattgtccactaattcccaatggggcgatgaagtgactttgagagtggctgctgatgtgtatcaagtaaaaataatactcattacatcaatcaaacttattccatttatggagtttttgcccaagtctcaaaaggaaccggacaaagtcattcatatgagctatctagctgggatccatttcaactccatctacaaaaaaaataaagaaaaaggttaacgttctcttccttctccattgtatatacatctcatctccttactcttgatttgaggctttgagcaatattgtatcattcttattcttcgtcttgttggctgcttcaggttcacgttcatcttcatcatcgagttctgcagtctggatgaagctacagaggaagaaggagaatgaggcgaagaaaaaggaggaggaggagaaggaaaggaaggacatggagaaggaggagaagaaaaaggacaaggaggataagaagaaggataaggaggataagaagaaagccaaggtgcagaaagagaagaaggagaagaaggagaagaagaacagaaatcaccactttcactattctgaatgatttgttttgataaattaagtgtatctgcatttgacaagttgtatgttattattgggatcattgtggttgttttgactcttttatgttcttttcgagcttattctagttttgagccttagatactgataatcataaaacacaacatgataatgtgaaagagtcatcatgacataacatcagcgtcccaaaataacttgaccatcgtctccatggtatccaaccgtcgatcctcaacgactccaaaaagcaaggacatgaatatatgatgatgataagccaaacttttgcatgaacacagtttatacaaaatttaaataactgttaaattcatttgaaactttaatgaatgatatttctgacagtaacttaggaaataaagcttatacaccgttttagtttgaagataataattctaaatctgttttcaaaatgtgcagtcaaaaagattcttaatactaaataggagattttggtgggaatcgcaacattaacatcatcaaatttgttttagttaacaatatattgaatttggtttatgctgttttgatgaattgttttgttcatctgtcgtactttaaaatatctctgcatctagaaagttgtatgctattattatatattgcactcgtaatggactctaattatttgttgcatttgtgagggagtctctcgtgtcacacgagttgattattaaaatgattaattaaagacaatcaagaagaccttgtatgccaaagattgtcaataaatacacacaattcaatacccataagcttcatctccttccatcattcagagctcaataattaactggttatctctctcccttcaatttttttttttttttttttttttaaagtaactcctagtttccactactatgtatgttgcttcacaaaatgtttttaaaacaagaagtagctctttatatgtagatatgtattcttgaatatattagatttaacaaacacttttaaacctaattgattgatttatattacaccacatcaccaataatagagctatcaacatcaaacagtaaatatttacccatgatcagttgattgttctatttgtgtttcttggatcattttggtgtttttgctatgtatttgaataggctatacagtgttatcatggtatttatgtattactaaccacaaaccagctttaaaaactatatataaagctgtacatatatactttcgtttttggattatctatataagaagtaatttttgcattttacaatattttttagattcgaaatg

SEQ ID NO: 12231 - DNA, 3000 bp, Unknown
  misc_feature (1)..( 3000): cDNA_ID_2992400_gDNA_ID_2214537_Annot_ID_134415 3000 nt of promoter + ATG
cgatgatgtatatgagggtgtaagaaaagtgtatgtaggacaagatatcaatcgtatcacttacgtcaaattcgagtatgtgaaggaagacggccaagtcgtaacaactgaatatgggaaaatcattcaacaacccaaagaggttcttcacttcatttaccctctcatcacattccaaattttctacatcaaatatctaaaactcacactacaacactataacaaactattatactacaagctccgatcaattataagttcttttcgtgaattttagtttcttgatttttttggttagaaattttaatttcttgattgaagaaatgatatttaattcataaacagtttgtacttcaatatccggacgaacatatcatagcggtggaaggaaactatcgcggagtggctctatgtgccacagaggtgatcacaaacctcgtcttcaagacctcaaagggtagaaagtcaccactgtttggtccaaacttgcttggaattacgaccggtacaaagttcgttattgaggatggaggaaagaagatcgtagggtttcatggacggtcgggtaatgctctcgacgcgcttggagtttactttgtacatggctctctaacaacgtctccgcctgtttacaagctggatgcccaaggtggtacagacgggcgtgtttgggatgatggttcttacgacggcgttaaatcgctgcgtattggtcaagataattctcgtattacttatttagagttcgagtacgagaaaggcggtaagttagagacatgtcgccatggggtgaaacaagaaagatcactgaaggtaaatttctagaaactgtgagatatagtagaacaaccaaaatttaggtcttaaatataacttttgatatcttgcgacagaagtattcttaaattttgattttgttgcagtttgagcttaacccggatgaatacatcaaatcggtggaagcaacctatgataaaccggacattttccgcaatgtcgtcattacatcgcttacatttgaaacatcgaaggggagaacgtcattctctgggtataagggaggtaagaagtttaagctagagcaaaagggtcgtaggcttgtcgggttccatggaaaggaaggttcagctattgatgcccttggagcatattttgcacctattcctactccgactcctataattccagccaagaaactaccagcaataggcggcagcggaggagttgcatgggatgatggtgtctacgatggtgtaaggaagatacttgtaggacaaggtaacgatggtgtagcctttgtcaagtttgaatacaataaaggaaaagatcttgtatctggagatgaccatgggaagatgacattactcggaactgaagaggtcagttccataaacaagagttatgttttttcttttttcagctaattttattttaaattatacacttatccttgttacttttgagtctttgcagtttgtgcttgaagatggtgaatatctcacggccatagatggctattacgataagattttcggagtcgagacaccaatgattatctgtcttcagtttaagacgaacaaaagggagtcaactccattcggaatggattcgggtgagaagttctcgcttggagagaaaggccacaagatcgtcggattccacggacaagctagtgatgttgttcacagcatcggagtcactgtcgtgcccattaccaacaccaagtgaaaaaccttttattatataagtaaaaccagccagtgccatgtcgactaaatgaaaacattcaataaggattggtgtgtttactctactacttttgatgtgtttgtaacttactgtttctgtcaaatatgtccaataagaattggtgtgctctcttcaactattcaataaatctaccatgagccgtgtcagagtagctaacattgaacacacagccccactgatgtaatgaaactttttacccactattttaattgctccttgtaacatttcaaagacatagacattagaaaaagaagctttctcattgttgtcttcctcaaagcccagatctctaaagtggtcttacaagatttgattatgcatatgttgcccaaatgactaaaagtaatcttaacaaaaaataatattaaaagtaatcgaaaatgagtcgtcctatatatttaagaaaataaatatatatttttcctacatatgaatctaatcatgactaaatatgttttttttctccggattttcagattggagttgcacaatttcaccgaaatcaagatgaaaagtgatggaaattgccatctaattaatatttctaattccttttactcaatatatcaaatacttgatgtcattttttatcgtactcatttattcgaaaattttcggatcaaagcaaataataaaattaagtattcgattaaaacgaatcgaataacaaatatccccaattttccggatattcgattcgtgcccaggcctacgtggcacatatacaagtgaaaatgaaatcatacgcaaataaaacaataccatcggtataaacataaagaaatgaactatttatttttccttaagataattgtaaatttcgtttatttttttaattatggaattttttgctttttctttttcgttcttttagtatattaaaggataggatcatcataattcacaattaactgttggagaaagatttttttttttgagaaacgttaaacctagcagccctaatcttttctaagagaggagatcgagactctgttctgaatcaataaccatcgatcaatctcaactctaaaagatgtctaatactcagaccaagtcgttgtgtttggacggtcttagtgatcgcgaaatacttgagtataggtattgatcgattcttcttgtaaactttgttccaattatttttttgcctgataatctctgactatatatgttatttcttattcttcctggattttcagattggaatgggaaaattacaccgaaatcatg

SEQ ID NO: 12232 - DNA, 3000 bp, Unknown; identical to SEQ ID NO: 12226
  misc_feature (1)..( 3000): cDNA_ID_2708545_gDNA_ID_2214537_Annot_ID_134416 3000 nt of promoter + ATG

SEQ ID NO: 12233 - DNA, 3000 bp, Unknown
  misc_feature (1)..( 3000): cDNA_ID_1957136_gDNA_ID_2214537_Annot_ID_134417 3000 nt of promoter + ATG
tacgaaactaaagttgtaatttgtataaacaaatcagaacttgagagagagagaagagagaacctgtaaattcttgatcttattcagaatgaaattaaggaactatcaactatgtctatttattgatacaatttggaacacgtttttgttgattccaataatttagttatacttgtaagttgtaactaaatcatgattgacctttttctgttccctttacttttccttcaaaaagaatatgagaaggaaaacattttacaaggccaaaccaatccccataatttgtaatttaagtcatattagaagagaaatagccaaactaacccaaaatatattagagatctcaagagcatcctggctgcatgttatcattctggacgatatgtcacgagacgagaggttctaacaaataaagcaatagatgattttgataagagtccaataatactagcatattacaagttgtcagatggagacatccatgattgtaatgaacagaggaacaaaacaattttgtttcacaaagaaattttgttataatatttttcatatactgtttacatcgtcgtcccattcacgtcctccttcatcaccgcaaagtgccaacttccgctagatcctcatccattttgaatcaccaaattaatccttaaaaatgaaaaaaaaacaaactaaactatttgttagtccaagtatgaatgcatagctttataatcatttcctaagctggatatgtgattggtaataaactaatactaccatgacaacattgtaccctattcatatacatcgcaataaaataccaaaattttccactaatcgcagatagaggaatcaactaatgcatggtagggtaaatatttatagtgtgatgttgatagctctattataggtgtactatataaatcaatgacgatataagtatactgtatagtattaaacaagccccacacaacaaactgaaattgcatccacatattcatttctcacgtttatttcatctatatatcctaccctacttgctcataaactttcctctcttgtcttaaacttttaacgttacaaagtcacagccacaatattctatcctcaccgatataataatcaccgcaacagtataatcttaccttgatatctattatatggattaaaacccgatttcttactaaacatttgacactttcgcgtagaacataatctgtacatacgaatttcgaattcatatatatatatatatatatatatatatatgttggataatgattgttttctcgaatattgtgtcgatttatagtgtagtcatattttagatagctactccgttcatcaccaatagcttgtttctatggttaatttctttcacttattagatttatctcaaccaatcactcaattagtttctagagattgttgtgattgctatactacatgttaagcactttttatttttgccggatttcttggccaaaagggttggcgatagaagcaactacattaaattcatgacctaagctaaattacatgtaacgatatacaatacaagatttgtctaaactaaacattgattcaaccaaaacttatatagactatatatttaacccaaatacttatcatataaatgttttcttttttgacgtcaacacaaccgtaaacattcgaaatcttatatatttaattatttactatgcttgttatttcatttgtcgacgttgttttttttttttgcattcttcagatccactaagaaaaggcaagtccgaaagataatgggcccaattagtggctatataaaaacccgacccggaaagactaaacctgatccgcaaccgaaccgacccgacgacgctagtataccgtaaaaatttgacaatcttcgtctccggcacaacaaaattgttcttcttcggcaagattcctcgattttctccgtgttctgtaatttccgatagattttgacaactctctttgattgtttccctttagctttttatttttatctgccttttttttttttgttgttgttccggttctattcgtttccttttgttaccttgtttttggttttgatctcaaatcctgctctgctctactatcttcaattcgattcttcatccgaacgaagaagacacaaattggagcttcactggtacatattcttgacgctttatctctgatttgctatttagggcttttcaatgaatgaatttagtttttctgctatgttcattgggaagtaagttcaatcgtatgtgtgatgatttttcaggacgttgatgataaagcatgaatcacggagggaacactcaggccgtagcaccaatggaccctaattccattgaggtaattaacaatctcttgcgccttctctttcttttaagcttaaatttttccaatttgcagatttatttagtctttatatgcaagtgaaatttcgtgcattggttcaatttttgcgaattgaatttgtttattttagtttgctccagatttaacttggtagatatgaaagttatgcttgttgttagttcaccattgtaatggttagaggaattttgcatgtcagtatgtttatgcagcagaaaaaaagtgactttgattctaggctccgtatgtgaactcttggaacatttcagaaaatcagtttctgctttaagaatagacctatcatcaattctgtggagccgtatgattttcactagtaatatgttatgaatacagctcaatgatgcaaagtacaacattttctattaggtgttaggtattgttacgaaacttagctgctgatcacttacttcatggaaatttgcagttttattgtttgattcaatcagattgatttgagactgtgggaggctttagcatcctaatgtagtctttatctgagatgacatttctgtttgttgtttgtctatgtttcttttcactcttcaactttttgtttatgtctacttgttaaatgaagattctcagaccttggccagtactaatgttttttctttt

SEQ ID NO: 12234 - DNA, 3000 bp, Unknown
  misc_feature (1)..( 3000): cDNA_ID_2686877_gDNA_ID_2214538_Annot_ID_134420 3000 nt of promoter + ATG
ggataaataccatatgtgagctagtaagccaaatgatttagtcgtttccgttgatgacgtatttcacttttggagctcggccttatattatatcatcaaaaactagtgagagattaagtatattgatatcatttaaggtacctagaggtccaaaacatatgtgccatatccaaagattttgggaagcaacagcctgtagttcgattgttggttttccagatccacgtgtatattgttctttccaagcggtcgggcaattctttcactcccaatgcatacaatcgatgcttcctgtcatcccgagaaatccacggagctctccaatacgcagtagtcgtttaagatcttgtcgcgtaggtcttcttagatactctttcccgaacaaatatatgattgcttcaaccgaatgtatcatacaagacatcaaagtgttttcaccaatccggaggtatttgtcaaccgcatctgtcgcacaatacaaattgttgcttgtggtgtcttcttgtacaagtgatgtcggcaccactcaaatcttcaggatcctgcaactcaaaactcatttgataagaccaaccacaagttagagaacttaaagcatagaacacaactgaaacacttaaattatataacacacaaactcaaaactcatttcattcatgatcaaaactaaaacacttaaagtatataatacaacctatcataaagaccaaacttattagccgaaacacaaagcaataactaaagtccaaactattagccggaaaagaaagtaataactaaagtccaaactcatttgataaagtccaaactcattatccgaaacacaaagtaataactaaagtccaaactgatttcataaagagcaaactcataagcagaaacacaaagtaataactaaagtacaaactcatttcttaaagaccaaactcattagtcgtaataactaaagtccaaactcatttcataaaaccaaactcatttcattcaagaacacaactgaaataattaaatccacgtattgcaatagacgagtgtttatgtttcaattcatacacaaaccaaatcaaattcatatcaatctaaaaggcaaaaatcaaaagtaataacgactgattatgtgaacacaaaaccctaatttcgtttacatataaaagccctaattatcaatcataaaaccacaattcacgaaaccctaatttcaacaatttctattaaaccctaaataatgaagatctaaacactcaaatcaaatgaatcataccttcagaagagattggagatgagtatcaataaattctccgatttcgaaccttaaactctccgatttggatcaatgacgaatcgacacactatcgccgtcgattgagacggatcgacacactatcgccgttgatcgagacggatcgccacacaattgccgtcttgttctctttgagctaatgatcgagacagatcgatatcggagagatacaatcgccgtaaaaagtcgccgctgcagagagaaaccaaacacgtgaatgcccaaaaaaaactaaacacttgtaaaagattacgtttatcgaaaaacttcatggaccaataatatttagccacgtatgggtccatgaagtatcccttcgatagggaacggcccagatctatttttgcattttctatttaattttgggttttctggaagaacctactatattaagaactctataagaccatccttattgcaagtctcttactataaatcttaggcataatataatcaaaagagtatgtgaatagttaagaagagtttcttagctaaaagataaaagaaagtttaagagcatcattatggttgtctctttgattagttcttaggataagaacatctcattttaactcttatataagagacaaatgacaaaatgtctcttatataagagtcaaaatgagatgttcttagtaattaatgatcaaaaaaaattctaagaactaacctaagaaactaccattaatgaagctctaagagcttcaaaccattacaaaagttcttagttacaattttttcaataaaacaattcattaagattcaaaattaagagcctatcattaaggttactctaagggacttccattgaacgtgctctaagacttattaattctaagtctagtcatgtttgagttttgtctataaagtctatatagatgtgagaagtgtcttttagtaagataatcataagaataatttcaattacaaacttcaattcaagataccataaaaagaaaattaaataaaacatagcacgatttactaaatctaacactcctcagttttctatttatttgatattttaggaggaaaactttattctaaatcaaaatatatggacaaattaaatgaatttacactaattacttcaaataaaaaaagatttgacatgtgaaaaattcccaaatctaaatgctaagaaaagcttgacaagtaacataacttataacccatttaattaatatatacaatgcatataatatatttttttaataaaagactttaatttatatttattctcaatatataaaagtaaaaatccataaaacaaattactcttaattttttttctattataatagagatttagaaaatagttataaacacacaattacattatacagtatactttatgtatttgttgtcacaaatcctttttatatatttatttatttgtttttacattgtctcaatagaattttataatgagtttcgtcgtcgatatctgtttgactttgaataagcgtcgtctatagtcttccactccaatctaagacgttaaacaaaccatctctcgattctctcgggaaaacactccaactacgaatctacaatcatcgagcacatacaaagaggaagatttcaaatccaatcatcaatcatctcttttgaatgatccgattccatctacttgctccttaaatttattgttgatccgtttgaatttggtgtttgttgaggcggagatctcgaagatg

SEQ ID NO: 12235 - DNA, 3000 bp, Unknown
  misc_feature (1)..( 3000): cDNA_ID_2708576_gDNA_ID_2214538_Annot_ID_134422 3000 nt of promoter + ATG
atgattcatttgatttgagtgtttagatcttcattatttagggtttaatagaaattgttgaaattagggtttcgtgaattgtggttttatgattgataattagggcttttatatgtaaacgaaattagggttttgtgttcacataatcagtcgttattacttttgatttttgccttttagattgatatgaatttgatttggtttgtgtatgaattgaaacataaacactcgtctattgcaatacgtggatttaattatttcagttgtgttcttgaatgaaatgagtttggttttatgaaatgagtttggactttagttattacgactaatgagtttggtctttaagaaatgagtttgtactttagttattactttgtgtttctgcttatgagtttgctctttatgaaatcagtttggactttagttattactttgtgtttcggataatgagtttggactttatcaaatgagtttggactttagttattactttcttttccggctaatagtttggactttagttattgctttgtgtttcggctaataagtttggtctttatgataggttgtattatatactttaagtgttttagttttgatcatgaatgaaatgagttttgagtttgtgtgttatataatttaagtgtttcagttgtgttctatgctttaagttctctaacttgtggttggtcttatcaaatgagttttgagttgcaggatcctgaagatttgagtggtgccgacatcacttgtacaagaagacaccacaagcaacaatttgtattgtgcgacagatgcggttgacaaatacctccggattggtgaaaacactttgatgtcttgtatgatacattcggttgaagcaatcatatatttgttcgggaaagagtatctaagaagacctacgcgacaagatcttaaacgactactgcgtattggagagctccgtggatttctcgggatgacaggaagcatcgattgtatgcattgggagtgaaagaattgcccgaccgcttggaaagaacaatatacacgtggatctggaaaaccaacaatcgaactacaggctgttgcttcccaaaatctttggatatggcacatatgttttggacctctaggtaccttaaatgatatcaatatacttaatctctcactagtttttgatgatataatataaggccgagctccaaaagtgaaatacgtcatcaacggaaacgactaaatcatttggcttactagctcacatatggtatttatcctaaatgacctacattatccaatctatttcacttcctcaaggtgacaaagattctttatttgctacaaatcaagaagtttgtcgtaaagatgtagagcgtgcttttggagttttgcaagctcggtttgccattgtcacaaatccaactcttatttgagataaagaaaaggtaggaatgatcatgcgagcatgtataatactttacaatatgatagttgaggatgaacgagatgagtatacttattttgatgcatccgaattcacacaaccggaatcaaccgcttcttcacaagtggatttcaactattttacagatatggcttcaaatctcggtaatattatggcgtctggagcctggttcgtgctcggactatgcatcaacaattgaaaaataatttaattgagcatttatggcacaaatttggcgggaatcaagctaaccactaatcgttattttggttttcaatatttatatcatgtatgtttaatatttaagtatttacattaataattaaattttatgaaataaaatatttgtaatttttaatttaataataatattttattttttaagaaacccgcttaaagacctaccattggacaaacaaaaaattaaagaaccaaaaaaatctcttaaacttttaaatttcaaaattatgattaaaaaaatatgaagagcccctaatggtctcttaccattggtgttgctctgagattgcatgtttatgtatctatgtttaggatatgcaaagttgattatgaacttgcttttgggataattgtcttctttttttatgcattaacaattttaaaatttttaggataacaactctattcaaagtcttttaacaaaaatactccattcaagctcaattgttactaaaatccaaaactttcgccaaaacttattttctcaattggttataattttcattgggtaggtttcaaaacaacatgttttgaaactatatttttttttacttttttttaaaattagatatctatattctaatctttaatctcctttgacaacattctaattataaattcacagaaaaattaactaatgctaaaattttcaataacatattttattattaataattaaattaattgttttgtcacatggaaagaggcaaaaagaaaagtatatatcatcacaataagatcttcatttcgatcctcacatgcattccatgaatgtgtattacatcaatttacaccttttttaaaaaacattatttcagaacagtattaaaacaaatttcgtggataattctaaagtattacatactctagaattaaatatatttccgtatttaaaaaactaagaatatatttttagaacaaaaacttaaaaataacaaagtaaatcgatagattgataaatatatcttctctttgctctttttcaatctgtaaccaaaatattaaaattcctcatgtatttatttctgatatcaactaattgttaaaaaatttttttactggttttaaatttaacccgtgcaacacgtggcttgatagcgttatataaaatattttgtttgacttgaatgggtcatctatagtcttcccagtcacacccaaaccgctcaacaagaaaaaccagatttattttctctggaaaacactcttcaagtcttttaccttccgagaatatatttcaaattctatcatatcatctttgatcattttccttgtccttcgaatttgttctttgttgtggcggagtcttgaag

SEQ ID NO: 12236 - DNA, 3000 bp, Unknown
  misc_feature (1)..( 3000): cDNA_ID_2708572_gDNA_ID_2214538_Annot_ID_134423 3000 nt of promoter + ATG
taatagtttagatacttatagaccgacattctgatcttcttctagcagctctcatataacccattgtcagtacattgtaaagaaaattttcggtttaccctcttagatttttgagagcgcacatcttcctggtgaaattcaagatataattgttatttcatgctcactaaaactttgaacacttatatgccatcatttcccattagagattgataattttatgttgtctctttgctgtgctttcgtttgatgtcaaaattccatactgaactggtgtttgcattgcagcaagcgggccagggagatgcacaatcaacaatggaggttgttggcatgaagagcgagatggacatgcgttctctgcttgtgtggttagtggtgtcttctgcgcttaagtgtataatctcacagtttagtaagatacttctgtctcaacttgtaatgccttcaggacaaggacagtgttaagtgcgagtgtcctccaggatttaaaggagatggtactaagaagtgtgaaggttagaccctctgaaaaaacttgaattacagtactactttgttctagttctaatcatcttataaggattttcgtgcttcctgcaccagacattaatgagtgcaaagagaagaaagcatgccagtgcccagagtgtagctgcaagaacacatggggaagctatgagtgctcttgtagcggggaccttctctacatcagagatcatgacacttgcatcagtgagtatttttttttgaatatggaagtctaaagtttgattattcaaatagtgtttctcccacctgttttccaattgttattggttctatttgtcgaaatctaggcaagacgggtgcacaagtgagatcagcatgggcggccgtttggcttataatgttatcattgggacttgcagctgctggtgcatacctcgtttacaaatataggctaagggtaagcttttttaatctcttctgctcttttgttttctgttgtgttaatagcgaagattaatcttgtatttgccatatccgttacttggggaaaattgttttaacattcctatgcccctggttttacagcaatacatggactcagagatcagagccataatggcacagtacatgccattggacagccaacccgagatcccgaaccacgtgaatgatgaacgcgcctgagaaagcaaaacagtccatctatttattccccgggaaggacccaaggtgacacgttcttttaactgatgtggcccttaacgacgatgttttctcgcctctgtatctttgtaactcttttttttttttttaccattacagtgtatttgcatacaaaagaggttcgagtgactttgtgcttttttttctcacttgtgtccatgggacttctgtaataggaaaactctgatgtaagtagcttcggctaacaagacaagagagagttacttgttttagagttcatgttgttaattgtttcctttttttttttttgtcgactaattgtttccttttatcttggaaaagtgtgattctcatttcatttatccctaaacaaaagaaggtccgattctttgtgtaagtcatcttctttttagttattaaagtaagaattatatttttgacttttgaaaatgtacttatacgttttatattcctaactttacaagtttaaattaatataataaattatgcaaaaacaaatttcaaaaaacaatatattggataaatatattgcatatatatttagttaatatttattgaataatttggtattaatataataaattatgcaatactatgtaactaaatatatattgattaaattttttacaaagatttttgttttaatatttataaattctagtttcatagatcgcgcatttcgcttatatcacagtttttttattaataggctatgttttttaaagtactttaatgttgtaatcttagtcactatttatttataagcataaaactataatttctatgtttttgtcgcctttaaaaaatcaatattaatactaaaatttaaactacatttaagtttgaatctctaaagcttgtgttaatggatagcttggaaagcttatctttccggagaacattattattgtacaatctattagctcttgattcttgaatttagttagtgcatctcctgattatgttccactttcattttcttctaattttaggaatctggatgcaaatccaggttaagtacatttagcttaatagaaagatgatttgactcggactgatgaaaatggtgccaagaccaaaactctaccactcggacgagtcaggtcaaaaacaactcaaattgactattgaaccatttttctaatctagaccagacaccaaaactctaccacagctctccgacattggtgggcctaataaattcccacaaatatttttttctgttttctttttctataaacggttggaattacatcttttgaacccatatttttttttgtactaaaatgattaaactcgagccaaaaaaatatcaatttattaggcaatcactacttgtataatgcaatttatggcgtgattagttccacaactgcatatagactatcgaatacttacacttttatgtttttaggaatgtgagtttggagtttgttaccgaaaaaccaatcaagttcaagcttaaagccttaaaccaatcaaaccatatcactttctatttttaggaatgtggatgcaaatcaacattaaatacatttagtttctaaaaccaatgttaccggttttgataattcccacaaataataagatgttcataaaaacgtggccaacaaccatttatgttcaccaacctaatcgcccctctctcaaaaaaaaaaaaatccaattttccaattttatttaacggtcacattttcctcattgcctaattaaaaacattcagacacaaatttagtttcttcttcttttggttctgtctgaatccaattttcttatattttatttcctccaccaccgtgagat

SEQ ID NO: 12237 - DNA, 3000 bp, Unknown
  misc_feature (1)..( 3000): cDNA_ID_3024323_gDNA_ID_2214538_Annot_ID_185160 3000 nt of promoter + ATG
ctctacttatgttcattttaggagacaatcaataatttcgttattatcaccatcaatctgtaaccagaaaataaaattaaaaataaaacctccaaaaactagtttggtttttcaatttttaaggactctacgttgacaaaaaaaaattgattgaacaaatatgagttaaaaaaaaaaaaaaccacaaattagttttacaaactcagaataatcatgacctaaactatgttagtcttttctcaatgaagagaaagaaaagattacaaataaaactaaaataaaaaaaaactactataatttcaaattaatgatatagtatatcatatttcaatcatctatctttttggtaatcaaatatttacattatcgtataaaagaaaaaaaaatcaaatacttatgttttttaattatcttcattgcttctttctcttctttattttagatctgattcgtataagacatattgattgagtagaaatctgtaaaaatatgttgtggtttatatgttatgaagtatattaactgcttttacaatggctacgtatcatctataacatatgtgttttaatgtttgtatgtagtaaattatgctttctatttgtactgctcttggttgtgatgtaattatcttgtatttaaagaaaactattgtgttttattcttatgcttgaaaaatgattggccactttggagatgttcagcccgttaacatacagctcagcccagtagtaaatcaatcaacccgcttgacccatcaaagagctcatatccatgaaaacccacctcgaagtcatcctttggatcttaccagcggatccacttgaagccgaagtcacattttctttcatttgtacaaatatcaacactaaatatgtgaaggtggagatcatctaaactatcaacaacctctttccaggcctaacccatgaaaaatttctatgaaacatagttattgggcctcattttgtggaggaataaacaaaggtattgggcctcttggtccataaagctttggtgcacctttccacgctttattttacaaataccaaacttgccgtaattggatccaagtagctttacatcacaacacttttttcttgtcattgttgctacgttttgaagatcctcttatcagtgactagccaaaaagtctacttagtgatacgatggtacattaagcggtctacaatttaatcagatactttgtagtgaagacttttctaatacatgaatagattgatgctgattgagcttattgaaagagatatataaagattgaaatgcaatagctctaatgagctttaatgaaatgtaaaggagagaaaggaagctttagattgtcttgaagatcaaaatagatttagatttgatttcatacaatgaagaaaagaagagttgctcaatggcaactctctaggctacattcatcaatgtcatacaccacatatatatatgagaaactctaactacaaaacctaatgacatgagcttagatgggcttctctactctttatattttgggctttatgtggcctcttatgtagaagggttatgaagagaagaattattttgatggtggggaagtaagagctctccatctgcatcggcatgtgtggaccatgagggatccaagtaaaggtaaaaaatatttcccgctaaacatgagactggcattctctaagaggttgttgtaaccagttagggacttagggcgttacaaatatgaaagatttggtctctcatttaaacccatatgcgggttcattaagataaacgcttcccacagtggatcttgtggtgattccttctttttgcttgtcgaaattggagtttttttttttttgtgttggattgtggattatttgaatggaagatctttgacccaccaaaccgacctttcgcttcgtatggtggatcagtggatgtctttatagaatacgtgtcttgcgtttgttttcgagtcgggtcaatctgttggtttaatttttctacgtcttggaaactatctccggggtgattgagcatgcatggtacaactaactaaagcagccttttgtctacgtctatgtgttgtgtttttataggcaataatagcaaattcacttacaacaaagagagacaaaaaaactttcaactaatatataagggatttttacgttttaacataatatggtttggataactcatttgtattttcttttgatctatactattatttgggaagcattttgtgaactacaatattgtgagggtagtttaatactagggtaaattacaggccacacccgttgaccatgttttattttcatggattgtcaaagtcaaatgtggttttcaccatttgccttttcgcctgcaaaatgacgcttctgcccttgcgcttctctcttagtaactgttgaaatgtacggtttagtttagcaggtttagttacgtacactgttccggttcagttgaagattttttgtttcacgttgacgcgattcggttccgttacaagtgagattattttcattattccgaagtgacatcaacatttaatgcccccaaaaagtttagatgtgactattgtcacaattaatgcaaaatcatcattacatcaaataatataaaaaaaattattgataataattaataaaaaatttgttgagataaagaagatgaacccatgaacaaagaattattgagaacgtacattgctgctgaagaagtgttgatcttgtttttgtaccaagtttggagcattgctcgtgtaagtaatgaagttcttttaagaagttttttgttatgtcatattaggatcttgattgtgttcgaactccatttttttatcagaatatttgcaaaatctatatttgtttgtttaaaatagtcaaatgataattggtatttaggtttataaatgtgtagtatcgacattccattcgttttttatatgtatagtatttttcagttgcatttaatgtgtgtctcctgaatttatgatgcaggtgggttatg

SEQ ID NO: 12238 - DNA, 3000 bp, Unknown
  misc_feature (1)..( 3000): cDNA_ID_3024331_gDNA_ID_2214538_Annot_ID_185157 3000 nt of promoter + ATG
atatatttatataaatatatccatattaattcctattttatttgtaatcatattttgtcgtgcgtgcaaggatcgtctctagtacaagaattatctcgaaaagtttgcaatcaggagtataaagacaatatcatatttggcaaccccaattctcctcttatgatcaacaaaaaagtttctctaaagatgtctaaatttaaacaattactatgctttaaggaaaataggaagagactaatattaactttccgtggcaaagtagaaaaatatataatagagaacctaaaggaaatttttgaagaagtcacatgtaatacaaatataacaatttggctctactgtatgatggaaagagatggttgacatataattttttattttattttattaacaattattgaaaggtgaatgttttaaaggctcaaaattttaaacttgaattttgttttaatagcaaaaaaaaaatatgaaaactgaatcattttattctgtataaaaaaatattattcttttttacatagattactagattctgacccgcacgttcgtgcgagatttcatattttaagaaatgtgttgtataaaatttatattcaatatagttttttttgtttttgtcatatatattgtagtatatatattataatatatatatatatataaacaaaattatcgattgttatttatgtttgtttatgacataatagctaatattgtgaactataagtcaaattctggagtttaaactgaaaagtagattagaaatatcttagatggaaaattatgctaggttataatgatgtcaagtatttttatataaaaaattatggttagagaattgcaatagaaatttgtgttatcgatggtgaaacacaagttaattttgataatgttgatttttcaaaattttaatggtatgtgtgaactaagaatttgtgttagcatgttaaaatatttaaataccgatgcattttttgtatatgtgttttgggctatatttaattggctgcttgtaaatccgtgttttgccaaagtaacttaaacaaataatggcaaagagaaaactctaatatcagtaaacatattatctatagttggtccatgtagaatttgtaaattgttttgtaagtatggattcgagtgcaaagctgagctaagtcctgttttctatcattgtatgttgaatttgttttatgcatatgtatagttagaattctctgatttaaatgattcttgttatgtcaattaacaaatccgcataatatgcttcattttgaaggatagcaatctttaaattttaattaaaatagaaatatttgaattaatgctagaattattttctagatatttaaaaatctaaaatccaaaaagtatttgttgaatatgctatattttaaatttaaatgatggtagtttagattatatatgataaatataataaatgttttttcatatttggaaaatcaagaaatcgttttttcaatgtgtaccaatcaaaattaatcagtttagttttattatggaaatttttaaaaatctaaactaaatgttatttgttattaaattgtattgttgttttcaaaaatatctaataaattattaccaaaataaataagtttacgtatatacgatttcgaattaagtagtttgatttgttatggaaactttattaaacgatttacaaaaagtattgggtagttttttttttttgtcgatattgggtagttattcatttattgatttaatttcggatttgttttttttttttttaattccaagatccgcttgtttatccgaatcactacatttggtattttattcccatatatttatagaaatgtattggaataaattcatattttttcctttaaatataattttggatttgtgttttttttactaataatttaacgtttatataatatattaaaggaaaaaacaaataagatcgtgtatctctaaacatattacgatttgatcaaaaacaaaatattggatagaatgtatgtcttttggttatgtacttaatttgatatagttggtaaataagaaaatatcagaatattctaatatatttataacattaatattattgttaaaatatatttaacattattctaatatatttatagattttattgttaaaatatttggtatttttcaattaatggtatttgatttatgttgaatttttttgtttaatctctaacaaattgaaaaatacaaaatatttcgatttatattcaaaataaatatattgatcctgaatattcagttatcatttaatatttaatgttatttcctttttttatttttgtagacaaatcataccaaaaatattgacgaaacaaatctgagaatatattagattatttaatctcgttatttgttttttcaaaaaaaaataaaagaaggatccgaatcaaagatattcatttaattgatatatttgttaatttattaaattatccatgcaaaaaatcatttagttagtattaaaagaaattttcacaaaagtggacgaaaaaagatttgtactcaccgtttgtcaaagtgagaactggtttttacgttttgtcttttcattcaatttcggacaaaattaccctggaaaaacttaataatggcacaaaccaaaccgtgcagcagttcgtatcggttaagttgacggcgtaaaccaaaccctacagcagtttgtttcggtttagttgatgcggttcagttttgaaaaagacaaaaaaaaaaaactgaaacgaagaaaccgagaaaacgaaaaagagaataacggagagatttgagagagaatcaaaaagcgaaacgaaattcagtatccattgcttcaaaattcgacataacttcgaattgttgggtagttgaattgagccactgaactcccacatccggtgaagtgaaagttactgtttttcccggcgaagccaagagaaagttactgttttttccggcgaaatttgaacctccggcgagatagcatctttagct

SEQ ID NO: 12239 - DNA, 3000 bp, Unknown; identical to SEQ ID NO: 12236
  misc_feature (1)..( 3000): cDNA_ID_2708572_gDNA_ID_2214538_Annot_ID_185154 3000 nt of promoter + ATG

SEQ ID NO: 12240 - DNA, 3000 bp, Unknown; identical to SEQ ID NO: 12235
  misc_feature (1)..( 3000): cDNA_ID_3024339_gDNA_ID_2214538_Annot_ID_185153 3000 nt of promoter + ATG

SEQ ID NO: 12241 - DNA, 3000 bp, Unknown; identical to SEQ ID NO: 12234
  misc_feature (1)..( 3000): cDNA_ID_3024343_gDNA_ID_2214538_Annot_ID_185151 3000 nt of promoter + ATG

SEQ ID NO: 12242 - DNA, 3000 bp, Unknown; identical to SEQ ID NO: 12238
  misc_feature (1)..( 3000): cDNA_ID_2711660_gDNA_ID_2214538_Annot_ID_134425 3000 nt of promoter + ATG

SEQ ID NO: 12243 - DNA, 3000 bp, Unknown; identical to SEQ ID NO: 12237
  misc_feature (1)..( 3000): cDNA_ID_2711656_gDNA_ID_2214538_Annot_ID_134427 3000 nt of promoter + ATG

SEQ ID NO: 12244 - DNA, 2046 bp, Unknown
  misc_feature (1)..( 2046): cDNA_ID_2708993_gDNA_ID_2214539_Annot_ID_134432 3000 nt of promoter + ATG
aagcttccagaggtattagtgctatatattcatagtgccaccgagtattttgaactccgaaatgatttctcactatccgaccactcccaattatataacatgcttagaattattcgtaagatggatcgtagttgcattttacgacaccatacaggacaagtccatgatagtttgagttggtggattttggaacccctgcaaatttattttatacataacaaaggccccaatccattccttagcatcacaacttgggacttctatcttttgaaggatacattcacttgttggttttggtaaatatgattgtttctttacttccgaataagcaatatataaaagtatctaaaaacggaagtaacttttgatgatcctaaaggttttgtaattgatacatgtccaaaaacctcttaatattctttctcacaaactgttgatggagttaacaaagggagacaaggtaattgggacaatatcaacgttagatacaggacaagtgaaaaatgtggggttgatgtcttcagctgcagcatatcaccgttggtatatattgtcaattattagtcctatggatttgaaacgtgttttagtaaataagagtgtccaagtgggacatttccaataacgtatcacagctcctagagcttttgctatgtttctctaggcctgggccgcctagcccacattccaagcaaggaaatgaatggagttgggcatcaaaattttggaagcatttttaagacaaattatcttttaagtttccttttttaaacataaactatattttaggcttttttaagataaatattatttggattttctttcactcatatttttggatttcaacttaacaaaacatagggcgtgtctatttgactccacctacccaccctactggagttcgatcccactaaatcgcgttatcccgcatagtagggattgactatggatcggactttgtcgatccaaagatatctaagaaattcagaaaagattgtataaaattcagaaacgattttacgaaattcatgaaaaatgagaaatacatgttttttttaatttacgtcggcattaaaaacgttggaccggctctgtgtttcaccaaagaaattgtttcagtttatgcatgatcttcaacttccatattcttgttttcaattctggaaatccctaacagatcggagctctcctcattcagtgagttggaagattgcatgattatataattactcttcacatccacatatattacattatattcccctataatttcatacaaccctagaaaagaatcttcaagtaatctaatcgtgtcgatgactccactcatttgctagaaaagaaaaaacaaacagacttcatttagctgaaaacaatcttttattcaacattacaaagcactgatcaaagaacctctaacatggtaatatatctatgacattttacgtatcctaaaagaaaacaaaaagtgatgtattggatgatgttttttttttttactttctagtttcttattacaacgacaaaaagagtccacgtcgtcacgcacttttccggtggtgaaaaaaatgtccaaatggattaaatctataatatctccagagagatcctctccttctatctttttgggctccacttttcctatctctttttgcccctttcctctctctgttcacaagtcatcttcttccttcctctgaatcttgttcctttttgctctctctacttgattcacccactctgtttctcgattagtacgttgaaaactcactttggttttgtttgattcctctttagtctgtttttcgatttcgttttctctgattggtttggtggtgagatctctatcgtagtttgtcctttgggttaagatatttcatttgattggtgggtttgttttattgaagcttattgttgtgaaagttggagtctttctcagtttttaggttgaattattaagagaaagggaagatttttggtgtgaagttaggttatttggggtttgagaagtttgcaagtgaaaaaggttgtgaattgtgagtgatg

SEQ ID NO: 12245 - DNA, 3000 bp, Unknown
  misc_feature (1)..( 3000): cDNA_ID_2708997_gDNA_ID_2214539_Annot_ID_134433 3000 nt of promoter + ATG
cttctgaaaaccccaaaattaagaactcataaggactagattatcacatttctgaatcaacgtatatcaattagaatctaaattgtttggattcactaaactagtaacatattagacgtggtgattgaagatttagacattatttgagcaaaacaaacgaaataggtaagtgattatagaaaagagagagagagagaccttggagagatcaatgtgtttgtagagagaccaatcggaagaacactcatgatcttcgcagttgtgatcatgcgtacacgacatttttcccaattctcgtcggctaaacacaaaatctggatttttcgccaagaaatttcgagaaacttaaaagcgagcagtggaagaagaaggtgggcatcaaactatcacaaggccgacaaaaagatattccaactacacgacgacgtattagtttttggaaacgcagcgttttttgtgttggtgtttctgataagcaatcataaaaatcaatcccacgcagcgttttgttcataattaatcttcttctttttttctctcaatgaaatgttgattctgattagtacattattaacttagaaaaatcattctacacatatcctaaatttaacatgcatcgttataacatctttacaactgttgatcaagttcttctcataatcttcaaatcaaacccacattcgaaaatatgaatatttgctagcttttccaaacaaaaagtatgttgaatttcacatttttgggttagttcgacatattttagaatatactataacataatctatgttatcttctatcatgcattgaacgatctctactctttttcttttttttcttttttagcacaaacaaactgaattttattaagattaaaagtcaaacataagtttcttctccttatccaccaatggtagtaaccatagacggttacaagcggaaactatcaaagcaataagattcacacatattttcaaggctggccatgagtacaagcgagccaaattcatatatttgcaagcgtaaatacaataattatctccaaagctttatcagcagaattagtcattcacttactcaaagtgttaaagggctgagagcgcgaacccttcttccttcatatcacttatctttaagcttttttttgtttttgttttatagggccaaatctttttctacgtgtagcctaatcggtcgatatgcatattccctaacttcccattaaactaaaggccaactatctcacttgtgtagcctaccctcggccaaagtgtagaatctttcaccgtctggataagtgttttagaatcactatagaaaatgacttccccaaaatttgaattcccaaatcccaacacaagacataactcaaaaagtttatttttagttctttatattcaaatttaccacaatacaaaaatcatttctacaagactcattccggcaaaagaaaatatttcaaaacaaatttaactttcaaatgattaatgtacatggcaagttacattaccaatctctattgtggaaatcaaaattaatttggaattgataagtttcgaaactaactcatttttcagctaataaacaaagatacacgtaactataacgatttagggaaaatgatcattgagtgaacgaatttagtctgattgctttacagtgacatttacgttacactacactaaaaggcaaaacatatgcatgattaatgcccaaaagcccaaactagtgtcctttttctttaactttttccacaatgaaacgaaacaacattcattttccttcttttaaagaggaatgatcttatgtttccccagccgtgaattgcctagcaatcaatcatatttcaaagtttaaagattaagtgaatttgccaaatgccaaggacgaaaatttatttaggtaaatgacaagtgttttaggtttttattagaaacaaacaaaaatatattgttcaaaattaagatagtaatatcacacgttattttatcaaaaatatttttgtaaaattttaaaataattgcattcaattcaagcacaaaacactttgttcatattcgaaattatttaatcaattttcaccgtattttcgctttgaaagtcagaaaatcttcgtaaccttcctctctcattcttttatgttcttgacacgagtttgtctttttccaaagttttttcattgaaatatatattttttttaaaaatcagaaaagaatcatggaagtaaacttgtagagccatcatacgactaaattgagattttctgaaatgagatataaaagatcactgtctagctgcacttgaaagagatagagataatagaaatgtttgtcttgcttggactattgtagaaatagatttggagttttcatttggaaaaaatattgatttcctctcgataatcctcaaaacaaactcgtattggacatactaacagatgataaccaatgttatatgttttcttaatgactaacaacgatatgtctattttagcttagtcaacggattctcgtgtttcaaatggtagtcaacgttttcatgttttgaataaccttgatgttcaaaatggtcacaatttgaaagttgactagcagaatcgtaaatgagtgttagagattgcattaacaactgataacatcatgtctattttgatctggtcaacgaatttttatattttaaaaattactcaatgttaattcacgatttaaaagaccacatataaaattaatgaataaattacaactttttaaaaattaggaaaattaaatgacaaagccaatacttttggcttttaactaaaacagaatatctataattaaaaaaaaaaaaatgtacattttactagcgtgtatagataaaacaagtaatggccaagcgttacgttggcataagaatgattcattgaatattaaaatttataaatagcagaccccgcctcgtcttctctccgaagattcttatccacgtcacaccttcttcgcctgagaataccacctaacaatg

SEQ ID NO: 12246 - DNA, 3000 bp, Unknown
  misc_feature (1)..( 3000): cDNA_ID_2994352_gDNA_ID_2214539_Annot_ID_134435 3000 nt of promoter + ATG
tatatgggaagaatcataaaccattcgttaacccttcaattttttaaaatatataaattgaaggatccctttatttgttttttgcagtttgtagtggactatccatatgaatatattacatcaatagaagtgacctgtgacaaagtctctggcaatacaaaccgagttaggtcgttgagtttcaagacatcaaaagacagaacatctcctacatatggacgtaagagcgagcgaactttcgtgtttgagagcaaaggtagggctcttgttgggctccatggaaggtgttgttgggctattgatgctctaggtgcacattttggtgcgcctcctattcctccacctcctcccacggagaaactacaaggatcaggtggtgacggaggagaatcatgggacgatggagctttcgacggtgtgagaaagatatacgtgggacaaggtgagaatggtatcgcatctgtcaagtttgtgtatgacaagaacaaccagttggtactaggagaagagcatggaaagcatactttgcttggatacgaagaggtgattaattatactatacttcgttgctattttcttaaactataactataaagttgtgttattgttattctgatgaaccgctttcacagttcgagttggactatccgagtgaatacatcacagcggtagagggttattatgataaagtgtttggtagtgaatcttcagtaatagtcatgcttaagttcaagaccaataaacgaacctccccgccttatggaatggatgctggcgttagcttcatactcgggaaggaaggtcacaaagtggtagggttccatggaaaagctagtcccgagctctatcagattggggtcactgttgccccaatcaccaagtgacgacgtccttgaactttattctcaaatcaagtttgatcatgcatatttgttaaggcgcctctctcgtattgtctccaccacttttctacgtgttttgttttctccgatgttttactttgaaaaatctatttcaatcaagcaatatcgtgtaataaaagcaaggttctcgaacctgcgggtaaactttttattttgaataatttattttcaatcaagcattcttttgactttttgctttaaccaaatgtctctagtttcaaaaaagattaagaactcaaagatataagaattactttcttattaagcttactttcttattaagcttaggaaaattactcaaaacgtaaacaatctcaaagtcttaatttctctaaactcatatagtcaaccacagcttgggactcatatatatagagattaataaaccaaaacatactaggattagcattagataactcctaacatatatctttagatatctcctaaagatttaacataatccttcttattctttaatgacttattgctcaagtcatttcaaacttactccaacattctcccctttaagcttgaaaacttcttttgacacctcttgtactccaatgagatctctcatctccaagaacttgatcttcccaagcgcctttgttagtatgtaagccttttgtcgaactccgagaacatgttctacttcaacttgaccattctcaacacactcccgtatgaaatgatatcttcgatggatgtgtttgcttctcccgtgaaacaccgggttctttgtgagagctatagcagatttgttatcaactcgaatctttactctctcacacattgtacctatgacttcagcaagaagtattaatatgattaagaacacttaggatttaagaataactctcttactaagcttaggaaacttactcaaaacctaaacaatctctaagtcttaatctctttaaaactcatatggtccaccacaacctgggactaatatatatagagattaataaaccaaaatatactaggattagcattagataactcctaacatatatctttagatatttcctatagatttaacataatccttcttattctttaatgacttattgctcaagtcatttcaaacttattccaacaacgtcaagtttctatgtttgatgtatctttcgctttgttacaaggaatacaaaacaaatgttttgaatatgtttaatccctacagcacggggtgatgttttttcgaagtaacattagttaataaataaaaactacggttgaagtatcatattcggtaatataatttgtatgtatctttattttaaaattttaaatgtggttggctaatattgatgtatgatattacatgttgttaacatcactgtagatctctttgattagcgtaggctaatcgtgattttggctgactggggttgtcggagcccctgttagtttcgtgatttggtttccattggtctggattaattttgactggttttggaaaaggtgcgttggtcatcggtcgatacaaccaataatctgaaataattgtaaaaaagaaagtctattgtgaaagtaaggaaacaaaaatcaccaaaagccaggagaacttgagaaaaaaaaaagaacatatttaaaatttgatggagaagatcaagagaatccgatgagaaaaaaaaaagaacatacttaaaacttgatggagaagatcaagagaatccgacctgaaacacagtaaaaagagaagaattcaacaacatcatgataaacttttcaatccacaaccaagccaaaatcaccatcatcattattattcaaaaatgaatataaaactaaattaaatcacaaccacgtagtaattaagcgatttttttcttaaaaaaaaacataattatgtagagagagaaaaaagttacatagttaacaaaagtaaaaatggaaaagcggtaaaaataaaaagtaaaaagggaaaaatatctgaatatatatataacagcaaggtttttgtccgcatatataaataatcgcgtgtgtgttcacctctcagttgttttccttcttcttccttatctccgcctctttctagggtttctctcaaatcagctcttcaaccatg

SEQ ID NO: 12247 - DNA, 3000 bp, Unknown
  misc_feature (1)..( 3000): cDNA_ID_2711703_gDNA_ID_2214539_Annot_ID_134436 3000 nt of promoter + ATG
tataattccagtgaaaaaaagaaatcgatgcaatcaagcggaagaatgaatcatagaggagaggaatattacagggagattcgaggaggaggaagaagaagatgacgaaacagcattgtcggaaattagatgcatgacaccgcgagtctcgccgattctagggtttccagaggaaaaatgaactgtctgaatcatatcggagagagaggattcaccggaaacgcttgccgagttcatgactgttcacttacttgcttcgacgagccttttttctccagaaaacaaaagatgtgatccactgcacatgaaataataagacgaatcagttaatgaggatggaaagtaatacagcagagaatttagtacataatgaagaacatctataaaaaacaatgttccctctaacaaagaaacaatgctcaagcagcaaaatttgaattcaaccaaacagatcatcaaacctacgcatacccaaaacccttatttgattttcaattcatataaaacacaacgaacctgtttctatcaagatatcaccttatttcgtattttaattcatataaaatacaacaaacctatttctagcaagagacagacaataagtatctcgagtttatttagaagcaaattaaactaaagcaaccaaagcttgaattctgagcttaataatgctgctaaacgaagcaaagcttttttgaacagagataattcgacaaacaaagtatcaagacacaagtaataaacaaattcatctaagattcacaagaaaacagaaacttgatctctaatatctcatcacaagtgagagctttcataaccaacacagacacggaatcaacaagtagtacagagagtatctaaaatccagtatcaataattattagcttgtatctgtaatgctcccgattagattgtatctcttgaattaacgtttataaacattagagaacacacacttagctccatacataaacaccaagcagcatatatccaaaaataaacagacacaagtaattacaagctctaccaaaaacaaactctacatattctgtgaggcatttcatcaaacacatggttggcatcaaaggaagggagagagaaaatagcaaacaagtgaaatttggacaaacccacaagctgaaatcaaaggaagcatatgcagaatcacaattaaaagaatagcaaagaacaaagcgatgaagttgcatcaacactgagagaacaaaatcgacgagactatcacatgaacgaaaatttcagagagaacttattctaatcaacggattcctattctaatagaacttaccagaagtaggagtcgagagagagcttcgtcgccgagagagaacaaaatcgacgtgtgagagagaagagaagaaaaccgatgtgtaattgtttagttgaagatgttgagttggtaaaaaaacccagcccagcccgaatctgaattgagcccgcccaccagaagcccaaattaaaaaaaaaactgatgtgtatcggatttaatagtaggtagacctgaaaaaaaaaaacgatagatactgggcctgtggataccggaacttttatacttgagtttttttttgtttttttttggggtatttatatgtattgattttcatacatgttcatctaaaattttctatatattcatctaaactctgttaatttttttaaaacttatataaaataatatatatatatatatatatatatgacggaaaaatataatcacaaaacaatgttcataaattacaaacttcctaaattacaaacattaactataacaagataatttgtaaccaaataaatagcacaattgcaccatttttctgaagaaacttggtccaacggaaatacgaaataatcaatcatccaaagttccaaactaaaagtaagcttgcattctagttatattttttagccataggagtatcagaaagaaggaacaactcgatatcatgtgttgtacattagcatcgtgttgaacccttggtcctcggtttcaatttctctctttgcgaaccggccattaacttgcggtctcatctctgctaaacgtttagcttttattgtcactgctaaacgtttgttttggattattgtttgtatagttgttctatactcgtgtctatcataaacattaaaatcaagactaataccaaaacacaaatcaatatactaatttggaaaaaaaaatcagttaagatcgtcaacgaacgactctcgatgagaaaaatttatgagaggtgtgttgagagacgtgccttcttaattaagtgattcgtccgagatgagatctctacaagatctgaagaacctctcattgactttcatatcttctacaatttatatacatgttttggactaaaaaagctatctatatatatatagcctatataggtgaagtttgtatagtaatggcgagaacatggttcagtattagccattattagtaaactgacactaataatgttaaaatatcgtcctatactcgtgtctaactgcatgtctatcatgtacattaagatcaagactaatataaaactcacaaatcaatatactacttaagaaaaagaaaaaaatctggttcttttttattcatgcacacacatagtataagttaaaaaatgaccatattaatttgtaaactgaccaatcgtgtatataaaaggacaccttctctacctacttatatattatacatcatttctctacattgttcaccagctctctccatctctctactccaagcataagaggtaatctctcaatagtttgaaacaaccttttgtaaaacgtattgtaacttacttaaaattgtagaacgtgagaaatatcttaaatgtttaaagtcttcctttttcacccaagaactgaaaatgattttgcatatatattttctcaagtgggtataatggatataaagaaattatacaatgactaaggaacaaaataaaatctcttttattgaataatgatttgaatcagttctcgatg

SEQ ID NO: 12248 - DNA, 3000 bp, Unknown
  misc_feature (1)..( 3000): cDNA_ID_2711699_gDNA_ID_2214539_Annot_ID_134438 3000 nt of promoter + ATG
aaaaaaaaagagttcaggtagttctatatttaacatgcttaccgtttgtgtgaaacctttacccgagacaccatgaattggtccaacaactgtttgtccagctttgacatactcaaacttgatgaattggattccttcaagaccacctcgtacatgtatctttgttacattttcatggtcggctccatcatcccattgattccctccctttccgccttttgcctccaacctttgggccatcgagaactgattcaaatcattattcaataaaagagattttattttgttccttagtcattgtataatttctttatatccattatacccacttgagaaaatatatatgcaaaatcattttcagttcttgggtgaaaaaggaagactttaaacatttaagatatttctcacgttctacaattttaagtaagttacaatacgttttacaaaaggttgtttcaaactattgagagattacctcttatgcttggagtagagagatggagagagctggtgaacaatgtagagaaatgatgtataatatataagtaggtagagaaggtgtccttttatatacacgattggtcagtttacaaattaatatggtcattttttaacttatactatgtgtgtgcatgaataaaaaagaaccagatttttttctttttcttaagtagtatattgatttgtgagttttatattagtcttgatcttaatgtacatgatagacatgcagttagacacgagtataggacgatattttaacattattagtgtcagtttactaataatggctaatactgaaccatgttctcgccattactatacaaacttcacctatataggctatatatatatagatagcttttttagtccaaaacatgtatataaattgtagaagatatgaaagtcaatgagaggttcttcagatcttgtagagatctcatctcggacgaatcacttaattaagaaggcacgtctctcaacacacctctcataaatttttctcatcgagagtcgttcgttgacgatcttaactgatttttttttccaaattagtatattgatttgtgttttggtattagtcttgattttaatgtttatgatagacacgagtatagaacaactatacaaacaataatccaaaacaaacgtttagcagtgacaataaaagctaaacgtttagcagagatgagaccgcaagttaatggccggttcgcaaagagagaaattgaaaccgaggaccaagggttcaacacgatgctaatgtacaacacatgatatcgagttgttccttctttctgatactcctatggctaaaaaatataactagaatgcaagcttacttttagtttggaactttggatgattgattatttcgtatttccgttggaccaagtttcttcagaaaaatggtgcaattgtgctatttatttggttacaaattatcttgttatagttaatgtttgtaatttaggaagtttgtaatttatgaacattgttttgtgattatatttttccgtcatatatatatatatatatatatattattttatataagttttaaaaaaattaacagagtttagatgaatatatagaaaattttagatgaacatgtatgaaaatcaatacatataaataccccaaaaaaaaacaaaaaaaaactcaagtataaaagttccggtatccacaggcccagtatctatcgtttttttttttcaggtctacctactattaaatccgatacacatcagttttttttttaatttgggcttctggtgggcgggctcaattcagattcgggctgggctgggtttttttaccaactcaacatcttcaactaaacaattacacatcggttttcttctcttctctctcacacgtcgattttgttctctctcggcgacgaagctctctctcgactcctacttctggtaagttctattagaataggaatccgttgattagaataagttctctctgaaattttcgttcatgtgatagtctcgtcgattttgttctctcagtgttgatgcaacttcatcgctttgttctttgctattcttttaattgtgattctgcatatgcttcctttgatttcagcttgtgggtttgtccaaatttcacttgtttgctattttctctctcccttcctttgatgccaaccatgtgtttgatgaaatgcctcacagaatatgtagagtttgtttttggtagagcttgtaattacttgtgtctgtttatttttggatatatgctgcttggtgtttatgtatggagctaagtgtgtgttctctaatgtttataaacgttaattcaagagatacaatctaatcgggagcattacagatacaagctaataattattgatactggattttagatactctctgtactacttgttgattccgtgtctgtgttggttatgaaagctctcacttgtgatgagatattagagatcaagtttctgttttcttgtgaatcttagatgaatttgtttattacttgtgtcttgatactttgtttgtcgaattatctctgttcaaaaaagctttgcttcgtttagcagcattattaagctcagaattcaagctttggttgctttagtttaatttgcttctaaataaactcgagatacttattgtctgtctcttgctagaaataggtttgttgtattttatatgaattaaaatacgaaataaggtgatatcttgatagaaacaggttcgttgtgttttatatgaattgaaaatcaaataagggttttgggtatgcgtaggtttgatgatctgtttggttgaattcaaattttgctgcttgagcattgtttctttgttagagggaacattgttttttatagatgttcttcattatgtactaaattctctgctgtattactttccatcctcattaactgattcgtcttattatttcatgtgcagtggatcacatcttttgttttctggagaaaaaaggctcgtcgaagcaagtaagtgaacagtc

SEQ ID NO: 12249 - DNA, 3000 bp, Unknown
  misc_feature (1)..( 3000): cDNA_ID_2708596_gDNA_ID_2214539_Annot_ID_134439 3000 nt of promoter + ATG
tatcttttcctcgcccattagtattttgaaaagttgctacaaaatgtcaaagaggaaacggaacagaaaatctcagaagctgcgagcaaggcaataagccagagactgcagaagctgcaaaccaggtttgacagatgtgtcaaagagaagcaatttcttgaagatgtgagtctctatctagctttcgttttaaaagtttttcttgatggcatatttacatctacttacatttctgtagagtattattgacttgttgttttctcatgtgtagttgaacgaaaatcttgtgaaaaataaggacgtatggagcaccaagattacagaaatgaaagaaaggtattatctatctagcaaatctcgtcatgggaaattgtgcatattcgctagcttgtgagaccatgctccatttctcattgatctttgatttagggagaagaaggcagttcgggcaaaggatgaaaagattcagggcttagaagaacaggtaaagaaacatctatagacaatacaaccccctgctttgttggttatataataaaacacctactaaatcggttattcacactctcagcttggaaacctaatggcccaaatggatggtgagagtgaagtctcagagacgaaagaggtccaggacgccactgtctcgaccaccaatacctcttcttctggggcagggaatgttatacatgcaaataaaaagaagagtaacagaagaaagggttagatcaagattcaaactctaccaaatctcgcttagactagtcgactaaagttcaagcaatctaactgcttagaatgtctagatctaacaattcattcgtgttataatgtgtgctatgatgagaatctgagagaaacgtttggtagttgttgtatcaaacctgatagaactatagccgttaccctcttggtgtatataatacaattggttgatatcaatattaaaaatcgtagttacttgacggtaatgccatcactatgcataccgttggaggtttcataagactttaccccatcttatggctttatcttctaatttcctcttttcgtttataatcaaattcaattatttttcatgtcactagaccggttagttatagttttacatttgaagcactaatttcaagagtcaatgatacttatgataaacaaattctatgggtttgaaagttaatccaagttaaatgactgaaacccatattgtaccaatttggaattagaagtccattatctctttcagatggtgtctactaacacacaagatcacaagaagaaggtgcaagctataaagagagtagacaccatctgaaagaaagacataattggactctcacataaaacacttggcttgaagcgaaaaatgcttttgttttccattcgttgttctatttgtcattggtggtgctatgttatgttcgtgttgatctacgcatccgggggccacatgaccatgggcctcgtttgctaccacgttgcttcattgccacttgtaagtcgtaagtattatcatgcggtacaacccttcaactatgtcctttttttttttttttttttttttctcttctaacaacaacctttcaaatatgtcatgtagaattattgggtatccgtattatgttcatgcaatttttaataatttgtaactacgattaaaaaatatatattttatgattatgcaatcacataattatgcgctatttttttatttaaaagcaaaataaaataaaattatcctatgttacatattttcacgctttgtgttggattactctacgcattaaactcttaaactaattatttgtgcatgaacaaaaaaattgtgttcttaaactaagttaaaggaaacatatatgagagggtccttttaatacatctgtaccacctcccctggaggataaggcttgtaagtggaatgcacttcatcgtcacatagttggggcaaagatatccagggaataaacgcattgagtaagttttggtccatgtctcttcttgtgtatcaatgtccatatggctaatttccaatcagaaagttcagcactgccactaaccatggctagaagatcttcaaggttgactagcggccaggtgtaggtaatgcgcgcggtcttgggacacatcatggaactgttcagtgtgaagatccaaagatagaatcttgtaaccattaagtacttcgaaccagtagatggaaccattcacaaagaccgaatgatgtctggcttcgacatagtaaggaggcggactcggcattgtccgccattcaccaatgtttaaatcgagaagttgtgcttgatctcggtttagttggatgagccacgaatgctaggcaatgcgtagggcattgaatatcatttggagtgaaggttttgaatccctcaggcagcttgtgaaagagcttccgtttagcgaagttatataaccaagacattcatgttgcttttcctttatgggctatgtatatcacggtttttccagtttcccggtttttcaaaatcgttatcattgcatctcgacaccgataagattcatagcttaaagttttgtcgatgcactgaagtttgagttgtttttgctttcatgtttactttggacctttaaaactggttttgcaatctgtaaaatctgtaaacgtacactgattaatgatatttacattcttagaaaagaaaaatgaatcatcagcccatgtgaacatatcgaacaatgtagcactttctcaaagccaacacaaccgcccgcttagcttacattagatagatcaggcagcctttcatatgtaaagataagtggcggagaaaccagccatcaactattgattagtcaacatcttatcttctatcattagctatttacgatttaatatctacttgacatgtaaaagactaactcttcaccagttcactataaatagaggttgatattgtgcttatatcttcacactacacacaaatacatacaaacatacattaattggaaactgaaagtaatataatc

SEQ ID NO: 12250 - DNA, 3000 bp, Unknown
  misc_feature (1)..( 3000): cDNA_ID_3024373_gDNA_ID_2214539_Annot_ID_185194 3000 nt of promoter + ATG
agagcgttggatctgagtttgatttgggtcgttggatttggaagagaaagatgagctaatggcgatggtaccaatcataaggttgaggaagacgaagagaactgtcggagtgaaccaactatacatcgccgtgagtacagattccgacatatctaacatagatttttgttttggttgtgttctttgttcggagagaaaaggagaagaggaaggagatgggtgcgtttggtttttttcggaaagcaaatagaagcacatgtgggaactgggggtatttttggtatttgatgttctcacttatttttcagctttgtttttttttttttgtgaagagtgagatggtggaagacaaaggagggaagtggaacatgcttctagaatgtcacatccactacaattttgtttggtttatttcaatttttatgttcttggatttttaagaattatttgttgttttcttatggtaaaaaaatgtttcgttcgtgtaaagactaaactgagaaataaccattttgatgactagtttttaaacttgaagcttatcatttgggagttactatagagtgtctcctcggttccggcaatggtggagttaggagtcgaaacgtgtcattttatcttccctttattatatgggagaagcccaattttgagtggattgcgagctttatgacaccaattttacgattcagttttaaaatactacaacttgtttataaatgatgataccaattcgaaaaataataatttaacaaaaaaaacttattttaaggtttaaaaagggtttgttggaaatataatcaactttgggaacataattatgaaattaataacattactatttataatttgtaaaataaacatttttcactatttattatatttattatgtatactaagatttgtacaacatattaagtatttgtatgaataaatatacatattttatttatatgtacagtaaatgagttatacgaatgtaaatgtatatatttgtataattaatgagatgtacaaaaaaaaatgaatttattaaacaaaatgcatatcaaattatagagaaaaatatgggttttttgtgtagtaaaagattttttaagaaaaatatactaataaatattttaataattaaactagaggaaaagtgaaaaaaaaaaatttgggtccatcacctattttgcaaatgtaaatagtaatattattagctttataaatatgttggaaaaatgttaccattttgcaacatatctcctaaacaaatgtggtgtggtgataacatcatcaataattaaggttatgttttaaacatagcatgatatcatgtaaattttaatataattggcttaaataacatataatttgtttgaaacacaaacctatatatcccatgctatttgttaaatacagtgcgagaaatgattttttttatttacaattttttatctatcattttacgaacaaatgatcaagatatggttggtattttaattatgggatgatttttacccgttggagataaattttaactattaacaatcgacttgtcacgatttgatacgtagaaactcgataattttacgaaaatcaaagtaggatttcccacattattagcgttaagagatggtctgctacatcaatctttcaaaaagtatacgtaaccgtgcaagcacattaaaatgtaattcgtgaaataagctttcaaaagtaaaatgtaaaacatgaggatcagatactcttatcagttatcactggtatttcccgctctattgactattaattaattttgagatattttcacctaaaatgagagatatttaaggcaaccaaatgagcaatctataacattgctttagcatgagcgaattactcgaatccgaatccgaaaaacttaatccgaacccaactcgaacccaaagtctaaatatacctgaatgggttttagatttctaaatccgtaaaaaccgagtctaaacccgaccaaaatactcgaacgtccaggccatcattgctcaatactatgcgtgtccaatgcaatgtacctcaagccaaagatatccaaactctacggttcctttatgttaacattataaatttataaccattcgggcaatccgcactcattaccctaccatattacttattataatgaaattatcacataccgggcatttattccactaatgtggttcgggtaacattgttaagaaagccaaaacattcgaaaataagattttggtgagaaagttctacaatatattacggcatttatattcttgtcaatgtgtctcttctcttgtgtcctacatgcccatttgtatttttttctgtatatgtgggtttaagcccaaaactctaatgattttttcagcccaaaggtgaacatgtacatacaactttcttcaaatgtacataatttaataaattaggtagaattagaaatttttagcgtaaatttgatagaggttaaaaataaaaagtgatccaaattgagcgtttataatacaaatgaattgtcacatacatgataaaaaatgtaaaatcacttacataaaaagtgtgttacacaaaagttattgcaacggtatctaatttgacttccaagttagacttctctcttctaattggttagatattttttcattattcagatttcagatgttgagcttattttgtgtcatatactgtactcacatttaattttgtagtacttctataatacattttggggcaattgaatctcataaattgtcatgtgaatgcattcattgcatctctttcttagttctgtaataaccaaaaataatacaggaattattacataacgaatagatttcgtgtaagaagagagaatcacaaaaagaggaaaataattagattcgccacagtttcacacaccaccctcactaaaagcaaatagacagatctaaaaaaaaccagagtgaccaaaattatcccaaaacccaaacttacccttagaccaacctcagatttacgataatg

SEQ ID NO: 12251 - DNA, 3000 bp, Unknown
  misc_feature (1)..( 3000): cDNA_ID_3024376_gDNA_ID_2214539_Annot_ID_185193 3000 nt of promoter + ATG
tatccgtgactgtaattctttgttgagtttatcagttttggtgacagatactgaatttgtcaggtacgagaaacaaggcaatttgattggaaatgaatactttttacatgcttatggaccgatatacgttctttcagccgagatagtagcttcacttgcagcagctaggaatggcaggtttgaaatgtttttgatgtacctaactagcagattttgatatgcaaatctcattatcggtgtttttcatttcagtctgagaatgtttaataatgaagatgtaactatcggatcttggatgcttgcaatggatgtacatcacgaagacaaccgcgctttatgcgatccgcattgttccccaaagtccatagcagtttgggacattcccaaatgctcaggtaacattaatatgttctcacataatagcaatagcagtcacacaagaatcaattagccaagcttttcttctcaaatctttagggctttgtgacccggagagtcggttaaaagagcttcataagacggatatgtgctccaagagtccgacattacctcccgatgacatcgatcagtagtttgtttcaagagttgcccccacttgaaacttcttgagacagttctacggaatatatgatctcaccacaagcactagagttccgacatcattggagctgtatagggaaaagatgacttcatggttcttacatgatctgattttaatagttgttgttagattgtaccacatatatacactgaaactatatgttatagacagatacatcaatatccctttttgtaaaattagatttatgtgcccagtataggcactgggtgatggatgatacatcttgtttcatttgtaaaagaaatcaaattcaatctatttatttgttatattaatttttttcatcaaatactgtttcaaattttatgatacagcggagataaatcagacatgagactatgtcaaaattgcaggagaattattctaaagataaaaccgtttagtggatttggttaccaaaatgttgatatggccgagttggtctaaggcgccagattaaggttctggtccgaaagggcgtgggttcaaatcccactgtcaacataattattattattatttttttttttaaatttatatataggcttcaaatcaaacagtgacacttttttggtacaaatcaaatagtgacttatatattagagaaattgttggaaaaaaacaaatgtgatatccattgcttttgcggaaacgttgacaaattattggcgaaatggtgacttatatatttgagcaacatacacactcgtttttatcttatttttatccaaaaaggggaaagtagatgaattatgtggattttattagtgaatatgtgatgcatttcattagtgaatttgtttgtttcgaacacctaacaatcaattatgtttgagaggatattttcagggcggtcctgaggagagcaacatgaaacatttgtatgtgacctcatagtttttttcaaaaaattacattaaaatttatttgtaaataggcccccaaaaatatttaatttgaaaaaaaccttaaattgcaaaacagtttatactccctccctctgttccatcaagattgatgttataggttttttttcttgttccaaaaagtttgatgttttagatcaatattattagtatttttatttgtgaccaatatagagaagagaaaggcagtgtctgatattattaaacaaacaaaagaataataaaaaaataaaaagttatttttcttaatttgtgtgaaaacccacaacatcaaacttcatgaaatagagggagtattaatttcaaaatatataatttatggtttagaccccagattgtcatgaccgaccgttgatactttgcatagcttagaactttcatctctgcgtgtagtagagaatgactagtttggtaacctaatttacttatagatctttaaacatatagatcatttgacccaatttactgccacgcgttttaaatgtactaactactaagtatgaataaaatgatcaatttgagtcacaaaaagtatgtttattgtgatcaattgtgaaatgccaactcttttacaggtattactaggttgatgggaaatattttgctagggtccccgaccaaaccgcactaacaaaaacatgaaatttaattagaaaaaaaaaagttgcaatatttggaggacgatagttccgttgtcaaatgatgaacaacgaagaaaccgtacattgatgagataagttttatgtgaaacacatcttgccacctatatttatgtaactatgtgaaccataataatcataagctctttacaatatattttcttagttttgtttgtaaagcaaatttatggaagaaaaaaaaaattgtcgtccacatatttccaatctcttccactttgattctcttccattcaatctttcttcgaggtttaaagcattttctatgatacaaaagtataagagatgtgtatccagttgcaaaacttatactatgaattgactatactattttgataatttctataaccataacggctgcatgaactatatacttaaaactatgactacgatagtcgcaataaatgtatcgtactatccttcgaactcttatacgatttaaaaccttagcatatcaaacatttaaatttctagatagtgatatcaaaatcctacagccgcaatttttccagaaaaaggtgataattttttttttttatcagcatattgcttcgatgcaaaatacgtggaatctatgcaaacaaatttgtttcttctgtatagttgcttattgagttgagtggttgtcagtcaccaaccctcttcagatctcaaagccacaataaaatacgttaaattaataattaccaacctcaaaactataatctatatatatatatatatataatcagcattttcttcagtgtctctctactctctctcagatttgcatttgtttttttttggtttggttatg

SEQ ID NO: 12252 - DNA, 3000 bp, Unknown
  misc_feature (1)..( 3000): cDNA_ID_2711678_gDNA_ID_2214539_Annot_ID_185192 3000 nt of promoter + ATG
ctaatggcagatacatggaaaaagccgtattcacgggaatacgcagccttccccgctccatggctccgctcctccaagttctggcccactacaggtacttgaaaactaggggtggcatttcccatagaaaacaatttgttatttgtaaatcgtttcaaaatgtattaaatatgtgtgaaacagggcgagtggacaacgtgtatggagaccgtaatctggtgtgcactctccaaccggcgaacgaagaacaggctgcagctgcagtgtctgcttaaatgaagccactatgaagcgattcgcactcgcaccaaaacccacaatggggcgattcggactcataccggatccagaaacgtatctttactggcttttacttctcttcccagcctcatcatcactttcactttcacttcctgtacaatgtacatacgtagtcctaagttcttccctcatttatttaataaaatacatttctttatgttccactttcttatacgtataacattccatttggatgatgtgatcaccatcgtggttatatttatgccatatgatctctttgaaaaaagtttgaattcttaggatatttattgtttcattttataattaggaaatttggcaaaataaccataattctaggttttataaacaaactgactgacaacatataggttctgaatggttgcatgtagagtaaaaagtggaagtgaaggagacaaaaaaatttagtgaaagaaacaaccaaatattaaaggaaaggaatctaaattttgaagtagttattttttctctctcctttgggtagagttagatttttttttataaaaaaaagcttaataccaacttgaacttcctttccaaagaaaactaggaacttggtagagttaaaatttaatttcacttttctacattttggccaaaaaaaaacaaaaagcagttctaaccaatgctaatcttttctattttagagacacacattggaacaaaatcaactctaaaatagtgaaaaaaaataaaggtaggacatgggagatgctcttatgtttctgctaattttttcaattgccactaatcagacttgtagcattattctactaaatatcagattggacattagatcacctatactaaaaccatctccaatggtcacctctataaatagaggaaaatatagaggtcatcattagagatgccctaagtccttgaaccaaaacctgtatttcctcacagaaaatagattttctgtatagccacattaattcattctaactagactctcactgaatctttgagaggaccaacctcataatgattttttcctatcctatatactaatgcttgtttttttttttcttccgaaaggtgattaaaggagcatattctcatcgagccctgttcggttacctctctagcaaacaactcatctatcctacgctttatcactattttagagcacctgacatttctcttaagaacaaatcaaccttgtaaagcatatgtggcttgattcaaaaagacaaacactagtgatagacgcaagaaccctaaataaaaaaagttttctagattctcaaaaccgttaggtctgacagacatatataaacaattatcgaattgttattaattaatacgatgtcactctatacctataatagagattagggtttccatgtgttcatttatccaaccataattaataacgacaacggtaatcaataagacacattaagattgatcggtcaagagttatgagtttcataagtcatctccaaattttgcggaaactaaatatttaaacatcggattctctgtttgtcagttgtcagatcatctgactcgcatgcacatgattcgtctcaaaaaggcaaacacgaatgatagatgcaaggaccctaaatcaagaaagttttctcgattcttaaaaccgttacgtccgacagaaaaacataaacaattgtcgaattgtcataaatacgatgtcactctatacctataatagagattgaggtttccatgtgttcatttatccaaccataatgaataacgacaacggtaatcaaacacgacaaattagaaataatcgttcaagagatttgagttttatagattgactccaaattttacggaaactaaatatataaacatcggtttctttgttacaaaaaaaaaacattggattctcttcagtatttgagcttttattactgaaaatacaaattttataatttcgtagctctggattctgatagtaaaactgcaattgagaaggatattcaaatatttcaaaattttctagtaaaactgcaattcgtagatcttttttttttgttcaaagttttgataaagcaaacgtccctttttccttaaaataattaacttagtatataataataaaattaagacagtgcagtaattgataaacaaccaaaggttcattgtacctttctccattgtcttcaatgaattcctaaaactagaagaagcgttactttagaaaaccaattataaaaatctcctctttcttcatcaaattccacaaagcatcagtttcttctccttctccaagctctcgcatcactttcatcgatttttcctctctgcgtcgatccttcagacatcggcgtcggagtttccgacaggtaaatgtaaaacacagtccactgttattccctgcttcttagctttccattatgattttttgttgtgatttttactgttttctacggaaatgcttttgatgggttttgtttagtttccggtgaaatttacagagaaacccacaatgctgaaaatctgaattaggctcaagttaggagattactacacaattagtgctgtgagaatgaatatacggacatgctttgttaaaaagattgaaacttttgcttcattttgatcaaaagattttaactttcgattcttttagtaaatgggtcgctctttgtttggactataatgatcagactgctcttgtcttgtgtgattaggaatctaaaaatg

SEQ ID NO: 12253 - DNA, 3000 bp, Unknown
  misc_feature (1)..( 3000): cDNA_ID_3024388_gDNA_ID_2214539_Annot_ID_185188 3000 nt of promoter + ATG
aagattgttttcaccttataggttaaagatattgagttcaatttacgccaatgtataaatcctctacataaataagaagatggaaactctttgacaaaatgggcttataaataagaaatgatctagtttttgtattccctcttgtttaatatttttacccacaaattaagaaagcataaaatattcatttaattgttctctttacataaaaaaacattattaattaaactgaattcaactaatataaaaaatgattgtaaaatataattggtataaaaatgcatttaatttgtataaaaaattgaaagcatcacttaaaatgaaactttttgtttttgctaaaacatcacttaaaatgatacgggaagagtataagttagaacaagagttaatatatggacaataaacaaacagaaagggataaatccgtccaaagaacaacacccatagatttgtagtaatatataaaaaaacactcatagctcccaaaaaaagaactgtcttttattctcatctctttcacaaaccccccaacctccaacaagaagacctctctttcataaaaccctcacacgtgtgactgattcatcaccatgagctcatccccggccgtgaaaggcctaaccgatgaagagcagaaaaccctcgaaccggttatcaaaacgtaccaccagttcgaaccagacccaaccacgtgcacttctctcataacccaacgcatccacgctccggcctccgtggtttggcctcttatccgccgcttcgacaaccccgaacgctacaaacactttgtaaaaaggtgccgtctcatctccggtgatggtgacgtcggaagcgtcagagaagtgaccgtaatctccggcctcccagcctcaaccagtaccgagcggcttgagttcgtcgatgacgaccaccgtgttctaagcttcagggtcgtcggcggagagcaccgactcaagaactacaaatcagtgacgtcggtcaatgagttcttgaatcaagattccggcaaggtttacacggtggttcttgaatcttacaccgttgatattcccgagggaaacacagaggaagacactaaaatgtttgtggacactgtcgtcaaactcaaccttcagaaactcggagttgccgccacatctgcacctatgcatgatgatgaataatttcaagtttatttcttatattttctctcggtaagttttttcctttcttctgatgattattgattatttacttaatttgtgagatttactattggaagcaaatgtttaattcgattccgttaacgaaactattgttgcataacgcatattagttctctgtttatttttttccaataaacggcaaatcacgaattctgtcatttgattttgctttttcaccatctatttttgaataaatttggactatttttgaataaactttggactatttttgatgatgtcaaaaattggtattacactcttaattaatattggttatagttggtctatagtatttgcgctacaaagagtcaagaaatcttgccggttatcaaaaagcaaaaaggaacttagaaatcacttcttgtcgcaatgttgaattagatttttatttaccttaccaaaatcattcttcttcttcttcttattaggttaacgttttttagggcacctttgaaaaaagtttatacatatatattccgatggtttgtgtctccacaaaacttgtccaatacattttttttcattaattatagtcgtcttaaaacattggaccgttgtgatgtgtagtctagttatttgtgttgctatgtaattgtatcacacattcagatttggtcccctttactatgtgttattaaaaaaaaaatggtaagaattgcgccacagtagttccagttcaataaaaataatataattttttgtattacaagaggaatccatggtctagattcgtgtagaagctcttttgcctttcacttctttaaagtgctggaaaagagaagtgtgtcacattatgcatgcagccatgtactacttccaatggttgtgtctccacaagttgttttaccttttcaatagaaagacaaatacagtttttctatttcgcttgattttctttttctttttcctccaaaattgctttaaagtaaagtatatctaattgacagtaatctttaatattcagaaatatatatactttatattttcacttggaattggaagtatatatattacatattaaatataatctaactttttatttataaacaattaaaatctattgttaactaaatttagtttcatatttaaaaaatgttagaattatatttataaataggtttttaagacatagttttttttttaaacattataactacatattataactaattatgatcttcttctaacataatttattatcttttttatataaaaaaaatctctttacaaattttataatcaatatcttcttaaaaagatagctaaaatccattttcttggatacatattatttttatttaaaatatattatatttaatagtatcaatagtgttaaagatattatatggttttgaacattataataaacatgtgataataaacattatagtaaaatccttccaaatggtcctgaaccgagtcagcatccagacaaactatgttcttcggtttgatatcatttgagtactgagtagacattcacattttgggataagaagagttttttttcataaatcgtaaataagataagaagatatcaatgggcttattcaagcccaattaggcccaatccccgatcgtatcagataacaacgccggcgacggtgacacgttcacattcacattttgggatcaattttgaaactctactccgataacttcaaccataattctccggcgagtcagatcgacggtgagttcttcagaccaagctcgattacatgattgtgtgtctgattttgggatcagttctgaaactatttgatactttaggattttgtttcttgcgatg

SEQ ID NO: 12254 - DNA, 3000 bp, Unknown
  misc_feature (1)..( 3000): cDNA_ID_2711695_gDNA_ID_2214539_Annot_ID_185187 3000 nt of promoter + ATG
atacatctgtaccacctcccctggaggataaggcttgtaagtggaatgcacttcatcgtcacatagttggggcaaagatatccagggaataaacgcattgagtaagttttggtccatgtctcttcttgtgtatcaatgtccatatggctaatttccaatcagaaagttcagcactgccactaaccatggctagaagatcttcaaggttgactagcggccaggtgtaggtaatgcgcgcggtcttgggacacatcatggaactgttcagtgtgaagatccaaagatagaatcttgtaaccattaagtacttcgaaccagtagatggaaccattcacaaagaccgaatgatgtctggcttcgacatagtaaggaggcggactcggcattgtccgccattcaccaatgtttaaatcgagaagttgtgcttgatctcggtttagttggatgagccacgaatgctaggcaatgcgtagggcattgaatatcatttggagtgaaggttttgaatccctcaggcagcttgtgaaagagcttccgtttagcgaagttatataaccaagacattcatgttgcttttcctttatgggctatgtatatcacggtttttccagtttcccggtttttcaaaatcgttatcattgcatctcgacaccgataagattcatagcttaaagttttgtcgatgcactgaagtttgagttgtttttgctttcatgtttactttggacctttaaaactggttttgcaatctgtaaaatctgtaaacgtacactgattaatgatatttacattcttagaaaagaaaaatgaatcatcagcccatgtgaacatatcgaacaatgtagcactttctcaaagccaacacaaccgcccgcttagcttacattagatagatcaggcagcctttcatatgtaaagataagtggcggagaaaccagccatcaactattgattagtcaacatcttatcttctatcattagctatttacgatttaatatctacttgacatgtaaaagactaactcttcaccagttcactataaatagaggttgatattgtgcttatatcttcacactacacacaaatacatacaaacatacattaattggaaactgaaagtaatataatcatggctaagtctgctgccatcatcactttcctcttcgctgctcttgttctctttgctgcttttggtgagtaatgatcttataatattatatgcatgaaaaaataaattctgaattttcctctttagatttattggtaattaacaagatatttatatatgaatgcagaagcaccgataatggtggaagcacagaagttgtgcgagaagccaagtggtacttggtcaggagtttgcggaaacagcaatgcgtgcaagaatcagtgcattaaccttgagggggcaaaacatggatcttgcaactatgtcttcccagctcacaagtgtatctgttacttcccatgttaagctaccaatgactaccaattatacttggtgcttcatggtgtgtattttacataaaataagtctttgtcattctatgagtgactttattatgacatgcatgtttatgttttagtgtttcgtttgctttgttgttgttttctttttttcgtttgctttggttttataataaaaataaaagaattatgtacgaagttttttcttcttctatcaatatttgtcacgttagatcattaggtgaaactaaaccccaatttattgtttgatcagactaccaaattcaagcttgacaaatgaaatattaattgagactttgaattatatatacggtaagaaactagagatttaaattacctttttatagcatatgttctaatattgtcttgctagcaagtaacaataatagcaaacataaaatgcatataaaaacatgattgggaatttgggatgaagcaagaaaaatatataaaaagattgaataaaaatgataaagataagagaattaaatctcaaacggaagtgacgagaatgttatatatgggacaatgggacgagcattacatacatcaggcatcgataacagtttgtttcatgtctccgaatagtatttatactacatacgactgtttcatcggatccatatttgtttgaatttccataactaagaactactcacaatatatatatatatatatatatatatatatatatatagcattttgcctatgtaccctaaattcatagccacgaccaacaatggtttgtttatacatagcaacttagctagtttgaaaatttaccaccggcgcaagagattgatgaatcatccaattttcgattataggtgtttcctggtaaaatgtaaatgggaaacttcgacagcatgcagtttcttattctgaaaacttggttgaacgatgctgctcttgagatcaaccaaaccatgtcgatagtcccttatgttgtatgtctaggggtgatgctcaaatcggaaaattttgaccgcttagttttatcttgttcatatatatagttttcacctttcaaaaattttgcacaaattatgaaatagcttacactattactatcaaggtatttattcgacgaaggtcagactaccaactacacttttcctaactgtgaaaatctctgaatttaatatacttgtgtaactattggcttggttaagatcttatttcttgcatcttgtccaagtcagattaaccagccgcccatgcaaagccaaagcagccgcttaggttacattagatattgagagagaaaaatatgtggtagataaacaagccatcaactattaataagccaagatcttatcttttaatattagctcgagaaggcgtacgtggtgtgtttaatttgtggggtacaattagctcgttattgtaccatgcacaagtagaaaataaactcaccatcatttcattataaataaaggttgatctcttaagcttatttcttcacacaacacatacatacatacattgaaaacaaagtagtaataatcatc

SEQ ID NO: 12255 - DNA, 3000 bp, Unknown; identical to SEQ ID NO: 12249
  misc_feature (1)..( 3000): cDNA_ID_2708596_gDNA_ID_2214539_Annot_ID_185186 3000 nt of promoter + ATG

SEQ ID NO: 12256 - DNA, 3000 bp, Unknown; identical to SEQ ID NO: 12248
  misc_feature (1)..( 3000): cDNA_ID_2711699_gDNA_ID_2214539_Annot_ID_185185 3000 nt of promoter + ATG

SEQ ID NO: 12257 - DNA, 3000 bp, Unknown; identical to SEQ ID NO: 12246
  misc_feature (1)..( 3000): cDNA_ID_3024398_gDNA_ID_2214539_Annot_ID_185180 3000 nt of promoter + ATG

SEQ ID NO: 12258 - DNA, 3000 bp, Unknown
  misc_feature (1)..( 3000): cDNA_ID_2708603_gDNA_ID_2214539_Annot_ID_185199 3000 nt of promoter + ATG
ccttaagtacctgaaaatgcacaataaagacagccaaccaacggttcaaaattcatcccattgctgtattacaagtcactgtgcaaaacctgagctgtctagtacataatttgaagttacctttgacatgtgagactccaaaatctggcgtcgaccttccacgtctgggttaggtacaacaatatgacgatcaaacctcccaggtctaaccagggccttatccaaagactctgggaaatttgttgctgcgaccacaataattccttcattctgtttaaacccatccaactcaacgagcatctggttcaatgtcatcttcatgtattgctggtccttgggattgcgacttcctccaatagcatctatttcatcgataaatataatacacggggagcacttctttgcagcactaaaaagatctctcactcttctggctccaactccaacaaacatctcttcaaactcactaccactgcaggagaagaaaggcactccagcttctccagcaatagctctagcaagcatagtttttcctgtcccaggaggaccgacaagcaacacacccttaggaagctttcctcccagacgagtgaacctctatagtaaagatcaaaagatgaaagagtgaggcctaagaacaaaacagtactaactctagaaaaacctggcacagataattcagaggataaaggtctatatgataacttcacatgatttatgcttttgaatttacatcactagacagattttatacttaactagaaaaacactctagcactgtgaatttactttggggtcgcgaagataatgcacaatttcctctagctcagcctttgcttcatcaacaccctttacatcagaaaatttggtgctcgaatccatactaggttgcacttcttcgtgcaaaccaagtcctaacatgtattaagcataaattaatgagcacaaagtcattcaatacagctattggatcactgaagaaaacacaaccaaactctacctttgccaattcctctgtcctcgataagagctccaataccagaaatgagtaaaaaaccaactccaatagttcggattgtactccatagctgttctttaaagtgagtcctttctgtggatatcgtatggatcggtgcactagcagttccaaggacaccatcttttgttggttttcctacgtttctaaatgccccaagacctccaaaagtctcttcctcccttgcaacaccagcaatacctaaaagaaaaacagcaaaacatttcccaatattatatagagaaatggctcagaagctgctaatacaaatatgaaagcaaggacacaatccaagtatccattcagattcaaacaaacagtctctccctccttacccacctctttgcaatgttcgaaccagctcactttgatcgagcctatcaactttaaccaatgccttaatgtattccgataacgcagaggcattcgcatgcaaagaaggttggctttcaaacattctgataacagcctcaggatcatttcttcgaataagttctctcagatgtgcaacctcattaacttcttctctatcacggactctgcgagcaaagctaccaacataactcgattgaaacctcgttcgcggtaaagaagctccaccaccacccacagctatagataaaataaaaccaatttacatcaaaaacacttctaaaacaacaagaacaactcataaacggaatcagaatttacctccagtaactcccactctaggaaaagaggagtaagctctaacaagtaagcttcttaaactgctcaattccctttcatgactcgaaacctgtcatcggtgaagagaatcaatacagatgaagttaattactaatcccaaactcaaaatgacactagacaacacatgaaaacattttgataaaagtgaatacttttacccattttgaatcaaaaaaattgaaactttttataccaatttcaaaattaggtgacttgggtagtcaaataaatcaaatgacaatatcacagagacaatctagaatcctaaaagacaacattttgagggcagagaagaatttgagcttctagggtttgaaaaatatcatctttagcttatgaatcacaaagatcttgataaaacccatcagaaattattatctaattagatcaaatccactacagtatcaaaccaaagtcgaaacctttttcgtattaaaaattggataaaggggaaaagagaaaaatgaaacaaaaaccttggtgatgatgcgcctccaagccatcaatcaaatctctccttcacgatatcttaaaaattggtgttaatgtctgataaatcgaagttcctcgatctatatcggaaacaaaagacttcttcgttgtgtttggggaagaaccgttctaatcttattccctaaagtcttaaaaacactaaattacacgtgagagacctgtttggttatcgggtgagagaaaaattgtgcagcaggtggagacacgcacgagatatgtaggtcgcctcttaagtacataaatacccttggacatacccaataattcattttagtaggctttttctggcggcccacattaaaaagaaggacctagaacataaattggcatcgttagaaatgggcttaagtaaaggcccatatgatatatatataaaaaaagagattctagattagtaacgaagtttctggaacattgtcttgtcttgtcgccacgtgctcacataaatgtcaaagaagcttcaatacagtgaaatgatcttgtcttgtctctagaaccttctcttctctccccttataatttcatttctctctcctccacgcctcaatctctcaactcaaaactcaacattttctgaagaaagtcgcaaactttacccaaaacccagtttctaattttagcaacaaaatcaaaaatatctacttttgtttctcgaaagttacgaaattcatacaatctagcttatctctgagcttatggatttgagataaacaacgaaa

SEQ ID NO: 12259 - DNA, 2571 bp, Unknown
  misc_feature (1)..( 2571): cDNA_ID_3024365_gDNA_ID_2214539_Annot_ID_185198 3000 nt of promoter + ATG
tctacaaaaatatcacacaggccatttagttccaattatgtcccaagtaactagatcaacaagtttgtaaattttatgaacttcaaaattaaaagtgttacattcaaagaaatactttcttagtatcatgacctcttttctctaagaaagcttagcaaaagttactaattacataaactcctaaatgttgaccaaagtgagtactaagataagtagacacggagcttgatactcttatcgcagctccatctcatgcttctaaggtctggagaaggaaaaacaaacaaccattaaaattgtcaaacgaaatcagagttttttattcatcagaacaagaaaacacaaatgtacaacaaaccacactcaatgactcttccttgagtcaaaacaaacaaacaaacaattcaactagtaaataaaagtggtagcattaccataacttagaccgcaacaagtagatgtgttaataccgtatagttaaggttccgaaccaagaaaacccatttgatcaaccatgtcatgtagatcttggctgtcccaatccaaaggcgaaccaaccaaatcttccactttcacatccaacgctgcttccaaattaccatctctcatcatcacattcatagcctccaaacattgttcctccttagtaggcatcgaattattcgcctcatcatcgattgctgcagcgaacaacatttccatatcatccttcattctatcaaactcttgatcatgtaacaaattctcctccatagtccccaagcttggagtagaagtaagcctccgtttcctccccacatccaaaccaaacaaactcttcttctctttactcataaccgcaaactgctgaacaaagttcggattgttcaacgccttggcaaggaacgtcatcatctgctgctgtctcttctcagtaacaagcaaccgttgctccatagctgcaacttgactcttggagctgtgttgctgttgcctcaacctaactacctcagctacaagcacaccatgatccctcttcaacctctcaacctccccgtcgaaaccgtattgcccaacctcaacacatgacatcccagatccttgctgattcacattctgcaaacccatgttcctccttcttttgatgttcttcaagagatgcttttgtcctgctaaaaacccttcatttgcaaattcccatctatctggatcaatctttctgaatccctgcaatcaccaaaacaagtttcatcagctactgaacttgaggcagagtccttacttatcattccaagattctgtttttactaccaaacacattttgaacttcagaaacagaggattgaacagagtttatgttaaatgattctcttaacatatgaccaaaatctcaatgcatctaatttcaatttagccacttaaaagcttaaagaactaacctttatagctgaagactcataggaaacccatctaaagaaatccaaaattaaaaattagaaacaaaaacagaaacaagactaagtagatataaggaagcaaagaggtacttacataagtattgagctgacgaataaaacttgagaaattgctatgcttgaagtaacgtggaaggagagttgttgagaacttatgagaatcccacaccacaaagctgttacgaccattactccaagaaaccaccgtgtccgtcgccggatcttccaccatttcgtaagtcttagtcagaaacggtggtggccctgtttcgttaagcccttccattggtctaggagaggaagaggatcctacagatgaagaagccgctacagaaccagtaaacgtcaccgtttcttcctccatttccactttcagttcttccattttcgttgtttatctcaaatccataagctcagagataagctagattgtatgaatttcgtaactttcgagaaacaaaagtagatatttttgattttgttgctaaaattagaaactgggttttgggtaaagtttgcgactttcttcagaaaatgttgagttttgagttgagagattgaggcgtggaggagagagaaatgaaattataaggggagagaagagaaggttctagagacaagacaagatcatttcactgtattgaagcttctttgacatttatgtgagcacgtggcgacaagacaagacaatgttccagaaacttcgttactaatctagaatctctttttttatatatatatcatatgggcctttacttaagcccatttctaacgatgccaatttatgttctaggtccttctttttaatgtgggccgccagaaaaagcctactaaaatgaattattgggtatgtccaagggtatttatgtacttaagaggcgacctacatatctcgtgcgtgtctccacctgctgcacaatttttctctcacccgataaccaaacaggtctctcacgtgtaatttagtgtttttaagactttagggaataagattagaacggttcttccccaaacacaacgaagaagtcttttgtttccgatatagatcgaggaacttcgatttatcagacattaacaccaatttttaagatatcgtgaaggagagatttgattgatg

SEQ ID NO: 12260 - DNA, 3000 bp, Unknown; identical to SEQ ID NO: 12245
  misc_feature (1)..( 3000): cDNA_ID_2708997_gDNA_ID_2214539_Annot_ID_185178 3000 nt of promoter + ATG

SEQ ID NO: 12261 - DNA, 3000 bp, Unknown; identical to SEQ ID NO: 12254
  misc_feature (1)..( 3000): cDNA_ID_2711695_gDNA_ID_2214539_Annot_ID_134440 3000 nt of promoter + ATG

SEQ ID NO: 12262 - DNA, 3000 bp, Unknown; identical to SEQ ID NO: 12253
  misc_feature (1)..( 3000): cDNA_ID_2711691_gDNA_ID_2214539_Annot_ID_134441 3000 nt of promoter + ATG

SEQ ID NO: 12263 - DNA, 3000 bp, Unknown
  misc_feature (1)..( 3000): cDNA_ID_2711678_gDNA_ID_2214539_Annot_ID_134445 3000 nt of promoter + ATG
gttaattcttatatgttatgatcgctaatccatctttctcaatgattgagttatctgcttttttgtactcattctgtttactctgctacagatacctaccggtggtatccctgaacccgagcagacatcaccgctgggaaccatttctgcagcaccatgggggtctgcgcttatcttgccaatctcgtatacttacattgccatgatgggatctggaggactcaccgatgcctcaaagattgcaattttgaacgctaactacatggcaaagcgtctggaggtaccttatcttatcttgacaactctttaaagagagtgaacgtctcttctcttgtgcaacctcacttatgctttcttgtctttcagagccactacccagttcttttccgtggtgtcaatggaacagtcgctcacgaattcatcattgacttgagaggattcaaggtatgtttctttatctcgtttgagtaaatgctctgttttttggttgtacatgctaaatcaatgtcttgttcaatgtcctcagaacactgctggaattgaaccagaggatgtggccaaacgattgatggattatggtttccatggaccgacaatgtcttggcctgtccctggaacgcttatgatcgagccaaccgaaagcgaaagcaaggtaattatgtcttgcattgcattgcaaatctctcactgactcagctctcagtctctaaaacatggcttcataatttgtatatatatatgtaatatttcaggctgagttagataggttctgtgatgctctcatctcgatcagggaagagatttcacagattgagaaaggaaacgcagatccaaacaacaacgttctgaaggtaagaaaaaatttgagaccacaatttcagttcggactagccctctagtctgatactaatgaactttaaaaaacaaacacacacagggtgctccacatcctccgtcattgctaatggcagatacatggaaaaagccgtattcacgggaatacgcagccttccccgctccatggctccgctcctccaagttctggcccactacaggtacttgaaaactaggggtggcatttcccatagaaaacaatttgttatttgtaaatcgtttcaaaatgtattaaatatgtgtgaaacagggcgagtggacaacgtgtatggagaccgtaatctggtgtgcactctccaaccggcgaacgaagaacaggctgcagctgcagtgtctgcttaaatgaagccactatgaagcgattcgcactcgcaccaaaacccacaatggggcgattcggactcataccggatccagaaacgtatctttactggcttttacttctcttcccagcctcatcatcactttcactttcacttcctgtacaatgtacatacgtagtcctaagttcttccctcatttatttaataaaatacatttctttatgttccactttcttatacgtataacattccatttggatgatgtgatcaccatcgtggttatatttatgccatatgatctctttgaaaaaagtttgaattcttaggatatttattgtttcattttataattaggaaatttggcaaaataaccataattctaggttttataaacaaactgactgacaacatataggttctgaatggttgcatgtagagtaaaaagtggaagtgaaggagacaaaaaaatttagtgaaagaaacaaccaaatattaaaggaaaggaatctaaattttgaagtagttattttttctctctcctttgggtagagttagatttttttttataaaaaaaagcttaataccaacttgaacttcctttccaaagaaaactaggaacttggtagagttaaaatttaatttcacttttctacattttggccaaaaaaaaacaaaaagcagttctaaccaatgctaatcttttctattttagagacacacattggaacaaaatcaactctaaaatagtgaaaaaaaataaaggtaggacatgggagatgctcttatgtttctgctaattttttcaattgccactaatcagacttgtagcattattctactaaatatcagattggacattagatcacctatactaaaaccatctccaatggtcacctctataaatagaggaaaatatagaggtcatcattagagatgccctaagtccttgaaccaaaacctgtatttcctcacagaaaatagattttctgtatagccacattaattcattctaactagactctcactgaatctttgagaggaccaacctcataatgattttttcctatcctatatactaatgcttgtttttttttttcttccgaaaggtgattaaaggagcatattctcatcgagccctgttcggttacctctctagcaaacaactcatctatcctacgctttatcactattttagagcacctgacatttctcttaagaacaaatcaaccttgtaaagcatatgtggcttgattcaaaaagacaaacactagtgatagacgcaagaaccctaaataaaaaaagttttctagattctcaaaaccgttaggtctgacagacatatataaacaattatcgaattgttattaattaatacgatgtcactctatacctataatagagattagggtttccatgtgttcatttatccaaccataattaataacgacaacggtaatcaataagacacattaagattgatcggtcaagagttatgagtttcataagtcatctccaaattttgcggaaactaaatatttaaacatcggattctctgtttgtcagttgtcagatcatctgactcgcatgcacatgattcgtctcaaaaaggcaaacacgaatgatagatgcaaggaccctaaatcaagaaagttttctcgattcttaaaaccgttacgtccgacagaaaaacataaacaattgtcgaattgtcataaatacgatgtcactctatacctataatagagattgaggtttccatgtgttcatttatccaaccataatg

SEQ ID NO: 12264 - DNA, 3000 bp, Unknown; identical to SEQ ID NO: 12251
  misc_feature (1)..( 3000): cDNA_ID_2711674_gDNA_ID_2214539_Annot_ID_134446 3000 nt of promoter + ATG

SEQ ID NO: 12265 - DNA, 3000 bp, Unknown; identical to SEQ ID NO: 12250
  misc_feature (1)..( 3000): cDNA_ID_2711671_gDNA_ID_2214539_Annot_ID_134447 3000 nt of promoter + ATG

SEQ ID NO: 12266 - DNA, 3000 bp, Unknown
  misc_feature (1)..( 3000): cDNA_ID_2708599_gDNA_ID_2214539_Annot_ID_134450 3000 nt of promoter + ATG
agttgaaaataatctaatcatctactattttactctggttatcgttcaagcaacttctttctttttggaacaaaacaaattactcttgttatttttatttttatttcctccttttttcagattcactgtcttactcgtattttgctttactctatatttcctttaaagtaggatatacagatttctgtccaattagcaaaataaagaataagttgtgcatgttaataaataataagtaaaaagttttgaactaaataaatgcatgataaccctaagaaaaacgagtctaaagtttttaatactttttatgtcttcatataatcatgaaaaaggaaatatgatgaatcaatgtttcctataactggattttcgatctttgatgaaaattgctctaaattatgcataaaaactttctttcttttcattgaacttatctcaagactccaaaaaaaaaaaaaaccaaaagactccaaaaaatactttaagcattaagaaaacatagaaataaaacattaaatcgaggtttaaaaccaattatacactacacatgagagttgtacatcaaggttactcatttgttgattaacctataaaaagataataacctttgaaaaattgaataaaagcaacaaccaacttgatgatagataagaggattacgaaaatcgtaaataagaaaacctgggaacatgaaaaccaagcaaagaaagaatgcgacacattacaagatatgtgtgagactgacctttttgaaaaagctttaaacctttctaaataaaatagctatacaaactgcaaccaacaaaactataacctttcaaccaaaccaacaagaaacaaggaaaacattaattatgaactcgtaagaagttgaatgacgcccatgtagagagagtcagaaaattagtgtcgcacctataattcaattttttaaaaaattataagtatctttcaaatgcatgagtcaaatatcacttagtgagtactatctcttttaaccacatcttaacaccaataaatataatgaacaatcaaagccatgcattcaagttttcaaccaaataaataaataaaatacaattttggtttcatcccgttcagattttttagaatatccatgcatgagaatacaaaataattatctttttagcacttcagttatagtgtatgtcccaattgtttagtttcttaaatgcctcatctaaattgttttttttttctgttctaatctgttcttataatattgattgtttaactacccattaaaccatgcctaagaatggtaatagtaatacagttgaactttctgttccgagtctaaattttcggtaacttgaaaagattgaaaattcaatgcagttaagaaaagaaaaaaaacattaaactcctttaaattcaaattaaaaattcaaaatatttgttttcagtatttcattcagcattgaatggatcggccattaggaaggaatcaaataatggaccaatcaatcattgaaagcttttggactttgggctctcctcagcggcgcaaaggcataatggcgacgaattattgtttgtcgtctttctatgtttactttcttcaatatgtaaatatatctaacaatcaatgaagatgacagaattaagaataaaatattttaattagcaatatttaatatgatattttatatgatattttacaacacgctcggatataattttaacttagcaatattttatatgataattttacaacacgctcggatatgtgcttaataaataaattaatagtatatctttgcaacaatataaaatcatttttttttttgaaattgttccccactcttttttagacacaaagaatatggtactttacctccaatgaaaatgacccttcaccatcgtagattgattgaactttgcttggcttcatttgtaagtctacttaccactaagatttcaaatacaattattgccaaagggtggtatctttttccattgtagtaaaactaacgtatgattacgaattatggatttttacatgtatttcaaaaacattacaaaaaccctgaacctttaccctgtaaggctgtaaatggttcttgatatcttgttttgtaggttaccaaattctagactaaaactaagaatcaaatgtcattatatatagagaatcatgagatgaactatgtctaaaacctccctatgtccataccacaagttcctgcttaagtacaagcacaaatagtgcgaccgtcccaagttcattgacataaggaacccataaaaaataatttgagcagaaaacaatttaataaaaaattatggcaaaacaagtccaaagaaaacaaatttgtgagcaaaaggatcccattttcaaaatttgtgagcaaaaatcgctcattttaaaaatatgagcataatgaacttatttttaaaaaaaaattcgcaagacctattaaattcttaaaccagcacttttgatgggtgccagcttagatatatggtcagagtgcgacccttcaaatccattggcataagaaaactagaatatttttctttttaagcaaaaacagtctacaagaaaaaaaacatgtggcaaatccattggattggttcattccaaataactattaaccactagctttgagttacctacatatgcccatcaattcatatgaattagttttactttattttatccagtcaaaatcatttctaggttcgtcactcgttggtttttgttcttacattgtgtagtctaaacacgcatgcagattccaatcctctttgatcgtaggccttataaggatgcatcgtgatatgcgcagtcagtgactgacctaagacctagcaaatatggaaacaaaactcacgcacaagtctaatctgatcttcttccattttctttctttcctaactttctatttctactgacctttcctttaaagaaaaatatagctctatatatgttattgagtggtaaagcgtctcctcagaaagaagcttcaagtaaat

SEQ ID NO: 12267 - DNA, 3000 bp, Unknown
  misc_feature (1)..( 3000): cDNA_ID_3024365_gDNA_ID_2214539_Annot_ID_134451 3000 nt of promoter + ATG
acaacaaaccacactcaatgactcttccttgagtcaaaacaaacaaacaaacaattcaactagtaaataaaagtggtagcattaccataacttagaccgcaacaagtagatgtgttaataccgtatagttaaggttccgaaccaagaaaacccatttgatcaaccatgtcatgtagatcttggctgtcccaatccaaaggcgaaccaaccaaatcttccactttcacatccaacgctgcttccaaattaccatctctcatcatcacattcatagcctccaaacattgttcctccttagtaggcatcgaattattcgcctcatcatcgattgctgcagcgaacaacatttccatatcatccttcattctatcaaactcttgatcatgtaacaaattctcctccatagtccccaagcttggagtagaagtaagcctccgtttcctccccacatccaaaccaaacaaactcttcttctctttactcataaccgcaaactgctgaacaaagttcggattgttcaacgccttggcaaggaacgtcatcatctgctgctgtctcttctcagtaacaagcaaccgttgctccatagctgcaacttgactcttggagctgtgttgctgttgcctcaacctaactacctcagctacaagcacaccatgatccctcttcaacctctcaacctccccgtcgaaaccgtattgcccaacctcaacacatgacatcccagatccttgctgattcacattctgcaaacccatgttcctccttcttttgatgttcttcaagagatgcttttgtcctgctaaaaacccttcatttgcaaattcccatctatctggatcaatctttctgaatccctgcaatcaccaaaacaagtttcatcagctactgaacttgaggcagagtccttacttatcattccaagattctgtttttactaccaaacacattttgaacttcagaaacagaggattgaacagagtttatgttaaatgattctcttaacatatgaccaaaatctcaatgcatctaatttcaatttagccacttaaaagcttaaagaactaacctttatagctgaagactcataggaaacccatctaaagaaatccaaaattaaaaattagaaacaaaaacagaaacaagactaagtagatataaggaagcaaagaggtacttacataagtattgagctgacgaataaaacttgagaaattgctatgcttgaagtaacgtggaaggagagttgttgagaacttatgagaatcccacaccacaaagctgttacgaccattactccaagaaaccaccgtgtccgtcgccggatcttccaccatttcgtaagtcttagtcagaaacggtggtggccctgtttcgttaagcccttccattggtctaggagaggaagaggatcctacagatgaagaagccgctacagaaccagtaaacgtcaccgtttcttcctccatttccactttcagttcttccattttcgttgtttatctcaaatccataagctcagagataagctagattgtatgaatttcgtaactttcgagaaacaaaagtagatatttttgattttgttgctaaaattagaaactgggttttgggtaaagtttgcgactttcttcagaaaatgttgagttttgagttgagagattgaggcgtggaggagagagaaatgaaattataaggggagagaagagaaggttctagagacaagacaagatcatttcactgtattgaagcttctttgacatttatgtgagcacgtggcgacaagacaagacaatgttccagaaacttcgttactaatctagaatctctttttttatatatatatcatatgggcctttacttaagcccatttctaacgatgccaatttatgttctaggtccttctttttaatgtgggccgccagaaaaagcctactaaaatgaattattgggtatgtccaagggtatttatgtacttaagaggcgacctacatatctcgtgcgtgtctccacctgctgcacaatttttctctcacccgataaccaaacaggtctctcacgtgtaatttagtgtttttaagactttagggaataagattagaacggttcttccccaaacacaacgaagaagtcttttgtttccgatatagatcgaggaacttcgatttatcagacattaacaccaatttttaagatatcgtgaaggagagatttgattgatggcttggaggcgcatcatcaccaaggtttttgtttcatttttctcttttcccctttatccaatttttaatacgaaaaaggtttcgactttggtttgatactgtagtggatttgatctaattagataataatttctgatgggttttatcaagatctttgtgattcataagctaaagatgatatttttcaaaccctagaagctcaaattcttctctgccctcaaaatgttgtcttttaggattctagattgtctctgtgatattgtcatttgatttatttgactacccaagtcacctaattttgaaattggtataaaaagtttcaatttttttgattcaaaatgggtaaaagtattcacttttatcaaaatgttttcatgtgttgtctagtgtcattttgagtttgggattagtaattaacttcatctgtattgattctcttcaccgatgacaggtttcgagtcatgaaagggaattgagcagtttaagaagcttacttgttagagcttactcctcttttcctagagtgggagttactggaggtaaattctgattccgtttatgagttgttcttgttgttttagaagtgtttttgatgtaaattggttttattttatctatagctgtgggtggtggtggagcttctttaccgcgaacgaggtttcaatcgagttatgttggtagctttgctcgcagagtccgtgatagagaagaagttaatgaggttgcacatctgagagaacttattcgaagaaatgatcctgaggctgttatcagaatg

SEQ ID NO: 12268 - DNA, 3000 bp, Unknown; identical to SEQ ID NO: 12258
  misc_feature (1)..( 3000): cDNA_ID_2708603_gDNA_ID_2214539_Annot_ID_134452 3000 nt of promoter + ATG

SEQ ID NO: 12269 - DNA, 3000 bp, Unknown
  misc_feature (1)..( 3000): cDNA_ID_2708633_gDNA_ID_2214540_Annot_ID_134453 3000 nt of promoter + ATG
ttatttggaacatcgcctaaatcatttgcaaataatattggtccgagccaatttttgtcgtcttattcatgaaattaaaatatcaaatgattggttcaagaattttttttttaagtttaacacctaagttcaacattaggattttgattaattaattaaatgtaattgaaaaagattaatttatgataaacaatgtatgtgtcgtcgtggaaacaagtttgccacaccttctcctcccgagactggtctggcggccagggaccaacccttcataatgagaaaccagatttattagcacttgatagtttcttactaatttaatattactatgcaatcatacatgcatgtttgaaagttttctttttcgtatttatcttcattcatatgatactaattaataaactatttttccatagttaaaaaaaaaaagaaactatttttcaataagtcactcgttatttttttctttatcggacatatttatttacacgcgtacgtaaactggtccatcaaaataacagaaataattagtgacataactaattaatttaaattttccatatgcaccaccatataagatataaataaatgttttagttttaagaacaaaatagaccgcaaaattcagaaagttgtttacatgtttgaagaactattttgagttttggactttggtttgaattcttctggcttacaagaaaataaaatattgttgacaaatacaaatatatatttctatattatatacataatgtgagctaaattcatgaatatttgcacaatgtcaaagtcagattatactaatattctattagaaaaatagtctaatcaagtagcaatgagcaccaattccacggtgcgacaccatattaaagtttatagttaaaattgatgaactattctactttttatcaatttaattaatattcctcaaaaaaaaatcaatttataattaatataagattatccacgaactttcatcattcttaatttcctagcatattgataactcgtcgtacctagaaaaagtcaaatgttatacaatgatatgaactgaaaaatcacattaagttataattggtatttttcattgattgaagcattaatatcgtgtgtgtgctactagcagaattagggggtaaaacagaatttcgttaagaaaatgcattaattaaaaaataagaaagatatatatatatatacatatatatatataagagtagattataaatgaaaaaataattaaggattaaaaataatgataataataatatgtataagatgggtaacctaactttacttggacggtcgacaaaaaaaaaaaaaaactttacttggacgagtatagccgacaaattcattattgggaagtgccaaaacaaataacaaagctgagaccaaacctaatgaaacgttacacataaactttcttaatccattactccaaagattttaggttattgttgacgaatcgtattcacccatatcatttttttagtttctacccacttttattgtacttctcctttgtgtgttctcttgataattctaatgttacgtcaggtaaccaaacaaaaagtgatttaaaaggtgagcacccattttttacaactgtttcgaccacatattgcaatttgaataaaaatcgggtaaaataaacctaactacggacttaagacttttgattatatctagcgatatagcttgaccgagtcttaatttgtgatgtaatgactgctcaaaatataatagtttgaattccggcttttaacaccatgcatggtataaatcagtaacatttgttatcatggtatagtgacatttatatatatagttgttcttattttagtattttaccctaatatataaatatattcgtacactttagtttcaaaatgattttacttccttttttctcttatatgttttattggtacatcagtttatcttgaaagagaaagcgcgatatgatatattataaaactctaggaaatactttgtaatctatatagataactgtgagttaaagctcgagactaattatggatgtaacgagttattggtacggatgaatcaccttgtttaaaaaatttcgaaaataaagtatatgcctaagcctaactctttccaaaaagtactaaattaattggtgaatgacatcaagagaaccaaacctaaacaagatggtggggatcactatccatatgtatacgaagaaaaaaaaataactaaaatatataatacataattaaataaatgaataaaacatcaagggccaatgtgtttctatgataaggaaaaggaggctgaaaattagtgggtaaaagtaaaactgtcttgtggtccgttatttaaaggcacctcttaatcactttctaattactattcatactaatttcgtctcttttttttttttttgtctacaataacgtacgcttcatgataaaaatattcatgatataaaaatctaaaataccgatgccgactgaacccaatgataccagaaaaagaatggagaaagctttaaatataatatttaatttatattcatgatacgataattccatcttctaccaaatataaaatcattgaactttttcgggaacttttctcttattagtgggaagaatagtagcaagtgccaagtgagatgctcatttggtcaacctttgcaagtaagaaaaataaaagtagagagaattgtgccatcataatttcccacattattttttttttctttcaggaaaagaattaccaagaaaataaaatcatttctttaaaataatataaatcattcctttgattaataactattagccatccacccacccatcaatttcttaaaaatataaaataaaaaaaatacttttcttctccttcttaagaagccccattggcttcatctcctcccattatcttctaaactcatttccttttcctctcgaaatctcaaagatagataaattttaaaggcatatttttttcatttcgactcagatg

SEQ ID NO: 12270 - DNA, 3000 bp, Unknown
  misc_feature (1)..( 3000): cDNA_ID_2708623_gDNA_ID_2214540_Annot_ID_134456 3000 nt of promoter + ATG
cccatttctgtaatctaactctaagcaaaagccatatactgattttcaagaaagtaaaaaaaaaaagcagagtactttagttgtttttacagttcagacctgagtttctacagtactgaagataaggtgagacatctgatttgcctgaagcagaagagaagctaagcatgtgttcttgtcctttacgaggatcattaatagtggtagatctcagtaaagggatgccttgatgaaacgacagcgttttagcagaggcaggggaagaagagaatccatcagttgatgttcgtgagagctttgaacttctccagcaatcttcaccatcgaaaccggatctttcttgcttgttactgaaaccagatccgagttcagtttgacccggagaagaaacggtttcatgaccagaaacacgaactccaagatccataaaaaatggattcagaaggagacaaagaaaaagtagtgctaaataatcacttcagagatttttcccatgggaggtaatcgctttgagctcagtgaagaagagaaccgagagagagagagagacagagggagaagaacgaggctaagtttttttattttattttatactctagatattatttttattattttggagaaaggatatttattatttaataataacaaaaagtaataattgtgggagtgagagatatgatatagctttgggtggagacaaagaatggtaccgaaaacacaatcaagatctcggacatgttactacaaagaaatgaaaactataatcagatgctctacgtatgattttattttgatttatgtattatttaagattttaataattttgtggttacttttgtgatatgagaaaaataattatagaggaagcaaacaatgaactttttaagataaaagacatgtggacaccacgtgagacatgtctctctagtttcaacttcaaaccctaagaaaggaattttcatttgctttttgctttttgctctaaaatttgttatggtatgcatttttaccaaacgttgcaaagggaaagatggggtatactttaagtgagattttagtatgaaagaagttagagaatgagattgtcgtattgaaataataaatatagtattgagttgagtatcaaatatctatcagattcacgtggttcccaattgtatttggactgtctaatggtgttctccaatgtaccccagctgattatagttacatgggccatttatgtttttcaatcctatctcttgggtttaagttttattacaacttttttttttcaaatggccttatcccttatgtaacataagtacataagtacatcatattcatcgctagtgaaactcatatcaattaggttatgaataatttgtatttgaaaccttaaatcagaaattagataagattttaatggttatataaattatatgagtcagttcattttttgccaataagttttgaatcggaagtctataatctaatatgatattagaatatgatttataattcgtgtctatcccaatcgaaaatcggttcgatcctagcaaaaaaattttagacagcagattttgcaaacaattctaggggcattactttgaaaaatgtgcatcttgagttttgcattcgtatcaaatgttcagaaattcaaattcaccttacctttctattttccaaaaaggttaaaatgatttttttttttttaatttgctttgaaattaagaagttgggcttttcgattcacataagccttttcgtcgtaatcaaatattaaaggtgcctagaagtctaggatgggagctggatccaaactatactaaaaccatgcacgtgataacctgatacccacctcatatgaacccaaaccatactagttctttctaagacaaacagaagaagaaaaaaaacacttgcctttaagctaatagctaatggtttggaattaaacaatagaaatatttactacgttaagttgacaacgtaaaaacaaaaaatactgttaacttatattagaatatttttttattagtaatggaatttttattaacagtttaaaatataattattacccaaaacaaaaatgtttttatatttttgttgatttataaaatatcttatgatttttttttatcaaatatcttattagtcataaatataaaatttaatagatattaaaagtttactaaaagaaaaataattattagagtcatatcaatatttataacaaaaatgaatatcttttgttaacataatcaatttgtcagttaattttgtggaaccctgaacacaataaccatttaaaggttaaaagtagcaatattgacaactaaacgttttattataagaattcaaaaccttaaaggtataaactgcaagtttttgctctattagattatttatgggattaagaatatacatttgataaaattaacaaactattttgttattttttcattcaaaagaaaatttattattactcaaaaatacaataatgttacactcccatcactagctactactactaaacagaaattcagtttggtttcgagtagatccatttgatttcaagtactttggatataaagatttaagatccaatcaattatttggtttggttttttctggacttgattgatccggatctctccagattcggttcgatttcaagtacctggaatattaaaaaataatttaaaaatagtaatttttttttataaaaaactaaaacttcgatttttttttttttttaaatataaaagtaattactttcctaagtttatggttttagtttttggataactagactacatcaaatttaaatataattattatattggatatctattcggattttattccgatattttgagtataaaagtctataatcctttggaataatttatcggtttggagtcaattcagaatttttcttttctcggttttagttcggttctagatatttgatctagcaatattcgtttgtcttaaactaaacaaaaaattatg

SEQ ID NO: 12271 - DNA, 3000 bp, Unknown
  misc_feature (1)..( 3000): cDNA_ID_2708619_gDNA_ID_2214540_Annot_ID_134457 3000 nt of promoter + ATG
ccttgccgagagtatgagcaagagcggaaccggcgacaccagctccgacgatgatcacatcagtgccagaatcaacctccgtttcaagatttttggatacggtatcgttttgggaaacgacgagtccacgattcttcttattcttattactactccgacgcaaaatgtagagaagcagaaacgtaaatagagaagctataaattgatccaacgcaatcttcgccggtttcatcatcaccgtggagttcacggcggagagtttgagtgtctgcgccgccgttgctttccatcggcgaatgtaggtggctccggtggtgaatcgacgagtagagagagagaatcgagaagaggggcgatgatttgtgtagagaagcgaagatctaagagttgattgaaatcttggaaggttcctgattacgaatggtttcataattttttgtttagtttaagacaaacgaatattgctagatcaaatatctagaaccgaactaaaaccgagaaaagaaaaattctgaattgactccaaaccgataaattattccaaaggattatagacttttatactcaaaatatcggaataaaatccgaatagatatccaatataataattatatttaaatttgatgtagtctagttatccaaaaactaaaaccataaacttaggaaagtaattacttttatatttaaaaaaaaaaaaaaatcgaagttttagttttttataaaaaaaaattactatttttaaattattttttaatattccaggtacttgaaatcgaaccgaatctggagagatccggatcaatcaagtccagaaaaaaccaaaccaaataattgattggatcttaaatctttatatccaaagtacttgaaatcaaatggatctactcgaaaccaaactgaatttctgtttagtagtagtagctagtgatgggagtgtaacattattgtatttttgagtaataataaattttcttttgaatgaaaaaataacaaaatagtttgttaattttatcaaatgtatattcttaatcccataaataatctaatagagcaaaaacttgcagtttatacctttaaggttttgaattcttataataaaacgtttagttgtcaatattgctacttttaacctttaaatggttattgtgttcagggttccacaaaattaactgacaaattgattatgttaacaaaagatattcatttttgttataaatattgatatgactctaataattatttttcttttagtaaacttttaatatctattaaattttatatttatgactaataagatatttgataaaaaaaaatcataagatattttataaatcaacaaaaatataaaaacatttttgttttgggtaataattatattttaaactgttaataaaaattccattactaataaaaaaatattctaatataagttaacagtattttttgtttttacgttgtcaacttaacgtagtaaatatttctattgtttaattccaaaccattagctattagcttaaaggcaagtgttttttttcttcttctgtttgtcttagaaagaactagtatggtttgggttcatatgaggtgggtatcaggttatcacgtgcatggttttagtatagtttggatccagctcccatcctagacttctaggcacctttaatatttgattacgacgaaaaggcttatgtgaatcgaaaagcccaacttcttaatttcaaagcaaattaaaaaaaaaaaaatcattttaacctttttggaaaatagaaaggtaaggtgaatttgaatttctgaacatttgatacgaatgcaaaactcaagatgcacatttttcaaagtaatgcccctagaattgtttgcaaaatctgctgtctaaaatttttttgctaggatcgaaccgattttcgattgggatagacacgaattataaatcatattctaatatcatattagattatagacttccgattcaaaacttattggcaaaaaatgaactgactcatataatttatataaccattaaaatcttatctaatttctgatttaaggtttcaaatacaaattattcataacctaattgatatgagtttcactagcgatgaatatgatgtacttatgtacttatgttacataagggataaggccatttgaaaaaaaaaagttgtaataaaacttaaacccaagagataggattgaaaaacataaatggcccatgtaactataatcagctggggtacattggagaacaccattagacagtccaaatacaattgggaaccacgtgaatctgatagatatttgatactcaactcaatactatatttattatttcaatacgacaatctcattctctaacttctttcatactaaaatctcacttaaagtataccccatctttccctttgcaacgtttggtaaaaatgcataccataacaaattttagagcaaaaagcaaaaagcaaatgaaaattcctttcttagggtttgaagttgaaactagagagacatgtctcacgtggtgtccacatgtcttttatcttaaaaagttcattgtttgcttcctctataattatttttctcatatcacaaaagtaaccacaaaattattaaaatcttaaataatacataaatcaaaataaaatcatacgtagagcatctgattatagttttcatttctttgtagtaacatgtccgagatcttgattgtgttttcggtaccattctttgtctccacccaaagctatatcatatctctcactcccacaattattactttttgttattattaaataataaatatcctttctccaaaataataaaaataatatctagagtataaaataaaataaaaaaacttagcctcgttcttctccctctgtctctctctctctctcggttctcttcttcactgagctcaaagcgattacctcccatgggaaaaatctctgaagtgattatttagcactactttttctttgtctccttctgaatccatttttt

SEQ ID NO: 12272 - DNA, 3000 bp, Unknown; identical to SEQ ID NO: 12270
  misc_feature (1)..( 3000): cDNA_ID_2708623_gDNA_ID_2214540_Annot_ID_185213 3000 nt of promoter + ATG

SEQ ID NO: 12273 - DNA, 3000 bp, Unknown
  misc_feature (1)..( 3000): cDNA_ID_3024418_gDNA_ID_2214540_Annot_ID_185219 3000 nt of promoter + ATG
atacaaataaagtaatatatcgagcgagtgattaatgggacattaatgttacatatagaaaaacaaaaaaataagttattgcctttatacaacaaagttcccaaaattttgaattttttgtaatcatctctaagattctgttaatggtctcgcctgagacatcatcatcacattaccaatcatctccaatggcaaaatacgccggaacaagaaccagaccggttgtatgtatctccgacgtcgttctcttccttggcggagctttcatgtcactaatcctcgtctggtctttcttctccttctcttcaatctccccaaatctcaccgtgaaaaacgaagaatcctccaacaaatgttcttcaggaatcgatatgagccaagatccaaccgacccggtttactacgacgacccggatctaacctacacaatcgaaaaaccggttaaaaactgggacgagaaacgaagacgttggttaaatctacacccttcgtttatccccggagctgagaatcgtacggttatggtaacaggatcacaatctgcgccgtgtaaaaacccaatcggagatcatttgttgcttcgattttttaagaacaaagttgattattgtcggatccatggtcatgatatattctatagtaacgctcttcttcatccgaagatgaattcttattgggcgaaacttccggcggttaaagcggcgatgattgctcatcctgaggcggagtggatctggtgggttgattctgatgctttgtttacggatatggattttacgccgccgtggcgacggtataaggagcataatcttgttgttcatggttggccgggagtgatttataatgatcggagctggacggcgttaaacgccggagtttttctcattaggaattgtcagtggtctatggaactcattgacacgtggacaggtatgggccctcttattgttttgtctttttaaaaatagtttaaaaccctaataagtaggcattgtctggtttggtttagatatttttaaaccaattatggttcggtttaagatgagaatttagaatttcggtttcatttcagttaaatttagctcggtttggtttataaaagacgaatttggttcgatttaaggtaatatttcggtatctttcaatattttcgactaaatttatataaaaatgatcaaaattctgttaatttcagttaaattacactatatttcaatgatattggtgcatttttgacataatgcaataattttcgataaattatgacaaaaatttggtaatctcggttcaatttagctcggttcgaggtttttaaccgaaccagtaactgaatgtcatgtttcctcttattggttggtttagaaaataactgaatctgaatcaaattaaccaaaattttgatttatctcatgcaggtatgggaccagtgagtccagagtacgcaaaatggggacaaatccaacggtcaatattcaaagacaaactcttcccagagtcagatgatcaaacggctctgctttacttactctacaaacacagagaagtgtattatccaaagatatacctcgaaggagacttttatttcgaaggatattggttagagatcgtaccgggtttatccaacgtaacggaacggtatctggagatggaaagagaagacgccacgttgcgtagacgacacgcagagaaagtgagcgaacgatacgctgcgtttcgtgaggaacggtttttaaaaggagaaagaggcgggaaaggaagcaaacggagaccgttcgtgacgcattttacgggatgtcaaccttgtagtggtgatcataacaagatgtacgatggtgacacgtgttggaatgggatgatcaaagccattaatttcgctgataatcaagtgatgcgtaaatatggtttcgtacactcggatctaggcaagacttcccctcttcaacctgtaccgttcgattatcctgatgagccttggtgaaataattgtgttttgttgttttataaactctttagatgtgcttttataatgagttgattattataatccatgaagtgaaaggtttataatgcggaatctttttgaataattcaatgattattggtttatttgattgaaatattattgtagtatgtagggcaaacgagataaagtaaacaataattagaggtaattttaagaatttgttttttccatagtaatttatgctgagtgagattggtgattggacatattattgtggttcacgaactaagtgttgtggaaacaagtagagtagtcaccgtaagtacttgttgaacacatctctcacaatttctccaattatatgggaaacatttatgtttgtaatgaaatatgtcatatgagttatacacgaacctcttttgtgtttgtaatcttctattttatggtttgtaataaaacgcctttggtggcacttgaacttatttatgggattcttggaaaatgcatttaaaatcttcttcctaatcaaaaccagagataatgtattggattagcttgtcatcctaatatgtgtgtgtgtggttatgaagaactctatatgcttttggtgatttggttcctttgatggtggttgatatttccttgattatatacccaattcatatctctaaaccaagtgaatattttatttttgttttaacgcatctccaagtaaatgtttttttattcctaaagttttctctaaagaaaaaataaatatatatagaaatctgtattaacgagtaattttgggtttaataatactttttaatgttaggttttagttggtaacttcataaattaatccaaattttttgagattttctttgaatgttattatctcaatactctcttactttctttggtcaaaattatctcttttaaatgatttttttatcctgtcacaaaaaaaaacatatccttgttttatttagctttggaaaaaaaaacaagaaacttgatatatcttttcagacatcacatactctgcttcaatg

SEQ ID NO: 12274 - DNA, 3000 bp, Unknown
  misc_feature (1)..( 3000): cDNA_ID_3024414_gDNA_ID_2214540_Annot_ID_185221 3000 nt of promoter + ATG
tcttggctcatatcgattcctgaagaacatttgttggaggattcttcgtttttcacggtgagatttggggagattgaagagaaggagaagaaagaccagacgaggattagtgacatgaaagctccgccaaggaagagaacgacgtcggagatacatacaaccggtctggttcttgttccggcgtattttgccattggagatgattggtaatgtgatgatgatgtctcaggcgagaccattaacagaatcttagagatgattacaaaaaattcaaaattttgggaactttgttgtataaaggcaataacttatttttttgtttttctatatgtaacattaatgtcccattaatcactcgctcgatatattactttatttgtatcagatttttatttgacgtaattgtgtttgtgaaaagtaaatgttgtcaaaaaattgaaattgaagtgtactcacattaatagttttcgtgtttcgattggtaggtttataactgctagagataaggtttttatatgtcagaattgtcatgtgatagtgcttttgttctggtagagaaacttgaacaacgtgagtgtgacgaaccggaccggtttgtttcaccgacactgattgtaaaataagattggtgttggtttctacgtgtcggtaagccggtgttccggttaagcaagggcacgtgagtttgctgcgataattttagggtgcagaagattactatctcacccgcaatttcagcttttaatgttgaaaattgcactgctttaagtttattttattttattttatttgagttgggtgttttataattgaaaataactactatattggaccgatatactaaagaaaaactctaaaagctagcttaagaaattttatattgatgacagtcacgaagagcgcatctttatgcccatcacaattaatgaggaggcacaatatacgaagccattatacaaaaatatttaatattcaatttcggtaaagattaaaacttagtatatgattaaagctactcaaaccgacaaacatttacatagtccaagcctttaacgtggatcaggattagatcttaagaagagtcagattgaatctatgtcatgaatatgtatatagtacgtagttatatccctaatgcatagtcataggcatttgatatcataaaagtataacacagatcgtatagaattataaacactaactaataactttaacgtcacgatcctactttttttatatttcctagaaaaggatgataattagccatgttcatcaacgctagtaaataccgacaatagataggttgacaaaatcgtgaagaatatgacgcaagtatagttttcggaaacactaacataaaaaaactgtcgcccaaaagtaccagtaatagtaccaattcacttgccttagttaccattatcaaaaaaccgtggtattgtcatctgtgattatgcaattggataatgttgatattctacaagagttagcgagtctagcaagttctcatattggagacgggtttttgtttccgtttgcatgcaacctagatttttttaatagtaaaatgtggtatttatatttatatttaaaaaaatattattttgtctaaagaaaatcaaatatggagctatatatgatatctgattcggaaaacttttttttttttgtatgaaagttacgtttataccgttttcatacagaattttaggaaaaatgatagaagaaaaagactgaaaactataagaaaggaaacaaagcaaagaaaaacggaaaatgctttaccaaaacatgtcattattgtttctaagagagagaatcttttaaaagaaacgactataaagagattccattacgcacacctgacaccaccaactccaaggcaggcaccaaccattgagaaaataacaaattgtaacttttgcctttcttaactcatttggtttagcatttggaaggaagtgataatcgcgaggtttgagatatttatatccaaaagacgcgatatagtctcttcttgggttttgtatttgttccttagttctttgcttcgacatccgatattcatatagcacaatcaaatcaaacaggcttagattttctagcaaaagtaacgttaacctttggttaaaggttgtcttcggttattgaataaaccaactgagatctcggttaacttgaactgaactgggattggtggcattagagtttttagatggattttggatagtatatgggctcgactctagaagctgggccaagttggttataacttgcaacataattgggaagaatatcagttggactacacttcactattagtgatgagtagaaaaatattggtttagtacagtttttacgttggttagatcaagagttaattgttggtgtagattagagatcaaggtcattagaaattgaacatggatccctaatctttataacaaaatataattaagagatcaattttcaagctctagttacttttttctatttttcttatctttatcaaatgaaaccatatagtagattgtttttgtttggaatgcgttttcaatattagtccaattatattttttagtccaattaaccaacaaaatgtctgtaatattagaccccaaaaaaaggggaaatacatttttattaaatacaaaagttttttaaattattaaactacatgaatttagatatttgtaacttataagtattccataattatccgatggtagaaaaatcatatgagattctattttcatctaatcatctggctttcaaatagacacccattatcacaataaccatccaaattgaatctcttatcgctctattatctcattacacattttcttataattttctcatattctctttttttgtctaattataattatttgtttcattgatttatcacaagagtcttcgaacaagagaaagaaaaagaatcccattttttaatactaaagtcaatcacctatcatttgattttgatcttgtacaaaataa

SEQ ID NO: 12275 - DNA, 3000 bp, Unknown
  misc_feature (1)..( 3000): cDNA_ID_2708610_gDNA_ID_2214540_Annot_ID_185223 3000 nt of promoter + ATG
aatgattgaggccaaactatctcccggaccttctatttacaatatacgccgacatggtgatagtagtcgtttgcatgaaacaggcgttagggtcgatactggtaacttctttgcagcaaaggtgagtttttcactttgttgatatgttaggttggatgtagattcttgtcatgttcgatctaattaattgtcatggcagagaagaggtgttgttgatggtgttgattttggagcaactggtttagtgaagaagatagatgtagatcgaatccgtgagaggcttgatagtggttctgtagttttattgaggaacttgggccattccagcaccggagaagtcttaaattgcaagtatgctctctttattggtaataatttacttgctaaatcttgacgacattaggtttttgtcaccctgatattgggacattacttctacactgcagtacctatgaggttgctacagcatgtgctttagctataggagcagataagcttatttgcataatggatggtccagttcttgatgagaatggacatcttgttcggttcttgactcttcaggaagcagatacattagtcagaaaacgggcacagcaaagcgagatcgctgccaattacgtgaaggctgttggggatggaggcataagtagttttcctgaacctcttggttacaatggtatggtgacgactcccaacaatcatattgggagaccgatttgggaaaaactcagtccgacctttcagaatggtgttggatttgacaacggaaatgggttgtggtctggggagcaaggttttgctattggcggtgaggagagaattagccgtttgaatggatatctctctgaactggctgcagcagcgttcgtttgcagagtgagtccttgagctaacccttgtgcctcttttttacatccagctctgattcgttgatttgttgaagggtggtgtcaaaagagttcacttattggatggtactataagtggagtgctattgttggagcttttcaaaagagatggaatggggactatggtggcaaggtatacacaactgttttcactttcgaatcatgcaaagttttgatttttcttacaaaactatggaccattcttgtcacagtgatgtatatgaaggaaaccgggaggcgaaagtggaagatcttgctggaataagacaaataatcaaacccctggaagaatctggggctttagttcgtagaactgatgaggaggtttgccttttagccatatcactagcttagattctacttctttttgtttaggtgttagcatcaaaggataattggtttttggtattcagcttctgcgagctttggattcgtttgtggttgtggaaagggaaggacatattatcgcttgcgcggctttgttccctttctttgaagaaaaatgtggagaagttgcagctatcgcagttgcatcagattgccgtggacaaggccagggagataaattgctcggtataatcacaaaacttttgagcattgtgtttcgaatctactggtaagaaaaaccccggtttcttgactgtgaaattttgcagattacattgagaagaaagcgtcagctcttggacttgagatgctatttctgctgacaacgagaaccgcggactggtttgtgagacgcgggtttcaggaatgtccaatcgagatgataccagaggcaagacgggaaagaatcaatctttcgaggagatcaaagtattacatgaagaagctgttgccagacaggagtggaatttctgttgttcgaacatttcagtatgattcttgagagtgtccagaagcagaaaattcaaacatagagcaaataaaatgtaattgacacagaaacatttagctgaatctctaagattctgctgagttttgaatcaatattttcaggaacagtgaacgagacaaatgtctttccaacgctatagtggcatctatcgatcgctttgagcttctccacgaacgattcctttgcttccgtcttctcctatgttgtcttgatctcgtgcagagaccgtcgtctactctttgtattgaatacactttgccttcaactgctttgtcttctgtttggttcaacttatataaatgcgaacctataaaatgaaaacaattctgtgtgatattgtgaagaagaaatagtttgatcagaatcctcaaagccgacaagaatccgtcgaaatcgcggtttgacttcccggagaattttccagataacaagaaagaaagtacactttcctggaaagaaaaacaaaatcataaacataacttttgagctcgttcaaattgaatcagttcacaaaacaaacccacattcacttgaaactcaccaagtgattgacgcaagcttggttttaatttcttctttcgtcagtttacaatccgatgcagctaatattgcagcagtagaatattaatatacaatcaaatttatcacttatactgtatatgatcccaattctaaatgtgatcagcaaagctctattattggtagtatatatgtgtatattcattagtggagactggagagtgggtgagtaaaataaacgatatgactagtacctcgcaaaacatgacgaaacctctattattacaaagatccttgtttcctatatgaggactttaatttttgatttattaaggtattaattcatccaaagttattttaaagatcctcaattttttttttttttttttttggtagttagatcctcaatatataacctactccttttcttttgtcgaaaatataacctactcctacatttgacgtcaggaaacctctattattgataatatatggtcctacatatgactatagtacaataaaacgccatcaaacgtctattattggtaattaattaagtaattaacttcttttttttgggataaaaattaaagatccttgtttcctaagatgactcgatctttagaaactaagagagaatgaaactaacactaaaattcctacaaaaaaaaa

SEQ ID NO: 12276 - DNA, 3000 bp, Unknown
  misc_feature (1)..( 3000): cDNA_ID_1807898_gDNA_ID_2214540_Annot_ID_185220 3000 nt of promoter + ATG
gtttctttaccgttagcgttggtccagcttcgtcgttgatgctccgttgtcgaagaagacacgtgattgtgtctcatttgcttcggacatccccaagaacctggaggttcagaccgaaaatcggagttttcccaaaccacgccgcggctgagcttgccaacgcacggtcgtggagttctgcaatttgccatttattttgtacaagatcaaaatcaaatgataggtgattgactttagtattaaaaaatgggattctttttctttctcttgttcgaagactcttgtgataaatcaatgaaacaaataattataattagacaaaaaaagagaatatgagaaaattataagaaaatgtgtaatgagataatagagcgataagagattcaatttggatggttattgtgataatgggtgtctatttgaaagccagatgattagatgaaaatagaatctcatatgatttttctaccatcggataattatggaatacttataagttacaaatatctaaattcatgtagtttaataatttaaaaaacttttgtatttaataaaaatgtatttcccctttttttggggtctaatattacagacattttgttggttaattggactaaaaaatataattggactaatattgaaaacgcattccaaacaaaaacaatctactatatggtttcatttgataaagataagaaaaatagaaaaaagtaactagagcttgaaaattgatctcttaattatattttgttataaagattagggatccatgttcaatttctaatgaccttgatctctaatctacaccaacaattaactcttgatctaaccaacgtaaaaactgtactaaaccaatatttttctactcatcactaatagtgaagtgtagtccaactgatattcttcccaattatgttgcaagttataaccaacttggcccagcttctagagtcgagcccatatactatccaaaatccatctaaaaactctaatgccaccaatcccagttcagttcaagttaaccgagatctcagttggtttattcaataaccgaagacaacctttaaccaaaggttaacgttacttttgctagaaaatctaagcctgtttgatttgattgtgctatatgaatatcggatgtcgaagcaaagaactaaggaacaaatacaaaacccaagaagagactatatcgcgtcttttggatataaatatctcaaacctcgcgattatcacttccttccaaatgctaaaccaaatgagttaagaaaggcaaaagttacaatttgttattttctcaatggttggtgcctgccttggagttggtggtgtcaggtgtgcgtaatggaatctctttatagtcgtttcttttaaaagattctctctcttagaaacaataatgacatgttttggtaaagcattttccgtttttctttgctttgtttcctttcttatagttttcagtctttttcttctatcatttttcctaaaattctgtatgaaaacggtataaacgtaactttcatacaaaaaaaaaaaagttttccgaatcagatatcatatatagctccatatttgattttctttagacaaaataatatttttttaaatataaatataaataccacattttactattaaaaaaatctaggttgcatgcaaacggaaacaaaaacccgtctccaatatgagaacttgctagactcgctaactcttgtagaatatcaacattatccaattgcataatcacagatgacaataccacggttttttgataatggtaactaaggcaagtgaattggtactattactggtacttttgggcgacagtttttttatgttagtgtttccgaaaactatacttgcgtcatattcttcacgattttgtcaacctatctattgtcggtatttactagcgttgatgaacatggctaattatcatccttttctaggaaatataaaaaaagtaggatcgtgacgttaaagttattagttagtgtttataattctatacgatctgtgttatacttttatgatatcaaatgcctatgactatgcattagggatataactacgtactatatacatattcatgacatagattcaatctgactcttcttaagatctaatcctgatccacgttaaaggcttggactatgtaaatgtttgtcggtttgagtagctttaatcatatactaagttttaatctttaccgaaattgaatattaaatatttttgtataatggcttcgtatattgtgcctcctcattaattgtgatgggcataaagatgcgctcttcgtgactgtcatcaatataaaatttcttaagctagcttttagagtttttctttagtatatcggtccaatatagtagttattttcaattataaaacacccaactcaaataaaataaaataaaataaacttaaagcagtgcaattttcaacattaaaagctgaaattgcgggtgagatagtaatcttctgcaccctaaaattatcgcagcaaactcacgtgcccttgcttaaccggaacaccggcttaccgacacgtagaaaccaacaccaatcttattttacaatcagtgtcggtgaaacaaaccggtccggttcgtcacactcacgttgttcaagtttctctaccagaacaaaagcactatcacatgacaattctgacatataaaaaccttatctctagcagttataaacctaccaatcgaaacacgaaaactattaatgtgagtacacttcaatttcaattttttgacaacatttacttttcacaaacacaattacgtcaaataaaaatctgatacaaataaagtaatatatcgagcgagtgattaatgggacattaatgttacatatagaaaaacaaaaaaataagttattgcctttatacaacaaagttcccaaaattttgaattttttgtaatcatctctaagattctgttaatggtctcgcctgagacatcatcatcacattaccaatcatctccaatg

SEQ ID NO: 12277 - DNA, 3000 bp, Unknown; identical to SEQ ID NO: 12271
  misc_feature (1)..( 3000): cDNA_ID_2708619_gDNA_ID_2214540_Annot_ID_185214 3000 nt of promoter + ATG

SEQ ID NO: 12278 - DNA, 3000 bp, Unknown; identical to SEQ ID NO: 12269
  misc_feature (1)..( 3000): cDNA_ID_2708633_gDNA_ID_2214540_Annot_ID_185206 3000 nt of promoter + ATG

SEQ ID NO: 12279 - DNA, 3000 bp, Unknown
  misc_feature (1)..( 3000): cDNA_ID_1394465_gDNA_ID_2214540_Annot_ID_134460 3000 nt of promoter + ATG
agaagcaacgagacatgcatggctatgtcctagcgaacatagagtagtagtttatacaagtataccaaagctaaaccagtctcgtgaactatatatatacgtcaacaccgaaactttggaaatgtataatacttgtatagttagtctctgtgtctgatattaaattgtacataaatttctttatgattacagtttttttttcccccgatttatttgacacggtttgggttatatatatgattagtcacacaccgacttgtaatatactctccaatacacgcttttaaatttggtgcgttccaaacggatgataagaacaccatgtcacactaatcgggtagggacgtccactaaccatattgacagttgtatcaactacaactacaccatatataacggtagatccattgcattcgtgtggaatctatagtgtttatatttgcatatatcatgtcaaatgatattttgctaatgtaggtaggtgacgccatagaacttttgaatatattaatatggaatcaatgcttttaagaagtggatggtgattatcatttatcactctatcatcccacgtttcatacacgctgcgacttatattttgatttacttttcttatgggtttggtccaattccaccgctaaacactatgcacaagtgcaaacaaatatttaattaaattcaacttccgatttaatcggtcattcaaatgagactaatgagtccaccaaactccacaattagatacccataaataaaatagaaaattcgaggttatcaacgtgcgataagatccactttttgggttatataataactaaataaatgaacaaaacaaaaatagatttgactaaaatttggctataaataaatttgagtttcaaagaagccaaacccgtcaacacatcttctttaagcatctctctcccttcaaagaaaatatcacaaaaatggcaaacgtctccgctttgctcaccatagctcttctcctttgctccacgctaatgtgcactgcccgccccgaaccggccatctccatctctatcacgactgctgccgatccatgtaacatggttagtctgattcacatgccatgcatgaatcaatttccatatataaacacaaaataaccaatatcagagcttctaaatttttaaaaatatttaacacatcgaataggtttaataaattttttgtaatgtatgatgattactttggcaggagaagaagatagaaggaaaattagatgacatgcatatggtagacgaaaactgtggtgcagacgacgaagattgcttaatgaggaggactttggtcgctcatactgattacatctatacccagaagaagaagcatccttgattttcacttactcatttctaacaaacttttgctcaagattatgtaatttatgtcatccttaattagtatttgtcacatacaagatcaagatagttatgattgtgattatttatatgtattttggatgatatattgtagaactagaagtttgacaataaaaagtttatagtgtcgttgtatgtttaagaagtttgacaataaaaactttatagtgttgttgcatatatgtgttgaaaactcattaaaaacacacacacacatgaagtacgcgtatatttataaataaactataaaattgagagtggattcatggaatcttttttattgaaaatacatgttggcttgtttgattagttgagagactgctaaacatttatttcatataactagcaaagatcgatatatcgtcgtgtacacaaaagtactactgtatatgtttgatcgaatctgaagaaccaaatttatattttcagactgattgtgtatatggtctcgtaatatacaatcatatgataattagccatcactaatgtagtcatgtctttatgctgaaagagtgtagagactctgccgtcataatgcagctgttaactacgagagcgaagctaaatatttttgaaaagctcccacttcaatcgaacggagggaaaaacctcttgcgcatggaatagagtagtcaacaatcatttgtaattgtaatagaaaaaactagtttaattagaaattgagcatcaaatttaaacagctctgtaaaattttctaattgtaataagaaatttttgttatatctgtcttaaaatatacaccaaaggtagacacaatatctcctacaagtgcacattcaacttctagatatagacaaagttccaaacttataataagtttttttgcaaagttattggttataattaagtttaattggtttatcaatgggtaaagtatacagtaaactgattaaacctagctatgtgggttatagatctcgaactatttactcgaagtacattaagttatagaactttcatttcggagaaaataaggataaaacttttattttatagacatatgaactagagttaaaatatatgagctctatctactgatactttttatgagaaaatagaccttttttctaaaattatctttgatgaaaattttgtttggtactccaacatgtgtacaaaagttgcgctagatcaaaacatatgtaagtaacacaacttatgacattcttgattgcaaaattagttaaaatctagttgtttttatattattgttgacacaaaaaaaaatgtcagcatatgaaagcctccgtctgaagcagaaggaacgactctggtctaaaactctaaaaaccctatcttcttcgttctaaacccaaaacacacacaaaacaaaatggtgctacttctccgatatcgatccttaacgataaatctcactcctctaatacccaaatctcaaaaattccacactctccaatcatttcgtaaccctaatttcatctccatcccaaaaatctcagcctccacgaacaatccaacaacaacaacgaatcggtcgatctccgacgcgactaaattcgctaagtcagtgttattcatacctcctggtgtagagattgaggaactaacagatgat

SEQ ID NO: 12280 - DNA, 3000 bp, Unknown
  misc_feature (1)..( 3000): cDNA_ID_1807898_gDNA_ID_2214540_Annot_ID_134463 3000 nt of promoter + ATG
accgcaacaatcccaccagagtctgcaaaattggaatggctctttgtttctttaccgttagcgttggtccagcttcgtcgttgatgctccgttgtcgaagaagacacgtgattgtgtctcatttgcttcggacatccccaagaacctggaggttcagaccgaaaatcggagttttcccaaaccacgccgcggctgagcttgccaacgcacggtcgtggagttctgcaatttgccatttattttgtacaagatcaaaatcaaatgataggtgattgactttagtattaaaaaatgggattctttttctttctcttgttcgaagactcttgtgataaatcaatgaaacaaataattataattagacaaaaaaagagaatatgagaaaattataagaaaatgtgtaatgagataatagagcgataagagattcaatttggatggttattgtgataatgggtgtctatttgaaagccagatgattagatgaaaatagaatctcatatgatttttctaccatcggataattatggaatacttataagttacaaatatctaaattcatgtagtttaataatttaaaaaacttttgtatttaataaaaatgtatttcccctttttttggggtctaatattacagacattttgttggttaattggactaaaaaatataattggactaatattgaaaacgcattccaaacaaaaacaatctactatatggtttcatttgataaagataagaaaaatagaaaaaagtaactagagcttgaaaattgatctcttaattatattttgttataaagattagggatccatgttcaatttctaatgaccttgatctctaatctacaccaacaattaactcttgatctaaccaacgtaaaaactgtactaaaccaatatttttctactcatcactaatagtgaagtgtagtccaactgatattcttcccaattatgttgcaagttataaccaacttggcccagcttctagagtcgagcccatatactatccaaaatccatctaaaaactctaatgccaccaatcccagttcagttcaagttaaccgagatctcagttggtttattcaataaccgaagacaacctttaaccaaaggttaacgttacttttgctagaaaatctaagcctgtttgatttgattgtgctatatgaatatcggatgtcgaagcaaagaactaaggaacaaatacaaaacccaagaagagactatatcgcgtcttttggatataaatatctcaaacctcgcgattatcacttccttccaaatgctaaaccaaatgagttaagaaaggcaaaagttacaatttgttattttctcaatggttggtgcctgccttggagttggtggtgtcaggtgtgcgtaatggaatctctttatagtcgtttcttttaaaagattctctctcttagaaacaataatgacatgttttggtaaagcattttccgtttttctttgctttgtttcctttcttatagttttcagtctttttcttctatcatttttcctaaaattctgtatgaaaacggtataaacgtaactttcatacaaaaaaaaaaaagttttccgaatcagatatcatatatagctccatatttgattttctttagacaaaataatatttttttaaatataaatataaataccacattttactattaaaaaaatctaggttgcatgcaaacggaaacaaaaacccgtctccaatatgagaacttgctagactcgctaactcttgtagaatatcaacattatccaattgcataatcacagatgacaataccacggttttttgataatggtaactaaggcaagtgaattggtactattactggtacttttgggcgacagtttttttatgttagtgtttccgaaaactatacttgcgtcatattcttcacgattttgtcaacctatctattgtcggtatttactagcgttgatgaacatggctaattatcatccttttctaggaaatataaaaaaagtaggatcgtgacgttaaagttattagttagtgtttataattctatacgatctgtgttatacttttatgatatcaaatgcctatgactatgcattagggatataactacgtactatatacatattcatgacatagattcaatctgactcttcttaagatctaatcctgatccacgttaaaggcttggactatgtaaatgtttgtcggtttgagtagctttaatcatatactaagttttaatctttaccgaaattgaatattaaatatttttgtataatggcttcgtatattgtgcctcctcattaattgtgatgggcataaagatgcgctcttcgtgactgtcatcaatataaaatttcttaagctagcttttagagtttttctttagtatatcggtccaatatagtagttattttcaattataaaacacccaactcaaataaaataaaataaaataaacttaaagcagtgcaattttcaacattaaaagctgaaattgcgggtgagatagtaatcttctgcaccctaaaattatcgcagcaaactcacgtgcccttgcttaaccggaacaccggcttaccgacacgtagaaaccaacaccaatcttattttacaatcagtgtcggtgaaacaaaccggtccggttcgtcacactcacgttgttcaagtttctctaccagaacaaaagcactatcacatgacaattctgacatataaaaaccttatctctagcagttataaacctaccaatcgaaacacgaaaactattaatgtgagtacacttcaatttcaattttttgacaacatttacttttcacaaacacaattacgtcaaataaaaatctgatacaaataaagtaatatatcgagcgagtgattaatgggacattaatgttacatatagaaaaacaaaaaaataagttattgcctttatacaacaaagttcccaaaattttgaattttttgtaatcatctctaagattctgttaatg

SEQ ID NO: 12281 - DNA, 3000 bp, Unknown; identical to SEQ ID NO: 12275
  misc_feature (1)..( 3000): cDNA_ID_2708610_gDNA_ID_2214540_Annot_ID_134465 3000 nt of promoter + ATG

SEQ ID NO: 12282 - DNA, 3000 bp, Unknown
  misc_feature (1)..( 3000): cDNA_ID_2711751_gDNA_ID_2214541_Annot_ID_134471 3000 nt of promoter + ATG
ggtcctattgcgtttggtttaagccgaaaacccgagttctccaatttccggttcggtgtaatcccggttaaatatacgcttcacagttttaaaccatcacagtgaaaaagcttcatagctttcttcttcttcttcttgacgatacaacgaggatgatcatcagataaatttccattgattgccaacaaaaatggcgactttaaagccacccgaatctcaattactaaaaaccctaacatcaatcctcacatcagagaaaacccatttcctcgaaaccctaaatccctacattcctcaaatcacacagcctctccttacctctctcctctcttctccttcactcgctaagaaaccagaaaccctagtatctttcttccaatgggctcaaacttcaatccccgaagcatttccatcggattcacctcttccacttatctccgtcgtccgttctcttctctctcaccacaaattcgccgacgccaagtctcttctcgtctcctatatccgcacctccgatgcatctctctctctttgcaactctctccttcacccgaatcttcatctatcacctccaccttctaaagctctattcgacattgctcttagtgcttatcttcatgagggaaagcctcacgttgcgttacagatcttccagaagatgattcgattaaagcttaagccaaatctgctcacttgcaatactcttctcattggtttagtcaggtacccttctagcttctctatctcaagtgctagagaagtgtttgatgatatggttaagattggtgtttcgctaaatgtgcaaactttcaatgttttggttaatgggtattgcttggaaggtaagcttgaggatgctttaggaatgttagagaggatggttagtgaattcaaggttaatcctgataatgttacttacaatacgattttgaaagcaatgtctaagaaaggtcgtttgagtgatcttaaggaattgttgttggatatgaagaagaatggattggtgccaaatagggttacttataataatttagtgtatggttactgtaagttaggttcgttgaaagaagcatttcagattgtggagctgatgaagcaaactaatgtattaccggatctttgtacctataacattttgatcaatgggctttgcaatgcggggagtatgagggaaggtcttgaattaatggatgcgatgaagagtttgaagttacagcccgatgtggttacttacaatacattgattgatgggtgtttcgaattggggcttagtttggaggctaggaagttgatggagcaaatggaaaatgatggagtcaaagctaaccaagtgactcataatatctctcttaagtggctttgtaaggaagagaaaagggaagcggttactagaaaggttaaggaattggtggacatgcacgggttttctcctgatatagtaacttatcatactctgattaaagcgtatttgaaagtaggagatttgagtggtgcccttgagatgatgcgtgagatggggcaaaaagggattaagatgaatactattacccttaataccattcttgatgctctatgtaaggagaggaaacttgatgaggctcacaatttgctgaatagtgcgcacaaacgaggatttattgttgacgaggttacttatggcacattaatcatgggattcttcagggaagaaaaagtggagaaagctttggagatgtgggatgagatgaagaaggtaaagattactcctacagtgagcacgttcaactctttaattggaggtctctgtcaccatggaaaaactgagctagcaatggagaaattcgatgagcttgctgagagtggtttgcttcctgatgacagtactttcaattcaatcatcctcggatactgcaaagaaggacgagttgagaaagcattcgagttttataatgaatccatcaaacactctttcaagcctgataactatacatgcaacattctcctcaatggtctttgtaaggaaggtatgacagaaaaggctctcaatttcttcaacacgctaatagaggagagagaggttgatacagttacatacaacacgatgatctcggctttctgcaaggacaagaagttaaaagaagcatatgaccttctatcagaaatggaggagaaaggactagagcctgatcggtttacatacaacagttttatcagtttgcttatggaagatggtaagctgagtgaaacagatgaattgttaaagaaattttccggaaagtttggatcgatgaagcgggatttacaggtagagacagagaaaaatccagcaacaagtgaatcaaaggaggaacttaacactgaagctattgcttattcagatgtaatagatgaactttgtagtagaggaagattaaaggagcattctagatcttacactagttgaaggagaaactccttttttgtggtttcttttttgtatttcgattttctcaaagcatacttattacttgttacagaaagacattgtaatgtagtttttatgtgatgatgatgattattatgtttagattgattaaaaaattgtgtattaacatatcaggaaactttcaaaatgtcgtgtactcgtacgtataatattttactgacaacaaaagagagaaaaaaacgatctgaattccttttttgtaatcggtgaccggttcggaaggctggaccgatcgggttaccgaattttttttataattttggtgaattgtttccatttttgggtttaaaaccgagcctaaccgtgacaaattctccaaaaactaccgaaatatatcaaaactaccaaacataaaccgaaattacccacataaaccgatattgttttttaaaccgaacttgggttccaattgagaattattttctcgaaacagaacttcatcgttctttctcaaacgtcaacggtcaatgaataggccatctccatttttgtacatcttctgagcttcaacttttctcgctgctctctatctcatg

SEQ ID NO: 12283 - DNA, 3000 bp, Unknown
  misc_feature (1)..( 3000): cDNA_ID_3024477_gDNA_ID_2214541_Annot_ID_185245 3000 nt of promoter + ATG
ttttactaatttatagtttttggagagtgtgttgaataaaagacattgagtgatttatattaaaatgaaatatcctatgtactaaatgtaggttggtacatgctacattaccacaaagtcagttggaaaaaaggcgagtttgcacccaaaatccatattgaatctaaaatcaaatactagcttaatataatttatttaactgaataaaataagtaaaaagaaatggagaaaatattgattaaatttatctcccgctatgatttcaaatcctactgtcgctcttttagatgtttgatactagtttgagtattgtttatctatgttcgggagttcgtttctatcttcatcattaacaaatccatttggcaagtttgtggggtgtttttggttttgaagttcagttttagtaattagacttttaaaaaaaaaaaagttattatccaaaataccctaaaagtcttggaacttaaatgtcatgatcagatcgattacaaaacaatataataataaagcaacaatgaagtgtttaaagaaaaaggtcgattacaaaccaatataataataaagcagtgttcaaagaaagagccaagatagtaataaagcagtgtcaaagaaaacgaagtagagaaagaagtcagaagacgaatggaatgggctacctctgaaaccagtagcggcactgggtggcgagaccggtaaaccaccactgagacccttgaggaaaaaaatcatctgcctcactgttcttaacctgaaagatctccacctaggtaactcaagattgaggttgatgaggagccttatattcttttattatgcagcagcgtagaaagtggagcttgccaagagtagaattcagactaggacgatctaggatcatgattgatctatctccctcaagaagacgatgatggcgggacctcaaaatccaaatgattaagcctacgtctctgaaaacttgtttttctatgtatctggtgccattaatcgatctccgatatcattaggattaccaaaaacaactccgcttgttttgctacctacaaaacccattggttcgtccctgccacatgaggccagatctgaccatgaccaaactgctcttcccaagagcgagctaagtggtcttttaatatattgtcgtgttgttttttcaggagtttttggatcaaacagatccttccagtagttgtaatccttgtactgtgagaactcctcttggggcttccccttggattcccataagacattttcttctttcacctcgacattttgtttatgttaatgcatgatgttattttaaagtatatgcgtttcaacaccaataaattctttcaaatatttataagaactatagttttaaaattgttgaaaaatatgactatagttttttgttgatttttatgttcattttgataaattcatctatttaatataattattattttttatgattagattcatctataactcgaactatcaaatctagtacaatatgaatatttatatatttattattctaatatttcactatcatgatcacatacaacaacaatatatgatatactgatacaatgtatgtagttatattacttatgtgtttagaaatttgtctaacttattgtaacaaacaattttttattctatatattctctcgtcatctagtacacaatcacatcataatatgctagtaatttaattcaacactttaattctcatctctaccatatagtcgtatatatagacagactctcatgttttttttttttggtatgtctaatgtcttggatgactattacgtcaaaaattgtatatcaatgttacaaagttatcagaacccacagaaatatacagaatgaatgtcatatgataaatcaaattcacaaaacgtaataataaaaaaatatccaactaaaattactaaattaatatgaggttaggtagtaaacatttaaactacaacacaagtaactttttaggcattatggatcaatgactatcgataaaaataaaaaataataagtagaatagaataaaagtagtacttgatacattattatgattttttatttattaatatttttagaaaatttatttaaaagtgagattaatggagaatttaacacaacaatagacttttgattttttctcaattagttttactaattttttaattaattaatgtagaatgacacatgtcattttattgtgtgatgatgtgtcactcatatggaaaaagttgggcaactttcatatatatgatttaagttgaaacctaaatttaaacttataaatgacataaatataacgttatttgtataatatataaatcatttaaatatttgagattttaatatataaatttatttataaactaaaaattgtgttattttatggaattatatagttcgatatttaatttaaaatatttagcacatttattaaatttgattttgacatctccagattgaacgatgaaaactttgattatatagtaaaacaataggaagtagagaaaatattatatagtaaaacacagtaacatattataatataaaaaataaaataaaaacttggattgggcctttggacccgaaagagggttttaggctgaatctgggcaagtgggtaagtaaacctacagagagttagcgaccacctcacaagcttcttcgtctccttcacagagctttattcttgccctagagataccgagcgggagattccagattgagagcagcttcgagtctctctctcctcgccgttccttttcgcttcttcaagtttcgttgccagagaggtaagtaccgagttgccaattcgccttttcaatttcaatctgaaattcgccgtatcggaggaatttgactgtggaaccgaattagacagttgccgtatgaataatgtttccattgggagtgactgatgttgaggttgtgcttgttattctactaatctacctttcttttctagattctaggtattgaagttatagaatg

SEQ ID NO: 12284 - DNA, 3000 bp, Unknown
  misc_feature (1)..( 3000): cDNA_ID_3024485_gDNA_ID_2214541_Annot_ID_185242 3000 nt of promoter + ATG
ttcagatttgattaacatctacttccgaataaaaaatttgatttgttgaatccaaacagagactagagggaaacaaaacagcagctgtaattgaaatgagtgttgatattctaagataccatcatcttttactcgagagatcatataatctaaaagaagaaacgaagacacgtttagattgtcgagtttgctatgaagctgtgttcaacttagtcgattttgcagctgcggcttttgtgtagatagggtgaagaacatgaccacctattggatcaacatgaatccatttgcgtcctgtaatcttgcttttctcgaacctgactcgtccttccttcaatgcaaacagagtatggtccttaccaatcccgacatagtctccaggatgaaaccgagttccacgttgacgaactatgatgtttccaggtatcacactctgcaaaatcacacacacacagactaagattgatttgatcatctcaaatgttatctaggtaggtcaatgtttggtttcttacctctcctccgaatttcttaacaccaagaaacttgggattagagtcacgaccgttctttgtagaaccagcggttttcttagtagcccaacgcttcaagaccaaactcaacccacttgaagaaccatctttaacatcccaagaacaagaattacacaaatgagttaaccagatcaaaatatagacaagagattttgaaaacatataccggaaatgctgctgccagtataagcaggaacctcagtgatgagttccctcagactaactcttctgcaaatggatgcagctgagtttaagaaattcattttctgcaagcaacagagatcaattcaaacattaagcattcaagtagaattaatactctatacaaactcaattcagtggaacgcaacgaataaacgaattgaaagcagatccacacgaaatcgaatcctaaagcactctaaatagagaaatttcccagagaaggagcacaaaggagttatagagaagaagctatacaacacagtcacataagagatgataaactctggagataaagaaacaaacttgatttgaaaatcaagcacgcttataagaatctgaccgaaagacgatcaccggagagcgagttttggtttttggatgggatcgtcggctgcgagagaaggagagaggtctccgggagatttttcaagtgagagagaaagaaaaagcgtttggagaaaagagagccgaaccgaaccaaaccaaaccattcggttgtattttttctcaacccaaataggtaggttcggttcggttttcgataacccaatatatttaattaattaattaattaattatattaataatattgtaaataatgtaaatatactagattttaacccgcggtataccgcggaaacaatttattttttaatgttagtatataaaagtttacaaattgtatctaactataaaatatttttattttatagtttacaattattattaagtaacgtcctattaaactcgttccgtcaacccgtcccgtaaaacaaaaccatttattttattaatgttgatcttatttatgatatgtttatgaattattgtctaaatattttgtaattttgtagtaattaaatgctatcaaattatatttctgctttgattattataactcaattgttatagtcatggagaaaagcaatatcaaaaatgataattttgtagtaattaaatgatattaaatgttggaagttttattttagaaaataatcgtgtagttaatgtggagagattttggaaagattgttaaatgtcaaatatttaattcgaagattttctttctaattatcaaaaacaaacatcaaaatccagtggcagccattgtaaataagtccaactacatgatttatttcacaaaatggctgcaaaaatgtatatatagatttatggtatatataaattattcaatttaaaattctgatttgaattttttgtttaatttaatatattatcaaattcaaagttgagccatacattttgctcgaaccatttgatgtggtcaaaacgaggttgatggctcaaaccaacctgagactgtgaaagtggggtgagatataaagggatgggtgatgccattagaaggatttatgcagaggaaggattattggccttatggagaggattgtttccaatgctaatgaggattccaccaggacaagccattatgtgggctgttgcctgttgctgatcaagtcactagtttttatgagatgagattactccaaaatactcctctatagagattctttttttttttaaaagaatcagtgtttcttgttggtttatttctgaaaatcttgtttggatttggatttgatctttaagaaaaataaaacgaggctacagttttttatttatttttaaaatcaaattttggagttaatttggtaataaaatatgtttaccacaaaaatcactaccccaaaattgctaacagcgtcaggtaattaaacgcgaaattgccacgtccatattagtttgggctgggattattttattttgggccacgtttggaacacaggcccacatttttcaaccgcagatgccaattgttatatgtttatgcttttaaccagcttcttgtatttttaattctcgatattgtgcgtgattgataagactcaatatctgttagatttcataagaatgtagtaacattttttaattatttagcctagaaatcaagagaaagttaactatctttgtcacattcgtagttgaacagaagagtgctatcaatcaatgttttcaattattcgaaattgattacaaaatattttaacgaatataattcttattaccttatgcaattttggtttttataataatcagatagatacaaaaaaaaaaaaagaacctgaatccggcgacttggtaagcagatccaacggctgagattcggtgagtggcctggtgggatgtcataaaaaaaaagaaacaattagagacaataatg

SEQ ID NO: 12285 - DNA, 3000 bp, Unknown
  misc_feature (1)..( 3000): cDNA_ID_3024501_gDNA_ID_2214541_Annot_ID_185238 3000 nt of promoter + ATG
agatagagaagctagaagggtacctgactaaaccaatgagaagagtattgcaagtgagcagatttggcttaagctttaatcgaatcatcttctggaagatctgtaacgcaacgtgaggctttccctcatgaagataagcactaagagcaatgtcgaatagagctttagaaggtggaggtgatagatgaagattcgggtgaaggagagagttgcaaagagagagagatgcatcggaggtgcggatataggagacgagaagagacttggcgtcggcgaatttgtggtgagagagaagagaacggacgacggagataagtggaagaggtgaatccgatggaaatgcttcggggattgaagtttgagcccattggaagaaagatactagggtttctggtttcttagcgagtgaaggagaagagaggagagaggtaaggagaggctgtgtgatttgaggaatgtagggatttagggtttcgaggaaatgggttttctctgatgtgaggattgatgttagggtttttagtaattgagattcgggtggctttaaagtcgccatttttgttggcaatcaatggaaatttatctgatgatcatcctcgttgtatcgtcaagaagaagaagaagaaagctatgaagctttttcactgtgatggtttaaaactgtgaagcgtatatttaaccgggattacaccgaaccggaaattggagaactcgggttttcggcttaaaccaaacgcaataggaccctgtcgtttcatgatttttttttttttcattggtaaaaatcatttcattctcaaatgttttggtcatgctacatagtacatacgaattttcgcatgattatttttcttataatttatattttaaaaaaattggatcagtaaagtaaaacagatttctttttaaattaaaataaatttatttgttttaattattattgtttattcttaggtttactgtatgacattcatatttctccaaaaccttattttgcgtagctacagacaaatagaaaaaaataatttacttatttacaagttagaaaatatcttttgcgaaattgaaatgttgataaatgtagtgattatattccaataaaaaaactaactgttgcatttgtgttttcatccctaattacaatataacgtttaagaaatgttaagctataagttagtaaaattatattttatcactaattcacaaacacgaactctagtacaatagcactaaattcgatgatgatacgatagcagcacgaatacaaaagcacttaattcaaagttgtattaaccactagattataagtttggtcagtgataaactaatatttacattagatataagcatttgctattcaattattcagcaacatctaaatctaagtattgaaggagcattatatattctatgtcgacgacaacgaaacgagccaacatgacatgaagctaggatactttatatgttatataagttataaaatgagcttctagaaaaagaagtaagtgtatatacgtatctacagaaatatcttgtagataggtgttgatgtagtgcaaaaaagtaagtctaaagactaaaagtgaaaaggacaagaaacaaaattttcaaaatataaaactaagaaagaaaaacgaacggcgagacattgcctagaacgcgacattgtcactgcaagaggctgtggctagtacttggctctaatgcaaaagtggggcgaaacgatagaccgtcgtagtgacttttgtccatgtcaattgcatcatcatagtgtcctttctataaagtcataataataaaagaaaaaaaaaaaaaagatttatgatactacttagagtttgaagatcatagttctttacaactatactttaagtgaacaaatagcgtatatatacgtatatttattcagtgaaaatatgaatatagtgtatccaaattatcatcttttaatatatttttcctcttcgtcaatttttgtatttgtttatttgatatatagtctttctagagtattggtttctagaagaaacttctgggacattgcttgcttccgtgagaaagttatacgtaacacctgtcttgcccaaatctttgtgattctttttcttcttttcatctaggttttacgtttaaacttacgcatgcatgagtgatattgatacataaggctataagcattaatcattattaatatatgggaaattactcgaagtgtcagctttggattatcactttcttcttcttcttctttttgatttgaaatttgatttgaaggtgatttcactgatatgtaacaaatgagtattttaaaatgttaatctttagataaaaattttttttgtcacaaatataatttaatttaagtcacaaaatatcccacataccttatgatgtctattattaccctatatgtatacgtaatattaaacttttatttaccctagtgtaatggtttttgctatcatcatcgatgtgtctccactctctacctaaattcaactcgataactaagttcgtacgtaaactagaatcagttgaacttacatatacagataaagtattatcagatgacactgttctttcttaatattaatgttatgacaactccactcaaccaatatacttgtaacttaatatgaattttatgtatatttttttttttctgtttaacattaaagatgacactattcgtttccgaatttatcctgtcttgtagctgattaatgtttgacacatacttgtataattagaaataatggttccctcagtttggttttcaaactcgagttttagcttaacttgtgtcgatgaaaataaactgtacacgtatgtattaaaatatttatttaaagcaccaactaaaatgttatgctatttgataatatccaaataattaaatcaatatcacgattcacttcctatatatatagggcttgcggaccgaacaacatatcgtgagaactaagaaacacccaagaaaacaaacaaactttttaaaaa

SEQ ID NO: 12286 - DNA, 3000 bp, Unknown; identical to SEQ ID NO: 12282
  misc_feature (1)..( 3000): cDNA_ID_2711751_gDNA_ID_2214541_Annot_ID_185236 3000 nt of promoter + ATG

SEQ ID NO: 12287 - DNA, 3000 bp, Unknown
  misc_feature (1)..( 3000): cDNA_ID_2711743_gDNA_ID_2214541_Annot_ID_134474 3000 nt of promoter + ATG
acgagtttatctaaggtcctagcgagtgactaaaccaatgatgtggtgtactttagtagctatggtgttccatgtgccgttgaattattggcttgtgatggtgaagcattggggtgttcttggtgtggctattgcatctgttgtgacgaatttgatcatggttgtgcttttggttggttatgtttggatgagtgggatgttgcggaagagagtgagtggtgatggtgatggtgggtctactacggtggtggctcaattgtcatctatgttggagttgtttggggatatgtttggagtggtggtggtatgagattgtgattgtgatgggtggatacttggagaatcctaagcttgttgtggctgccactggaattttgattcagactactagtcttatgtatactgttcctacggctttagctgaatgcgtctctgctcgggtatgtatctctatacttctttgttgtgatatgttaatggtcagaattttagttaaattaaagaagactaagtggtcaaaatttgagtcaaagctacaaagttgatttgagtcatgattagactaatgattagtgattaagtggtcaagatttgagtctagaaaactatttaactaagttgatttgggttttgcatttgaatgttcaaaatcaaattgtggatgaaacgtttgaagtcaacacatgtctttgctttttttttttaaagaaaatttttgttgtgcctatgattgatattggagagagtgagagtaattagattaaattaaagactaaaaaggcaaaagtcttggaacttgaaggtaccaaaacatttcagtagaggcaataacgttttattcaaaaaagatgtacaagttttttatctgttagctggtgctgtaagttttaccgaaatagtgcaaagctctatgaaaaagttgtaggagaaaactgtacaaaaaagttgagagtaaactgtttgtaacgcttttgacaaagtgtacagctttgtaaagcttttcccaatcaaacccatgaacttttattcttgtattgctttctgctatatatattcaaaatatctacaattcatatataaaaaaatgtctatagagaacctatcatgaagaagaatttactacaatttatgtttagcataaaaatgataatatttaaaaaatttaaataatatacctactttacttagaaaaacaacttgtgggcaaacttgaagagtgcttatgatcttgaattgactaacgtaaaattttctactaaatttgataatttgaaactctaatttttctaagttttatatctcctggataatgtatttttcttgataagtttaaaaaacgttttttcttatttaatgtattttttttgctacgaatttttttaattgatttattccttttgctgatttgtagtttgttttaaagtgtatttttctgttgttgaatgtaatgatcaatttggatttttaatatgttagaaataaatcaaattaacatatttactatgtaaaataacaataaatataccttaagattttatattggtcgaatgctatgttagtattgattttcaatattttctaataaacaaatttcatggtcatgagaatgtgtaggtagctttgttttaagcttacatattttaaaatttctagaatttctttttaaaaacatgtctaattattaattcatttgtatttacaatatgtttatccacaatatatttcaagtattgtttattatacctttcaccattcaaatatttataccatatttcatattgtttcctttttatctttcacacattattcagcaacttattttatctaactacatgaaaaatatacaatgacgaagataatcccatcaaacaacaatcactaaacagtaccaacgagatttaccaaaaatacctacggataatctaacgataacttctatttcctcatattaagctgctgagaacctttctctcgataaccccatcaaacaacaatcactaaacagatcttaaacatacttccaataacacccaactacaaattaaattagcaattttactaataaaaatcttaaaccaatgagaaaacaaaattagtagtccccacaaataaaattgaaataaaaactaaaactattaaaataaaaagtcggttaataatgagtaggtgtgaacaaatgagagaggaggaggatcagctttgcttttgttcccttttctcgtctctgcagcttccttgttgtcaacttctggaagcctttgattgattgcaacttctatctccattctcctgctcatttaatattccaattaatagtcaatctcgtcgaatcttcaattttttaaagcttttggtcaaatcaaatgtaatgcaaagacagaccaaaacctcctcttcttcttcttatatacttcctctcctacaaaatctctatttacttccatcttctctgctaaagacctttcttcaccattcccaattttccggtaactctctctttctcatgtgtatgacaaaaagtttatagctttgatcgtaaaattcggtgctttattgttctagctacagagattttttgtgggtctgctttgatttctcaataacgatgttccataataaagttatggttttttgtttgattcgagttattgttgtggcctgtggggattgtttggtacagtggtttatgtatatgttttggtaaagttgtcttctttgtttctctctcttttggtggaaaccagattggagttgttgaactatatgctagtgtttgatttttgtaaccattttgtttattattgatttgaggttctaaagtcttgaccttttttgacataccctgaagtgactttgttgaactcgagaagccacatttgttagtgttcttgatgagctcggttctttctttttttgttattcatgctgataggcttcttgttttggttgtttgtttgcagttcttgtttctgattgaatctagatattgattaagctatg

SEQ ID NO: 12288 - DNA, 3000 bp, Unknown
  misc_feature (1)..( 3000): cDNA_ID_3024485_gDNA_ID_2214541_Annot_ID_134476 3000 nt of promoter + ATG
tatctaggtaggtcaatgtttggtttcttacctctcctccgaatttcttaacaccaagaaacttgggattagagtcacgaccgttctttgtagaaccagcggttttcttagtagcccaacgcttcaagaccaaactcaacccacttgaagaaccatctttaacatcccaagaacaagaattacacaaatgagttaaccagatcaaaatatagacaagagattttgaaaacatataccggaaatgctgctgccagtataagcaggaacctcagtgatgagttccctcagactaactcttctgcaaatggatgcagctgagtttaagaaattcattttctgcaagcaacagagatcaattcaaacattaagcattcaagtagaattaatactctatacaaactcaattcagtggaacgcaacgaataaacgaattgaaagcagatccacacgaaatcgaatcctaaagcactctaaatagagaaatttcccagagaaggagcacaaaggagttatagagaagaagctatacaacacagtcacataagagatgataaactctggagataaagaaacaaacttgatttgaaaatcaagcacgcttataagaatctgaccgaaagacgatcaccggagagcgagttttggtttttggatgggatcgtcggctgcgagagaaggagagaggtctccgggagatttttcaagtgagagagaaagaaaaagcgtttggagaaaagagagccgaaccgaaccaaaccaaaccattcggttgtattttttctcaacccaaataggtaggttcggttcggttttcgataacccaatatatttaattaattaattaattaattatattaataatattgtaaataatgtaaatatactagattttaacccgcggtataccgcggaaacaatttattttttaatgttagtatataaaagtttacaaattgtatctaactataaaatatttttattttatagtttacaattattattaagtaacgtcctattaaactcgttccgtcaacccgtcccgtaaaacaaaaccatttattttattaatgttgatcttatttatgatatgtttatgaattattgtctaaatattttgtaattttgtagtaattaaatgctatcaaattatatttctgctttgattattataactcaattgttatagtcatggagaaaagcaatatcaaaaatgataattttgtagtaattaaatgatattaaatgttggaagttttattttagaaaataatcgtgtagttaatgtggagagattttggaaagattgttaaatgtcaaatatttaattcgaagattttctttctaattatcaaaaacaaacatcaaaatccagtggcagccattgtaaataagtccaactacatgatttatttcacaaaatggctgcaaaaatgtatatatagatttatggtatatataaattattcaatttaaaattctgatttgaattttttgtttaatttaatatattatcaaattcaaagttgagccatacattttgctcgaaccatttgatgtggtcaaaacgaggttgatggctcaaaccaacctgagactgtgaaagtggggtgagatataaagggatgggtgatgccattagaaggatttatgcagaggaaggattattggccttatggagaggattgtttccaatgctaatgaggattccaccaggacaagccattatgtgggctgttgcctgttgctgatcaagtcactagtttttatgagatgagattactccaaaatactcctctatagagattctttttttttttaaaagaatcagtgtttcttgttggtttatttctgaaaatcttgtttggatttggatttgatctttaagaaaaataaaacgaggctacagttttttatttatttttaaaatcaaattttggagttaatttggtaataaaatatgtttaccacaaaaatcactaccccaaaattgctaacagcgtcaggtaattaaacgcgaaattgccacgtccatattagtttgggctgggattattttattttgggccacgtttggaacacaggcccacatttttcaaccgcagatgccaattgttatatgtttatgcttttaaccagcttcttgtatttttaattctcgatattgtgcgtgattgataagactcaatatctgttagatttcataagaatgtagtaacattttttaattatttagcctagaaatcaagagaaagttaactatctttgtcacattcgtagttgaacagaagagtgctatcaatcaatgttttcaattattcgaaattgattacaaaatattttaacgaatataattcttattaccttatgcaattttggtttttataataatcagatagatacaaaaaaaaaaaaagaacctgaatccggcgacttggtaagcagatccaacggctgagattcggtgagtggcctggtgggatgtcataaaaaaaaagaaacaattagagacaataatgacgactatacccttgacgccgctgagctcctcctccttcctcttgccttgttcaatctttctcctcgattcttcttcttcttctgataaagaaaaagcaattcatagacgatcaaaaaacgtaatcgattgaaatcttcctccgatcaccacttcttctccaaggttccaattcggtactcacaaatctgttcgttgccagctcaatgtcattatatattcgcgtagaatctctgtaatagtttttgatgatcttgttagttttttccttcgatgatgaattaatcggaatgtaatgttctattggcatggaatgtcttcgctttgagaattgtttctttattaatctgtgttagcttggaggatgttgttgttgttgttgttgcatcatagttttagatccttactctcttgtaggttattttcattatttttgcactactctctcatcaaaacttttgctttggcatttttttttctagatg

SEQ ID NO: 12289 - DNA, 3000 bp, Unknown; identical to SEQ ID NO: 12283
  misc_feature (1)..( 3000): cDNA_ID_2711733_gDNA_ID_2214541_Annot_ID_134478 3000 nt of promoter + ATG

SEQ ID NO: 12290 - DNA, 3000 bp, Unknown
  misc_feature (1)..( 3000): cDNA_ID_2711729_gDNA_ID_2214541_Annot_ID_134479 3000 nt of promoter + ATG
atcatgtatttgaacttatttacaaggtcatgacactaacattaattatttaggaattaaagatttaaatcttttaaatccttgcttttagagttattatatcattatctaaaaggctcaaaatataaaaaatttaaatattattatttatatatttaaactttataaaacattattaatatttaaacttataaaaggtttaatatatcatactttttaacatcattatataatatatggagtttaaaaaaatctcaattcttccgtcatattttgtgactcaaaattttaaaaatgaacatgtattaaccaattggcgaaaaatgtgtgagtttaacgtcccacatcgactaaaatatttagacaatgattcataaacatatcataaataagattaacatgaggaaaaaaaaaagattaacattaataaaataatggtatttttacgggacgggtttggcgggacgggtttgacaggatgttacttaataactattgtaaactataaaataaaaataatttatagatagatacagcttgcaaaattttatatatactaactttaaaatataaattgtccccgcggtgtaccgcgggttaaaatctagttattttcttatatgtattaataatttaacacatattaatttttatttgcgcttacaagaatttttaatttcatcacaacaatttcttttaaattagtaaagttaaatgattttattttttattttatttttatttttgataaaggaagatcaaagctattttttacttttcgtgattaatcacaatgattttctttgattcattatgattggggctatcaatttgaaagcgagagttaattagtgatttggaattgagataaagatatttgaagctagagagcaaaaatgcatgtatcgattcagagtgatattgatgaagccctatataattgagagatgacctatattattatttggaaactacatagtagaaagtaatcttgcctttgtaaataattacattagaaaaaaaattaagagtaaattaattcacctcatacttggtaattatgaacaccaggatagtagcaccctttgtgatgtataaacgttttgcactgagcatcttttttggctcgggaagttggtctttgttttctcagttcgtggcacatgcttcgttggcttatgcctctttcccagcaactccattttctctttgtggacgacgaaatccgaggcccgatataaggcgtcctgaatttcaagggtttggataagttataaacaagccaaatactaattttgcaatctaattaatttaaataaattattaaaaatgaaaatacatttttcttaaagaatgattgatcaaaataaacatatgaattttattttataaattatgtttacaagccaatgctttcataaatctagattcgtgatccaagcaattctatttcttaaaacataaactatacaataaaaattattttttgataagacaactcaagttttcatattgagtacatttatagacgactttatgttttttctcctatttttttttgttggacttaacatcatattaatttttttctatttttttatttcctcctattagagttttgaaggctgttctataagtctgtagagtgtcatcgagtttggtggaccagtatattcttgaagttccaaccattctattcaagatagtttttatctgtttgttgctgacttcaccttgaccactagtctagagatggtaggctgtcgcaaccttatgctgcactccatacttctttagcaagttctcaaacatcttgttcatgaagtgagatcctccataaccactcttggtataccgaagatggggaatatgatactcttgaatagtttcaaaactaccttagaatcattggttggacttgcaactatttcaatccacttggagacataggctacgacgaccaagatatacttatttccctaagaagatgggttaaaagttccatgaagtcaatcccccagacatcaaacatctcaaactcgagtataggattctttggcatctcattttttctggtgatatttcttatccttcggctataaacttatgaacattcttgaacatggttggccattagagcccaacttgcagtatcttctgaacagttttgaaggttgcaaaatgtccttcataagcagagccatgtcaatgttctaggactccttggactttttcttcaactatgcatcttctgaataaaccatatacgcctttcttgtatatagaaggctcatcccataaataatggttaatatccctaaataatttctttttctgataaacatcaaggctttaaacaaatcaaatactaatttatgcaatataattaatttttaaaagttataaacaaaaatatattattaattttttaaaaatgaccgatccaaatgaacatatgaattttagtatataaattgtgtttacaagccaatgctttgataattctagattcgtaatccaagaaattctatttcttaaaacataaactctacaaaaaaacatattttttttatgggacaactcaggttttcatattaactacatttatagactaaattttatttttctcctatattctttggacaacattaattaatattttctctattttttcaagctaatggttgacaaaaaaaaagaatatttaggagacaaatgaaatttacaaaaacaagaagaagttactattttgcaaactctctcttttaattaacagctttaaaagaaaatagataaactcataaaaagcccataagagaaaacttgaacagaacaaaaaacccaacaaaacccaacttagtagcgtctctccattctcttcttcttcgtcgtcgtccctgtcttttccaaacttttttgctgtgcgtttttttttgtccaaagaatcatattcttttgccctctcacacgagtcatatttacctttttgccacaacaatc

SEQ ID NO: 12291 - DNA, 3000 bp, Unknown
  misc_feature (1)..( 3000): cDNA_ID_2711725_gDNA_ID_2214541_Annot_ID_134480 3000 nt of promoter + ATG
tagttgagaacagtgcaattaccctcgggagactagcattgattcgaccagacttagttgcaccatacatgaagccatggtccatggcattgtcaatgttagttaacctctgtgttggatttgagtgtccacactcttacattttgctccatagatcgatagttacaatacttgcttttcaggttatatgatgtcaataagaacgaagacgcatttatttgctttgtgattcaaacatgtaaaccaagtttgacatttatatataagttgtctgcacaaattcagtttaaagtggatccattagaagtttttgactcactttatttcatatgtcaagccattgcgagttcgcacgtaagtaaacagaaaactaattctgaccctcctagctatatttcaattcaaactcgatactgagatttggaaaaattggtttacacaagtgacacctttttttttttatgtcaggaaataagaagtgaggaaataaaaattggaaaaattggtttacacaagtgacaatttatttcacttttttttacacaagtgatccaacatattttctgtccagtgtttaaccatcttattgctcatatacattagaagtgattatatgtcaaatgattaatgtctttgatttaatctgtcttcaaatgatgggaggaaacttctgagagcaatgtctctctttatgtgaaggaaaggcttgcgagatattaagtgtaacaatgattttacaccggttagtctcaaatcagagagatgtgatctagcttattctcattgcaaacaataactagattgacagagtactttgagcaaaaggtgttttagaggtatttacatttttgaatccaaaatgtgattgtttggatttggatccatggtttatacacaaaccaaattggattaatgagaaagaactctattaatcaagttgcagttttattataaataatagatttcttttatcaacaataagatttaattgttttagtactgacatacagatcgtttcgtaaaaggtcaaattaagtttttgatagaagagaattttttgtcttaaaagacttataaatctgaatccaagccaaaacaagtaaatcagaaaaaaaaaaattaaataaatttgaaaaacttctatagtaaagttccgttaacaaaataaaaataacatatatcgatctatatgtactatcgtcaaaatcctaaggatgtcattaaattgatactttacatttttggtttgttaaaaaacgatgcatattttttttctggaacatacgagaaagcgatgtttgttttaaaataattttggatgaatcaattgagaaggatcaattaatatattcatatcagtatcacccctgagttttcttaaaataatgaaagttgaaaattctatgtagaatttaaggagttaaaacaaacatggaatttaaggagtcaaaacaaacaaatctcttgaactcgttaattgcttaaacaccatgttgtgtagcgtgtcttgtgccggcgagactcgaggctgtggttttttctccaacgtcatcatgtcttttgacaatgaccaatcttccatttcccggattgtccatggtcgtgtctccgatctaccatcttctcgcatatgacattgcgtcttacaacccttttgctccttttattgtttttaatcttgttgtatcaaacattgagaatagtattctcccaaaccttgtactacatttgagttattgaatggaaaaacaagcttttgcccaaagaaaaaaaagacaaacatggataaaagagaagcatgagaaagagagacgctagctttacacttttcacaattttaggattttgaataaacataaaagattttgaaaatttagggttctataaacaaacatcacaatgttttatgtaagaaaaatgttgttttctaacaaaccaaaacaataacatcataaaatagaatatcgtttaaacaatatatgtttaggcaaaattatagaaaaactattttcttatcttgatacattttttattgataatttaactaaagggtttaaaatggattaaccgacatttgggaagttgttttattaaactaacttacttaagggtttaaaatttagttggaggcttaaaattagataagtcaatagttgaaggttttttcatgaaagtctttttattttgagaaaatactatcatacccattaaaattaatctattaataaacataccattttaattttttttttttggaaaatataaatcttaacaaactaaaccctatttacattttatttttctttctctttaaattagtcgccgcctcctctctccctcgggattctcgctctgattcgcctgtcactgtcagccgtatctttctctctctttcatcctttttctcctttctttcaccccctttctctcctttcgtatcaactgtgggtaaatatattttcctttttcgttcattttcctctcaatttgtaaaatcttatacaagtttgtttatgtaatagtgtttactcaaatatttcatgttattttggtgttagctttacattttttcaatttattaatgcttaaagattgtttaatttaacattagtagaccaaaattggttaactggccttattttgtctatttcagttgatctccagaatttcatggcatataaggcatatgtcttaaaaaagctcaatgaagaagtatctcttacatcatgtaaattttggtaaatgatttttttctgttgttctgttttttttttaatcaaattattttctagcttgtaaaattgcttaactatactattgtttgccaggcctgcatattgtgatgctcagctggaaccaaaggacttaaaggagttattgccacgcctgattccagtaaaatgatacttctctttttcttctactattttttgggcacattctagtagtttgacattttaataaaatttggtttggatttattagatgttgctctcagat

SEQ ID NO: 12292 - DNA, 1294 bp, Unknown
  misc_feature (1)..( 1294): cDNA_ID_2711783_gDNA_ID_2214542_Annot_ID_134482 3000 nt of promoter + ATG
aaaaaacataagctggcggaaaaagagaattcttcggaatctagatcctaaataaagaagatgaagtaaactcaaattataatgcagaaaatatcaaaccaatctcgaaaaaggacgatagtacaaactaagatccatattaacaagacaaaatcttaaaaaaataagagatccaacaaagcagaaactccacttcttttaacacacctgcaagtacgattgatcaaatccaaaataacatttaccacctcctatcacgttgagagccaatctctcgagaaccaaggatatcataacccgacatgcaagaccactaaaagaaacacaaacaccattccagatacgacgatgaccaccaattcgtcacttaacgtctagatagaatccttcaaaaaacaatcagattacgacaaaattgtaaaagaaggacaagaagcgaggcaaaacttctcaaaacccaccaatcacaagatcaccaatcacgagtaaagccacaactattttaattaaatcatacaatatcctaaattaggcttttctttttgataaattaaaaaaaaaaagataggatcatccaacaaaaatagtacaaacaaaaaatgtcaaaatcttgcatcacctctaaaaacctttcatgttaacaaaatcttgcatatttttgccctatacaaagtcttgcatatatacaaagtcctttggtatattgttgttagccaccttatctaactcttttacgggctctgtcctcatgaagaagaacaatttttttaataaattgttaccttaccacatataagcttaatctggaatggttgtgatttaatcaatgaagatattgcctcaaacctgaatagaggagtgaaagtggatttcaattggttggttatcaaacccatcagcatgatacctgttagtttctcggccataccactcaatcattgccataaatatcattgaagtctactagtctgtttgagacattcaactcacacaagtggtgggttattttctctgacaaacacggccaaacaataaaattgctgaaaacaagaagttgcctaaaaaaccaaaggacttgtgagaaaaatggcaaatgcgggctaggatgggctgtggattagaggcccaatatgcctaatgggatacaacacgacgtcgtttagaccagccatagttctcttgtccgccaagacgggagagactaaggaaaagcataagaagagaagaaccaaagaagaagcaaagaagcactgataaatctctgcaactcaacaaatttctgagattagctatg

SEQ ID NO: 12293 - DNA, 3000 bp, Unknown
  misc_feature (1)..( 3000): cDNA_ID_1807247_gDNA_ID_2214542_Annot_ID_134484 3000 nt of promoter + ATG
ctggcgttggtaagtgctgtttatttccccctaccattttccatttcgattggaccactctcacactctgtatgtatcttgtttatcctagtatgtaatggctaatcactacttgtgcatgcgtcttcaaatttcagttagagatgttatgtattgtaacatcatcactccctgttagatatgctgtatatacaaatatggtctttgcatactctgcttggctgacttcaccatcattcacatgtataaactcttatatttgtgctctttcttttgtctttgagaacatactgtttttatttttttccggttttcgttcctgtgtaaaactgatctgtaatcttttataacacaggtataactggagtcctatgtagcaaattttgccgtaaagttatttttactgaccacaacgatgaagtgctcaaggcaagattacgttactgaagatttgatatgggaattcaacattggtagaatataatgaggtcttttaaatgaacttttcagatactgaagaaaaacattgaccttcatggacattcaagtggtcccaaaccctcagctggtgagaaagaaaatcaactaagctattgactctcattgttcatattattgatgtgttctgtttctcatttctacctacagaattagaggctgcaaagcttgaatggggaaatagtgatcagcttggtcaaattttaaagaaacacaatgatggctttgatcttattcttggagctgagatctatatccttatgttcgttaacgaattctttatctatccgctaggacagtggttgatcttagttttatccgtagttgaagttttggtccggatcttctgttcagttttcatcagttaaaccgtcatgggcactcctataatttacaccggaatgaaaaagaaaaccttgacattacgtaagctttcagcaatcaagtgtgccattgctatttgacagtgttgagcagcttctgcggatcaggggacaaggaaactgcaaattcatactagcatacgtatcacgggctagacagtaagtttgtcagctaaaacttttgcatttttctcatataagtataactgcaagtttcatacgagtcagagaataaactatctgaaacgttatttcaggatggattctgcaatcttgagagaaggcgctcagcacgggatgctgatgaatgaagtttctgggactcggtgtaccgtaggaaacttggaaggggtcatatatgaaatcacacttcaaaagaagagaggaattgtgttcgagtaacttagttcctttgatacctcagaattttgtaacattatttttatgttatttagatgcatacatttttggtgaaacgtttactaaagttacagttcaaaaagtatacaatgacatttgtggatgctttgaagtgaatccacattgttagctgaaaaactgttgcaactatcatatctcctttatgatagttgtcatgtccaatttcttgacttcacctacttatcagttttcatgtatatcattctttttgttttccacatcaatggatcatctttatcctgcgtgactttaaaagtaaatatttttcagtcttattttatcttctatattatttttcagttttttttttttatcttttacattatttttcagtcttattatatcttctatattattttcattcttatttttcttttgtcggtattttcattcttattttatattctaaatcatttttcagtcttattttattttccctattatttttcagtcttgttttatattctacagtattttcagtcttattttatcttctttgtcattttcagtcttttttatcttccatattattttcagtcttattgtatcttccatattattttcagtcttattttatttatctcttacattatttttcagtcttattttatctgaaagtgtcatttaggtaggtgcagactgaagatattgggactttagttgatattcgaaaaaaaaagatattgggacttaagtttgcaaagttttactactatagtaatatcgtaagtacgtaaaagatatattttactaatgttttaacaaatcgtttaatatcataaaataaaataaccatgttatttatttttggggaaagtatttaataaaaatacaccacataatttctattcccacaaaaaaatacacgatctattttttcgtaacaagaaatataggcttttttttttactcattttagtatttaaagtttaaaccaatattatttatttaaaacaaggactaccacacaccacttggttagggtcaattttattcaaataaatttccaccatataataacttaagttacactatacagtttactcaattaaaaatttgttgtccaatcagtaaagaaggaaagaaaaaaaacatgttataaattgattgaggtctaaattaaatgttggtcatcttccaactccaaaaggacccctcccaaccagaattagtggagataaacttgacgcgtcccttcttcattctccgtcttcttcacgtcaccggaaaaacgacgaatctcattgcctgagattcttcatcggaattaaacctccggaggaattaatcacggtaaatttcagactcttcgttatctcttacgctgatcgaattcaatagaatgttagggctgatcacaaagagcgatgatttttgcagcacgattctgttctaatcggagaacatttttcctaattttgtgaaattcatgttgaatttattgattttccggataattagtagagaatcgattttggaatttgaatgataatttgtggtatatttgaacatattttttgagcaatggacctgaccattttctccagagaactcaaactattgctgaaaaatgcaatggaatggggtgagacgagcccattctatatggtgcaagagattaacaaacaacactcatttgcatcatccttctattccagtctcacattttttcaccatg

SEQ ID NO: 12294 - DNA, 3000 bp, Unknown
  misc_feature (1)..( 3000): cDNA_ID_3024525_gDNA_ID_2214542_Annot_ID_185274 3000 nt of promoter + ATG
gctcaaaataactaaaatatatgaatgtacatacttatatgtgtctagagtaaatattttttgcaaactaattcattagattgaacaaattatttagttcttttttccacatagtttatgtacaaatatttaattcaaaccgaacccaataaaatttggttatatgtcggtccgaactgagagataaccgaacatagtcaaaccgtaaaataactaccgatccgaaccgcatgttttttggttctatatgaattctaaaccccttaaaacaatttactcaaaatcgatctgagccaagtcgattatcggatgtccacgttagatttttccaaaagaaaaagagtagaataaaatagtcattctcacaactaataaatacctacaatttacatacttgttttgtattattatctttgacatgtgtaatggggacaggtataaatggaccgttagattagagggatactagtctattatatactgtacctattttgattaatttattgattctagcaacattctactttcttctcaccgaatttttccttctactgttttttaattaattatagcaatgttttttttcgaacatttcaaacatgtatttagagtgacttgtaatctagaaatatcaagatgagctggaatcttttgagtcaatttggtctggtctggttctatcattttcattttaggattagaattttcaactcatgtattaatggaagtatgaagtcaattctaacatgtttagtggttattggttagaataaattatgcatcattattggtcataaaagatagataaagtttttaacgaataataacaaaataattaatagaaatggtaaaaaaaaataacagtatacaagtagatattagtctctctctctctttttttttgtctttcaacaaattgttatgtgattacaaatagttttttctttttgttttcaagaaacagaaaataaaaaataatgatatacgatgacgaagtacgggtctggcctgttttgatcaaaatcagatctactctttgttaacattaagagattgatgactagccatcggatccattctctttggtttcatggccgatcatagctgatctatttctttgaattttaagctagcattctattaatgcttttatttcattggtcctctcttgttgtaatctcctttcaaactatgtagataattttttgttgaataaaatttaacattccaaatttccaaccaaaaatctaatatcttaaggtcattttgtttcctcccgagacctttcttcactttaggaggtattgagactcaattcatcaagcatctaatctaacgagacaaatgaaataaaagtttggttgcgggttgatgacttttgaaagatgtgacagtcttgttcttttcctaaaaactaggagtggatatatcgtaaaagtgtcttaagatgccaaagctgagagagtgagtgttgaacaacctgcgttgaatcattgtagttcaacttgtttatatccaacaatattcatagagagacataaccttatgtcattccatttagtttgtagaagtagagaagattcgaacatgcatctttaaataaacgaagaatgggaatttaaagagaatgcaaagaaagaaaagtagagtagaggccaagaaacataaactagattatacatctctcgacgattctacttattatttatctcttaagaaatttatgcatatcccccaacaaaaccaaaaacataagattttcaaatgtaaaaatgtcgatgaaacatacaaaatttggcagtgaaagagtgaaaatcagcttcgtcggccaaagatttgtctgtcgccaaccaaaatattaatattaatggttacaaacaaagtatgggggtttcttggctggggcatggtgctaatcattatccagaaaattcaaacaaactgtcacagaactcagcactcacatttaatgaaaactttgtatttgttcagtcgaataaattaacgtgtagtgtttcaaaatgtgttaaatcaatacttcatcatgtgattgtcttgattttatgagtttatctaactaataaagctattttcacagtaaaaatagaggcaaatcatttggtggaaatagaccatattttcagcatatttctacatcttgattgacttttccaacatcaataaatatgtttttgcagcacagttttcaaatatagaatttctgtggtatgaaccatagtgaatatgtgcatcttatccatatataaactaaaatgtataaaaatatacaatcttgtttaacaatacaatcagactgtaaacaaaaaaaattcaatagatatgattgattaatacatgtgaaacttaggcatacgacttttgagcgaaccgaaccgttcggtttggataattggtttttcgagtatctagttaggagataagactgccaaatttaaccgaacaaaaattcggtttggatcggttcagttatcagttaactcagttcggtaatgtgtctcaaatccatacaaaaatttggtttgtatagcaattttaaagaattttggtattagtttataaaattggatatgatttgtttatattagtttaaaaaattagaaaaaatggttaaaagattgttcgattaaccgtacctaaccaataggaaaagttaccgatcggaccacttctattaatcgactggttaaccgaacactcaaatctcaattaggttctgttcgaaaacacatcggaaatgacgacaggaaaaaaaaaaaaaaacacacacacatcgacgtagttgtagtagaatcgatccaaaaatgttaagtagatattttccagataggattgttgatgaaaggggcagatgaagaatgtgtggctctcctctctttcacaacactccacaaaaccctttgtctcctcctcatttggagatgtcactaactcatcttctctgattcaccaacatcctaaaacccttttgatcaaaacatg

SEQ ID NO: 12295 - DNA, 3000 bp, Unknown
  misc_feature (1)..( 3000): cDNA_ID_2708658_gDNA_ID_2214542_Annot_ID_185272 3000 nt of promoter + ATG
agaacttgtgtggacaccagcaatggcagcatctttatccgcacagattgcaaccatggcatcagatatttatcgtgaacaacagaagggttctgttattgaatgggatgtaccagagcagtcagctggtcaacaagaaatgagagacgagccacaggttattttatttatttaaccctatatatgaatcagagcagcagggaaagagttcctttaagtggaagcataattattgatgaaatttttctctctaggttggtggaatctatgtcaggcgtttcttaaaagatccaaaatttcctctgagaaatccaaaacgattcttggaaggactgctggatcagtatttgtcagcaatggccgcaacacattacgaacaacatcctgttgaccctgagctccctctccttctctctgctgcattggtttctttgttgcgtgtgcatcctgcacttgcagatcacattggacatcttgggtatgtcccaaaacttgtcgctgctgtggcatatgaggggaggcgggaaacaatgtcttctggcgaagtgaaggctgaagaaattggctctgatggagtgaatgagtctactgatccctcaagtctacctgggcaaacccctcaagaacgtgtgcgccttagttgtttacgtgtgcttcatcaacttgcagctagtaccacatgtgctgaagcaatggctgcaactagtgctggaaatgcacaggttctctactctatttctctcctcctactctaccacacgctgttaaaaatggaaactagttgttggtgttacctatgacatgtataatgactcttaagttgattaaacaccaggtggttccacttctcatgaaagcaataggatggcttggtggaagcattttagcactcgagacacttaagcgtgttgttgttgctggaaatcgggccagagatgcgcttgttgcgcagggtctaaagtgagtaatcatgttactatatgataatgtctttggtactcaagctgacgggtgctcacatcttaattatctctaactgcaaaactctgttaagactgctgaagtgttaatctgacagtacctagttacagaataaaattgtggaaaatagtcgtttagaagaagtggatttgggtgagatatatctaattgtctgatacaaatgattgtgaaaattggtagggttggtctcattgaggttcttcttgggctgcttgactggaggacggggggtaggtatgggctcagttctcacatgaaatggaatgaatcggaagcatcaatcgggcgggtacttgcagttgaggttagtgttgaatttgttagcgagatgtttgttatgtgtgttacacatgtgaatgatgaaataattaatatatgtctcaggtattgcatggttttgcaacagaaggagcacattgctcaaaagtgcgtgagatacttgacgcgtcagaagtaagttgtgatattgaaacactaggaataaagtcttgttcaacatagtagttctctgttgttaaaaaaactcatatgaatctgtcacaggtgtggagtgcatataaagaccaaaagcatgacttgttcctgccatcaaacacacaatcagcggcaggggtggctggctttattgagaactcatccaacagtctcacttacgctcttaccgctcctcctccgccttcgcatccttgaccatttcttccttgtatatccttttgtaaagtccaatcattaccgtgcttttttttttctttctatagagaaatactgtcgtttgtaaatgtttgatgagaaagtagaaaatatttgtggtttccttggaccaacaatgaaaactacggtctgatgacaggatttgtagttgttgggtcgtagacgatatccaaacaacttgtccctttatattttgggattaaacttgttgcttattaagtcaattttctccattatctaaaataatctgctcactccgtaacttcttcagctgaattacttatttgaacaactcactccgttggtaataacgtaaaatccgaatcttattccaactaattaagaaagaatacgtaatcttttttaacaatataccaaacagaaagaatgacttctacaagtgtagttgtatttatgcactcgatgtactaaaatcttttctctattaacagactaactgtattatcttatccacttgaacagtttctcgtcagttgccagctcagcttgaagctcctttcttcttccttcctacataaactttcatgcaaatcccatcgatattgagatgggtaaatgactaatctgaaaatcatttacttagaagttataaccttaaaacatgttgttttccacaaacggaacacctaatcgtctacttgtaatagctcaatgccagctccatcgactattttggaaccgtttgatgctgcaaatgattttatgtactatgttcccaacttgtttttagatatgttttttagaattgctcatccatgacatgactacactttcctttctgcatagaatcacggtgaacggctcaattgtacatcgttagagatcttttgtacacttgctttcattaatctacaattttgttaataaattgcaatgtctagaactcaaaccgcatgccttgaatagaagcatgaattaaccctacatcaatcattggtctaatggggcttccactagaaacaattttttcatttcattttggtttggatatatattttcaatttggtttagatagaaaagattcggtttatcttaagcacctccaagaaacagtctacaccttttaagaaatagtaattaatttacatctttaagaatgattcatattgtctctttcttttgactagaattggtgcccaaaatcttatccatttatttcaactctatataaatgatttccattttccagcattgttctttcatcacgtatgacatacccagcaacaattttaattttaaaagagagagattaaaatcaaaaagatg

SEQ ID NO: 12296 - DNA, 3000 bp, Unknown
  misc_feature (1)..( 3000): cDNA_ID_2711755_gDNA_ID_2214542_Annot_ID_185271 3000 nt of promoter + ATG
ctcctcctccgccttcgcatccttgaccatttcttccttgtatatccttttgtaaagtccaatcattaccgtgcttttttttttctttctatagagaaatactgtcgtttgtaaatgtttgatgagaaagtagaaaatatttgtggtttccttggaccaacaatgaaaactacggtctgatgacaggatttgtagttgttgggtcgtagacgatatccaaacaacttgtccctttatattttgggattaaacttgttgcttattaagtcaattttctccattatctaaaataatctgctcactccgtaacttcttcagctgaattacttatttgaacaactcactccgttggtaataacgtaaaatccgaatcttattccaactaattaagaaagaatacgtaatcttttttaacaatataccaaacagaaagaatgacttctacaagtgtagttgtatttatgcactcgatgtactaaaatcttttctctattaacagactaactgtattatcttatccacttgaacagtttctcgtcagttgccagctcagcttgaagctcctttcttcttccttcctacataaactttcatgcaaatcccatcgatattgagatgggtaaatgactaatctgaaaatcatttacttagaagttataaccttaaaacatgttgttttccacaaacggaacacctaatcgtctacttgtaatagctcaatgccagctccatcgactattttggaaccgtttgatgctgcaaatgattttatgtactatgttcccaacttgtttttagatatgttttttagaattgctcatccatgacatgactacactttcctttctgcatagaatcacggtgaacggctcaattgtacatcgttagagatcttttgtacacttgctttcattaatctacaattttgttaataaattgcaatgtctagaactcaaaccgcatgccttgaatagaagcatgaattaaccctacatcaatcattggtctaatggggcttccactagaaacaattttttcatttcattttggtttggatatatattttcaatttggtttagatagaaaagattcggtttatcttaagcacctccaagaaacagtctacaccttttaagaaatagtaattaatttacatctttaagaatgattcatattgtctctttcttttgactagaattggtgcccaaaatcttatccatttatttcaactctatataaatgatttccattttccagcattgttctttcatcacgtatgacatacccagcaacaattttaattttaaaagagagagattaaaatcaaaaagatgacaagaaagaaggtgaaacttgcatggatagagaatgacaacacaagagcaataagtttaaggaaaaggagggtagggttagttaaaaaagtgagggagctatccatattgtgtgatataaaggcttgtacaatcgttttcagtcctaatgaagctgagctaatggtctggccatcagttgagaggctcgtggccttctagatgatttctttgctttaccgaggtatgagcatattaagaaagagatggatattgaattatttctaaatgagaagacaaataaggttaatgaaaagttgataaagagttgtaagaagaataaagagtatgtcagtaatgagttgatgatgcaactacaacgcggtcgtagaatccatgatcttaacttaagtgagatctatacattactatcttactcaagggaaactatcatgtcttttaggaagaagtttgatttcatgcagcattctcctcttcgtgatccaccggtgcttccattcgaggtgcaagtcgaacagtttaagagcaccactaaggacgcttttttagggggtgatctagacgttgagagagctaggaacacaaatgaagcaacaagaataattaacattgatagtttaagggagaataaaagttattacttaatagatcaatggtttccaacacctgaaccgcctaaacctgtaacataccagcaaattgggtatgaaacttcaaaccgtagaggctacaatccataccaaggaagtagtagcaatgggaaccctaatttcgagatgatgtcagtttccccgaagtgatgactttccagggttcggttggatctacctctcaaccattacaacatcaaaacatgaataagaatccaatagtggctatgaatcaaccaagccaatacccttttgatttatgtaaacatttttagatggaaaaggaatttactccttttgttatttttaaaatatttattttcttcgttgcttttcagtaaatttctagataagttttaatttgcttgttaagagtttaatatatctttctttgttgtgattaatattgaagctaagtgctttgctttcagtagtaagaaaaagtttaaaagacatttccatgtatttgtgctaatcttttttaccttcatatataacccaaagatatgtttgacatcttttttaccacagtcatttattaatacaattttcacttgtcaatttatcagtagtatattatttgcttgttaaagggcttgtaattacttatcattattatatgctatctatgtatttggtaatcaatatttatgaatttttgaatatatggaggcctaatttacaccatctgctttagaattttcttttagctaatacataaaaaatgtgagattgtctttttaattttgttccttttgaattgtttctttggggaataaaaaattgtttaaaattcgtttccatttacttgtgtcaatctttttttataatatatacacatgcttggagagagatttagaacatgcacacctttgaccaaaaaaaaaagaacatgcacacctagaaaaatacaaacatataagaaaaaaacaaataatagaaaaagaagcctataaagttatccactcatttatcatctccaccatcaaaatctaccattcccccaaaacaaaatg

SEQ ID NO: 12297 - DNA, 3000 bp, Unknown
  misc_feature (1)..( 3000): cDNA_ID_3024541_gDNA_ID_2214542_Annot_ID_185268 3000 nt of promoter + ATG
aatacactctagtcattggcaaaacttctctagtagcttccgattaccagagcgaaaatccagcctccactgaaagaaacttctcaggtatttttctagggtttttcagttttcaacattccagcttttttctaggttttttattttggctcgttactctgttttggtttctttcgctttcagacaaatccttattagttcttctctgtttacttgtttgttaatgttttatttcagggtctgacaaaattaaatgataaaatcgaagttcagtttacaacaattgggtttttgttaaagatatggacagaatcagtgggttacctgatgaactactagtggagatattacactgtcttccgacaaaagaagttgtatcaactagcattttgtctaaacgatgggagttcctttggttgtgggtacctaaactcacgttcgtgatgaatcactacgaatcagatcttcctattcaggattttatcaccaagaatctgcgattacttaaacctcaggttatagaaagctttcatctccaatgttttagttcatcatttaaacctgaggatattaagcattgggttgttactactatctctcgccgcgtgcgtgagctgattatcaactattgtgatttgtcttggcttgacaaacctgttgtgttattagatttaccaaacagcttgtatacttgcacatcgctcgtcactttgaaacttataggccattccattattgttgatgttcctcgaacggtttctcttccttgtttgaaaactttggagcttgattctgtggcatactctaacgaagaatctcttcgactacttctatcgtattgtcctgttcttgaagatttgactattcatcgagatatgcatgacaatgtcaaaactcttgtgattattgttccgtctttgcttagactaaacttaccgatagacggggcttattcgtgtgatggttatgtgatagttactcctgctttgaagtatttaaaagttcctggcctttatagagaagatttctcgtacttgcttacgcatatgcctaacgtggaagaagcagatcttagtgttgagcaagatgttgagaggctttttgaatcaatcacatctgttaaacgcctttcgttattcgtattactcgacattgaagacgaggtatacttcttataactatcacttacaacggctaaattgttttttcttttcttgagactgaatcataattttttttggttatgtttttgtgtgcagtctatgtatcataatggtatttacttcaatcagcttgaacatctgaacctacatatataccgcgataactggtccaaattacttgttcggttgctcgaagattctcctaaactacgagtcctcaagattgttgtcgatgtaagtttcttcattggcaatctaaaggcactagtcttattaattatctcttttctcacaaaaatttaatctcagggtgaaccatcctttgatgaggagtttgaacatgttagctggatatataatgatgagagctctgttcctaaatgtttgttggatagtcttgaagttttcgagtttgctggatacactagaagaccagaagagagagatttcgtgagttttatcttgaagcatgcttgtcatttgaagtcatcatcaatatcgcgcttatcatgttatgttctagaatagaaacttcgaaatcgatttgttgtaccgatctctggattttaggcttttttttgttgtccaagaacgaagtaggtgtttttctttatctaactgtaatgtggaacttgctttccaatgatcatctctctttgatgactccatatttccttaatcaaccttgaagttttttgttgaactttctttgcgttatcaagtaaaagtagtatgtaggatttgaagtgtaatcaaataattagttaattttaccgtcttaaaaccttcatttactgttttctcgtcgaatttgtttagccgaaagttctcttgatctctctctagaacaatataatattagttttccaaggcttataattcaatttggtttgctgtttgcattcaccttgtgttagtttcttagcttaagtcacaagccaaccttgtattgattccttttcacgaaggttttaactctctttattgccttcatggcttcatgagatacaaccctttaaacccaagttcagaatttatatcacgtacacttcgtaagtgcttctttcttttttaaccatgaaacgtgaaagctgctgcgatgtgtttgtataagatgtttggaggagcttatgattctctattcctttctctcattttttttatgttgtataagatgtttggaggcggaagaatttatacgagtcttcaaggttagagaaatgagaatggattaattagctaataagagataaatattgaagaacgattttgtgatatatatggaatgaaaatcgaagtgttctctctttgaaattattgacaaaaaaaggtaaataagtaggaacctctcgtcttaattatcctaatgaaagtatttgctattttgcgttagagattagaaaaaatagataattttgtctaaaataaggagttttataagaaaggactagttgattgtttgcataattttgttttgtttcagaattgagacttttgggaggaagaagaaagaaatttgttttctgaagaaggtggaggtgccaagagaattatcttaatccttgttcctcctcctcctcttcttcttcctcattggttgtttatgtttttatatataatctaggttttgttagtccaactctatctttctctctcttgatttcaacaacttggtttcaagttcataaacaagagagagaaagaattgttagtctccatgagtaggttatgttatcccataaccccaattggctatctatttatcacctccatccatttatactcctagaaacaacaaatctaaaggcaacacaacacaaatagtaccttctaaatg

SEQ ID NO: 12298 - DNA, 3000 bp, Unknown
  misc_feature (1)..( 3000): cDNA_ID_3024545_gDNA_ID_2214542_Annot_ID_185267 3000 nt of promoter + ATG
atattagttttccaaggcttataattcaatttggtttgctgtttgcattcaccttgtgttagtttcttagcttaagtcacaagccaaccttgtattgattccttttcacgaaggttttaactctctttattgccttcatggcttcatgagatacaaccctttaaacccaagttcagaatttatatcacgtacacttcgtaagtgcttctttcttttttaaccatgaaacgtgaaagctgctgcgatgtgtttgtataagatgtttggaggagcttatgattctctattcctttctctcattttttttatgttgtataagatgtttggaggcggaagaatttatacgagtcttcaaggttagagaaatgagaatggattaattagctaataagagataaatattgaagaacgattttgtgatatatatggaatgaaaatcgaagtgttctctctttgaaattattgacaaaaaaaggtaaataagtaggaacctctcgtcttaattatcctaatgaaagtatttgctattttgcgttagagattagaaaaaatagataattttgtctaaaataaggagttttataagaaaggactagttgattgtttgcataattttgttttgtttcagaattgagacttttgggaggaagaagaaagaaatttgttttctgaagaaggtggaggtgccaagagaattatcttaatccttgttcctcctcctcctcttcttcttcctcattggttgtttatgtttttatatataatctaggttttgttagtccaactctatctttctctctcttgatttcaacaacttggtttcaagttcataaacaagagagagaaagaattgttagtctccatgagtaggttatgttatcccataaccccaattggctatctatttatcacctccatccatttatactcctagaaacaacaaatctaaaggcaacacaacacaaatagtaccttctaaatgcttctatacttgctcatcacttgtctctctttcttcttcttttccaaatctttatcctttcctcaatgggcatctaaaaccaaaaatttgctctccttctacttctccaagtatttgtttacaaacagtctacaccagatcacacccgatctagcctctccggtgctcggaaaaatgtcaattcttgacctccctgaccttccactcgactgcattcttgaacttcttccaccctctgaactatgtaccatggctagggtctgtagctcgttaagagagagatgtgtaagtgatcatttatgggagaaacacttgaagactaaatggggaaaaatccttggaccttctgctcacaaagaatggcaatgctatctatcttctccatatcatctcgattctcctcatcacaaaactagtcatcttggtttggccaaaatcatatctcttatgcgatcgctttcatccatttttcgagatgatgatcataggaggagatatccatcttcaatccctcttgactctaccatgaacttctacctatccctcgaaacaggtcgcttttggtttccagctcaagtttacaaccgtgaggtaatcatagatttcataaacatatatagctactccattttattctttatgggtttgactaaagtagtgagggcttttttggtgtaagagcagaatggacatgtagggttcatgttgtcatgctatgatgctgagctcagctatgacactgacactaatacttttcaagctaggtataaaatatttcatgtccatattcaacacaatattttgcttattcttcatagaatgctataaactatactgtattgaggattttaggtatccaccacatggtaaaagagcaattgcggttgaaaaagacgtgacatgggagaggataagagcagctcccgttgatgcatcaccccataatctctatgtgtcagattctctaaatgagttaaaacccggagaccacatagagatccagtggagaaggaacaaagagtttccttatggtaagtataatctataatgcttgtggtttggacataatatatatgattctaaaacaagcttgtgtaggatggtggtatagtgttgttggacacatggaatcttgtgatggcaatctaaaccattgtcaatgccataatagcggtgagtcctcaactttatatttctgttttggctgtcacattcaacataaaccccctaatcatatggcattagcctttctctattaatgttgtgtcaaaagtatctatgcattcacatgttgtactaaatggtaagtgttgatgtatggtgaaaatagagatgatggtgttggaatttaaccagtacacagtcggatcaaggtggagaaaaacgatgattaacaggagagatcatagagagaaaggtaacgaggaagacgggttctatggaggaattcgaaaaataaattgtaaagaagatattgaaatgtggaagcgtctttggccatcctccatcttggagtaggatgagtaggatgttaatcttagaagtgtttgctcttgtaccaatgtacaattgatctttcattatttattgataaaatagtaaaaatatgcatgaaacttttgtgtcacttgaaaatgaggttgtttgatttgagaagaaatatgggggtggtgttgtatagatatattcaatacaattgatttaaatatatatgtcatcaaagtagattttgttttttgatagtccattctgagaattatttaggtcttaatattgttaaatacattttctataaaatgtaaaacacgctcttgtatgtcaatgtgtattttttttttttttgggtacctgatgttattggatgtatgttgacgggccaaagcccaatttgggatgccttattaatgttaaagcccgtttaaaaaaaatattagataaataaaacattaataaaaaaatagacaaaacacaaaaatgaaactgagagttagttttgctcagtgcttcttcttgtaatg

SEQ ID NO: 12299 - DNA, 3000 bp, Unknown
  misc_feature (1)..( 3000): cDNA_ID_3024551_gDNA_ID_2214542_Annot_ID_185263 3000 nt of promoter + ATG
tcatctaattcattgatttcacttcctttttatttttattaatttcatttatttttatgagccttttcatttaattttgttttgaatgctttttaatttaatttcaaaaatatatctattccacgtttcaaatatatatgatactttggaatacatatatatatatatatatatgtattgatactatgttatcaacttttatgtcttactatatactacagttaatgacataacacatatatatttgtgtttttgtattcgtctaaaatactttttaaccactattaaaactgttttttaaaaaaatagaaaattcatctcgtacatagaataataggatgttatctagatttcttctataaaagggatattttttttattttgttttggaaagtctcggagaaaacgaacttgatttaaaatccgtaaatcgcgttcactgttcaacgattacactaactcaagtttcatagattgacccgataatatttttcaacccatattcaaacctcttattgaactagagtttcgattttatagcattgttgtcaacaatgaacacgatttaaagattttcattgcagttgatgagctagttaaatttttctaattggtatgagtttaatagtttaggtaaaattatgaagtttataattagttcataatgaattgagtagagactaaaaatatatgattatccgagttgagcgcatgtaatatatagaggtgggtatccacatgcaacatagtagctttcgttcatattcaactttcaagtggtgttaaatcacttggccaaaacaaacacttcacaaactattaatgattgctttctttaatcacttggcaacatatcggcaccggaattggtttctcaatgcatataaatatgaatttgaccgcagtgaacatatatatatatatttgtaaaagaaaaaatgatttgtattaattttctgattggtagagaaattcatattattattatattataatcaattgtgtaataaaaacacataatttttattaacaaaacacataatacttttatgtgccgaagttttatgtgcttggagagatctaatgcgcttttggatttgataaccactttctaacccaaaatattgtaattttgtttttatcttttttttttttgccaagattactctactctagatattgcccttgtaatacttttttcatttccaatgatattaacattcatagcaaaaaaaaaaagaaggtatatgacaaacatgcttattcattaggtgatagtttaggatattaagcttgagttgaagttttgatggagcacataccaggagtgtcaatgacattgattattggaccatcttgtattgcagctctgtacatttcacatatcatggtaacgccttttgcctggtttttagatttgaactgctttgtaccaagaagggtgttccctgtgctgctttttccattaccagtacggcctaccagaactatgtttttgattggctctgacatatcgaagaggagaaaagaaagaacgagtttcttttacgttttctagtgtagaacaagaaagaagaagaaatggacaagttaacggacgacacaattgaagcttatatacgaacgagctttctttaccaaatcgcttgctgaaatttatattttcatatttttatatttgctaacaaagaatctcaataaacaaaacaaattcaattggcaattaataatattgatagtgcaattggaatgacgaaccgaaaggccaagacgactttttgaattttgaggagtgagatgactttgactttgtgaattgttaaccactcgctattagattcaatttggatattgaaaataataactataatcatctactaggtttattaaatataatacgattgtccgtaagaaaaaaataaaataaaaataaaaaaaataataatacgattactattacataaagtcggcgagttcaataaactttagcaatcaaaaaccaacgagaaaagatattttttttcttctagagcaacaagtcggtaaaacaaagatattaagataggactccaagaactaaaaaactaagtaaaccatgaagctagaataatccacgaacaacatatccaaaatttcaagacaaaaataaagcaaccactttgtaacacttcatttcgttatatatccaagcagatgagtttaagtttattatcgaacatatgatgatcataaaataacgaaacgcaaaaagattgactcttattgttcgtgatttaagtttattgaagtcagaaaagaaaaggataggaattaattacagtaaaatctttacaaaaattaatatatttcaaaattctattaacgtatagagacattaaattattaataaattaattattaatttatagaaagattttattaatttgataacttttacaaaaattatatttcaaaatagtttttctctttataatcgaatatcagctttttaaaaccaaatataagtaaaaaaataattattaagtttagaaaataacacacctttttcgatatggtaaaaacgttaaaaataaattcaaccaaaaattaatacaaatttttaaaaaataaaaaatattagagttatatttcactaaattattttaaatataatattttacatacctaaattactatagaataatttggtgtgtacatatatgatatatagaataatattttatattcatattatatataaatgatatatgtatatatatattgataagtttatacaattattaatttatgatattaatgagattttacatagaattttcaaaaaaaatattatcttattattttatcaatttgtgtcaatttttacatggatcggaccgaaattttttattaatttataaaatttattaattaatcgaacattaatttatatagttttttgctgtattttagtgtatttttctctcaaaccggttaatatcagataaccgaaaaaacatg

SEQ ID NO: 12300 - DNA, 3000 bp, Unknown; identical to SEQ ID NO: 12293
  misc_feature (1)..( 3000): cDNA_ID_1807247_gDNA_ID_2214542_Annot_ID_185262 3000 nt of promoter + ATG

SEQ ID NO: 12301 - DNA, 1294 bp, Unknown; identical to SEQ ID NO: 12292
  misc_feature (1)..( 1294): cDNA_ID_3024559_gDNA_ID_2214542_Annot_ID_185260 3000 nt of promoter + ATG

SEQ ID NO: 12302 - DNA, 3000 bp, Unknown
  misc_feature (1)..( 3000): cDNA_ID_2708670_gDNA_ID_2214542_Annot_ID_185275 3000 nt of promoter + ATG
tattcactatggttcataccacagaaattctatatttgaaaactgtgctgcaaaaacatatttattgatgttggaaaagtcaatcaagatgtagaaatatgctgaaaatatggtctatttccaccaaatgatttgcctctatttttactgtgaaaatagctttattagttagataaactcataaaatcaagacaatcacatgatgaagtattgatttaacacattttgaaacactacacgttaatttattcgactgaacaaatacaaagttttcattaaatgtgagtgctgagttctgtgacagtttgtttgaattttctggataatgattagcaccatgccccagccaagaaacccccatactttgtttgtaaccattaatattaatattttggttggcgacagacaaatctttggccgacgaagctgattttcactctttcactgccaaattttgtatgtttcatcgacatttttacatttgaaaatcttatgtttttggttttgttgggggatatgcataaatttcttaagagataaataataagtagaatcgtcgagagatgtataatctagtttatgtttcttggcctctactctacttttctttctttgcattctctttaaattcccattcttcgtttatttaaagatgcatgttcgaatcttctctacttctacaaactaaatggaatgacataaggttatgtctctctatgaatattgttggatataaacaagttgaactacaatgattcaacgcaggttgttcaacactcactctctcagctttggcatcttaagacacttttacgatatatccactcctagtttttaggaaaagaacaagactgtcacatctttcaaaagtcatcaacccgcaaccaaacttttatttcatttgtctcgttagattagatgcttgatgaattgagtctcaatacctcctaaagtgaagaaaggtctcgggaggaaacaaaatgaccttaagatattagatttttggttggaaatttggaatgttaaattttattcaacaaaaaattatctacatagtttgaaaggagattacaacaagagaggaccaatgaaataaaagcattaatagaatgctagcttaaaattcaaagaaatagatcagctatgatcggccatgaaaccaaagagaatggatccgatggctagtcatcaatctcttaatgttaacaaagagtagatctgattttgatcaaaacaggccagacccgtacttcgtcatcgtatatcattattttttattttctgtttcttgaaaacaaaaagaaaaaactatttgtaatcacataacaatttgttgaaagacaaaaaaaaagagagagagagactaatatctacttgtatactgttatttttttttaccatttctattaattattttgttattattcgttaaaaactttatctatcttttatgaccaataatgatgcataatttattctaaccaataaccactaaacatgttagaattgacttcatacttccattaatacatgagttgaaaattctaatcctaaaatgaaaatgatagaaccagaccagaccaaattgactcaaaagattccagctcatcttgatatttctagattacaagtcactctaaatacatgtttgaaatgttcgaaaaaaaacattgctataattaattaaaaaacagtagaaggaaaaattcggtgagaagaaagtagaatgttgctagaatcaataaattaatcaaaataggtacagtatataatagactagtatccctctaatctaacggtccatttatacctgtccccattacacatgtcaaagataataatacaaaacaagtatgtaaattgtaggtatttattagttgtgagaatgactattttattctactctttttcttttggaaaaatctaacgtggacatccgataatcgacttggctcagatcgattttgagtaaattgttttaaggggtttagaattcatatagaaccaaaaaacatgcggttcggatcggtagttattttacggtttgactatgttcggttatctctcagttcggaccgacatataaccaaattttattgggttcggtttgaattaaatatttgtacataaactatgtggaaaaaagaactaaataatttgttcaatctaatgaattagtttgcaaaaaatatttactctagacacatataagtatgtacattcatatattttagttattttgagcctaatcataactaaattttctggtttataaatatagttttgaatatttggattatctcaaacataaatataattaacattttctgatttttatgacattgactaatattttctgatattaagatattgatctccttaaattgtttttatcattctttaaagttcattatcttgtttggttccaatttcttgtacataaaccataaatttgaaatttcaattagaaaaataatttccttttatgagatacaatcatacaattgtatttcaagtagttcgaatactcattccgttttcggtttagttccaagttgttataaaagatgaactacactatttggatgtttatgattatctggttcggttcggtatctcttaattcggttatttcggttttagtaatccacataaaacagactataatctcttgcattatatccacatagacctaaataataaacaatttgtttcttcccgctaagtgattattaatgagcctcccttcttctcaactgttatttcactttaacgtacaaaaaaaaacacacacagagagaaagagagagagaaaagtttccgcattaatggtggcttcacctaccagttgtctagtggtgagagattaatgtgacgacgacgacgacacagaacaagagatagagggagaacaaaccaaaaccaaatctacactgcaatctcttccctcatcttctccaattatcatctctctctgattctgttgcgccgccgcggaga

SEQ ID NO: 12303 - DNA, 3000 bp, Unknown
  misc_feature (1)..( 3000): cDNA_ID_2711775_gDNA_ID_2214542_Annot_ID_134485 3000 nt of promoter + ATG
ttgtgtttttgtattcgtctaaaatactttttaaccactattaaaactgttttttaaaaaaatagaaaattcatctcgtacatagaataataggatgttatctagatttcttctataaaagggatattttttttattttgttttggaaagtctcggagaaaacgaacttgatttaaaatccgtaaatcgcgttcactgttcaacgattacactaactcaagtttcatagattgacccgataatatttttcaacccatattcaaacctcttattgaactagagtttcgattttatagcattgttgtcaacaatgaacacgatttaaagattttcattgcagttgatgagctagttaaatttttctaattggtatgagtttaatagtttaggtaaaattatgaagtttataattagttcataatgaattgagtagagactaaaaatatatgattatccgagttgagcgcatgtaatatatagaggtgggtatccacatgcaacatagtagctttcgttcatattcaactttcaagtggtgttaaatcacttggccaaaacaaacacttcacaaactattaatgattgctttctttaatcacttggcaacatatcggcaccggaattggtttctcaatgcatataaatatgaatttgaccgcagtgaacatatatatatatatttgtaaaagaaaaaatgatttgtattaattttctgattggtagagaaattcatattattattatattataatcaattgtgtaataaaaacacataatttttattaacaaaacacataatacttttatgtgccgaagttttatgtgcttggagagatctaatgcgcttttggatttgataaccactttctaacccaaaatattgtaattttgtttttatcttttttttttttgccaagattactctactctagatattgcccttgtaatacttttttcatttccaatgatattaacattcatagcaaaaaaaaaaagaaggtatatgacaaacatgcttattcattaggtgatagtttaggatattaagcttgagttgaagttttgatggagcacataccaggagtgtcaatgacattgattattggaccatcttgtattgcagctctgtacatttcacatatcatggtaacgccttttgcctggtttttagatttgaactgctttgtaccaagaagggtgttccctgtgctgctttttccattaccagtacggcctaccagaactatgtttttgattggctctgacatatcgaagaggagaaaagaaagaacgagtttcttttacgttttctagtgtagaacaagaaagaagaagaaatggacaagttaacggacgacacaattgaagcttatatacgaacgagctttctttaccaaatcgcttgctgaaatttatattttcatatttttatatttgctaacaaagaatctcaataaacaaaacaaattcaattggcaattaataatattgatagtgcaattggaatgacgaaccgaaaggccaagacgactttttgaattttgaggagtgagatgactttgactttgtgaattgttaaccactcgctattagattcaatttggatattgaaaataataactataatcatctactaggtttattaaatataatacgattgtccgtaagaaaaaaataaaataaaaataaaaaaaataataatacgattactattacataaagtcggcgagttcaataaactttagcaatcaaaaaccaacgagaaaagatattttttttcttctagagcaacaagtcggtaaaacaaagatattaagataggactccaagaactaaaaaactaagtaaaccatgaagctagaataatccacgaacaacatatccaaaatttcaagacaaaaataaagcaaccactttgtaacacttcatttcgttatatatccaagcagatgagtttaagtttattatcgaacatatgatgatcataaaataacgaaacgcaaaaagattgactcttattgttcgtgatttaagtttattgaagtcagaaaagaaaaggataggaattaattacagtaaaatctttacaaaaattaatatatttcaaaattctattaacgtatagagacattaaattattaataaattaattattaatttatagaaagattttattaatttgataacttttacaaaaattatatttcaaaatagtttttctctttataatcgaatatcagctttttaaaaccaaatataagtaaaaaaataattattaagtttagaaaataacacacctttttcgatatggtaaaaacgttaaaaataaattcaaccaaaaattaatacaaatttttaaaaaataaaaaatattagagttatatttcactaaattattttaaatataatattttacatacctaaattactatagaataatttggtgtgtacatatatgatatatagaataatattttatattcatattatatataaatgatatatgtatatatatattgataagtttatacaattattaatttatgatattaatgagattttacatagaattttcaaaaaaaatattatcttattattttatcaatttgtgtcaatttttacatggatcggaccgaaattttttattaatttataaaatttattaattaatcgaacattaatttatatagttttttgctgtattttagtgtatttttctctcaaaccggttaatatcagataaccgaaaaaacatgggtttggtctgctctaaaaatctaattacttttcacagttccgacggaaccgccgcagctgtagtcatcaacaagcgcaattctctaacaaagtaacaaagaggaggtatttgtcaatcaatacctttcttcgtcgattcccttagctgatgtgttgttattttcgaatttgatttgttggaacacacttcgaagcttgggatctgaaatatctgattctgactgtatactgtagtcaaagatg

SEQ ID NO: 12304 - DNA, 3000 bp, Unknown; identical to SEQ ID NO: 12298
  misc_feature (1)..( 3000): cDNA_ID_2711767_gDNA_ID_2214542_Annot_ID_134488 3000 nt of promoter + ATG

SEQ ID NO: 12305 - DNA, 3000 bp, Unknown; identical to SEQ ID NO: 12297
  misc_feature (1)..( 3000): cDNA_ID_2711763_gDNA_ID_2214542_Annot_ID_134489 3000 nt of promoter + ATG

SEQ ID NO: 12306 - DNA, 3000 bp, Unknown
  misc_feature (1)..( 3000): cDNA_ID_2711759_gDNA_ID_2214542_Annot_ID_134490 3000 nt of promoter + ATG
gtagtgtcgtagtgatctcgaacatcgtattcgagactctttcatcactggagcaccacaagaatgtggccatatctagttctagaatatacgattttggttttggtggctacagaggagaaatataaccgtgtcttccaatcttttttaatcttgttgaaagttatctcatcttagctttcaagaaattgtgatgtttatgttccatattgtctttctacatctatgaacttgacttctcgccatctgataggaaactctaaacatactctccattgtattctgaaactttttatctgtaacttgaatttccgtaccacttatgtaatgaaggaaaaaaaaactctttgattttgaatctaatgattattctactaattattcattgttctatggctatagagtgcaattttccttcctttttaatgcagtcaactataataaccgtaagttttcatttccatgctcgaattggtaaaaaaaaaaaagaatataaaataggtccatatggagaattcaaacatatcaaaatctaaaaaatatttgaacataaagtatgacatatataaaaaaaaacaccttacaaattgagaccaaatatggaagttaacaaaactttgactaatattaattgaaaaacaatgtagtcatcatggtctgaaaattataaatactgaggttttcataagaattcattcatagacataaagaagaaacatttaaagtagaaaaatggcaaaagtaattagcatgacgtttataattatgatactagcggtaatagtgatagaaggcgacgcaaaatcagagatagaatgcagtaagatttgtcgagagcactgtaaacgctcatcaccagcatctgaatgtgcggcttgtcgtaaaaaatgctacgaatctccaccagttgcagtgagagccaggaatcccatcatggagttagaagagcaaaaatatcatttgttttagttaaatataatatatatggtgatttatagatggagaggtcaatacattttaatatttctatgcaactgattaataataagatgataaattacatgtttatctctccatgctcaaattagtgatttctttttttaaagtacaaacaaatagcatatatagtagaagtgtgaatgaaactggttgaatcttggtaatattattatttttacttcgattggaaaattatttttcatgcaattatgaaagtgtttaatcagtaaaaatccgttgcataatgctagaaaaacaaaggcaaaagtgcagaacatgtgttttggcttaaaaaatacatatgccatttggaaatgaatgggaagcacgtatttgctgcatttgttctctagcaagaattagaccatttggttttcgatgatgcatatagctttcgcaacaaagacagaccgagctcaaatttctagcggacccataacttaattagacccaatattgcaacataatttttttgaaaataaaatatttgggtttttttttactaaagaaaaaacccaaaaggtctgatggacgctttgctttggcactctcagcacatgcacatgatcgggcctgattaaaggcggatcaagtaattttattcaccaatcacacatattgtatatgaaagtgtagtttaggtttagaaattaatttagatagaacctgctggtgcggttcaaaatgtgattaaaaatatgtggttagatgcagaacttttgatttttattcttttattccaaagtaaatctgaaacaattttgaattttattcttttattccaaagtaaatctgaaacaatatatacaaattaatttacacattttcattcaataacaattggtttgatcactctaaacatttttaaaaattagttaatattggatttgattataccaaactatatttatgataattaccattcaaacattctcatgtaccgtttgttacacattaaacatacgttttcatatgataaatttttctccaacgaactacaattgaaccatattacactagtcaattcgcttatcccacactgtttgatccgttgtagccattcacattttttcttctatcgatatcaactttttcttctttttttctctactccatttttttttctcatcacctttatgtcaatcttgttcaaaaacgaacaagcaaattattttgcaggaaaataagtttccactaataagtggaggaaagaaatatcaaaatgaatgccaaaagcattggaaagaaaaatatgcaaataaccaaggaaaagcctcccaaaacctttaaaaaacaagcctcagaagacaaacccttcttccatatccacctttactccgttaacatttgatacaaggtcaagtgaaagggtaaggctaaaaatttgcaatagtaaaggcaatcatcactttagagatgagaaagaaaggtttaaaaaagagtctccatctccttgagaagatcctcactctttaggtacatgaaaaacttacattcttcaatccttcgatcattgagacaaataaaatatttgcaaaaaaattgtcaatttatatatatatatatatatatatatatatatatatatatatatatatatatatgaatacaagaaaaacaaaacgtgattgggctaaaaatctatcaaaggcctaataattggctactggaggcccataaaagagtatccacatcaaatacactctagtcattggcaaaacttctctagtagcttccgattaccagagcgaaaatccagcctccactgaaagaaacttctcaggtatttttctagggtttttcagttttcaacattccagcttttttctaggttttttattttggctcgttactctgttttggtttctttcgctttcagacaaatccttattagttcttctctgtttacttgtttgttaatgttttatttcagggtctgacaaaattaaatgataaaatcgaagttcagtttacaacaattgggtttttgttaaagatatg

SEQ ID NO: 12307 - DNA, 3000 bp, Unknown; identical to SEQ ID NO: 12296
  misc_feature (1)..( 3000): cDNA_ID_2711755_gDNA_ID_2214542_Annot_ID_134491 3000 nt of promoter + ATG

SEQ ID NO: 12308 - DNA, 3000 bp, Unknown; identical to SEQ ID NO: 12295
  misc_feature (1)..( 3000): cDNA_ID_2708658_gDNA_ID_2214542_Annot_ID_134492 3000 nt of promoter + ATG

SEQ ID NO: 12309 - DNA, 3000 bp, Unknown
  misc_feature (1)..( 3000): cDNA_ID_2708662_gDNA_ID_2214542_Annot_ID_134493 3000 nt of promoter + ATG
ggttctcttcgtccgtttttacttctatgggctgtatacgctttagccaaatcaaatgttgattggaatattctttctttgattaacttagatccaagagtcgttgcatgtccaaacatcactttttcttgaaacgtttgaatcaaatatttgctttctagttactgtagaaacaattcctggcatactcacttactccttgagggatttctcttgtagagaggattgatatggacatatgctatgtgcatttggaaacactacatttggttaacattaattgttgagcagccaactaatacaaactttttctgtgtgttttattttagactcttaagctttcggcacctcttgcgactggccttatcctagtctcatgctgccctggaggacaggcgtcaaacgttgctacttacatttccaaggggaatgtagcgctctctgtactcatgacaacgtaatccttctattttcacttctttctcttttcgttctttaattttattggtcagatttcatatacattatctgttctttaatttattaggtgttcaaccattggggctattataatgactcctcttcttactaagcttcttgctggtcagcttgttcccgttgacgctgctgtgagttttctctataactattttgaatcgtttcattcaaaattgcattgataagatacatttctttttatgtatgaaatataagatacatttcacttagctaaaatatgaataatcatggttcagtaaaagttattgaatgatttaaagtagaatgaagcgcaagaactctattagaatatagttgcagccctccacaacgaaagcttatggatccatttttttacgtcagggacttgctcttagtacgttccaagtagtgttggttcctaccataattggaggtaagtatggtgctacgtgtttccggaaaaatgaatttgtgcttatatatccttagggactaatgtctttttctgcattgtgtgcagttctggcaaatgagttctttcctaaatttacgtctaagatcataacagtgacgcctctaatcggagtcattctgactactctgctctgtgccagccctgtaagttcatatatccagatatatatattttttttattgaattttgagactggaattggtattgattactaccttatctcttctgaaaagattggacaagttgcagatgttttgaaaacccaaggagctcaacttatactcccggtggcactccttcatgctgcagcctttgctattggctattggatttcaaagttttctttcggcgagtccacttcgcgtaccatttctatagaatgtggaatgcaagtaagttactttctcctataccgtagatatacattgccgtttgctttactaaggcttctttttgaaaatctgtgtactttgcaaaccgcagagttcagcgctcgggttcttgcttgcacaaaagcatttcacaaaccctctagttgctgttccttctgcagtcagtgttgtctgtatggcggtaagttttcatagccatttcactaaagttcacatgcaaattccttaagtttaattatgttcaatggcattctgcagcttggcgggagcggcctggccgtgttctggagaaacctaccgattccggcagatgacaaggatgacttcaaagagtaaatgaagtaggaaaggcggtttgcatcttctccaaacgatgtgattgttttgttgtaatgttagtaaacattacaaaatttgtgttgaaaaacatgaaacaaaatgtgtttaagagacatagaaacaagggcgtgcatgatgacaactttgtggtcaaccttttttttatttctcaattaatggacaaatcttttttggcacaccttctccaaattttgaatctaagtttcagattgggattagcgttgttcccggaatcctgtctactctcacaatgcactccctcatttccagccatgacttctcttagctcatatacgtcttttgtcagcaatgataagttttgatgtttttagcattaggtggttttggtgaattttcattttaaattagatttgagtgtttccttttctgatgaaaacacaacttccaacaattaacataagtaaacatgtaaagttgattggaatgtggccagttgatctcggtttcaataaggtgaagagtctcattgtattttggtctttacatgattggaatagtactatgcttctggagttctggtctcagtgtataaatggtggtaaaaaatgttttcagtttacagtaaaaaatgtttagctatattttaacatttcttttactgtagaatgtttcccatatagattttctgttttttttttaattagtaatatttttagttttcatatttttttaatatacgtgctaattcatttgttgaaagagccaaagaaatagtaatctagacaattatacattttgacacacgtttaatccgcgttaaaggaacagaagaattgatgatgattgcatttgcaccggagagacaccgaatcaaaaatggcctttagcctttaaccctctcaaacaaagtcgtcacactgtaaaaacaacagcaacaacaacaacacacaaattcacgactctttctctcccaatctcagatcgaaaatttgcttcatttccctctgatcatcatcattcaccaaatttcgtattcaagaacaaatcgatcgcattcatcttctccccgaggtttcttacatacgactaaaattagggtttaagcttcccattttggatccgattgttgcaaaaggaccttctagccccggtggcttttgctataaccaagtcaaagaactgggggcgaatcagtcccacccccgccattatcctggcgtttccgatcattccagggtaggattctgggattttctacgacctcttcttaataatcctcctcgaaacaacacgttacagtttatcgattccgttggatctgatcggactatg

SEQ ID NO: 12310 - DNA, 3000 bp, Unknown; identical to SEQ ID NO: 12294
  misc_feature (1)..( 3000): cDNA_ID_2708666_gDNA_ID_2214542_Annot_ID_134494 3000 nt of promoter + ATG

SEQ ID NO: 12311 - DNA, 3000 bp, Unknown; identical to SEQ ID NO: 12302
  misc_feature (1)..( 3000): cDNA_ID_2708670_gDNA_ID_2214542_Annot_ID_134495 3000 nt of promoter + ATG

SEQ ID NO: 12312 - DNA, 3000 bp, Unknown
  misc_feature (1)..( 3000): cDNA_ID_1807682_gDNA_ID_2214543_Annot_ID_134500 3000 nt of promoter + ATG
aaatccaaggactaatcaagccaacttacattcatactaactctgtagctaatttccagtttatctcagctctgtttatagagacctaatgggcatacaatattggccagtgtaaacctttccagatgataataccaaaactacatcccaattcctagtacacctaagaacggtaactagaccttttcgtgcagatccatatttaacacagcagtaagggatttgcgtattcttgattgattaccgtttaactcaacacaatggtcatggatcttacaacaagcatcaagatcatcacaaggctcctcaccaggacaaccagaatgtccaatcccacaatacttcccatatcgaatagaaagagctgaaacaaacatacatgtgagtcagctaaaaagctaaaaaacctaaggaaacttcagaaaagttgtaatcttactgtcacaattctgtgcaatgcaagttcttgtacactcctgtaacaatttgatgcaacaaacaagacacaaaatcaattcattgttcgaaattaccgcaagaaacaataaaacacagagacataaagtgaagtgaaattagcaaaaacatcattgtcaaaatcagatttttggcaaggttccaattaagtcaatgcctacaagaatgtgattcctttcgtctaatttgggaaacagagaaaaacacagaaccaaatcgaacctcactgcgagcgacaccgacgagaacgacgaagacaatggcgaagaaagctgccgcgaaacgcatcaatgaagtgcgaaacatcatcgtcgtcgtctcgtaaatcgttgttgtcttcttcgctaaggtttcgaaattgtggctaaagattccaattgggtctccttaagatcccattggtcttcctgctttctcgcacataccaaaattttattattatttttttgaatattctctcgctgagatttgaagttaattcaatattttatcttaagtccactcaaataaatgtattatatatttctatttttgaatttatcagctgcaaaattaaatttttacttcaactatgatatcagtttctcaaacaaaataaaaataacagttttttactcaaaaatcattttcttgtgaatatcataaattcttcaaaataacatttttttcaaatattcctctatttttgaagttattcgacaattaacaatcacttaatatattaaaaaaaataattctctgatgttttaaatattgtgaacagatattaaactttgtggataaaataaatatctaaagaagaatcttgtatcaaatgcatttttctcaacttattaagagctttaccaaaatgtttttttttcccttagctccaacacttctgtttcaggaaaaaactgaaaatataaatggattcgaggaagtatatatagttcaagtgaggaatcatatggagggagttacaagcgtcaggaagaatattccggcgacctggttgtttgttgtctcaatttcaagggtagtagccggtgaaagtgaatcctctgccgacgatttcacctgcgcaaaaccaagcaaagcattctaagccaaacaatgcagcgattcctgcatcttccaccttcagattcgctctgttcttcaataagttctttgcgtagtctacttctttcctaaatgtttcgtagcgcccgggaatgctgtagttagtaagaagagtattagctatagacgcaagattgcgtatcacagaaagccgaactcttcaactgatagcaaaacacaatgtggtgcttataatgtgttatctagacaggaaaaacaagacaggcacatatattatcctaatcaaaggatatttacaagctcaattccatcgaggacaaaaactactagaggataacaaattctcaagcatatttttttcaggcaaaaaaggctacctactcgcgagtaatgcaaattcaacttgcacatttcatcagcattctctaaagattaatgtttcaaaagtatacataaaagatagtttgagcatggccattgaaaatatgtccatgagataaagagagaagaaaatggtaatgacctagcaagacgagtgtagagcaattgtttagacaattcactgcacttctctatagttgcaggctcttggatgtattgcttgttctgctccaacaattgcttgtagtacgaattcccatgcttggccacaaactttgaagcctgacatgcctttgattgaagttgaaccaattttgatgccatttttcaataccaaaatcctacaaaatcatagaaaccaagtttagcatttaccaattgagtctcagaaactaagcctaaacaagaaagattagctcatcatatacaatagcatggttcattatacacctccacgatagaattcaataactaaaacaggaaactgaaaaaatgtaatttcagaagcaaggcatccaaaagcataaggcttttcacacatatcaagctaaatcactaaaaccctagtcctcaattccagactaacaaatcgaacgaatccgaattatggaaaaattaagcaattcaaaacctaaaaagcattatcgcagtgaagagatttcaaattagatctgagactcaaacacataaaaaaacaaactttaaacccctaaaaaccaaaatccaaaagagcgaagaagaattttagaccaaaatatcagaatcttaaacgaaataaaagaagaatgaatcggtgatcgtaagcaagccataccttttggccgtgctcaccactcaccactaccagcgtcagaatcttttcctccaaatttcatctacactgccttataattacgacaataaccgaaccggatcggtataaaccaaaccggtttatctgtcaaaaacaattgaaccggcggctgaaatagaatcatacacataacataaagttcgtatccatcctaaaaccctaaatctttttgcttattcgaatctgttagccatccaaaacctctctctttgccgcaaaaaatg

SEQ ID NO: 12313 - DNA, 3000 bp, Unknown
  misc_feature (1)..( 3000): cDNA_ID_2708706_gDNA_ID_2214543_Annot_ID_134502 3000 nt of promoter + ATG
tcctcaatcttccctttcaaaaccgttataactgccaacaaaacaaacacaaacacttgtttcagccaactaccatcagatcataaaccatttgaataacactctaaacacatacataccatctgagaatccattcgacttaacaatctcctttgctgtgtcagccatttgagaacactcaacctaagaatcattagtcaaatcagatcaataagagccaaactttgattaacggagaagataaagagacatactgcgtaaacgtgagctgctcctgctttagcacagaagagagacaagattccagttccagctccaacatcaagaacaattttgtccttgataagaaacttgttcttgtaaataacatcttgataactctttgtcctcactacatcctttaacatttcctaataataataacatcaccatagaaaaactgttatacacattgcctaggtttcagaacaaaggattcaaaacaaaacaaaaaagcaggagactttacttacttcatgaatacctgcaaaaatcaatcaattggaaacagagtaagcactttgcagagaataagataacatgaagaaagcaacattatataatgaaagttcaagggtttataccgaaatgagagtaagaatcgaagtagtaatcggcgctggtaatgtcatcagcaacatcggcattgttgtcatctccatcgtgcattgattcatcagcatcctcgaagtgtaacttcgtcgtctgagtttcatcagagccgttgttgttgttctccgtactagtcattttttgcggcaaagagagaggttttggatggctaacagattcgaataagcaaaaagatttagggttttaggatggatacgaactttatgttatgtgtatgattctatttcagccgccggttcaattgtttttgacagataaaccggtttggtttataccgatccggttcggttattgtcgtaattataaggcagtgtagatgaaatttggaggaaaagattctgacgctggtagtggtgagtggtgagcacggccaaaaggtatggcttgcttacgatcaccgattcattcttcttttatttcgtttaagattctgatattttggtctaaaattcttcttcgctcttttggattttggtttttaggggtttaaagtttgtttttttatgtgtttgagtctcagatctaatttgaaatctcttcactgcgataatgctttttaggttttgaattgcttaatttttccataattcggattcgttcgatttgttagtctggaattgaggactagggttttagtgatttagcttgatatgtgtgaaaagccttatgcttttggatgccttgcttctgaaattacattttttcagtttcctgttttagttattgaattctatcgtggaggtgtataatgaaccatgctattgtatatgatgagctaatctttcttgtttaggcttagtttctgagactcaattggtaaatgctaaacttggtttctatgattttgtaggattttggtattgaaaaatggcatcaaaattggttcaacttcaatcaaaggcatgtcaggcttcaaagtttgtggccaagcatgggaattcgtactacaagcaattgttggagcagaacaagcaatacatccaagagcctgcaactatagagaagtgcagtgaattgtctaaacaattgctctacactcgtcttgctaggtcattaccattttcttctctctttatctcatggacatattttcaatggccatgctcaaactatcttttatgtatacttttgaaacattaatctttagagaatgctgatgaaatgtgcaagttgaatttgcattactcgcgagtaggtagccttttttgcctgaaaaaaatatgcttgagaatttgttatcctctagtagtttttgtcctcgatggaattgagcttgtaaatatcctttgattaggataatatatgtgcctgtcttgtttttcctgtctagataacacattataagcaccacattgtgttttgctatcagttgaagagttcggctttctgtgatacgcaatcttgcgtctatagctaatactcttcttactaactacagcattcccgggcgctacgaaacatttaggaaagaagtagactacgcaaagaacttattgaagaacagagcgaatctgaaggtggaagatgcaggaatcgctgcattgtttggcttagaatgctttgcttggttttgcgcaggtgaaatcgtcggcagaggattcactttcaccggctactacccttgaaattgagacaacaaacaaccaggtcgccggaatattcttcctgacgcttgtaactccctccatatgattcctcacttgaactatatatacttcctcgaatccatttatattttcagttttttcctgaaacagaagtgttggagctaagggaaaaaaaaacattttggtaaagctcttaataagttgagaaaaatgcatttgatacaagattcttctttagatatttattttatccacaaagtttaatatctgttcacaatatttaaaacatcagagaattattttttttaatatattaagtgattgttaattgtcgaataacttcaaaaatagaggaatatttgaaaaaaatgttattttgaagaatttatgatattcacaagaaaatgatttttgagtaaaaaactgttatttttattttgtttgagaaactgatatcatagttgaagtaaaaatttaattttgcagctgataaattcaaaaatagaaatatataatacatttatttgagtggacttaagataaaatattgaattaacttcaaatctcagcgagagaatattcaaaaaaataataataaaattttggtatgtgcgagaaagcaggaagaccaatgggatcttaaggagacccaattggaatctttagccacaatttcgaaaccttagcgaagaagacaacaacgatttacgagacgacgacg

SEQ ID NO: 12314 - DNA, 3000 bp, Unknown
  misc_feature (1)..( 3000): cDNA_ID_1807082_gDNA_ID_2214543_Annot_ID_134505 3000 nt of promoter + ATG
ttggcatcttcatcatcgtttctcttacgggcaacacggactctaattctcctcgggggacctcggatacctttgctccatatctgcttgttgagtttaacatccactctaacgtcctttgttcccattgctttcaatgcaaacttcctgatctctttaatggcattgggtgccttcttcttgaaggtgctgttcaatttagaaaccatcaaactcagtatttcttaaaccacatgatcaatcttgacaacgaaaaaagctctaatctaaaatgtacctaagcaacaagccaacctttctatacaataaaaggagtctaatttctccattttaaactaaaatttagacaaagatgcaaggagccaaggtgatcaacaacaactaggagatctttatgatcattactcatctacagaatcaaaattttcaacaaagattcaaatattctaactcttttcattcatcaagaaacctaattcgaatcaatacaagttgcaattttagtctaatcattagactctatgcccagaacgaacttaagcaaaacggaaacgagatattgcaaataaggtcaaaagtattgaagctttaggttttaccagctatggaggcgcctgtggagattgatagtgtactccctggtcacgacctcttcctttcttccctttcctttctccattttgcttcgatctccctggtcttcgaaatggtgttggagacggccacagcaagagaacagaattaattcatgtctaagaaaccctaatataaacctttccgtatgctataagttgggccgtctatgggcctgatgggcttttggataagtatagagcatgctaagatggaattctcaagttggtttttgatgggatctaatgaaaatgtcaacattatagtccacaagaacatcacatttgatgcaacaaatctaaacatttatgtttgctattttgagtcaatttaggctttcaaaagtcataatatataaggacttggttgttgattacatttgatttgctaataaaatctagaatagagattttaagaaagttcttgattcgataaaaggatctaacaaaatgtaacacaagcacaccagaaacatcaagcataacaagataaacttctaactcctttataataaggataatgaaaaaggagaatagcattatggttcaacttcaaagcaacaacttaaataaaacctgttcaacaaaatcttttacttcaaaaaaaacagattgtgaaagaagaagcttaagcttgtctgtttctttgcttggcaccggacttggcaaccctgagacctttgctgatggcgctgagtctagcaagtgcagctttcttcaagtccggcctgtagtagttgtccaccacctaaacatttacacaatcatttggtttagattgtattcacgtatgaaaccaataaacagcaacattaagcagatcaatgaaaatagccaagtgtaaaattaatatttcatcaatatgccacaaaaaggagccttatatgaagttaaattttaatctttgcacagctatgcatcatatcgttttaccataacatattaactctcctctcacaggtagagggaagaacataaaaaccaattgtagatcatagccgtgaaaataacacacaaaactagatatagagacctataagcacaccatagacatataaaaaacactaaagtaataaaaattgagtaatacctggttagcaacagcctttgacatcctggggaattccttcttgaggatagacttgttgacagagagcttaggcttgttctgcttcttggtcttggtggtggcgagcacaacagcttggtccttgtcagcggcctggatggtcacagtctttttgtttgcaagacctgaaaccacatcaaaagattcaaactttagcctaattcaagacaataacaaaacctaatacatagtatgaagtgtctgctcaactcagactaccatttttgtctttaaattagaagatacatacacaattgtaatacagattcaaatggtcaaatgtaaagaaactacatttcacggtcaacttgcaacagataagaaaataagcttatactcgagaatcaataaaatagtgcataaagacgatctcaaacagccaagtttcaaccacaatcatctaatagtcgagaatccacaatctttcatagaaccaaaagcacttaacacatcaacatttcttaacaactttagttcccaatctattctactaaatcaaccaaccagagatgtaaagtaatcatttgttctcaaatggccaagatatcatttcgttcagaaacaaagaatctcgtaaacaagagtacaaatttaccagagtgcttgtaagagtgaacgttggtgaggttgttagtctccttgctgaattgaaccttagagtttcctctaccgaactgcttcaccaagaaacagttgttgttcttcacgatctcccagatcaattgtcctggaactgtcgccatttcaaatacctaccttcaccacaccaaaaatgatactaccaatcaacaacacatacattaacagatcgattcctaaaggctactactatagagctcgctgaatcaaaatatctacacaaaatcagatcatctaagctacgaaaatcaagacatactgaactgagaacaattgagagtaatactaagctcaccgtgaaatttcgcagatagagatcgagagattttaatggtggcgccggagctttgttagaagacgaatggagctatttatatatgacctctgaaaaaaataaaaccctagctcatgtaagtgaacgtgaaaagtctaaaatacccctaatgtttttcgaaatgtcgaaatacccacaattctgagaaacgttggaataaacccatttcctgctgctctgttgaactttaggggttatcgattctttttgattcgttgtcattcgattatagaatttgtattagaaatcggaattttcgatcaatg

SEQ ID NO: 12315 - DNA, 3000 bp, Unknown
  misc_feature (1)..( 3000): cDNA_ID_1383333_gDNA_ID_2214543_Annot_ID_134507 3000 nt of promoter + ATG
attttgtaaagtaatagacaaaaaactagctgattctgcggtttgagcatagaaatggtatctttatacttcagtcacaaactatcaactttgaaaagaactacttcaaattcctaactaaaaacatacaaaacacagacgaagatcgaaacaaacttaagttagaccataaactaaacaggagcagatatgactttctccaaccatagatcaagatgtaacttatccataagaatcaaaaaacagaaacttttcaatcttctgcaacttcatagttaaccaagaacaaagcttaatcattgggaccatgttgtaaccaatctcttacatcgagtgatcacacatggaaattcttgagctatacgtgttaggatcagctcaaggaccaacaaaacaatagagactatggatcattaatcatacttcactacaagcaaaagtgactaaaaccaatgtcgacgaaactgataaatctaaacaagtagatgaaaaattagggaaatgaattaagacccaattagaccagaagaaagaagaagtgaaaaatctcacctttctctttcatgattttgagaaacgaagacattacggtagagacaggtttcaactccaccgaagctttccctcgcttctcagcattcacgatcgttctcaatgcatcgttcaatattctcctccccattgatcgaaaattccgatttctaatacaaattctataatcgaatgacaacgaatcaaaaagaatcgataacccctaaagttcaacagagcagcaggaaatgggtttattccaacgtttctcagaattgtgggtatttcgacatttcgaaaaacattaggggtattttagacttttcacgttcacttacatgagctagggttttatttttttcagaggtcatatataaatagctccattcgtcttctaacaaagctccggcgccaccattaaaatctctcgatctctatctgcgaaatttcacggtgagcttagtattactctcaattgttctcagttcagtatgtcttgattttcgtagcttagatgatctgattttgtgtagatattttgattcagcgagctctatagtagtagcctttaggaatcgatctgttaatgtatgtgttgttgattggtagtatcatttttggtgtggtgaaggtaggtatttgaaatggcgacagttccaggacaattgatctgggagatcgtgaagaacaacaactgtttcttggtgaagcagttcggtagaggaaactctaaggttcaattcagcaaggagactaacaacctcaccaacgttcactcttacaagcactctggtaaatttgtactcttgtttacgagattctttgtttctgaacgaaatgatatcttggccatttgagaacaaatgattactttacatctctggttggttgatttagtagaatagattgggaactaaagttgttaagaaatgttgatgtgttaagtgcttttggttctatgaaagattgtggattctcgactattagatgattgtggttgaaacttggctgtttgagatcgtctttatgcactattttattgattctcgagtataagcttattttcttatctgttgcaagttgaccgtgaaatgtagtttctttacatttgaccatttgaatctgtattacaattgtgtatgtatcttctaatttaaagacaaaaatggtagtctgagttgagcagacacttcatactatgtattaggttttgttattgtcttgaattaggctaaagtttgaatcttttgatgtggtttcaggtcttgcaaacaaaaagactgtgaccatccaggccgctgacaaggaccaagctgttgtgctcgccaccaccaagaccaagaagcagaacaagcctaagctctctgtcaacaagtctatcctcaagaaggaattccccaggatgtcaaaggctgttgctaaccaggtattactcaatttttattactttagtgttttttatatgtctatggtgtgcttataggtctctatatctagttttgtgtgttattttcacggctatgatctacaattggtttttatgttcttccctctacctgtgagaggagagttaatatgttatggtaaaacgatatgatgcatagctgtgcaaagattaaaatttaacttcatataaggctcctttttgtggcatattgatgaaatattaattttacacttggctattttcattgatctgcttaatgttgctgtttattggtttcatacgtgaatacaatctaaaccaaatgattgtgtaaatgtttaggtggtggacaactactacaggccggacttgaagaaagctgcacttgctagactcagcgccatcagcaaaggtctcagggttgccaagtccggtgccaagcaaagaaacagacaagcttaagcttcttctttcacaatctgttttttttgaagtaaaagattttgttgaacaggttttatttaagttgttgctttgaagttgaaccataatgctattctcctttttcattatccttattataaaggagttagaagtttatcttgttatgcttgatgtttctggtgtgcttgtgttacattttgttagatccttttatcgaatcaagaactttcttaaaatctctattctagattttattagcaaatcaaatgtaatcaacaaccaagtccttatatattatgacttttgaaagcctaaattgactcaaaatagcaaacataaatgtttagatttgttgcatcaaatgtgatgttcttgtggactataatgttgacattttcattagatcccatcaaaaaccaacttgagaattccatcttagcatgctctatacttatccaaaagcccatcaggcccatagacggcccaacttatagcatacggaaaggtttatattagggtttcttagacatgaattaattctgttctcttgctgtggccgtctccaacaccatttcgaagaccagggagatcgaagcaaa

SEQ ID NO: 12316 - DNA, 3000 bp, Unknown
  misc_feature (1)..( 3000): cDNA_ID_2708688_gDNA_ID_2214543_Annot_ID_134509 3000 nt of promoter + ATG
aaggtcaccaccttaccgccgccgctatcatcggccatgatggtagcgtttgggctcagagcgctaattttcctcaggtataattacctcctcctctattatcgatcgatcatgttttggtttcgttggtcttaaatcttttatgtagagaaatatgatttgatacttgctatttctatccgttacgtacgtatattatggacatatttatagtgatatataatatagatgagctgatcaactttgatttgtaatctcaccatttgcatcaagttcattgttccggatttagttcaacgttaaaagtctgaggattcatttgtcttcaaatagttcaaacctcaagagatcacagacattatgaaggatttcgatgagcctggtcacctcgctcccacgggtatgttcctcgcagggctaaagtatatggtcatccaaggcgagcctaatgctgtcatccgtggcaagaaggtatgtttaggattaacgctcgattgtttgtgtttgcattctacaaaaataatctaagaaatcctaaaatatattgttttatttttttaaatatgtgaattttactttgcgcatgttaaatgcacatgtataccattgcatttgaaacaatcgacgtttaaggcctagcaaccatcgggatcgaaaaatattttatgaaacttgaattattttctaataaaaaagattcacatgcaaacgcttaaaacaattgaggcctacgattttatgagaatcaacccctcccattgcactccatagagccgactatgattaagagaataatctcatgcaaaaatggtcaatactctaatcattttgatagtatttgatgttatgaatgtaattcaaagtcttaccaaaagcatcgcttatatggtacatagtatatagtcgatgattttgcactcccaaactttttcatttcttgaaatgataattacattcttgaaactataagcttatcataaaaacatttaatgttaagaatttggtttgaaactcaaaaccattaatataattggaacttgggcagggagctgggggaatcacgatcaagaaaacaggacaatcaatggtgtttggtctgtacgaagagccagtgactccaggacaatgcaacatggttgtcgagaggttgggtgattacttgatcgaacagggtctttgaaccatctacaatgttttatatctctttctctataaatcattaaacctttgtttctctttttgggttttggttttccgtttctataatttaattttgggtcttcctggtttctactttagccaagtttaacagaaagcttaagcctaaggttgcagataataacactaagcctgtgtgaagaagccaagacttataagacttttgtttcttttttctctttttcatggttattgattaatttgtgtttttaaaaaaaaattaattttatagtattgttgcgtatatataaacttgtcatgttaattaatatctcatttcttcatatacataccaaagccatcatggataacaattaattatgtaatcgggtgttggacatataatagctatccatgcgtttatcgcttgaatcgacggtgtcggttcacatacatgcacattgttaccggaggaagaatggaggacatgataactcctagttttttcgatgtttattttgacaagactacgaatgtaaacatgaaaataaaactcgactaaccaaaacaagaaagtaccaaaccagaagtatttcgattattcgttctttatttattttcagttattgcatacattaagagatttggttttccttgagtttagaaacactatctccacttttgaaattaatatctagtgttcaagacatcaagtttacattgctttgattattttagtaaaactaatggcgtttttatcagttgaaccaatatcacaaaaccctcaatattcatgtatgtatctcctaatttcttttcatgataagcactaaatagatgggatcttaaattgaaatagagactatattttcatattttgaatcttgtgaaacagaaggtattgttgtcaattaaaatgtctaaaatgaccagccatgattgcgagaactcgaactcaaaattttcaattcctataatgacctaccatgatcgagagaactctgaactcataatttataattccatgataattcttttaaccacaataccactaaattatttctcaagtttgattaaaaaattgaaaatacgaaagtgatggaccacacgtaaatgcaatatttggtgtaacgcaataatatatgattgagaatctcaatttgagatcttgctatagcatatccactctgtatttgaagagaacaaatgatgttgccttctggcatattaatttttttctttttttggaataaaaaactttatttttataattgggaaaagtttttgagtttcttttttttttttttgttaaacaaacatccatttggaaaaaattaaagaaagtattatgataaagaaggattaaaaaaaaaaaaatcttcttaatatagcttacaatgttttgttgttaaagtatagctaagtaaagtatgttataaatggtgcatgattttttatttttgattaaaaagtggtaaatgatatttttttcctccattttgcatttttacactttgtatgatccaatttgcttttatttatctacatataataaatctctataataaaccatttacataccattactaaaactaaaattataatggaaaaatattattatgttatttattgttactttggtaaagcattattatttattttgcttattttaagggctaataattaattgaaattaagcagttgacgaaagttttttttattaatttataaagcacaacatttccttgtctacacgatcataaagctcacaaagagagaattgagaagaaacaaactcgtcggagaattcagtactcgccgaagaggaagaagaagaagatg

SEQ ID NO: 12317 - DNA, 3000 bp, Unknown
  misc_feature (1)..( 3000): cDNA_ID_4283538_gDNA_ID_2214543_Annot_ID_134510 3000 nt of promoter + ATG
ttccccaagaagaaaagacagcaactttaatcaaagcttctcgagtttgttgagtatcaaaaagcaaaacaagaatcatgaagaagaaaggcaccaacaacaacaactttagccttctgtctttgtctctgttcctgaattgtttgattctaacaaacggatacagcattggagtcggagttggaatcggcggtggagacggtgacgacggcggagtttggataggtggaggaaaccctaattccaatcctggctcagctccaaaccaacaacagacaacaaatgcagcttacaatgctcttcaatcttggaaatccgccattacagaggatccatctggtgttcttaaaacatgggttggtgaagatgtttgttcttacagaggcgtgttctgttctggctcatctataacctccatagatctaaacaaagcaaatctcaaaggcaccattgttaaagacctctctttactctcagacctaaccattcttcatctcaacagtaacagattctctggtcaaatcccagattctttcaagaatcttgattctcttcaagaactcgatctcagcaacaacagattctccggttctttccctcaagtcacactctacatcccaaatctggtttacctcgatctccggttcaacaatttcactggctctataccggaaaatctcttcaacaaacaattagacgcgattctcctcaacaacaatcaattcaccggagaaatccctgggaatctcggttactctacagcttcggtgattaatctcgctaacaacaaattatccggcgaaatcccgacgagtttcggtatcaccggttcgaaattgaaagaggttttgttcttgaataaccagttaaccggttgtataccggaatcagttggtttattctccgacattgaagtgtttgatgttagtttcaattcattgatgggtcatgtccctgacacgatctcttgcttatcggagattgaagttttgaatctcggacacaacaaattctccggtgatcttcctgatttggtctgtactttgaggaatctgataaatctgacggtttctttcaacttcttctctgggtttagctctcagtgctcgagccttagcgttgggtttgatttcaccggaaattgtattcccggtaagggttatcaacggcctcagccggattgttcggcgattcctggtggccaattgagctgttttagaattccggcgcagccgttaacgtgtgctgcgattagcttggggttgaaggtggcttcatctccatgaaaacataaaaagttcgaagcttttgtattggttatgcaattgtgacttgatagaagaaaatggtttttatcagttacattattaatcaaactgatttatattagtagataaaacttatttctgattttgaaacctttgtaatctgatctttctaaaaaaaaagaaaagttgggatcttgctaaggattttttttgtttgtttactagaaagagcaaatattgttgagatgaaatttattatgttcatcactaaattaaatggtcttcaataaataaccaaaaaggaattgataatgttgttgttggtccaaaactggtcctgtatttgcctaaccaagtaaagaattctacaatgagtaatgatggctaagaaagatccataaaacatatgaaaaatgaaatgtgatgaggattagcaaaaataaaaaagaagacatgagcagaaacatatcaatacaaagatagataaccaaacggatctttaaagtttatgggttgagatagataaaattcttaaattctttttagacttcgcatgaatcgacgacattgagcctgacagatgctaaagagagctacgaagaagagaaatgtgtttgcatgcaaatgatgtgttgtaccgcaacgtgaaccactagttttgctcatttttatttgttaaatggtttgctccatcagaatttattttattggtaacgactctaccttcatccctgttatatcaatgttttccctcttcgttgtatactatactaatcagtcttgttatcatccgcattatagtagaccacaacaaaaatcatttaactaatcttcgtgtattgtcgattcaaattaaatgctctagtagataatttaggagtagctaactagctatagatcggataaaacactagtttcatagtcttttcatgcatttagttagttttgttgcaagaaatttgagaatatagtttggattaaaggaaaaaagcatgtggaaaattggagaaaacatcatggcgatcgccgatcagctatgatcagatcaatcgtcacctcgaccgatcagaagagggacaaattagcagaaatgacaacaactcttctgaaaatagtttgatcggtcactaaaatgatcatgatatccattaattatatcacgtttagaacagatacattggttcttttagctagaatctaagtctatgttgttatttggtacggcacaatgtctcaaagagtaaatccaaactgtgtcgagaaactataaagatccaaattcaaattgagacaatcttttttgagaggctgctacaaaaccacatcttttttacaaaatcttgttcatttccttagtcttttaatcatatatgctaaacaaatattaatagtttaatactgttattatttcctgaaatccttcttgttcgttattattaggaggaaattagcatagggaagaaaagacacgtggcgtgcatgtagtgaatgattaagctataacaaaggcgagacgtcagtagcaataataataaaaaatgagcggctgagaatgtgtctaatgaatccaacggcagatacttcatcctacaacattcttcttcgctccctatttatcgagacgaccaagtccccctgggagttgcattgcacacacatacatacgtagagagatccaaaatacccaacctcgcagagtaaaagcaaaaagaagaagaaatcagagagaatg

SEQ ID NO: 12318 - DNA, 3000 bp, Unknown; identical to SEQ ID NO: 12312
  misc_feature (1)..( 3000): cDNA_ID_1807682_gDNA_ID_2214543_Annot_ID_185284 3000 nt of promoter + ATG

SEQ ID NO: 12319 - DNA, 3000 bp, Unknown
  misc_feature (1)..( 3000): cDNA_ID_3434971_gDNA_ID_2214543_Annot_ID_134512 3000 nt of promoter + ATG
tcacatgaattttataagcattatttagctgggaatagtatatactccatgatattatttattgcatatggttaggagagtttatatgtatgtctttcgcaacatttaacatttagagttcatgtttccatgcttttagaagaaaaaaatactatcgattaaattatttttagaagttaccactgaccagtgacaattgtcataataaaaccattaattaccttctgtgttcagaggattcttgtatcgactttttttgttaaagaacctgaaaaaagtctcctatgaattaattgagaattcagagaaatacatattaaaaacttatccatgtgctatcaatagaacgttcttaagaatgtttctaagcaacactttgtttttaaaacttatttacaactatgtcactagacatatgtttaaaatttgatcataataaatacatgaaatgtattaatatcaaagaaaattaactatttgtatataaaacaaaatcatcttattttatggagtacctactaatattagtgtttccacgttccactttccactgactccgatttgctatcataatatttgtctgtcatatcagttgatttttctgatattccatttccaccaaagtaataatgtgaagaactgaaccactattgtgaccgacgtaaaaacaacattactgttgcgtattatgaccaaatttgatacaaaggaaataattaaaaacgacaaattaccagatagtattagtttatactccttatcatgcattgatgatgcatatatcaaaagtagaaaagagaaaaaaagaagaagaagaagcagaatctagggaggctatttaaagtatagaagaaagaaaaatatgtagcagcttctgagtgtgaaatgctgtgagattgtgttgacttgagataacgattttaatgaaatgttaaaaaattgggagatttgtatcgcctcacatggaggggacacacaccaatagattttgggaatgagtcatccatatatactagaaaattaatcaaaataaatggcgttaaaatatacaattattttccacccattatattctggctctgagtactattgttcgttttaagattaggtggatacttaaatttcttgtagatttttccattcaaaatctattagttatacatgcatctcattgtattttacgatttttaataatatttgtgaaaatgcatctcatattaactcaatttacgtaacataattttgatctccgttttgcactactgaagctagaaaaacataaacataagacaaaaaccaaaaaaaaaaaatccttttacgaatgagtgagatcatccacacaaattttgatggaattcaaaagaagactaatgttaataaagattaaggaaaatacaaaatatatgaatctagctagtggacaaacaattgtatgtttcttatatctggggcacccaagcagctaactagtgtttcaaaataaaaacaaaagaatgtccacataatattaggatattaatacttaaatctagcaagaatacaacaattgtatgaatcttatgtttggatatgcaagccgccagctcatatctccatataaaaccaaaaaaaggtatttttggtaaatataaattagataatacaaaataagtagatgtggatatgtatgtataatgtttaataaatttggtccatgtagtgttaatatgtgatgttacatatattgataaataggttaggttatagcgcacttaatgattacataaattagtgagtgagagatttaatgtgaatgcgaagaaggtggaggagaagaatcaacaatttgattggggtttctgtaaatttgagttgtaagctatatattccccactaggccactaataacggttattttttcttcatcactattcttttgggtgaaaaaggtaacgattataaaagaataaacattatgatctttttttcctccccattttgactttcgagtatagagacattatagcattcataaagaaacacatttttcttttatctatatcgcatgccgcatgcgccatctatagcattcatacgaaacatatcgagttttatctttattccatgttctattgtatcaatttttgaagaggaaatgaaatggtggtaatggattatattaaccaaaggccattgttatagacttatagttttgaattaaactcacggtatattgttttagggtcatacactttaaaagcttacgaagcttttgactctacacgtgttaaacattaataattacagtatatcaaaaccaacaaacatttgaaattttgaaacagaacagaacagaaccatataacatttgtctaacctaataatttgtagctggcatgacggctaatctgttcgttttattgttgttacttgtcgtcgttgtcgatgccaaaatcatgttttttttgtgcgtagtcaatggttcaacgatatattttagtaatgaattcctataatttcttaaaattgcaaaccaataacgtcagtacacataaataccatgggcttttcggtgccttaatattagtgggcttatataggcagaaacatacacttttcccccaaaactagttttgataacatgggcttttcaatgtttaatattagtgggcttatatcaatctaatgaaatttgaagagaagagagagaggaacctgcgggtcgttgactcgttgtatgtttcggcccatataagcccagtattaactgaaaataaaattagtttttttcatattaccatgcatgtttttttcggcccatataagcccaatattaccgtgcaagttttttcttattttttaaattttatctgaaagtaaaattgaacagagtaccgatgacgtgtcctaactcccaagtagaagaagaagaagaagtaaaaaaaaaaaaaaaaagatctgaaagaaataaaaaacgaatcggaagagagagagagagagagagattggagctagttggag

SEQ ID NO: 12320 - DNA, 3000 bp, Unknown
  misc_feature (1)..( 3000): cDNA_ID_3024594_gDNA_ID_2214543_Annot_ID_185312 3000 nt of promoter + ATG
atagctcttccaggaattcgatcaggaaagacactcatatgacaatagttggatcctctaacgttgtgtgtccgaggaacaactccttcatccaacactttgacaaattcttcatcctacaaaacatttttgaaacataataagtaacaaaagtagtaattggcttacaacataagagtaatcatcacctcataagacgtcttcaattgctggtgtaaatcttcggttctaaccccgggagccatttccacatatatagtcgattgcattccacggatctacccaaacaactgaggatcagttaatgggtttaaggttaaaaattatagaaatcatgctaagattatttgtaccattggcatgagatgtggcgtaaaactgactgttacttttgactgtgcaacatcagataatccctgttcaatttcaggaactgcaaaacaaaagagatattgaattcaaatcatggcaaaattttaactcattgtgataattagtttgtgacataccatggcgatgacgggtgacaccataagaagaaatgccttcagctatctcagagtaaagatttgcctccttagcaccacgtcctgatgaaaatttcatatcagtcaagaaactagaaacattgcatcattgttcattgatcacggagtaagctcaaacctgctccactaacaccagattttgcatcgataatgatgttttcatgtttgatgagatttgcctgcaccaaaatcaacacattgagtagagagacggaagactaggcagttaagtaaaatcgcataccagaaaagaatagaaaaacaaacctttagtaaaggaacaagaggaagttgaatcgtagtcgggtaacagcctgggttagccacaagtcgtgccttttttatgtcctcccttagtatctctgttagaccatacacaacttctttctgaaccccgtaggacacttggtaagtataaccattatgaacacaacagacctaaaatcaaggaataacattgagagaaatgtacctgtaactctactgccttgtgaggctgaccataccattcttcatattctgcaatattacgcaaccggaagtcctgaaaagcgtattttagatgggcttataactgaaagaaaaggaacaaaaaaaaaacagttcttcaaggattaccgctgaaagatcaacgattttcaatgcagtaggcagttccttgatgatttcctgttgaaatacacactcatttccgttaagctaagaaaagctttaagaaattgaaatggaagaatgaaaggaaaatgaacctgagttgttccgtgaggtaaacagcagaatacagcatccacagtagaaaaatctgcatcctttaccgagaccaaagtaggtagtttctgtggacagtaaaggttcaattattaatcaatatacaccatcacaaagtaacattgaacagattcatttcttggtatattactagggatagaaatcacttatacttgagctctcaggtgtgggaaaacgctttccattgactggccagcttttctatcagcagtcatcaaagtgacctggaaatgcggatgatttgcaagaagcctaacgatctgcaattcaataaagaagagtaaacttaccatctcatgggtttgaatgaaaccttgaatgcctcatccattctttcccttgtaattttaaacaactttaaagcaacgactataagacttttctcttccttttatcgagaaaagattaactttgcatatgtttacagcttaagctaaattagaaggccaatacccaaaaagtcaaaaacttgcaacaagatgcataccacttaagctctgattcattgcaaaaccaaagagatcactaaaacaaacaattccaagaaaattaaacttgaaacagacagattcaacattgcacaaacctcagcaccagtgtagccacttgcaccaagaagaccaatcctaatatccttttcaggtttaacagaactactagctgaaactctgaagctcattgaagatggcgaagccacatgggatcccaaagtaagcctcttggctcgcttatccgctacacattttcctttcgcccttttcaaaacaaagaaaacccacatttacatgattatcagattgcaataacacaacacaagctacaatgagcttgaatgtggattcagtgggaaaaaaaacagagattttgaagagttttaggaattgaccttgaaccagcatccttggattgaactaaaagccgacgcagtactcattattggattcgattctgcaaaaaacaaaattcaggaacaaaaaaagactaatctttttgctaagaacaagaagaaattagcttctctcaatgtgatttgatattgagagtcaattatggtagtgatgaaacaaatacccgtaaactcttcgtcactctctctctctatacgaagtggtcggagaagttcgacggagaagaagacagcagaaaaccacgacaaagattgtgggacgaaaacgcaagaacgacgacgtttcagctagccctacttaaaacctatcaaagcggtgccgtttcagggatcgaacccgtttactgaacaggctacccgtggttcaacccggtttatcgacgaattaatcgtttgcagaaaacgcgatatgtcttggcgtttgcatcgggtgacgacaaaaatctggcattttggtaattcccagactaagagtaaaggcattcatgtcaattacttgagtaagcgccgaagcggttagatgaatttgtttcaatggagtcaaaagaaaatctagagaaaaagctccgacctttttatttcctctctgtttcttcttgtgtcatcgtcaaatcaaatccaatcactaacagtagaaactgtttctctactgggtatttttttttggcaacccttaaattctgaagtaagagagaagaagaagaaagtgtgagattccgacgaacgggaagaaaaatgataaattttcgcagcatg

SEQ ID NO: 12321 - DNA, 3000 bp, Unknown
  misc_feature (1)..( 3000): cDNA_ID_3024598_gDNA_ID_2214543_Annot_ID_185311 3000 nt of promoter + ATG
aacttcctattgacgaatcatactatctcatggggacagtggatcccaccggagagctaaaggaagatgaagtctgtgtcatcctgtatgctaccaaaattttatttatttttttgtaatataaagtgtggatggaagaataaacaaaccgtgcaacttgcttcattggagttgtgagttagctcttcatttcctcactactttctttttcgttgttttgcagcgggtctggccaaatctcaggatgtgctagtttacaggaatcctggactacattttggagacatacatattctaaaggctacatatgttaaatccttggaacagtatgttggaaattccaagtatggtgtgttcttccctcaaaaaggtccaagatctttgggagacgaaattgcaggtggtgactttgatggcgatatgtatttcatatccagaaatcccaaggtacactgctatatccatcacagttatagtaaaatttcattgctgagacctaacttataaaccgcaacttcctctgtttagctacttgagcactacaagccaagtgaaccgtgggtgagttcttctccacgtagtaaaatttacactggtagacaaccaagtgaactttcacccgaacagttggaagaagagcttttcaaaatcttcttaaagacaggatttagtcccaggtacattctttaattctcgggttactttcaaggtcacatagtcctttgggttaaatatgtcttgttttctgggtttacagctcagttataggacaggctgcagatagctggctagcaataatggaccggttcctcaccttaggagatgagaatgttaaggaaaaagctgaaatgaagaagaaaatgctaaagttgactgatatatactatgatgctattgatgcaccaaaaacggggactgaggtcaatctcccgttagacgtaaaggtcgatctttttccacattatatggagaggaataaaacattcaagtccacttctattcttggattaatctttgacactgtggattttcataatgcagaggacaccacaccatctggtacgggtcttcttgttactattgataatcaaagtacacaataactcatcacgttgaatatgttttaacggtttagctctgggttacctttcaggaatcagtaaacttcagtgttttgaagatgagccggtctctgagtttgacatggagaaatgtaaactctggcacaaggattacagaaaggagatgtgtcaagcgatgaactcagatgatgatgattcctgtaatgaagttatccagaaatacaagcaggtaagctcttcaatttagttaattctaagagaaaagctttaaccaatagccttcatggatcactggttttttgttgattgtaatgctttataaacaaatcattggttgaacggtttcttctctctgtaacaggagttctacagtgctgcagggtttaaagaaagcaagaaaattctagaagaactctacccaaaggcccttgcactttacaacgtcacttaggactatgccatcaagtggaataacgttaaaagttgcgggtttgtctggaaggttgcaggtccggtcctgtgcagattctacgagaagaatttagtaatgtgttcgatttccatgctgaaagagattttcggctgaacactcttactgttctgttctggtgataacaataagtatttgctgtcttcatgtctcataatatgcgtgttaggcaagtaacctacttataggccaaaccaagatgtgtggtgtagtactggctttgatttaggtctaatcttagatttgtcctctagttaacatataattccgtgtgtatgtatatttgcttatggaatagaaaaaaatgatgacctttatagtgtggtggtgtacaaagctatcttctccagtgcgactcctctctgcgtcctcatgcttccatttggattttccacaaccttcttccttccattactatatttttcaagaaaagtagcaaaagtttcttcctttgtgaatagtagcaaatatagtataatatattagcaaatatagtaatggaagtagcaagactaaattcttcagaagttaatgaatagtgcacttgcagagcccaccttcctatatcttggttctggttaagtaagaatcaatttttggaatcacacagtctgatcctttatgtccacatatttttattatgtcttcttgtttggttattgactggaacagaaatagcgtaactcataaacctccattggaattttcgagttctgaggtgtaggggaataataacctctaataatgaactctctccgtcttgcttgtagcaaagtttcttcttcactgaaccgctgatatacctcagtatccatttcactgcatgccaatgcttctttatgattttgctcatgaatctacagactaagtaacttagctaataggtaccaagatgttgtagcgactttggtttggttctaaacttctaatatagatttgttgcctctgctgagtattttttgtgaataaatgcttatgacaatgaataaaattacctctgcaggtgtgtttttgtaaccttgaaacttgtaatatgaatgtgcatatataaataattcgcgattatgcaatgagacaaaatagtccgaaaacgcgattttacttgcgcgtttgcagcgccggcgagaaagtagtggcagatttgtaaatatagtagtgatggttgggcattttgataaaaattaaaaaattaataaacggctagaatagcgtactgcatataaatctccgtgtagtcaaatcaaagtatcaaacagatttacacaaaacttctgtttttttctttttttgaaacctaaaggacgaaactttgagaaaatggcagcaaaagcaattccagagttaaacaagtttctctcttcccactagggctatatattatgaaccctagattatagacactgactccgattttggggagaaaaaatg

SEQ ID NO: 12322 - DNA, 3000 bp, Unknown
  misc_feature (1)..( 3000): cDNA_ID_3024608_gDNA_ID_2214543_Annot_ID_185308 3000 nt of promoter + ATG
tttctaatattattaaatattatagatggtatatatttttaataccaagtgtctggtagctcaattggtaaagatcatagatgaagtttagaggtcgccggttcgagtgacgcttggaacgaaactaagggggtgttattagttaatgaattttaatagaattaaaatccaacactaatcaactgttattcaactaatgattctaaatccagttttaaaatctagtgttattggaactcatctttgtaatcatgcttaatagattttaaaatttagtgttattcaattaagattttaaatatttcattaaaatccagtattattcaaaacaaaaaaacttgtaaaatccttgtatattagttcatttgaaatgaaatctctttggagtttcatgagtaaatcattagaatcaatattcaagacatattgcatagattatattgcatagattttgaaatttatacaaacatatttttaaaagcaacatcagaaaacaaatctaaagcttaaagaattgactttaactccataattgaataacaccacctaatattacatgctgtagttttggatctggaaaaattacggatttcggcctagaaccttcttatattaaaaaaaaaaaaaggtatatatttttattgtcacgaagaatgtgtgtatacacgaacgctcataatccattgaagtcaatttcttgcgataaacgtagtttatttcttgcacacaatcaaatctagttacgtacattagcaaacactgttttagattggtccgagtgattgtttgactttgatcgaaaataaacacacaattttaattaattacctttgaaaatatgtaattacaatgctcatattagtgcaaagaaaaaacaacaaatataatttgaaccaatagtttgttcactagcaatatattatatgtatagttgactctagtacattagtatcaatctaaaaatctaatctaactcgatattaggccatatgttttaacaccaaattagatttgaaaaacatggcaatggaaacacaataatatttttaagtcacatcagagaagaagatgcatagaatatacctagaaaatattcaattcgccaaggagatcaatgattaggtcataggagtaataaactatagaataaaattatgtggaaaaaataataaataaaattaagaaaagaaattgggttgtcaaaaacacacatgtatctaagctgtcaccactcgtgatactctgttcgaaaaggacatctttagattcggcatcacattctggcatctttgccgccaaaattactttattgtataaacaatattttcctcttgagtaagaataatccttcacgagaaagtaaaaattaactttgatcttgcgagcaaaagtagtttacatgtttaatgtgatatatgcaaaataagtgatatattattaaactgtaattggtaattgatgcggatcaccacactaaacatatttgatcattgttcatgtgaaacttaaaatatttttaaaaagtcgagtatgagtaggtgtcttttggagatgccatgttctgatggtttgatttagcttcaagagtgtgattcgacatttgaaaaattaaataatgcatcaaaaaatggttagaaaaactctctcttcaagaatatatatgtcttaatatgcaggttaagaagcacatgaactatttagtctatttcacgtgcaattaagatgtagtcatattccaagagacatgttactgttgcaatcttaggtcgaaagcatcatcttttgtcgaaacaaaagttccaagagtccaagacattaagttacaatatgcatatgatgcgagcaaatcatcacccatttgcacaacttctttcaaaaccgcataaaacagtttttttttttatctcgcttaagagaagcaatttttagaattagaaaaataccttcaaatgacaatgatccatatcttgaaagttatttttgttgcttcagctctattcaagcctcacatcttattcgaaatatccgtaaaactcattgaattcaacaaccacaaaccgtacttcatctttcgagatcctaaaccgtataaatcacaatccttgtctcaaatgtagaatacgatctccatacacaaataattgaaaaaaaaaaacttgcacatgaataatccgtttgtttgaaaaacaaatatctaattttttacaagaatctttccaaaacataaccaatccaacacttaaaccaataagcctaccagttgacacatggtcactagctagagtttataatcttttcaatgaaccaaaaaatgtttcttaacgcggttttaggtttcgaaatataatcagaatattgacaaacatatgttcttctaatagcaataaattttagtatatgctctatacaaaataaatgaaagattataagatttaaatgcttatagatatatacaacacacacgtaaacatagttttttttttttgacataatacaatgatatatatttcttttaacagaatatttatttccttaactattgggaataatttcttttgaaattgatgacaaccaaaaaaaaaatcttatttgaaatttcaaatagaaggtgctgattcttaaagatttatgaatttattaaaaataaaaaatagtaaagttgagttttttgaattaaaaaaggaagaggaaagaaaagggatgtgtccatgattgattgaatggtgtgatttagtttttgaaaaatattattataagtttagttttttagttttctctctggattttcgctggtccgtcaatggtgatctgagacaatttcacgaatctaattggtttcgatgtgtgacagagagagacaacgagacgaatttcaaatctagggtttctcattttttgctcctctgttctctcttcttcttctcaatcctttattgtcgcgaggaagaggacgacgttgaatacaaggagaggacacaaggaaaagaaaagagacgaaag

SEQ ID NO: 12323 - DNA, 3000 bp, Unknown
  misc_feature (1)..( 3000): cDNA_ID_3024612_gDNA_ID_2214543_Annot_ID_185307 3000 nt of promoter + ATG
gagaaatcttgcgtagagttcttctgaagatggctgaagaagctgccttctttggcgatatcgtcccacctaagctgaaaataccattcatcataaggttgattagttgctccgtcgttatgactacttgccatcgattcagaagtctaataattatgtttgcggtatgcaggaccccgaacatgtctgctatgcacagtgatacttccccggatttgaaggttgtaggaagcaagttaaaagacatattggaggttagactctctcctatacacaatgatttcacactttaatctataaatctcaaaagagtttctttggtggaactctcaggtccagactagttctctgaagatgaggaaagttgtgatcagcctatgtaacatcattgcaagccgaggagctcgtttatctgctgcggggatctatggaatcctcaagaaaataggaagagacgcaacaaaagatggagaagctcagaaatctgtgatagcgatggacggtgggctattcgagcattacactcagttcagtgagtcgatgaagagttcattgaaagagttgcttggagatgaagtttcagagagtgttgaagtgatactgtcgaatgatggttcaggtgttggagctgcattacttgctgcttctcactctcagtatctcgaacttgaagatgactctgaaacaagttaattttaaaagccttttttttgtgtttaaccttcttctttgttttgccgttagggtttaaacaaataaaaaaaagtaagaaggtaaaaatgcccttttgggaaattttatttttgacaattttcaggaacaataaaacctggattcttcatcaaagctctgggaaattcaaacgaccagccaatgttgtagaactatacatatatattcgagttctttctatgaacgttcattttttcccaaaactagtaatcagaaattctatcaagtcttttctttcgtattcttaacttgaaacacaaatcaagcatttgaaacaatgtcttctctatatttccgagcaaaagaaatacttggtataaaaacgatattttttttctcgaatttaatttaatattatatttttaaaatattaattaaaaccatttagactaaaaataatgaattaatataatacatttgttttaagattttcgaatttactagcaaagaaactccgaaatttaggatttgaatagatgtaacatatggtacgaacaactagaacattttatttttgaacagacaacaatcaatttactgcatatcaaatttatttttatgtaaatctgatatgtaattagtctgctaccaattttgttttttcccatggttatcattacaaattacaatttataaacagtaaacaaaagggtctattcagtaaaacggttttgtccacctcatccattaacacttctttcttatcttctccacttctctcctttagaatttactcgaaaggttggaccaagaacaaaaacaagactaatttcaagtgtttatttctttggtttcaattttaatgtaatggtttaattttggttctttcctcttttaacagttttgaatatattaagttgtagttcaacgaaaagatcaaatacaaaatctcagatctctcattaaagatttaattttgtacataatcttcttttttttttttttctaaaatttttgtacataatcattccaacatttttgttcttcttaaaagaaacaaaatcgaaatgcttcaatattacacaaacaaaaatgttgggatgattacagactacggaccataatttcttgtttttgctcttggtccaagaggctagctcaagccttgaagaggtaacttgtattttccttgtgttagttccaagatcatgaatatctcattcccatcttagctataaattactaaaaatttttttccgtcaactatataaactactaattacaatttttaaatctggtatgtaatttgtccgcgacaaaattttgtttttcacatgtgcatatcggcctaatgttttcacgttcgacccgaattgcccggttcaactgattaacctgtgattcgaatacttttctagtttgggtttaatgttaaaatctgacaagttcaaaatttaaaaaacccacaaaaagtcaccattaacccgtgaccggtgaaccaattgaaccggccagatgtgggttttaaaaagcttccttgactttagaataaaatataagatttaaacatttattcaatcattgaaaaagttttttcacttcttaaactcatttgatgttgtagattttggtgaagacttcacaatgccgctttaaacaatgaatcgaatggtgagagagacaaccaagattagttgtttaaattcacgatcttttcttagtttatttccgtgattggtgatctcttactatatttgttatcgtgttagatatttagttgaatataaaaaaatgtaatcattttattataattatttgattttatatatttatatatttttagtgtaaatgattttatattttattaaatgtgatgtaattaatttgttattatatttataatttttttaaaatttttattaatattaattaattgatccgtggtccaatccggatgactgggtgacccaaagatagtccggtcactatctgggtcaggtttaaaaacatcggtggtagcattggtaattcaagtctatttgaggtgatttcgtgaaagagattatttttctcgcaacgacaccgttttctagtcatttctgttgtacttctattctttcttatcttctccttcctctggtctttcccttaaaccctagaaatctctggtagtcaattggtctatgaatgggagaatcttcaaccaccgttatccaattgcgcttcgtttgaaaaattcacctatccccaccggatttttttttattttttctcttctgtttactccgaatcatgtactgtaacttaacaagaagccaaggctttcca

SEQ ID NO: 12324 - DNA, 3000 bp, Unknown
  misc_feature (1)..( 3000): cDNA_ID_4359973_gDNA_ID_2214543_Annot_ID_185306 3000 nt of promoter + ATG
gccatacaaaaatctataggtggtgtccgtcattccactaagtaggattttttgtttgaatcatttctatatagtaaattacattccatatagttgtagaaaaccctttatttactttgtatttccagtattttaagtttctcttttatagagcatagtttcagagaaatttcgttttctttcgactatatttccagagacatttaggtcattcaccggtttatgtttttctttttgaattttggattttggggatatttaatttttccatctgtttatgtaattttaaaatatatttttctatgtttttatatataaaattagatgacaaaaaagaatataaaatcttcgaaaacgattgcatcgtcattttgattatctgtttcccattatataaattatggttatattatggtttaggctgttttgatttcttgcattctttaatattttcagaatttattcgaataggtttaattagttccgtacaaccaacatagaaagatattattagtttttgttctattcaattttgatggaatgtctactcctaccaacaggtttgaacaaggattttgcatagttatagtattaaaaagtgactaaaaagtagaaagttagagagtgggtagtgttgctaaacactttattctttctcgtaccaaactgatgtgatatctaaaatgactttgaactgaaaagagagcatagcactcgacaataaaaagggttttgatagatcccactgattatctctgaagcgaaaaacccctttttttctctcaacttgacgattagggtttcttcttctccttgccgccgttggtgtggcctctcgcccaccggcgagaatcttcctctttctccctcctctcccttttttctatggctttagtgatgcttgctcgggctcctgctccacctttgctcctcccttctccgaatccgccgccgtgtgctctaccgcaagatttgaccagtttggtctctccttctgaacctcccgaccctccagacccaccagactatctcgttggagcttccaactcctttctctcgattttgctgttgaggtcttcagatctaggatcagatcttgttcagactttgagccctctagatctgggttttgctttacgatctattactgctgtgtgcagttcgtggtaccaagtatttcctctcgcttgtttggagctttggttctctattccacacctctctcatcctctagtcactctatcaaaaggttttgtctctctgaaaggtagtaatttctttgaatttttaccttcctttggaacatgccttcgtttatacttcagttccctcaccatgaggatgtgatgatttctactagttttaggctggttttacctcaatatgaggctgttatgatcttgcttaagctcaagctgttcttacctcattatgaggattgttgttttcgattggacttcgaattcagcttcttttacctcagtatgaggttggtttgattctgtataagcttaggcttctcttacctcattatgaggatgttatttaaaaactttggttaagagcaattcatgttattgtttctttggtttggtttcttgaaatttcacgcaggataaaggaaaagacatatgacgtcttaacaagaaatgatcttgggtcttggactccagatttgttcatcaagaagtggtggttttcgcaaccccacacctctccgaagttgaggtttttctcacatctcgtaagctcaagaagttggtgctttgtcgcctatgctattgtagccgtatttcatgatgcgttttatccactagaggatgttgcatctccggacagcagatcaccaagtgtgctctcttatttccgaaagctcatctcatgttgcagcactattggtgtctcgaactttagttgcttaactgttatgtatgcttctatttttttctttcgtgctttctgtatgtcatttgtagcagtggtttttttggcctttgtagcctctttgatgtacttgttgaaccatttctccattgttggagagtagaatcatttataaaaagctagtttgaccaaaaaaaaaagatcccactgattttgccaataccaaattttactattcccaattaactgtaccaagcaatatctttttggtttgtaacataattttggcaaagtttcgacatgtatcaaactatcaatcaaatttgcgatactgatttctatatatagtttcaattttatttggatatcacaaataaaaactaaaagtgggttgaagaatttacgaaataattaacataattttggtcggcgctgaccataataattaataaattgcgtcttttagctcttaagtatagtcaaacgttaattttttttagtaaagcaaaagacgtgtcaaagtcaaactaactaaaattagatgttctcatatactgatatacaatcatatttttaattatgaaactatattgcgtcgttgacaaaaaaaaaaacttagattgcatcaataatggttattcttacaaaaaaaaacccgttaataaatgatataaaacaaatgaaaaattaaaaaattcgatatcataaattcatgatattctcttttactcttttagtaattagatctccgaataataaataatcgtttactaaaaacgtcctccacaaaattcggcaagtaaaagaccaaaaccaaatctcttcagggtcaatttcgtaacttcacactaattccataaccatacataaaaacaaacaaaaaaacaaatcctgcgagaaaaatcccaaaaaatcaataatttaaatcactttccatagtttacagacaacacagagcttgcttacgtgttctccaaattttgtatacattattttcacaaaaccagttcctcaacaactagatccatcatctctagcgttcttaaagtttccaacttttttttttattaatttgggccaactttttttggtttgagaattgggcgagggagaaag

SEQ ID NO: 12325 - DNA, 3000 bp, Unknown; identical to SEQ ID NO: 12319
  misc_feature (1)..( 3000): cDNA_ID_3434971_gDNA_ID_2214543_Annot_ID_185296 3000 nt of promoter + ATG

SEQ ID NO: 12326 - DNA, 3000 bp, Unknown; identical to SEQ ID NO: 12317
  misc_feature (1)..( 3000): cDNA_ID_4283538_gDNA_ID_2214543_Annot_ID_185294 3000 nt of promoter + ATG

SEQ ID NO: 12327 - DNA, 3000 bp, Unknown; identical to SEQ ID NO: 12316
  misc_feature (1)..( 3000): cDNA_ID_2708688_gDNA_ID_2214543_Annot_ID_185293 3000 nt of promoter + ATG

SEQ ID NO: 12328 - DNA, 3000 bp, Unknown; identical to SEQ ID NO: 12315
  misc_feature (1)..( 3000): cDNA_ID_1383333_gDNA_ID_2214543_Annot_ID_185291 3000 nt of promoter + ATG

SEQ ID NO: 12329 - DNA, 3000 bp, Unknown; identical to SEQ ID NO: 12314
  misc_feature (1)..( 3000): cDNA_ID_1807082_gDNA_ID_2214543_Annot_ID_185289 3000 nt of promoter + ATG

SEQ ID NO: 12330 - DNA, 3000 bp, Unknown; identical to SEQ ID NO: 12324
  misc_feature (1)..( 3000): cDNA_ID_4359973_gDNA_ID_2214543_Annot_ID_134519 3000 nt of promoter + ATG

SEQ ID NO: 12331 - DNA, 3000 bp, Unknown; identical to SEQ ID NO: 12322
  misc_feature (1)..( 3000): cDNA_ID_1808122_gDNA_ID_2214543_Annot_ID_134521 3000 nt of promoter + ATG

SEQ ID NO: 12332 - DNA, 3000 bp, Unknown; identical to SEQ ID NO: 12321
  misc_feature (1)..( 3000): cDNA_ID_2711799_gDNA_ID_2214543_Annot_ID_134524 3000 nt of promoter + ATG

SEQ ID NO: 12333 - DNA, 3000 bp, Unknown
  misc_feature (1)..( 3000): cDNA_ID_2711795_gDNA_ID_2214543_Annot_ID_134525 3000 nt of promoter + ATG
tattcttaattttctttccaatttggcagctttgtcctcggactgtccaggttcgaccttcgatgatcaaggtgtctaaagatccatccttgtccaattttagcacctttaacgccttggaagtagtaaccacaaggtattttgttcgctgactacttgttgttttaatactgaagttctctccctcaaatgttcttattgtggagtgaagttatcctagtaacatctagttgtttccatcatccagtaatccaccaaaaagaacaaagctatcaaaaaatttggttgcgctgcttagctatggaggaatccctaatgaattctttttggatatattgctcaacacgttggaagagtctaaaagcatattctacaacaaacgtgctgcacttaatggtgcttaaaattcctaacgtttctggttcttttgcattttgtttctggtgcctagagctatttatttttaagaagtcaaattttcggtgcagctgctcttaattatggggaaatggacgaccagaacgccgcacagatgatattggttggtatcccccttgatgaaccacacttgaagaattatctgtctatacttttaaagacagagaaaaatgatctcaaagcaggaaaacttcctgtgaccgaatcatactatcttatgggaacagtggatcccaccggagcgctaaaggaagatgaagtctgtgtaattctgtatgctactcaactcttcttttaccttttcattttgagttttaattgcatggaaaaaaaaaacagtggtttagttttttggaattgtgagttagttgttcatttcgccactgcttcttttcatggttttttagtgagtctgggcaaatttcgggagaagttttagtgtatagaaatcctggattacattttggagacatacatattcttaaggccacatatgtcaaggccttggaagagtatgttggaaattccaagtttgctgtgttcttccctcagaaaggtccaagatccttgggggacgagattgcaggtggtgactttgatggtgatatgtatttcatatcaagaaaccctgaggtaatccaccacattaatcagtaaaattaattattgttgtgacctgattttcttgggtttgctttctggtttagctacttgaaaacttcaaaccaagtgaaccgtgggtgagtttgactcctcccagtaaaagtaactctggtagagcgccaagccagctttccccagaagagttggaagaagaacttttcgaaatgttcctgactgcaggatttcatgccaggtactctcatctctgaaagatataaaagtgtcttggatttgcagaatcaatctttgaaattcatttcctttttcctcgggtttacagcaatgttatagggatagctgcagatagctggttaacaataatggaccgcttcctcatactaggagatgacagggctgaggaaaaagctgaaatgaagaagaagatgcttgagctgattgatatatactatgatgctcttgatgcaccaaagaaaggggataaagtctacctcccaaacaagctgaagcctgacatctttccacattacatggagcgggataaaaaattccagtccacttctattcttggattaatctttgactttgttaaatcacagacaacagaggaaccctcaccatcatctggtaaaggacctttattggttctactatatacatataatcagatcaccaaagaaatcattaatcatgatatgtgttttactgtggtttacaatttagagatcagtaaactcccgtgtttcgaagatgagccggtctccgagtttcatatgcagaaatgtagactgtggtatgataattacagaactgagatgacacaggcgatgaagactgataaggatgaatcagccaatgaagttattcagagatacaagcaggtaaggtcctcaattcgatgtcaccactctggagattcagttaagtctaagagcaaagatctgaccagtagacttcatgaatctccaatgttttgttgattggttccgtggaagtatgtaaccagcaggagacaatcatgcttatcaaagaaatggtttatttgtcgtgtgtcaggagttctatggcgctgcagggtttgaagacagcaagaaaagtctggaagaactctatccgcaagctctcgcactctacaagatcgtttacgattatgccattcatgcaggtgtttcgaaatgcaggtttgtctggaaggtagcaggaccggtactgtgcagattctatctaaataagaaaatgcaggagaaatgtttagtgtgtgcaccatctgtgcttaaagagctttggggttgaagaatacaagcctttgttgttgctacatgtctaataataagaagcgtatgaggcaagtaagttaactaataggtgccaagatgtgtgtgttgtagtgccttttggtttggttttaatgtagatttctcctctggtgaatattttttgtgaatcttttgcctatgaaatgaataaaaatatgttacataacgaagcttttctattaacgaagctcttacctctgcaccagtgttttttgtaagattgaaatttgtaaaataaatgttgagaattttaaacaaaattttgatcgcgagattgtttgtttacttggcgtttaaagcgacggcgacaaagctttggcaactttgtaattttggtgactcgtgttagggtattttggtaaattccaaaataaataacaaacggctatattgtgtagcctgtataaaaaatcttcttcaagtcaaatccataaaatcgattcacaggaaaaaagctttggactttatttttgtttttcccgtgtgttgtcagatcatcaacgtcgcatcaacagcgcaatgaagaaatttgaaaaattgagaacagttccttcttctcactgggtacttgcttatttgtatgagaaccctaaagagacaactgtttttctcgttgggaaaaatg

SEQ ID NO: 12334 - DNA, 3000 bp, Unknown; identical to SEQ ID NO: 12320
  misc_feature (1)..( 3000): cDNA_ID_2711791_gDNA_ID_2214543_Annot_ID_134526 3000 nt of promoter + ATG

SEQ ID NO: 12335 - DNA, 3000 bp, Unknown
  misc_feature (1)..( 3000): cDNA_ID_2708762_gDNA_ID_2214544_Annot_ID_134529 3000 nt of promoter + ATG
cttgaagacttggttcatttaggagaatgactttttaacttccacgcgcttttacgcgagtggtggatatttttggataatgacttgtacttatttaattatactttttatttagtttttttctcttgtgtatattttcttctatatttgatcttatcttatcatgattattaaataaatattcattatctatagattgaatataacttgcaatgaaataatttcataaaaaaaagtaagactgactaattttctcataatatatagtttatgaccataactggtttttagactaagttaagtaattatgagtttgcagctaattatataaaatttaatttcagtataactaaataattaataagaaaaaaaattatagcaatgtcttaacaaataaaagaagttttgtttaccacatttttattttgaaatttcttaacttttgtaatttttataaatcattaaaaaaacttttattttctttcctcagttgtgaccttctaaaaaattaaagacagattctgtttatggttataaacttacgatatataattttatttgtaaattgtaatacacaacaaacaatcttatttgcaatatgctgaaattatgattatttttttgtatctacagtttttttagttaaacaattgtttgaaaagcataccttagcctaatataaaaccattaaacctttgaaagatcaaatggctttcactttcatatgaatatcttatttctactatgtcaaataattgagtatttctttttccttttgtttttacttgcgtgagcaaaatgtaaaggcttccaaagtccaatttgtttttgtttactcgtaatatttgtcaacgtttctactcgtattttatttaatgaaattcaagtgactaatatatacatatgccactggaaaatttgcaatttgtttttatgcttttggaggctgcgttgatacctaacctacttattatagaaaatagacaatgggaagaatcaaatgacatgatcttttatttaaaaacatatgtagatcgtttgaatcaggctgcatgcattgctacctaagtacctaacctacttgcgttgttattgttgttgtgtacttgtgttgttttttatttttcttgttggattcctttgaagcactattttaaatttgtaatatacattattattggataacgatttttggtatttaaaacaatctatcatagatttaagtgaactagattgttttaaataccaaaaatcgttatccaataataatgcatattaattagattgttttatgataatttctcaaataattttttatattaataagatttgaaattttgacaaaaaaataaatagatttgaataacttgattaaattaaaaatgataaatagaagataatattgtaaatattaacatatgtaaattaggagaatggatttaatacattaagtgttacctaaaaatttaatccattctcctaatttacatatgaaatatttatattcttagcataaaaaaaaagtccgactatatttcaatttagatcattgtttgagaaaaatttcactttttaggtaaatgaccaatcacgttacaacatatcagtatcaaatccacataagacatccatgtgacacattgcatatgcaaagagaaaacgagacaccaaaattttgtacaaacaataatcagtcaatccgaggctactatattaaaaaattcaaaaaaaaaattgtgatttaatgatattttgaaagtttaagttttttcgtcctaaatttgaaaactgacacatttttgatatttttacctttgatacatccgtagaaaaaatatttacctactaaatattttcttatatgtagcttataagtataattatgtgaataacactaactaaaatagatattagtttatttaagtttgaaaaaaatgtgacggttagcttctcatagcttgagttttgtggaaactttactttattatattaaatatcatcatatcacataatatgatagtaacaaactaattagtaatgtaccatcaacttttctagtagtaagtactactttgaggaatcttgcactctgatgatatcaggaatatgatcataaacttcagagcatcaactcctagaagaaaccgagtgaggtggtccaaatcaacaaacctgaacacacaagaaccttgaataagactttccaaataaaagtagaaaaaaaaaacagagaattagaaattcaaaaaccatactcttattttctgggacaagggtttttttatacccgaacaatttacaaagtgtattttcataccaaaacaaatttgaaggatgaattcatacccaaactccaaaaacatttgaattttatagctaaactttacatttagtgcttaattcaaaatcgtaaataacgagtattagtcaactgttacagttgctgagtcaaatgacatgtatttgatgttatacttcaaaacgacatcgtgttaaatgttagaattaaagttatacaaaattttgtaaaaatcagatattgaagccacgacgtttcactcatttaggcagcttattaacatttgatcgacaactatcatgagttcgagacctaatttttttgtacaactctataaaattttaattctaacacttaaaacgatgttgttataaactcttgaccaaacctagatatgaaaatacgtttttcccctgatttgatgttagccccacgaaactcatgacccgaacctagatagtttgcttgtcttcaagcaaacgctgtccagatcaaccaagtgaagggacttattttcttttttccaatgattcggaattcaagacccactacactattgggtcttcatataataaaaggcccaataaaagtctccagaggaaacaaaactaatcgaaacgacgaaacagttaaggtaacaaagtaaacaaacacgattcccaaaacacgaagaaagataaagcaaagaaaaaaaaagaaag

SEQ ID NO: 12336 - DNA, 3000 bp, Unknown
  misc_feature (1)..( 3000): cDNA_ID_2708758_gDNA_ID_2214544_Annot_ID_134530 3000 nt of promoter + ATG
ctcgttccttctttcactcgttctcatatccgatttacttactccgccgccggtgcttcttctcctaatcgagctattcactgcatggcttccgattcccctcaatccggagatggttccgtctcttctcctcctaatgtcgcggctgttccctcttcttcttcttcttcgtccgcttcttccgccattgatttcctctctctctgtactcgtctcaaggtaagctttgattgatccgccttacattttcgctaagatccggtggttttgtgtgattatacaacgcaatgttggttagatgatgcgattgttcttgttgatggattgtgtggaaatctgatttcgttagggaaatgaaacgatttcaagctatgtagttacttttgatgttcttgttgatggattgtattggaatctgtaaattcgtttgtgcaatgaaacgatttcaagctttgttgttactgtgtagatgtgaagtttttatgtgaatctggttagttttcgcggtggtttctgtcaatgaactatttctactcgtaacttttgtctatggaacctagaatttgatacagatgttggtttgaaacctctaacgcattgtttagatttatgtggatgttttttaccaatgtaagattggatctgtgttaagaatggagattattctggtgatggattgtagaaactcaatgcattgtaactgtttatataagatcatttgttttttagatttgtgtggatgtttgttatcaatgttatgatggatctgtgtggagatagcttgaaacgtttcgtgcttaatggattgtattggaatgtatagtggattgttacggaaatgaaacattgtcaagcttggctgcatctgttgacggattgtagaattcgtttaggggaatgaaatgatttcaagtttatgtgattaatggtctgtgattactaaatccttgaagatgtgaagtttgtcatgtgttttacttttttgtgaatcaagtgagtttttgtttgctgatttaacgatagagtttgtgtgctgtatcgtttggtaaaccatctttttatatcaaatagacaactccaagagctggatggattaagagagatgtgaaagatccagaatctatagcggatcacatgtatcggatgggtcttatggctctaatttcttcagatatccccggtgttaacagagacaagtaagtttcttgcttgcttctctcttttcaagtttcaactgctgtgaaaaaactcttcttatatacatacttttctttctatagatgcatgaaaatggcgattgttcatgatattgcagaaggttagttctttcacttttagagatttttaatcatcgattttcttaatcacgagttatttagtcgagttgttgttgagcagccattgtaggagacattacaccttcttgtgggatatctaaagaagagaaaaaccgaagagaaagcgaagcacttgagcacatgtgcaaactcttgggtggaggcgaaagaggtctgtttctcttctattgttgaaataccttatgtatcttcgttcgaccttcttatgctcatttgtataacacttatcatcacttctaaaaatgtatatatcgtaattgcagcaaaagaaatcgctgagctttggagagaatacgaagagaactcttcacctgaagccaaagttgttaaagatttcgataaagttgagctgatactacaagctttggaatatgaacaaggtaatgaatgaccaataaaagaaactctctttcgataagagatttagcagaaactaatactcatattgttttttgtttgctatttaacgcagatcaagggaaagatctagaagagtttttccaatcaacagcaggtaatttttgttgtatgtcattatactctaaatagataatctgaatatggttgaaggctttaagcttgttactgtttgattcagggaagttccagactaatataggcaaggcttgggcgtcggagattgtttcaagaagacgaaagcaacattagttctcacttgactctttctttttgtttcttaacgtctagctcagtggagttcaaatactcgtacgtttcaaatttaatcatcttaaggtttttctaataatcttcgtagctgtctttacttgttttgttactatcactaataaaagatagctagctagtgactatcttatagatagctaatgaagatcaaaaaacttaatcaagctcttaaattttattttaagaaagtatcattggttcctcaatataaattttcggatcgttaatagaggtcaaatgatttttctttgttttgttttgtttcaagattttgcacgggttaaaagttgaataagaataacgaatagagtatagacacttcataaagtgtagtttccctgccacacttagatctcctactaacctcacttagattagatttctctctagtctaaaagtctttaaaccttttaccattgggtttcacaaaattaacattagtagttatgtcttttctttttaaaaacatattttagaataaaccatatctccaaccgaaaactccaaactctctccgacgcttatccgcatagttcttttgtcgattttgagcttcttttatcttaacctttaagattttgattttttccgatgttcatgttattaaccacaagtctacaattaaattattatatttttttaaaaatgattcttgcgcgagaagctacttagtggactcggaaggagaagggaaattggtagaggttttaatttgcaaaacttataataatataatagtagtagtcgtaacaaatggtttagctgattattcaacatggaacttttcaaagaatgtttcagttttagttgaacagacaatttttacccttgtcgtaacaagacaaataacgatttttccgactctcttcattcgatctctctccctctccctctctcgatcggaaaagtttgaatctccggcgatcttctcaag

SEQ ID NO: 12337 - DNA, 3000 bp, Unknown
  misc_feature (1)..( 3000): cDNA_ID_2708746_gDNA_ID_2214544_Annot_ID_185351 3000 nt of promoter + ATG
ttgcacccggacgcatcccaagatttctctctgcctcagaatggatttcattgattttcttcgctttcacctgccattgaataagtacaacaacacgtaagcacggataaagaactaaagactgttattaaaagatttgagatggaatgataaaatcttacctcctcacgccttggtacccatttattagctcgaagatcaacaacgttttggaccataaatctgagacgcagctctagctgagggtgccttgctagctccttcaaccgaccaaagtacgtgtcattaatacctcgagatcgtgggctgtcatcaagttgcttcccaatggttataaaaaattggcagagagcttcaacatctccctctgctgggcaagctttagtatcgtctcctaaaagctcctgaacaatatgatgaactatcttctcaggcaccatcttttgcttgagaagttcaccaatcagacggatatttccaagtgtccggagctttgccattttctccttatccattctttccatttcttggtctggattagtcatctgtctgatctcttccttcaatttgccagcaccttcaaatgcctcttggcaattattcaaaagcactcttttaaaggttatttctttcccaccgggttcctcagagggaaacgaaggtagctgtccgttaatatcaaaacacagaagagcatacatctcgcagaatgtgggctgcagtatagcattctcaaaaattagctgtatcacttcctgcaatcaaaggtaagagcaaatcaataccatgaaagagagaactacaacaatagagatcaggaattgaaacaaacctttaggatatctgcggaagtgatgccagcgtcaatcaattgacctttaagaagctcgtacttctccggagtaagcttgtttagaatactgcataaaattgtaaagaatcagtcagaatatacatcacatcaaccttcaaacacaaaagctgaaaagaatagtattagttgttgacaataccctttcacgctcttaacgactcgatctttatctgaaagagctcctcttttagctgaccacggaacctccgctttaatcagcacaggggtaggaccagactgtttcacaagatgatcatgttagcaagaagagaaaactagtaatgatatgccaacacataacaagtgacgaaaacttaccccttgccatgtacttttggcttcacgagggtcgtcccttaaccattctttaccagaggttggaatctgagaacgactatgccagtcacggttatcagtctcggtatgacgatgctgagtatgatttgttatctaataagaccaaaaccaagaatgaaagtttaaaagacagattccaaaacaggaggattacacacacacacacagacacacacttactttactctcggctgcatgattcccccaactctgctcttcgccaaaaagctcaactgcgatttccttacagcgtctaagaatttcatcagagacttgaacagactgcgatcaagaaaacacaaaggtgaatgatttggttcacaaagtcaaaaacagaatcagagaattaagttaaatacctctctgtgctgaagtatctcttctcgggaaaacctcacacgttcaccagaattttctctctacaaaaacataaaatgtcaagagcttaggattcaattacataacataaagtatcaatctttgtccatattcaaattcaacaaccctaaaaattcaaactttgtacaaaattcgattcaaaatcatggaaacgaatccaatcctcgtttaaactcgaattgcgaaaccaaattgaagagaaacagaggatttttcaatgtatttaccttgacgggaaaaggggtttcttcggagccgccattggtaagatcaaaagaggaagaggagctaaagcgagggacgaaaagcctgcttttgccgccgccaccgccgggtctcaaactcaaaaccgatggttcaccttgttgttgcattactcgattctcttgttttttcgcaattagaaggattcaataaaaaaaagttttgcagatagatagaggtatatagtgtatatatatgtgtctgtattgacggtggagaagataaaatcacttcgattccctttttttttttggctgaagctgtgttctgtggtttgccctaatttccttttcttcttctcacgtgtaaatgttattgttaattacgaaaatattctgtatatcaaaataattttatttattgaaaaagaattgatggaaaaatcttacgaaataaagacttaatattgtttttaatgcatcattatcaaaatacaagtctactttcacagaattaattaccaaagtatcctctgtctataatctccaacacaaaataattaatttttgggaaaaataattgatggaaaatcttatgaaatgaagacataattattttgtatttattgcatcactataaaaataaaaatctttgttgcatcattaaaagtgttgttggcatggctcttgcatgagttaagttagttaattcaaagattacctctatctataagttatttatttttgtttcctaaaattatgaatttttaagtaaatttgacaaatatacatatgtataataataaatatagttggtttattagattataatttcttaaaaaataaaaaaataactttatatgcatagattcctttgcaaattataactttattttactccctttaaaattaggaacatgatattcctcaaatttctcccatgttcaatgtgattatgctggttttagtttagatgttaaaataaaaatcctaaaaactaaaaagtaattgggccctttgttttaaagcccataagcccattaataaaaacattgacgtttagcttccaaacattggaaacgacgtagtttcattctccgttgcgttttattcttctggataagagcttcgtgatggtttgaaacctctgagtgaagaagaagcgcc

SEQ ID NO: 12338 - DNA, 3000 bp, Unknown
  misc_feature (1)..( 3000): cDNA_ID_2708721_gDNA_ID_2214544_Annot_ID_185350 3000 nt of promoter + ATG
gtagaaaagtaaatatacaaaactttactttagctctgaaaatcctaccacaagattttaaactcaagaatcgatctgtagaggctctggctcaggctcaggctcaggctcaggctcaggttcaggctcaggctcaggctcaggctcaggctcagctgttatttctgcagctgaagctgaagcttcgttttccgctgtttttttcttctttcttgtgggtggttcttgtggtttccgaatcatttctttgtttgggaccaagataatgaacatatttctgtccctgaagtttttgctctcttcagttgcaagctacagatccgggacaagtttcagtgatccattcatttcacagtcagtacacattgaaatctgatacatactttctatatataggaaagggtggagaacgaacttattacctcccctatttcggtttggaaacgtctgaggagttcaatagcgatatttctgaactcgttttctcgtcctttcatgctcacaatcaccttaacctgtgtacattacaagtagtaaacaaaaaattacattcagacgggacagaactctaacagctcgtgaagaatatgggaacaaccttgtcaccatcttgcaagaacttttgggcagcccttagacgaacggaataatcatgctgatcaatattataactgtcagacaaaaaaaaagcagtaacctttgagaggattcagttctaaagaagtcatttgcaacatcacagacaaacaaaaaaaacgaaagccgtaccccattttaagctcctttaaatccatgcgagttgctaatatgatataacacaaaaaaaaaatacataagctgataagcatatcatctccaactctaagactaagaggggcagaaacagtcaatacttttcttttgctgatcttttttcctcttttgctgttcgtatctgtatttactgataaacgcaaaagaaagaaagcatcattactggtaattacggcacagcttggcatatatcttcaatacatatttagatactcacctgtagtccatcattttaacaaccggaggatctgcatcaggcgatagtataacctgaaaaccaacacaatcaatcatttatagttggttggtttagttacactagagactcggtgtagctaaattaatttatgaagttctgatttgcttagtaaagagaattttatatataacaatgtacattctcttcttcttgaagaagagaataacataaatcattcacaactcttatccaaattctgttaatctaatacggtatcagagcatatcttctaatatttgctttgattctagttcaatcttccatctattagctcaatttcactgattcgagttctgactcatatcatacaaaaaccattgcatatatcaaatagctaatgtccacaagtaagagcatttcaatggaaacacataccagatcaagttcagcatcatcagccattcgaacggcttcgtctttagacactaaaccaagctatagagagcaaaacaaactggaaatttatgagtcctattatgcagaatcaaagctacaattcgaagaatttgagtcacatttaccatgttttgttgcccatcgataagcctaacagtagctgacctactcaaacatagacatcatcatcaacaaatcgaatcagaaagaaattttcaattcacgattaggcttaagaatcctcacctaattgaggagatatcaagagcttcatcaatttcagcttctttcggcctacctcttctattgtctccagagaatcgataacctccaccaccaccgccgaagcggcaagtgacggcgaaagcacggcgaggagaaggagtgagattagtgaaagacagttcggttttggagagacgaagactacagagtttggaatcaacagagaagagtgaatgtgatgatactgttttggttattccggtgaagacggcgttgaatccaacggtgctgctggtaatcccagccatggcgcttcttcttcactcagaggtttcaaaccatcacgaagctcttatccagaagaataaaacgcaacggagaatgaaactacgtcgtttccaatgtttggaagctaaacgtcaatgtttttattaatgggcttatgggctttaaaacaaagggcccaattactttttagtttttaggatttttattttaacatctaaactaaaaccagcataatcacattgaacatgggagaaatttgaggaatatcatgttcctaattttaaagggagtaaaataaagttataatttgcaaaggaatctatgcatataaagttatttttttattttttaagaaattataatctaataaaccaactatatttattattatacatatgtatatttgtcaaatttacttaaaaattcataattttaggaaacaaaaataaataacttatagatagaggtaatctttgaattaactaacttaactcatgcaagagccatgccaacaacacttttaatgatgcaacaaagatttttatttttatagtgatgcaataaatacaaaataattatgtcttcatttcataagattttccatcaattatttttcccaaaaattaattattttgtgttggagattatagacagaggatactttggtaattaattctgtgaaagtagacttgtattttgataatgatgcattaaaaacaatattaagtctttatttcgtaagatttttccatcaattctttttcaataaataaaattattttgatatacagaatattttcgtaattaacaataacatttacacgtgagaagaagaaaaggaaattagggcaaaccacagaacacagcttcagccaaaaaaaaaaagggaatcgaagtgattttatcttctccaccgtcaatacagacacatatatatacactatatacctctatctatctgcaaaacttttttttattgaatccttctaattgcgaaaaaacaagagaatcgagtaatg

SEQ ID NO: 12339 - DNA, 3000 bp, Unknown
  misc_feature (1)..( 3000): cDNA_ID_3024701_gDNA_ID_2214544_Annot_ID_185342 3000 nt of promoter + ATG
aaaaagatgagaggtagggaaaagaagacacgtgtcaattgtctaggtggcaaatgtcagattttggtgaaatgagctttgaggagaaccttaatttattgtattagatttactgagtacacttcaagtttaattgttctacatgtcaaaaattattttgtattgaaaacctgatttagttccaaaatacaagaatttactacaaagatatgatatatagatcaaccatataatcttcatttgctttcgaattaagaaaaagagtatattttttttttaataaaaagaagaatataatccaactgataatgaaactgacaattacttggctaattgggaagattacattacatttctacaagaccaaatttgaccccaaatctggttcggatcctcccaacctctttattaaaccttatataaaacccatttaagctccaaaccataacggccaaactttttcacgtctaaagagaaaaagaattctaggcaagtggttgcaagttttgtttgagtagagaaaaaaatggtgtctttgattagcattgtgtccgtagtgtttcttttatttacaacattctaccactttggtgaggctagaatcattaatgtgggaggatcattagacgcatggaaggttccagaatctcccaaccactctctcaaccattgggctgagtccgtccggttccaagtcggagacgctctttgttcgtatctaattctttcttctaaattatacttttgacgttttttaattggttttgaatattttgatctacatgctagctagttttatcaagtgacattattaccatggttttccacaaaattccattatgattaaatgggtcttaatcttttagcatgttaataaaatttaacataggttgacattttaaaaaaaaaattgatgctaccatagtttcgtcatgatggtcaagatccggatgttagttattgttggatacacttttagtctgcaaaggcttctggtttgaatatcagaagtcttgagttgggtttggttatttgatatgtcaataatccaaatcatttagatatattcaaggaacttaaaacacatttaagatatataattattttttcatatatacgaatgcataagatagtaagctaaggattgtttttgcatgtgacagtgtttaaatacgattcaaagatcgattcggtgttacaagtaacaaaagaaaactacgaaaaatgcaacacacagaagcctttggaagaacacaaagacggatacacaacagtgaaactcgacgtctcagggccttactacttcataagtggagctccgagtggtaactgtgctaaaggtgagaaagtgactgtcgtggttcagtcacctaaccacccaaagccaggaccagccgctgttacgcccactcttcctccaaagccatctactactccggctgctccagccccagctccacccactccttctccaaagtcatctacttctacgatggctccggcgccagctccggccaagagcagtgctgttgggttggttgctggaaatggcatcttttgggcctcgactcttgttgctgtcattgggcttgctttcgcttaaggcttttaacaaaagttcttgaagtttaaatttcatgttatgcatccaaaatctatgttttgcagaataattattatctgaatttacaatatgtcatatctgacattacttataatttaatttacaattcttttgtttctgtcaacaatttattctacaaatataaaaaaaaattagtttcctagcaatgtcaaatcttcttggtacctaaatattttatattgatgtctcattatttattcaattgggtgatgaatgttttgatttcaaggtgaaatccttcacttgtcttgactcttgcagaatacattaatcggagtacatttattgattcacgtagctttcttcattttcagaattcggattatatctacagattacagctcatgtaggttagagttattggaataaaacgaatgttaaatataataagagtatcagagcacctccagtggagagagcctctccaaggactctctccatttttttatgattaaatttccaaaaaattaacaagagagctttgtgttttactttttgttaaagttttcttaaaagagttctctgaaaaaaaaatgaatgatcttgttttcaataacttgtgtcttctccttcatcctcatcgcccttgtttccatcctcgactttactttcaccatcttcgatttcttcaatttccaaaaccaatacgagatggaatgctcagctccatgtccttggaccttgatcatctccattgtatcaaaaccgactattacttatgtaacttatcacatctttatctcttttcaaatgaatagagaaaacaacaatagcaactgtaaagactacaccatgcagcagaatcatttaaactaaagaaacacatagacatatacacaaggatatatatatatatatatataaagcagtggcaccaacctacatgactactattgaagcatgcttatgtacgctttagattcagaatattggaagattagccaaaaaaaaagaaaaagcaagagtaataagaaagcagctttagctaccgttccagaagaaagctaggcttaaaatgacttaatgcatccagtttttaatgaatgatctacaaaggttcatgatgtaataagataatatacctgaaaagacaacataccacataattattatccgaggcaacaacagtctgcattatgtcttcattttcctttacttgaaagtatatatctgcagagcataagcgtaattctattaaattattcacagttataagccaactgaataaatacaaagcaaaaaacaaaaactaagaattctggccaaagaatattctcatgaactccaataccaagtaaacctgagagcatctgggtaccttttttgttcacctgaacaagacactacgggaaatg

SEQ ID NO: 12340 - DNA, 3000 bp, Unknown
  misc_feature (1)..( 3000): cDNA_ID_2708735_gDNA_ID_2214544_Annot_ID_185336 3000 nt of promoter + ATG
aatcaggtacatatatatactacattcatgtaactaataatgtaattgttctggctatgtatgtgattgtaggagctgcacaaatgtatgagaacggtgtgttagcgtacgtagatgttgaatttgtagcggatgttcacattcgagcattcgaggatacttcggcttgtggtagatacttttgcttcaaccaaattgtgaacacggaagaagaagctctcaagcttgtacaaactctatctcctttaatacctatgccaccaaggtaattattattactattattgttattatcattactactatataatttattattttatagttataatatatgatttaggcatgagaaagaaatgcaaggaagtgaagtttatgaagagagattgagaaacaagaaactaaacaagctggtggaagctggatttgcttgttaattacatgaagagagatgttataaattaaagggcaagaaaataacaaagaaattttatagtaagagttgtttgtttacttatttttttaattattgtactctcaattcagtattttatatatctatattttattttattttgaaatgaaaggaaaatatgtgttactcatagaaaagtgagtattttttttttggttttaatgtgagaaaagtgagtatttattacttgtatgtcattatttatggaatatatgatgaggctaggtagcaacaaataataagaaaatgagaaaagcattatacagttttgtactaaactacacatttgcaagctaagaaggaaataaattttgacatgtgcttgatgtaatttatgagttgtcaactttaaagtatatagctaactgttgatgaatgatttatcattaacatttttaaaaaaaattagatacaatttgaaacgtgtaataaatgatgagcatatatccatacattttgtttgtaatgggtttctgatttatccacacttcagtttctgcaagctgtgatgttagacatgataaaatcacacaaacaattcagagacatacaaaatcaggattgtgaagcaggatttaaagtatatagcttagttttttttgtatttttttttaacagcaaaatcaatattcacgttttagacatcagaaaatgaagcaggatttgcaagtttgagagttaaaagtcagtcattaacaaaatcaaaatctcaaatgcatccacgatttattaatacaacataaataatgcaatacgatccaaaagaaactacaaaaataaaatttaaggttcggtcttctcaaaaaagatcaaggttttgtcttcttggtatgtccatcatgaagtttcttctatgggacgttctttaaatttgcatgatatagatcaagatgggttgttgccatatgcgaggatgatgttgaattgcctctgctggaccaacgtttcaaggacactaaaattttaatgtctttggcaggaccggctataaaattttggggtcaaaactcaaacaaaataatttaagattattaaaaaaaaaagtggagccaattatcgtaaaataaaagtattattaacagtatattgaaattttaaagtcttgaaccacacttttgatcatatgagataatatgttttggtggtgttttaagagcaaaactaaaggagatgggaaactcgatatttggtcgatgtgggatgagtgtagacaacttcaaggctgtgaagatcccaacaccggctcttactccatttcttttcaaaactagtcgatacattctcatacacaacttattattaataggtttcagtgttttacatcaaccaattttatattaatcgtttatttatatttattttgttgtcgatgaatcggtattagaaattgagagcttgtggcatggtatatctgtacattcaagtattacagtggagaaatttttattttggactgatatattgttgttatcccgagctaaatttgtaaataggaaacacaaattgaaacttataaagtaaatcgcgagaaaaatcaattgattattagagaaatactaaacaatctgaaatgcaaatcgttcgctcaaagtaagctcacgattacacaacgatcaacatagactgctattgctacatcaccagagtatttctttgtctctctctcaacaatctagaaaagcataaagcttatgagatgtaaaggtagaaaaatttagagaaatatttatcatttttcaattaaaaatataataagagaaaaatgataatgcattatgtttaaataatatatatatataaagaaaaaaatttaaccttgtgaaatttataattttgttagtctaaatatagtatatgtagataaaatataaaattagtgagtataatagatgtgtcaccacttaccacttattacctaaattaaattcattataatgcatattggtggcagaaaaattgtatatgtaatgctgaaaaacaaaatggtatatgtaatatcattcgatagaaacaattcgaacaattggccgcattagaactacaatgacataaaaatgtcttcgtcattttaatttttttcttatcatttttgatgttgtggtgaaattttagtgtaacttttaaaatttatcgattggtgaaatcaaaaatatttgatcaattggttagacgctaaatatttgatcaattggttagaccacaacaaaaatatttaattaattggttagacgattgtaagatattacatcagattaatagcgtctagagaatacacttcgacgaaaaaggaaaatcacttaaaaaaaaaaaaaaaaatacacttcgacgaaacatgtcaatagtcatatgagttgggccttatagtttattgggcctgagtagattattgggcttaaaggagtagtaaaaaacaagaagacgctaacactagacttccaaaaatcaaaactttagggtttcagagcaaactctgtcttcttcaagccgagagcgaaaaccctaagctcaattccgattttgcaact

SEQ ID NO: 12341 - DNA, 3000 bp, Unknown
  misc_feature (1)..( 3000): cDNA_ID_2708742_gDNA_ID_2214544_Annot_ID_185333 3000 nt of promoter + ATG
taccgtgatataatcatatgatctgatgatttggttgattgcaacatttcttttattaccatttttcaggcgtgtcttatagcagacatggtgcaatattttgttgacgccaaacttgagtttgatgcctctaacatctacaatgatgtcaatcgtgctattcaacatgtccatagaagtggattggttcatagaggaattcttgctgatcccaacagatatttgctaaaaaatgcaagtgaaagtccttcaaattatcttcacttgttatattacctttgattggtatattactgaaacagcaatttgcttctcagggtcagcttctacgtttcctgagaatgctaaaagataaaggaaagaagctttttttgctgaccaactctccgtataattttgttgatggcggaatgcgctttctaatggaggtaattcacattattgaatagatctaaaactcttttattttctcgttggaatatcactagggacaatcatttcaacactttttttattttaattagttgtccataatcttcttacggccagttccatatttttttttttttaagtggttcatgacctttattgggttgtgcttattgttcgttaggaatcttttggcttcggagattcctggcgagaactctttgatgttgtgattgctaaagcaaataaaccagaattttacacatctgagcaccctttccggttagttgtcattacgatataaccagaaacactatgttcttgtgtaaaacataatattttcttgtggaattgatcgcttaactcttttattgctattaatccttgtagttgttatgattcggagagggataatttggcatttacaaaagtggatgcatttgacccaaagaaagtttattatcatggttgtcttaaatccttccttgaaatcacaaagtggcatggccctgaggtactctttacaacaagctgatatattccattctgtaacttcatgcttttgaatgcatttaaagacagactaccacatgttttattcataggtgatttatttcggagatcacttatttagtgatctaagagggccttcaaaagctggttggcgaactgctgccataattcatgagctcgaggttagtttaccatacttgatgtctatatagctttttagttgattgtatcctcaaaagtgtttgtacatcatttaaagcccaaccttgtacactgagttctctttatgatgttatttttttggttcagcgagagatacagatacaaaatgatgatagctaccggtttgagcaggtatagtcacaccatcctcttttacttcccaagaatggctttttgcttatacgattttaacattcatgaccgtgatcgtagacatatagtagtttgagatactctaaataaagcaaagacgtatgtgttactaagtttgataagacaatttattgtgcttatattcaggccaagttccatattatccaagagttactcggtagatttcacgcgactgtatcaaacaatcagagaagtgaagcatgccaatcacttttggatgagctgaacaatgcgaggcagagagcaagagacacgatgaaacaaatgttcaacagatcgtttggagctacatttgtcacagacactggtcaagaatcagcattctcttatcacatccaccaatacgcagacgtttataccagtaaacctgagaactttctgttataccgacctgaagcctggcttcacgttccttacgatatcaagatcatgccacatcatgtcaaggtatataaacctgtgaccttaaaagagccggacattttgagttttattgattgatttgacttttgaattttggaattaaggagcttaacgaaaactcttttctacttttcttttcaggttgcttcaacccttttcaaaacctgagatagctttcattcccctaagaactgaacagatgatttcgctagacgagaaacttttcttgtatcgatgacgaatcagacgacaagaaggcttgcaattcaatctcagattcttgctgctgctgatgattcttttgcataacttaaagtggctaacacttgaaaacaaaggatgtaacaattagagattttttgttggttttagttagggattatggtgctactttgaagtttgatttctaaaaacatgaaatatctttgtagattatggtgcaagtttaataaaggcttaaaatgttttaagttgagccgtttattcataagttgcgaattcaattatgaaaaaaaaaaaaaaaaaaaaaacactacaattggagcaaagaagtagatgtatagggaatctagagcattagaatagtttagtcccaataagtaaaaaaattgctagtctcataaatattttacttataatataatatctcttaaaacggataaaatctcaatcccaaataataaatttaccccttcaacattacatgccaatttgaaaactaattaagagatttgtttttattataggtaactcaagatcttaatgatcttcttatagcccttataggaaggtccggatatttcattccaattgacatacaaattttcttcagtcaatttacctaatttaagatctataacttcagaagttggattattttctactaaaacgggaattgtttgtcttaacagaaataaataacaagattggtacataattgcaccttttttagctctacttatttttggtaaatcaattcaaggcttagatttagataaagtttaagcatgtttttctctattttgttcttctataaattactctgttttaagccaaataaaaaaacaaacacaaataccaaaaacaagtcataagaatcaaatggagttctctatcaatccttcaactctaaaggtaacgttattttaaacaatgtcatcctcctaaacatgttttgaaagtgagtttaatttgtgagaacattcaaaatatggtttaattttttcttctattcaacag

SEQ ID NO: 12342 - DNA, 3000 bp, Unknown
  misc_feature (1)..( 3000): cDNA_ID_3024730_gDNA_ID_2214544_Annot_ID_185330 3000 nt of promoter + ATG
tttaccaacaatcaataattccccatcaaaacaaggttttattatatcttagactggttagtaaaccaatagcaactatgagaaataatacctttgggaccttaagtaacttcatgtgtgcttcgtctgctgtcttctgtcctttccttgagttgcatcttgaacatgcagctacctatgtttcatgaaaccaattgaagaaaacaatttaacccatcttcaatattcttggctacaacatatatgctacttcgatatcaatcacatactaggttttgccaagtccattctccacctcgagaaaccggcataacatgatcaatggtcaaattttctcgcgaagaacaatatctatatcccaaataattaaagttctgtcagcaacaatagtttgattccgcaaaaacagagagatatgattgcgagtagagatagaaaaccactcactgacaagtataatcgtctcgtagtaaaatatttttacggctaagtgagtttttcactcttcttcttttaacaacctgaagcaaatgtggaacctgaagcaagacaatgaagtaagcttcaaactggcaacaagagataaaaactggctaactaaactcatattctacatacccttaatacagctggtatgtagaacgaacccgtaggagaactaacagtctgatcataatactccaaaacgtcggcctagacaatgcacaaaacctgaattaaagatcattatacaaataagcaactatatacctactttttacataatacaaatcctgcgtttttgttgattgggaaatttcttgcataatcgtattagaaaacgtcattatgtcattatgcgtgttaccaatcagaccctaagtatcaacatgagttaaaagtcttttggcctgaccttatccatgtactcgaggcagattgcgcgcttccagcaaaccacattgaccggcctacagtgacacaacatgcttgaacttgaataaagagagaactaatgcttcaatcaactatataactacatatattcgtaacacaaacgaagaatttccatatatctcttttaatatatcctgttctaagatcaatgaatacattgtaactaaaaataataaactaaaatgtaataatacaaaaaaaattgttgacctgtatgaaatatcaagaaccaagcctctgaagcaagaaagatgatcatcagtctctaaaccatcatcgtctccatcaaaatcccactcatcgttgtcttcgtcaatatcaagatttttctcggtgttatcgagatccctaattttctttctcttataaggaaaagagtaagatgagaagattctagcacaaaactttagtcggctcatgcgtattggaaccaaaggagatccaccaccggccatgtaaaggctctgccgaaattggtctctcgaatctacaccaaaagataatccatcgttgcttgagagaagcttaagtctagcagagaaatgtgccatttgattgaaacgaaacgaagaagttagggtgatccaaagtcttggaaaattattaggaagagaaattgtttacacaatttggacttgagcagagccgttaaccacaaactgatttctatagaaaaaatatcatgctctataaaatgacgaatatggcctcttatctttctaccaagaaattagaaaaaaaaaaaaaaaaaatcatattcgacgctgccgacaaatcacaaattttcgcgctaagctaagtatcgatttttagtttaaaatttggaataattgttactcgttatataaatttggaatttaataaaatgaaattaaaaatatgtatagtttgatagatcccaaaaagtattcaaatttacataaaaatagaatataattttgatactttttgttaaattttttctattaatataaaaatttgaattgtttaatagaaatttcagatatgttaattttcaatgataaaaataatatttcagatatgtgaagaaaaaaaattcagcatttcattacatttatataaaacacacaaagaatttttgtgtgtttgaaacagtacaaactatagttacaagttacaacgtatagcacctcatgaagaggcaaaagccaaaaagttgcagaacctgtgaaatagtgtttgatatttccatgtatgatgtattgtcttaagacctcatagtttcgaggttatgcggcttaaagttgcttctatagatccgtgaggttcattggtttggcaggtacacatcatctttaaactgcaaatgcaattcattggaaacgattcatatcctaaaattattggcttttatgcaagtttttttttgttgtctgattttaagtttataactatgtactactgctgctacttttctacttatcattttcgtttacgtttcgtggtttcatcataaagacaacatcaaatagaggttcttaccttcaccattgaagggttttgcttggttgaaagtgtatatttggcagttttaggtgaatcgatgatacatcaacgaacctgatcatgttaataagaacctttatcatggtaagaatcacataatcacacaaacagcaaaataaatatatactgatatgatgataccttttcagtacggcgcttcccatgaggaagagagtgcgttggacagaagagctgtacacaccagtttctggtggaccaaagaaagtatccattaggactttctttacgtctatgaacttctcgctgaaatagagtccctttgttgggatgcttgcaactgactcaaacgagtatgtcatcgtgaacgtgtatgtcggttctaagaatcaattacagataagaatgtagcattactaattaactcatacctacaagatattcgacagatacgttattgtctgccttaattaaaggcttaccttaaaggtaaaacaaagttttgggaatcattaaatagttgtgattagctcgtgtttctaaggcttctcgtgttttttttttgttttttttgaggtt

SEQ ID NO: 12343 - DNA, 3000 bp, Unknown
  misc_feature (1)..( 3000): cDNA_ID_3024738_gDNA_ID_2214544_Annot_ID_185328 3000 nt of promoter + ATG
attaaaagttaacggtgacttaaacccgttaactaaattggtcccttagttgatttagcgatatgtcttatttagcaaagtcaatgaaaattaacaatttaattggaaaattgattaaagttggtaaattaattaaccacaagaaaagttcacactttcgattttttttttctttaaagttttatgtgtatgtttttttttcatacattgacatcaaatattctcacaagaacatgtcgatcctcgattcctagtctgtgcagttgcgtcagagtccaagttcacttgcgaccagccgttccgcagccgtggaactagttaacgacaagatttacatttttgggggagtgtcaaatgtgtgaagagggatacgaagagatccaagcgccagtctctgaactatagaaaaaaggttttaatgcaaacttggcaagtcgctaatacatgcatcaccaccatgttagcttttagtgcagtatttctgctggaatgacgcaatggctggatacaatggcaagctgtcgtttttgtggcatgaaacgaacaaaatgcagatttacttttcaaacgaataagtctagatctcgaaccaccctcatatatatctaactggtacgatactctaataaaatcatagtaagtgtaaataaaatatttataatgtttaattaggttaagaaataagtctctaaatatgtacagtccaagctcaaacctttgaacatcatcccttatatgtaaaggatatgattatctagatggtcattgatatttcatataagattttagtgcaatatgtatatacaaaataggtctgataatattttacaaacatattattgtacagattcaatcgagttttgctctggcaatcagctccaacgccatagcaagacaaattggtaagagtgttactggtaatgaatatctacaatgaagtaaagagaaaatgtctaacaaaaacattgaaatataaaccatttctggtccttggtggactggtgatgttggtcgtggtggagcaaacataagtaactctcagtttagtctcctcaactagatgccccgattctttgttaaactgaatatatagttgatctttagaggaaaatgaaacaaatgctttaaggaatcaaaaaccaaagtgtgaattattcatcaaatcaacaatgtgaatgatcagtgccgtctcaagagtaacttctttggctgtgactgcaggactagcttttactctttgaatcataaacttttcattgctctgcatatcagatgggccgggcttccttttgagcttgcatggttactagataaacaccaaacaaagattcatcaaattcctagtccaagaacaagtttggcagttgaagggaaaaaaaaagtttccacaagaaaaagatttgagaacggactttacaagtcgactttggaagaataagtccataattaggcctaacgcaatagtttttcggatttgtcgtcataacctcaaaaaaaacaaaaaaaaaacacgagaagccttagaaacacgagctaatcacaactatttaatgattcccaaaactttgttttacctttaaggtaagcctttaattaaggcagacaataacgtatctgtcgaatatcttgtaggtatgagttaattagtaatgctacattcttatctgtaattgattcttagaaccgacatacacgttcacgatgacatactcgtttgagtcagttgcaagcatcccaacaaagggactctatttcagcgagaagttcatagacgtaaagaaagtcctaatggatactttctttggtccaccagaaactggtgtgtacagctcttctgtccaacgcactctcttcctcatgggaagcgccgtactgaaaaggtatcatcatatcagtatatatttattttgctgtttgtgtgattatgtgattcttaccatgataaaggttcttattaacatgatcaggttcgttgatgtatcatcgattcacctaaaactgccaaatatacactttcaaccaagcaaaacccttcaatggtgaaggtaagaacctctatttgatgttgtctttatgatgaaaccacgaaacgtaaacgaaaatgataagtagaaaagtagcagcagtagtacatagttataaacttaaaatcagacaacaaaaaaaaacttgcataaaagccaataattttaggatatgaatcgtttccaatgaattgcatttgcagtttaaagatgatgtgtacctgccaaaccaatgaacctcacggatctatagaagcaactttaagccgcataacctcgaaactatgaggtcttaagacaatacatcatacatggaaatatcaaacactatttcacaggttctgcaactttttggcttttgcctcttcatgaggtgctatacgttgtaacttgtaactatagtttgtactgtttcaaacacacaaaaattctttgtgtgttttatataaatgtaatgaaatgctgaattttttttcttcacatatctgaaatattatttttatcattgaaaattaacatatctgaaatttctattaaacaattcaaatttttatattaatagaaaaaatttaacaaaaagtatcaaaattatattctatttttatgtaaatttgaatactttttgggatctatcaaactatacatatttttaatttcattttattaaattccaaatttatataacgagtaacaattattccaaattttaaactaaaaatcgatacttagcttagcgcgaaaatttgtgatttgtcggcagcgtcgaatatgattttttttttttttttttctaatttcttggtagaaagataagaggccatattcgtcattttatagagcatgatattttttctatagaaatcagtttgtggttaacggctctgctcaagtccaaattgtgtaaacaatttctcttcctaataattttccaagactttggatcaccctaacttcttcgtttcgtttcaatcaaatg

SEQ ID NO: 12344 - DNA, 3000 bp, Unknown; identical to SEQ ID NO: 12336
  misc_feature (1)..( 3000): cDNA_ID_3024743_gDNA_ID_2214544_Annot_ID_185326 3000 nt of promoter + ATG

SEQ ID NO: 12345 - DNA, 3000 bp, Unknown
  misc_feature (1)..( 3000): cDNA_ID_3024675_gDNA_ID_2214544_Annot_ID_185354 3000 nt of promoter + ATG
gtcccgtaaaaaaaaaccgcagtacaccgctaatttaaatatataatgaaaataaatgttttacgggcttgcaattgtattttagtttgtcaaacaatattttgttttaaatagttgtcgaaatctagttcaaattttggagaaataagtttagtgaattgataagaaatgtatttaggtgtgttttgcttattttaagggattgcaattgtattttggtctgtcaaatattttttgttttaaatagttaccgaaatctagttcaaattttggagaaatttgcatgatatatgagattgaaatatatttggaatgttttttatttgttaattaatttattgcaaaaaaaaaatcaataattaaaagccaatagcagccattgtaaataagttccaactccaggatttatttcacaaaatggaagcaaaaatgtatatatagattttgaacgggtcagcttcatcgttgctgatttttttatgggccgatcactattttagtggaccgtctttgcattgggctgattatctcttaatgggctgtcttcgtcttgaaacgagtcaaaaggaagggtgttaattccatctccaacatttcattcatctatcttacacacacacaaaaaaaaaactgtgatttgttcaattttttatattttaataggataaagatctatttaggagtttggaggttagttcctattgcatacttcatcttcggtaaaactaaaccgcctagaggtatcgatctctggcttgaagagagagttctcgaggaacattaatagtgtgtagaatggtttatgtaaactgagaatcaattgtgactacccttggttaaaccggaaccttcttctataaaaagaggttttcattgtaacaaacacttaaaagaataacagaataaacacaatcttaaatcatcgtttgtatcataaacgtcattaatctcaactaggtcgtctctataaatttgcatctatctgtcctatcgtatttcatatctcaaattagttttttcttggatttataattattttcaatatttaactataaatctatattattggattattattattattattagattttgtttgttattgttcaagaacatgatgatctgagcacgagtttagatatagaagctcttagaaaaaaataagctgagctgagctaacttatgaaatatccgaactcattatgagctgactaatatattgaagctaactcacagaaaaagctatcaagaaattttaatatgaaaaaactaaaaaaataaatgaaagtaatatttttttctgaacacaaaaatgaaagtatttactatatatatactcttgaccaaaaagagaaatgatatttttactcacgacattacgtcgattagagaaagtgtggcgtaaatcacgtgagatcaaaataggaaactcagcaagaaacctattattcacttatattgatatgacctgcagtgaggttacttatttgatttaaaaaaaaaactgatttatttggtgtgcataatgttttttgttgttcactgcgggccggtcgatgttttttaactaagaaaattaaattttaagttcttgctaaaacaattttgaattttatattttatttattttgttacagtatttaatattatataaatgtattttgagtggtaattttaggattttacatgcgctataccattccaaattaatatcgacccaaacttatctcacagtataaccccattatgtgaaattaaatatcactttattatttttcattccaattatacttttatttaaaacacatattcatgagtcacccatagtatgtttgcttatattgtgaccataatattcctttcgttgtgatccatgttgccaaaacagacatcaattaatgaaattgtgtgtatttcgtccatgtttactcaaaaaaggtcaatatctttaatgtgatcagcaatgtgacttacgaattccccgaattccaccaaaacacctgattgcatcacttttttaatgtttctgaagcttacaaatatcatgggcaaaactccagcaaagccataaatggttggagaagaaaatctagttacatctaagggatggtccgataggtacacaaatgcctctatcatagaacttatttcatctctttcactacttttaaataaacatctaagaacaccttctacgtcgaaaacctacaatgtggcttaaattattgtacgtaggcaatatatcttctgaatttgcattctccgaccaatctatcatctgctggaaatgaataacaagctccactgaaatctcattgaaattagaaaatactctatccactttcatcattgagctgccgcaaccttgactaaaagcaaagaaatcgttttccaaatctcgagcttaccatatattcgatacattcatgagataaagcttcattgaagccaacatccttcaagcctaatcaataaaggccacacaagttgtagttttgtcctccattgataaaacaaattttatgataataggaataaggtacaaaaatatattttttgatgcaatacatgttgccaaaacgtatatcaaccaacgaaatcttatgtactttgtccattaatcagtatgattcacaacttccttaaattccaccaaaatttcggactttggcctattcaaacccattaatgactgtttaaaagctttggcctaaagattaatgttaagatgttgtcatctttggtttccattgatttaatcatttctttctttattatgcacacttggccaagtgttatcattttgagcaaaaccaactataccggttttctcctaaccggaataaaccgaagtaaaccggatatcacatcatccgttcactctctttagctcttaaggcgaaaaaagcttatcttcttcatcatctctttcctcaatcggagtgagcgcaaaaaatcaaaaattcgccgagagcacaaaccctaatggcttctctctca

SEQ ID NO: 12346 - DNA, 3000 bp, Unknown; identical to SEQ ID NO: 12335
  misc_feature (1)..( 3000): cDNA_ID_3024747_gDNA_ID_2214544_Annot_ID_185325 3000 nt of promoter + ATG

SEQ ID NO: 12347 - DNA, 3000 bp, Unknown; identical to SEQ ID NO: 12343
  misc_feature (1)..( 3000): cDNA_ID_2708754_gDNA_ID_2214544_Annot_ID_134531 3000 nt of promoter + ATG

SEQ ID NO: 12348 - DNA, 3000 bp, Unknown; identical to SEQ ID NO: 12342
  misc_feature (1)..( 3000): cDNA_ID_2708750_gDNA_ID_2214544_Annot_ID_134532 3000 nt of promoter + ATG

SEQ ID NO: 12349 - DNA, 3000 bp, Unknown
  misc_feature (1)..( 3000): cDNA_ID_2711861_gDNA_ID_2214544_Annot_ID_134534 3000 nt of
gaaagacgattccgaattgcgagccaagcacaaaaggagaattttggcgttgcgtgagcgaaccaaactcctttatgccacgccctctgatttgatgaagttcggatatggttccatgtgtcttttgtggagaatctagccttaaagacgtcctctttccccctccagaggatggcatcctctagctctatgttccgatgctggtatttctgaagcagaatctcctcaaactcatttagaatctcaactcgatgtctcttccgtcttcttcgactccatgcttcagctagtgtcatatggcgagaaattcccatgtcaatcgctcctcgggctccagtcaggtttattaagggacctttctccgaccagttatcaaaccaaaaagatgtgttgactccattgttcacttctatcttgcagaaactttttgcaacttctctgtgttttagcaaccttctccaaatccaagaccctaacgttgagtgcgtaccaatggaccagaatgattctttcttgagtaggttcatcctagtccatttcacccacaaagaatcttgacaagatagcaaacgccaaatcagtttcagactactaaccttattcgcttctcgcaatgattgtaacccaaggcctccttccttctttggtttacaaatctcatcccaagagactttcgctttctttggatttagctccggtccagaccacaaaagagctgagctgattctattaatttcattaatacactctctgggcagcctaaaagcattcatccaaaagtttgtgatactccacaaaacagaatttattaaactcaaacgacctgcaaaagaaaggtaacgtgaagtccacattcctatccgccgacgaatttggtctattaagggagaataatctgatgttgtaagccgttttgtaactagaggtaggccaagatatcggaccgggagctttcctaccccaaaagagtacctacttgacatcaactgacgtgaatgatcggagacaccagccaaatacaatgttgtcttttccatgcaaatttttaaccctaattttgctgcaaactggttcagcaccttgactataccatcaaccgagcgaattttaccatcggtaagaatcatgagatcatctgcaaaacataaatgagttaatccaagagttttgcaccgggggtggtatccaaattctctcgcccctgctgccttatcaagcattctcgacaggacatccatacttataacaaacaaatatggagagagggagcatccttgtcgaagacctcgagcgcttcggaaatatcctgctaactccccattaacttgaatggagaaggatgccgtggacatacagagagagatccaatgaataaattccccggggaagttcattgcagccaaaacgtgagtaagaaaagaccattggagagaatcaaatgcttttgatatgtcaatcttcatagcgcatcgtgtagagatgctatctttgtggtagtcttttactagctctgttgctaataacacattttctatgagtaatctatctttaacaaaagctgattggttccccacaatgaacttaggaagaatcctcttgagtctgttcgccaaaatctttgaaatcgccttgtataagacattgcaacaggatatgggtctataatcctttatttcccgtgcttccttcttcttggggattagagctaagatagttgagtttacaccctttggcaaaaaaccctttgcaaaaaaagactgaattgctatgataacctcatcaccaataatctcccatgaagctttatagaactcacttgtataaccgtccggtcccggggatttgtcctttggcattgagaatatgacttttttaatttcttcccctgttaccacccttgtaagcaacctatgatcatcctctgaacaacgaaaaggtagcaaattttctagctcctctacacacatcccttcataatctgcagggattgtttgtaaaaaatcctgaaaatagttcactgcctccgtttggatatcttgttgactagttacaaccaacccgtcacgtgtaactatttctcttatggaattcactgcctctcgagtagttattgctcgatgaaatgttttattgtttctgtccccaacatctaaccagtgtagtttagacctctgcttcaaaaatttctcctcgattttcaaattttaattcaactagtgttctgctcatgaaattttcgattagcatgtaactatgttgacacaaattgatagacaaatccattttacatatccactgttttacacgatgtgacgcaacacctgtttgacacttgagtgagaatttcttgttgggagaatctccttgcaaagccaatactctatccacgaaatccatgaatctctgtcgatttcctttccttttcggtttattcgcagagtcatcaatctcgatacaagagacaaaagcaatgagatatcgccacctcttggagagaatcgaagtcagagcagcctcctttgtgttaaggaaggacaatatttgataaagaagctcgtctggtagactgctaacaagatccatcgtctctgaacgaaagaatagaaacaggtattaaaggttgggacttgggagggaagcaaagaaggcgaaaagtagatttagggtttgccaaagtgaagagaggaggaagtcacagagaaaaggttttagttttcctttacgtgccctacataacaaatgaaacgcagcgttttataaagtgatgcgttaaaacaaaacttgtttcattgggcccagaattaagattacaaagctacatagcccataaggcccaatactaaaaaagtcatccgaaatattttgtttcccggatttatctccgtcgacgataaaccctaaccgccattatctatttcaatgacgtcatcatcttcttcatcaaaatccaaattctcaagtccactctcagaaaaaagctgactttctccaccaatcact

SEQ ID NO: 12350 - DNA, 3000 bp, Unknown; identical to SEQ ID NO: 12341
  misc_feature (1)..( 3000): cDNA_ID_2708742_gDNA_ID_2214544_Annot_ID_134535 3000 nt of promoter + ATG

SEQ ID NO: 12351 - DNA, 3000 bp, Unknown; identical to SEQ ID NO: 12340
  misc_feature (1)..( 3000): cDNA_ID_2708735_gDNA_ID_2214544_Annot_ID_134538 3000 nt of promoter + ATG

SEQ ID NO: 12352 - DNA, 3000 bp, Unknown
  misc_feature (1)..( 3000): cDNA_ID_2711853_gDNA_ID_2214544_Annot_ID_134540 3000 nt of promoter + ATG
taaagtattgtttcccattaacttcgaatgtgctagattcgatttttcttttcatcgaatttttgcagaagaagagtatttattcaatttaaagcagaaggaacaagttcggggaacgaacacaataagctacaaatgtgtagcacaagagtttgaagcatatattattggtgtaatttgtgtttatgagaatattggcccacgagaaatgtattataacaatctttttaaaacgattcaaaaagtaatatcaacatgctttacaacaaaaaaatgagaggcaaacatcaacttttttcgtaaaggcaaatatcaacgttttaatttggccactttaatttttttgtgcgcaaattattgagaaaagtgatgctgcttcttaaataatggttgtaaattacagcaattagaatccgatgattctatgataggttactattgatgataattgatattattttcttgtaacttttaattaaaaataatggtaaaaaataaatcaatcttgatacaaagaaaaaataaatatcaaggactttcttttagatgttctaaacttttttttctcttttctaatgtaaacttttcctgacccaaactaaagaacaacaagtattggctaatgtgtaccaggtagtaagtttcgtatatttgtgttaccaaattcttagtgttttttactcaagaatattttggaaatatatagggaaaaagacaaagaagcattgcgtaaatgatcacagaacctgcatgagaaggaaaatagggagattggttgcatatcatctcgctgctgacgttattttgatctcctcaaatcggactttggtccaactactgtagttcaattttaatttccatttctagcttagcaatatcaaactaaattttttatacatttggtcggaatatccatttaaaatacttaaaaaacatatactagatattatcaaaaacaagtagagtaaaagtctcttaagtccgcaaatgtgttaaacatgtactaattttttttaatgaaaattgtatttatgtcaggtaaaatatttacaaaaacatgagtgtgaaataatccctcaacacaaaataaaaatgacaaatcttaaacaaaaatggtttcttcactatgagtatgagaattatctttataggtgcaaatgcatcaaagcctaattttttaaaaaagtcaaaagtcaaatgtgacaagaaaagatgactagaataagaaaaatgtaatactagttcatttgttacaacggaaaagaatggggccattagtgggaacgagaaaactaaatagacgaaaaaggaaagaaaacaaaagtagagggacttgtcagaaaaaatgtaacatcacaaatcaaaccacatcaggcaaggcaaaagcaagcctctttccgtattccagcctttttttcttactattttctcatcctatctcagttttcatatgttgtattataaaatatcttttctaaaaaagaagtatcgttatcgaattagatggcacaaaaattaacgttttttaacctctggaggtaacattttcaatcacgagattttacagtggaaaaatacggaagaaaataagaagaaaaaaaaaagacaaaaagaagagagaagaggtgcacgttagcgtagatcagtctcgtacccactgcggactggttacaagtggtgatactggtacagtctacacacgtcaaatctatgcattcttttttatttttacttttttactggtgcagttgtgctataaattttatcttgcaatttttgttattgtgatggtaagaatacctttatcagtgagtcatatttgtgggtgataaatcagactaggggaattttcagcttatatactcgagctttgcaaagttcaaagtaatctgcccatagaaattagaattatgagataaatgcattcttttcattggttactttaatcaatcataccacagttttatacggtaaagtattggcatgagttcattttttaggcatagttatttttttttgttatattctttgcatgttgttatatatgtgtctttgctatattcataatcataactagcatcatcgaagtaacatgttcgcaactcgcaagtcgcagtcgataatctgtttttttttttgtttttgttttccattatatcgttattaggtatcagtgtttgtaggtgaaatttccttcaacacgcctcaaatattttgttaccaatactattcgtatcttgcctcctcccattttatacttttcagaatttcttagaaaatagttttgaaaattctgaaaatattgtaaacaaaaagaatatgctctgtttaaacttcctttttcttttttttacggaacataaataaataattttgattgagacacttctcactaatttatacaaaaaccaaaaaaagaaatgaatataaaattttgttattcttttttgaatacaaggacttattcatttatacttttattttgtttccgttatggtctctccattgccaccattatttatgtataaaacaaactttcacaaatttagcatatacaaaaaaaaaaaaaaaaaaaaactcgaaaagagaaagtatcatcatccaccaccatacgggtccgtatcagctttcctacctgattctccctccccacaaaccacaacactacctacactctctcttgctttctctcctctctgttttttctagctttctctctcacaaaatcaaaactttttttctgtgttcattatcatctccttaaattcataacaatacactctcataattcttctctgcgtaggagagacattgcagaaataaaagagtttttaatagacccaagaaaaagagaaaaaaagcattcatttttttcttgctttgttgctttgcttttgcttttctgtttctcttcttttgtgggcacaacaaaacatcaacaaagtaatgattttgtgttcttccttctccttctggtaatctaatctaaagcttttcatg

SEQ ID NO: 12353 - DNA, 3000 bp, Unknown
  misc_feature (1)..( 3000): cDNA_ID_2711846_gDNA_ID_2214544_Annot_ID_134542 3000 nt of promoter + ATG
aatgatttttttcattttatgaatattgtttatatatatatatatacatatatacatattgtatcgtgattggattatttttaatgcatacgtaggaatataatcttgtatatagttgtgagtaaaaaaaattagatagcttctttgaatggttcttgtatggatttttcttcgaacgtgtacacaaatgatcacgtaagaattatttttctttatataaattttataaaattagatacagctacttggaaggttatttattcaatctaacagtacagttgacaatttgatatggaacctcacatttcgtataagtattaactaaagttaacttattctaatttaagaacacaattattggataatatatgtccagctaatagctagagcgaagggaggcaaagtagcgagagcaaggaaaggaccagagctttgccttggaaacataaccatcgtgaaagaggcagtgatgccggaaaattacttcggcgaagaagttccagcgaatctgaggatcataaaatgtcatcaggatgaagttttggagcttccggaaaatgcaaaactgttagcatattcaagcatgtacgaggtagagatgtattcaatcaaagataacttcctttgcattcagggacatcctgagtataaccgtgacatcttgttcgatatcattgatcgtgttcttgccggaggccacattaaggtttttttctaactctccctttgtagaatatccatttatttataatttgtatcctaaaacaattgctacttacctaattaacttaatgtgcagcaaaactttgccgaaacgtcaaaggcaacaatggaaaagaatgaagcagacaggaagttttggcagaaaatttgcaaaaacttcctcaaacgtcaaccctccttattagtttgactcacaaatcttcatcacacttgtttaatatatattccaactccatgtatcaacgttacaatattatttgtaatgtatgacatattgatgtgttgtatccataatataattaaataaaagctttaccctcactaacccagaagcttctttatgctccaataagttttactaatgccttgatagaaatgagcctcctttgcgccattaattagtgggagtaatcgtatgttcggattctggtattttgttatgtttcatgggcttttaactcaaaattagtaatttgttccatttccattaattatattcaagtcctttttcatcttactcaaaattaattggtcattagtcaaatgctccattcccattatattcaagtcctttctcatttttccaatgtaaaatatttcttcacattcaattgtcttagttatttggagtaagttattaagttttcatataaactaaatgtgaatatatatatatatatataaacaagtttgaatgtgtaccgttttcaacattccatattttataaacaatatttattataaaattatgaaaatattagaaaacaagtaagtaatgcactaacaccttatgctccgattaatcgacataggcgttaaacccttatcatatgcctagttacggcctaagagcacgtccaacgtgggtctctttatacaggctcattcacttaaaaataacaaaaatatttaaaaagtaaaagagggatgaaagagagtctctgaaagtcctcatttaagggacgttcccacaaacatatttgcacgtgtaatcttatcaatggtcaatttatattaaaaaactaaaatataattaaaataataaaatattattactttttacttttttagggattttgatagtcccaaccatggtacatgctctaagagcatccttatcaatgagttcttaagaacatgaaattttttcttaaaatattatataaaacaaaataagaattaaagatataagaaagggttcttaagagaggaaaatggtttttagataagagatatttggtacactttttcttcttgttaagagcctactaatatttagttattattttatatatcaaaatgttaagaattttgtctaagaacccaccaataaggatggtctaacgatttttttcttcaaacaattgatttaaaacagtgtattaaaacccaatccaggatcactacgagtctacaagtcaattgaataatagattttcaattaaataaaaaataatccatattagttattttttttgagcgacataatgaaatatttattaaaaaattacaacaaacataatttatacaatatattatataaatttaaagaaaattttaaatttcaattcatattttaaacacgaatagtttaaccaataatattatatcatatattttgatattgaatccgaacttgattagtaggattatgaggcttatcgtatcagctgtgatttgcggtcggatctgaatacattgatttaaaaaggtgggaccgtaatttttatagtcagtttatttttatttatcttatgtgaattttgtgtgaaactgtattttaatttatgctgatatttgtttttccttttttgcgaaatttaaatacattagctgtattattatttttgtttctaattctgcaactatccctatgtggctagcttgcctataaaacttttgttgatttctataaaaactttgactggaatttatcattaagccataaaattatttgtgctctttatgtcattaaattctcatagtcaaatctattgtggtcaaatagtaaaaactctaaaaatacaagtaaataataaaatataggaaaaatctgtcttttctttatctattatcttatcaaaatatccaataatattagagaatataataatcgaattaaaacaagaaaaaaatccacctagttaatttgttacttacaaatcacaacagatacgcaacaaagactctccagttggcttctgttacgatctctggccgtctttaaaacacacaaaaccttttcatgtaaaaacaacaacaacaacaacaacaaaa

SEQ ID NO: 12354 - DNA, 3000 bp, Unknown
  misc_feature (1)..( 3000): cDNA_ID_2711842_gDNA_ID_2214544_Annot_ID_134543 3000 nt of promoter + ATG
cttgctttcgcttaaggcttttaacaaaagttcttgaagtttaaatttcatgttatgcatccaaaatctatgttttgcagaataattattatctgaatttacaatatgtcatatctgacattacttataatttaatttacaattcttttgtttctgtcaacaatttattctacaaatataaaaaaaaattagtttcctagcaatgtcaaatcttcttggtacctaaatattttatattgatgtctcattatttattcaattgggtgatgaatgttttgatttcaaggtgaaatccttcacttgtcttgactcttgcagaatacattaatcggagtacatttattgattcacgtagctttcttcattttcagaattcggattatatctacagattacagctcatgtaggttagagttattggaataaaacgaatgttaaatataataagagtatcagagcacctccagtggagagagcctctccaaggactctctccatttttttatgattaaatttccaaaaaattaacaagagagctttgtgttttactttttgttaaagttttcttaaaagagttctctgaaaaaaaaatgaatgatcttgttttcaataacttgtgtcttctccttcatcctcatcgcccttgtttccatcctcgactttactttcaccatcttcgatttcttcaatttccaaaaccaatacgagatggaatgctcagctccatgtccttggaccttgatcatctccattgtatcaaaaccgactattacttatgtaacttatcacatctttatctcttttcaaatgaatagagaaaacaacaatagcaactgtaaagactacaccatgcagcagaatcatttaaactaaagaaacacatagacatatacacaaggatatatatatatatatatataaagcagtggcaccaacctacatgactactattgaagcatgcttatgtacgctttagattcagaatattggaagattagccaaaaaaaaagaaaaagcaagagtaataagaaagcagctttagctaccgttccagaagaaagctaggcttaaaatgacttaatgcatccagtttttaatgaatgatctacaaaggttcatgatgtaataagataatatacctgaaaagacaacataccacataattattatccgaggcaacaacagtctgcattatgtcttcattttcctttacttgaaagtatatatctgcagagcataagcgtaattctattaaattattcacagttataagccaactgaataaatacaaagcaaaaaacaaaaactaagaattctggccaaagaatattctcatgaactccaataccaagtaaacctgagagcatctgggtaccttttttgttcacctgaacaagacactacgggaaatgtcagatccgcaaaaccaagttcggaaaaaacaaacaggtagagtcaaaaccagtattcatcaatcttaaattcaatattcaacattggttttacaattgttttacctgaatttttatcttatgttgaattgaaagattaaaccaccaaatacaacatgtaatcacgatatacaagcaagaatggcttgattcatacctaatttggagacttcggcaacgattactctccaaatcagatttgctattctccgattgggtttctcttccgccgatggtcttcaccgtctttcgttttgatgaatccggcgtctagaagcctcagataacacaattacacacaatcacggcgtcaactaatcggaaatcaagagttcaccgccggtttcattatcacgagagagagagacagagaaagaaagtgattatctctttcgaacaaaaaaatgaaacgctactttttttttgttttgttaaaacttcacaacaaatcaattagcgacacctgtcgcctctctcgttccctcaaaaactctcttcagagaaacgcctctctcagtttaattcaattttgatttatttgtaattcaaattatcaagagagcccaacaaatattgcattaaaaccctgcgttggagatgctctcttatagcatctattatcaaccatagtatcacattttttttgtggacaaagaaccataatataacattttgatacgtaaacaaattatttaattccatgcatggcgtgggacaacctaattatacatataatttatttttttaagtagtagatattgaatcaaagtaaaatatagaagcagtgaaaattatagtttgtagtatatccctatatttcttacatgtaatgatttaaaaggagacagcacaggaagcgggtgggacccgactcggacagcaagaagaagaaagtcaattttttggacacaagacagaagaagacaccttcactttcttctctgcccgttttttaacaatttgtgctcttcttcttccgtttcttcttcgccgtcagattcgactgtaactgtaagttcttcttcttcttcatgttcctcctgatctcagtcgctgagcttgattagagtttgcaattgtttgactttggattcgatttaggctatcttagaaatgagtttggttcgttttgtgtagctaaagtttcgatttttgtttctgggttttaaatttatcatcttttatgaatctggtgaaatgataaattagctcaagtaacctaatttcagaacccaatcgctttgatttgcaaaaaaagaaaaactcctccttagttccaattaggtaactcctaaaattatagctgaaaagggttcgctagtgattctcttcttgatgataatttgtctcaaaagcagtttttttaggattcatgagttaaaagagtatgttcgatacttgtggcccaaaaggagtcaaatctcaagtcatcagtggccaacgcgagaactttgtgaggtatatataacaatttttgaatctcatgaaattgtatgaatagtattaagctttttgagtattcctgaattcaaataggttagatagtatg

SEQ ID NO: 12355 - DNA, 3000 bp, Unknown
  misc_feature (1)..( 3000): cDNA_ID_2711838_gDNA_ID_2214544_Annot_ID_134545 3000 nt of promoter + ATG
aattctgaaaatgaagaaagctacgtgaatcaataaatgtactccgattaatgtattctgcaagagtcaagacaagtgaaggatttcaccttgaaatcaaaacattcatcacccaattgaataaataatgagacatcaatataaaatatttaggtaccaagaagatttgacattgctaggaaactaatttttttttatatttgtagaataaattgttgacagaaacaaaagaattgtaaattaaattataagtaatgtcagatatgacatattgtaaattcagataataattattctgcaaaacatagattttggatgcataacatgaaatttaaacttcaagaacttttgttaaaagccttaagcgaaagcaagcccaatgacagcaacaagagtcgaggcccaaaagatgccatttccagcaaccaacccaacagcactgctcttggccggagctggcgccggagccatcgtagaagtagatgactttggagaaggagtgggtggagctggggctggagcagccggagtagtagatggctttggaggaagagtgggcgtaacagcggctggtcctggctttgggtggttaggtgactgaaccacgacagtcactttctcacctttagcacagttaccactcggagctccacttatgaagtagtaaggccctgagacgtcgagtttcactgttgtgtatccgtctttgtgttcttccaaaggcttctgtgtgttgcatttttcgtagttttcttttgttacttgtaacaccgaatcgatctttgaatcgtatttaaacactgtcacatgcaaaaacaatccttagcttactatcttatgcattcgtatatatgaaaaaataattatatatcttaaatgtgttttaagttccttgaatatatctaaatgatttggattattgacatatcaaataaccaaacccaactcaagacttctgatattcaaaccagaagcctttgcagactaaaagtgtatccaacaataactaacatccggatcttgaccatcatgacgaaactatggtagcatcaattttttttttaaaatgtcaacctatgttaaattttattaacatgctaaaagattaagacccatttaatcataatggaattttgtggaaaaccatggtaataatgtcacttgataaaactagctagcatgtagatcaaaatattcaaaaccaattaaaaaacgtcaaaagtataatttagaagaaagaattagatacgaacaaagagcgtctccgacttggaaccggacggactcagcccaatggttgagagagtggttgggagattctggaaccttccatgcgtctaatgatcctcccacattaatgattctagcctcaccaaagtggtagaatgttgtaaataaaagaaacactacggacacaatgctaatcaaagacaccatttttttctctactcaaacaaaacttgcaaccacttgcctagaattctttttctctttagacgtgaaaaagtttggccgttatggtttggagcttaaatgggttttatataaggtttaataaagaggttgggaggatccgaaccagatttggggtcaaatttggtcttgtagaaatgtaatgtaatcttcccaattagccaagtaattgtcagtttcattatcagttggattatattcttctttttattaaaaaaaaaatatactctttttcttaattcgaaagcaaatgaagattatatggttgatctatatatcatatctttgtagtaaattcttgtattttggaactaaatcaggttttcaatacaaaataatttttgacatgtagaacaattaaacttgaagtgtactcagtaaatctaatacaataaattaaggttctcctcaaagctcatttcaccaaaatctgacatttgccacctagacaattgacacgtgtcttcttttccctacctctcatctttttttttccttccttacctttctaagaaactaaattttaatattaaaaactaagatataccatgatcattttaaattagataaaattatttaattatttatctaatatagaaaaccattttccaatactttttctaagatttatttctatcagttgaagtaagatataaacaccaaattactaaaatatttttttccaaaaacaactcagtgatttatttctaatttatacagttttccttgttactactaatagcaaaaaaaaaattcttttgtcaactaatagcaattaatagtatacaaagtttggacttcatgtaagaatcttacctaaggatatgaaaatcttgatttcgaatagtgaaactggatcatagtgtacaacacaattaaaccgggtggatccaataaaataatttcggttcatacgggataagcaaataatttttaatcatatatattcacacaatacaaaactaaagacactagatccaaatactattttagtaaatattagtgaggatgtcccaatagcaacaaattattaaaatgataattgcgaaagaaaaccactattgttattttaatatttcacattatttaaaattatcagttcaatggccattaagttcttgtgtttcttaatctacatttatcactgttttcattgaaagatatatatagttttccttgatgctaactaatggagtctataattgtaataatgatacgacacattattcatatctttggtacattagaaattacaaaaatctaaactggtcaaaacactaagaaaaaggtagagaggtcatcattaagtaatgaatatgactcaacgaaacacacattacatgatagcctccaaaaccccatccatccatccctatgtctctcccacacatgacacaaaatatatatacatatacatatatttgtataaaaatgagtggtcgtaacaagtcattcttcattctattggtctaacaaagcccattgacgaaaaagagagacaatattgaaagagagagaaaacgagaa

SEQ ID NO: 12356 - DNA, 3000 bp, Unknown; identical to SEQ ID NO: 12338
  misc_feature (1)..( 3000): cDNA_ID_2708721_gDNA_ID_2214544_Annot_ID_134550 3000 nt of promoter + ATG

SEQ ID NO: 12357 - DNA, 3000 bp, Unknown; identical to SEQ ID NO: 12337
  misc_feature (1)..( 3000): cDNA_ID_2708746_gDNA_ID_2214544_Annot_ID_134551 3000 nt of promoter + ATG

SEQ ID NO: 12358 - DNA, 3000 bp, Unknown
  misc_feature (1)..( 3000): cDNA_ID_2711826_gDNA_ID_2214544_Annot_ID_134552 3000 nt of promoter + ATG
aatgaaattaccaaaaaaaacttagtgagtgtttagcattcctagttagtagaaattgatgatcacggtgctaagtggttatttaagctgggatttaatgctccttgatcatttgattgcgaacggaagtttttgatgattagatgatcagtgaagagtaccatggaaatgaattagtctagattagtgatctaaggccaaatgaaaatttccttacacagtattttacatgatagcgtatactacacgtttcatcacacgcaagaaaacacaccatgttttgcaattgtattttattgtctagttttgctagaaaattatatatgattatccatcagataatttttaatgaattggcattgaattgatcgtattgaagattcatgtctgaatcataaacaaaagtaaaattgggaatcatctatctactatttgtgtgtgttactgaatttcttctcactttaatataaatgaagattaaatatttgtataatctaattttgaaagttattatgaaattgcacaaactagatccaataacttaagagaaaagggatggaaacataggagaatcacggcatatgcaataaaaatggtggtcacaatataatcatttggttaagcacatgaatgctcatcatttggtctttctttgcttatatacttaacaacaccaaacgccaaaaacaatctagagtaatctaagttatctttcactttcggcattttaaatttgtgttggtttcaataatattagtaattattatcttacattcttttttacaacaatcattatattacattactctctttcttttattttttggctaaatacattactttgttttttagctaaatctatacattacttggttacattatatagcgtcattatcaatttatcactcatacaaatttgtgagtgcagttaggtaagctcgtgtaattagtcttttctctttcctttggtcgagttagatagattaatttgttatgtttagcacatatcaacatatattaatgaatgaattaataataaagttatgatctctattcatatacttctgtatatcttcttaaaacattatataactgtgagtctgatttggtgactggtagtgttaaaataatggaaacaaaagtaagagaacttaaccaaaatagaagtaagagacaataaaattagttaaaccgtaaaggagatgaattaatttctctccattttatagagtattaatcttttttttttggttttttttttcaattaatggttgtataaatcaacacttcaaaaagcaatcagttaaatattaacataaacattgtcaaaatgacaatcactatcatcatacgatgttttgtagggtcaatgatttaatatatataacgaataacatttttctgtttacggttacccaaaaaatactaataaaacataagttgaaaatttgaaaatagcaaagtcttgtcaaagagatctaaatacaatgtaacaaaataacaatcaaaacaaaaattcctctgttctctttttttgggtcaaaattcctctggtctcttgtggtgagcgtcttacgagcttcaaaaacaaaagttgtcgaagatatagcacaaattttagggtttgttacttggggatcaagcgttcttcatcagtccaggtgagattctccagtttcctacttaatctactttttttagtggtactttcttttaacactattttgataataattataaaccctaattaatttgctggattttgatctgagacaagacaaatacactaaaaaatcttgtttccatttctggagattttaatgaagaagccaagaacaagtttaagattttgcagaatttaattaacataataaattccaaaaatagttttaatcgataaaacttgtctgcttcttcacagacacaagtcgtgttcactttcagacactttttttttgttttttgaatcccaaatttcattgtttcacgagcttcattttcccaagaaaatcatactttttctttctttctcaaatggtcaaaacataaaaatataaattaatcaccagatttttttgctaattcatttgcattattgttagtttgttactatattaccgccaaatttttcaccatttttatcagagagtagagacactgattcttctaaacacgtggtcatctttgtctcttcccatataggaaacagatgaatctgcaaaatctccatttttgctaattctttaatcaaactcttagcattattataatcaaaaactgtttctaaaatgcattattaaaaattcttgagatgctaataaaggaaacttctttttgtttactttgaggtttttgattttttgataggaagagaggaagaagaaaggtgggtctgtgaaatctccattaaattttctccagcccatccgaccatggcacacccgtgacaatgacactgaaaaagattgttttttgctcagaagtttttaaagtctttgattgaaattaagaatatctctgaaactgtgaaagtgtaagcaattaaactctactacttgtagacctttgagagtttattttttatagtccttaggcacagctttcttatctctagcttttactctgctaggtctcagcttgttcttgttgtcactttttcttttgggacctaacttactttatgaaactagtcagcttgtcccatggaccaaggattgtctttttcaatctacatgtcttgatctgttttggcttcttgatcaaataagatcttaccttttttttttctctttaagtgattcttgatctgtgtttctgttgtaaagatttaatctttagctctcttttatcatttgggttgtctaaaaatattctctgcttttgctccatcttgctcatctggaaggtattttacttttggcagaataaaaagagtctacaatgagaaacattagttgctgaatcaaatcaatgcaagttggttccaagaaagcatcaatg

SEQ ID NO: 12359 - DNA, 3000 bp, Unknown
  misc_feature (1)..( 3000): cDNA_ID_1807032_gDNA_ID_2214544_Annot_ID_134554 3000 nt of promoter + ATG
cgttccgccaaacccgtcccgtaaaaaaaaaccgcagtacaccgctaatttaaatatataatgaaaataaatgttttacgggcttgcaattgtattttagtttgtcaaacaatattttgttttaaatagttgtcgaaatctagttcaaattttggagaaataagtttagtgaattgataagaaatgtatttaggtgtgttttgcttattttaagggattgcaattgtattttggtctgtcaaatattttttgttttaaatagttaccgaaatctagttcaaattttggagaaatttgcatgatatatgagattgaaatatatttggaatgttttttatttgttaattaatttattgcaaaaaaaaaatcaataattaaaagccaatagcagccattgtaaataagttccaactccaggatttatttcacaaaatggaagcaaaaatgtatatatagattttgaacgggtcagcttcatcgttgctgatttttttatgggccgatcactattttagtggaccgtctttgcattgggctgattatctcttaatgggctgtcttcgtcttgaaacgagtcaaaaggaagggtgttaattccatctccaacatttcattcatctatcttacacacacacaaaaaaaaaactgtgatttgttcaattttttatattttaataggataaagatctatttaggagtttggaggttagttcctattgcatacttcatcttcggtaaaactaaaccgcctagaggtatcgatctctggcttgaagagagagttctcgaggaacattaatagtgtgtagaatggtttatgtaaactgagaatcaattgtgactacccttggttaaaccggaaccttcttctataaaaagaggttttcattgtaacaaacacttaaaagaataacagaataaacacaatcttaaatcatcgtttgtatcataaacgtcattaatctcaactaggtcgtctctataaatttgcatctatctgtcctatcgtatttcatatctcaaattagttttttcttggatttataattattttcaatatttaactataaatctatattattggattattattattattattagattttgtttgttattgttcaagaacatgatgatctgagcacgagtttagatatagaagctcttagaaaaaaataagctgagctgagctaacttatgaaatatccgaactcattatgagctgactaatatattgaagctaactcacagaaaaagctatcaagaaattttaatatgaaaaaactaaaaaaataaatgaaagtaatatttttttctgaacacaaaaatgaaagtatttactatatatatactcttgaccaaaaagagaaatgatatttttactcacgacattacgtcgattagagaaagtgtggcgtaaatcacgtgagatcaaaataggaaactcagcaagaaacctattattcacttatattgatatgacctgcagtgaggttacttatttgatttaaaaaaaaaactgatttatttggtgtgcataatgttttttgttgttcactgcgggccggtcgatgttttttaactaagaaaattaaattttaagttcttgctaaaacaattttgaattttatattttatttattttgttacagtatttaatattatataaatgtattttgagtggtaattttaggattttacatgcgctataccattccaaattaatatcgacccaaacttatctcacagtataaccccattatgtgaaattaaatatcactttattatttttcattccaattatacttttatttaaaacacatattcatgagtcacccatagtatgtttgcttatattgtgaccataatattcctttcgttgtgatccatgttgccaaaacagacatcaattaatgaaattgtgtgtatttcgtccatgtttactcaaaaaaggtcaatatctttaatgtgatcagcaatgtgacttacgaattccccgaattccaccaaaacacctgattgcatcacttttttaatgtttctgaagcttacaaatatcatgggcaaaactccagcaaagccataaatggttggagaagaaaatctagttacatctaagggatggtccgataggtacacaaatgcctctatcatagaacttatttcatctctttcactacttttaaataaacatctaagaacaccttctacgtcgaaaacctacaatgtggcttaaattattgtacgtaggcaatatatcttctgaatttgcattctccgaccaatctatcatctgctggaaatgaataacaagctccactgaaatctcattgaaattagaaaatactctatccactttcatcattgagctgccgcaaccttgactaaaagcaaagaaatcgttttccaaatctcgagcttaccatatattcgatacattcatgagataaagcttcattgaagccaacatccttcaagcctaatcaataaaggccacacaagttgtagttttgtcctccattgataaaacaaattttatgataataggaataaggtacaaaaatatattttttgatgcaatacatgttgccaaaacgtatatcaaccaacgaaatcttatgtactttgtccattaatcagtatgattcacaacttccttaaattccaccaaaatttcggactttggcctattcaaacccattaatgactgtttaaaagctttggcctaaagattaatgttaagatgttgtcatctttggtttccattgatttaatcatttctttctttattatgcacacttggccaagtgttatcattttgagcaaaaccaactataccggttttctcctaaccggaataaaccgaagtaaaccggatatcacatcatccgttcactctctttagctcttaaggcgaaaaaagcttatcttcttcatcatctctttcctcaatcggagtgagcgcaaaaaatcaaaaattcgccgagagcacaaacccta

SEQ ID NO: 12360 - DNA, 3000 bp, Unknown
  misc_feature (1)..( 3000): cDNA_ID_2709205_gDNA_ID_2214545_Annot_ID_134555 3000 nt of promoter + ATG
tgtttgttcttttgatgattgtgcaggtaaaaggagtattccacccatacttgagtctcaccctgctgatgttccgcacttctttggtcaacctcacacaccaactgcctataagccacctcggatgatgagacgtctttcaaagaagcatttactgccaccttttgatccacctgatataaaaaatccaggaaagtcaagctattgagtctaaagaagcgtttagtgggaggcaacccacttgtatgattttctttttcttttctttttcgttttttttttctcgcttactccggatttgaatgccacttgggacagtgacgtttaagtctggtggaggcgcttactaactacgttttctttttgagtgttattcttatacatatttttctttttcagtcgttttattgagtcaaaattttgttaggaattatgatctctattctttagattatatcgtggttgattaatgctgcaggttcgactcaatccgactattgtaaaatttagatggcaaaccaacaaacttgaggatatcctagtttccaatacaaccactaaggttagagctaatctcactgctctttcttttacctcatcaatcggttagtattcatagatattgactccttatcatacctgatattgagaccaatgtgataaagaaaagtattcctctccccttataaaaataaaataaaatgaatgatgaataagagattgataggactttcagatagtgtataggggtaggaatgtttcctatgaccccattattatacattatttggaatgatcaattacaaaggttggaaaaatgcctagggtgtcgatccagtatgcgagttcccctttgtttactctctaaaaagaataattctggggagagaaagaacaccaaaaaaagaatataaagaacggtcgatttatcatggtatagtacaggattgaatctagacggatcttgaatgttagcttgtttgatgagacccagcgatgaaagcctaggggatatagttgtggaacttatgtatggaatctagaatgttgtgtaagcttgcagagaagtacatgttggttaggatttgattagaactgctagacatatggatttggttaggatgatcaaggcaataagctagagaatgttgggagttcctgtgttttcaaacctcttccatgggttcggcttttgtgttttgcttgagggcaagcaaaagctaagtctcggggagttgatataaccctatttttactgcttttagctatgatttaggtataggttttagagtccttttgtgatatgatcatggatagcattaacgatatggagcatgaaccggagcttgaacgtgagcttgtagccgaggaaggagctaagcttgtagctgaggatgagcttgtagctgaggagaacttgtagcggaggatattcttgtcacaccggccgtcccaatgacttgttctagagctaagctattcgaccaagccattgccgggatgcttaaccacatttgggaccgaccaaatgacttgagccaagtcactacctctttggttttgattcaagctcaaggacctcatcaagatggataagtgattcatgagtgctctttttccctgcctttggttttgtcccactgggttttccaaaggaaggtttttaatgaggcttatgttttcacttcatataatccattttgatgattcaaggcccaaacccactaaaataaagagacaatttcgtggccttagtagttgaagagtttattttgattttcaaaaattgtttttaatttctgttgttttctaggcagccttggagcatgttccaagacttgcctcttcatcttctcttctccttctctttatatactcttgtatttacttttgagaacttatctttcttttaatcaaaaaccttttctaagaagatcatcttgttggtgtgtatatccagcaaaatccttagtctcttttagtgcgcatatccaaaggatctaagtctcgatatcttgaagcccttccgcaagcttctgtgatatccatcgattcatttaaatctatccatcatcacggcatcacagccacctctatccatttctcaacctaagagtgccgagtccttgggaggatctcatcatgtggtatcagagcacactctgaaagttgagttttccatcgttatcattttgtatattttcatctttagatctgtgtccgtctgtcaccttgatttaattttcataattatttggtgcatgctaaaattgcgaaattaactgtcacgggtttgaaaaatactctagtattttttaaaattgtttctggaatttttgggaacgttatgataatatttagcatccgaacaagtgaaactgtcgtaattagggttctagggcatctgaagggttatttcgtgtttgtttaaaaagaactagttactggtgttgttttgttgtctctattgcagaaagaatggctgaatctgaggaggaagagactagccacaatcgaaacaacaaacttttggtggaagcctttgagaaaatgatggataccaaactgaatgcttttcgccaagagtttcatgagaaactagagttggggcagactcgtcctcgagaatgaaggagagttaatgagccgcttgagcaaagagatgaagctacagatcagtactatgggcataggagcacttcatctcacaatagtcaaaggagacaccatagacgtgctagagaaggtagagatcttttgcaagacaatcttggaggtcttaagcttaaaattccaccattccatggaaagaatgatccagatgcttatttggaatgagaaaagaagattgaattggttttcaaccttcaacactacaccgagatcaatagggtaagagttgctgctactgaattttatgactatgctttgagttggtgggatcagctagttacttcacggagacgtaatcaagagcttccattggaatcttggtccgaa

SEQ ID NO: 12361 - DNA, 3000 bp, Unknown
  misc_feature (1)..( 3000): cDNA_ID_2711880_gDNA_ID_2214545_Annot_ID_134560 3000 nt of promoter + ATG
aaaaaggtattacatgccaagttcggcctcacggtctaaaagctgtcaagtcatatagttttaaccaaaaaaaaaagagagatgcaacacgaggacttcccgggaggtcagccatcctagtactactctcgcccaaacacgcttaactgcggatatctgacgggatccggtgcattagtacctaaaggtcaatgtagaaaacacatccactataaatatgaaggttcttggtttatagttttctttgttttcatgttcatcgctttaaaccatgttaaaggtaacatattatcttttgattcagattttttatttgcaccaagaaaaaatatctattgattatttatatatgaaaagctggtgttaagtttttaatctcttgttctataaatgtttacataatactttatctacattttaaatctattttttggttaattaaacatcaaaccttttgggcgtaaacaagtctctagcttgatcaagaaacaaaattttcttattctgtttgccagacctaatgtaattcactactctcacacattttcttcaaaagaaatctttctatttctacaagatcatatatatctcatgcaatgcatataatttatatatatatttgaatatctggaagttcaagcccgaaaaccttacatctcctagtggcgggatcatattaaatttatttcctttggagaagagatctctcactcgaatgtcgaaactaggagatttaccactaggtcaaccccacattggtttaatatatatatttttttgtctacatcaatatagtagattaatgtcattttatggttaaatatttctaaaattattcgatcaggatttttgtttatgaatataaagatacaaaccaatgtttattaaatttttaacaatttattgtccagtagattttaataaacttggaggaagaggataaagaagactcacttcattaccacatgaagatgatcgggctacatcgtcgggttgataagcatgagtcgtggcaaagcaatacacattcttaagaacctacacatctgtgaggattttcattcgtccatcaaactcatctccaaagtttagaagagaaagtttagaccggaattattttcaccatttctaagatggctcatgcttttgcattgattattggtgaaagtaaaccggaagacggaagactctttccctgtgcatacacatgctctattttatttttattttggctcaacattgataaaaattgattttgtttttagttagtagtttttttttcttgtcgtattttagttagtagtttagaaactatcattcaagaaatcaaaatttgctttaaattgataaaattgacaataaagataaatggtgaactaagtctcaaaagtcaaaactatcattcaagaaaatatcaaaaaaattctttagattgataagaaacagcgtaggagaatgagaaaagtggatggaacaaatacttcaagtttacttaactgtttgaaccaaaatttctgtttaaaaagaaaaacaacatcgttttggaattttaacagaaactgttgacgactttactttgtttaattagtctgtcacttgacttaacaataccctaaatttggtaaagtcaaagaaacttcataattaataataaaattaattaaaattggtaatttaattcacccaaaacaaaattgacattttttttcaaactgatgttttttgtcgtcaaacttttcattaaaatccaaagaggattacaaggtgataaagagcccaattacacaaaagataaactcaattagcccaaaattacaagaagaaacaagagaacataggtctaaaagggacacgtgtgaagatacgtgtattgatgcatgctggaagtggaaaggcacagccaccaccatctccaccgagctgaaccaccgatcaatccttcgactttcaccatagaaaagctttttctgaccaaggattttaccgatcttcagcttcaaactccaatcaccttgctttgctaccttttgctaaactctccgattgtaaaaaacagagattagcaagccatcagatctatgaaacacgggaagacgcagcgggcgagagggcaaatcagtcgtaaacacactctcttgatatgttctgcaccagccaacgaaatcctctcaacacgatttgaaaccttgaggtgataccttcttccaattccgattacggccacgattaggatatgaaggatttattcttctcatgatcgaaatcgagcagccaatgatcttaaaaactctcaattaaacgttcggattttgattcttctttactggaagagaatttagattctgcaaaaggattgaggaaacaaaatcaaaatagccaaaacggctaaaagagaactcacgcttaggtgagaaggtacatatccggatttagccggcaaagaactgattttaattggaaaacaaaaaatacataaagcttcctctctctaaaggatatgagagagataagagagagaagcttttttaaaggttgcggtaatggaccgactttcaaactgatgttttaaataatatttttctgctaaataataaacaaaaacatataaataaaaaaaatacacaaccacgaacgatcgacaattgggctcaatcggatggaaaacccacatagcattcatttaattcatataaaaaccatttcagcgagaaaaaatgtaattgggcttttccttaccggatttgaaagtgagcccaatagatataaaccctaagaactcagtaattaaagcccaaaacgacaaaaccccgttttcttcgttttacttaaaagaaaacaaagctcccgccgccgccgttatcacgacgaccaccgtgcgataccctaaatttcaacgttgattccactttgtcaagtttgtatctttcccactttgattccgatttgttaaagatttgcagattaaaagttttctttttgaagaaatccatgagtgcccaa

SEQ ID NO: 12362 - DNA, 3000 bp, Unknown
  misc_feature (1)..( 3000): cDNA_ID_3024762_gDNA_ID_2214545_Annot_ID_185395 3000 nt of promoter + ATG
agaataccatgaatagacaaaggagaaagcttccaattcgaagagatggtgaagcccaaattcaacgtgagggaattgaagccaatcatgttgcacccgaaatagttggaggcgatggagttgcaaagcgtggagttgcagaagatggagatataggtgatggagttgtagaggagatagtaaatgaggagggagaaggatatgatctcatgattctagtgttgatgaagatgattgtccggttattgtcgaagataatagcgggtacagagaggcagaacaatgtttggctgaaaatttagaggaagaagaagatgaatttgttgatgttgaaatctgcaataacttagaagaccattttgggtttgatgcgtgttaagatgatgctgttaataaatctgatgaaagcggagatgatgtttgggacagcgagaagattccagatccattatcagatgatgatgacaaatatgaagctgagaggccattcactcatggagaccattccgatgaaccgctagccttgaataatacaatcaacaatgcagacgaattcaagtatgcactcctcaggtattctctaaagactgaatacgatatcaaaatgtttaagtcatcatcgaataggcttggggcaaagtgtacacaacacatcaaagaaaagtgtccttggatagtgtattgttcttttgagaagaggaaaaacaagcttttgataaggagattctataataagcatatttgtgtaagatccggttaaacaaagtttttgaaaagtggaactattgcacaactttgggaagaaaggcttcgattgaatcctaaaattaaatctcaggagatggtagttgaaattaagagggagtttaatatgattgtgactgtgcatcagtgtaggagagcaaaacaattgctaagaaataaaagaaaggctagtcatgaatcacattttgcttgcaatgattctataggttatatgtttgttttgatgcattgaaaacagcttggaagaagtcttgttggcctattattcgtttagatgatgcatttatgaaatgggatatcaaagggaaaatgttagttgcagttggtaaagatggggataacagaatatttccaattacttgggcagtggtagaggtggaggatattgataattagatgtgttttgtgcaactgttgaaaaaagacttgagtcttggagatggagctgacattacaatgatatttgataaacatcatgtaagatttttggttctcgtaagttaaatgcaagattttatgatttcttgtgttggatattgatattatttacttgtggtgacaagatttattaaatgcagttcgtgatgagcttccccaagctgaacacagaatgtgtgcaagacacattttggaaaattggaagaagacaaacaaggatattgaatttgagcgtctgttttggaaaatagcaaggtgttacacatcacaatcctttgcaatatagataaattttgatgactttaattttgactataaaaataatattataaatgacaaatttaattacaatttattatattcatatttcataaaaaaaattatattatttatttactatcttcaaaaaaataaacatttaagatagtacttatttagttattgaatgtagcagatttatagttggaatatgtaaactgcaatattttacatgcatgccatttcaatatgtgtaaaacattttgacagacgatgcatgacacatatctctctcacaaatttccaaagtccttttaaatttttccacaacttctatttatatatatttgattatttattctgaagaatacttttagaattttatttatcttcatatttatggataattttggtatatttaaaaaatgagaaatgaaaaaatatttaacaatgtggataaagatcttctagaggttctaggtttaacagaaaaaaaaacaaaatcgtggcagttagctcaaattgagttccatgttgataattaaggttttcttaaaccagataaaaaagtttgggttagaaagatctcacataataatatatttatttaggattttggtgctttgtggacggatcacagagagaaaacaataagttttcaggaacagtgtggttctatacatcatcaaatacagagttgccaactatatgacgcgaatctctgtagaagtctatctctactccatacctaagtcgaaggtctactctggacgataaagtgtatgatttgtcccgaaaactaagatttagcctttttacggacagttcaaacctggtgaatatggtgtctttcccaaccgaatggtcggcgtttcaacatatttggaggattttcaaagcgacaaagaagaattcataagcttctttttattattaatctctcacaatgcaaatgtaaaagttgataattcggtatgaaaagttcgaaccgtttcgtatcatttatgtaaacaatattcctcaaaattggatcttttgaactctaaataaaaagataattaaaaaaatgttcatctatgatgagctacatatattatattgtattagcaacaaacctcatgatacgttcaacgtcgaaaatacacattctaagtaatagaaaaataactattaatattcccatccatgttgaagaaaatataagaaaagctaagaaactcaaaaagaagaaataaaaacaccatagaaaccggaagtgtctaaaattccaccacaaatctctaagtgactttctcaaaaataaagacttcgtcaacacaaactttcttttgatagaccacaaaaatttcttatgttgtctattcttggtatgctttgatagagacctctcctcttcaacactcgctctctctctttctttcctttttttcctctatcatttcatccatctcagattatcttcgtttttcttcatctccagagactctccttccatctacccttagagggcgcgcctcccgtgcgccttcttaactggtt

SEQ ID NO: 12363 - DNA, 3000 bp, Unknown
  misc_feature (1)..( 3000): cDNA_ID_3024766_gDNA_ID_2214545_Annot_ID_185393 3000 nt of promoter + ATG
acctgaggagtgcatacttgaattcgtctgcattgttgattgtattattcaaggctagcggttcatcggaatggtctccatgagtgaatggcctctcagcttcatatttgtcatcatcatctgataatggatctggaatcttctcgctgtcccaaacatcatctccgctttcatcagatttattaacagcatcatcttaacacgcatcaaacccaaaatggtcttctaagttattgcagatttcaacatcaacaaattcatcttcttcttcctctaaattttcagccaaacattgttctgcctctctgtacccgctattatcttcgacaataaccggacaatcatcttcatcaacactagaatcatgagatcatatccttctccctcctcatttactatctcctctacaactccatcacctatatctccatcttctgcaactccacgctttgcaactccatcgcctccaactatttcgggtgcaacatgattggcttcaattccctcacgttgaatttgggcttcaccatctcttcgaattggaagctttctcctttgtctattcatggtattctctctgaaatcaatgaatttgatttcgatctctatgcctctcgattaattttgagttgaatcgcctaaggttcttatttggggaaaaatatgagaatttttaaggtttagtctaggtttattacgtttaattgaagggatttaacaccttctttagttactaaacgttgaatatattttggtccaaaagcatcaagtcaatgataagtttgtgatttaatttgttcccacaatagttcaggaataaatgagttaattgcacatagtttaggaattaaatgatcattttccccaccggtaaacacattcatgtctatggattatcgttttaatctatctatacatatttggtagactatttagccaaaaatccctatactatttactatttacatttaggttcttacaaattttatctcaaccaaatattttatttttaaaaacttacaaatcattaatttgcattaaatacttgaattaactctttcctaaatttttaaacttaactaaatctttctttattaaactctatccgattaagaataatttcctaaaacatctatatcgagactaaatataaattttttattttttttgtcactatatttgtttatatatatatatatatatatttactttatatataaaatacatatagttaataaaatattaaatttttttgcatctgatgtaattaaaattttgtaaaacagacatatgatactcaatcgatgaaaataaataaaagtacaaggtcccactttgcttaaagaattaggaaattgttaagagccatattataaaaaaggtcaaaccgattccgaatacgaatgagcaggaaccttaatatatcaaacatccaaaagtaaaagtgttattcgattactccatttctttattttaaaatcactacaactttcaaagttttaaaatattatatatatttaaactttattaaaagttaagtattaaaattttttaaacttttttaagagttaaaatttattaaaaattttaaatattaatgattttgaaaattttataaagtttaaattttgtaaatatttgaactttataagaaatttaaatattataaatattaatattggacgatatactacgggtgaaatgctagatttaacaatcaatatacaattgtaaagtttggatcgatattaaaacttttttgaaagtttccaatattataaatattcaaatttcataagaaaatgataaaatgatgtttaattgtacgggacgaggttggttatattgtgggattggtttggatcaatatgacaaaatgatatactatatacgaaatcctaaaattaacagtcaaaaatacaattatagaattttaaacattcaaacttttttatcaaagtaaatataacttaaattttcaaaaataaaatagttataaaaatcgtcatgaggtgtatcatagtatcatacataaaaaaaaaatagcatgtatctatagatcatcttcaaaacaaaattcaatttttatttaataaaagtataggtctatgatgtacctcttgaatatgttatttatatataaataatattaattaaagtaaaaatctttaattttctaacaaaaatatcaacccacggtgtaccgtggatcaatccctaaataatacaagttttagatctttattacctctaacaaacccaaaccacaaaacaatactgaattttaacattaatctaatatacaacaaatatgagaatataaacatgaattacccaagctttagatagataaaaattatatatcaacaatatattattcatatacaaataataattcttataagaaaatacctataacttttcaatgaacatatccacccacggtgtaccgcgggtcaatatctagttaatcattaaattttgaaaataaaaatcatgcatgcataatatataatgcttttacttaatatgaattttatactatgttgttcagaatactatgaccaacaaattgataaattttcttaatctatctaatgcttaaacattttatacaacctcaactggttacatataagaatactatttatagaaattttattatatacatgttggtttaagaactagataaaaaatagaaagcatataaatgctaaagatgtgtataattttattacaattataagttaccaccaaatacagatagagatatgcatgcaaaatattacttcagttataagataacaatatttcctaaaagaaaactcgagaagacacgatggaaggcaacaaaacataaccgaaaagagagttgaaaaccttgcatcttgcctatttgctaatattggcatatgttttcaacgcctttgtaacccacaattttgcatttataaacaaattgttaaaatcctgtttttttggcaagagtttttagaaatg

SEQ ID NO: 12364 - DNA, 3000 bp, Unknown; identical to SEQ ID NO: 12361
  misc_feature (1)..( 3000): cDNA_ID_3024770_gDNA_ID_2214545_Annot_ID_185392 3000 nt of promoter + ATG

SEQ ID NO: 12365 - DNA, 3000 bp, Unknown
  misc_feature (1)..( 3000): cDNA_ID_3024856_gDNA_ID_2214545_Annot_ID_185366 3000 nt of promoter + ATG
actctcttgcgtgcattgattaaaaagaaccttaaaacttgggaagaatgcttaccacatattgaatttgcatataatcatgccatgcattctgcttctaagtattctccttttcaaattgtttatgggttcaaccccatctcaccttttgatctaatccctttgcctttgagtgaaagagtaagtattgatggtaaaaagaaggctgagctagtgcaacagatccatgagaatgcgaggagaaacatagaagaaaagaccaaactctatgctaagcaagctaataaagggagacgagaacaaatcttcgaagttggagatatggtgtggattcacttaagaaaggagaggtttccagctcaaaggaagtccaaactcatgccaagaatagacggtccattcaagataatcaaacggatcaacgacaatgcctaccaactcgatctgcaaggtaagtataatgtgagttctagcttcaatgtttctgacttggtaccttttattgcagatgaaccagatttgaggtcaaatccttttcaagagggaggggatgatatgatcatggatagcattaatgatatggagcatgaaccggagcttgaacgtgagcttgtagccgaggaaggagctaagcttgtagctgaggatgagcttgtagctgaggagaagcttgtagtggaggatgttcttgtcacaccggccgtcccaatgactcgttctagagctaagctattcgaccaagccattgccgggatgcttaaccacattcgggaccgaccaaatgacttgagccaagtcactacctctttagttttgtttcaagctcaaggacctcatcaagatggataagtgattcatgagtgctctttttccctgcctttggttttgtcccactgggttttccaaaggaaggtttttaatgaggcttatgttttcacttcatataatccattttgatgattcaaggcccaaccccactaaaataaagagacaaattcgtggccttagtagttgaagagtttattttgaatttcaaaatttgtttttaatttctgttgttttctaggcagccttggagcatgttccaagacttgcctcttcatcttctcttctccttctctttatatactcttgtattctcttttgagaacttatctttcttttaatcaaaaaccttttctaagaagatcatcttgttggtgtgtatatccagcaaaatccttagtctcttttggtgcgcatatccaaaggatctaagtctcgatatcttgaagcccttccgcaagcttctgtgatatccatcgattcattcaaatctatccatcatcacgtttttaagacatatatatatatatatatatatatatatatatatatatatatatatagtttttaggttattgtttagacctaagcttggagaggctaatctcgtttttctcttttgtactttgggagcaaaaccatgtggagactccctttagagaagatctttacttactcttttcttttgttattttcttcattgatttcttattcagactatgatttgtgtttctttgatcatgtctgagtaatccacttgttaggtttagggtttctcatttgggatttagatgatttagtagattgcccccttgctaggttatctgtaggattcttcatcttgactggtcttaatgatagttctagagtagctaactggaacttgatattagataataggtatgtccaccataggtacttgttatttgaactatcatagatgagcctaggcatttaagaaagaacatgtaggctcatagaagggctctggtttagatactaggtgaactaatcaaacttgataataatgcatactttagtataggatttctcggcttctccggttatcttaactctaagtatagagagtttcgcggaacaccaccggttactctaaaatcatagtttgagctcaagaatggttcgataacaacctacctatttctagatatactatcatctatttcctgagaataccctaagcctgacgcttttaatatcttgtttcacaaccatccaatcgtctattgcttacttttgtttctctttagattcattactgttttacgtagcttaattcaaaactttagtctattgcgtgttccgagagctttgtgaattcgatccctaagtgctgcaactgacctctttatttgagagagtggtcttacgattaatttaacctatatctattcacatgggatcaaatgaatcacaaatacccatcatttgcaccagaagaaagcaatctgaggcttgaactttctactgatggatttaatccattcaagatgaagaatacaaggtatagttgttggcctattttgctagtaaactacaatctgccacctcacttatccatgaagaaggagaatatcatgcttaccatgttaattcttgggcctcaacagccaggcaatagtattgatgtctacttagagccactcatagaggttctatgctagctgtggaattgtggtgagttaacttatgacgatttcaataaaacgacttttactcttaaggcaatgatgctatggaccataagtgattttcctgcttatgggaatcttgttggctgcaaagtaatgggtaaaattggctgtcctttatgtgagaataatataaactcgaggtggttgaagttcaggagaaaatatgtgtatatatgccacagaaaaggtcttctaccaacacatacttataggggaaagaagtcatggtttgatggaaaagctgaacatgagagaaggggaaggatactaagtggtcgtgaaatttttcataacctgaaaattttcaaaaacaactttggaaatctgatacaagctgcaagaaagagaaaaaaagagggaaaatgctgaattagactctgatagtgaggatgaatctagtgagtcataagaagatgagggggaagaagtggacgaggaggagttatccatatggaagaaa

SEQ ID NO: 12366 - DNA, 3000 bp, Unknown
  misc_feature (1)..( 3000): cDNA_ID_3024860_gDNA_ID_2214545_Annot_ID_185365 3000 nt of promoter + ATG
cgcaacagcaagcgtccacatgaagcaagctccggattcgttgctgagaatcgatttgcagagatggtgtcgaccgacaccagtacctgtgtcgatcgacaccccaaacgggctgaaccagaactgtgtactaaagctgcttcgcaagttcagatcactgctgctattctaggacctgttgtcacgacaaccactgcatctctacaactgcatccacctccgaggaggcaacggtactcatatcttcctcttaaacctacagatatcatcaatttgactttaaaatttccaaagactgtttcacggtttagcaagccacgagtttctcgtcgagcgcttgtttgttcttttgatgattgtgcaggtaaaaggagtattccacccatacttgagtctcaccctgctgatgttccgcacttctttggtcaacctcacacaccaactgcctataagccacctcggatgatgagacgtctttcaaagaagcatttactgccaccttttgatccacctgatataaaaaatccaggaaagtcaagctattgagtctaaagaagcgtttagtgggaggcaacccacttgtatgattttctttttcttttctttttcgttttttttttctcgcttactccggatttgaatgccacttgggacagtgacgtttaagtctggtggaggcgcttactaactacgttttctttttgagtgttattcttatacatatttttctttttcagtcgttttattgagtcaaaattttgttaggaattatgatctctattctttagattatatcgtggttgattaatgctgcaggttcgactcaatccgactattgtaaaatttagatggcaaaccaacaaacttgaggatatcctagtttccaatacaaccactaaggttagagctaatctcactgctctttcttttacctcatcaatcggttagtattcatagatattgactccttatcatacctgatattgagaccaatgtgataaagaaaagtattcctctccccttataaaaataaaataaaatgaatgatgaataagagattgataggactttcagatagtgtataggggtaggaatgtttcctatgaccccattattatacattatttggaatgatcaattacaaaggttggaaaaatgcctagggtgtcgatccagtatgcgagttcccctttgtttactctctaaaaagaataattctggggagagaaagaacaccaaaaaaagaatataaagaacggtcgatttatcatggtatagtacaggattgaatctagacggatcttgaatgttagcttgtttgatgagacccagcgatgaaagcctaggggatatagttgtggaacttatgtatggaatctagaatgttgtgtaagcttgcagagaagtacatgttggttaggatttgattagaactgctagacatatggatttggttaggatgatcaaggcaataagctagagaatgttgggagttcctgtgttttcaaacctcttccatgggttcggcttttgtgttttgcttgagggcaagcaaaagctaagtctcggggagttgatataaccctatttttactgcttttagctatgatttaggtataggttttagagtccttttgtgatatgatcatggatagcattaacgatatggagcatgaaccggagcttgaacgtgagcttgtagccgaggaaggagctaagcttgtagctgaggatgagcttgtagctgaggagaacttgtagcggaggatattcttgtcacaccggccgtcccaatgacttgttctagagctaagctattcgaccaagccattgccgggatgcttaaccacatttgggaccgaccaaatgacttgagccaagtcactacctctttggttttgattcaagctcaaggacctcatcaagatggataagtgattcatgagtgctctttttccctgcctttggttttgtcccactgggttttccaaaggaaggtttttaatgaggcttatgttttcacttcatataatccattttgatgattcaaggcccaaacccactaaaataaagagacaatttcgtggccttagtagttgaagagtttattttgattttcaaaaattgtttttaatttctgttgttttctaggcagccttggagcatgttccaagacttgcctcttcatcttctcttctccttctctttatatactcttgtatttacttttgagaacttatctttcttttaatcaaaaaccttttctaagaagatcatcttgttggtgtgtatatccagcaaaatccttagtctcttttagtgcgcatatccaaaggatctaagtctcgatatcttgaagcccttccgcaagcttctgtgatatccatcgattcatttaaatctatccatcatcacggcatcacagccacctctatccatttctcaacctaagagtgccgagtccttgggaggatctcatcatgtggtatcagagcacactctgaaagttgagttttccatcgttatcattttgtatattttcatctttagatctgtgtccgtctgtcaccttgatttaattttcataattatttggtgcatgctaaaattgcgaaattaactgtcacgggtttgaaaaatactctagtattttttaaaattgtttctggaatttttgggaacgttatgataatatttagcatccgaacaagtgaaactgtcgtaattagggttctagggcatctgaagggttatttcgtgtttgtttaaaaagaactagttactggtgttgttttgttgtctctattgcagaaagaatggctgaatctgaggaggaagagactagccacaatcgaaacaacaaacttttggtggaagcctttgagaaaatgatggataccaaactgaatgcttttcgccaagagtttcatgagaaactagagttggggcagactcgtcctcgagaatgaaggagagttaatgagccgcttgagcaaagag

SEQ ID NO: 12367 - DNA, 3000 bp, Unknown
  misc_feature (1)..( 3000): cDNA_ID_2711873_gDNA_ID_2214545_Annot_ID_134563 3000 nt of promoter + ATG
gtgcatacttgaattcgtctgcattgttgattgtattattcaaggctagcggttcatcggaatggtctccatgagtgaatggcctctcagcttcatatttgtcatcatcatctgataatggatctggaatcttctcgctgtcccaaacatcatctccgctttcatcagatttattaacagcatcatcttaacacgcatcaaacccaaaatggtcttctaagttattgcagatttcaacatcaacaaattcatcttcttcttcctctaaattttcagccaaacattgttctgcctctctgtacccgctattatcttcgacaataaccggacaatcatcttcatcaacactagaatcatgagatcatatccttctccctcctcatttactatctcctctacaactccatcacctatatctccatcttctgcaactccacgctttgcaactccatcgcctccaactatttcgggtgcaacatgattggcttcaattccctcacgttgaatttgggcttcaccatctcttcgaattggaagctttctcctttgtctattcatggtattctctctgaaatcaatgaatttgatttcgatctctatgcctctcgattaattttgagttgaatcgcctaaggttcttatttggggaaaaatatgagaatttttaaggtttagtctaggtttattacgtttaattgaagggatttaacaccttctttagttactaaacgttgaatatattttggtccaaaagcatcaagtcaatgataagtttgtgatttaatttgttcccacaatagttcaggaataaatgagttaattgcacatagtttaggaattaaatgatcattttccccaccggtaaacacattcatgtctatggattatcgttttaatctatctatacatatttggtagactatttagccaaaaatccctatactatttactatttacatttaggttcttacaaattttatctcaaccaaatattttatttttaaaaacttacaaatcattaatttgcattaaatacttgaattaactctttcctaaatttttaaacttaactaaatctttctttattaaactctatccgattaagaataatttcctaaaacatctatatcgagactaaatataaattttttattttttttgtcactatatttgtttatatatatatatatatatatttactttatatataaaatacatatagttaataaaatattaaatttttttgcatctgatgtaattaaaattttgtaaaacagacatatgatactcaatcgatgaaaataaataaaagtacaaggtcccactttgcttaaagaattaggaaattgttaagagccatattataaaaaaggtcaaaccgattccgaatacgaatgagcaggaaccttaatatatcaaacatccaaaagtaaaagtgttattcgattactccatttctttattttaaaatcactacaactttcaaagttttaaaatattatatatatttaaactttattaaaagttaagtattaaaattttttaaacttttttaagagttaaaatttattaaaaattttaaatattaatgattttgaaaattttataaagtttaaattttgtaaatatttgaactttataagaaatttaaatattataaatattaatattggacgatatactacgggtgaaatgctagatttaacaatcaatatacaattgtaaagtttggatcgatattaaaacttttttgaaagtttccaatattataaatattcaaatttcataagaaaatgataaaatgatgtttaattgtacgggacgaggttggttatattgtgggattggtttggatcaatatgacaaaatgatatactatatacgaaatcctaaaattaacagtcaaaaatacaattatagaattttaaacattcaaacttttttatcaaagtaaatataacttaaattttcaaaaataaaatagttataaaaatcgtcatgaggtgtatcatagtatcatacataaaaaaaaaatagcatgtatctatagatcatcttcaaaacaaaattcaatttttatttaataaaagtataggtctatgatgtacctcttgaatatgttatttatatataaataatattaattaaagtaaaaatctttaattttctaacaaaaatatcaacccacggtgtaccgtggatcaatccctaaataatacaagttttagatctttattacctctaacaaacccaaaccacaaaacaatactgaattttaacattaatctaatatacaacaaatatgagaatataaacatgaattacccaagctttagatagataaaaattatatatcaacaatatattattcatatacaaataataattcttataagaaaatacctataacttttcaatgaacatatccacccacggtgtaccgcgggtcaatatctagttaatcattaaattttgaaaataaaaatcatgcatgcataatatataatgcttttacttaatatgaattttatactatgttgttcagaatactatgaccaacaaattgataaattttcttaatctatctaatgcttaaacattttatacaacctcaactggttacatataagaatactatttatagaaattttattatatacatgttggtttaagaactagataaaaaatagaaagcatataaatgctaaagatgtgtataattttattacaattataagttaccaccaaatacagatagagatatgcatgcaaaatattacttcagttataagataacaatatttcctaaaagaaaactcgagaagacacgatggaaggcaacaaaacataaccgaaaagagagttgaaaaccttgcatcttgcctatttgctaatattggcatatgttttcaacgcctttgtaacccacaattttgcatttataaacaaattgttaaaatcctgtttttttggcaagagtttttagaaatggtgaagatg

SEQ ID NO: 12368 - DNA, 3000 bp, Unknown
  misc_feature (1)..( 3000): cDNA_ID_2708773_gDNA_ID_2214545_Annot_ID_134565 3000 nt of promoter + ATG
gtgaagcccaaattcaacgtgagggaattgaagccaatcatgttgcacccgaaatagttggaggcgatggagttgcaaagcgtggagttgcagaagatggagatataggtgatggagttgtagaggagatagtaaatgaggagggagaaggatatgatctcatgattctagtgttgatgaagatgattgtccggttattgtcgaagataatagcgggtacagagaggcagaacaatgtttggctgaaaatttagaggaagaagaagatgaatttgttgatgttgaaatctgcaataacttagaagaccattttgggtttgatgcgtgttaagatgatgctgttaataaatctgatgaaagcggagatgatgtttgggacagcgagaagattccagatccattatcagatgatgatgacaaatatgaagctgagaggccattcactcatggagaccattccgatgaaccgctagccttgaataatacaatcaacaatgcagacgaattcaagtatgcactcctcaggtattctctaaagactgaatacgatatcaaaatgtttaagtcatcatcgaataggcttggggcaaagtgtacacaacacatcaaagaaaagtgtccttggatagtgtattgttcttttgagaagaggaaaaacaagcttttgataaggagattctataataagcatatttgtgtaagatccggttaaacaaagtttttgaaaagtggaactattgcacaactttgggaagaaaggcttcgattgaatcctaaaattaaatctcaggagatggtagttgaaattaagagggagtttaatatgattgtgactgtgcatcagtgtaggagagcaaaacaattgctaagaaataaaagaaaggctagtcatgaatcacattttgcttgcaatgattctataggttatatgtttgttttgatgcattgaaaacagcttggaagaagtcttgttggcctattattcgtttagatgatgcatttatgaaatgggatatcaaagggaaaatgttagttgcagttggtaaagatggggataacagaatatttccaattacttgggcagtggtagaggtggaggatattgataattagatgtgttttgtgcaactgttgaaaaaagacttgagtcttggagatggagctgacattacaatgatatttgataaacatcatgtaagatttttggttctcgtaagttaaatgcaagattttatgatttcttgtgttggatattgatattatttacttgtggtgacaagatttattaaatgcagttcgtgatgagcttccccaagctgaacacagaatgtgtgcaagacacattttggaaaattggaagaagacaaacaaggatattgaatttgagcgtctgttttggaaaatagcaaggtgttacacatcacaatcctttgcaatatagataaattttgatgactttaattttgactataaaaataatattataaatgacaaatttaattacaatttattatattcatatttcataaaaaaaattatattatttatttactatcttcaaaaaaataaacatttaagatagtacttatttagttattgaatgtagcagatttatagttggaatatgtaaactgcaatattttacatgcatgccatttcaatatgtgtaaaacattttgacagacgatgcatgacacatatctctctcacaaatttccaaagtccttttaaatttttccacaacttctatttatatatatttgattatttattctgaagaatacttttagaattttatttatcttcatatttatggataattttggtatatttaaaaaatgagaaatgaaaaaatatttaacaatgtggataaagatcttctagaggttctaggtttaacagaaaaaaaaacaaaatcgtggcagttagctcaaattgagttccatgttgataattaaggttttcttaaaccagataaaaaagtttgggttagaaagatctcacataataatatatttatttaggattttggtgctttgtggacggatcacagagagaaaacaataagttttcaggaacagtgtggttctatacatcatcaaatacagagttgccaactatatgacgcgaatctctgtagaagtctatctctactccatacctaagtcgaaggtctactctggacgataaagtgtatgatttgtcccgaaaactaagatttagcctttttacggacagttcaaacctggtgaatatggtgtctttcccaaccgaatggtcggcgtttcaacatatttggaggattttcaaagcgacaaagaagaattcataagcttctttttattattaatctctcacaatgcaaatgtaaaagttgataattcggtatgaaaagttcgaaccgtttcgtatcatttatgtaaacaatattcctcaaaattggatcttttgaactctaaataaaaagataattaaaaaaatgttcatctatgatgagctacatatattatattgtattagcaacaaacctcatgatacgttcaacgtcgaaaatacacattctaagtaatagaaaaataactattaatattcccatccatgttgaagaaaatataagaaaagctaagaaactcaaaaagaagaaataaaaacaccatagaaaccggaagtgtctaaaattccaccacaaatctctaagtgactttctcaaaaataaagacttcgtcaacacaaactttcttttgatagaccacaaaaatttcttatgttgtctattcttggtatgctttgatagagacctctcctcttcaacactcgctctctctctttctttcctttttttcctctatcatttcatccatctcagattatcttcgtttttcttcatctccagagactctccttccatctacccttagagggcgcgcctcccgtgcgccttcttaactggttatggaatccaaatgtctcatgttcgtttccattgtatctgtcttcttc

SEQ ID NO: 12369 - DNA, 293 bp, Unknown
  misc_feature (1)..( 293): cDNA_ID_2706598_gDNA_ID_2214546_Annot_ID_134566 3000 nt of promoter + ATG
agttatataagttcattaaaatttgtagctgaagaccaaaaagttaatagtaataagtgggcttgacgaaataaagttaacaacaagtgggctgataactagataacaaagtgggctgataaaataaagattgggcccagattttaaattgagttttattataattgacccagcttcgggcaagttttcgcttttgacccttaactaattattctccgtgtggtttggatttggcgattggcaatagattcatcagaggtttttgatattggagggaatcggtaacgggcatg

SEQ ID NO: 12370 - DNA, 3000 bp, Unknown
  misc_feature (1)..( 3000): cDNA_ID_2708814_gDNA_ID_2214546_Annot_ID_134569 3000 nt of promoter + ATG
ctcgccgttctgcggacactgaacgcggatgagttccagcggcagataagcgatctcgccacgtggctaagcgcagcactcacggatgatgacacgtgtctagatggatttgaagagacgtcgagtagaacacggacggtcaggatggtccggaggaaggccaccaagtgtatgcgactatgcagcaatgctctggctctcctcaagaagcttgcttttgatggcttgtaatctacgctatgatatttatttattacccatacaatcatgaatcatacatacattagaagaagaaaaaaactttattttactttcgaactattattgtaacactaattataaataatatgattgttgattgttgtcctggttattcttaactcacacaaattatcatgaatttatcattttcgtacttattacaaaatcagttggcctcggtttattatctattatatcttgcaaatatctcattttttcgtaacgttacaatgtttttggatcaatcgtatcgtgattgccatggaaccattttgtcattccgtaagtttggtgacaaaacattataaaagttgtttccaactacatttcagaaacattcatttaatggtacgttatttatttccacaagtatattcattacatgtggtttttttcactttattaaaatattggagaattgtaattgacaaaatttattgtggaataaaacaaaatattctacatatcaatttattgaggcgaataaacaaaaggggagcgagatggtcattggtcactatattagctaaagcccaaatttgaatctaacggggattggtagatgtttcagagatgggcctacatttagcccaaaatgcggattcagatttttccccgtgactactccaaaaggcccacaaacaaaggtttcttttgtttttgtttttgtttcacaaaaacgttacaacagcaatatcaattgttttgagtcatgtaattaaaccgtgagatagtttttttttttttttttgggtaaaaaccgtgagatagttctgaaaatactgctgtttaagttataatgctcggcaatgatttgctgcagacttgcagtagatgtacgtgagtcgtgacaaattactactcctactatttgttgttgatatttttaatagtagacgtattctgcacatacactattatatatgttcatctacttactctatactaaacaaataaaaaaaaaaaaaaaaaaaaagtgacgctgctggctcgaaaatggggagaatgaaagagtgcagaaaacgtgggaaataatagagatacacgtggcaatatatgaatcagtgtcgcttcacgaccaagtcccttctccgacgtgcgagcctcctcctcctcctcctcctcctctatcgttttcatcttcgtcattttttttttcaattttcattctaatttgggtttagtaaattaagttgtgttcacataatgtcaagcacacaacattaattactaattttacgaactaaatgtagttgattctaaataactttaacttttaactgagtttcacgtatcaatgaaatcagaatcaaatttgtattaatcgattttatattatgttggttatatttctttatatgcagaaaatttatcaaaataatgacaaggctcgaccaaaaaaattaaaaattaaaaatattgacaaggcattctcatgcatgtatgtgtatcgttgaattgtcaatattccgccaaccttggttaattttaaatatgatgtatatatattatagaaattaaatatataaaatttgtgcgtctctttgtccattatcgacaccaaatcaatctcttattgtttcttcctcttttctcttagcaaacttatattcgtttttgtttatgtatgttaggaagttaacgtcaaagtaaacctagataaatgttattaccacggtcacccatacaatataatctgacccataaaaaaagttatcatcgaaactcaaaacatgtttgtacctaaataataatatgccaaaatttgtgtcaaaaaacgttgttatgtcacgttttcttctcaacaaaaaagtgaaaacgttatgaatgcatgtgagtttataaatctgtcaataaacgtttcgtacgagaaaaatatatttcctaacgataaatgtatacataaatgatcatatatatatgttaggtatcactagtgggaaaaataattaaacagaagaaaataaacgagcgttgaaatcactcaaagttgccatcaaattggctttgcgtgacaaattaggcgcttattgactttcttaaggtacattactctactttgttaactctatgatacattttcgtcgtttttttatatatcgatcgagtatgaagttttctctaaataattccttacttacatagtcatattacatatactttatatgttgtcagcactttccaattcaaaaattcatttccccataatgacaatgaatacaaaagttataatttatacaaaatataaaaatgcaaagaaaatgtcagtagttgccaaataaaacatcaaagttatttaataagtcataaatagattgattcacaacaagtaataaatacaaaactgaaaataaatttatttctttataaaactagtcatttaattttgtaaagacaacattttataaaagagaaaattgtaattggtcaacaaatgaacgaagatagtaatcaatgtccgtccggttttgaagaatcgtttacttttcaaatctgaaaaacgcctaaaagagagagagaaacaaagtaaatataggggcatcatcgtaataaaagaagaagaacgaggctaaaacagtaacgcaccttcgtctacttaaatacaagcgaaaacccaaatcggttttcactccccgtcctacaggtcgactcagtctccggctagttcgactcggtaaaatcacgattactttctccttccatttatcacgatcgtggatccagaaactctgaaagatg

SEQ ID NO: 12371 - DNA, 3000 bp, Unknown
  misc_feature (1)..( 3000): cDNA_ID_2711904_gDNA_ID_2214546_Annot_ID_134572 3000 nt of promoter + ATG
cttgctagttctattatctggctgctgaatttgttgctattttcggctttccctttagcagcttgttttttggtttcttgcagattgcattggatcagcatttaacatgaaaggagccatgcaatgccctaactgtcgcaatgtcgaaaagggtcagtggttgtatgcaaacggttctactcgcccctttccagagttttccatggaagattggatccctgaagaagacttgtacggtttaagctatccggaaatggtaaaagctcactactttgtgcaacgatatgctttcttttcgtgtacatgagaactgtgcttttatcatataacctccttatgagagatcgcttatcctgacatttttacggggtttgcagcaatatcgggtccattggtgcccgtttggtgaactctctcaagcagcagcttctttcgagtaagcctacaacacctttaccatggtttttgctattatctctcttttctaaggcttttgatccttcaaacgcgaaagctagaattgacttttgctctgtgtttcagggaactggaacctgcaaccactacatgtaagttagacgctgattgttctgtatataatcatttcattttgtctagcaatccgtttataatgtcaaaacccatatttcttccttagatcatactgagttccatggacatcacgccgctgctgtgaatcattcgtatcttgcatatgttggacctggcccagccgctaccccgagaactagcgacaataacagcacagatgatcatccctggaacagccactctaacgatcactttcaccagcttcctgttgccccccagtatcatcaccattccccatcgttttcactacccgctgctcatgtggttgatggtgaagttgactcttcagcagcacgaggcctaccttatgcgcatccatttctttttagtcaccggttagcttctcaaactccctattgctctcaacttcttgcagagtgttttacaatattcttttggaattgggcattgtaggtctaatcaaaggtcctcaccagcaattaacagttaccaaggaagcagcacccaaatgcgtgaacagcatcatgcttataatcatcagaggcaacaacatcatgccaatggtcccactctcgcatcacctctcatctccatgacaagaaggggattaccgccgccgccacctcccccaccaatgccagatcagaacgttggattcttcatttatccaggtggacaccatgaaccagaaaccgatcaaattcatgcatgggagagagattggttcccacatttccctgtcccatcgaatcatcgcacgatccctagcttgtggcatagacacttctgagagaagttgtgtcagaactctacagtcgcctgggagaattctatcaggcttaatgatcaatgtataaaagaaaactggggacttgtttgatcgatcaaaacttgtttatgatgtaactataactggtttccaatgtacattgtgagctttccaagaacaattgttataattaattaaacacaagttatcgacaaaatgttgccattgttcctggttggatggagtaatagtgaagaagtaaatgatccacaatccacatgtccataattcaggtggaaaagtatacgtctcaaagagacgatttaacataaaaagaaagcagaacatgattggataaaattgaaaactgaaaaacaatcaaagcgtttagagattccaagatacaaaatcttccatgaaccttttattattcttctctggaatcggatgaagcttgaaggaggattgttgagactagtgatggttgtgagtcccatctccggcttcttcacctttcctcgaagctgctcttagtttacgctgctcctccttgtatatcctgttccttctttgaaactgcaacaacaggtacacaacacataaaaacttaaacttacagcatcttcattcaaagtaaagaaaccactggtgtcaatcgtaatgttctaagagagccgtgtaattgcagaagaaacagttgtaacatgtacagagatgatttagttccagaaacgcctaatcgatacatcctatcttaaacaagagaacatgatctttcaatggcatcttgattctgcagctgaggattccgaaaatggccaatcaacaaaggcatgggactcatttcccaattgctcgacctgatctaggatttttggaatttcgacaactaagtgatctagacatcacaatcacactgatctagccggaaacagtggcgaacatcagaaccatcaaatcaatgaaattcttcaaacaatatcaccggaaaaaagaagtgggtacctacctctttggaatggtggagacactcgaggtaatcttcacgaagaagggtacaatctttgggctctctgcagtgagacatacattcactgaaatccatccagaaatcgtagcatctccctttgtttcccgttattccccatcccgacgccatttcctctccaacccaaatcggaagaacgcaacaaaaccagacaggttcgtcaacttcatcgaaaatggttcgggttcgggtttttggatgacccgagatatccattaatggacttttttattactgggctatgagtgggccggttctatttgtaagtttttttcctgctttttttcaagtgttttgattggcggcacttttttgcccatgatatatatatgtcctttccttagtgggacctaggtaattcgcggcaagctctccagtgtgtgtatacacccgcacacattttgactagtcaaacctagtcaacttattagacttgagagatcaacgagcgagctaaacgtacgctcgtcgcacctgatcgacgctcccctaaaacccccctaaaagcgtagagaggaaggatgtgattggcagtattagaaataccagagactggactagactctgtgtgtagaggaagagagacagtgctccgcgtacgacaacaatg

SEQ ID NO: 12372 - DNA, 3000 bp, Unknown
  misc_feature (1)..( 3000): cDNA_ID_3024937_gDNA_ID_2214546_Annot_ID_134573 3000 nt of promoter + ATG
cattttggacactatcttatagattcgatctattgtatttctaaagcatatatgcacccaatttttaagaataatgaaagaatactcccaccataagcatttagcttcatctaaggatcttcgcaccaaacaggaactcatgtgataggtacttatgcagtagcagaagacctagcaaacccgactgtccttactatttcacaggtaacccaagtttgacatcttctattataaaagaagttaaacattctctacacaattataatattattaccatttgcgtcattaatggctctggattccgtgcagcaaatatggagaacttgttgtctcaatgacagcttaagtatagatgggggctcatgttcttcaagcttgttaaaaaatgcactcggcaccaggcgatacacctcaccatcacatgttcgacctgtcctccctctacgttgctcagcctataacccacataagaagctaaatttagaacatccagtcatccactattattccataaatggtaaattctagcaatacctgagatctagagacccaaacaagctgtactgcgtctctttttctggacggatcccagaacacttgcagagaccggcacgagtcaatgacatatgctactttgggtattgttaccgaagattccgcaatgtttgtagccaatattacctgagaacagtattttggaaaatttatataactatgacgtcacaaaatggtagttgcaactcattgcatcaatacgagtttgatgtccccccaataataatgctcatctctcaaggacaaagaaacatggaaaggtaaaagagaaaccttgcggcgggatctgcatatcttcatagccgccaaggcttgctcggtgtcaatgcttcggtgcaatatgtgaacctcaaaagatgcaaaaaagggttccaattgatgatactgctgctcaagggagtagtatgtcggaaggaaaaccaaaatactcttctcaatgtctggttctttttcatgaatatataagataagatcatgaataagattttgcagttcaggtttgatttcagtatcagctgaagaaggacttggaccaggacagtaagctgacaaatcagaactcacaccaagcaatcctgcaacctgcttcacaaacagtgtcatattaattagcttggaaatacttgccgtcagaaaagaagaaaatcaattggataataatatagtttcataaagagcaacaaatctaaaaaagtttaacctgctcaagatataatactcttcgctggaaaattgttctctggtcagggctaggaatagcaactacttctacgcgttcacccctgcctagttctttaaagtagtctctgtaccttgttatatcagcagttgcagacatcaagaccaccctgtaattaatcaaatcacctctttaataaccatgacctcaatacaaacgttatcgatgataacacggttgaagtaatgaatcggtatagtatagaactgacttatcttctatcagcaaacacaaccacgcgaaacaatttaagaaccttaaagtaattacatcatgttgtagaaaagggttataacctgaggtcattattcttcatgagaaactgcttaacacagacaagaacaagatctgactccacagatctttcatgcacttcatcaagaatgataaccttgtactttagtgcattcaaccccttgtctagcatttcatccaacagaactccagcagttttgaacagaattttcgacctgcatgcaacaggataattgcataaaagtcatcaataagggggaaaaagccaaatattgtcctgaaaactcggacacagtagaagaaactgaaaggagatattgttctataagtcaagaagatgaagataatgatagttacccttcggtcaaaatcttagaatgcccaatgtggtaaccaatttctccacctaaatcggagttgcgagatttagcaaccatcttagcaacagctacaaccgcaaatctcctaggctgtgtacacaaaatgggagccatgtttgcttccagaaggaactgtggaacttgtgaactcttccctgaagcaaagaaggacaagtaagtaaccacactacgtatgagatgagtcgaaaatccagctatccattacaatcacaacagttcaaaggcgcagggaagctaaatatggcccaacttgtactatttccgtttaacgcgttaagatagaaacgaatcaaatggactatccactcacagaaaacattcaaaatctggtgtcatacaggaagaaaccccaacggagcatttctgtaatcaaaatgacgaagacgacaaaacaaaaacaaaaaccccaacggaaatgcagattactaactagagtaagtcgtctcggaacgaaggaagaaaaatagaataagagaaagaagaaggcgagcgcaggtaccgcatccaggctcgccgacgatgagagtgacgcgattctcgaggattttgtcgatgattctccttttcatcgccataatcggaagcgaagcgaagttggaggagggtaaaggtaacgattcagaagagctggaagacgaagtcggcgaagaaaccgccattgttgtcgtacgcggagcactgtctctcttcctctacacacagagtctagtccagtctctggtatttctaatactgccaatcacatccttcctctctacgcttttaggggggttttaggggagcgtcgatcaggtgcgacgagcgtacgtttagctcgctcgttgatctctcaagtctaataagttgactaggtttgactagtcaaaatgtgtgcgggtgtatacacacactggagagcttgccgcgaattacctaggtcccactaaggaaaggacatatatatatcatgggcaaaaaagtgccgccaatcaaaacacttgaaaaaaagcaggaaaaaaacttacaaatagaaccggcccactcatagcccagtaataaaaaagtccatta

SEQ ID NO: 12373 - DNA, 3000 bp, Unknown
  misc_feature (1)..( 3000): cDNA_ID_2729568_gDNA_ID_2214546_Annot_ID_134575 3000 nt of promoter + ATG
ttagggtcaaactgttgaccttcaacttgaagccatacgttagtggttgccttgactttcttgcagtcttgggagataagcttttcacctttctcactgtattcctctgctaggtactgtgtgatggctcttgactctgcaaatatattaccaacaaaaactttcagcaacaaaaataatcatcacagtctgtcatttcagataaatcgttatccaatacaaagtgactaaggcgtaatgatgtttctgtaaatctaaaaaagtcaaatcattgatcaaagcaaaagtaaactgaccgaaaagcgtcaaatcaccgtcctcgagagcaggaatttgaccgaagggctgaaacaaaacaaagatcattgtcagataattggaaaaaccaaacataaagtgttttcagttttgtttgttcgtaaagagagagagggagaaaggggttacgttgagggcaaggtgggcctcttgcttgtgggcaccggctctcatatcgacggggatgagctcgaactggagatctttctcgtaaagagtagcgaggacgcgcattgtggcggtggacatgggaactccgtgaaccttgatactggccatgatgatcgaagaagaagaagaagaagaagatttgttggatctgattttgaaattggaattggatgaagaagaatgaaggaaggtatggtgttttatagaagggggagaaaggaacaagggaagacgagcttgaattgctcccatttttccagaatcttctcaccaccacccactacccacaggcacgtctctctttcctttttttttattgggtcccctttatttattgcattgttatccatctaacatatagaaatcacggatttattgactgaaacaaaattcccctcactaatttgttattttgcaaacaaaaaaatcagttagattcatgtcaatatagctaatctatgtacatgtaaagaaatttcattgaataaaaatagaaagacacaaacatcacataaactgttctaaggtaatccttccttcctttgtaaacatacaaatccaaaagtgtagaggaggtcgtcatcaatgacataagattctagagttataagtgtggattgaaaaagtcaacctctcctagaaacgaatctcatctttcctgagacgacgactcaaaagaaaagactttttacgtgtaaacgtatcattcgatattaaactactcccaaaacaaataatttaaggacatgtacagacaaagcccacctgtttttattaattttctaaaacccataacaccttttgaccaactaactctcaatccaattcaacaggagaagaaggatcaataacaataacaataatcaatccccttatgttataactaaatctagttgctggaaacagaaccatctccctcctcatcagatttttgcattaccatctacaatttggaaacagttatatggtgattatatacatgtcaagaattcagaaacaaacacttgaactttcattatcactctcttcatatgcaattttactcttgtaatgttgacctttctttttgttgtttttttcagaaaaatatatatgcaaaatagtattctcaatatgagatccaacgtaattaactaaataatcattaagtgattagtggttcaacatttacatatatacatactctctcttcttgcctcgagattgaccgacaattccataactaaccggaaaccacatatgttaccaaagacacaagcctaaaatccagaatctcaacaagattaatatatataaaggaagtaagagaatgctgacttgttgtttcaaaacacagaaggcggcttcagacagttatgatactcgagctgagacatctctcctccgtgtactggatcaaaactggcctttgtagaagctgcaaaacacccaaaaatcaaacaaagctgctgatccgacttgtaggacattattaaggttagggtatggttctcttacctcccatccatcccaagaatctgtgttcttctcatgtccaaatgccactatgtattaagatccttcgaccaaccggaactgagccactgacaactctgagctgaaatactttggtaacactcctatatggacaaagagcaaggtttgatgatagataagaatgatgacgtctcaaaatgctacggagaaactggtttggggtttaaggtatatgtacctctgagtaatgatagagatgatgacggtgataaagcagcatgaattgcatcaggtgcctttcgggatgtgtccttccctggagatccagaattgattttcagaccgacaacatgaacagtggccatgggaatctgaagattctggagaaatctgaaatcagataaaaaaaggtaaagagtagcgtcaagacgaagaagaatataactaaaagcaatttggttagagaggtttctgtcgcactcctgcttttgcttcacgtcgtcatattattctacagccggccgtctcatttttattttgtaattgttatcatctgagccggattttacccaactcaaatcattccactatttgaaattagatttttcttgtaatagttaatttccaagtaaaatcgaaagttatcaaaccaattcatatcagtttgttactaaaaagctaataactgttaacctgcaaaatccttttatgtactttgttttatgggtaatattcaaattagaataaattttgtgtaaaatctgtgggttcttcttatttaaaatctgtgggtaactttaaatattgggaaatttactaatggaaaggcataaagaaatgaggaccagccacgtcatcaaatcaaagtatcacattcctcttttctttttatttaaagaaattaaataatagaagaagaagataccaaaactctctttttctgtgcaaacactttggaggattcttctaggcttctttctaccacaaacacaagagcgcgttttcttcacgccggcgaacaacgtcagagtcatg

SEQ ID NO: 12374 - DNA, 3000 bp, Unknown
  misc_feature (1)..( 3000): cDNA_ID_1834169_gDNA_ID_2214546_Annot_ID_134577 3000 nt of promoter + ATG
atacctcttgatagctccatatccatggcttcccacaacaagaatagaagcatgatgcttatctacaacttcacataggatattccttgcatcaccttcgaaaacttcgatcaccgcgccatgaacctacacaacaaacctaggaatgatgattgaaaagaagaagatagttgctaaccaaagatagatagttactataagaaaaaccagtgctacttagcttgaagctcttaaatgtgctagagattcacattcacattaccaaactcatctaatagagtccaatacaacacatgatgacgattataaaatccaagaaacacataaaacgaatttgaatgtttgataatagcaagatcgtaccgatctgctctgacaaattgctttggctttctcgacaaccttagcagcggtatgcttcagatcagcatcaacataaggtacaacctccgcagttcctaaaacacacagattaacaaaacctaaatgatctctccccatcgctgcccaaaacagaacccctagaagagtagattcgagagtgaaagcaaagagcgtaccgggaccagcgagaccaacggcggagacggcgttaggtttggcgtggacgatgaagagcttaaaaggataattgggagcgtaaggagcgaagaaacgatcgagcgtccactccaaggcgtaagtgctctgctcgctgtcgtcaactccgacgaccatcaccgatttcccatctccggtggccatgactctgacgttgttcgccggcgtgaagaaaacgcgctcttgtgtttgtggtagaaagaagcctagaagaatcctccaaagtgtttgcacagaaaaagagagttttggtatcttcttcttctattatttaatttctttaaataaaaagaaaagaggaatgtgatactttgatttgatgacgtggctggtcctcatttctttatgcctttccattagtaaatttcccaatatttaaagttacccacagattttaaataagaagaacccacagattttacacaaaatttattctaatttgaatattacccataaaacaaagtacataaaaggattttgcaggttaacagttattagctttttagtaacaaactgatatgaattggtttgataactttcgattttacttggaaattaactattacaagaaaaatctaatttcaaatagtggaatgatttgagttgggtaaaatccggctcagatgataacaattacaaaataaaaatgagacggccggctgtagaataatatgacgacgtgaagcaaaagcaggagtgcgacagaaacctctctaaccaaattgcttttagttatattcttcttcgtcttgacgctactctttacctttttttatctgatttcagatttctccagaatcttcagattcccatggccactgttcatgttgtcggtctgaaaatcaattctggatctccagggaaggacacatcccgaaaggcacctgatgcaattcatgctgctttatcaccgtcatcatctctatcattactcagaggtacatataccttaaaccccaaaccagtttctccgtagcattttgagacgtcatcattcttatctatcatcaaaccttgctctttgtccatataggagtgttaccaaagtatttcagctcagagttgtcagtggctcagttccggttggtcgaaggatcttaatacatagtggcatttggacatgagaagaacacagattcttgggatggatgggaggtaagagaaccataccctaaccttaataatgtcctacaagtcggatcagcagctttgtttgatttttgggtgttttgcagcttctacaaaggccagttttgatccagtacacggaggagagatgtctcagctcgagtatcataactgtctgaagccgccttctgtgttttgaaacaacaagtcagcattctcttacttcctttatatatattaatcttgttgagattctggattttaggcttgtgtctttggtaacatatgtggtttccggttagttatggaattgtcggtcaatctcgaggcaagaagagagagtatgtatatatgtaaatgttgaaccactaatcacttaatgattatttagttaattacgttggatctcatattgagaatactattttgcatatatatttttctgaaaaaaacaacaaaaagaaaggtcaacattacaagagtaaaattgcatatgaagagagtgataatgaaagttcaagtgtttgtttctgaattcttgacatgtatataatcaccatataactgtttccaaattgtagatggtaatgcaaaaatctgatgaggagggagatggttctgtttccagcaactagatttagttataacataaggggattgattattgttattgttattgatccttcttctcctgttgaattggattgagagttagttggtcaaaaggtgttatgggttttagaaaattaataaaaacaggtgggctttgtctgtacatgtccttaaattatttgttttgggagtagtttaatatcgaatgatacgtttacacgtaaaaagtcttttcttttgagtcgtcgtctcaggaaagatgagattcgtttctaggagaggttgactttttcaatccacacttataactctagaatcttatgtcattgatgacgacctcctctacacttttggatttgtatgtttacaaaggaaggaaggattaccttagaacagtttatgtgatgtttgtgtctttctatttttattcaatgaaatttctttacatgtacatagattagctatattgacatgaatctaactgatttttttgtttgcaaaataacaaattagtgaggggaattttgtttcagtcaataaatccgtgatttctatatgttagatggataacaatgcaataaataaaggggacccaataaaaaaaaaggaaagagagacgtgcctgtgggtagtgggtggtggtgagaagattctggaaaa

SEQ ID NO: 12375 - DNA, 3000 bp, Unknown
  misc_feature (1)..( 3000): cDNA_ID_1807546_gDNA_ID_2214546_Annot_ID_134579 3000 nt of promoter + ATG
ctatgttgctggaagtcggatgaggatgctaccgagattaaccggtcttggacttcaagtgagttggttgttaagccgccaaggaaccgcaagaaaaacagacactctccttactagtaaacagatactactttttgggtcttgtgtcttttataaaagttgagactgaagaggacagtttcctttatgtctcttgttcttgttattattaaaaggcaaagttgtttaaatgaaatattgaagaaagattacatctcttgggatagcaaattgcagaaaggaaagaaaaacagagtacatacagtatatatactctatagaagaaggaatctttggcttcagaagagtaaatagtcaatcagctcgacactgatcttgttccaaaatatcagagatcttctcaataggaatcatgggtagatactctgccccaaagtagtctctgtcgccaacgtaacgaaccgcatcgttgtacttctctgaccagtaaaacgccgtggggatcactaaatgcgcaacttcagggaacaacggcagttgattcagtaaacgccacagcgtcgctgcgtaatactctgccgctggctcgtacttgtcccggacgcttcttgcaatgctcttggtagtgtccacaacgccggtgcgctgcacctccgtggccaccgtgagcgcttggctagaagcttgcttcaccaatgacggaacatatgtctcaacatcgaagaacacatcgtccacctgaaaaccaagcaaatcatttgcctctcactcatgaaaccgaagcgatattcaagttaagaattacattctgattgttaccttacgatcgacgaaaaggagaagcttgaaaggaacgtcgtggaatttttcgtataatggagcaagcacggttcgaacgcaatcttcaatgttctcgacgccgagtttgagtggaccagcgttgtctttagccaactcgtagagggtcgagaaacaggcggcgaagtaaaccgccgcgacttgaatgaattccaagtgcttgagcttcatctcatcgtcgtcttccaccactaacgaaggcgaagacgaagaagatggtggaactggagtaatctcctgtggctgtgattgctcttcttcgactactatttcatcttcagccattgtcaaagacttggtgccgttgcagacaaacgaaccgctctctctctctttaaaaagacttatatcacaccggacggctcagatttgaaactggtgagccacgtggcatgttgctgccatgctccattttagttttaatttaagcgaaagggattggattgtgagagacgagtgacctctaggacagctgtcctattgacagatgtcttactcttaatggaccgttttcaacacgtgtcgaggtatgggtcgagactgttgcacgaaagccacggccactccgtcggcacgagtctcgagggtaaatcaaaaaagcacaaggacctctcgttcgctatcattcatccactttttgtatattccctccaaaccttacatgatatcatcacgtgttaaaatggattgggccctaatcctcgagttcctatattaattttaggtttaccactgactgagaagcccacaaaacagtgtcaacggcccaacccaaaactgatcaaagtatagttggctttaccgtttgaatttgttccgtttcggcgacataaaagtaaaacgatcgccttttaagaatctcacagtttgatttcagaccaacgcttaaaacttctacaatatcacattatttctcaagtatatcatgttcatgtctattactccacaatgaccagaccattggatcgcaaagacatcttttatggtatatatcacaaaaaacaaaaacaacaagaaacactcatatgactcagactctacaaacatcatcgtatagcgtttacagatctcacgcgactgcaagctttacattaacagcggctacaaaggcagcccaagccaaacacggctttaccagattaccagcgaccggacttatctcattaaaggccttgtagcatccgaataacgcagccgattgacccaaccacaccgcaagccccgctactcccgacccgacgcggaacgtaaccggatcccaaaccaaacagagcaaaaactgagctaagtaaagatacagagcattgggcttcttgtggaagccaccgtcaacccatacaagccacgcagccaaacccatcagaccactagaagcgagacacgttgtgtgtaggagccacagaggtgggatccacgacgaggacttagctcgattcccgtatccgtcgcttgtgccgaggaaatacgtagcgaagagcgtcacgagcacaggagccgcaaccgctaccgtcagagacttgagaccacgtttcgccatcgccctcttttgatcgcgttttcctttgttgtcgtcagcgcttttcctctctgtctcggccatagccgtcgttgcagcgtctctgtcgtctccgccgcggtatctgatgtcctgagaatccattacaaacgtccaaaacagaatcgaaggaacaagattactgagatttgagatgttggatagatggagaagaagcagcttggtcaaaagagagtataatcaggagatgatattaatagacaagaagaagaagcaaaaaggccaaggctcttgtacacgtggcgagtgatatgtacacgtcgaatgctaattaattgttttttgtttttagataactttgtgaaaaagtgtggacacgtgcttactctatatgctcatgtctgatgcatacacacagttttgggacgattgcgatgcttatttatttatcgcttaatacttttgcattattaaaaaataaaacaacaattgggctctacaccgactaagacaagaagcccaataggctcatttaatttgggctaattagaagagtagtaatatggaagtagttgtctgttacgcggcgttggctagacgctgatgcgatttgctctgttttcatg

SEQ ID NO: 12376 - DNA, 3000 bp, Unknown
  misc_feature (1)..( 3000): cDNA_ID_2708799_gDNA_ID_2214546_Annot_ID_134583 3000 nt of promoter + ATG
agacatatcaatccatccacggaagcggaaagaagcttgttgggcttgttaggaacaaagtgtacctataattaagaacagagttgacatctataaactaacaacaaactagttcctttcccgcttgagcagaaagaatgagagagcaacaaacctgagtgacgtcgtccatgtgggattcctctaaacaagcaacttgctttgagtttctccagtcccacaaaagaacctgcaccatcgcttcagattgtaacaagctgaaacatagaaaatgctcaaaactagccttttttctttctcaaagtgtactcctttttaaacatttagagaaacaaaaaaaaaaacacgattccacaggattgagatgcctaacctgctctttgcatccaccagccagaagattatctgcagcacctccataggagaagctgaaaatctcctgatcattcccagtatcaatacgcgaaacctgaaacacccatgatcaacttaaattcaatgagttccgaaaatggaatcacatttacgacagaatttatataaaaaaaaaaaaactcacctgttggaaacttcgagtgtcccaagatctaatggtaccatcggaggaacaagagtgcaaaacgtgaggagacgccgccgagtcggaggaaaacgcaatctgattgacggtatcggagtggcctttacattcgccgtagtactgaccagtcaccggcgagtaaagcttgacggtgttggttgataaggaaaccgcgattgctgtccaatcgattctgtcacaaaaccagagttgggttcactttcagtaaactaattagtatggttatcgaaaagagagaacagaaagcttttactttgggacaatctggaagacgtagtcagagccgaagttggtctgaatagagttcttgagcccaaatttcttcacgttttgagccggagaagaatccgaaagctgacgattttgaacctccacttccatctccgacgacacttcttccatttgccgtttcagcgaaattgataagggttttaacggtctagggtttgttcgttgatcaaaacgaaacgaggattagcacttacctctctaagtcatagagaaggttataactctataggtcaaaatttaggcctgttttaaccttttcggcccatttaacgcacggtccaatacgattattagcccaaggaaacaacaaccaactcgctcgctcaccgtgcgcttcttctaaacatgtccatagaaacataaacatactaaaatgtgaaaagattaaattaaaaaacggatagaaacatatagaaagccacgtgatggtagcaaacagatttagtggttacaaccagatatcatttgatattgagatttatgaaaatgtcctttttcaatggctccgatcggtcagtgatcggatctaatattataaaggtgtgttgacccataacataatattattactaatacaagtaacatgcggtaattaactctatgtcgatcttttttctctgcatatatatcttttagtcggttttttcgttcttgctaatcgttatattcctctacacatggcaatggaaaagaaacgagtaacaacaacaagtagcctgcaaataattaagtgcgataagacaactctgctctgattggaaactgatattccggcccgtcccccttttattacgtaggagtaataaaattgggaacgtcaacttatattaatcatgacgacgttttctcaagggagcaaattgtacgttacgtctcatattatcaccacttttttgcagcaacacagttttatttcacacaatacaacaacactttatattatatatgagagtgatagaattttatcattccatatttccatgatataaagggttccaataattggtccaatttttctaataagacttttcttattctcatagactcttcttattcatctttcttaatcaattcgaccaactcagtggaagacaaatctcacacgaccctttccactttttggtaactttattattaatttattagtatggtgtagttcctttctttcttctgctgatcttgtcaacaaaatactaaatttttcctaagcggctgtttatatattattaacaaaggtttccgcgtgtctcttgtttaactagtagactaaaaacaaatcgtaaactcgattttctcaaccaaatttagaagatactacggcatgtaattagctaatgataaaagattcgaattttcgttccaatggatttgtcttttcttttgcccaaaaccaagaatttgtcttctcttggcagtatttagctagacaacgcatatagctatatattttgtgtacactggtcaaggtcgtggatacgtcattaataatattatttccaataagtcctattaaaacattaaacaactttgagttttaaaacaaacttagtgtaaagaaaataaaaatagcagacagtttacgggtaagactagatgaccatatatgattgagtgcataaaacatcttttttctttctttttttgaaaaagcgaaactaaaagattattagttgttggaaatcagcttagcgtaatcttcgagaaaatgactctaatgctaaaatactgatttaatcaattttctaatggtttgacccaacagacttttttttttttctatcctctaataatatataatcatatagtagtaattatttagtagataatatgattaacacgtgaatagcaaagtttctatcatttttattcaaaaaaagattcataagtaataaaatgatagtcaacttttctttttctttttgtgtttggccttttgttgcagcgtcattgttgtacaccaccagtcacactattgtgggatgtgataatcggtaccttttaatgtcaggagcttctttcttacattttccacttcaaacaaaccgataattcagaggaattttctcttcctctctctctctcttttttatattttttcactgggaaaa

SEQ ID NO: 12377 - DNA, 3000 bp, Unknown
  misc_feature (1)..( 3000): cDNA_ID_2708787_gDNA_ID_2214546_Annot_ID_134586 3000 nt of promoter + ATG
atagtaggagcattcgttatcaccctacaaagagtttataaaagatcatgcaaactcgagactagccttttatttgacatgagtggaaacaaagcttacctctcgtacagggtatccatatatatttagtggaacgtggctcatggatccacctgcattctttggatggtggaatttgcatgacgccccaaatttacaagttccagttttcaagtaaaactgccaggaaagcagagatcaataatatcacaaaaaaccttgtttcatcacttggaacatataaaatgactggtcggggtgggttacctggcatgggggttcaccaaaacgttcaggatactgcccggtagctctaacagttgcttcaacctatacatgaatcaacatgagaaaatagtaaactgtggccaagctaagatgacaaaatgataagcttttacaagagcatacaaaggtatcagtaaatacagggaaacaccgggtagagtcaatgcataagacaaaaaaaaacgtgacgtaaagcacaacaactgaaaccagtaaagcttaacaatttccccagtttagagagactctataaggccagtgatcacccacattgcggaaaaaacagagagaagcatttgattgtgtcctcctagtatggatggtttcagaacaataataagaaagaagaatgaatgagaggaagaaattaccgaggcacgatcgcgagggtgattgtaacgacatctattaccgtagccacagacaccagttcgcatgtagtaggcacagtcaggagcacctggtctctcagggtacgagtcgctacccaaccctaatcgccacatcgattctgcaaatcacaaaattgagcacagtcagggccatttagcggaaaccctaaagagaccgtacagttgctgagaatcaaagcgcatgcgagaccttggagtccggtatcggcatctgcaggggtccagtcgggagcttgagcagattgtgagccattgaggggaggattgcgagcatacatgtccttaaatttagggatttggtgtacagtaaaaaagatactagtaaaaactcctctcaccaaactagaagaaactaataagagagtaaatgtcaaaagctcatcggtggatcgacagagatttaccggagaagccgattagaaaagctctgagagagaagaaaaaaagaagaagaagaagaagagatgcttcgacagtgattgagaggagcttcttctttggtcggtctctctctctctctctctcttctttcgctcttcaggaataccgtacggtctgccctctgcactactgtttctttttttagctttcaatttctttttctcatattcttttttaaataataatagtatatagtagtagtttgtattaatttgttttgtgagatttatttttggttctctcttggtccttgggtcgccaagtaaaagcatcccagaaaagggaagatatttccaagaaatatactacttgacaaaacaacaaacaaaaaataaataaactaatttttactagtttccaaccaaaatgacggtaaggtccttgggcggggatagcgcgcgagtggccaacatgtgacacacagacagttttctcacttcacttgctaactcggggagtaaagtggtctggtccgaaagtggggacacatccgtcatttctacctgctactgtttcttaactgctctctcaactcgctctgaccgagtctgactcgactcgactcgccttcaatcaatgccatcacatttcttcgtttccgcttcccatttgtcggcgccacaaaaaccttctgttgttcacgaagccctctagtaccatatataggcccatttatatagctaagtcggcccaattatgttgttagtgtgcgcgggccaaattttagattcgaaaacggcagcgtttgagctgttacttttttttgctcttcttgtcaacaaatcgacactgccgactaaacagcgaaaatcccaaacaaaaaaataaaagaatggcgtctctgtgcctttctctccaccaaaccctaactaatcccctgtcggctcccagatgcagaccactcagcctctccttccccggatcctcaaccttctcgatccgcccctctagcagacgcgcaaccgccttgacgacccgcgcctcctacaccccgacgccggcgactgagcgcgtgatttcgatagcgtcgtacgcgctgccgttcttcaattctctgcagtacgggcggttcctgttcgcgcagtacccaaggctgggattgctgttcgagccaatcttcccaatcctgaacctgtacagatcggtgccgtacgcgagcttcgtggcattcttcgggctgtacctgggagtggtgaggaacacgagtttcagtaggtacgtgaggttcaacgcgatgcaggcggtgacgctggatgtgctcctggcggttccggtgctgctgacccgaatactggatccgggtcaaggaggcgggtttggaatgaaggcgatgatgtgggggcacacgggggttttcgtcttcagctttatgtgttttgtgtatggagtcgtcagctccttactcggcaaaactccatacattccatttgtcgctgatgccgccggtagacaactctaattccggccaatatctacctcactcagtgttcgggttttcgattctagaatcggttatttctggtttataagagagaccaaatcaatcagtgttgttaattaaccattaccgttttaaaaaaaatattttttgttatactcccaacatttgatttggcccaatatgaaagaacagtatggggggcctttaatgaagctatcattgactgagtataattttacaatcgtcggtgaaaaggtaactaagtaaacggtaaaaaaatgagcgccgtctatcttaccgcgcaatgaatgagaagtcaatttgggaaactgatcggagaaaagagggagagagggtttctcagctgaaatcaaaatg

SEQ ID NO: 12378 - DNA, 3000 bp, Unknown; identical to SEQ ID NO: 8349
  misc_feature (1)..( 3000): cDNA_ID_1836253_gDNA_ID_2214546_Annot_ID_134589 3000 nt of promoter + ATG

SEQ ID NO: 12379 - DNA, 3000 bp, Unknown; identical to SEQ ID NO: 8348
  misc_feature (1)..( 3000): cDNA_ID_3024907_gDNA_ID_2214546_Annot_ID_134592 3000 nt of promoter + ATG

SEQ ID NO: 12380 - DNA, 3000 bp, Unknown
  misc_feature (1)..( 3000): cDNA_ID_2708783_gDNA_ID_2214546_Annot_ID_134593 3000 nt of promoter + ATG
gctctctcttctcttcagatattcgagattttgaatttattttcccagattttacggctattaatacaacttatccaatgaatattcgccacgtgtgtatcaaatacccaaaaaaatcctcttaattaccatccccaggcctttttcattgtaagcccacaattaggcccacgtatgtaatttgaagatagaacacatcgtttttcattcattgtgatcgatcaagtcgaagagctcatcgccgataccgaatccgagcatcctggccatgtcgctcgtcttcaacctgggctttgggacgccgtgccgtttcagccacggataaaccacaaacactttgttcattacgaaaagctccaacgcctccggattgaaaacgacacccattctcaagctcatctggtgcggcactaacatggctgcgtatcgagcaagttctccagctcgccagtccagcagcagaggcagccaagggtacatcgcgtcgagcctcacgaaccatagtcttacgtccgggtactctgacagctcccgcggatccccggggtcttctctcttgtaattgatggtgaatccgatggttcgatccaaataccgttttggttcagctacaccaaaatcatcaggcgaggttatgccgatggctctctgaaacggggataggtcaagccgcccaattgagtcgttgtcgatcactacttcgtaccggccggtcgttggaggcatcggaggttccactttatctgaatctgctacgcctttcacataattaattagtagcagcctttttttatttatcattctgaatcaattgagcaagtacgaaccttggtcattctcgaaggcagagatgtcgaaattgccagaaggattgaaggcgacggagactgctacgtcttctgccctcctctttcttacacaccacccggcggtctccaacgccggcaattgaaccactgggaacagcgatacgtgtctcggcgatgggataagccacgggagaagaactgcctttgttgccattcacagacgctatctctctttgtgtcttagtcttctttttatcctcttcttttggccttttcttcatttctttccattttatccttttttccttcaccgcacaaatacatatattttgctgtctgtcgtaaaggtttcaaatgttaagcagaatgcatttcttcaatcgttcagaaaaatgaagagctctcttctttaatgtggaatgttttcaactcaagtcagcctcctcggtctcatgtagatgtaggcattgtcgaatctccttcactgttggtgaggtgtttcaggagcatctgcaagcttgaccgtctctgatcttcttcttcgccattgccccttgcaagcagtgaggccttctttgtcttccaaggtcgtaccgggtcaaaggagttgcacaatagaggctttgtaagtaagtagctcaaagactgagaattctgctcactttaaagtttaaatagctatgcaatggaacattccttggcaaagataagtccccaaggtctctaccatagcagtggcaaagataatatgatttgagagaaaaagctcacctatgcaatctagtaagatgaacataagcgtcaaaagatccacttcacagtgtcttagagtgcctgagaatgaatatctattataaggccaaatgatgattttgttgtagtgattaacttctttatgctgtgtaggcatagttaagatcgagacccatttagacttcaattcggcccatatagacgaaaaaaaggattcttacggcccaataatgttattttttataactcataacacctttttttttttttgacgttttcctttgtttgtttgtttttgtttacgttttgaccaaatcagtagttgtccaaatcattatttatatccaaagaaggaagatttcatcttaattatataaagtaaaacgttaaaacaccttttggcccattaaagcggcgaaagtgctgtgatcacggcaacaaaaagcttactctgcttagttttgttttgtcaaatacaattgcgtaaaaagaggaaaaacggaaagaaagtttccattaaaccaaagtattctatttgtaagtcttcttatcttcagatgtctattttatatgatgaattttgaacaagattttttagaatctagtcagttaccatgtttatttcggtgaagttccaacatttctagaaacattaccaaaacaaaagataacaacgagaaagagaaatacatagaaagcacactttaatttcgttatcatgtggcagcttaatttatttctataattgaaaagctttctttatatatatcccttaattaaaaaggcagaagataaatcggtaagaatacggtcaattagaatgaaatgtaaaactttgttaccaaatttagtttgaagaaaataatgataaaataataaaatgactgactgacaacaattaaaaatgagacaaggaaggaagcgattggataacacagagacagacatacatattcactcccccgtcaaaccctaaaatctatttcctctgaccgcttcttcttctgtgggttgtaaaaggcattcgctttcgagtgttggttgtcgatttcgatgccccaatctgggacctgggtactgttcccaagctccacctggattcttattgatgtgaagctcgtataacttgtgaatcgatgcggcctttttaatttcgcttgggatttcttaggtatttattctctgtatccggatctctatctataatcggatcttgtacctattgggttagtactcttgatctgaatgtaataagaagcgtgttttttttttttaataatttggaggagcttgtgttttagttcgttgagatctcgttcgttccgaatgtgggtttattagggttcttgaaaaagtctgcaactttgaattaggtgcattaccaagaaatatatagagactgcttctagttcgttattagttagaattcagagccatg

SEQ ID NO: 12381 - DNA, 3000 bp, Unknown; identical to SEQ ID NO: 8345
  misc_feature (1)..( 3000): cDNA_ID_1376179_gDNA_ID_2214546_Annot_ID_134594 3000 nt of promoter + ATG

SEQ ID NO: 12382 - DNA, 3000 bp, Unknown; identical to SEQ ID NO: 8348
  misc_feature (1)..( 3000): cDNA_ID_3024907_gDNA_ID_2214546_Annot_ID_185430 3000 nt of promoter + ATG

SEQ ID NO: 12383 - DNA, 3000 bp, Unknown; identical to SEQ ID NO: 8349
  misc_feature (1)..( 3000): cDNA_ID_1836253_gDNA_ID_2214546_Annot_ID_185427 3000 nt of promoter + ATG

SEQ ID NO: 12384 - DNA, 3000 bp, Unknown
  misc_feature (1)..( 3000): cDNA_ID_2038779_gDNA_ID_2214546_Annot_ID_185426 3000 nt of promoter + ATG
tggattgaaaagagtgataaataaagtgatgtttgtacccttctttgatagaaatggaagcaatagtaacagtcaaagcgagaatgggatgattcatatcaatgccgtgatgatgtccactatgaattacctcaggagctgcggacagtgcaatctgcaaatgagaaaggaagggagaagaactctgtaaattgaatttattatatcccaaataaaacaaacaatggaggatcgataaaagataaacatgaagtgcaatatattctcatacaatgaagcaaggttgtggaggtggagatgagtaattaaaaaagaaagagaaaggagagagtggtggtcatacagataaaaggtctaaagcatgccaggcaataccagagccagtagccaaaagcatggcagagatgccaagtgctccaagcgtttcaaatttaccatgacctgcccttgtatgcatggggaaattcagttcattgttattataatgtatttacatcaaaggaaagagaagagaaaaggtaaccataaggatgttctttgtccttgggaacatttgcagctctgtaagacactagagcaacaccacttagaacctgagatataatgatgatgatcatgtgagaaacaaaaccaaaggaaggatcatctctcgtcctcagcaaatgagaattttcattaccacatcggaaacggaatgagcagcatcggcgataatggcggtgctgccgcagagataaccggtgagagcttttgcgacagataaacctatatctgcggtgagacctagccggaatatcttctccccttcttctccaggcttttgatattgctggtgatgatcagggtgaccaaaatgccaccttctggagaaatcgaaactaggtttttgcgatgaagaagaagatactcggagtggtgatgatgatgatgatgatgatggcagataacggcaagacatataatatatagtagacctacaaatcctcgtcggattcaggatttgaaatctgataatacccattttgatttcagctgagaaaccctctctccctcttttctccgatcagtttcccaaattgacttctcattcattgcgcggtaagatagacggcgctcatttttttaccgtttacttagttaccttttcaccgacgattgtaaaattatactcagtcaatgatagcttcattaaaggccccccatactgttctttcatattgggccaaatcaaatgttgggagtataacaaaaaatattttttttaaaacggtaatggttaattaacaacactgattgatttggtctctcttataaaccagaaataaccgattctagaatcgaaaacccgaacactgagtgaggtagatattggccggaattagagttgtctaccggcggcatcagcgacaaatggaatgtatggagttttgccgagtaaggagctgacgactccatacacaaaacacataaagctgaagacgaaaacccccgtgtgcccccacatcatcgccttcattccaaacccgcctccttgacccggatccagtattcgggtcagcagcaccggaaccgccaggagcacatccagcgtcaccgcctgcatcgcgttgaacctcacgtacctactgaaactcgtgttcctcaccactcccaggtacagcccgaagaatgccacgaagctcgcgtacggcaccgatctgtacaggttcaggattgggaagattggctcgaacagcaatcccagccttgggtactgcgcgaacaggaaccgcccgtactgcagagaattgaagaacggcagcgcgtacgacgctatcgaaatcacgcgctcagtcgccggcgtcggggtgtaggaggcgcgggtcgtcaaggcggttgcgcgtctgctagaggggcggatcgagaaggttgaggatccggggaaggagaggctgagtggtctgcatctgggagccgacaggggattagttagggtttggtggagagaaaggcacagagacgccattcttttatttttttgtttgggattttcgctgtttagtcggcagtgtcgatttgttgacaagaagagcaaaaaaaagtaacagctcaaacgctgccgttttcgaatctaaaatttggcccgcgcacactaacaacataattgggccgacttagctatataaatgggcctatatatggtactagagggcttcgtgaacaacagaaggtttttgtggcgccgacaaatgggaagcggaaacgaagaaatgtgatggcattgattgaaggcgagtcgagtcgagtcagactcggtcagagcgagttgagagagcagttaagaaacagtagcaggtagaaatgacggatgtgtccccactttcggaccagaccactttactccccgagttagcaagtgaagtgagaaaactgtctgtgtgtcacatgttggccactcgcgcgctatccccgcccaaggaccttaccgtcattttggttggaaactagtaaaaattagtttatttattttttgtttgttgttttgtcaagtagtatatttcttggaaatatcttcccttttctgggatgcttttacttggcgacccaaggaccaagagagaaccaaaaataaatctcacaaaacaaattaatacaaactactactatatactattattatttaaaaaagaatatgagaaaaagaaattgaaagctaaaaaaagaaacagtagtgcagagggcagaccgtacggtattcctgaagagcgaaagaagagagagagagagagagagaccgaccaaagaagaagctcctctcaatcactgtcgaagcatctcttcttcttcttcttctttttttcttctctctcagagcttttctaatcggcttctccggtaaatctctgtcgatccaccgatgagcttttgacatttactctcttattagtttcttctagtttggtgagaggagtttttactagtatcttttttactgtacaccaaatccctaaatttaaggac

SEQ ID NO: 12385 - DNA, 3000 bp, Unknown; identical to SEQ ID NO: 12377
  misc_feature (1)..( 3000): cDNA_ID_2708787_gDNA_ID_2214546_Annot_ID_185423 3000 nt of promoter + ATG

SEQ ID NO: 12386 - DNA, 3000 bp, Unknown; identical to SEQ ID NO: 12374
  misc_feature (1)..( 3000): cDNA_ID_1834169_gDNA_ID_2214546_Annot_ID_185412 3000 nt of promoter + ATG

SEQ ID NO: 12387 - DNA, 3000 bp, Unknown; identical to SEQ ID NO: 12373
  misc_feature (1)..( 3000): cDNA_ID_2729568_gDNA_ID_2214546_Annot_ID_185410 3000 nt of promoter + ATG

SEQ ID NO: 12388 - DNA, 3000 bp, Unknown; identical to SEQ ID NO: 12372
  misc_feature (1)..( 3000): cDNA_ID_3024937_gDNA_ID_2214546_Annot_ID_185408 3000 nt of promoter + ATG

SEQ ID NO: 12389 - DNA, 3000 bp, Unknown; identical to SEQ ID NO: 12370
  misc_feature (1)..( 3000): cDNA_ID_3024947_gDNA_ID_2214546_Annot_ID_185404 3000 nt of promoter + ATG

SEQ ID NO: 12390 - DNA, 3000 bp, Unknown; identical to SEQ ID NO: 8344
  misc_feature (1)..( 3000): cDNA_ID_3024891_gDNA_ID_2214546_Annot_ID_185442 3000 nt of promoter + ATG

SEQ ID NO: 12391 - DNA, 3000 bp, Unknown
  misc_feature (1)..( 3000): cDNA_ID_3045094_gDNA_ID_2214546_Annot_ID_185440 3000 nt of promoter + ATG
tttaattcttttaatcaaagcatgatttaatgtaaaattatactactgtatgactacttttcttaaaaatataacctaggcaacttgttcatgtgggtctactcgttaggtgcttcattttgaatgatcatgtttaattgcgtaacgagataagtaaactggttaattgcttgtgtgacaaaagatacatatcaaatttaattaatcattaactttgattaaagaagtaggcggcatccccaaagtcaacaaataaaatcaaaggtttctggtttaatccacgcgttgccccatccatattccctttatttctaaacgaaagcgaccgccatttccgtattttgtctccctagcaccaaaattacatgaccatttatttacttacgtggttctttttttctttgcagcagaattatataaatatgcaacactggttagtctaacgctatagatatggatgatattttagatatctatatatacatttttgcagccattttgtaaaataaatcctagagttagaatttatttacagtggctgccactgacatttaataattgtttttgataattaaaaagaaaatctttgaattaaatatttgacaatcttcccaaaatctctccacattaattacacgattagttactaaaataaaacttcccaaaatatttaatcttatttaattactacaaaattatcatttttgatattgtttttctacatgactataataattcgattataatcatcaaaccgcagagatatttgatagcatttaattattacaaaattaaaaaatatttagacaatgattcataaacatatcataaataaaatcagtgagttttttttacaggacggattgacgggacgagtttgacaggacgttacttaataacaatcgtaaactataaaataaaaatattttatagataaatataatttgcaaacttttatatatagtaactttaaaaaataaattgtcttcgcggtataccgcgggttaaaatctagtaagacctaatagagtaccaaggctagaacaattaatacgagtatcgcgtatgaaaaagaatatacatgtattctgataactatataaagtagtagatgaaatgattttgattcatgaatctctatgttgagtgagaaaatgaatagcctgagacaacacaagtgtaatagctttcacgcttggacttgtgtctgaattttggaactgatgatgtttgctgctctttctagaagacctgttgaaaaaagcataaatacgctctgttttcaaatttggcaattgatatttgtttttgtacgtgtctatttaatttttggtaaagaacgcacgttgtttatacttacacaccgcccttctagaagaacaggctctcacgtcatttgcatacaacttccatcttctggaaccaatggatccctgttacaaaagttgctcttaaaacataaacaaaaacaaaagaaaagaaaacatttttatatttgtcgtcaataataatggccactttctgcttacatgtatatgaatgtatatattactataatacgtagctgctcgtgtttcttgtctaagttctctgttatagttaggagacaaataaagagaattagagaacagaagaccagaaaaataaagatgaacacaaccaacaacgtgtttgatgtgtcaccgttcttgcttttagaagcatctgcagattccgaagctggccacgacagcgttgacgatgataaatgcgttaaggattacgatcttggtcatgagtcttctagtgccagttcttgcgagacgtcttgcgtgagtcagagaacgagtttgttaggttttgacctgcaggacgatacggtgaatcatgaagaaagagacgccggagatgaagaagacgaagacggagaaggagaagtgaatagctacataagatgtgggagaagccaacgtgaaaatctggctgtggattctgctgcggtggtgagtgagatggatcaaaatcgaatgttctgggaagcttgtctcgcatcttgatctgtctttattaattaatgtcatctcatcatcaacagagaaaacaaaatagtatatatctagcttagcgtagtgttcttgtctgtgtttcccctttggcttttaatgcacaactaatcgatatgatatctacccattaaccttaattagtcccctttagcgtagtgtaaatttgttttgattcgtcaagagaaaaaaagtggtctaagggactgactagttggagaagaatccgtataaaatctgttaaaaggagaaacaatatactatactagtcttttctcgtagaggaggatgttatactaacattactaatttatgctcacccagtttaaataaaataaaatcaatacttttttggtttgtactaattaacatatatatatatatatattcccaaaattaaagattccatggctaacagacctaaagaagaagaagaacaaacacaataagagattggtgtagttttacttttactatattcatctttgtctttattgaccaataaagtaatttctcccctttatctatttgatagtggtatactttaagttgctttttaattgctggtgtacaattatattggactcaccaacaagaatctgtgtgcagtcagtgtgcttgttactattgttttatctcattaattgatgatcactttttcaccttcatacatgagagctgaattcatcactttgttagttatataagttgggctattctattattaacagtttgatttttgacagtaaatttgtctgccagaataacttatacacattaccacccaaaaaaaaaaaaaagaagaaccatttttggacattacgtggttttgggtttgtctagcgaccttttatgggccaatgatatgaggcccagtaaggaaacaaagaacggcccattataatgtaaacatatttagtacaaggaaaaggggtaaaaaaggaacaaggggaaagaa

SEQ ID NO: 12392 - DNA, 3000 bp, Unknown; identical to SEQ ID NO: 8345
  misc_feature (1)..( 3000): cDNA_ID_1376179_gDNA_ID_2214546_Annot_ID_185434 3000 nt of promoter + ATG

SEQ ID NO: 12393 - DNA, 3000 bp, Unknown; identical to SEQ ID NO: 12380
  misc_feature (1)..( 3000): cDNA_ID_2708783_gDNA_ID_2214546_Annot_ID_185432 3000 nt of promoter + ATG

SEQ ID NO: 12394 - DNA, 293 bp, Unknown; identical to SEQ ID NO: 12369
  misc_feature (1)..( 293): cDNA_ID_3024953_gDNA_ID_2214546_Annot_ID_185400 3000 nt of promoter + ATG

SEQ ID NO: 12395 - DNA, 3000 bp, Unknown
  misc_feature (1)..( 3000): cDNA_ID_2711892_gDNA_ID_2214546_Annot_ID_134597 3000 nt of promoter + ATG
acaaagatgaatatagtaaaagtaaaactacaccaatctcttattgtgtttgttcttcttcttctttaggtctgttagccatggaatctttaattttgggaatatatatatatatatatgttaattagtacaaaccaaaaaagtattgattttattttatttaaactgggtgagcataaattagtaatgttagtataacatcctcctctacgagaaaagactagtatagtatattgtttctccttttaacagattttatacggattcttctccaactagtcagtcccttagaccactttttttctcttgacgaatcaaaacaaatttacactacgctaaaggggactaattaaggttaatgggtagatatcatatcgattagttgtgcattaaaagccaaaggggaaacacagacaagaacactacgctaagctagatatatactattttgttttctctgttgatgatgagatgacattaattaataaagacagatcaagatgcgagacaagcttcccagaacattcgattttgatccatctcactcaccaccgcagcagaatccacagccagattttcacgttggcttctcccacatcttatgtagctattcacttctccttctccgtcttcgtcttcttcatctccggcgtctctttcttcatgattcaccgtatcgtcctgcaggtcaaaacctaacaaactcgttctctgactcacgcaagacgtctcgcaagaactggcactagaagactcatgaccaagatcgtaatccttaacgcatttatcatcgtcaacgctgtcgtggccagcttcggaatctgcagatgcttctaaaagcaagaacggtgacacatcaaacacgttgttggttgtgttcatctttatttttctggtcttctgttctctaattctctttatttgtctcctaactataacagagaacttagacaagaaacacgagcagctacgtattatagtaatatatacattcatatacatgtaagcagaaagtggccattattattgacgacaaatataaaaatgttttcttttcttttgtttttgtttatgttttaagagcaacttttgtaacagggatccattggttccagaagatggaagttgtatgcaaatgacgtgagagcctgttcttctagaagggcggtgtgtaagtataaacaacgtgcgttctttaccaaaaattaaatagacacgtacaaaaacaaatatcaattgccaaatttgaaaacagagcgtatttatgcttttttcaacaggtcttctagaaagagcagcaaacatcatcagttccaaaattcagacacaagtccaagcgtgaaagctattacacttgtgttgtctcaggctattcattttctcactcaacatagagattcatgaatcaaaatcatttcatctactactttatatagttatcagaatacatgtatattctttttcatacgcgatactcgtattaattgttctagccttggtactctattaggtcttactagattttaacccgcggtataccgcgaagacaatttattttttaaagttactatatataaaagtttgcaaattatatttatctataaaatatttttattttatagtttacgattgttattaagtaacgtcctgtcaaactcgtcccgtcaatccgtcctgtaaaaaaaactcactgattttatttatgatatgtttatgaatcattgtctaaatattttttaattttgtaataattaaatgctatcaaatatctctgcggtttgatgattataatcgaattattatagtcatgtagaaaaacaatatcaaaaatgataattttgtagtaattaaataagattaaatattttgggaagttttattttagtaactaatcgtgtaattaatgtggagagattttgggaagattgtcaaatatttaattcaaagattttctttttaattatcaaaaacaattattaaatgtcagtggcagccactgtaaataaattctaactctaggatttattttacaaaatggctgcaaaaatgtatatatagatatctaaaatatcatccatatctatagcgttagactaaccagtgttgcatatttatataattctgctgcaaagaaaaaaagaaccacgtaagtaaataaatggtcatgtaattttggtgctagggagacaaaatacggaaatggcggtcgctttcgtttagaaataaagggaatatggatggggcaacgcgtggattaaaccagaaacctttgattttatttgttgactttggggatgccgcctacttctttaatcaaagttaatgattaattaaatttgatatgtatcttttgtcacacaagcaattaaccagtttacttatctcgttacgcaattaaacatgatcattcaaaatgaagcacctaacgagtagacccacatgaacaagttgcctaggttatatttttaagaaaagtagtcatacagtagtataattttacattaaatcatgctttgattaaaagaattaaataacgggatataatcatttatccaaagaaacacaaagagagagagatataagtaatcattaaggtttttggaacgagaacgatcataagtgcagatacaaaaaggattacttatcagttatcatacctaatttgtttatacgtgaaaaagatttctaaaatgtatattcaaccttgtctaaaaatatttgaaagtaatagagatattggtgtacctcatctggtggccccaatggttgtgaaatgggcagctccatagaataaaaacaaaataggcccattaatgttaaaagggggcccattaggacccagtggtaattatgaaaatatggggaagaagcagggtcaagtgaagatggaggcgccaaagaagcgagagtggataagaaaatcaaaaaaaggattctctttttctctctttcttctcacttctctctgtagttagtgtgtctctctcgccggccgatatg

SEQ ID NO: 12396 - DNA, 3000 bp, Unknown; identical to SEQ ID NO: 12391
  misc_feature (1)..( 3000): cDNA_ID_2685819_gDNA_ID_2214546_Annot_ID_134599 3000 nt of promoter + ATG

SEQ ID NO: 12397 - DNA, 3000 bp, Unknown
  misc_feature (1)..( 3000): cDNA_ID_2708822_gDNA_ID_2214546_Annot_ID_134601 3000 nt of promoter + ATG
tttgtttcttagtagaaaataatttggctcctttgtagaagaagaaaaaaactaaacggctttaacatatggactacgccgtttgtatcttgttgttacaaaccattaaacgttactgtttgatcaatatgttaattcagaactgtttggtttaaagcataagtattgaagtcgtcaaatgaacaacttgcaatcttttgctttgtatgagatacaaataaaatcgtggtccgtttataaaatagctttctccaaacaatttcaattcccttttaactaacacaacaaacgacccggcccgtcaaaagaagaccaacagacgatgaaataaaaggaaaaactcaattttctaaactatttttgggggtcgtaaataagtgaaaagcctgccgacgaaaaaagaagaagtgaaaaaagaagtgaaaagcccttgtcttatttgtcttttactatttttctgatttaaaataaagaaacaaacatttacagtatttgtttataacgggggctaagtagagaatcatgagaagattaaaatccctaaaagttttgggggaaagaagaaagaaggaagacgatgatgatgctcagaatccgaagcagagatggactggagagagtcacagcggagggagctcatatcactgtttcccagctcaaaaccttgatcgcggatcagcttcagatccctctccataagcagaccttatccaccaatcgtgatctcctcctcgccaaaactcccgctgatctactcgccttcaccgacctcacggacccaaacctccccctctcctctctcaacctcggccatggctctatgctctacctcgcctacgatggcgagcgctccattcctggagctcctcccgttactcctgccggatccttcgggaggaagatgaccgtcgatgacttgatcgcccgccagatgcgcgtcactcgtcaggagacgtctcactgcgactccgtctccttcgatcgcgatgccgccaacgctttccagcactacgtcaatgagtctctagcttttgccgtcaagcgcggcggctttatgtacggcaccgtcaccgaggaaggacaggtggaagttgatttcatttacgagccgccccagcaaggcacggaggctaatcttattctgatgagagatgctgatgaagagaagcgcgtggacgcaatcgccatgggcttggggatgaggagggtcggtttcatttttaaccagaccgtggtgcaggacaagactgaatacactctgtccaacgccgaggtgctacaggcggcggagcttcacgccgagagcgagctgaaggagtgggtcacggcggtggtgaagcttgaggtgaatgaggatggtggcgccgatgtccatttcgaggcgtttcaaatgagtgatatgtgcatcaggctgttcaaggaagagtggttcgagacggagattatgccggacgatgatccaaagctctctaagatgaagaaggaggtggttgttggtgtgaaggatcttaaggaggtagataacgatttcttcctcgttctcgtcaggatcttggatcaccaggttcgtgtttttctctctacccttcctttgcatcaatcatcattgttctttgtactaatgctctgcttgggcaaataaagtaattgaatctggagcttttaagtcttaggttaatgaagcttgtcagtgtttgctttccatgagataattgaaaattagcatttcgtcaatggtccctgtgttttaacattaggctgctgtgatcaggggcctctgtcatcaacattcccaatagagaaccggagcagtcgagcaacgatgcgggctctaaaaacacatctggaccgggcaaagagcttgccgttggtgaagaagatgtcagattttcatctgcttctctttgtggctcagtttctggacgtgtcatcggacgtccctgctttagccgagtgtgtgcgtctgcagtcgcctgtcccagagggctatgcgttgctcatcgaatcaatggccaacacttgttaatttttgtgtcattgttttttggttcttgatacagtatatcatgttcgttttatggtccagaaaatcttttttactagttgacaaatgaaaaatctctagtgtactcgtgatgtatttgattcaagtttgggggttaatttaagttatcaacaacttgtagaaacaaagttaattcacagagtaataaatcattctaataggtatgctcaggggcaaattggcaaaacataaaaataaaaagagagctactaaagttttcgagcgaaagcgaaaatgaaaattttataattcgagcgaaatgttaaaaagctgaaaattgggggaagaagagagaagagtttcatcgtcactggaatcaatagagtcaattggcgggagaggttagtctcgaaaagaagtggaagccctagggggaaactttctcgctcactcgctcgtctgcaaacaccatggaagacagtcctcaaggccttgtgagtctctctttgcttgtttgattttgtttgggaattttggattactcttaagtttttctgctgggcgtgtagaaaaggagtagagatccggatcaggatcaggatgacgacagcggcgaggctggcaaggccgacggaagcggcggagagaatcaggagcgcagcagcgaccagattgagctcgatgacgacgatttccaggaaacccgtcccaagcccaagcgtagtcgcacccatcctcctcaacagaatctcattggtacaattcatattcctaaatcgctccaagctttgtgccaattgattgtttcctaaattgattgattgtttttcttagagagcttcatcttgtttgtttgggtagatctttcagctttcatattttttttgctaacagaggttgtcaaaggcaacggggatcttatttctaaagccgtcaagatttgggttgaaagatatgaagactctcccagccttgctaccactgagctcttgtca

SEQ ID NO: 12398 - DNA, 3000 bp, Unknown
  misc_feature (1)..( 3000): cDNA_ID_2711934_gDNA_ID_2214547_Annot_ID_134604 3000 nt of promoter + ATG
caccgtattggtgggggctgaccgttggtggtatgatgggaaccggtgctcacgggagctcattgtggggtaaaggaagtgcagtccatgattatgtgaccgagatcaggatggttagtcctggttcggtcaacgaagggtttgcaaagattagaattttaagcgagactacgactcctaacgagtttaacgcggctaaggtttctcttggcgtccttggcgttatctctcaggttagaaaacttaaaatttcagtttcagtttttactacaaagctatatcatatttctaggccattttctttagatgtttacattttgtttttgtttttttaaaggtaacttttgaattgcaaccgatgttcaagagatcgctgacatatactatgagaaacgattcggattttgaagatcaagccgttacttttggaaagaaacacgagtttgcggatttcatatggttaccaagccaaggaaaagtggtgtatcgaagagatgaccgagtagcggtcaacacatcgggcaatggtttgttcgatttcttgccattccgttcacaactctctgcggcaatagccatcatacgaacatcaggtacttctcgtctatcctttttctaagggtttgcgttgacttttaaaaactgaacgtaaaggtacaatcttgttcgtataaaaacaaagaaaaaagggtacaattttgtccataaagtttatctttaaatcaaagaaaaacattatccgatccagactcccattttgtatgaaattttttactcagtaggtttcattttcatttaagtcctattaaattttttaggtattaaatttaaaccattagttaaccaaaaacacaagataaattttcagtggccttattagaagtagttggtccataacccttaatagaaccattagttaaccaataacaaaataatcaggttatttttgaatttgtatataaaattataactcttggatccaactaggcaactaccgatatttaaataagagattatcaggaaaacaaaatgttgatatacagaattctacacgtaactttaatttgttttcgtttataataataatcaagaggagacgcaagagaggttcagagatgcgaatgggaagtgtgtgggagccacaataatttcatctacactgtttgctccctcatacggtttgaccaacaatggtaattatttcttttcattttacttacacgttttcattgattttacgtacagagaatattcttgcttacctacctttatgtttcaataggcattatattcactggttatcctgtcgttggaagccaaaaccgtatgatgtcgtcaggatcgtgtctagacagccttcaagatggattgatcacggcgtgtgcatgggactcacgtataaaaggcgaattttttcatcaaacaactttgagtgtccctctcacccaagttaaaagttttatcagcgacatcaaatcacttgtaaagatcgaacaaaaatctctgtgtggccttgagcttcactatggtattctaatgcgctatgtcacatcatctcccgcttatctagggaaagaaaccgaagccctagactttgacataacatattaccgagctaaagacccgttaacaccgcgactctacgaagatttcatcgaagaaatcgagcaaattgcattgttcaaatataacgcattgccacattggggtaagaacagaaacttggcgtttgatggagtgattagaaagtacaacaacgcacccgcattcttgaaagtaaaagatagttatgatccaaaaggtttattctcgagcgaatggacagatcagatcctaggaattaaaggaaacgcgtcaatagtaaaagatgggtgtgcattggagggtttgtgtatatgttcgaaggatgctcattgtgctccggcgaaaggctatttgtgtcgaccgggaaaagtgtacaaagaggctagggtttgtacacgtgttgatgggataataagtgttatttaaacagtaagttcttaattttcattgcttcttatatcagtaacagccatcgtctatatgcgtgggtcaatatttattgtgagcctaataatgttattgtgttgcaacaataatgttttattgattcgtgctatagtgttagtacgtaaatcatttcaatcggccgtgcggaggaggatcttttatttatttatattccacagatctattcttgttccttttactatgaaaattggaagagtagttatagtagatatctgttctggttctggctagctataggttttcctagtaaatgtgggggattttatcattttgtgcatacacagtttcttaagatgatacaattataatttttattttttatatcatatcgcatgaccacaccccaattattgttataattattaccgaatgaaaaacaaaaaccatcctccccaaaatgcgcaacgtctcgtgccttcccttgacgcccgtatagaatgggccatatatatagtcaaataagtattcccactaaactatgcaagtcgtcgtacgtctatccttttttattgaacatatatacacaatttgcaaaatattaaatatcgaaacattttttaatgataatattaaatcatggcagcgccgatgaggttatcactgacatacaaggatacggtttccataatatatgaaaccaagttaaaagaaaatatagaaaatctacatttacttgattttgcaagtctttaagaccatgtgatataaatgaaactaacattgacagctcaaaagtaatggatcgaatgttattagtcgttatatatcttacacgctagcatgatgcatctcatccagccttttatgaatttatcaaccaaacatattttatgtaaaatatcaacaagctagcatgatgcatcactgaaccggcctttaagccacaaccactatatataccaaacatttagaaacgcctccattagacaaaactcaataaaaaccatg

SEQ ID NO: 12399 - DNA, 3000 bp, Unknown
  misc_feature (1)..( 3000): cDNA_ID_2711930_gDNA_ID_2214547_Annot_ID_134605 3000 nt of promoter + ATG
atttgcatcattttacatcgatcgaatattaagtcactcctacctttattatggtttaaacattcaccggctttaggcatgatatttaccggttatccggttattggaagccagaaccgtatgatgtcgtcaggatcatgcctagacagtcttcatgatggattaatcacagcgtgtccatgggactcacgtataaaaagtgaattcttccaccaaacaactttcagtattccgctcacgcaagtcaaaagtttcatcaacgacatcaaatctcttgtcaagatagagtcgaaatctttgtgcgtgcttgagctatacgatggtattctaatgcgttatgtcacatcttctccggcgtatctcgggaaagaaacagaggctttggactttgacctcacgtattaccgagccaaagatccgttatcaccgcgactatacgaagattttatcgaagaaatcgagcaaattgcgttgttcaagtataacgccttgccgcattggggtaagaacaggaacttagcgtttgatggagtgattaaaaagtacaagaatgtgccggcattcttgaaagtaaaagaaagctatgatccaatgggtttattctcaagcgaatggactgatcagatcttaggaatcaaaggaaatgtgacgataataaaagatggatgcgcattagagggtttgtgcgtatgttcggaggatgctcattgtgctccgaccaaaggatatttttgtcgaccaggaaaagtctacaaagaagctagggtatgtacacgtgctgatgacataagtgtgattcaatcactaagttactaatcttcattgcttcttttttattttttcattactaatttttcattgcttgttttagatataagatacttatcttctttatatgtggtcgatatttatcatgacgagttattgttaatgttgtggtagcaataaaaatgtaagaggcagaaaaaaaaaaaaaaaaaaatcgtgaggcacgatgcctaataatttcgatgtcttggttagtttctacttttgactaatgaaaaggaattagaaagaaaaaaaatcaaagtcaaagtacattttaaggtgtcgtatcttgaaacttgttccactgaggagtgagggttatgggtttattatttattttaccaaatgcgcatgttcataaatcattaattaggtcattttctgccttgcgctacaaataagaccctttgttttttttttttttttttttaaataagaccctttgttgcgaaaacaataatgatgttaataattgaggacaaataaactacgtactttttttttagcaaacgacaaataaactacttaagagatataaaaccaaaaaaaaaaaaaaaaaaacttgtgagatatacatataccttaaataacaagataaaattttaggattgagtatcgtggacttcaaaatttgaaccgaatacgaaataaaattcgcaaagttcaagatactgacatgtgtgtgcaaggaagaatagtttaaaaccctttaacaaaaaaaaaaaaggaagactagtttttttcttcaatatctgatatttattttcttacaaacactatttctattaaaactttatttttgtattagaaattaaataggattttaaattcattagattatgtttcagattagtgctaccattatatgtatttgaagattacatatcattacacaatgcagtaatatatattctgtaggatttatcaaaaaatttggagaaaagtttgaactatgactagtactgactttcatttattaagattactcccatggactttcatttactaagattactcccatggactttcattgaatcatttactttgtgtgtgaaggcaacggcttgtgaaaggcgtgcgtaccttggcgatcttatcttctttcaaataaaattgattattcactgtatattggacaaaaccacaactaatgtttttttattataataaaactcaactagtgggtgtagtatataggccatgaatgtctataattttaaaatagttttctggcttttggtttttattttttagttttagattattttttttcttaaaaatttgaatggtagtttgttgggtgtcctactttatttagtttttgatttttatgttaatggattatattttcgttagaaaaaaagaaataaaaaatatgattgatgatttttgaggaaaaatcccaagtcctaaaaattacagattttagtttttctttgaaaaatagttaaacactgaaaaactagttttttatttcttagattaataaattgttttcaatttaaatcttgaatgactataaaataaattttggaaaaaaaactaaaactaaaaattagttcaaaaactacgtacaaacattcaaggccatatatagcttaatatatgaattcaagacattacagacttgagttattaatataatgctactacagtagttgaaattatcgtgtacatgtattagctcactaaaatatctaagtcatcgttggttttttcaattttcataaaatcaccgggtgaataatttgactaaacaagaatattttttttttgattaaagactaatgagattgccatagactatgatacttgataagaatatggtcaagtcttttaagacaacgtaatagaaatgaaattaagaagacagtccataaaaatgaatggaatattataaaataatcgaatatgattaattagtggttaatactctcttacgtacaagattgcatgaaccatctcatctcaacctcttttgatttaactaaacataatattttatttaaatactattgaacccgccttaacgccacacaatatctatatataccaaatatatttacaaagccgacattcacaaatcacaacaaattaagattcaacaaaactgaatcaaaccccatggcatttacttttcctccttcgtatcgcacgctagtcgggttatattatatatttacacttatg

SEQ ID NO: 12400 - DNA, 3000 bp, Unknown
  misc_feature (1)..( 3000): cDNA_ID_2711926_gDNA_ID_2214547_Annot_ID_134606 3000 nt of promoter + ATG
atgcatgtattatgtatatgcaaacacactagcatacttcagactataacacaccatctctttccgatcgtgactacacaaaagctaaaaccgcttcacaagggagataaagtccgacgagaacggatttgccgacaaaaattaacctaagtccatcatcgttttccctcactttattacttatttatcttacactaacgagtttcgaggatgattctctcaaggcatattaggatttttttttgatgctcctttaattcactgtcctttgatgtctatatcgctcaaccattttgctctttttacctttattaaatttctcaccattaatcatacacatatcttatctctaacaaacccacaaggattatggagaaaaaaaaactaaaatcataattagaaagagatagccaactcaatcacctataataacctcggaatgagttgctttcgcaatcaaaccatacaccttaataaccatgggagggttataaaccaaatcaagctaattaatttttgaaccatcaaccatgcagcgttgtcataaacaaatttaatggttattgagaaaatgcaccgaatgcgaatttattgccgacatcgatctacaattctacatgaagatgattattggactaacaattttcaacaacgagggtatatatatgaacaaaagatggtcgagataatatttatgtaagactctttataagaatataataaccaagaagatgattcagggtaggtgcgatgggatagtgcaagctcgtcccaacgaggtctaacatccatgtcggaaaaaatgtatatacaacagtctgattttacaaaaaaaaaaaaaaaacagtctgcttttgtgtttcaaatgtgaaaagttttttttttttcaataaatttgaaagaaattaatcaataaaaaggtgattggaatcttctgtttaatttttctcttttttgtatttaatttcccatcattttgatgtgattacaattgggtcagaatctattatgcttgaagcttcgcctttatggaaattgattcgaattatagttaacatgaatcatgtgtattcgtttacacatgacattgaatttctggggttatgacataagaaggttcgagtggtaataaacgtatatggttattttcattttcttaatgcattactcatatatatatatatatattaaaaatctagtcagtattcatatatatatatatatatatatatattaaaaatctagtcagtattcattatatataatgttttgtgataaaagtatatgttttaactgattttcaagtagaagctccactaataagtacttgagagatgaccgtttgttgaaagcttttgcatggtttttataataaaattatatatttgataaaaacatatttgtttaactgttatcacttaaacaatgaaaagtgtttgtataattacatttgatttctaatatagttgggttttagactggttgaaagttcattccttttgcattgcaacgggttatactactcccaagtaaaatgctgggcctgggctgaatgaccgaatgctatcttatatgtactacaattattattttttctaaaaatttaaaactagaatatcatttatcaaaaaagtaaaaaaatatgaaaacctatacaaagccaaaaccaaaaaaagaaacacacacacacacctacacgtttctttatattcgttcgtacatttgactagtcggaaaactacacgttcagtatgctgacttttctaataaattaaatcaagtggacggtaatattcaatacgtgcgtgtctcactgttttttttttttttttttttggctccactagtttgattaatacgtacgtacctaaagttaggcagactgagttgtttggtaaatcaactaataatatcttaacatacaataaacctaatatatttataacttgtagtatcatatttttgtgaagattctacggtagaggtttggaccgtgtggtgcaattcttcctagttactttgtgtgaaaaggaaaactacgaatagtgatggtaactgcacaaaacattaagcagcctgcataaagtatatttatttgtcgtaacgattacaattgtaattttgtaacagaaagaaacattataattggcgcaaaatttattaaaccaaaaaaaaaaaaaaaatggtgcaaaactttaaaaaagtaaagtatttctaatttgatgatatataagatatagtactctccagatctctccatttattgtcaattaagtaaaattttaagttgaaaacttatcttccgtaaataaacaaatgtgattggtacgaattaataaagcaagccaaaaaaatacatgcacaacttttaattgttaccaagtgacagtacgtacagtagttatgtggtcaactggtcattgctatgttgatgggggacatattacttttgatttctgctgaacacatttctgtggttattagaatgtttacatagcaatcatatataatctgtggacttaaaacttttatcaaatttatttatttatttaaattcatcggcttagttttggtttgattgaggtctctcatataccacaatcatatatatatatatatatatatattcaataatatagtattggatatatcataaaattaattaaagagattggctcaatacaaagttctctgaacattctttgtttgcataagtataaaaagatgtgataagttttggtatatagatttttattttttttagacaaaaatatttctcgttgaaatactaatgagagaagatgatcattaatcttatcttacaagcatctcatatctcagttcttttcctatcaaccagatataattaactaagtaacactaaaccgtccttttacgccacacaacctctacatacaccaaacgtatatatctatctactacacacacaaaaaaacaccaaatgcaatatacgtttgaaaagaggcccccccattaatg

SEQ ID NO: 12401 - DNA, 3000 bp, Unknown
  misc_feature (1)..( 3000): cDNA_ID_1808795_gDNA_ID_2214547_Annot_ID_134607 3000 nt of promoter + ATG
aattgacataggcatcaatgaaacctacaatacttcacgtgctcatggaaaaaacaccaacaatatataagtaatgccctcagaacttacttaaagatacgcatatattagaaatttaaataattctaccaacaaaaatttttgtaaagaactatttgtttgtagagttggatcagcatccagatttaaacccttatttttgtttttgccaagcatccagacttaatcctatattagatactgtatatgcatcttgatggaatatagactatatagaaagaccaaaaatggaagagtacgaataaaaatgcataatataccttggaaattattcttggttattgtgaaacttaaaacatttcaacgaagtcatatactattatttaatcattgatttaaaattgctaatcaaatcacgtgttgttgttatatatggataaagagttaaactataacacaactgagaaaaaaataaagttatcaattttgttaagaatcaatgaaggtttcacaagactgggaagaaaaaaaaatagatatatggagtacataaaacattaaaattttgctaaattttacttttgaactctattgattcgggttgacatgatgataatgttacattcgtacaatttcacaatgaaaaaaacgagtactaaatattgtcaatcaaacatatgaatgtacaaaaatccataaactctaccaaaatagaatgaagattctgaaatcaaacctactttttctttttaattataaattcaactatattataaatttatttatcacaaataatagaggagtgagaatattttagacaacgcaaatttcttttatttagttcttatactttattttttaccaaacgttaattaaaaaaatcacacatacataatttctaaaaaaaatgtattcttcaagtaatatatctttctgagtactagtttatctatttatctccgtatttaataatcaaaagttacgtttaaaatagaaacaacttttatcaaacaaaatatattagaaaacgcatggtactggctactggaaagaatcatgacctgtaaatttctacagttttcccgttttatatagtacttagaaactttggattttcatagcgcaaccaataaacacatggacttaagacacaaaaaaagttgggtgcaatgtcattaatcaaactaaaaaaataatgattaaaagcatggaattccgaaaacgcaacaaaatgattctgtgtttagacaaatgcagaaaggcctcttaactaatcttaaataaagtcttagttccaaccacataaacactccttagctccattaattttggttttcttaattacgtttctacacaagtacacgtacttacacatacaattccacagtctaaatgataaaactatgtggtttttgacgtcatcgttacctttctgtcgtctcacctttatatagtgtctctaacagaacgtaacaaccaaatgtttaaaaaaataaaaacagcaccccttaattaggctcattcgttttgcactaaccatactacaaatcatctcgaacgatcgagcaaagatttgaaaaataaataaacgtataactctagagattttcattagctaagaaaagtgaaatcgattgttaatcctatttcagacgggacaggaacactcattacccaactctatcatctctcgaacaccaaactatatctaccgtttggggcattatttcccactttctttcgaagacaatttcccatatataacatatacacattattactaatatatttttataaattttcgtcacatcccaaaaaaaaacactctttgtcacatcaactagtttttttgtaacgatcaaaccttttcgtttaaaaaaaaaaaacttttgtagtgtaaacgtttatttatcgatgaaaaaagccacatcttccggagggaaactttttaagacaccctatttcgactttattttgtaaatacagtgtgcatgtgcatataaagagagatatcatttgtataaatatcaagaattagaagagaaaaagagagaagaagacaatctattactattacgatgtgtgggttgttaatttgtttaaagggagcttttctatagagatttttaaggtcaagggtcatcgttcgatgtgggcttgcttcctacaatctagttgccttacggggcctactctttttcttttgataactacatcaccttttttttctccgacaactatatatcactttttttatgttttcctttttttcttcacaataattctttactcgttgcaaatgtaaagatacacaaagttacttattttgtttacgatggttcttagtagtttaaagaattaatgaataagataaacctaaactttgaaaagactaaaaaaaatgtataacaacatacattatacgtatttgaaatagtccaagtgatattatgtcattgatattagcacaaataattacgatgcctgatattgtcacatttgatgattttaagttcttgtaaaagataagtgtaactaaatcactatagtgaggcccacgttttaatttctaaactaattacaatgacaataaaatagcaaaactatttaaaactagacgccaaaaaaaattgaaactaataattgtgaaaaaagaacaagagaataataatcattaataattgacaagtgaaattaatatattgctcttggagggttatattttaattttcaaactaaataatgaatacaaatggaaaagctaatgataagagttgaattttaataattaagaaaaacaaaaaaaggtgtacaaggagacacatgcgttttcctcatgcatcttgtttttatacaacaatatatatatatatattgagtcattctctgctagctctctcatctccaactttcagtatgatatatagttacaattaaataaacctcacatgctctattcttgcttgatttttgagttaatcttgaatctctttgatgatg

SEQ ID NO: 12402 - DNA, 3000 bp, Unknown
  misc_feature (1)..( 3000): cDNA_ID_2708847_gDNA_ID_2214547_Annot_ID_185470 3000 nt of promoter + ATG
catcattgttttagagagggagaaagaaaaagagctcagctttctgatggagaggagtattcaaggacaaaacaagctctgtgtaatgtatcttatctcaatttggaacgttactagtttttatctttcttgtaatcttttctttcaactattgattcaaagatgtggacttgcatttactccttccaaaagagtccacaatggttgcattcaatgctatatgtgtttgttataccaaaaacaccaacaaatctgctctcaactgtttccctctctttgaaacattccatttttcattctaattttgtttcgctagactgacccactaaccaaaacccacactagtctacccaaatttaatatctctcttctcaatctcactttctcttcttactcacttggtaggtaactccttcccctgttttttcttttgttgcagtgtttggaccaaaaagtgaatgtgagaagaagcctacaagttcaagaaactgtagaggatcatcaaagctttgcccttgaagaggaagaacaacaactctcaactccgagcttgctgcaagacacaacaataccatttctacaaatgctgcaacaaagtgaagacccttcaccgtttttgtcattcaaagacccaagctttctagcactactatctctccagacacttgaaaagccttgggaactcgaaaactacctcccacatgaagttccagagtttcattcaccgatccattctgaaaccaaccactactatcataatccatctttggaaggagtcaatgaagccatctcaaaccaagaacttccattcaacccactagagaatgcgcgttcaagacgcaagcggaaaaacaacaacttggcatcattgatgacaagagaaaagcgaaagagaagaagaactaaaccaacaaagaacatagaagagatagagagtcaaagaatgacacacattgcggttgaacgaaaccgcagacgccaaatgaacgttcatctgaactcactccgctccatcattccatcttcatacatccagagggtataataaacaaaacccacaaatcaaagttccaacctttatcaaatgtcgaattttcttaactaatatctctcgtagggagaccaagcgtcaatagtaggaggagcaatagacttcgtaaagatcctagagcaacagttgcaatcccttgaagcacaaaagagaagtcaacagagtgatgataacaaagagcaaattccagaagataacagtctcaggaacatttcgtcgaacaagttgcgtgcgagtaataaagaagaacaaagtagcaaactcaaaatcgaagccacagtgatagagagtcacgtcaacctaaaaattcaatgtacgaggaaacaaggacaacttctcagatcaatcatattgctggagaaacttcgattcactgttcttcatctcaacatcacatctccgaccaatacatctgtctcttattccttcaacctcaaggtacttacttatataacaaaaaacccattattcaaaatcatcgacaatggtgaaaaaattcaatcttttttgtttgttgctcagatggaagatgaatgtaatttgggatcagcggatgagataacggcggcgattcgtcagattttcgacagctgattgactaatccaagtaaaaagtaaaataaaaaaagaaacgtttactttggtaacttcgttttcatgattaaattctttatttggtcgtatgtgattggagtcttctcggcatggaacttgactttggttttagggtactagtctctacagaagctgtggtccttctttggatagatttataatgaaagtttgacccctctctctttttttattgtctttttgttttgcttttgcctctctctcggggttttgacttttgtatcataaaactagaatataaaagtttacaaattatatttatctataaaatatttttattttatactttacgattgttattaagtaacgtcctcttaaattcgtcccgccaatctgtcccgtaaaaaaaactcactgattttatttatgatatgtttatgaatcattgtctaaatattttttaattttgtagtaattaaatgctatctaatatctctgcgatttgatgattataatcgaattattatagtcatgtagaaaaacaatatcaaaaatgataattttgtagtaattaaatgatattaaatatttcagaagttttattttagtaactaatcgtgtagttaatgtggagagattttgggaagattatcaaatatttaattcaaagattttctttctaattatcaaaaacaattattaaatgccagtggcagccactgtaaataaatctcaactctaggatttatttcacaaagtggctgcaaaaatgtatatataaatatctaatctttacttagatggcatgggtttgaaaagttctgagtaactgataggcccaatgactaaaagcccatatgtgtttctcatcataatggaaggcctacaagtagaagaattcgctcgtgtttatgaattatgatcttgattgtaatcttattatcaaaaaccaaccgtaaaagtatatgaattgcgtatttgtaaattgtaattattatatagtattgagattgtgattaaaagtaataatgaatttgttgaattattattatagactatagtatagtagcaagagtgaaattttgttttcaagaattgagtcctaattttataaaaggagccaaaaaacccaattctatctaatccaatgaaaactccaagatcgtctctacgtccgccacgtcagcactatcctgatcgggaaacccaaaacgagtggtcgaatagtttccgactggtaacagagaaagcatctccacaatccccaaaattctttcaacacttgctctccattaatcttttagataataaacctaattgtttctgttttgtttttgtttctgtgagattcttccgaggcttgaagctcaatagct

SEQ ID NO: 12403 - DNA, 3000 bp, Unknown
  misc_feature (1)..( 3000): cDNA_ID_3024970_gDNA_ID_2214547_Annot_ID_185468 3000 nt of promoter + ATG
cacaacgagcagcaaccaggagaatatcggatcatcaagcgtaagcttccgtaaccaagttcttcagtccacagtaacgaatcagaagcaagattcacccataccggtagaatcaaatcgcgagaaagcagctagcaaggaagtagaagctggttctcaaagcaccaatgaggggattgctggacaaagcagtagcacagagaaaccaaaggaagaagaaagtgcgaaacaacgttggagtagaagccagagagaagctgcattgatgaagttccggttgaagaggaaagatcgatgctttgacaaaaaggtaagagacacacaagcttcatcataaaaacagcatctgaaacaaatacaagatcaaactgattcaatggagatgtataaaaatggattacaggttcggtaccagagcaggaagaagctagcagaacaacgtcctcgagtgaaaggccagttcgtgcgaaccgtgaattcagacgcgtctacaaaatcatgaagagctctttcagtttttcctctgatttcttttgttgattttataacagaaacttatttagcttttgcaatctttagtgtgctttttttttttatgtatttgattggcttcttcttctcagctaatatgagatactggggcaacttttgtatatatgtctgcaaatgatcaggctaagctaaaacagtaattccaatttcgttaagttgagaaatatttcttgttgtgatcatatccaggccgcttctctctcgatacataccaacaagaaacagattctataaaacttgatttatataccattgctatagtctatgtattaaaactcatcacattaattctctcacagtcagagaaacaaaaaaaggaaacaaaagctatcgaaagaaaaatcaacaaagaaatctttttttgtgaccgttaaactaagattttgtgaccgttaattgtgattatcagtttccttttctttgcttataaataaataattagtgagagtctcaacgcttcttctaaaacattcgacaaatcaaaactctctatctctcgcttcttcttattcttcaaccctagttctcttctcaagacaattttgtcttcaaagaggagactacaaagaggaggatatagccaagagaggggagagctttatggtggtggatgatgtcacgagagggctaccaaagaccgacgggctcaaatctgactttggaatgggctttgctctatgggccctttttgctactaaatccaacaaggtattacttttttcattctttttttttttgttttatttaccttcaaaattatttttaagtaaaactaattagtttcaccataacatttatataactaaaatgtttatatattttcattagtttaagtgtaaaatgtttttacacctatattttattataactttagattttttttatatagataagtgttaaatttttaaattttgtgtaaactaattggatacatcatccaaacccctaggaggtgtgccaggttcaatatatggtttacacattatttaactttttaacacttgttttgcttttattaaaaatgtttttaaacttacatattttcatattactattaaatctttaaggtatttttatttggataagtgttaaatttttaaattttgtgtaatctaattggatacatcatccaaacccctaagaggtgttctaggtttaatatatagtttacacattattcaactttttaacacttgttttgctttcgttaaaaatatttttaaacttatatattttcatattactattaaatctttaggtttttttttatttggataagtgttaaatttttaatttttgtgtaaactaattggatacatcatccaaacccctaaaaactgttctagattcaatatatggtttacacattatttaactttttaacacttgttttgcttttattaaaaatgcttttaaacttatatttttatactactattagatctttaaggttttaaggtttcatttataggtttaatatatggtttacatattatttaagtttttaacacttgtttttcatttattaaaaaatgtttttagacttatatttttacattactattaaacctttaatgtttttttgggataattttttttttttaattttgtgtaatctaattgaatacaagattcaaacatgtaggtggtgttttaggtttaatatggtttacaaattatttaggtattgaacacttgtttaaaaaaataaaattaaatcttagtttaagtggtaaattttaaacacgttgaaaactaattgcgcctaagcatctcgtacttagttggtccgtaagttttggtgttcgaagtttggaaagttttcacgtaatttaacacttaaactttaaaaaatcagttcatttaaaactttttgaaaattagtttaaatggtaaattttaatcacgttgaaactaaccgcacatagatatctcatatttagttgatccgtaagctttggtgtttgtaatacttataattagtttttgaaaaatgttgattgtttttactaaatttaagaaattaattcactaaaactttttaagaactagtttaagtgataaagtttaaatatgtcaaaactaaccgtacataaacatcatatccttagttaatctataaagtttggtattcgaagttttcacataactaaattttaaattatgttttggaatttttcttcttagtcaattcaataaaccctcaaaagtgaaaacccaatcattttgctaaaccgcttctgcgaaccaatatatgaaaccgattaaaaaagccactagattgattggtttaaattaaaaatttcaccggtttgacaagatacccaatcattatacacaggtaaaaaaaaagcaaaaaaaaaaaagacagcaaaaattacggaccataaaaaacggccacgtgttcatcatgttcaccgtcaacgaaagagattccgattaagagag

SEQ ID NO: 12404 - DNA, 3000 bp, Unknown
  misc_feature (1)..( 3000): cDNA_ID_3024977_gDNA_ID_2214547_Annot_ID_185466 3000 nt of promoter + ATG
gacttcttacattatgcaaaccatatatgtgttcaaatattgatatttgaaaggatagagtatgatgtatatgacgcatttcgttttatttacatgatcacccaatcgatggttacataattaagatttgtcccttcgtaatgattgtgtccctataagctggcaatatatatatagcaatcttttgtataactaggtgtcctaaactagagcatagcggtctgctaatttcggctaaggcctgaatcgttaatgatggaatcagaatgtacatctcatggaagtcgatatcgttcaacttatagagataggcacatgttaggtatctgaatgctttagtatcaaaattagaagctctcttccattgactaatttcgtaaaacatatatacgaagctatcagaatcaatgtttcattgtacggattactatgttatgtattaacagtcagttactatatttaagcagatcataagaaatgaataaattttccaaatatatatatttaatcagctaaactggttaaaaagaaactgattcaatacataatagatttgaagtcagttcaaattacgttaacggaagagtgtgctttatgttgctggtctactatatgtatacattccaaagaaatgaaatttcgcacagttcaaaactttatgaatcaagccataaaatgtgacactccgtaaactccattatattacatatgagatagtgtgaattctgtatacatagatttactgggctttagaaatggattttaagcccacaaatagtcttgcttcatttcaagaggtggccagtagtaaaaaataataatattaattttcctttttgataaaaatgatttactcttttcaattaaagtcccatctgccaacgaagattccaccacgtggcaaaggaaacgttgacggtcaaaataacgggaatccgtatcattcgctgtcacgttcatacgccacgaccaatcaacagcgtttataacggattttcagactttaaggaaacaaaatcgctggacacgtcacgcgtcaatttttgtactgtaataaaaacatcactcagatcaatgatcccatgcacgcgggaccacgtacgcgtgataaagtcttgtgatacacaccgttggatgataaagtgcaatccatctaacggtgattttgttcaagttgagaataaaataaatattttagttagaatactttttaatactatataataatattgggaaagtggctgagcataaacatgtgcatgcctgcctgtatcttgcagccttcatgtggatttatcagtgcgacactatccatcatcaaataactcatatctacactttctttcttatatatgtgaaatttatacattacattttgtaaaataaatatttatattccaaaaacaacgtagtagacgtgcctcaaaatcaaagagatgtggaacggctttagaagcaaaatccaaaattggaaaataatgataattattgccacaaaatattgattacgaaggtgatatatatattaatcactgattgatgttgttaaggaaaagaataaagttttgggctaccaaattttcgaatgttgaaattgacttttacatcgtgatctgacaaacgcatgtgttgattcaattgttcataaatcacaatacttcaaaatttcaatacgtatattttttcatttcactaatcactaatacattggtacgtttctatagattttgccactagcaagttttagcaaaatctgttatcagaatgctttaagttgagaaaactgctaatgctattaaaagaaacggctaatgattggtagacgcatcgatcgatcattcgttgagagttttcaacaaggtctaaataaactatttaaataaaatatcatagactataaaatggaaacgaaaaaaaagagcatatatttccacaattaccgttagtacttaatagtagtagtagtaaacagtgacacatgatacattttgacggctctgatcgaataaaaaagaaagttgtactaacagactttattaaaagacaagctacaatgattttttttttttgtaaggataatattttttttttataagaaaactgagaataggcaatttctgcaaatgttttgaggaagacaacctgtcttctgtgttaaaaaccaggtctgccctacatttataattatttcattgtttttttataataaagggtttacagttaaaattcaaaaatacaaaacatccaaaaaattcgaaaaaaggaaagatagaatttagaagattgtgccacaaagtcaagacccacaaaaacatttttgttttgggttatgtactgcacaaaaaaaagtgtaaataatttaaaataaacccaaaataaaataaaatagagaaaaattcagcagattattctcttcgatatgtattaaaaaattctcacagttatttttattaatgcttggagacgaatggtcaaagtttggttttatttttttgataataatgaaagtttaattatcaagaattttgcagaaatcaagagagaaggttgaagacagcgaagcaaatgtttatgtacacaagagacgcataaatatataaaatacagcgaaaaaggtaaaattgggtctctggcttttcctcatattttcaattgcttctctcttctctcttctatagccccattgtcgtgggttcccactagcagctttcttgtcttcctccattttcttttccttcattctactaaaacagaggtttttgcctcttcctctcttgtttcactctttagggtacacacaaattcactcttttttcttctttgtttgggaggggaaaagttacagttttttcctctgttttggatcaaaatttcgtttttttggttgtgttaagaaagcaacagagagagagagaaagattgaaactttggatgtgaatttagggttttgtgaattggggaaaaagcaatccagagatggctcaacagagacaatttcag

SEQ ID NO: 12405 - DNA, 3000 bp, Unknown; identical to SEQ ID NO: 12401
  misc_feature (1)..( 3000): cDNA_ID_1808795_gDNA_ID_2214547_Annot_ID_185465 3000 nt of promoter + ATG

SEQ ID NO: 12406 - DNA, 3000 bp, Unknown; identical to SEQ ID NO: 12398
  misc_feature (1)..( 3000): cDNA_ID_2711934_gDNA_ID_2214547_Annot_ID_185463 3000 nt of promoter + ATG

SEQ ID NO: 12407 - DNA, 3000 bp, Unknown
  misc_feature (1)..( 3000): cDNA_ID_2711918_gDNA_ID_2214547_Annot_ID_134609 3000 nt of promoter + ATG
agaagagctaattgcaatcttgcttgtcttggtgctcaaaaacctcgtcctcctacttctcctcgacatggtttgaatctctctctctctctcctctcttaattccaatgggaactagctttagggtgattggaaaaatctgatctttttacttgatcaacacgtgaagaagtcaagagtgttgttttacgattcttggtggaaacttgatttccaggaacaggtagattcagatcaccaggatcaggagttggattagttgctccttctcctcagtttcgaggctcttcttcttcctctgcttttgttcatcaacaacaacaacaacacactgctcaattcccatttccttactctacttacgggtaagaatacataatcatcacattaaataacaatccattctgattagtgtgcgtgtgtgtgtgtaagcaaaacttaaaatgcttgtgttttcttcttctgcaggttttctggttattctcaagagggaatgtacccaatggtaagttcattttataaatttgtagagtcgtttccatttcactgataaatctttgaagttcttatgtttgtgttttttgtttgtttgcagaactactacaatcatcatctctatggagacaacagttttcaccatatatgggacatccatcagcaggatcaacaggaatgttccatggtttttatccctactatcctcaatacaatgcagcacaaagtagcaatcaagctcaagctcaagttcaagctcaacatcaccaaggtttcagctttcaatacactgctcctcctgctcctcctctgctgcaatatccttacttgcctcaccagccacacttcagttctcagcagcaatttagctctcagcaacctcctcctccaatcctctccctcccaacctctctggctctatctttaccttcatcatcatcaccgtcctcttcaacttccacctcaggtttgatttcacaacacaatctacattgaaaaccatttgtcacattgttttgaatcatgcttgattctttgttttgttttgtattagctgcaacaacagcaacaaaaacagtagttataactacagcaacaaagaaagcagaaactgaagctagcagcaaagatggtaatgaagcaatgacaacatcaaccatcaagatagagggttgattcagaactactacaatagccagaagaagggacaaacttcattgtacactaactcatcatcaaatctctccaacaacgttctagaaacattcattcatccatcgtttttaggattctagaatcttaattagtacttaggaggaggaagaagaagaagaaaccatcatcacattctttctttttttttgttgttgtttcaaattgcattttaggtaaaagaatcaagagaaagcattggtggctttcttttagattcttaagaaaacttggattggtgcagaaagcatcatcagattattacattcatttggggaattttatttttcaggttcaaaagaaatgttttatgtcttcttttgaacctaaacaggatttttaagcttcggataagcttaaaatcatttcttttacatttgtaattcttgaaattgttataattcaatcacattgcttcttcttactatatttgttcgtttattatgattataaaatgtttgatcaaccaagaatccgttcatcgatcactttcacctggagttttctcgtgttttataatcataaaaagattgaacctttttgataattattttgaattcgtatgatcattttctgagagtaaaatgattattgtctttggattccaaaggggatcttatgaagacaaaagtaccggtcaaaagaccgttggaatcaaacggatctttttcttcgtcaatggataatatttcacttctactattcttttaacaattttataataaaaaccaaacaaacaaaacatagagaatacataagttatgggcttttgaaaatctaaggcttaaattcttataaagcccattaatttttatatgtgtaagtaagttggccatagaaagcttaaagccttagatatgtaaacacgcaagaatatggtaagttgtttattacgcactgtccacatcatagatcgatagatattctttccacgcaaagcaaagttttattaagatggttctagaattccttcttatccacagaaaatttttatattcaagaaaatccaatttttcatttggagtcgaaatttacgcggccactaacgaaatttgatttaattaaaactagtgggcatttaatatttgaaaataatactatttgttaaatcccaattgaaaatttaataacatttaatataattaacttttttgaaaaaaggaacaaaaaaagccatccaatttgaatgatacatagagcagctgaaaaaaaaaaatctaccttttagaatttattaaatccaaccaaaaatcaaacttagccacacaattacaatagaaacccacgtgtcatccacatgaccactagatattcagacgaatatctccacttccgtagagcgattaggttaatgacacgtgttaaggtggacctgcgaagcagaggaccacctccaccgaatcagccgcgatacagagaaaatcaaaacaatggctcatattaagccacgtcagctcagtgaaggcccgctttgttacacaccgttaattagatttctcaaattgtttatttgctctgagcttatacaacaaagtcttcttctttctctgagaagatattttcgtggttgtgatcgaaagataccaaactaaagagtttaactttcttcttccttcttctttacttcaacatctgatattttctctctctcttttattcagtctgaaacaatatttctcggtagattaagatctaaagctcgttgatctagattcttgtttctatttttgtgtgttttaggctttgttggttttaccaagtgttgtgattcagtttgttttgaggtctgagtct

SEQ ID NO: 12408 - DNA, 3000 bp, Unknown; identical to SEQ ID NO: 12402
  misc_feature (1)..( 3000): cDNA_ID_2708847_gDNA_ID_2214547_Annot_ID_134612 3000 nt of promoter + ATG

SEQ ID NO: 12409 - DNA, 3000 bp, Unknown
  misc_feature (1)..( 3000): cDNA_ID_2711949_gDNA_ID_2214548_Annot_ID_134620 3000 nt of promoter + ATG
acagtaatttaaattcctttaaccggattttttttttctaactatgaattgattgttcaaattgtttaagtaaccaagttggttaacaattatattggtagtgtttatagtaaaaaatatcaacttgttgctagttaaaatttaaaactctatactacattctaaggagtataatattattcttattcaattgtggtggggaaaaaataagccctaaaaatttatataactaaaataaaaataaaaatatgaaatataaataatacttcagttttctgacccaaaacaaaacaaatataaaataagataagaaattaaccaaataatttttagattaataacttattattttttcctaaacataatttttcgactgttttgtttttatgtccacccctaatacttttcatttttgtgttatatacatttctatatggtaatctacactagttaatatgtttcaaatgatattttatgtttgtaatagttatatatatatatatatatatatgtgggtgtgggtgtgaaatagtttttgtttactataatataaataattttcattagtatattggtagttaaactattgaagttagttaacaattatttgggaaaatataaaaatcatttctatgatatatctatcagagaatctttggttcatatacttttgaatacacaaagttaaaaacgttatcatgtagaaaaaggttgagctagatagattttagaaatacatatagcatactgtattttctatacaacttaattactcacaaaaataattttaagaaagatgattgtgaattatcaactagtaagctaagtctacgaaaatggttgatgtgagaaatgaaaaagctaaggagcctaagtagaaattattaagttaggttccctgatgcccaacactttaattattatacatttgtattacattatgctcgacgcttcctagttcttcctatctagatacagcctactttccagttggaaaaaggactcaaattatcaattttcagttaatgccttcaataatttttttctgttttttttcttttatttagagtttgaacagatgaaaactctagataaaacagtaaacgaaaacatgtcgcaagggtctctctttaagatcaaataggtttaatttattttttgttaaatagtaatgcatgtgagaagaatacttacaaggaaggttcgagccacttaattcgccaaacttattcataggccaagatcaatagtcaactacagaagtatttttagtaagcatgaattaaaattggaaatggtttattgaaaaagtggatatgttggataagatatagaaggtgtagggtttacttaagtttcacgactttgggaagtataatgtggaatcttttgatatgaaggcagattgcatgcgcgtatgctttttctaaagacattaatctaaatatcatgcattgtttttctttaacttttgggagtattcaagttgacgacattttcacactttttctttcatttctgtttttgttctaattatatttcaattgtgatctttgataaacacaaacaaagacaaccaaatttgtatcaagccaaataattttttattgtttgcatctacacggacatatgttaaatgaataatttataggtatgattctaatttgatgaaaattttagagtaaataaactagcttcgaatatattgattgttaagtaaaaaaaagtttggatgtaatgtcgtattttgagttgtaatgttatatttaatttttatagattgtttttttgtaagccttgtaattctgtcaaacttttaaaataacaaaaatttaatcttttaccaaaaagaaaaagttcggatgtggaacaccaattggaaaaagtttcacacaaatttttatcaagattatttagttgataaaaaaaactaaattacacacatggattttaacatacaaagttggcatatacaacattaaatacaagtgacaacattaattatgcaaagggattattgttgattttgtcatttttcatagagatcttttgaaattgccatttttattaaaatcttacggatatgccattttctaagacttaaaaatgtatggatttcagattttttttggtaaaaatacatagtttacacaaaatactaaaccctaagaacaaccacaaccaactaaacccaaacataatgaataaaacgcatgttaaatcatatttccgtaacctgaaaaatggcaaaatctacaaactattcaaaaaggggcaaaatccacaaatgtcatcccaaaaaatggcattttcataattgattcttatgcaaatatgggatttatttttatttttctattaatttgggaacaaaacgattactatatacatatcttcatatatatagcttcaattttaaaaccaacgaatatgcacaaaaatatctagacattattccaaaactccaaactaatattcaaatgtataacgtatggttgtggtaagaagggaaaacagagtctgaaacgtaagtctatttcattgccctctctttttagtggaacgagaaaaagctgttgtgtatcattatcaacggcttaaatataaaaattaatcataaaatgaataaagtttttttcttcttctttataggtggtagaattgtaattaaaaggaaaggtagatttctcagacgatgaccttaatcataagttcctaacacattttgctcctcgaaatgcgaatctcattcaacattaggccttaatcatagttatccacatgaatgaaacacatacaatctcttctctctccctgtatatatagtatccataaaaataaaagtgactttaacaaaataaaacataaaataattgggactctacatcaatcatactagagttgtggttgttgtggaagtcgggtgtgggggaagtggatattgtggtggcaaccaatcagtttattcatgcgaaggtggtgagtaatggggatcatatg

SEQ ID NO: 12410 - DNA, 3000 bp, Unknown
  misc_feature (1)..( 3000): cDNA_ID_2711945_gDNA_ID_2214548_Annot_ID_134622 3000 nt of promoter + ATG
ctcactttccaggttttgatttttctttataatatctgattttattatctcttttgtttctattttcatatatcaataacttcacttaaaagtaagcatttcatagagctactcttgattctttgatatttttttgtttatcattctttcttgattttatataaaagatcctagctttatcaagtgaacaccgaacaccagtactagaaagtagaagcctacttaaattattaatctgtacaaaagtaatcattgacgattgtacagtactcatcgccaaatcttttgtcttactagtaactgatttatcttcaatctagttaaaaataaccgaaaatagcacattttctaagttaataaattttaaaatggcgtaacttcattaaaaattactcactaacaacccactttgtctcagtgagcgaacatctatgtaggtctgtgaaattctgaaaattttgtgaaacctaattttactttggacaaatttgacagtaagtgccattttaaacttatgaaaaaatgtgttttttttttttttttttctctggtaaaaccgtgtttatgttttttaacttttaatgcgacgagtcatcgcttctggcaattgaacccctttttttaatttttagtgttaatggtatctccccttttaatgcttttaggttctattgtttggttttgggtatttaattttacatcagaaaaaaaaaaaagaacgagtcttgctaattaagtgcctgcatgataatgatatgtcaaatgaggatcagatacgtagttatgttaattttctttaggtttggcgttttgatagatcaaacagttgtcatataataataaatgtaaaacaaaaacaaaaatgatattaatgtagatgagatcatgagaataagatatgactacgaattattccacattgatgttgaaaaaagaggttcctacaacgtcaccacctaatttatcttctgaagtatgattatctttgttttaaaaattgggctggttaagataatcctatatagtttcactaaaacttataagactttagcaacttgtaaggatattgaatttgtggccaagacaattgtaagatttatgtatacggactatttgacgtaagtcgtagttagtaattaattaagtttctaaaagagttttcaataataggaccaaacataaacgacatactagattattaagactacatgtacaatataaccacttacttaggtcaatgtcttattcttcattgtcgttttctaatcacaaagtgtattattaacaagtggacattcagaaatttaactaattatttattcaatattacttgtttttggggatcttcatatataattacatatagacagtgactaaacagtgacaagagtctgcctccattggagctgactttgattgctagttagctagcttctttgttaatggtttatgtgcttctctttcttttggtttgtaaaattaccgaaagcatgattatagaatatatgaatatactatattatatacatgtttaaaatgtaatatttaatgtattataaaaagagaagtaatatttctatttttatatatttttgacattttatttcctcaatattaatgttgaatcacgtaggaatgagatacacacaaagtcacaaatatcaacttttttttttcttttctatgaaatgcctcgttcaaatattatatgactgtaaaaccaaaagaaaaggtactaattgactgatcatgccatgttcttgttactgattttggggtttccttcgtatttgtcaaatgtcactagttaatgtaacatatctttaaacaaataaaaatgggcaggattatggagtgacgataaatttgtatagaacacagtttctagtagatgtggttcaagaaaaggcaggacgagtgcttgtgcttgactccatcaaacaagccgatgcttggcttggcatggatgttcttatcttcaactcgtggcactggtggactcacacctccggacttcagccgtacgatctctataaattaaactctctcttttgataagtttcattaattatatatgcttcttaattaaacgtttaataatggtttgtttaattaccagctgggattatatgagggaaggaaaccaattgtacaaagacatgaacaggcttgtggcttattacaaaggacttaacacatgggctcgttggattaacaataacattgtcccttcacgtactcaagtcttctttcaaggtgtttctcctgtccactatgagtaagttttcttttactctccctcttttttcccactttacctaaaataacgttttcaaaacattgattttcttgaaacagcggaagagagtggaacgaaccattgaagtcgtgcaatggtcaaactcagccgttcatgggacaaagatatccaggaggattgcccttaggttgggttgtggttaacaaagtgttgagccgaattagaaaaccggtccatcttctcgatctcactactctctcggagtatcgcaaagacgcacatccaagtctctacaatggtatctcaaaggatctagactgtagccattggtgcctccctggactccctgatacttggaacttacttctctactcatctcttacttcctagtccttgttttacatatttgtttgtttctaccattttataaatagtttgtgatgatcctgtgtgattgtgattgatatttttccttcgttaatttaatcttaaatgtaattaacattgttactagtttacttgcagcatcgatcagcttaaattctccatacatttgttattactttaatttattttccaaactattataacgtgcgtatttacactttcaaagtctttaacaagcaaaacttgtgtgaaggaccaatacttacacgcattatccaaacctttgaacactccaaacgaattttacgacggcacaaagaggaggaggattggacagaagagaagcgaaaatg

SEQ ID NO: 12411 - DNA, 3000 bp, Unknown
  misc_feature (1)..( 3000): cDNA_ID_2994364_gDNA_ID_2214548_Annot_ID_134623 3000 nt of promoter + ATG
attatgtatattgtatacaaaaatatataacaagaaaggtaaacaagagaactcactgtagaaacaaagacttataaaaagcttgaggcttgaagaataagttgatcattctttcttggcgaccttaaatacaaaatgggactctgtttccaactcaacttagcctctctgtctctcatactcttctcttcattccctggacttttagcacaatctcaacaacatttcttgggacaaaacaacacaagcttgttgagtggagggagatgcaatttggctagaggcaaatgggtctatgattcttcatatcctctctatagtgcttttagttgtcccttcatcgattccgaattcaactgccagaaagcgggtcgtccggacactaactatcaacacttccgttggcagcctttctcctgtcctctccctaggtacttttgcacatgtattactattaaccactatagttttaaatagttagttagaagaaaagctaaggtttagattggcttatacactaatttttgcgtttgtgtataaaatatagatatatagtattttctgataaaatactttagcaatatgtaaacacaaacttgttggtgtttgcgttcacaattaacaaatgagttttgtttaaagatagtaaagattatgagtttatttgaaaacaaaagatagaaactatatataaacgcaaacgcgaacaaacaatccaaaatgtttttggtatcaaatgaacgagtatgaaaagtctaactagtatcttgatcatgcagaaaattggttttgaattgggtcaaaagaaacataataaagtttataagatatgtttttcgaaagaggtatattaacaattaaaaatgactatacagattcgatggggcgaattttatgaggagaatgagagggaagaagataatgatggtaggtgactcactgagtcttaacatgttcgaatcgttggcctgcttgcttcatgcttctctccctaatgctaagtactctcttcgtcgaagccaacctctcacttccctcactttccaggttttgatttttctttataatatctgattttattatctcttttgtttctattttcatatatcaataacttcacttaaaagtaagcatttcatagagctactcttgattctttgatatttttttgtttatcattctttcttgattttatataaaagatcctagctttatcaagtgaacaccgaacaccagtactagaaagtagaagcctacttaaattattaatctgtacaaaagtaatcattgacgattgtacagtactcatcgccaaatcttttgtcttactagtaactgatttatcttcaatctagttaaaaataaccgaaaatagcacattttctaagttaataaattttaaaatggcgtaacttcattaaaaattactcactaacaacccactttgtctcagtgagcgaacatctatgtaggtctgtgaaattctgaaaattttgtgaaacctaattttactttggacaaatttgacagtaagtgccattttaaacttatgaaaaaatgtgttttttttttttttttttctctggtaaaaccgtgtttatgttttttaacttttaatgcgacgagtcatcgcttctggcaattgaacccctttttttaatttttagtgttaatggtatctccccttttaatgcttttaggttctattgtttggttttgggtatttaattttacatcagaaaaaaaaaaaagaacgagtcttgctaattaagtgcctgcatgataatgatatgtcaaatgaggatcagatacgtagttatgttaattttctttaggtttggcgttttgatagatcaaacagttgtcatataataataaatgtaaaacaaaaacaaaaatgatattaatgtagatgagatcatgagaataagatatgactacgaattattccacattgatgttgaaaaaagaggttcctacaacgtcaccacctaatttatcttctgaagtatgattatctttgttttaaaaattgggctggttaagataatcctatatagtttcactaaaacttataagactttagcaacttgtaaggatattgaatttgtggccaagacaattgtaagatttatgtatacggactatttgacgtaagtcgtagttagtaattaattaagtttctaaaagagttttcaataataggaccaaacataaacgacatactagattattaagactacatgtacaatataaccacttacttaggtcaatgtcttattcttcattgtcgttttctaatcacaaagtgtattattaacaagtggacattcagaaatttaactaattatttattcaatattacttgtttttggggatcttcatatataattacatatagacagtgactaaacagtgacaagagtctgcctccattggagctgactttgattgctagttagctagcttctttgttaatggtttatgtgcttctctttcttttggtttgtaaaattaccgaaagcatgattatagaatatatgaatatactatattatatacatgtttaaaatgtaatatttaatgtattataaaaagagaagtaatatttctatttttatatatttttgacattttatttcctcaatattaatgttgaatcacgtaggaatgagatacacacaaagtcacaaatatcaacttttttttttcttttctatgaaatgcctcgttcaaatattatatgactgtaaaaccaaaagaaaaggtactaattgactgatcatgccatgttcttgttactgattttggggtttccttcgtatttgtcaaatgtcactagttaatgtaacatatctttaaacaaataaaaatgggcaggattatggagtgacgataaatttgtatagaacacagtttctagtagatgtggttcaagaaaaggcaggacgagtgcttgtgcttgactccatcaaacaagccgatgcttggcttggcatg

SEQ ID NO: 12412 - DNA, 3000 bp, Unknown
  misc_feature (1)..( 3000): cDNA_ID_2994364_gDNA_ID_2214548_Annot_ID_185495 3000 nt of promoter + ATG
ctgtacttctccaaggcagtatagttatggaggtccatacagaagaacaagaatcggccgcaaacagatatttaaaaaagaggagctttcccaagtcatcaggccttatatccagaaagacttgactagtttatcaatggttcatagtgctcgtgtcaaagatgatcttggaactgtaaactctagtagtttatcaatggttcatagtgctcgtgtcaatgatgatgttggaactgtaaactcaagtagtttatcaatggttcatcatgctagtatgaaagatgatgtcggaactgtaaagtcaagtgattctcctccaggtgaagtagaaaaactcatctccaaaaagaaatgtcagaaagacgataaagccaaaaatcaacagagtctgacagtggttaattctgttaaaagtaatgattcagaggttatagtcgataatgaacacggtctttcggcagataagtctgttagaagtcaagatttggagattcaaccatctctggccactagcttacctgcagaatctgatggtaacatttctgcattctgatttttctctcttttgaaactattgattcttaaactagatcctgttacatcatatccagtaccacaacctatatgttctgtatcatttggtttagtttcatgattatgcgattgcttagcgttgtttgctacttgcattgagaatagaatgcaaaagagagaaagtagctcatgatttgaagcaaattcacttaaacttggttatggtttcttctattcagattgcagaaaggaaaccaatgtggaaacaagttcgagttctgtctcagagccgaagtcagagattctccaacatcttagtgggagatcagttgaagaaagctgtatacttgtggatagagacgaattccatagtgtgtttcctgacaagatggagaatgacaaacacaaaccttacaaggttgcttcttctgtctctctctatctgtctctgtctttgtctcttttttgtttcatgtttgcatatatcatcacgtgtaaagtaacaccgccttataataaactgattctacagaagatcagagacgctatatcttcaagaatgaagcaaaacagagaaaaagaatacaagcgacttgcccggcaatggtacgcagaagatgttgaaaatgggagagaatgtggcgataatccgaaaccgatagaggaaaaccaatcatcagaagaatctgaatgggagcttctgtaaaatgttaaatggtaaacagagaatatagctctcctctctctctttgtacataaagaatgtattaagcaaaacataagataagaagcagctaagaagtcaaaaggcttcttcctctggttacataataaataaggcccttatctttatcaaattttcgtttaacttatttttataatttcaagtgaagatgttttataaattgtttgcatttgtgaatatttttgtgggagaagaaaaaagtctttcacttggtggttgtgtaataattgctttcttgtttcgtctattttacatttccaaattgttccaaagataggaccactccacatcatttctattttctttcattttgattttgattttatttattttcaatccataatgtttgggacaatttgaaccatacatcttttcaaatagaaaactatagtcattttcgcaaataattttctaggagttcagaatccgataagcccctataaagtatcttcagcttcgacctattgtgctattttgcgtgttttatattcattttctcgtttatttattatgagttggaaaggatataataaactttatgtcatataatcaataactcaaccgttgaagtaattattgaattatttgatgaatgaactaatggaaatttctagttttagtcacaacttgctaatgaaggtataatcattaacaattttgaataagaagatgagccaaatgagtattaagttagtacttgcataaatagttatatttgttcctttatttatacattgatactttgtaaaaagtagtcaaaattgaaatggttcgattcattgcattacctaaataagagtcaacagagtaataaaagcattcgttaggtgtagattagaaaaaagcttacttataaagaaataaaaatgaagaaaattaaaagagaagtaagtttttgggagtgagtggtggtctagttggaaaaagcaagccaccctaaaactcatcataacatgtgccaattgctactacatatatacatcatccttgtcttttcattctctattacaacatgcattttaagccaatagctacgcagataaaatataaaccgttaaaaaagattcatgaaaattgataacacaacatgattgaggttgaactaaatggatctcttgatttttaatagtactaatcgtgctgtcaataaccaattactgaattttgtagtgacgcactgattttctacattagctagattactctgttaggaggaatagtttttactttaatttgagtacaatttttaaatttattttttcatgaaataaattggttattataaaaatttatcctttgagaacattcaatatgttaagcaattttgcaagaaccccattttaagttaataatatatcaaaaatggttgtgcatgcagaaaatttatgaaaaaataataattcatatgcatttaaatatttagtacatagttttataaatatagttaaaaaaaagttttggctgaaccgatatttctaactaacttgcttataacaagttttattcaattagtaaatttgattccaaatcacctttatcaactcttaaagtatatattaagtttaatgattgtccacgaaataattatgtatattgtatacaaaaatatataacaagaaaggtaaacaagagaactcactgtagaaacaaagacttataaaaagcttgaggcttgaagaataagttgatcattctttcttggcgaccttaaatacaaaatg

SEQ ID NO: 12413 - DNA, 3000 bp, Unknown
  misc_feature (1)..( 3000): cDNA_ID_3025097_gDNA_ID_2214549_Annot_ID_134635 3000 nt of promoter + ATG
aatcttgtagaagatatgtatgctttcatgaggctatggagtggcagtttcttacaaggaagaacctagtgaatcccgagaggagagaagatgggtggatggagatagagattggggaattctttaatgaaggagcatttaggaataatgatgaaattgagatgagtgtttcagagactactcagcgcaatacgaaacgtggcttgattattcaaggaattgaaatccgtcctacgaaaaaacccggtaatgaaatgccctagaaattaaactcccttttacctgatgaaccggtattattgtcaattagttttacaacgaagtaaagagttaaactccaatttatgaaagagtgttttcggttgagtgtggtataataaataaattgttttgcgaaaattaagttttacctttgctataagagtagaagatgttgtcaaaaaatattgaaccgacattaaacacattaaacaaatgtttacaaacaaagaaaaacgcatgaaacacatggaacgtgacttgtgaggaaaacgaaaacacgggcgttgacttaatggccaaagaagggcagtttcaatacgtgtgcacggctttttcttataggtatttagcgtcggagacgactttcgacgagtctttaaattcttatcttcgaatctaaacgaagaaaaacattacaggtagaagcaacaatgggacaaaaactcggcgttgactctagacaaaaaatcagacaagttctcggttcctcatccaaggtgcaaaaacacgacgtggaatctatcggtggaggcgggggagagatcgtacccggtcattcgccgtttgatgacttgccggaggattgcatctccaacataatctcttttacaagtccacgggacgtgtgtgtctccgcttcagtttcaaaatccttcgcacatgcggtccagtgtgatagtatatgggagaagtttcttccgtcggagtatgaatccctgattcctccgtggcgagttttctcatcgaagaaggacctctatttcactctttgctacgatcctgttctagttgaggatggcaaaaaggtatttatatttgtccatttatcagttttacactttgtttctacattttgagaataatgacctgtctcttgccttcaagtgggaaactatctattcagattgatcgtttgagatttttttctttctttttgaaaataaaagagcttttggttagagacggcaagtgggaaaaagtgtgtactgttagctgcaaaggaactgtggatcacaggagggaataatcctgagtattggcaatggattgaactttgtgaatctaggtatttattacttaaattcgattgtaatgactcctttttattatataaaaaaacactgagcataactaaatcgaaatgcttgaacttgaaacgaaccgaaatttagttgtaaatcaattggctttattgtttcaaaatataaataaaattttaagacaatacattactataatgacgaattgacgatcaatcatttagtacataataaaaatatgtatatagatgtcattatattgcgtatttcggatttatatttccaattcatgaacatatgattgaaaaaatgttgctcaaatgtgttatgcagttttgaaaaggtaccagagcttctcaataatcgttctttccagatgggtggtagtatgagtacccaaatcttatccctaggaactcattattcagtttacattgtgtacaagataaaagatgaacgtcatggcttacgagatttgcctatacaagttggtgtaggatttaaaggccaagaaatgcctaaacaattcatatgctttgacgagtctaccgataaaaccaaagagtggccaaagaagaagctaatgaaatcaaagaagaggggagatgggtggatggaggcagagattggggatttcttcaatgatggaggattaatgggttttgatgaagttgaagtgagtattgtagacgttacttcacctaatttgaagtgtggtgtgatgattgaaggaattgaattccggccaaaggattgtcagtaaattaagtgttctcggtttactatagtggaaaaacggtttggtgaattcaggttatgtttatgttgtctatttgaaaaaaatgaaatatactttgtgaatcagaaagtgaatcagctcaagtaaatactatttatgtcctttaaaactggacctaaatatttgcactgaaaagcagaatgacgttaaaatagaaaccatcaaattttaacggtgtaagaggtagatattgttgagtttcaacaataggtttagtttagggagaagcaatgacttacctgtagccagaccagcttgtcttcccttcttgtaaatggaactcattacgcagcttacgttgttttggtatgagttacatgactaagttaaaaatactgttgtatatcttggaaaaacattttgtaatcaagtttttggattgtaaattctggttatgtttttgtatgactataatgtctacgtaagttataaatttgttgtatatcgtggaaaccttgtaacaatactggatttgggtttttgattatgatgttcaattgttcatcatgattctctcttttttctttattttgttaaaagttaatgttcaagtgaacaaaattcgtaaaaaagtcaaagtttgtacgttcatatatcatttatggactttattatagatcgaatttattagatagacatgagaagtcggctatatagataattaatttatatcacgatgatcttaattatatactaatctgactaaattatataacatgatttgttagttagaatatttccaaataccaaaacgaacatcaaacgtgcacactgacgcaaagaatgatagtttcgttaacgagtggacgacattacaacgagtctttctttttaaaacatttagcagctgagactatttcttgaaagtctcagcttgcagaggaagaaaactatcgaatg

SEQ ID NO: 12414 - DNA, 3000 bp, Unknown
  misc_feature (1)..( 3000): cDNA_ID_2711961_gDNA_ID_2214549_Annot_ID_134636 3000 nt of promoter + ATG
aaccactcatctattggtattattgtcaactgcttatgccgtggaatgaagaggtaaattccaactgctaaaagtttgttcaactgtgtgttataagataagttataactttgttcttctagtatataaaggatgttgccatattggtgtatgattcctgttatgttttgctattagtataaatggctaataaaatcacattttgtttcgattcttcctggaaacaaaatcacatttgtttggaaagtctgtcagttgggctttggcccaattggtttacctggtagtcagaaatgcaggtggcctgactaccctctgacattagtcggaaggcattccaaactcggaccaggcagtgtggtggtccaattctacctggatcgggagaagtccactctgtatcacttcggtgcgttcctaccaaagctaaccggatcagccgatagggtatatcaaaaaaaaaaaaaaaatggctaatgctgatataagtgaaaacattgttttatatcttgaaaaaacatcttgtaatagaatcaacttgttggaccataatgttctcgaatgtaatgttcatgattctcacacgaacaaattcgacaaataaaaaatgtgtttcgatgatctaaaactctattgttcgtgcatatactgacactcattaaaagaaggagctctctctgtgataatttcctaatcgaaagtggcaaaaagttacgtatatatatatttgtctgtccataagctttgaactttgttagtaaggtttatagaatagttgttaggctaatagcttcaaaacaaacaatggatggtgggtagattagtacatgttatttatataatatctttatgactcatcttaattatttctgatgtggaattccttagtgatgaaatgtctcgtattctaagttctaactgcaatctataaataatcagcttctgctagagaattatggcttcaaatgatgtgatttaaacttattaactcaaaaggtttccactatcttggaacattttggttgttcaaaaggttttaatttttattttttttgcgtgttgtgttttttcctcggaaagttcaaatagaaaagaagagttgctttcaccttttcatttttcattcttctatttgttagcataacgagtcaagactatattatataaaaaagggactattattgccaaccgcaacacggttcatccaaaacgcctatcttacttgactctttataatttggggttgtgtgtaacaatgtttccaaaccaaaaaagtccgaaaccaacgactcctgtgagagacgataatgaccaaaacaaggtgcatgcatgtgcattttcgtaaaattctacaacgagttaagaagactcttagactctcagcttccgaccaacaaagccaaggcgttactgagccgttgtctttgggtgatttaccggaagaatgtatctccctcataatctctttcacaagtcctcgagacgcatgtgttttcgctttggtttcaaaaacctttgaatctgctgtccaatccgatatagtgtgggagaagtttattccaccagagtatgaatctttgttatctcgatcgcaacatttttcatcgaagaaggagctctttttcgctctttgcgacgaatctgttttaatcaacgttagcaaaaaggtatatctatctaattataaaatgaaaattttgtattgaattatggcaacgagaatgagattcgagcttaactcaaaaaatttatgctaatttggagcaatttgatgaaggatttaagttcaaattcgtgctgctatttgaattctagggagtgttatgggtatctaatttacaaaaattttaatgactttaatcaaatcattgaaataataaataaatgattattttggtttattccaaattaggacttgtggatagaaaaggcgactgggaagaggtgtatgatgttatcagcttcagctttgaacctttccactcatcacacttggaaatggattacaaaccctgtatcagcttggtaccaatttttcatgatttttttttagttcggttgtaatgacttggttcaaaagatgatggtaatgataaaaatatgttgctcatgtgtaggttggaaacagtaccagagcttctcacaacacgttggttcgagattcgatgcagaacgaatactcgttttctatcaccaagaactcgttactcggtttacattgtgttcttgaaagcggatatatgttatggctttgcgtatgtggccatggaagctgtagttagaatggtgggacatgaattaagtgaatcttgtagaagatatgtatgctttcatgaggctatggagtggcagtttcttacaaggaagaacctagtgaatcccgagaggagagaagatgggtggatggagatagagattggggaattctttaatgaaggagcatttaggaataatgatgaaattgagatgagtgtttcagagactactcagcgcaatacgaaacgtggcttgattattcaaggaattgaaatccgtcctacgaaaaaacccggtaatgaaatgccctagaaattaaactcccttttacctgatgaaccggtattattgtcaattagttttacaacgaagtaaagagttaaactccaatttatgaaagagtgttttcggttgagtgtggtataataaataaattgttttgcgaaaattaagttttacctttgctataagagtagaagatgttgtcaaaaaatattgaaccgacattaaacacattaaacaaatgtttacaaacaaagaaaaacgcatgaaacacatggaacgtgacttgtgaggaaaacgaaaacacgggcgttgacttaatggccaaagaagggcagtttcaatacgtgtgcacggctttttcttataggtatttagcgtcggagacgactttcgacgagtctttaaattcttatcttcgaatctaaacgaagaaaaacattacaggtagaagcaacaatg

SEQ ID NO: 12415 - DNA, 3000 bp, Unknown
  misc_feature (1)..( 3000): cDNA_ID_2711997_gDNA_ID_2214549_Annot_ID_134641 3000 nt of promoter + ATG
ttgaaagaacacggttggaacttaacttttgttgttcaccacataaaacctaacataaccaatcaatacaataaacaaccgaatatacttttatgaatttgaatttacctcttcggtcttcactccaccaataataccaatagatgagccgataatcgggttgttccgccgcattacttcagaggattttagcaggtcggatttcaattccttgaatgatcaagccacacttccgattgagctgcttagtctctaaagcactcatctcaatttcatcattatccattattcctccatcattgaagaactccccaagctcaatctccatccacccatcttctctctgcttaggtttcacaacgttcctccttcccctccttatagcttcactaaagcatattaatcttctagaaggctcctgtcccaccactcctaccgcagcttctatggccacattctgaaagccataacatttatccactcccttgaacacaatataagccgagtaacgagttcttggagataatacacgagtattcgttctgccacgaatctcgaaccaacatacatcgcgaagtttcgctactttttcaaaccttcataacacagggcaacaattgtccatcatcatcccaacgagtcattacaaccaaactaacgcaaagataatgaaaattagagtacctagattcaggaattggaatccattgccaatactgaggattatctccccatatgattgagaggttcatcgcagataacatcagacacctcttcccactcgctttctctaaccatacgctctttgatttccaaaataatcaaaatgattcaatagcagcaaacttcaaaattacaccaaaatagagatacaaattgcaactttaaggcgatgagatgagacagatcattcattattcataaattttgctacctttttgtcatcgtcgaatagaacaggatcgttacagagagagaaatagagctccttcttcgatgagaaaactcgcgatggaggaatcagagattcataatccgccggaagaaacttctcccatataatatctgacttcaccgtcgattcaaacgttttcgaaaccgtagcagcgacgcacgcatcgcgtggatttgtaaaagagattatgtaggagatgcaatcttccggaaatgaatcgaacggagacgactccgatttaactctgcgttttctccccatcgatcgacgcttgtatcttcgtcttcgtcttccacggaagctagtgtaaaatctcaagtcgttctattaatttacgaaagtacccctaaggattacgaaaatttcaagtcgttctacatattgacgaaaatagccctgatttgtgaacaatccacgcgtctacttcacgctccattgtttttttttggtcattattgtggattcgttggttaaggatttggttttgaaaatatccaaattccaaactaacaaaccaattaaaaaaaggtcaagtcaggtatgcattatggatcaacggtgggaatattatttgttttgaatttttataatatagtctgactcgttattccagaaaagtaaagcttaagctaacgaatacgaaagaaaaaattgataaaaaatgaaattaagtaaaagcaaacaatctatttttcatttgaattaaagaaaaaaaacaaacacaaaacacgcttctcttgttgagaagctagcaaaacaacactaaacctgaaacaaacgtaaatccgccgcaacaacccagttttttccgacggcgtacaagcttcctccgccgtaacgccgtcgtttaataccaagaagcttgattaggtttccgtagtgtgtgatttgtgagattcgttaaaccctagctctactactttataattcctgtgatgatctttagctagattgagagatcgaagtgatttgattactctagtgatgtatttgatcgtttgattttgggtttgaattttcccctttttagacgtaatcggaaatttctatgttcggagagttttgattctttctgtaattaactttactttttcgttatcgtttacttgtatgtaatctctttgtgtgtctttcaagttgctgaagttttttcaatactttgatttttaagctaagcatctttatcatctctctgtttatctattgatatagctatgttctagggtttgtttccattatccttgatcggttttggttggtttaatgtatagaacagtgattttttcctgttttgatggcttacaaatagtgattttatgtctctgatattgaattttggcttcagttttaaggttctgaacactgatgtcaaacccattgaaagagtcaagagaggatattgcaaattctactcctcacatgagggataatgagtatgttcggctagttgtggctcatgaagcctccccagctgaaaccgtgttgtctctatcgcaatcagaggtgcagagtaagaaatttatgtggtggttaaaagctttgggaatatgtgcagttgctctcttgcttacgcttgttttcggaaaatggggagttccgtttgtgtttcaaaaggtaatttctttactcaaatctcaagtttctgatgattatttccttgtgatgatccatgtcacatactctgctctttggattgtaatagtttgtttctattgaaggttcttattccaattttgcaatgggaagcaactgcgtttggccgtcctatgctcgcgattgtccttgttgtttccttggctttgtttcctgtgttcttgataccttctggtccttccatgtggttagctgggatgatttttggttatggtctcggttttgttattatcatggttggaaccaccattggcatggttctcccttacttaatcgggcttatgttccgtgatcgcctccatgtaagaacccttcacttctctttttctcatgtcatatgatcattttttacaagctcactgacttgtagatatgatttgttttttaacaaa

SEQ ID NO: 12416 - DNA, 3000 bp, Unknown
  misc_feature (1)..( 3000): cDNA_ID_3025066_gDNA_ID_2214549_Annot_ID_185527 3000 nt of promoter + ATG
ttctcaccacgttttgtatctttccttttttgttttggtttaaagcaatatgagaattttacatgctttaggtgttttttttttctttttacagcaagaaaaaatgaagagtacaacccaaagtttacagagtaatggtacaacaattaccagacgaattatcttcttacagcttggttaaatcaattgctaaagcacaaactaatggcgtgtatatatattgcatatttagccaaatagtaagcttgaagattctaagactttcaaagtaatcccttgctgagttgctattatgctgtatatgtacaatagtatataataattaaaactttaacgaagacaaactcatgtgaaaatgtaataatcagaagacaaaatataagttaataatatgtcatatatataataatagaaatatatgttcttttcgaattaaaattaaaaggtcttaattttttacaattgcaaaaactttaaactgaaaaaatgatttaatcttctggaatgtacattatataatatccgccaccctacttgctacccctagctaaaagccaaaccgatggaagactcgcttgcattaaattatgcactagcttaatctacttttaaactctcttataatacatttaattcctaatttctatcgccattttatatttttactgatatcaatattcgaagggtccatgcctatgattccatgtcatacataatatttcctttcatacctacattcattttaatgaaaaccttaaatatatatccaaaagctatacatttatgtaaactaaactggtataataatttttgaaatatgtgtatgtctactgatttactatttgattagttcgtagtaaatatattataaattgtttaaacataaaaacaaaaaaaatcatgtaactagataattttcttgacgaagattcgaattaacaacacaaaaaagttcattttctgatatcgcaatggtctaattaatggttgttgaatagtttatcttttccacgtttcataagcttttttggtacgcgacatccatattgaaaaatgtctgtctacactgagctcaatccaatgaaatttgttgtgaatgagatatatgcattcacggatttctaaaaaatatgaagtccatgacatccattgaaacatttgacaaaataaaaatataaaatatgaagtcattacaacgtagagtaaggtttctaaaaaccccactctcgtttcgtagaagccccactaccacctcactttaatttcattcattatctcatttacgttgatactttaaattcatttttccatataaacttgtaagtatgaaatttgtacttagtatatattttatctatctttccatgatgaacttaaatatattacagtttgcctagcctttttagctcagctatatatatatatatatatgctaatgttgttacgatgtttattgttttgtgtctatatcttatttacttttttgaattattaataaaatggaacaattatacatatagattatagatacatatatctaaatataatatattgtatctatatatattaatacaaattttaaagaactggcgggtttctaaattctaacatatgtactgtaagttcagcttcttactaagtcataggaacatggagagcgttggcaaaatcatggtcagtttgttttgcattcataattgaagacatagtagtatcatgcaatgaagatatggtgggccaaatatatcataaaaaaaatagcgaaacaataagagaacgttcgtgaagctgaagcatatgaaaaacacgtaaatatatttatgacgagtgacatagtaagcatacgtgatattattatttaattagtaatataggccaccaatcagaattctttgtctcaacgatgaataaattaactataataatccaaatttttaacattgttttaagaatatccgttattcaattagtctacctataacaatgaattattatggatcctttatcgctatgccttgatcaggagaattagattagttacactttcgcaatttttgtagcgatggattggaacaaaaaccaaaacaaaatatagactatttacacataaattatacatgaaatcaacttaatttgttattctctaaagtttagattgtctttataaaataccaatcatatacctaactaaaactaatgaatctttaacgtgcatgagatggtgcatgtgcaaataaaactataaagaaaaccatgatatattttttctaagaatgatagtttttgggaattttagactttcggtctatatttttcgtatgtccacaccaattgttgatattgcatttaaaacattaattattattttttccaagtataattgaactagtaaccatgaggtccatgacatccatttgaaagatgtcaattcgtaatattgtttcaaaatattttttcgtttataatacataaactttaatttttcctgtaaaagatatcaactgttcttttcatttgtgttacaacccaataattattaaatatttgaaactttagtatttagaaaaaatacataaaactaatagatagatattttattttattttgaaacaaaaagctagaaatggagagtgagagaaaggtccaaaggcacggctaagaaaacaaaaccgtggacaccctgtcctcaatttgacaagtctttgtctcctccttaactctcttcttctctctctttgtcttattctagtttggtctcaactcccaaaaacgatgacgtttcattcctatatagtcgtcctctcttcttcttctcctcctcttatctctactcaacaccactcaatttcatctctctttttcccttccattgttagtataaaaaccaagcaaacccttaatcacttttcatcatcatatatcaccttaatccacatgcatacacatatctagtctttttgatatatggcaattgtatcctccacaacaagcatcattccc

SEQ ID NO: 12417 - DNA, 3000 bp, Unknown
  misc_feature (1)..( 3000): cDNA_ID_3025078_gDNA_ID_2214549_Annot_ID_185521 3000 nt of promoter + ATG
tgttgatttctaatcagtcatcaggctatcaacaatggttttttcattcaacaccctccacgtcatcttcttttttccacatcatttcttctctcttccacataataattcaatacccacttaaattttatactctactatggtttgcttaataaaattcaacactctacccactatttttatttcatttttctttcttttatgttttaaatggataattagtaaaaatagatgtatttttttgtatccaaatcaaataaaacaagtctttatttatagagtttgaaatatggtgaattttaatataaaaaaaaattaaaacaaatatatattttataagataattgatctataataactcagaggaaaagtaaatatcagaaatttcagtaacaaataaaagaataacacatgtcctatctatatttaactcttctctcacaatttctgtctccaattatttaatgacaaatagcagtaaggggttcatttttaacaattcaaaattgttgaatccgttcaacaccgttgaatccacataagattcatttctttatttaatattccactgtaagcattcaattattgaattaattttttcaatagcccattgtatatagtcttaaaaaggggtgagtgaatgtgaatgaatggattgtattttcttaaaataatgtgtaagtcatacgtgacaatttcacaacaaaaatatttatatggacaaaagaaatttggtagacatatttgatattcccattaaaaaattgcatgagaaaaagaatatatatgaaatggtttggtttcctttctaaacaagaaaaaaaaaagtaatctccgaagaagaacaaattccttgctgaatcatggttaatttcgaatctctttctatctaattttataaatgtgatgataacagatcatcgtctccactcagtttccgtttgatagtcttatgttaccgatttttatcaggcgaagttgaagctctactcttactggagaagctcatgtgctcatcgcgtccgtatcgccctcactttaaaaggtaccagccaatgattttattcttttcttgtgagcaattctttgatctgaatttggttcttgttcgattttcattagggcttgattatgaatatataccggttaatttgctcaaaggggatcaatccgattcaggtgcgtagtttctaggttatattgaactttatttgaagtaacattgtaaagataagaatggtaagtaactgagatttcttatgttagacttagaagtttattcgttttggttctctagatttcaagaagatcaatccaatgggcactgtaccagcgcttgttgatggtgatgttgtgattaatgactctttcgcaataataatggtcagtagtaacacatccatttagtttgtttggttttgttgatgaaaaggaacattcgtttattcgtcttgttgtttttcaaatggacagtacctggatgataagtatccggagccaccgctgttaccaagtgactaccataaacgggcggtaaattaccaggtatcttcgatcctttgtcttcagatgatgatgtgttgccatcatctgcaaaaccatgtagttaagtccaaatgtagtgaacattatcagctttagattgcgagtgtgatcgttgttcttattttgtatatttcaggcgacgagtattgtcatgtctggtatacagcctcatcaaaatatggctctttttgtgagaagatgagattaatgtaatggattctactaatggaggttctataacaaagcaaacatagttacattttgtcattttttttaacagaggtatctcgaggacaagataaatgctgaggagaaaactgcttggattactaatgctatcacaaaaggattcacaggtatgatatctctaatctacctatacgtaatcaagaaccaagacatatgttcaaaatgtgattttgttgatattgtggttgtacaggtttataacgacctgtctgataatgtctcatatgtccttcagctctcgagaaactgttggtgagttgcgctggaaaatacgcgactggtgatgaagtttacttggtatgtctctaaatctccctggataatctctatggtactactctcttctttattacaatgaagcattgttttgcaggctgatcttttcctagcaccacagatccacgcagcattcaacagattccatattaacatggtacttttcctcagctaatctcttctcctggtacctagatattgcattgtatatccccccaaattccatggaatccttgatcagagttttaaggtagcatgaaccaaatgttatctctgtctcacactttcacattcacagagtaacatagacgtaatactcagtttcataactttttttcctcgcatcacttggttttcatctctacaattttgttgtataggaaccattcccgactcttgcaaggttttacgagtcatacaacgaactgcctgcatttcaaaatgcagtcccggagaagcaaccagatactccttccaccatctgattctgtgaaccgtaagcttctctcagtctcagctcaataaaatctcttaggaaacaacaacaacaccttgaacttaaatgtatcatatgaaccagtttacaaataatatttcattccaaacataaacatgttgtattcatcagagagattcagtgaaagcttacataaaccgaaaatctcggtttgatcgggtcggtttgatcggtttccaccgaaatcaacagggctctcagatagactcttttgactgaaaagaaaacaaaaatatttgcatctgatttacgttgaccgtaaaagacaaaaaataaaaataaaaaaagtctagtgtcgtcgtcgtcgtcttcgaattcgccacttcttgtatatacaaaacaaagtaatcgcgaaaacacacaacaatcgctggactctgctactgcgaagaacaacaaattccttgtttatc

SEQ ID NO: 12418 - DNA, 3000 bp, Unknown
  misc_feature (1)..( 3000): cDNA_ID_3025082_gDNA_ID_2214549_Annot_ID_185520 3000 nt of promoter + ATG
tcaacagagatcatctgtcatcgccatcgctggagactacacgaaagaaaatgttcaatcgaaataaaatatcaagggacatattttttcttctctttcctctcaactaatagcaacttgccacgtaggggtccttagttgtcgacaaaatccctaaacatagaaacgtccctctctaataaactgattaatgatttaattttttgctatattactcaagagatcaaccctcaagagcccattaggaactgccgttgagcttggtctaagatttccggttcagtttgatagtattaaaattaaaccgagtgtatttggattaccaaaataacatttaacgttcacatttttaaaattttacattagcattgtactattgggttttaatatatggatttttgttttcaacatattattacataaaaagcattctaaactcaaatcaaaagctaaaacaaaaacaattgaaagacccaaatctgtcatggccattaggcatgactcgacgaagagaactacaagctttgtctagaacatcgttgatagcctaaagagttttaccataaataaaaggttgaattgccttcataaatgaaggggaaaaaaacacttttctaaagaaacttcaacatatttgagcgttcgaccaaagttggtcacaacttaatccttctgagtcatcagagagaagctacgctaatgtattgatcaatcccaccttctcatgactaagcttcacgcattcaaacaaattttaatcagcttatcaagacatcgtattgttgctcggatctcatctttagaggtattacaagaaaaaaaatatcatatcacactatttctataacaagttgttaataatacatgtcgaagtttaacatacagtgtttcagatagaatctctagtctcctttagttcctttcaaaatatgttcatacatggagaaatatatgtcttcaaagcgtttgcatcttgactatcatgaacaaatgatgaaccggacaatgctacatcctgatcaaaactagatgaatcatgagtttctatgatcacctccatgtccataaccaaaagaatcatgggcgtcaaagaaaagaaaaaaaaaaacactttatttcatatgatttgtagatttggttcttataatatactctttaaccaaattacagcggcaaaatttatatttttgtagaatttacactctaaaaaaatacaattttctaacattgatagaacatttagttttagtataatgaatattcaaacaaatttggaacatggagcaaagcgtagaatgcatgttccaaatattttaaaattttgatattcagacttctaaaaactttagaaacgaaaacttgtataaaattcgtagaacatgtacaaaaatataaaatacatactctatttttcgtagaactctagaaaatgtgttctgataaaattagacgaaacattttctatcaaaaaatcaattgcatctaatcttcaatgatttcaaaaacttttccattcaaattctctatgtaaatcaatcatatttttctgattattgttttaaaagtctgattaaaattagaacaattcttgggtttaccccctaaagggtgaatccattcattcacccccttttaattgatcaattagaattttacatgtaatctatttaaagaataaataaattaaatcacaaaatctaaatcttaactacaattttatcaacccaaaccaaaatatatttcgtttaatcacaaaatttaaactttaaccactattttatcaacccaaaccgaaatataatttcgttttaatcacaaaatctaaaccctaaccactattttgtcaacccaaaccgaaatataatttttttttaatcacaaaatctaaaccctaaccactattttatcaaccaaaaccgaaatataattttgtttaatcacaaaatctaaaccctaactactattttatcaacccaaaccaaaatataatttcgtttaatcacaaaatataaaccctaaccactattttataaacccaaaccaataattttcttaataaaaattctacagaatttgtttccttaatttgttttgttttactaattttaatttttatttattctttaaatagatgacatgttgatttctaatcagtcatcaggctatcaacaatggttttttcattcaacaccctccacgtcatcttcttttttccacatcatttcttctctcttccacataataattcaatacccacttaaattttatactctactatggtttgcttaataaaattcaacactctacccactatttttatttcatttttctttcttttatgttttaaatggataattagtaaaaatagatgtatttttttgtatccaaatcaaataaaacaagtctttatttatagagtttgaaatatggtgaattttaatataaaaaaaaattaaaacaaatatatattttataagataattgatctataataactcagaggaaaagtaaatatcagaaatttcagtaacaaataaaagaataacacatgtcctatctatatttaactcttctctcacaatttctgtctccaattatttaatgacaaatagcagtaaggggttcatttttaacaattcaaaattgttgaatccgttcaacaccgttgaatccacataagattcatttctttatttaatattccactgtaagcattcaattattgaattaattttttcaatagcccattgtatatagtcttaaaaaggggtgagtgaatgtgaatgaatggattgtattttcttaaaataatgtgtaagtcatacgtgacaatttcacaacaaaaatatttatatggacaaaagaaatttggtagacatatttgatattcccattaaaaaattgcatgagaaaaagaatatatatgaaatggtttggtttcctttctaaacaagaaaaaaaaaagtaatctccgaagaagaacaaattccttgctgaatc

SEQ ID NO: 12419 - DNA, 3000 bp, Unknown
  misc_feature (1)..( 3000): cDNA_ID_3025090_gDNA_ID_2214549_Annot_ID_185518 3000 nt of promoter + ATG
ctaattgttgttccagttttcattatttgtcttgtatatttaaatttttagtatttgtattaattattcaattttatgaaataaaatatttataattttattttaataataataatttttgtaaaaaatccacttaaaaactcgactacgaaaaaattaactaagcaagaaaaaaataatggaccaataaaaactcttaaacttaaaattcacaaaatttaagattaaaaaaatcggaagaacactattaacgacccaaccattggggttgctcttaacattgtttcatggctaagaagtgaaatgaataatcaattgtctaatgaattgtacaaatgtggtttaagtaatgcctaaaaagcaaatctaaaaactcctggacaaccgtagattaaaatatacactactagatcaaagagagcatgagcatccatattttcatacactattttagcctaaatgcttcttttatttgtttcaataattggaatcagtcacactaatataaatccaatcttgactagtcttagtcttcctactatatcagactttttttaccccttttgttatttactctaaatcctgctgaagaacatgtcaacgttcaaagctttatacaaacctatcttagctttgtgtcaactttcggctaaggcaaacgctgatgattatcttcttcgtgctgaactacgttcttcatctcgaatctcacttttcttacttgaacttcttcatcttcattagcttctgcgttttgaagctctctcaaagctcttttcgcgtacacagtgaaagcaacagtggtcacaaccgcaatgactaaggagattacattgtacacaatctccactgttgtcaaacgttgatgtccgtattgcacatctgcgaatgttctgattaaccgaccgctgcatatgaatcggaatttagaattaggttttcgattcttctgattttaactgttttgatacgaggagagtaagactgacctgtaaatgtagatgaaagcttctggtatcattcctgctatggatccgaagaagtaaggccagaatctcatgcttgtcacgacgattgcgtagttaaaaatcgtgtaaggaaatggggaaacccgaaagattgccacgactctgaattgatggaaccagcttccttctgcagctagtcttagaacagcagcttgacgaggccatctttttaaccattgctgcattttgttaaaaaacaaatcatatctacaagtcagtgagcttgtaaaaaatgatcatatgacatgagaaaaagagaagtgaagggttcttacatggaggcgatcacggaacataagcccgattaagtaagggagaaccatgccaatggtggttccaaccatgataataacaaaaccgagaccataaccaaaaatcatcccagctaaccacatggaaggaccagaaggtatcaagaacacaggaaacaaagccaaggaaacaacaaggacaatcgcgagcataggacggccaaacgcagttgcttcccattgcaaaattggaataagaaccttcaatagaaacaaactattacaatccaaagagcagagtatgtgacatggatcatcacaaggaaataatcatcagaaacttgagatttgagtaaagaaattaccttttgaaacacaaacggaactccccattttccgaaaacaagcgtaagcaagagagcaactgcacatattcccaaagcttttaaccaccacataaatttcttactctgcacctctgattgcgatagagacaacacggtttcagctggggaggcttcatgagccacaactagccgaacatactcattatccctcatgtgaggagtagaatttgcaatatcctctcttgactctttcaatgggtttgacatcagtgttcagaaccttaaaactgaagccaaaattcaatatcagagacataaaatcactatttgtaagccatcaaaacaggaaaaaatcactgttctatacattaaaccaaccaaaaccgatcaaggataatggaaacaaaccctagaacatagctatatcaatagataaacagagagatgataaagatgcttagcttaaaaatcaaagtattgaaaaaacttcagcaacttgaaagacacacaaagagattacatacaagtaaacgataacgaaaaagtaaagttaattacagaaagaatcaaaactctccgaacatagaaatttccgattacgtctaaaaaggggaaaattcaaacccaaaatcaaacgatcaaatacatcactagagtaatcaaatcacttcgatctctcaatctagctaaagatcatcacaggaattataaagtagtagagctagggtttaacgaatctcacaaatcacacactacggaaacctaatcaagcttcttggtattaaacgacggcgttacggcggaggaagcttgtacgccgtcggaaaaaactgggttgttgcggcggatttacgtttgtttcaggtttagtgttgttttgctagcttctcaacaagagaagcgtgttttgtgtttgttttttttctttaattcaaatgaaaaatagattgtttgcttttacttaatttcattttttatcaattttttctttcgtattcgttagcttaagctttacttttctggaataacgagtcagactatattataaaaattcaaaacaaataatattcccaccgttgatccataatgcatacctgacttgacctttttttaattggtttgttagtttggaatttggatattttcaaaaccaaatccttaaccaacgaatccacaataatgaccaaaaaaaaacaatggagcgtgaagtagacgcgtggattgttcacaaatcagggctattttcgtcaatatgtagaacgacttgaaattttcgtaatccttaggggtactttcgtaaattaatagaacgacttgagattttacactagcttccgtggaagacgaagacgaagatacaagcgtcgatcgatg

SEQ ID NO: 12420 - DNA, 3000 bp, Unknown; identical to SEQ ID NO: 12414
  misc_feature (1)..( 3000): cDNA_ID_3025097_gDNA_ID_2214549_Annot_ID_185515 3000 nt of promoter + ATG

SEQ ID NO: 12421 - DNA, 3000 bp, Unknown
  misc_feature (1)..( 3000): cDNA_ID_3025107_gDNA_ID_2214549_Annot_ID_185509 3000 nt of promoter + ATG
tagatcaatttttcaaactgtttttaaccttctctttataaattacccgatgcacgagttgtaacaacgttatttttttcttttgagtataatttaacattctattcaaaaaaaaaaaaaaatgcaattatcggaaaatcacgttaagcaagtgaaaaactaacactaacttattttagttcttaagatatttttaatgtatgatttttatgcaaatcattcacacacatgaacacattacaataaataaatcaaaacgtgttttaatcatctacaatgcttttgtacactttacttagcaaaaactatagagacaggataacatatgaataaatttatgtacatgaacgtgtctgtacatcaactggtcttagtaaagttctcagattttgtagaccattgttaataagaaaaaaccaaacccaagagtaaaatttgctttctgaaaaaataaaccaatagtcagttaaaaaacaggcagcgttgcgtgaacgtgtaaggacgcacgcggcagggcaatgatgcgaataagggtagtttcgtaaatatgtgtggacgactataaacgagtcattttctattttttaacaacataggccgactttagaagatttctttaaattctgagtttccaaatgaagaaagatgatacaatcaacaatgggacacaaacaaagcgttgactctagaggcaaaggccgaaaagttcccggttcttcgtcgatggtgcaaaaacatagagttgaatctagcggaggagctatcatctccggaccgtcactgttcgataacttaccggaggattgcatctccaacatcatctctttcacgagtcctcgtgacgcttgcgttgcagcttcggtttcgaaaacctttgaatcggctgttaattccgatagcgtatgggacaagtttcttccatcggattattcatctctagttcctccatctcgagttttctcatcgaagaaggagctctatttcgctatatgcgacaatcctgttctagtcgaagatggcggaaaggtatatatattacatcggtttttatacatattgctttattgatacaattttggtgtagttgtcaagttatacatttcatgcatctattgaaatatttatgattgttttgattttttattttttgaattatttcttttattttccaaaaataaaagagcttctggttagagaaagagaatgggaaaaagtgtttcatgttatctccgaagaaatctatgtggatcacatgggttagtactcctcagtattggcgatggatttcgattcctgaagctaggtagaacttcttttttggtcattcatttcgattgcataatcactcattctcatggtgatgattatgatgatgcactcatgcaggtttgaagaagtaccagagctgctcaatgtgtgttggtttgaggtccgagggggaatgaatactaaagaactatctcctggaacccgttactcggcttacattgtgttcaagacaaagaatggatgtcctaatttgggggatgtgccagtagaagctactgttggattggtgggacaagaatcttctcaaagacacatatactttgttgggccttcggatcaaaggagagacagagaaacgagagatgtaacgagaccaactaaaagaaaagatggttggatggaagctgagcttggtcaattcttcaatgagtcaggttgtgatgttgttgacacaagtattcttgagattaagactccttattggaagcgcggtttgatcattcaaggaatcgaattccgtcccaccaaaagcctgttctatatataatcaagtgaaaaactttgttgtatgggtaacactacctgtttttagtttttggatattgcactgtgtttgatttggatgttcattatataagcaagtgaaaaactttgttgtatgggtaacactacctgtttttaatttttggatattgcactgtttgatttggatgttcatcattctcacatgaacatatttcaataaaggaattgtctttttttgttttcatatcatctacaatgcttttgcacagattacttagactccgaatggagacgtgcggttcaactgcgaataaagtgcggtacagttcaaatagtaacaaaaatatatacatacatatatatgcaaagaatttcgttattatttgaaacgcactgcactgtgcggttcggttaccatttagccaaaaacaatagagatagaataacaaattaaatttgttcaaaaaaaacaatgaatatatttgttacttccataatcttttttttggtgagctgttatttacatgatctgattttaaacaaagactcactaaatttataaattattgactttttctgactaatataatttattattatgtaacaaagacttcagaggtaagttaaacacgaaacaattatttgatttgggtgattaaataaaggcaaaacttttttttgaaaaaaccttttgagattctctgaagacgattcattttacaaggctaggatcggaaaattacattatatcctgtaacgatcactgacggatataaaatatctgcctagtttccacgctttattcaccgtttcttagatcatgctccattacttaacaaaaatcatattcgtaatgaatggacttatatttcaattgtatgtaacaactttagttattctctcttgtattatcacattgacattttcatcataaaatcatttacatgttctatttttgctgaaataataaatttatcgtagtcggttattttggaaattttcataaccaaaaaagtgcaaaaaccaaccaacactgaaaacatgaagcgtgtaatgtaaggtagtcttgtaaatatgtgtggacaacattacacgtctattatttcctctattacaacagaagcgagttttgaaagagtcagaactcacgagtttatcaagttttcgaaacacaaacgatttgatcaaaggcaccgatcgatgatg

SEQ ID NO: 12422 - DNA, 3000 bp, Unknown
  misc_feature (1)..( 3000): cDNA_ID_3025110_gDNA_ID_2214549_Annot_ID_185507 3000 nt of promoter + ATG
ttgcttagtcatgccctgtagctgaaaccatttgtccatgattcacacattcgctcagttaaatgtctaaaacgtttatattcctacctagtaactaccatcttctagatcacgcctggaaaaagaagacatcgtgtagctgaatgatctcttgtgatttgtgaacaaagtgtatatggttattttgatttgttgagaaaacagaaaagatcaaggctttttgtgatgtgaatacaacaaacccaagcaagtaaaactgggtcagttctaatctaacttcgaaggcttttaagaaaaactatactatgggctttgttgcacacattacgaaaacaacaaccttgggtttttagtgaatagaaatagttgagcttttaaactctgaaagattgtgaattgtgttgtgtaacaaagcaagagcatttttttatttcattttcaaatattatctttcacatttgtttcgtttttctatttaaactgcaatgtttttttgggtcaaactacaaagtttttttctattttgggtatttttcctataaatttagtagttaggatcgtagtatattttaggagttttagagacatacgggaaaggtaggaaaatattagaaagggtaaatatcagtcatctttatttacattctaatttatacttttttaccaaaaaaaatcgttgtatgttagcaacaaccagcaagagtattattagtttattaccaatcaaagtcacactatttgtaatatcatatatatcaaaattagctataataaactataaaacttagtaagtcaattttcagaagaaaaaaagaacctataaaagactaacgaaagccgattatatcgaagccattacgagccacatggtattgaagattaattatagagttgaatagtcgatgtcacatgctttgactgtctccttcattatagatatcgacattaatattttattattaacatggaatcgtatcttaacttttccacgtaaaacaatatttaatctctttatgaaagatcatgcacacactaggaaaactatataagtgatttcttatatggtaaaccaactttgaatgtaggctaattagtttattaagcaatatagtcttttatgtctatgttcaattcaccattcacccatattgtcctcatttacttataaatcaagtaaaccatcaaagaaagttgtgtaaacagcctatttttctttaagaaataaatcatggcaagaaaatgtgagactttttggttttattttgttaaaatgacaatctattatccttttctttttttcgaacaatctataacgtgtatattactacaaaggtataagagaatccattttttaactgccaagattaatttttttttttcgattctttccaattaattaataacggattctatcgacaaaatttaggatagcgttacatataaaagtaatattaacgcatcctaaatttgtcgtttttaaaagaaaaaagtattaacgacaaaaaataatcctttagcaatgaaaattggtgataaaaaaactgaagaaaaaagcaatgaaatttatgttcctataccgactattttttagtttcttttatataaaatataaaatagtttatatataaccgttcttttatttttttatcgtctacaactcacatacgttacacttttatagttatacttctaaattagaagtcaagttattgtatagtgatattataaacttcaagttatacaagtccggtcatatgaaattaatattagtaatttgattggaattataacgtattgatttggacatgtaaatagctaaaaaaaaatagctcctatattagattcttttaaccaacaaatacaacaattaagttgataaccttcctctttgaagtatttcaagattttatggaaaaaactcaagatttttttccgaagcttttatcggaaactaaagaatatctagtaggtctattttcattcattatcaacttgcgaaaaaagagaaacaatgtcaataattaatgtaaatagaaaaaaaaaaaaattgtagttgagaagagagagagatgcaaaggtgtcaacgtccgtgctttgacttctatcttttctcttgtcctcatcttaaatcctcaaagctgacctaaccggtcactcccttcttctccggtcatctttaattattattcaattaacccataatcaaattttaatataaaaattaaccatttgcaaaataaaatcaatataattaataaaagctactcctttacctttttattgcatagaaactactaaaatataaatctaccatttgcagaataatcggcaaaaaaccataaagaaacatttatagtcacataattttgcatatatttttctaaattcgatcactttcatcattcattattcattaatcgttccaaattttcttctgcctatccgttgaacgacaaactattcaaagtaaaagatttagacaaaaaaataaaaaaaatatttagagaaagactttcctaagtcaatgttattgattaagacttcatatatgactaaacacactcaattataattgacaaaacacggaaaagatttgtctataacaaattttccaaaaacacaaattaattcacaaaatatttggaaaaataatatttattcaaagcttcttatttcttcttcttctttatttaaagatttttactgtttgctctgtatcagaaaaaagaccaaacacaactcttccactttctatctctctctagaattttgcttgcattaaaacaacacccactacttgctgttgcgtgttgaagtcaaaagtcgccatttttctctctcttgcttcttcatcttcattgatcatcatctaaaatggcaataatcagaaaacccgtttcgtatactctcagatttctcaagggtttttgttgaatcttaattcttctctcaaagtttcttcctttatattcttcttcttcttcctctgttcttgaaatg

SEQ ID NO: 12423 - DNA, 3000 bp, Unknown; identical to SEQ ID NO: 12418
  misc_feature (1)..( 3000): cDNA_ID_2708879_gDNA_ID_2214549_Annot_ID_134642 3000 nt of promoter + ATG

SEQ ID NO: 12424 - DNA, 3000 bp, Unknown; identical to SEQ ID NO: 12417
  misc_feature (1)..( 3000): cDNA_ID_2711993_gDNA_ID_2214549_Annot_ID_134643 3000 nt of promoter + ATG

SEQ ID NO: 12425 - DNA, 3000 bp, Unknown; identical to SEQ ID NO: 12416
  misc_feature (1)..( 3000): cDNA_ID_2711989_gDNA_ID_2214549_Annot_ID_134648 3000 nt of promoter + ATG

SEQ ID NO: 12426 - DNA, 3000 bp, Unknown
  misc_feature (1)..( 3000): cDNA_ID_2708904_gDNA_ID_2214550_Annot_ID_134653 3000 nt of promoter + ATG
catccttttggtaagaactgcatcttttgaatgctattcttgaaaacttgtttggacttctagatgaaaagaaaattcgtttgaaaatgactcaatcattcggtgtttgttatgcttgacttgcaggcaggactatttttctatgatatcttctgggttttctttactccagttatggttagtgttgccaaatccttcgatgctccaattaaggttagtaaaaatgcctcaaaagtacacaccataccaaattgattctgatttgttcttagtcaatttttcagtaatctcattgttacatatttctttcagctcttattccctacgggtgatgctctaagaccctattctatgcttggtcttggtgacattgtcattccgggtatgttctctaatgcttaacccaatagctatattcagcttatggttatgcattcttgaatcatatttttggatatgatatgaatataagatattaatttttgttttcctttaggtattttcgttgcactagctctaagatttgatgtgtcaagacgtagacaaccacaatacttcacaagtgcatttatcggatacgctgttggtgtgatcctcacgattgtagtcatgaactggtttcaagcagcacaggtcagtttttgtgtcttaattgttgtcatctatttattgcaaccttattttgggatttctctctgataggtttttgtttttgttttgcctttgtttcagcctgctttgttatacattgtcccagccgtaattgggttcttggcttctcactgcatttggaacggtgacatcaaaccggtttgttttctagtccttctagatttcgatgtatctattgttgtaaacgcaattatgcaacccaaacagaagaaccttcctgttaccttctgtttgcttatcgtgtttttggttgtagattaagatgtaaaggattagtgagcttatggtcttcttcttcttctttgttttgttgctgttgcagttgttggcgtttgatgaatcaaagacagaggaagcaacgactgatgaatcaaagactagtgaggaggttaataaagctcatgatgaatgaggaaaaatcgagaaagaagggcagaggagaaatatatacacataaatgtgtcttaatatatggaacaagaaggaaaacaattttgtttccaaatgatcatcaatcagtcccttctaaccccttttttgtttttttagattttcaaactttcttttggccaagacttgtgtaagttactataagttacaacaaattttctttgacttttctttctgttttatgttaaattcgttaggagactggaagttatatatcatttcgaacagaattcgaaatatgagctttttagctattgtagacaacgtggtaaggatatgaacagtgagaggcaaagaatagcacatgatgatgataaagttatgaacataatctgtgctgagaaagggacatttttgcttggggagctatttggagacaaaaaaaagctagatagaaactctacacttaatgttttttttttttttttttctgacatctagtacaattattgcttggagagcaagttgtgtgtttaataatatataacgtatatgtaagttgaataaaaatgtagagaaaaatcttaatgttaaaaaaaaagagagtaggtttggggtttaagtttgtgattaggtctagagctaaagccaaggaacaagcacgtatcaaagatcaaacaaaatgagagtactgagggacggccaaagtggtggtggtgccaatgagggagctaaagcggagaagactgtgtttgaggttaaacttgagtctttcgaggcacgtgcgaaaatcaagatcattaaggaggtaaggagaatcattggtgtgggtcttaaggaagctatgaaattggtggtgaaggctcctacggttttgaaaacaggactttcaaaagaagaaggagaggaggtcgttgagaagttgaatgcacttggtgctgaagctgttttacagactagagtgagtgatattccaagtctgttttggaacagtttgttccatctaataagctgatggatgatgataccgttaataagagcttattagctcaattaggctttctcattgctaatgttttttttttataaagagattaactaaaccaatgtatctttgcttgtttaacatgtatcgcaagtccttcttcttggcataataataatcgataaatttgggaactttgttgttattccatggctttaatgatctccagtgagagttctcttactttgctcatttatttggcctgactccacagcacaactaatttgtgttgatatcaagatcttgcaagatatgcaagattagaaactgaaaaaatgtagcaaacacagaaaaatgtcattgtacctaaacacaaaggttacaaaactagggacataccaaaaaaaacaaacctccaacactttgtttgcgtgttgaaagttaaaagacatataacaatagattttaccaagaagtgaaatattctcacttggagatgtcaatatttacatctccgaacttaggcctaggaggatccgttgccatatccacatgacccgaccaattagtttactaaaacagtgtgattgttcatttccttctaccatctttggttgctatctcaagtcaaatcttgaacttttatttcccatcaaaaatattcagcttctctgtttcaagcacttacactaatgggctatatgagcccatttaaagttggtacatttgacaatgtgcgtgtccttttctttttttttgtttaacaatgtgcgtgtcctatttaacatcgttgtttactcccaacaaaaattaaaaaactctacaatgttggaatcgagtgtattcttcttcacaaacaaacttattatcttcaacaaattcggaagattcacaattgcttgttcctctcttatgtctacttcccagaaaaatttctgcttttgaaattcaag

SEQ ID NO: 12427 - DNA, 3000 bp, Unknown
  misc_feature (1)..( 3000): cDNA_ID_2712007_gDNA_ID_2214550_Annot_ID_134654 3000 nt of promoter + ATG
gaaatataattaagaagaagaaggcaaacagtaagaaatgacatgttgtgctcatgccctttctatgatttgcagagggaaaactgatttactatgcacagaagaataaaaaaagaataggtgaaagtatagaaaatgaggacagaagaagagcttcggatctgcatgcttgtaagtaggacgcataagaccccttgtgtacatcttctgtacctagtagaatatatgcttttgttcaattacaagtatcataatagtgtatacatgatatatggaagttgtatgtgatcttttgggtatctcaaagctgttgtgtcggtcttgttattgaggcagagatgaaaactaaagttatttcagatcatacaaaaagaagtttagtattcatttcagaatcatgttgactatgcgtctatagtctatacgattcagtgggtagggaaaaagagttggtaacaacgctataacacgacctgaagctgcataatgagatggggtctagttttctacagtcagagtcaggaagttggaagtgcacgcaggtaacgactaaatttgttgacccattgtgtcatagtccatagtccagaacttcaaattgtaactttattttagatgtttaaagcaactctttgttttggtggtatatacttctatcattttagggtgcacatctgctgcggctacctgtaaacggtatgaactaaagcacaataagatgttggagttttctcgcaaggccggaatgaggaggagactgatctttagttgcaggattatgcagttgagaaaaaatgtaaataagttgaatacagaaatcacaagacttgcacatgggggttactgaaagtgttgttagagatatatacgagcatataagaaaagtgagctaccgatgaaattgaaggtccctatttctgtatttttgttaagatatgatatgtttttccttctttacccatgaatcttgtaaaatctatgcagactcaagaaaggagcttagtgtataacgagactgtggttgaccttttaaatcgtgatactgagcccgttggactattaaatgatctagaggtatttaaagggttggaagctttaagccaattgctgaaatagacatacactatctcggctacttggagaatgttgtctattttgcagaaaggaaccattttgccattgaggagaatctgatggaggaagtggttgaaagcagacagcatttacatcatttaattggcatttgtgaaggttatacttcctatcgcttgttaatatactttttatgcatttgatggtgatggtattctaggtgcatacgtttggcaaagcctcaaagtgtgttgatgacattttgaagatatgactcattgtctctttaatgagacacatggtaatcatcttttccatccatgtatgtgattttccatttgcttttatagctcaaaggcaactagaaaactgctttgaacgacaaaagttcaagatcacatacaggatctagaatgaaggaattctagaaactaagcattctacgaaagttttacctgtaaagatgtagtgatatcaaattcgctctcctattaacattactcctattgcttcaaacttgtctgtgtttgatgatgtgcttattagaaaaacaaaaatggttttggttgttcttggtaaaaaaagacactcttctgatggtcttcattttaggggtttgattttagctgattttttgttttaggttgtctcagacaaaaaacatctgcagcaaaagtagcgaaactcgagtcagagtaaaggagcctggagtccagttcatctacctccttgaagtcgcttttaactgagaatgagatgaaaatccaacagctatgacttcaagcaggttgacgaactggactcttaactctgactacaagcaggattcacatcttgagtgatctcttctgaaaatatttaaaatgtggacctcacttgacagactacaagcactgttgaattcagttttattaacaaaaacaacatggagattgatttatcacttgcaattattcattcatgttaaactaatggcagaacagcttaggagaaatgataatgtgatgtgaggcagttagtctttaacttagctggtgcctattgtgctactccactgatgctatacctctgttgatagaatcatacaaagaagagtaatggatcttgacattatatttttggacaaaaccacaagcctcgagtaaagtttccaattttttttttgatatttagacaaatatatcaaaaatggtgatttactaaatcttatactaactataaaaaattcattaccatctaaattttttaatgctagattttcattttttttttcattttttttcttcacaaatgtaacattatattaaacattcgatacaatacataaccaaaacaaaggcccttaaagagatacagaaagtggaggctcaaactagcctataacgggccaaatttgttttgaaaatataaaagaacgggcctataacgaacttataaaaaggctaatatataagcccattaaaagataatgcatgcgtgtcctctaacttgaacccttactactaacaaacatatcgttctctttactttctcttcttcacagcaaactaatcctcaaaccattctctcaagctcgtcttcttcctctatctgtgatttctagggttttgttttttccctttttaatctctcaattgcttagtctcttcctcttctctcaacacgtaagacacgcaaagaagaaacaatttttcaatcttcttgtaggtaaagtccgtcaatttaatttaattttactcgcttgatcgaatcatgtatgtgaattcgaaattgtagtttagggacgtgaaaatttcggttgattcatgttgtttttttgataaatctttgttattgttcgttcttcgtattatctctcaaagaatgtactaactaaaattacaaaattgaaaccagatgcatagagat

SEQ ID NO: 12428 - DNA, 3000 bp, Unknown
  misc_feature (1)..( 3000): cDNA_ID_2708920_gDNA_ID_2214550_Annot_ID_134661 3000 nt of promoter + ATG
actatgttccctctttacaggtttgactataatgtttcttctgttctcatgaatatttaaggtggaacttaatgttttgatgcactctgccttctttgatcttcgtacagtttgttcgggttcgtcgttctgcacatacttatgtatgctggtaacatatactactggaggcggtatcgagtgaattactctttcatatttgggttcaagcacggtactgaacttggttatagacaagttctatttgtgggattaagcattggagtctttgcacttctttgtattcttgccaatcttgacatggaggttgaccccgaaactaaagattatcaagcattaaccgaacttcttcctcttttcctgctcactgtaagtctataaatccaatattcagcttttaatgcgaaaattagcgatatgacaataataacggaatgactgtgtgatatagggtatgtttgtagttctagtcttaccattcaacatcttctaccggtcgagtcgcttcttcttcctcacttgcctctttcactgccttgctgctcctctatacaaggtaggaacagaaactgaacgtctcattgatgattgatgatgaaaaataaaaatttgatcattgtacttcaacatatccaaatcttaatattcgacttctcctgcaggtaacattacctgatttcttggtgggcgatcagttaacaagtcaggtgcaagctcttcgaagtatccagttttatatatgtcattacggttggggagattacaaacatcgaataaacacttgcacagagtcagatgcctacaatgctttcttattcattgttgctgtcatcccatacgtctctcgtctccttcaggtacaaagcttgttgagttcatacgaaatccaaccattcgaaactctcttcattcatataatatttgctaaagaacactatatatttgcagtgcttgaggcgactgtttgaagagaaaaacccagaacaaggatacaatggcctcaagtacttcttgactatagtggctgtctgcttgaggacgacttacagtgtcgacgaggataatcaatttatatggagaatattagctgggatcttctcagctattgctgccattttctgtacttactgggacttagtctatgactggggtcttctaaacagaacatctaagaacccttggctccgtgataaactccttgtcccgcagaagaaagtatacttcatcgcgatggtaagcacaaactatagagtaacacaacatttggaatcctagtgcaaaattgattcttaactttaaaaacatatgcagatcttgaacatcttgctcaggttcgcgtggctgcagaccgtgcttgatttcaatttctccttcatgcacagacagacgatggttgctgttgttgtcagtctagagattatccgccgtgggatatggaatttcttcaggtgagaaaacataagttactgcaacttttcttcaccatgtattagcgctatttactgtcacacaacatatgatataactttcttggggatttgtttatgcaaaaaaacaggttagagaatgagcatttgaacaatgttgggaagtatcgagcatttaagacggttccattaccgtttaactacgacgaggatgacgataaaggcaactagttttctcggtttctagtcttagattctgtaaagactgattcatccacaacgagtaggaggaagatggactagactaaagctggttcattgagatcaaggagatgtttcactcaggataacggatattcgctagattagccatagtaattagggtcactgatttgcacttaaaatttgtttcattgagagaaacatgaaattcatgggcatcaacaaagcaatgacttaaaaaccaaattctcccacaataacaaaagtaataatcagaaacattcaaagtatcagaataacttaaccaaataaattctaataatcgctcactttcccttggtttcttcttcttcttccttcttcttcgccgcagcggctgcctcctccccttgttccaactcctttaacgactgagtccgcatctctttctgcattgctagaaacggtccgtagtaatcgacgttagtatacatacatgtaatcagcttcaatctagcatctcgacagttcgtgccgtcatctttcacttccctacaatgatcaacttctatgaatgcatctttgcaatcaccttttttcaaataccgactaagccaacactcttcacaatcttcttcctctttctccttgttagtctcactcaaatcatcatcagaacttactgttttggatttgttcggatcttccgaagcagcagatgaatctcctccttcatgatccaaagggtcgttaccgctttttggtttgctctcagaattctcagcattcgcattcatagaagacatggttgtttgattttaaaagacgaagttaggtttgagagtcaagaacacaagtgggaagcttaaaacccctcctcttaaaccctttagttatgtcggcttttaagttttaggaaatagtttcgttaaaacctattcttggagaacaagtggtggtattcttggagaacaatttttcttttatggtattttaagatttttttaattttaaaaatggtattttaagatattttctctttaattatcttattacttaaaattatatacattattttataaaattttgacatttgtaattttttaaagattactgtagtaaaaatttgacagtcctaattagaagtaattaaattttaacatggtttactttttctaatattcacttgttacaataggggtcaaaatataacattacaaagtttatggtgtaaaaagtaataatgtagaagtgaagatattcaattgaaatataattttattacaattaaaccatgtcgtggagacatgttctgaaataaagttatgaagtcggtgagtgactttagagtctccctcaagagcaatcaatg

SEQ ID NO: 12429 - DNA, 3000 bp, Unknown
  misc_feature (1)..( 3000): cDNA_ID_1834360_gDNA_ID_2214550_Annot_ID_134663 3000 nt of promoter + ATG
aatatcttatatacgaaatcaattaaatattaatcacataaatattagcacaaaaaaatatggtacattcgggtctatagtagttttgcaagacttttttggtggatttgggtaaaagtgcattctggtcatatggtagattcccttattaaataaatatggtgcactcctatgttattagctaaaatgtttagattataattcagagtcatatcataaataaaattaatattaataaaataaatggctttttggtaagacggatttggagggacgggtttttgaatcaacattaataaaaaggaaaatataattaattcaccgtttcaatacgggttaaatctttaatttataattttttaataacaattaatatatataaatacttaataataattataaactgtaaatatataaatattttataaaaataaaatttgcaagttttaatatatattacttttaaaaaataaatcatcccgcggtataccgtgggttaaaatctagttatagcatatatttatgatgctgccaatatgatccgaaaacccgattgttcttagtaaaatttgtcattataataaaatattatttctttaattttaaaacaattattttttgggttaagtctcaatattgttgttcaaatattattcatttttaaaagataaatttgttcaggtaagatttttgagatttacaggccaatttaatgctagggtgcgtcaattaacctcaaataataatagaaactaacgcaagagagaagtcgacattggtcacgaaaacccgcagctgagtcatggctcgacacgactcacgagagtctcccaatccagctcggggacaacttttctagtagcagccaaaattggtatctcccattgaagcctaacaatcaaaaaggttttggcatccaaggcaaagcaagtaaacgtttggaatggaaacgtgtccaccataaaaagaggctttactatagtgatgagataacgagtgcataccaaacgtaaagagtaacgcactaaatgaaaaaacaaacaaaactccatttcaataaatataatgcatgaatgcgtccattcaacacatgcaaaaagaattaagaaaacaaacgacaacgaagaagagaaaggggacgacgcggcgtgactggctgtccttcaaatagacagaaagtcaaaaactatgagaaatataattttattactcaataataatgtcaagttaaaattatatatgttacaagttatattgatcgtccaattaataataagtctttctatctcaatatataatttcagttgatttgaaaataaaaatacttgtttggaatttttactttgaaatcatcataagttctattcagtggctaagtactttcaagtttcaaccaacataaagatcttcagaatttaacgaagtggatcgttcttcttagatcgtaatctttgtgaatacttaaaccatatttttgtctatggtaaacgaaaaaagaaacatgcatgtggtatattgactggtgacttcttaagtccaaatagataggttcatgtttgtaacttcgatgtcacataagaatatgaaaagctgtaaagctaagaccagccagagtaagatcttatcgtttagatttgagatcttcaagaaaagatttagcatatacaaacaataaactaatcacagtatatacgtacgagcagcttcataatttgagaaagtcaagtggggactgtacatttataattatttttatatcaactaatgatttagatggtactggtaggacaaaataagatgtgaaatatttaactaacaaaataaaataagctatgaaatatgtgtaagataggcgatataatcggtgcaggaaaaaccggaccaatgcagacgatttagccaatacttttagggataatttgctagataatctgtttttatattatagtttgttgaactttcattttcttaacaaacaactctttttttttttttcaacgtaacaagttagacatacctatgttgatacaaattgtagttgtactattaattaacagaacgttaaaagtgtgttatagctcacgttttaagttattaattattggtggtatgaaaaataatttgatttttttcatgtttattgataacttgcaaaaaattggatactttcacaagttgcatgatttatttcaagcgtaacaaatatgttttgagtgatatacagtaatataacaaatatagcaactagtcttggaaactttcaaattctttcaaaaattcacaaatatgtttggaaactttcgcctaaatgttgaaaatcttttacaaacttttggaaactttcaagacttgttgattttcttcactatcaattatctaactttgattccttttcttcaatttctttctatcttaatgtttcaaacttatatatatgtcgtgacgagctgtgacgagctgtgatacaaaccacaagtccataaccggcctttgatgcacatgtctttttgccacctccacctccaaaaaaacttaagtctacacgtagaataaaaggctgctacatcactccaatttatctatctctatctcttttattttataatgttagaataattcagattggtatgtcaatattataatattatgagctgtacgtgttctattcggttccatctattgatgtccgtcgtgggacattcctcacgcgctttggttgcccaatctgaacacattggtaaatgtgttttcaactataaaccaacgaagatttgatgaaaaagaaactcgtttttataacaaagctaaaatcaaggaaaattgacccaatgaattttttattatatattgttggactgaccagtcactattttacccatcttaaagacttaaactaagttttgttctgtcttctctttcactcttcagacagacacaacagtgaaactaaaaagattagatttcttcggacaaagattttctcgagattggagaaaaatg

SEQ ID NO: 12430 - DNA, 3000 bp, Unknown; identical to SEQ ID NO: 12428
  misc_feature (1)..( 3000): cDNA_ID_2708920_gDNA_ID_2214550_Annot_ID_185546 3000 nt of promoter + ATG

SEQ ID NO: 12431 - DNA, 3000 bp, Unknown; identical to SEQ ID NO: 12427
  misc_feature (1)..( 3000): cDNA_ID_3025134_gDNA_ID_2214550_Annot_ID_185539 3000 nt of promoter + ATG

SEQ ID NO: 12432 - DNA, 302 bp, Unknown
  misc_feature (1)..( 302): cDNA_ID_3025241_gDNA_ID_2214551_Annot_ID_134665 3000 nt of promoter + ATG
aagcttgttttttttctcttgcatgacccttcgcttctcttctcctctcttctctaccgaagtttgattcttctcagctgagaaatacaactgccgatcagtaagtacttctaaactcgtatctataatctgtaagattgattaatcattttgccatcaattaaaacccatttctcctgatcctgctttggtttttgtgtttcatttgtggggattcaatgatcttcactctttcaatctctgtggaatttttcttttccttcagattctcatatatacatagacgtgctttaactctgatg

SEQ ID NO: 12433 - DNA, 3000 bp, Unknown
  misc_feature (1)..( 3000): cDNA_ID_2712052_gDNA_ID_2214551_Annot_ID_134666 3000 nt of promoter + ATG
acggatttgagacagttggaggagtattcacttgcgggtatggtttatttgttgcaacaagttaaacctaatttgagtaaaggtgatgcaatgtggtgtttgctaatgagtgagcttcatgttgggaggccgagtactatggatataccgagttctggaaaaggggatagtagtaatgtaggggttggtggtgctagtagtactgtaaatggggttggtggtgctattgctccggcattgtgtagattccatggaggttggggttttggtaatgggaaaggacccaagttttctggtaatgggttttctttgcacagtgaagagttaacgttgcagagagagattgattgtccaaggagatttaatctctcaccttcgatgaagtctttgttgagagagaatgttgcagcctttgctgctgggtatcgtgctagtatggagcaaaagaagcaggtgcaaatgcagtctgaaactagtggtactagcttgtcttgcacggctgctgctacacattcagagaagtgtgagcagccacatgtcttcggaagtgaagaatgtttcagttcagtgctggagaaattccgggatctgaaccttgatgacaatgttgattcggcacctgaggagctgaaggatgatgctttaataggactacttcagcaggttcaggatctcaaaaagcaattgaaggagaggaaagactgggctcagaagaaggcaatgcaagctgcccaaaaggtcagcgatgaactgtccgagcttaaatcgttgaggagtgagagagaggaaattcagcgggtgaaaaaggggaaacaaactcgtgaggactcaaccttgaaaaaattatcagagatggaaaatgctcttagaaaagctagcggtcaagttgacaaggcaaatgcggtagtaagggcacttgagaacgaaagtgcagaaatccgggcggaaatggaagcttccaaattaagtgcatcagaatcgctcacggcatgcatggaggcctcgaagaaagagaaaaaatgcttaaagaaactactggcgtgggagaagcagaaaatgaagttgcaggacgagattacagctgagaaagagaagattaaggcactcaatagagctttagctcagatcactcaggaagaaaaagaatatgaggtaccaagtaatgcattatcttcgtttacacaccgagatttttctggttcttcacaatttttgacactataacctgtggaagtccatttagttagaacataagataatgaacccttctctttgaaagcgcatctaattatctgttccaaggaattattattcctgtaaatacttttcatgggccaagtctttctctctatgctgctagatggatcatatttgcatagagaggttgtctttttcaggcaacttttcatcttgttaatatgtatttgcaggcgaaatggaggcaggagcagaaagctaaggagcaagttttggctcaagtggaagaagaacagcgctcgaaggaagcaattgaggctagcaacaagagaaaggtggaaagcctgcggttaaagatcgaaatagacttccagagacacaaagatgatctccaaagactggaacaagagctgtctcggctcaacaaagcctcttcaactgactcaagcctccaatccaataacacctctcacacaaaggtgaaatcagacaagtcgaagggagaaacaatgtctaagctgcttgaagagctgaataggcttgatggatcatatgagaaggaagcaaactatgaccgggaatgtctgatctgcatgaaagatgaggtttcggttgtgtttctcccttgtgctcaccaagtggtctgtgcgagctgcagcgatagcttcatgggcagtggcaaagcgacctgtccttgttgcagagctccggttcagcagagaatccgtgtctttggagcgagttcttagtaacaaagataattatctggggtccaaagattaatcacagcacaacttcttttgtcaggtgtaatacttttttgtttgtttgtttgtttgtttatggctccgtctctctacttcctattgtctcttatcttcaatctgagggggtttggactattcgcatcttttacattgttttgagttgttcaaagaagatgttgcctggtttatgatcttcccaggattcacaatgtaagtaaataaaaattctaccacctctacccaaccctgaaacgtcgtctcacaatttctgatacacatgaatcacttgatatgtttttcttaccatgaacctatcacaaaaatttcatttttagcttctaacttgtggctaaaacaagttaagcttcaatttctaatattagcccattgttcttctgtaacaagtttcatttgttatcacaaaagctaatttttcttttcacttaattttgtctagtaaaatttttggaaagaactctattgacatttcaacaacctcggaccaaaccggtctacaccgttacagaccaatcaaaatacggaaattcaaatctatgtattaaaaaaaatcactacagaattacgtacgtacgtataaatagaggttagtacattaatcggcgaaaaaacattcgacgtagaatccgccttcggagacttgagtcgccaccggtgagtacttcttcgatacattccgccgttcgtttcctcttacttggcgtcttggggtaagcttcttcataacctatcatcatcctccttctccagctcttcgagtttcagaaaacctagatctctaagtttttatccctaatcttttagggtttctaccttgttcgatcattctgaaattatttgtcttctctcggaattcaattcctggggactttctcctttttggttagagaagtttatgtatactctctaactctactgttgtatctctgaaacaagtgatttgaaatttatagctcttctgataatcgaaatctgtgttgatttcgtggtgttggtttatgattgtagtgcagtgaga

SEQ ID NO: 12434 - DNA, 3000 bp, Unknown
  misc_feature (1)..( 3000): cDNA_ID_1024045_gDNA_ID_2214551_Annot_ID_134669 3000 nt of promoter + ATG
gtctattataacttttttattttgttcatcaagtaagatttcaggcttttgtttcgatttaggttacacatattcaaacttatccatatatacacttcagaatctaaattaaagtaatctgatcatgttttgcctaatgttgtcataaactctttagacatgtacatatttcattggaaagttactgaaattattgtttttgtcttatgcgatacgaaaatattatcacacttacctttcaaattataccaaaaaatatgacaatttattatatagattatcttgtagataaccgagaagtttgacatttccttaaacgttacgtgccgtcaagaattggcaaagccactcccaactactcacaaatcacaatccataagtcatagccaagaaaaccctttatgaaacacaaatgtttattattcctgaaaatacaaatttaaattccaatttctaccacgaagatagcttactttataggtatatatattttcttcaccaaatccgtaaaaagcaaaagtgatttgaatttaaatcagaaacgcgtatagattgtgtatatatgtaagttaaagggcatgcatacctttttaatgttatttaatattaatcttaattccattcttcatagacttttgaataaattttatttttttcttgagtttataagtcagggaaattgtcacccacttaaccactaggaaagcagatttggttactgaatctttttcacacctaaggctcaatcaagttttgatgggacctaagttgacctagaactcattttcacacccataataataataatatgacaaaacttatcacactttatttctttaatataagggaatctcaatattcgagtacaacacggaccattgatcatggaatttaaaagactagctagatcatgtacatcaataggaattttggtctcaagtactgtcatgctttgtgttgtgtctcaatcagacaggacaaaaaactgatctcttggttgcacattgggtattaagtatttttcgtctgttgtgtgaatcttaccaagcaatggttttgatgcaaatatgcattacatctggcctgctcgtatgtcccggtctatacgatctgcattatatgtacctggaagctctctaaaatcctcgttgaatatggaatatgcactgcgaaagaaagcatgaaaaaagatcgaacttattcagctctaacactcaaaagagaagatatttcatggcctaaaactcaacaatactcatgaggataccactttacagctaataagaatactagcagaatcttatgcttccagaatcctaagacttttttttcacatctccaagttaccaatgatgtttacgttttagataagtgttatataatttggtatctggaaaatgagttgctatgtcagtcagatcaatggaggctaagtgtttttagaaatgtacatacctaacatcaccaggctgtcgtttaccaagattgagcaagatgattgaaaatccagtccctagtatctgaaaccccccgtgataacaaagaaagccatcaaaggagattaaacagaaacgacttgttagagacactacctctctatacaaaatgtctcatattcaatggcattgcaaaaacgttgggcattttcaggaatccagacattgaagataaagatgacttacaaatatagggcccagatcccaccgatgtgcaataggcgccaagataaaccacaaggtgataataacccacatctttagacttaaagagaaaagtcccataagaatgatatctagaagatcatcacacaaccacagatcaataaactatttgtttcataagttcttggacattgcagatgatgcacatatcaaagattaaagagttctcacctggcagcttcaacttgttacgcagaaagtagtataacttcctcttccaccggcttgctgacggtgggagtttaaacttctgcaatgccaaaagagattttataaggacagaaactaaaaaaccattctttaccagttaagaaaccattctttaccaaatcatcatcatcatcatcatcaaatgactcaactccagctggtggatttggtattacagcaacaataaaggaatctacacaataaaatcaagacttgtgcataacctaaagacgcatttaacaaacacagataagcattgatgcttataacattttcagcagaacctgtttaccttggtccttgagcgtaacgtataaatcatctccatcttcttcgtcttgcaatgcctttccacgaagaatcatccttaaagttgaaacgggaaatttacccttttccgcaattgcatttctcaaatcacgaatctaaaatcagcccaaggatcaatcaatcattcccttcgtacaaaggaattcacttagagagataaagaagaagaaaattctttactttgatatgagacgccactcgaatttgagacggccgagctgggccgatggttttgtacgtgatctcgacggtgccattgttggttgaatctgagctcagctcttcggttgaattcatcatctcaccacgaattgtatgcaatcaatgagaaattgaggattagggtttcgaatttgggaattgaaaaaaacagagtttgttttctcacttgctacttctccgatgacggagagtcgacttgagttttcaatattttcatatctgtccttacatatgtttttaattccacttttaaccccaaaggtttcagagagtataaaaaactccaaaacattggaaaagcaattgtaagagcttctgcgtcaaaaagaaggtttgggttacacttttcatacacaccatatgcataggatgaggccttcaatttctgccttacatatcaaaagatagaacacacacacaaataaagcaaagaaacagaatatctttgagatctcctctttatttggagaagacaaaacacagaacaagaattagaaagaagggagagaaagcaaaa

SEQ ID NO: 12435 - DNA, 3000 bp, Unknown
  misc_feature (1)..( 3000): cDNA_ID_2708937_gDNA_ID_2214551_Annot_ID_134670 3000 nt of promoter + ATG
atgagttgctatgtcagtcagatcaatggaggctaagtgtttttagaaatgtacatacctaacatcaccaggctgtcgtttaccaagattgagcaagatgattgaaaatccagtccctagtatctgaaaccccccgtgataacaaagaaagccatcaaaggagattaaacagaaacgacttgttagagacactacctctctatacaaaatgtctcatattcaatggcattgcaaaaacgttgggcattttcaggaatccagacattgaagataaagatgacttacaaatatagggcccagatcccaccgatgtgcaataggcgccaagataaaccacaaggtgataataacccacatctttagacttaaagagaaaagtcccataagaatgatatctagaagatcatcacacaaccacagatcaataaactatttgtttcataagttcttggacattgcagatgatgcacatatcaaagattaaagagttctcacctggcagcttcaacttgttacgcagaaagtagtataacttcctcttccaccggcttgctgacggtgggagtttaaacttctgcaatgccaaaagagattttataaggacagaaactaaaaaaccattctttaccagttaagaaaccattctttaccaaatcatcatcatcatcatcatcaaatgactcaactccagctggtggatttggtattacagcaacaataaaggaatctacacaataaaatcaagacttgtgcataacctaaagacgcatttaacaaacacagataagcattgatgcttataacattttcagcagaacctgtttaccttggtccttgagcgtaacgtataaatcatctccatcttcttcgtcttgcaatgcctttccacgaagaatcatccttaaagttgaaacgggaaatttacccttttccgcaattgcatttctcaaatcacgaatctaaaatcagcccaaggatcaatcaatcattcccttcgtacaaaggaattcacttagagagataaagaagaagaaaattctttactttgatatgagacgccactcgaatttgagacggccgagctgggccgatggttttgtacgtgatctcgacggtgccattgttggttgaatctgagctcagctcttcggttgaattcatcatctcaccacgaattgtatgcaatcaatgagaaattgaggattagggtttcgaatttgggaattgaaaaaaacagagtttgttttctcacttgctacttctccgatgacggagagtcgacttgagttttcaatattttcatatctgtccttacatatgtttttaattccacttttaaccccaaaggtttcagagagtataaaaaactccaaaacattggaaaagcaattgtaagagcttctgcgtcaaaaagaaggtttgggttacacttttcatacacaccatatgcataggatgaggccttcaatttctgccttacatatcaaaagatagaacacacacacaaataaagcaaagaaacagaatatctttgagatctcctctttatttggagaagacaaaacacagaacaagaattagaaagaagggagagaaagcaaaaatggcactaagaatgtgggcttcttctacagcaaacgctctcaagctttcttcttctgtttccaagtctcatctctctcctttctccttctctagatgcttctccacaggtgtttgtaattgtgtatgtagttgtgtgtgcatagctttatctgaaactgttgatgaatgtctctgttatttttttagttttggagggtttgaagtatgcaaattcacatgagtgggttaaacatgaaggctctgttgccaccattggcatcactgcccatgctcaggttcttatttttgtaatctaagtgttaaaatagctcagaaactagatagatgtctctttggacttttggagaatggttataaagataatgatagttttgtaagattattggctgaaatgggaggagaaatgacattgatgttgcaggaccatttaggtgaagtggtgtttgttgaactgccagaggacaatacttcagtgagcaaagagaaaagctttggagcagtggagagtgtgaaggcaacaagtgagatcttatcaccaatctcaggtgaaatcattgaggttaacaagaagctcacagaatcacctggcttggtacagttttaaagtcttaaggaaattaagtaagttaccactcatgtgacaacatataagcaatgatttggcaattgtgtgttgtttagatcaactcaagcccctatgaagatggttggatgatcaaagtgaaaccaagtagccccgcggagttggaatctttgatgggtccaaaggaatacaccaagttctgcgaggaggaagatgctgctcactaggagggtttctctctgtcttttatgttccaagttctatcaattctcatgcttgttttctaaatttgcatacactctatgaccaacttcacaaaataagagttcaagaagatgaaacagagacctaacaaacacattaagattttttctttcatatatcttgttatcctcaaaatgcatttaccatcaccccaaaagccagtccaataaaaaaggtgatcctaatcaaaaattattaataaaaatttggtaaccttaaagatataaccattactttaaaataaataattggtcataagaaaagaaactggtcgtccaaatattacaatctgctccattatattgaaatcacgtattcaagctcataaggcaagttaggtccctattggtcaatttggttgtatctaccgttgacaaaactgtaacatccattgtggtaaaaattgggcatgaaaacaaacataacgacatatgataacatacaaggaacataatattaacgaagcacacacatgacacgtatatatatattcatatgcacacaaacacagatagagatgaacagaaacacatgacataactttccaa

SEQ ID NO: 12436 - DNA, 3000 bp, Unknown
  misc_feature (1)..( 3000): cDNA_ID_2992404_gDNA_ID_2214551_Annot_ID_134671 3000 nt of promoter + ATG
aattgcattgatctttggtttgagttacacaagacttgtcctgtttgccggtgtgagttagatcctggcatgattggatctggaaggcttgaatcattccacaacacagtcacaattactattcaggacataaaccatgatgaggaaaatcctccaaccgctggttcaagcaaaaggctaatagaagcctcggcttggcgattctcgaggtcacattctactggacatttcatggttaagactacggatgctaatgtgaagtccaaaagaaggcattaccaaacaggaagctgtgtctcgttcgacgaacttactcggtatgaaggagcaggatggcaatggcttggtgattcatcacacattagcaggattgaagtatagtttactgaatttctgttacatcttcattattgtgttctttgtagcagtagttatttcaaaactgtaataagatctctagtcagattctcatgctcctatcggataacagagaaaataataagagtcactccacaatgttttcttcggaagtgtttttgtcttctacagtgtctccatcttcagaagcgttgttagcttctacactgtcaccatcttcagattcactggcgcttctcagactaaactttagagtgataggtctacccattatctcctatagaaaaaccaaattgtaatgaaacactttacatgctcaaggctaaaggagcaaactttatattaatatgcttggaacttcataccttcccattgagttttgtgattgcattctcagcttcttctctagtagcaaatgagacaaagccatagccagaagatctaccttcggggtcagcgaaaacaacccgagctgagaccgggttgaaatctgcagcagtgaaaagctctcggagatgtgttgatcttgctttccaagcgagattagatacgtagagtttgtgacgagtgtctccaggggcaggagaaggaagatcgttcggtgatttcggagtaggcttcttgaaccttcttgcaaagcttacgctaatgatcctccctgacacttgctgaaaacaaagaagatagaagcttaaacatcaaaccttagctaacaactcaacacaatgtatgatttagtagtttgaactatctacctaaaaggctttgaaattaaacaaacaacactcaatcagaaaagaatctaagggatttgagcttacaaaagtatcgaacttatcaatagctgcttgagcttcttctccagaagccatagttacaaaagcaaatcctcggttctttccatctttttgccttataatctaggaaaagtttataaattgaggtaaggcaattgctagtaataacataaagattgaaacgaaattgagaaagaagaaagacctcgacattgttcacagtcccacattgtccaaagagctcggaaatgtcatttacactcatagaccaaggaagattgaatacaaaaagcttccttttcagatttgaattctgggtttcttcagtcttctcctcctgcgacgtttcttcatccgccgatgtttctttctccgcgacggaacagagtacggagacgagccgccgtgagttatcgctgccggaacgtagagagaagacgggagagagattgctgggaattcgaagactaagggcagtaagttttaaggaagaagagcgtttagaaaagagataaggttttgaagaggaagaagaagaagagaaggagaaaatggagagagaagcttccaaaaccgccattgttagctttggcactagagaaatggattagaccgagacaaaaggataaaactttttgggccggtttggttattcggaaaaaaatgaattgtgaaccgggtctaccaacttcggtttttgaaggtaaatggcacgaggaacttaaccgtatatcatgtattttttttggtataccaataaattccaatccctccacattgcagtcaaatggaagaacaaaaaagtgatgaatctcatgatttttctctttgaagtcaaaactcgaatttgactaaaactgaatttgattggtgtatattctataacaatgtaaatacaaaagtttaaatttcaatattctaaataaataagttagtaaattttttttgagttttgagacatttggtgaaatacaaaatgaagagaccaagatttcaatcaatcccaaaaagttaattaatcctaagaaaagtccagccagacgtctccaatccatcaaacgatgtcgtttagtaacaacttgtagtcttgtacacaccaaccaaaccatttcctatttatttttcacaaaacgaaaaaaaaaaaaatccaaattcgagaaagaagagtccaacacaaactcggagacgaagaagaaggagagaagaaaaccattaagccattccttcttccgtatcactctgtcaccttcaaaatcctaaaccataatttttccgaattcgttgtggaagagactgcttgagtgagtcagaggtgggtttacgtgaggtattgctgacaatggcgtctctgggtctatcctttcctcccgccgcaaaaacgccgacgtatctagcctcttcgtcttcaactttcttctctaactcttctctatccgtcagaacctctcagtttcgctcccgaaactctgtcttcgcttgtgttgtaagcggtgttcatgaatctatagaattgcttattctgcatttttgaatgttgatccttcctttcttattacgtttccggatttgaggttcctagattgagtggaccctaatagccatcttgtcaagtttgtagttctgagatttttattggcgcatgagctgaaaagctcgtctctttcgtttgaatattgtttgtttatgcgaatatagctacataaaggttgtctctttcttcagaatacatttgtttgaaactatccaggaacagaaattgagacctatatgattatatgaatctctgattgagtcttgttgttgttgttgctagaaatgtgatatg

SEQ ID NO: 12437 - DNA, 3000 bp, Unknown
  misc_feature (1)..( 3000): cDNA_ID_2708951_gDNA_ID_2214551_Annot_ID_134679 3000 nt of promoter + ATG
ttaccattaaaacaaagctatgttaaaaaggtttctttgtagattgaatttgtattggtatcaccatctggttgtcttaatgtttggtaaatgtcaggtttctttcaaagaaggcacgctaaaacccccggtgatcaaatcaagtgtagatctcccagagagtgtgggcgtctttgggcagcagattagcctttcgttgttaaagcagtctttgaaccccttacaagatgtggcagcaaacatttcacgggcactctctggtcagccacctctcaagcttccgtttccaggaaaccgaggcagctcttggctcttgaccacttatctcgacaaggatctcaggatttctagaggagatggtggccttttcgtgcttgccagagaaggaagctctctgcttgagctctgaaatatttgataaagtatatatatagcaggcttcatgtaaaaaccgtaaccactacagtagagacatcttcagaataatgctgaatgcagattattgggcctaatcttaaattttaattatgtactcatttgtctgtcacgaaattagataagttcagtttcggtcagtagtaaaaaactaaaaagaatgattcagcaaaattggaggactgatatgagacaacgagtcagtctataggccaattggatccaatcgagagtgaaaacccgaaaagtaaacctgattgttttgttattgattatagaacccaaaatctctcagaagacattcctggttgtaattagaagaagaagaagaacagatagacgtgttagtcaagtaagtaatactagtcacaatttttagttgtccaggagattttcctatcaatccaccggttattaaaaactcatacaaagtgatacggttgagacaagtgtttccttctgagtatgttgtaatctaagaaacagaagggcctttgatgaattttggcggctttatctcttctgcaccatccactgcaaaatgtccttcctgatgacgctgttgaacccgcctctagcataaattggtttaatcagactggattcaccaacactgtaaggcctgtactgagtagtagttcccgtggatcttggaggtttgatcatcatcatcgaagcaatggggtatttggaccgaaagttcctcaaggacatgaacaagttcctatcaacctcacggttctgaggagtctgcgtgttaacatgtggtttaagacgggttgattgtaatactcttttcgccttgtctatgcttggctctgtattctttggtagtagaacctgagccgatggcttcatccggtcaagcccccggagaatccagtttccaagattccgaccaataaccatgtctctctgttgtatgttcttgtggaccctaagtgccatatcaaagatttgataagtcctcctgcataaaaggaaggaaagagagagaaagttaacacaccaatcgtctcagtcggtaatggaaatctcaaatacacaactcaagactcgtttaacagtagcattatctatacgactgtatgaccttagcatcaacaaatatatttcctagcgacaactacacttacaaatcccaaacgggcacaatataagacttcaatccaggaaacaccagatgttctatctctccctctatgaataaatgcatcatagcttcgtgtcactctactcttgaatctcacatcgaatggttcaagagcaatgtatagaattacgaaatcacataagtaagttcaacgaatcaaaaccgtggaaataggactagcctacctcttgattttacttaaatccaaccacttgcattgcattgcattgcttaaatcacatttttatagcgatacgggagtcagaacaaaactaactggacagtagaaaatcgaaatcaacctaaacacaataaacaatcagaacgatacatcaataacaaagcagtttcatcaattgaagaggccaattcatatacaaagaaacgtatttccagtcaaacctaaatcagaaacaaccaaatcgcaaaatccacaaaaagaaaagcgtaaagatgaaagaaacttcaccgatgcataaaatctcgaatccttggatgcttagggctaacaagccgacgctgggtcttcaatgcgagccggtaagtccgcctaatccccaagaagtaagctgttcctagagctaactcccacaacaccattactttctacaactttcttcttcgtcttcctctttgtcaccttctttcttcctcaacgtatttgaatacaatctacaattttcctttgaaagagccgccagaaatttcaatctcactcccatcggaatcacagatcctccgtttctagtttaaagcaccaggttgcttgatctgcgatacaatcttgaccgtccattttacttgttcgtcaagattttattttaaatgttttaatgggctgggcttttgtagccttgaaatatgcccatatagacgagacggacaaactttttatggataatttaggtttttgttcaccaatcataatttttggtatgcaatgtttttttttctttttttttagcaataattattatttttgtgtgaagcaataataatttgtttgcttgaaacgataagatttatatatatattcgctctaaaaatagaataaacttcagcaatcagattaatccgaatcaattccgttggtgttacagttattctacactctctatagatcccaacctctttcttttaaatatttatatacatctctctttttttgtgaatttttttactagattccaaagtaaatgagtagcgaatacgacaactctcgttattagacagagatatataataatcgcgtaataattatttcctatttaaatatgataaactcatgtgtgtgcatatttactttttatttacttatgggatactcaccaatatttatttgatacgaaccataaccttcactaagttttctttctctagcctccctcatctttctctctctgtcggcgatg

SEQ ID NO: 12438 - DNA, 3000 bp, Unknown
  misc_feature (1)..( 3000): cDNA_ID_2712033_gDNA_ID_2214551_Annot_ID_134680 3000 nt of promoter + ATG
actgcgtcaacaagattaaaaagtggaaggtaattaaccgaacaagccaatgattatttgacacgtacaagtgaatgagagaggagcgtcacgataatgattgtggactaaagtgacagtcgtcattatgacagaccgcgtggcatcatttatctcaccaaatgtcctttttcattattttcctgatcaaattaatcacaagtggagcaccctaattaacacgttgatatgacgaaccggacacattaacacttgccattacgttttagatttgattccttcagcttctttaagttttagttcagcaattatttgatcgatttggatatatattgaacctatgatgataatttagtagtagtgtaatgtaattttttagaaaataatgtatgaaattcatcagtttcatttttggataaattccggtttaacaagtatggtttggtaccaattaattaattgattaaaagtttcaaattcaataaaaataatacatgtggctgattatcgaatttgattcataaatagaggaatatttaaaaacgattattgaatagaggagattggtcactttaactcctcatagtagtaataattttctgatttcactgaatccaagtaaatgcctagaggaacaacaacgacgattctttccagctggaatattaatccgaagcacgaggcactgtaacggtccaaaaattccagctggattgcataactactcttaaaggcgcactctaacctactcctacttcactctactgttaacctacgcctctgtcagcgtactctagcatgacagttataatttcatcggcggcgaggttttattcgattttatctgcctttcgatcagttataacagaaacgcgactcgcaatattttaattggaagtaaacaaatcgacatgcgatgcgacgaataaaaattaagattgcgattgctagaagtcggcggttttccggtgagaagtccggcgacggggaagtgatttcgtcgtgaagctttccgtctcttgtaggtttcgtacactactacggatggatagagtatcggctctgataaatccagaaatttcgtcgccattttcgtcggatgattctagtggagatcaaaacaatcaaatcaggaactcaaattcaatgtgttaccaacagaaataaaattcgaaatgggaatcgaatctgcaatgtacctagatgtttcgaaggacgcatgaatccattaaactgagccaaatctgagaaaaattcaaaatcgaaaaaccgatcaaaatcaataaacacgagaagatcaatcaatcaatcaaaaacaggtggatcgtcggattttgaataggagaagccaacctgattgagacggagcgtaagaagtgaggtaaaggatgataaagcagatgagagtgagaatcggaatgaagtgaacaagcttctcttgtttctgattcgtcgtaacaaaaggagattgcaacgatgataaccgtcgcggcttaaagtctttgagctcgtgatcgtcgtaatctactgcggatgacgacgaagaaggagaagaggaagctggtttcaagtcatcaatatcgtaggtatcgtcctttcgtcctccatagctatggagcttcgaagctgatgagtctaacgatatcctctgcatcgccgacagagagagaaagatgagggaggctagagaaagaaaacttagtgaaggttatggttcgtatcaaataaatattggtgagtatcccataagtaaataaaaagtaaatatgcacacacatgagtttatcatatttaaataggaaataattattacgcgattattatatatctctgtctaataacgagagttgtcgtattcgctactcatttactttggaatctagtaaaaaaattcacaaaaaaagagagatgtatataaatatttaaaagaaagaggttgggatctatagagagtgtagaataactgtaacaccaacggaattgattcggattaatctgattgctgaagtttattctatttttagagcgaatatatatataaatcttatcgtttcaagcaaacaaattattattgcttcacacaaaaataataattattgctaaaaaaaaagaaaaaaaaacattgcataccaaaaattatgattggtgaacaaaaacctaaattatccataaaaagtttgtccgtctcgtctatatgggcatatttcaaggctacaaaagcccagcccattaaaacatttaaaataaaatcttgacgaacaagtaaaatggacggtcaagattgtatcgcagatcaagcaacctggtgctttaaactagaaacggaggatctgtgattccgatgggagtgagattgaaatttctggcggctctttcaaaggaaaattgtagattgtattcaaatacgttgaggaagaaagaaggtgacaaagaggaagacgaagaagaaagttgtagaaagtaatggtgttgtgggagttagctctaggaacagcttacttcttggggattaggcggacttaccggctcgcattgaagacccagcgtcggcttgttagccctaagcatccaaggattcgagattttatgcatcggtgaagtttctttcatctttacgcttttctttttgtggattttgcgatttggttgtttctgatttaggtttgactggaaatacgtttctttgtatatgaattggcctcttcaattgatgaaactgctttgttattgatgtatcgttctgattgtttattgtgtttaggttgatttcgattttctactgtccagttagttttgttctgactcccgtatcgctataaaaatgtgatttaagcaatgcaatgcaatgcaagtggttggatttaagtaaaatcaagaggtaggctagtcctatttccacggttttgattcgttgaacttacttatgtgatttcgtaattctatacattgctcttgaaccattcgatgtgagattcaagagtagagtgacacgaagctatg

SEQ ID NO: 12439 - DNA, 3000 bp, Unknown
  misc_feature (1)..( 3000): cDNA_ID_1395836_gDNA_ID_2214551_Annot_ID_134681 3000 nt of promoter + ATG
actcttttggtgaaactagtctccattatcctgtttttctttacttggaatcaaagagtcttttattgatcaacagccttggttctttgtgaggtttaattcatcagctggaagttattcaacagccttagttttaaaaagcgcgctaatggcgtgccatggcgcatagcgcaccgatgctctaagaatagggcaacaagacgtggaggcgaggcgacatctataatgcgcacgccatacgtgagccttggccgatgcacaaggtggcaaagcgatcgcctcttgtgttcaggcgaaaactcttcgaaaccaacaacagaattctgtgattttagggtttgcacgaagaaatgactaggaggaataggataaaccattttctaaacctagctggttaatacatgattcaatttagctggtcaatacctaatccacgactagaaagtttaaccatgagttataattagcttatcaaaccaaatcaatcctaggtttatcttaaactaaaacggatttgacccttacctcttaacccacgacattttaaccagttagaagatgtaaaatccctaatttttctaaatagaacaccatagacgatataagcttgaaggctaaaaccatatgcagagaatctgttaatagaacaccacagatctaaaaagcgcgcgctttggtgagccatggcacatagcgcactaaaggactctctgagccatggtgcgctttgtgccatttaaaactcagattggtagtcaattctcaaattatccaatatacaacttctttaacaattaaataccattgacaatgacaacaataacagaaaatttcttcaagagcattcgtttgtaggagagagcaaaaagcatgtcttgacactgtttatgtaaactgtggatgaggtccagtgtcagacgatggatcccatcccggcggttttatattgggccaatcgccacggcatcccaagcgtatgtacaaactcttcttaccttcaatatcataaaagacgcatttaatctccaaaacatttatcagattaaagcatcaatttacaaatgggtttcttctatttattacctggaagtcccttgtctgagatgatcagttgcttaagtgcactcaaggaagcctgagccacgctctttgcatgcgtcgggtcccaaccttggagcttcaccacaacgtcggcgtttgaatacccaatctccctctcttgcttacttctcctcgcttcttctttagctgactcttcatctacattcagaaccaatcttgaatgtataagcagtgattctcgttttctgttcagaagggttcattttaagtggatgtagagagaaattgacctgtggcttcagtctgtgatacccaaacggtaaatccggagtaaagatgtctccactgatcagctctccccgcagctccatgtttacctcccaaagttgagacaacagtacgcacatggctgcaaagacatggagatcagtggctaatcttggtaactggaaagagattgaacactagacatgactttttacctgctcaagctttccaataccgaactctctgcttcagctacagaatccggcccttctgcaagaatccctaaaatgaagacaaacaaaagggtcctgagaagtgaggaagattcttgttagatgatgaccatgatccaaaagcaaacttacaagaatcgattgtttgcttggaaaagctttccagcaattcctttgaatctaaaggactgtacctgcagatcataacaagtgtataagactctgaaatactattcatactgagctcatgaacgaaaggcgggaactgaattcacccactgagaagaatctgaattcatacccaaggccaacggctagctctcgagacactttttggttgatttcagttgaatctccaacaatgtagattgatgcacctttaagaagttgcatcattcctgcagtcaaagactcccaggactcgacaatatcaggccacttcaattccccatccaccttcttcatattcacaaccaactgatcttcgtctatgtacctgttctggatcaaaaccaaaacttcagccctcaaggaaatgtcacacatcacaaaaacaagtcatataatgcaagatttacacgtagctaaccatattgtttcagagggcataatcttctcaaagagatggttagtctctagaagtgtaatcagcaatccattccgcttttctttaacggctaacgatgttccatctgcgtcaacagatatatcctttggagaaagtatctcacctgtctttaacctcaatcttaattccacctctttgccaccatccgtgaactgcatcatatatgaaaacgattcaatttttatctaactaatgtacaacaactacatgatcatggtatatatacatagaccttggaaccagccatttatacgcaattctccattttatcactcagactgatagaccagcaacactagtatagacgtgaatacgaaaattcacctcgtaatcgatagtgctggtggatacggcggataagcaattacatgagaagctattaaaccggtcggggataacattttgagagaatcgccggaagccgcgacgtcggaggctgtgaaatccactgaaaacgcgaggagaggaacgaatccgattcgaagaaaggaaggtcgcttgagttgtgacagggtttagtgaaggagagttgaagattatagccaaaccagaagcaaaagcagccattgatgattgatttcaaactcactcactcagacaaagtatcactacggggataagggaaagagacgaatacaaatcgttataatgggcctgggtcaggcccattagtttaaagtttttttttttttgaagttttaaaattgcgttttttctggggtcatctaaatttcgtgtgattttctaagacttgagtaatcttgttttccgaaattttctcaccaagctcgaacacaaagatcggccatg

SEQ ID NO: 12440 - DNA, 3000 bp, Unknown; identical to SEQ ID NO: 12438
  misc_feature (1)..( 3000): cDNA_ID_2712033_gDNA_ID_2214551_Annot_ID_185568 3000 nt of promoter + ATG

SEQ ID NO: 12441 - DNA, 3000 bp, Unknown; identical to SEQ ID NO: 12437
  misc_feature (1)..( 3000): cDNA_ID_2708951_gDNA_ID_2214551_Annot_ID_185566 3000 nt of promoter + ATG

SEQ ID NO: 12442 - DNA, 3000 bp, Unknown
  misc_feature (1)..( 3000): cDNA_ID_2992404_gDNA_ID_2214551_Annot_ID_185561 3000 nt of promoter + ATG
ccttttctcacaaggatttgtaagaacaacctttcttatatcccaagcaatctacgaaactggtagaatctgggggtttctctaatcatcaaccttcaaatgtcgtcaacaacatcaatagattcaataccagctactgctgttttccctagtgtttccatgcctgtcaccgtagttttgaccggtgttcttctctttgtaattttcgccggattcttctctcttttcttatggcagtttcttctgaatcgattatttactacttggaaccttcaacgaacaccttacggtgacctaatccatgtggccactccgcctgaaaatactggcctcgacccgtttatcatccggtcctttcctgtattccactattcatctgcaactaagaaaaatcatgggacggaatgcgctatttgcttgtcagagttttcagatgaagatacagttaggctcataacggtttgtcgtcatccctttcattcaaattgcattgatctttggtttgagttacacaagacttgtcctgtttgccggtgtgagttagatcctggcatgattggatctggaaggcttgaatcattccacaacacagtcacaattactattcaggacataaaccatgatgaggaaaatcctccaaccgctggttcaagcaaaaggctaatagaagcctcggcttggcgattctcgaggtcacattctactggacatttcatggttaagactacggatgctaatgtgaagtccaaaagaaggcattaccaaacaggaagctgtgtctcgttcgacgaacttactcggtatgaaggagcaggatggcaatggcttggtgattcatcacacattagcaggattgaagtatagtttactgaatttctgttacatcttcattattgtgttctttgtagcagtagttatttcaaaactgtaataagatctctagtcagattctcatgctcctatcggataacagagaaaataataagagtcactccacaatgttttcttcggaagtgtttttgtcttctacagtgtctccatcttcagaagcgttgttagcttctacactgtcaccatcttcagattcactggcgcttctcagactaaactttagagtgataggtctacccattatctcctatagaaaaaccaaattgtaatgaaacactttacatgctcaaggctaaaggagcaaactttatattaatatgcttggaacttcataccttcccattgagttttgtgattgcattctcagcttcttctctagtagcaaatgagacaaagccatagccagaagatctaccttcggggtcagcgaaaacaacccgagctgagaccgggttgaaatctgcagcagtgaaaagctctcggagatgtgttgatcttgctttccaagcgagattagatacgtagagtttgtgacgagtgtctccaggggcaggagaaggaagatcgttcggtgatttcggagtaggcttcttgaaccttcttgcaaagcttacgctaatgatcctccctgacacttgctgaaaacaaagaagatagaagcttaaacatcaaaccttagctaacaactcaacacaatgtatgatttagtagtttgaactatctacctaaaaggctttgaaattaaacaaacaacactcaatcagaaaagaatctaagggatttgagcttacaaaagtatcgaacttatcaatagctgcttgagcttcttctccagaagccatagttacaaaagcaaatcctcggttctttccatctttttgccttataatctaggaaaagtttataaattgaggtaaggcaattgctagtaataacataaagattgaaacgaaattgagaaagaagaaagacctcgacattgttcacagtcccacattgtccaaagagctcggaaatgtcatttacactcatagaccaaggaagattgaatacaaaaagcttccttttcagatttgaattctgggtttcttcagtcttctcctcctgcgacgtttcttcatccgccgatgtttctttctccgcgacggaacagagtacggagacgagccgccgtgagttatcgctgccggaacgtagagagaagacgggagagagattgctgggaattcgaagactaagggcagtaagttttaaggaagaagagcgtttagaaaagagataaggttttgaagaggaagaagaagaagagaaggagaaaatggagagagaagcttccaaaaccgccattgttagctttggcactagagaaatggattagaccgagacaaaaggataaaactttttgggccggtttggttattcggaaaaaaatgaattgtgaaccgggtctaccaacttcggtttttgaaggtaaatggcacgaggaacttaaccgtatatcatgtattttttttggtataccaataaattccaatccctccacattgcagtcaaatggaagaacaaaaaagtgatgaatctcatgatttttctctttgaagtcaaaactcgaatttgactaaaactgaatttgattggtgtatattctataacaatgtaaatacaaaagtttaaatttcaatattctaaataaataagttagtaaattttttttgagttttgagacatttggtgaaatacaaaatgaagagaccaagatttcaatcaatcccaaaaagttaattaatcctaagaaaagtccagccagacgtctccaatccatcaaacgatgtcgtttagtaacaacttgtagtcttgtacacaccaaccaaaccatttcctatttatttttcacaaaacgaaaaaaaaaaaaatccaaattcgagaaagaagagtccaacacaaactcggagacgaagaagaaggagagaagaaaaccattaagccattccttcttccgtatcactctgtcaccttcaaaatcctaaaccataatttttccgaattcgttgtggaagagactgcttgagtgagtcagaggtgggtttacgtgaggtattgctgacaatg

SEQ ID NO: 12443 - DNA, 3000 bp, Unknown; identical to SEQ ID NO: 12435
  misc_feature (1)..( 3000): cDNA_ID_2708937_gDNA_ID_2214551_Annot_ID_185560 3000 nt of promoter + ATG

SEQ ID NO: 12444 - DNA, 3000 bp, Unknown; identical to SEQ ID NO: 12434
  misc_feature (1)..( 3000): cDNA_ID_1024045_gDNA_ID_2214551_Annot_ID_185559 3000 nt of promoter + ATG

SEQ ID NO: 12445 - DNA, 3000 bp, Unknown; identical to SEQ ID NO: 12433
  misc_feature (1)..( 3000): cDNA_ID_3025237_gDNA_ID_2214551_Annot_ID_185555 3000 nt of promoter + ATG

SEQ ID NO: 12446 - DNA, 3000 bp, Unknown
  misc_feature (1)..( 3000): cDNA_ID_1807526_gDNA_ID_2214552_Annot_ID_134693 3000 nt of promoter + ATG
tctttgttgatttactctaatctgtgaaattaactaactataaaaaccagcatcatgttttaatctactaataaagaccattcaacatattaataaaatataatccgatggtgacgactgatgatcataatactagtagtaatggatcaatcaagaatcctctttaggttagaaaaatagactaataaccaattatagagttatatttaagctcaacaaaacccacaatagtacattctcgttggtttcttcttaatattatattgttgcttgttttgtaccaacaaaaaaagtacgaaccacacactttcgatcgtgattaggcttctttcaacaaattttgattagtaatataattaaactatcatcgtctacataacatatgttatccgtttcactcaacctatctatgttatctctttgcgaatctggcgcgggtacttcaactagtgtagaaagatactattcaaaaaaaaaaaaaaaatctaagatcacgagattaaacatgatatatatatgatgtttaacaataacaaagcggtttgttcaaaaaaataaagcggtgccggtatgctagagaggaaagccttgataattacgaccacaagttgtatgagaaaaattattggaaccttttgtatttcatgaccctgagaaaaattgaaaatttgacttaacgtggagtttgctagagaaaatgactcaacaaaattatatccctagctttgttttacgtcaaattgttactctcttttcagttggttcgctagtttgatttccggtattaagttactaaaagcacataatgatatttcagttggttcttggtaataagtttacacgagacttttgtggtattaaagtacataatgatcttttaattagatattattaaagcaaaggtgaaaaaagtggttcgtttactgtttttacaatgtgacgactgacaagaaacatggacgtgttaggttggatagatagctagatactatcacggggcattgtttgattctttctggcgaataatatacacttattttgttctttttatatataccaattgaatcctataatcaatataatattagtccactaaccacgagcactttttgcagattgactttccaacgatttataatagtaatatcttcataaagaaattcattagcattctacaattttcttcataaactggaagtgacaacaatcggacataaaaatgattcaacttttccatgacaatttttgtttctttggtgaagaaattaatcttttctaaataaactttttttattgaccaaaaacaatgtatcttttaaaagattgcacggattctatggttgaatatattctagatttagtttgtaatagcatatcgtcaactagacataagtctatattcctcactagctcgtgttcctttcttctttcgtcacggttagttcagatccggacaagaatcctggattgacaaaattttggaaatggcttaattaaactattgttttatctttcttacaattctttgaaacggtgatatttcatataaaattctcaaaatttttaaattagtgtcgttaaattctgtattagcagctcaaccagttaaatataaagccacgttttgagagaatcggattatatctgaaattcgataccagttacgaagattatattacatttgattttgaagttgtaagataaaaaaaattagtgtcattattgtatgaacttcgtgaagtttatttatgtgcttcacttttagttaataatgtaatatgtataacaaaaacaaacttgtatgcctatatttagtacaggtggattgaatcgtatcaatgtcacgtaaaagttttatttggtttaatgtctcacgtaaaagttgcttttacttttcaggtgcctagccgtgttcagaaatcagagaccaaaatcttatgggggcaatatgatcaaatgtaatataccaacagttagttaatgcggattgttgacaaagaagaacatttcatgatcggatattgttgacaaaaaactactgtaagccaaaaatgaacaaaagaaattaatgataattaagtataagacttgacaaaaccaagccgacatgagctgagtcaagttcatgtcgtcaatgttatagtgatgattgacgaatatccaacggctgagaatgattggaccgcagtggaatggacttttaactataaaatgggacgaattattcatgattgcttaattgaaaattcacattgttattttgttatttatttatcattaaaactctacttcttttctcttttagtcagttttgataaaattcaaaatttcgtttgttacaatttgaatagtattttaaaatcaataacatcttttttttgtcattctaaataattaaaactcaaaataataatttttaaaaaatattgtttatatatgtgatataatgtggtaaaatacgaatcaatatattttcgtataataaatttatattccttataaattatcgtcaaacttcatattaccaatgtttatttttgggttaaaatctcacactattttttttttatacttcaaaactcatatattttttgaacaatcatgcctccaatatagaaaaaacaaaattgacggatacaaagaaaaaaaaacaaatttgacattgaatataaatgcaaatatttttttgaaaaagtagaaaaaataaaaagaagatggggtttaaaggcgggaccggtccgtcatcaatgccacctccctaactcctttctctttctctctttcagctacttgcaacaaaattgcaaaattgtcgacagaaacttctctcaaatttagttcctttctcatttatccactgctcttaatccaacttcaatatctctctatcctcacaatatttgttctgtttctccttcaactttcaactgataaagtttaaacctttatgctctttactctctgatctcaaaagggttttgtttagttctcctcaaaacc

SEQ ID NO: 12447 - DNA, 3000 bp, Unknown
  misc_feature (1)..( 3000): cDNA_ID_2709449_gDNA_ID_2214552_Annot_ID_134694 3000 nt of promoter + ATG
ttttactgatgtgttcgttggagagtgtgaaacgtgggacagtggtgtctttttttagttcttcaatgttaaatgtgtaatctttaggggtgaaattagaagtttgtttaaagtagaaggagctgtgaagcagatgtgaagagtacttctggtttcagcgtattatagtaaaagaagcagtaatagttgtgtttgtaatgcttcttgtagaactccatattgtaatttatatataaatgtgtgtatgtttatggtttattatcttctttttttctgaaaagtaaacatcattttgttacaaaccaaattttgatattaaatggaaaaaacttctgaaatgatagagaggttatattctactcttttatggaaattgcttcaattttctgtatttgtttataatggttgtttgacatttattatgtatttttatacttaagaataagggtgtttaatttcggttatgttaaagtggtttgggtgggggtattcaattcttatggttggttactatacttagaaagttagaataaaagaaaggaaattaattgattggccataaatatttgagttatctaaagaaaaaggttgggtggaatagtgtggatgataagaaaaaataaaagaagaagaatcatgggattttatgggatttcttttaaaagcctaaaacaaaatggatgatagtgaaattttgtacacaagcaatgagatgtaatcacgaaaagtatttaatgttgcctgctgttttttctttcttgagccaaacccataccatccaatataaatagcttttgcatgtatttataatatatttgaaacgtttttcatcaaaaaaaatcatgaattagataatagtatttgtattatgcgacaatacatatgatgaaaattaagaaaaattaagacttatttttctaataattttattaggtgggacatgtaattttattaaatatttttgtttcactatatgagcatgcatcatagacttttacatcattattaacttgttaattattattgtagtatttatcaaaaatattatataaaatagtttagctggtaattaataaagacgcacgctcaaaatttcgttccaaatttttagttaacaaattattattcacctatataattttgttttcttgtcactgatcaaactaactaaagaaagaaaaatatttgggttgctctttgtataatccattttcatgttcccatcaatttttgtagtttaaatgtgtacatggaaaaaagagaggagggaatagatagaaaaaagggtgaaatcggaaagaagctatatatgagagtcacatcaacgaggaaggtccattgggtacttaacgagtagaaagaagaagacgagattcgcacatgggtggtgggttctttttgttccctccctaggacatctatagtctcttccattcactttaaacaaatatgaaatttaggtttcaatgagaaatttgtaaacaatatcgtaaatatgtgtaaatattttgtagatataaaatcttaataagtcatcaatcatttcttcggtaaaagtatctaacaaataaccaaattttggaaaaactctttcaataacccaataacccacacctcctccctcaccagccaatgtcgcaaacatcggatcttgcattatgtctgtttgtggcgtgacttcaactgcaccaaccgtggaatctacgatggcatgatcatcaatggaagtgtgaatagtggtgttatgaatgtgacgtcaaaaatataaatgttatatgatgtttgatggtaaaaaagtttatggattgttaatgaaagttttcttttgataatggcagtagatgtgaaagacgcctgtaaaaacctaactagccatctctatatgtgatctatttatttttagttatttgtacattcatttttggtatactaaatcaatttctttgctcgtgtgtgaacaatataatttcattgatgtgtagaacatttatgtgaaatttactagaaaccaaaagtccctattatttctcctaactacaaacaaacctctaatatgtgtttcttttttatttatgagaaacctttgctacaatcctcctcttgcatggagaaatctattccccattcctcttatatggagaaaacatttgttttgatgagttaaactttggactgagttatattggcttagttttgactgttccaagatacaatttgagtttgtaaatagcataacagtttttggccaaaattcttcctttttctacaaaatgtctcacatgttatttacataattatcaactgatgtttgaaaccagtaaatgaagtttgcattatttaaattaacatatcaaaattatgtatgtattctctgacctatatacaatcagaatttttaaaagtgaagtccgagaaaggcccatcaaatgtccatgttccatatacgaaagttagttaggtgagaaaaataaaaatgaatcgaccgatcaactaacaacaacaataaaactagaactaatcaaagttggtcaatcgtcgagactggttcaaaatcttggtgcttcatgaataatattcttatcagaaaataatttatatgtatatttatggttacctaaaaaaaactcgtgcattactacttaatagataaatatattttatttatttttatagaattttttactttaaattcattaatgtggtcgatgtaaactattagtaatcgaattttctatatcacacacacaaaaaaaaaacatttatgcgactaactcgttctgagcaagactattactgtagtacttataccaaagttaggtcaagtcaagaaattttagatctctcggaatcgacgattcttaactcgccacgtcatcaactacgagttaaaacctgtcacatcagatcataagccatcttcaaagtgtatcatcttcttccaaaaagtcaccatttttattttcgttgactcggtcggatttggggaagaagaagaacatg

SEQ ID NO: 12448 - DNA, 3000 bp, Unknown
  misc_feature (1)..( 3000): cDNA_ID_1809029_gDNA_ID_2214552_Annot_ID_134695 3000 nt of promoter + ATG
atttctatgttctattttcttgcaatggtaaaagcttattattcttttaagtagtgttaaaaaaaactagaatccaatatctaatgtttaattggagcctagatacatgtaggcggtttaagtgcttaaataaaaaaaaaaatttagctaatttctgataatattataaagatattatgattcataataaacttaaaatatttcaaagtttcgacgataaattgaaagttgtctagatctacctaatgttcttaaagccgtttaataacaaaaccactaaaccctaacacttagaaaatacttgctaccatatgttgatgcatatataacatcatatagaccatttaaacttctttttaaaacaatgcttttatgatagaaccatgtgatttttcaaactacagtgttcttcctgttactaaaattacaataggctccacaacatgttcagcaaacatttttagatgtcaaaaaagcattatgcttttagccataatgaaagaaaataaaagagccaccattaacaaaacagagatattggcattgttttggcgcgtgcggctcgagaattcagtatttttctcaatttgtctttggatttcaagaaacattaaagtattaacattagtttcgttttttaggtggtgagcttattatgtagtaattttaatgtttcagtttaaacaaagattcaccggtttacatgctccggtgattacggtaatcaaaagggtcccaaagttatacgtcggacaagtacacttgataggattccatgtggtggtcccttatgttagtcatcactcatcatccaatcctagccttcttcaatcatacatattacatactcactcgaggctaaattcgtcaaagatgggtttgttttttaagtataagatgatataaaatgtgacaatgtttgcatattattaggttatctccttttgttagtcaatctatctcaattctagatggtatgtatagtcctactcttaccaaaccacacatgtctgattttgtacgtatatgagtattagttgaattaatatttaaaattagtgactgaaaaaaaaatagagtagatatgaaaaacaacatagattaacgatgcattaaaacatttttcaaaatagtaattcatttgtttcagttttatccattatattctacaactcattgttcgtttagatatccataataattttttgcatccagtttagggttgttactcgaggacttgttcaatccggtgtcgttcttgttgctcatgtagcctaatgttgagaaaaccattgtctcgagccaaatttactccaatgtgtgccaaagttggtctctagagaagacatgttggagtacttagattaaagatctcatgtatatcaattcatattacttgtaatctttagattctccaaacataggatctcaacttaaaataattatggttggaaagcttgatcctaatttacaaacaacaaaagttgaattagttctcgaaatcacattgcagtgatatttacgtgtgaattttttagggcgtatcaaactttgattcacgaagtttgataattgttattaatttagcttccaagtaacatacacgtacggtacgtgacgtaccctctctctatttttttcttatgtccgttacgtacggaggaccaatcatgtatcttgcaacaaaggggaaattatgcttaagaaaggtattaggtgtgatactaaaacaataattttgtctttgattttaatttaaggtactataacaacttctttatgctaatgtatattttttaagtagcgggacttttccatgagtatttttcactgtatcaagtagaaaactcgtacacccgtgaacactataaaatatttcatcataattacgtaatatctacatcattagaacattataaatacaaaaataaaatatttccaattctttgataataccgaaaaatatatacttatgttatttttagtagttaagtgtccatattcagttattcacttcgaactcttctactgcatttaattatttttggccatccataaacgttttcagacaagaaacttcaaaattctatgatctcgaaaaaataatatgaatttccacctacaattctcttttgagcaaagaaaaaaaaaagtgaattgaggtctagctttttgcgtatataaaaattgaataatttggcgaaagataatgtaaaatttaccaaattgcattaaatatatgataaagaaaatattatttttactgtacataagtccaatagccgaaatgatgatataaactaataaccatgatcataagctataaccgtttctttagaaactaaaattaacatagccattactagaataccaaattcgtattacttaaattcaatacacatcaatagttatcataggtccatagccagagacgatatagcaattttaaagggcgcaaaaattttgatagcaactaaagagtggtcgtcccaacgcgcttcaatggagcgtggtaacatctttatcagattttagtggtgatataacatcatctttatccgtacactatgaactatgattgggcagtgtgaaccacacgttactaaacgcaagtggtcttagcaataactatattttggtagagacacattgagggaaagggcatacaccaaacatttaattatggatttgtacgcatgactttttttacacatacaaataattgtaaaacttttgtcaaaaacccaaatcgtgtttagtaatctctattcataagctagagaactatgacccctagaggttaaacttttgtaatgataaagaaagagaataatacaaagcaagagaaataaataaatgcttaagtcccaatttatatatagtcacctctctatacccttccctacacacatggagacactccaataaactcttcttctgcctcctctgcccatttctcccaatctctctctattttctcagtctctctctcagataatg

SEQ ID NO: 12449 - DNA, 3000 bp, Unknown
  misc_feature (1)..( 3000): cDNA_ID_2708977_gDNA_ID_2214552_Annot_ID_134696 3000 nt of promoter + ATG
ctgaataattaaagtttcctttgaaaacaatgtcgaattccctcgtctcgttggctgcaagggtttgtatctcagcgaaatgaagatagaagtaaacttcagcgttagagggtcttggtttccaagttatgattagcggtgcactagcgtttttaggcgtggcagcacttttgagtgcagcttttggtatctcaaatgtatctgaattgtttatattgagactagtcgttatatagctaaacgaagagctgaagaatggataccagacacgatcataggagtcatcatcatacctgcaaataaattgcattaggcagcataattaagcaaatcaatccttgttatttgttaaaaccgatttaaatagaaaaaaaatagctgacacacacaaatctaatctcaatgcaaactacatttatttcatacacgaatcatttttgtttacatgtttaaaaaaattgtataacgatatgatagtttgataataaataacaaaaaaaaaaatgtagaaaattgattaaaacaaaacatgtcgtgcggtgatagttgcaacttgtttttttttatccaagttaatcatgaataacgatgtttatatactaaccaaaagtacaataatttatgtataagaaaattgatgccatgtatgattaatgacagaaaactcccacttattgttttaaacaaagtcaactaattaccttatttcgctatcagaagtgctgcaatgaacccggaaagagttcctcagtgagcctgaatgcgtaagataagtatcatttctcattggtcgtagttctatagatgatattattggcgaggttggtcctgttttaacaagacaaatatccaaagagcttgacctcactctgtgtatgatctcctcgaatgtaccattttgtcttccttccatatctattcttgcccacttatcaggaccaagatagagatcaaagtttggataaatattaagaccatcataatttccatatatgaaggtaaccaatataagataatttgtgccacgagtgacattcagactaacaattacgctttccttccggaaagtatcttagagtcaaatatggttttcggaatattttgttgagctctttatcgactctaccactttctccagtctggataaatgttgaatctgatgtgaatgttaatccagtagatggatcactataaggagattcctcaataggaaatccgcaatccaaactgatgaaacctgttcaagcataaaaaggatcgacgaagtttaaaaaaaaactatatatagaagatatatcaatttaaaggatggatgatcctcggtgaatatctactaaagagtttataaattattaccttcttgtttttgggcgccaactataacggcaaaggttccaattatggccaacaaaagatggctcatcatcttcttggaaagctaatatggaaatcaagaacataaaaaagacttgcttagtgaaaacaaggagctacgtaaatgagaaatacctcacatacacagattggaaggaataatacattaaagaaagtcaacttaagccagacatgaagattgaataattgcgagaattgctttatttttggtttattgtgtgaatttctttgacatgttccaaccccaacttgtgtttaaaataataggttatgatcataagactccgacatgtataggaatttccttgtattaaggtttgtatatgtcttctttaaacccttgaccaaacataataaatcttcgattgatcgttagacttggagcacaaggatataacaaggtttgatttaagtaattagtttgaacccggtcgttacaaaaaaggatttactacatatgaaaaacaattacatattacaacctatttgaaacattacgtctgattcacataaagaaacattacgtctgatccacaataattatagacgtaacttatgtaacttgttgtagaataattatgtaaaagagagaattcgtatattacaacatggacaggaaaaaataaagataaagatcattttgtttgattcaatgatttgcttcttacaaactcaggtatttatacaaataatgtgcatcaaggtagccagtactaaattttaaaaatatatttacaaccacactttaactattacaaacttgttaaaaaagcaacaataaaaaataagaattatcacataattaatatttttatatagttaacacatacagtttccgattgtcaaagctccattaaaaaagcaaattgtgaaccaagtggataatggtccagtagcgtttggaaatgatctttccaaaataaggtttgatctcttttcccactaaatcccacctaacaagggatattaacaaaggttgatgtagaatttcttggttgacaatgtatagtaatactgagaatatgagctataactataagaggccagctatctcttaacgtctatgagtaagccatagatagataatgcatatacaggcaaacaaaacgaatattagggtttgtcaagaaaagactaatcttagtttatttttgaagaccaagaattttacattattgcagaggtattgcgattataattgagtgaaagtcaacaaaatgtattaaatccaccaagttgttgttaagtacaagtcgttagcagaattatcatatagtttataaagctttgacattagatcaacttggcaggttttacattgtttaaacaaagattacatcaggtgctttgatttatgattaaattgctctcttttttccacaaagtggaatataaatgtatatatctttgttagaccattcttcagtcgtgcttggatatgaatctataattggagagtattccacgccaacatgtgttttggattttaattgatcttcatctaaagtatttctatcatttgtactagaaaatcaatatattgtatcatatatttcagattgtctttggtttcaaaaatttgtatgttaacttaacttgaaaatg

SEQ ID NO: 12450 - DNA, 3000 bp, Unknown
  misc_feature (1)..( 3000): cDNA_ID_2712094_gDNA_ID_2214552_Annot_ID_134697 3000 nt of promoter + ATG
cagcggtggaagagttgaccttggagttctaacgagtttcaagtagcacaacccggagctacatttgtgaggtgataggttatatttggtatctgattgtaacatcgtaggactatatgctgactgaataatatcttcttccaattcaatgtcgaattctctagtctcattgcccctcaaagcttggatttcggcaaagtgaaagtacacgttaaccttgtcactgtcgtcatctagagacacgtaaaatctcaatggcaagctggcattttcgggcgtgattcccatcctacttacagcttctggtacttgaaagggactcgaggatctcacgttgagggtggtgttcacatccgtttcaaattcattatatcggtcccatttgcgatcaaaaatatcatcaggatacctaaaaccatttttggagtagccatgcaaaagtaaatgaatcatgttagattgtttttttttataaaagagttgctaaagttgagtttacataccgtataaaaccggtagaattgctactataggcccgccggtagatgaggtctaagggaccgaattgagtcaaatatgaatcatttcttagtggccgtagttccaaggttgatatcattggtatagttgatcctgttttgacaagacaaatctgcaataagttcgacgttgtcatgtaaatgatctcacgatcttttccgaattccaaatcaaccgcaatccacatgttaggcccaacatgtaaatcaaatttgggatatacattaagaccatcataatttccatatccgaaccctgctcttatcaaatagttgatgccttgctctactttcagattatagcagtttcgtattccatcgggaaaatatctcaaatccttgtactgcctgtagatatatgtgttatcatccccagcttcaccacgtaaaccacttaaaataaaatcagcatcagatgagaatgttaatccggttcgtgggtcggtataaggagactcattaacgggtaaaccgcaatccaaactgatgaatcctggcaagatacaaaatgtattattagtgaaaaataatgttttccttttgttagaccatgaagcttataaggaagacaatcaaaagttttggaaaacagagaatcctttattttctttaaccaaatctcttatatctgtaatcgttaatattattttcatggtggctatgcgtacaacaaagtagaaatcggttagtgatctcgaccagtcgagcaagaacactcaactacttggctaatccttaagtctttatgtgtcaaaaactgaacatgaagcaattattaaaaaaaggtatatagagaaacctcgttgatcaggcggctgagcttgaacaagatgtgtaatggccaaagccccaaagatgaacaccagtaaacgttgacgacgaccttccattttcaagttaagttaacatacaaatttttgaaaccaaagacaatctgaaatatatgatacaatatattgattttctagtacaaatgatagaaatactttagatgaagatcaattaaaatccaaaacacatgttggcgtggaatactctccaattatagattcatatccaagcacgactgaagaatggtctaacaaagatatatacatttatattccactttgtggaaaaaagagagcaatttaatcataaatcaaagcacctgatgtaatctttgtttaaacaatgtaaaacctgccaagttgatctaatgtcaaagctttataaactatatgataattctgctaacgacttgtacttaacaacaacttggtggatttaatacattttgttgactttcactcaattataatcgcaatacctctgcaataatgtaaaattcttggtcttcaaaaataaactaagattagtcttttcttgacaaaccctaatattcgttttgtttgcctgtatatgcattatctatctatggcttactcatagacgttaagagatagctggcctcttatagttatagctcatattctcagtattactatacattgtcaaccaagaaattctacatcaacctttgttaatatcccttgttaggtgggatttagtgggaaaagagatcaaaccttattttggaaagatcatttccaaacgctactggaccattatccacttggttcacaatttgcttttttaatggagctttgacaatcggaaactgtatgtgttaactatataaaaatattaattatgtgataattcttattttttattgttgcttttttaacaagtttgtaatagttaaagtgtggttgtaaatatatttttaaaatttagtactggctaccttgatgcacattatttgtataaatacctgagtttgtaagaagcaaatcattgaatcaaacaaaatgatctttatctttattttttcctgtccatgttgtaatatacgaattctctcttttacataattattctacaacaagttacataagttacgtctataattattgtggatcagacgtaatgtttctttatgtgaatcagacgtaatgtttcaaataggttgtaatatgtaattgtttttcatatgtagtaaatccttttttgtaacgaccgggttcaaactaattacttaaatcaaaccttgttatatccttgtgctccaagtctaacgatcaatcgaagatttattatgtttggtcaagggtttaaagaagacatatacaaaccttaatacaaggaaattcctatacatgtcggagtcttatgatcataacctattattttaaacacaagttggggttggaacatgtcaaagaaattcacacaataaaccaaaaataaagcaattctcgcaattattcaatcttcatgtctggcttaagttgactttctttaatgtattattccttccaatctgtgtatgtgaggtatttctcatttacgtagctccttgttttcactaagcaagtcttttttatgttcttgatttccatattagctttccaagaag

SEQ ID NO: 12451 - DNA, 3000 bp, Unknown
  misc_feature (1)..( 3000): cDNA_ID_2712082_gDNA_ID_2214552_Annot_ID_134700 3000 nt of promoter + ATG
ctatttacaatttcaaaatatgtcatattcattgtagacttgaaggaaatccagatttgtgcaaatccagtttttgcaataccgaaaagaaaaataaattcttgctcccggttattgcatcagctgcctctttggttattgtagttgtggttgtggctcttttttttgtcttccgaaagaagaaggccagcccttcaagtaagttatgagccattaataatttgtttacctgctataaagcaatgcatatagttagcatataaccaaatatactatcatatgtagatctacatgctccaccaagtatgcctgtatcgaatcccgggcacaatagtcaatcagaatcatcattcacatcgaaaaaaattaggtttacttactctgaggttcaagaaatgacaaataacttcgataaagctctcggtgaaggaggatttggagtcgtgtatcatggttttgttaatgttattgaacaagtagcagttaaattgctatcacaatcatcttctcaaggctataagcatttcaaggcagaggtaccctttttctagtaattctcaatagatatccaattgatttgtatatctctaagagtgttggatgatggatgattggttaggtggaactccttatgagagttcaccatataaatttggtgagtcttgttgggtattgtgatgaaggagaacacttggctcttatttatgaatacatgccaaatggagacttaaagcaacatttgtcaggtaatatcacatatataattgttttcttaataaaacctaaccatgatataatttttttttctgaataattaaagatcataactaaattgatatgaagtgtgtttaattgatacaggaaagcatggcggattcgtcctgagctgggaaagtagactaaaaatagttttggatgcagcactaggtattcattaaactttaagacaaatgtttagttaataattacagcttttatgggtattagtatggcctcgaccggatcagaaaggaaccatatgatgatatcgaaattaatctccattttccaataaacgatggtattaaatttaatatgtaggattggagtatttacatactggatgtgtaccaccaatggttcacagagatatcaaaactacgaatatacttctagatcaacatctccaagctaaattagctgattttgggctttcaagatcttttcccatcggaaatgagaaaaatgtgtcaactgttgttgctggtactcctggatatcttgatcctgagtgagtataacttcatatgttagttccaaaatcaccattccttttttttactttacaatcacaacaatttcttgttttgcaggtattatcaaacaaattggttgacagaaaagagtgatatatacagtttcggaattgtactgttagagataatttcaaaccgtcctataatccagcaatcccgtgaaaagcctcacatagtggaatgggtcagttttatgataacaaaaggagatcttagaagtattatggatccaaacctccaccaagattatgatattggttctgtctggaaggccattgaattagcaatgtcatgtgtgagtctttcttctgcaagacgaccaaacatgtctcgagttgtgaatgaattaaaagaatgtcttatatccgaaacctctaggataggtgagggacgagacatggaatcaaaaggttcaatggaattcagcagagacatttataatgaggtaatacctcaagctcgctagctcgtcaaaatttattcttgctggtttttcttctcatgaatattcaaatttgtgtgtttcaagagtgtctttcgccaataataactaaggctttcactaataacatgtaatactgatgttgaattgtcgtagtgtgatatatattttgtgaaatacatatggtgaaatttattgaaattatttcatgaatttgtaacccacaactaattctcgtctttgtttctatctcaagaaatgcattaggttgttcccactttcggtattttgaaaaccaaaggaagagttgaatataccaaaacttatgtatttccttcaaaacttaagagctgtttatatttccttcaaaagaagataaataaagaagatataaatggtctaataaaccaaaagttggtcaaaatttagtctaaatataaaacatgaacgtaatagaacttgtttacaagcgtatatctcgttgatcctgagtttaataagatgtataatagtaaatgttacgaagaactccaataatgaaatatcacaagacagatttatcttgtggagagggttcatcatgtaaatgtttttttttttttcaccatgtaaagttggtaattcttgttgtatattgttttaacgaagacacacttcgacctagtctagtacacaaccagtggagatttaaaacaacatctatcattcaaattggacaaagaaataaccgaatccaaggaaccttgcattggatttaggatttatgacaaaaattcttcgcaaaatgtttccacgccaacctctctataaataaagggccacaagaacatgcatgagtgagaaaaatacattttcgaggcgggaaagatagactaaattttaattttaattgtaattcatagcttgaaattttaaaattatacagctacttggctcctttatcaaacaacgtgcaaaagtatagtgattttaagaccacgattttttgtgccactagagacgtgcttgcatctttagaaatggacattttaattttatgggagaactttccacaaccctaactgttgaatatatgttctaaatgctaattttatccaagtttgcctcttttatttatttttgtatccttttaaactctttttattcgttcatatatgtttcctttccggctgctacatttcaagaggtcgagcagaccataactctatcatttatcttagttaattcatatacataggaaccttggtagcttcatctttcaaa

SEQ ID NO: 12452 - DNA, 3000 bp, Unknown
  misc_feature (1)..( 3000): cDNA_ID_2708973_gDNA_ID_2214552_Annot_ID_134702 3000 nt of promoter + ATG
aatgaatcttattatatagttgtatttgtatattagtagtagagttgaaaatagaaaatattcctttctgtttcttgtaaaattcagaaaatatgttcctttccttcgaatccaaatgttaaactttgacttagcttctaaaaccgtcaaacactttaaaataatcgtaataatttaacgtataattattatagacaagatcttgaaacgttagagaaaatcttatcaataatttcattttactcgagattaagtttgcaataatggatccaaaaagagtactactacaagtatttcttgcatcatttgtccgagagcgagagatgcatttttttgtccaaaaacataaagaatgtaaagatgcattttagctaggggtgttctagagttcagttcaagttgtccgattctttatataaaatgaataatggtattcaaactaaaatttatgttcggattcatattttagtcaaaatataagcttaatttttgaaatttttgaaaaacttcggtataatatcgttatttttccgacttgggttttcggatatagaaaaaaaaaatcatataagttagattaagatatatggttcgtttttacttttcagattgagtattttgttttgatttagttcagatcagattcgtttatttatccggattatactcccaattttggctttcagttctcaagcattttgttatgttatctaacattcattgatatcaaaagttccatctgaaagattatgagagaccatagcacaaactgttttgattttatttttttttcaattttgatttctacttaatacattttgaagaaatatagatttcaaagtattgtagatctcacatatgtagcttatcatgtggacaaggataaccacacatacatgttccttgaccaccgtcacggtcacaatcgccactagcatcttgtccaaacttagtcttgcatgacccactgcaatctgtaatgacaccacacgagccaagaaccgccatgcatcccatattttgttcaactataaccaacaaaaccgttctatatttagataacaaaatatttactagaacttaggagatgtcattacactgaattacaatatttctgctacatgctaatgaatagagccgacgctacaaattatagtagatcatatgtgaaaacttttaagatattggtatgagcaaaccattgatacaaacgatactttatgcatggctaaaatcacaatggactacaacatttagggcatatgccaatgaatattgtgaatataaaatttttgaagaaaaaaagcttgagataaagaaatcatagcaaggaactaatataaccctaagagtatatgtcaatgaagaaagcccgaaattaaatgtacacttaagaaaaagatagcaatggattacatcatatagggtataacccaattaatatagctacaataaaaactatgtttataagaagaaaagaagatgattgaatattttgacgaataattctaaagataaaatgcgtacttaaggcgaacataacaaggaaaatgatgggaaaaacaagtgtagaagctgccttggccatagctatttttcttctttgttttcttaatatgtagagtagttttagttgataaatctgaaaatttgggaaatatatagaattatgaggttcaaggaatctcgaaaaagaggatctggcatcaattaaattacatcagttataaacgacgtaaaagtaggaaaaagaaaaaaaagtttagcatcatttatgggtactttagataatggtaactgataaaatatctactcatttattgtatgatactattcttagtgacatcaatattcgtcggaattattagcgctaaaaataacagtgcaaattgaaacttacaaattgtcccgatgcattcccgtatatggagaaattttgacatgataataaatttttaaaaagaacacactatcttctgctaatatagtaacatgacatgataaatcttttacactctttgatgtacatatttcttttttggacaataattatttttcggaaggtcgctcacctaaaaattattccagctcaaacacgtttaacttcagagtatttttgagaacatttgaccgaaaagataaatgcattttagtgacacccgaaaagataaatgtattttagtgacaccaatgaccaaattgattcttttaaaattcttcgcatgcatcactatattcctgaaactggagtgttataccggtgacatctctggggaaacatcaagactttggccagagaattagtggtggaaaaaggacaaccaatggtagaagcaaagagaggttgaatcagggagtttgtgattaactggagtgagattaagaaactgaaacctaacaataataaggaatcgatcaacaatggtgatgggtcattgactattggtttcatatattagagacgatgatgctttttttttggtaaaaaagacaatgatgctttctgttttgggtttgtaattaatttctacccaaataattctttaaaaatctttagaattaaaaaaacagatttgtaaatcttttacattccttaaaaatctctaattagctctctaattcaattcaatctttgattcatttaggtgcctgaacaaatattaaggacacatgtacgaggaaatcttgattattaacaatagctccatatgtaattaattatcgctttattgaaaaaaaaaaacaaatcttttcattaatcactacaaaacctttgaacgcttcaacaaccatcccaatctcaccatctctctcacagcgtccattcatttcctaaatctaccagagatccatccattttcccctaaatccatccttcagatccagaaatcaacacaatctttaacgatttcttgcatcacaagcaacaaatcgggtattggtaggtaagatttggttaattaatgcatgagaaaaccacataggagaggaggaacaatg

SEQ ID NO: 12453 - DNA, 3000 bp, Unknown
  misc_feature (1)..( 3000): cDNA_ID_3025259_gDNA_ID_2214552_Annot_ID_185609 3000 nt of promoter + ATG
agcaagtttcaaacgtttcttaaatcgtaactcaatgtaagtatgtaacaaaattacacaaacaacttttctttggtatatacccaagtataaagtgtctaacaaattttactatccgtacttaaatttgtgattaaacatactttgttcatcaaagtttcttgtgcaaatctttttaagttgttaaagtgttgaaatggacttgacgtagtaaaactggtatatgcgtatagccaaaggatttttttacttttattatacgtgtcaattagtaaacaatgcaacacgagtatcaaaaagagagatattgtgtgcataagaaggtgcgttcagatgttgaagctagtactatgttgggtataagaaattaaattacagcttagaatctaagcctttgatgttttaaaaaaagaattgttaacttctcttcttttttgtacgagagagtaattttatataaggaaaaatatggtaaaatgggattagaagaagtggtaaggtcacatggaaacatgtgtaagctgagtaggacatggtcaggtcggctggtgggtcttaatttttaacgcaaagccccaccattttcacttcatttatgtaccctaataaataattcacgtaatccttttgaagttctgttttggaaccaatgatttggaatttatgaaaagaatcgagttcaacgaaacatgtaagagtatttttgtggattttctctctaataccgttttctttttttttttgtcacatcatccatatgtttatttgtgaaatttcgataaacgattagatagtggctgtatatgattttattataagagacttccgcaatgttgcaaggaaaagtattctaaaaaaaaaaagtagtactctaaatactttctgatataacttaagacttttgttaaaaatttcaaactcaaaatgatgcgtatcattaattctatagttttaagaagagaaaatataggatatatttaagaagacaaaaatgtttacatacacaaatgtgattgtaaaagtcacatcttactcaaaaagtaataaaaaataaaataaaataaaaatatatggagaaaaaggacacgaatctatataaatagatgcaacttttttaaagggggattgacaaaaaggcactaaaaaaactctccttttgacgggcgatgtctcaagggaaatcttgaatgtgactcaaagcgaagagatgaaacagctcgaaaagatttggtttgagaatcaaaattgtcctcatacagacaacattgtcgtcccaccgtctcaaccttaatagcttctggggtctgtttttaatagcaggccttgcttcagtcatggcacatctcgtcttcatagccaacttcttgtacgaacataggcacacgctaaatgaggaatcgaaaatttccttttccagaaagctaacatttttgcttagaaactttgatgaaaacgacagaaaatcgcacatgttcaaggagagtgcaattcataatgtgagttcaccttttagtcaaaccactccaagaccttcaacagtgcagatcacaccatgaccacgaagtccgtcgcaaaatatgcagtttgagccaagatgtgtatcttttgaaagcaaagaatttttcactccccaattagaatgtatagctaaatgataaatagaatttcaaaagttgttgaagcattttgattacttagctaattttactgacttattttcatatttttgtgtgttagtctcttctcaaatctatatataacccatgatatactctatatttagcactttatcatggttattaagatccattttatggtgtttcattagtattttcattgtggtttgttgcatttagtgtccaagtgagtcttcttgcattttagaagtcctatagttactgtgtgtattttgtgtctcttttgagatatttcatgttaaaataatggaggacacacatttaaatgcaaagaagagaattgatgattcataacctatctgaagtctctcaaagatcgactcggatgaagttctttcattgagatttagctttggacctctttataatggttataggaaattgaaatagatttccaatggaggtgatgtttcatgggtatgtgagctattggtagagatttatggctgattttcgtatacatatgtcaatctatcgcagaaaagaaactcatctagaaacctctcttaaaaacggacagaagcttcttcgacctccaccttcggccccaacaccaccaaagcccctctccgatcaccatcgtcgtccatgacacaaccgaagccatctctttttagctttgatccaaattgcaaccgggttgtaacccggtttatctcgtcgatccggtcagaacctattaagcaaattttagacatttgttaataataaaattttcactacaaaaaaaataatatagtaattttccaaaaaggtttttggttcgtgttacattttctgagatgatccatcaacttacaattggcattttctttctctctctctcttagtaggatattcactagcgtaaaatcactcgattatgaccttttatgtgtatgaaacggtcttgctagctggaagaaaaatattaatcttccgtcaaacaagtaagaagactgaagttggagatttttcaaagtaaacgtatgtagcctaaaaaaaaggagtgacaatggtagagaataatgacaaaaagcgagctcatattatcgtccatacaatttttttctgtcactttcaaaccttaacttcgtttgttttcttttacattcttgttttcatattttattttatctctatatatgtatatatatatatgtatgtgtgtgtgtgtatatatgcaatagaacaataaaaaagaagaggaagttaaagaatgacataaagttcctcaatctggatgaaagtgatgaaccctagaaaaactaataatacctttatgtattactttgtcctgttcgtttgtggttttgtgttgatg

SEQ ID NO: 12454 - DNA, 3000 bp, Unknown
  misc_feature (1)..( 3000): cDNA_ID_2712076_gDNA_ID_2214552_Annot_ID_185607 3000 nt of promoter + ATG
actcagagctacacagcgagtctcacctctttcctcacggtacaaagtttgcaaccgacggtcacaaatgtaaacgatctcatcaaaaatagggattgtgtagggtaccaaggtggtgctttcgttaaagatattctattagggctaggatttcatgaagatcagctaaagccttttgattctgccaaagatgccgacgaccttttgtccaaggggaaatcaaaaggtatcgcagcagctttcgacgaagttgcttaccttaaggctatcctttctcaatcctgctctaaatatgtcatggttgaacctacatttaagactggtggttttggctttgtaagtaccttctgtttcctttctatgtatttttacaaaataaggggacaaataacacatgttttgtttccatgatcaatgtgtaggcattcccgaagaattcacctttgacgggagaattctcaagggctatcttgaatctgacacaaaacaatgtaacgcaacaaatcgaggacagatggttcccgaaaaagaatgattgtcctgatccaatgaccgctctttcgtccaaccgtctcaacctcagtagcttcttgggtctatttctaatagcaggcactgctatatctttttcattactcgtcttcgtggctcttttcttgtacgaacataggcacactctaggtgatgattccgaggattccttgtggagaaagctaaagttcttgttcaaaatcttcgatgagaaagacatgaattcgcatactttcaagaacagtgccattcataatataagttcacctatgactcacaagactccgagcccttcaactgtgcaaatcacaccatggccacaaagcccatcacaaaacagagagtttgagctaagaagagtgtcatttagcccgagcgaagaacgcttcactacgcaaccgataatacatcatgaagatggagaatctgatattgaatgtcgagttgaacaatagagatagatgttttacaaaactacattaagaagttatagatgattatttaccaaaaaaaaattatagattcttccatgaaaattaatacgattttatttattaaattgttattatagatttatatagaattcatctttcagtgcttgcctactcaatatttgaaagaagatacatcaaacgcacttctattaattaaagtttgtgaagcaagtaacatcagaacagagatgtctacaaataaaagtaagaacatttatattcttataacaatatacataagacttaatatcaaacccaaaaagaaacagaaaaagaaaaaagactgacgacgataacttaagaaaatttcatcattatgcgatcaccgaccaaagatgaatagatgattatacgaataatattaagacttttaaaaaacgaagggaagtttcttaaggaagaggaaacgttgaagtgtgaataactgaggagttccagcgaagcggctactgcattttgcagtgatctgaggttcgtatatgcgtacgtggatttctagggatgtcacggactaagttatttttattttaatcttcaaatgtcatttgatttatattttaaagatccttctccaacttatccactacgcagccctttcaccacaacgaacgaccatatacgtcaattttaagtgattcattgactaaagataacgttagtttaaagtatttaatttaccaaggtccaagatatgatgaagttttcaaaaatagtttagaaaataaggtttttggtgaccagagtaaattttatttaaaaccttgcattttataaaggtaaaagatcgtcaaatattctttttaatccattcgttatagaaactattaattatttaatcgttttcttaatcatcatgttatcaattgttttctattgcaaagattttttgtattatcttctatcgtcattgtgtatacacaaaatacgtaaaagtaattgactatcacatcgtacagagaaaagattcatcatcataaaacaaaaatggaaaaactcaaacgtagtatttgtttaactaatggaagtggtaatattttctaaacaaaagaaaagaatttaactttgctagattttttcttgctgacaagagaactcaaccatacaacattttcagtggatcccatttatctcaaagaaaaaatgatgaactaaggtctttgttttttgtggtcactaaagtgtagtgtggggttagccaaagggcaagtaaaatacagtccaaatacacaaacaccactcaccactgaatttacacattatttttcctttcttgttccgtacaggttttcgtatcaacaaaaaatataaattatcctaaaataattaatcgtagaacaacaaaggatagcaaacgataaccacataaatagtactgcgccgaacactttgtgtacaaatatctatatatgtaaagactcaaaagaaaagtaaaatcaagttttgaaaggagaacatgtaaataacattcaaaaaaaaaaaaaaaacaagtagaatgataagttctgaattatacttttaatatacttctagaatctaggatattctatttgtagtatatatgcaattttcaagtttgtgtttattggaccaaagaaccgtcggcaaatttttgtattacttatcaaaaatatattttattttaattactataaaaataaatacaaaaaactaagatagatatacgatctttattttttctttttgcatatattagctattcgttggcggcaaaattctaattaatatgtatataattaattacaataaataataaatgtttgaacaaaaaagaaaaaaaaaagaaagaaagaaaggccaggaatgaagtatctttccatctcaactatagctatataaacccctcaatacttcaagcaaaagtcactaacaagaacaaacaaacacacacaactcataactataactatacattcatacatataacaataattcacttaaatcactcggaataatg

SEQ ID NO: 12455 - DNA, 3000 bp, Unknown; identical to SEQ ID NO: 12448
  misc_feature (1)..( 3000): cDNA_ID_1809029_gDNA_ID_2214552_Annot_ID_185594 3000 nt of promoter + ATG

SEQ ID NO: 12456 - DNA, 3000 bp, Unknown; identical to SEQ ID NO: 12447
  misc_feature (1)..( 3000): cDNA_ID_3025245_gDNA_ID_2214552_Annot_ID_185593 3000 nt of promoter + ATG

SEQ ID NO: 12457 - DNA, 3000 bp, Unknown; identical to SEQ ID NO: 12446
  misc_feature (1)..( 3000): cDNA_ID_1807526_gDNA_ID_2214552_Annot_ID_185592 3000 nt of promoter + ATG

SEQ ID NO: 12458 - DNA, 3000 bp, Unknown
  misc_feature (1)..( 3000): cDNA_ID_2708965_gDNA_ID_2214552_Annot_ID_134704 3000 nt of promoter + ATG
cgacttgagcaagaatttggatttggtatgcatcatgagttggtttatgtgccaaaatgtgtatggctgatgctgaaagacttgctttttatttactaattctcattttctttgacagtacgcattggattgctttatatgatatctggatttggtggaagtttgttatcttctctatttaaccgggctggtatatccgttggtgcctctggagcattattcggcttgcttggtgctatgctttcagagcttctcactaattggactatttacgctaataaggtagccaaatcttcccttgttaaacaagccgcactttcgatgaatgatgtgtcaataatgtcattggtttttctacatttgcagtttgcagctcttttgacactcatcttcatcatagccattaatttagcagtaggtattcttccacatgtagacaactttgcccatcttggaggattcacatcagggtttcttctaggctttgttttcttgatacgtcctcagtatggatacttcaaccagcggaacaatcctcggggttatgctgcaccgtctgctaaatccaaacacaagccataccaatacgttctttggatcacctctttagtgcttttaatagcagggtatacttctttttctttcatcatgattacaaaatgaaacagattcagtcaattctttaatgcaaatttttgaaaatttggtgttagatataccgctggactcgtagtgcttcttcgaggaacggatctaaacaagcattgttcatggtgccattatctcagctgtattcctacgtcgctttggagctgtaaatctcaaaatgtctactgtgaggtaaatacttcttatgctctttagtctttatctaccatgtctagtttgatcccaccattcttgttttgtgttaatacttaaaagaagacactagtcttatgtgtgtgactaatcttatgttgtattcgagtttataaaaactgagagtgattgtggaatttggtgcagtcgagccaaattgggcagcagatgaacttgacatgtatcacgaatgggaaaacagagatgtacaagctctctaacgatataccgtctcggattcagcagttgtgttcccaattgtgcagatgaataccactaaacgtctaatttttatactcttgtagaaagttaggaatgtgtcttgaggaagagaagattgttcatttaacatgatcatgcacttgtggattcttctttctgatcattgtttgtttccacttcttgttttattgttgcatatgtattgaccatgatctatgtaatgagaacataggtgaagagaaagttgaacaaagtttttgttcttaaacattttaattataaattcagatgtttaatctaatcttaaatttcttttgcatttaagttgcataaaaatgaaaataatattttgttgtatatcaaatcattttatatatttaaatgaaaatttattagtgtaatagttatgtcaaatgataaatgtaatttactatcattcgcaactttcgaatttccaagaagaaaattatataattaatttaaaaattgaaatttgcttacttaaaagttaaaggagtctaatcatattttattatttcatacgtatatggttagtgcgaatacgaaaactccactaatatcttcttcatttttatatttttacgtacatgtgcgttgaatttacatgataatctataaggctataaccttatcacaagacacaaatcattattaactatatgcacaaaatagaataaataactatatggtaacttttttaaaacaaaattttgtattatataaaaaaatccagttaaacgaacatggaatatattagtttttgaaaagtattgttatgtagtgtagtataagtttggacgttcgagtattcgtttctgttttagtttaataccattgtatttcgattatttcaattttgaagtttaaaatctatataaacaccaaaaaatttggttatgttttgatttagatttggttttttttttatttagaaatctatgatccattcggattttttttttttggtgcaatagttttagatttgttatttgtatttagtcattactttcgtcaaaacatatttaatgtttaaatgatcgctgatatgagataaataaaaatcaagttaaaaaaatcataaatatatctgttaccagttaccaccaattcgagaaaaatcttcacttttctgtcaccgatccaatcctattctttttttagagcattaaactcttatgtattctaacgtagttttaactttaatgccaattccacccatcgtaatgttaggtcgctcggtggattatattgttgtttatccattggttgttactttgaaaatttcacaaatatcagaatcattatttgaatctttatttcataatcgttgatcttacaattacatactcaaagtttgacactagctagacttaccaaaaccagttggcgccaaatcgcaaaatagaataatcatatgattatagtaatttttttattctgattataaattcaaagaacgtcggaaatgcctaacaaatttcctgaccaagtggatttatgattcatataaagaggacaaaggagtgtgattaaacaaatgtaaaaacttgtatctatcttctatttattattctctatagttttatacataaaaaatacttagtctccaccacttacacagatcattttcttctccaacacaaagctttcttcttccatagcatccgaatcgtcgcatcttaaacctcctaaacaggtatgcttgtaacttttgtttcttaccagaactaaattcactttgttaatttgtgattagattctctgtttctttccggttactaatcttgatcagggacaagaatttgtttttgtgtcggagactaggaatataacaaggatttttgcgttttcttgtgtaacaatttttagggtttattagggttcttgatttcatca

SEQ ID NO: 12459 - DNA, 3000 bp, Unknown
  misc_feature (1)..( 3000): cDNA_ID_2708961_gDNA_ID_2214552_Annot_ID_134705 3000 nt of promoter + ATG
taataataacccaaagatcataacttttaaacctcgtacatcatcagattcattcaaactgaggtaagctatgacatcaatctcccgtatttcccgtgtttactctcattcacatgtgcaattcaatttcggttgcttctggaatctaaagtttgaatttttaattcttcctttgactctctctgtttcgtgttcttcttcttctttttgtgtagctttttctatgtgggcagagcaactagggttttgatcatggatccaaacttctctgaatctctaaacggctttgagtattttgatggtaaccctaatttgcttactgatccaatggaagatcagtatccaccaccatctgatactctgttgaaatacgtgagtgagattcttatggaagagagtaatggagattataagcaatctatgttctatgattcattggctttacgaaaaactgaagaaatgttgcagcaagtcattactgattctcaaaatcagtcctttagtcctgctgattcattgattactaattcttgggatgcaagcggaagcatcgatgaatcggcttattcggctgatccgcaacctgtgaatgaaattatggttaagagtatgtttagtgatgcagaatcagctttacagtttaagaaaggggttgaagaagctagtaaattccttcccaatagtgatcaatgggttatcaatctggatatcgagagatccgaaaggcgcgattcggttaaagaagagatgggattggatcagttgagagttaagaagaatcatgaaagggattttgaggaagttaggagtagtaagcaatttgctagtaatgtagaagatagtaaggttacagatatgtttgataaggttttgcttcttgacggtgaatgcgatccgcaaacattgttagacagcgagattcaagcgattcggagtagtaagaacataggagagaaagggaagaagaagaagaagaagaagagtcaagtggttgattttcgtacacttctcactcattgtgcacaagccatttccacaggagataaaaccacggctcttgagtttctgttacagataaggcaacagtcttcgcctctcggtgacgcggggcaaagactagctcattgtttcgctaacgcgcttgaagctcgtctacagggaagtaccggtcctatgatccagacttattacaatgctttaacctcgtcgttgaaggatactgctgcggatacaattagagcgtatcgagtttatctttcttcgtctccgtttgttaccttgatgtatttcttctccatctggatgattcttgatgtggctaaagatgctcctgttcttcatatagttgattttgggattctatacgggtttcaatggccgatgtttattcagtctatatcagatcgaaaagatgtaccgcggaagctgcggattactggtatcgagcttcctcagtgcgggtttcggcccgcggagcgaatagaggagacaggacggagattggctgagtattgtaaacggtttaatgttccgtttgagtacaaagccattgcgtctcagaactgggaaacaatccggatagaagatctcgatatacgaccaaacgaagtcttagcggttaatgctggacttagactcaagaaccttcaagatgaaacaggaagcgaagagaattgcccgagagatgctgtcttgaagctaataagaaacatgaacccggacgttttcatccacgcgattgtcaacggttcattcaacgcacccttctttatctcgcggtttaaagaagcggtttaccattactccgctctcttcgacatgtttgattcgacgttgcctcgggataacaaagagaggattaggttcgagagggagttttacgggagagaggctatgaacgtgatagcgtgcgaggaagctgatcgagtggagaggcctgagacttacaggcaatggcaggttagaatggttagagccgggtttaagcagaaaacgattaagcctgagctggtagagttgtttagaggaaagctgaagaaatggcgttaccataaagactttgtggttgatgaaaatagtaaatggttgttacaaggctggaaaggtcgaactctctatgcttcttcttgttgggttcctgcctagtgattttagtgttgttttgttacaaaaatcatgtaattttaggattacgtctgataggtttagaagaaatcttagctcaatttctctcatatatttctataaaaatgtttggccattataaatgaacttgtgattataagtttataaccaccaccaaagttagcttattggccccactttaattctccacagaactaattaacccattgtatgaaattccacgtaggattttactgggtcaagtaacgagccaattagcgtaccccacgtgtatatatagttcctttttccttggaacctataaaagaagaatctcttctttcttcttctctgcaatcaaaacaacttttccaatttttcagttccgatctgctgccattgactaggaagatcttcaagcttcaaaactctataatcggatcttttattccttggtacagttgaagttgatcaagctctagttgaatttattgttcttcatcttttggattttaacccagtaaaagtgttcaacactgtcctgatcatctataacgttctcgttaagctattaaatctatctggattcatataataaggttccataagtttggattttagtttgttttaagttttttcgatgatcgcctttgatcttgttttctgcagagatcttatctttatagctttgatactttgaattgaaatttgtataggatcgtatgttattctgaagttgattttttttagctttttattttgtgcccacaaggtattcgatgatttgcctcaatgggttgcgttgtaaaccagaattttctaataaagatcagattttgaagtgtttttctttttcgtttttgtggcagtggagat

SEQ ID NO: 12460 - DNA, 3000 bp, Unknown
  misc_feature (1)..( 3000): cDNA_ID_1834466_gDNA_ID_2214552_Annot_ID_134706 3000 nt of promoter + ATG
ttacactgcatgtagatgacatcttgtaatgtcgacaggtggcaccaaaaccttacacgtacatgccattcggaaatggagtgcactcatgtccaggaagtgagctggctaaacttgagatgcttatcctccttcaccacctcactacttccttcaggtattttaattgttttctattaaaaaaacctggatttgtttttttaatttggcttcaatgtctaaccttattttaattttaattaacacaattctatagcaactatttttatttactccatgcataagtctcttctgattgatagaattaaccctgagccaattctccccaagtctttaatgatgttttgatttgggttatagttgatataattaggaaaaacagcttcaaaaccaagaagtttgtgatatgatgcttcaaaactattctaagacgtcatcacttaatgatgtcatatacgcattaaaaacttctattttgacatattaactacgtgttttattgaagatgtttagttgaacttgtgatgatgaagggtccatatgaacccatgaagaaagaaaaaaaaaacttgtgatagtaaagacttggaaagagattgccagctgtaaatgagatctattataagaatcaatcttggatattgtttccattcattaaatccttacgagtagatatttatttacaacaataatttgtagtacccaaacatatgaatcggcgacctgtcaaattagtactagtctatatatggtccaacacaaaagatgtgaatctcgtttgatatcaatttgtttgcatatttcaatcttactattattattattatgataatattgatgaagtttggattttaatttgcagatgggaagtgattggagatgaagaaggtatacagtatggtcctttccctgtacccaagaagggtttaccaataagagtaaccccgatttaagcctaaggcatatttgggattttttttactagtccaataagtcatctttaatttctcttagtagagatttttttcttcttaaactttaaaattggcctccaatttggcccctttttcttttgtaatttttttttatcttaatgtaaagctgcaatttaatcaatctcatttttattgctttggacttattgaaatatctttgaactctacatttccaactagctgttattgctatcatgttgtgacagttgcgttgaaatatttgcgtttgtgtttggatccgaagcaaacgccaaatttggaatttgatattctcttttaacctcttggatcctaaatgttcgatttatccttttacattttctccggcatcattttctacaatgcaataattccggatatttgtttgagattccgttcagacatataatgagctgaggtagacgtaattgtttgtacggaagcaaaaacgtattataattatttacttgtaagtttttagttggtagtattagtaagttatacagagttgtaaataaactaataattcgattagaccaccattatcaatattgttgtatgtaacaaacacggaagtacataaatcgttgagccgtggaaaggagacaaaacatatttttagtctcgtgataaaacgagtcgccacgtgtccacagtcgggtacgtgcatgagatctaacacactttataactagcttacgtgggactctcgacttccataaaaacgaagaagattgaaatgaatctaattcattgtccccgatttgtctctgtctaaagtcagagaatcagagattcgtttcagagtaaaatgattttgcattggtccacttaagagtctcttaaccattccaaaggtttggtggacaaaacatgctccaaccctttcttatccaatttgtcccctcttgtctctctttaattaagccctaccccaaagtttttcacatgatttgttcttgaaagtgtctctctcaatctttgttgtttattattattatttgatgtgaggcgactagaacgtgtacaaagaaaagaggggagattggggattaacacgatcgatattccttttggattagatacgtgaagtacccgaaatgtataagttttaacatacactaaattagtgtcagtaataatcggcgtaaatgagaggagtctttcaaaaacatacactacatcttatatgtcgatcaatagacatagttcatacccaaaaaaatatacaatacgatggtataaggtgccatgatttccaaattgagtttttgcttgatatcagttcctatacattgtttatgaggaacaagttatgtatatatgtctataattttatcatatatatatatatatatatgataaaattagtgattatttatttgtttctcaattatgatttaaagagccataattcttctttagccaaaaaaaaaaaaaaaaagatagaaccataattctttcattaacaacaatgcagataatttcgttgatgatggttagtgtcctttttagttaatattggttcattactgaaaataaaataaactgatatgctacggctacctcttcacttttattttcaatttatgacaaaagctatgcccatatgttctccaaggcccaatatatgtaaaattaggcctatgaaccaaacactggtttaataagaccggtaagcacaagttggattcggacattatttagaacaaaaccggttcaagagaatctacagaacacaacaagtacagagtctttttgtctttgacatttcataaaccttctcttctctcgataaacttcagatattaaaaaacccaaacttttatttcccccaatcaaaaaccctaatttcttcttatcttgtttggatttttcatttcttctgtttgattttattccacaaacacaataaaaaagtttgcattttttcctcttctaagctcgtttcagatcttcgatttcaccatttttataaactattatgcgaacttagttttgttctttgtgattttgtatgacaatg

SEQ ID NO: 12461 - DNA, 3000 bp, Unknown; identical to SEQ ID NO: 12454
  misc_feature (1)..( 3000): cDNA_ID_2712076_gDNA_ID_2214552_Annot_ID_134707 3000 nt of promoter + ATG

SEQ ID NO: 12462 - DNA, 3000 bp, Unknown
  misc_feature (1)..( 3000): cDNA_ID_2712068_gDNA_ID_2214552_Annot_ID_134709 3000 nt of promoter + ATG
cccggtaagtcgaaagatgttccgaaaggttggcagattccaacaaacggaaagatgcttagagtgggcattccagtgaagaaaggcttcttagaatttgtggatgcaaagatagatccgatcagtaacgcaatgaccccaacgggttactgtattgagatattcgaagctgttcttaagaagttgccttactccgtcattcctaaatatattgctttcttgtctccagatgagaactatgatgaaatggtataccaagtatacaccggggttagttcgtctatttctactatggttcttttacttttactttaactttcaccgtggatcatgtcttttttctttatatgtgatttctaacatatcattaacattcgggtcaggcctatgacgcagttgtgggagatgtaaccatagtagcaaacaggtcattgtatgtcgatttcacgctaccgtacacagagtctggagtgtctatgatggtacccctcaaggacaacaagaacacatgggtgttcctcagaccttggagcttagacctatgggtcaccactgcttgctttttcgtattcattgggtttatcgtgtggattttagaacatagagtcaacaccgactttcgcggaccgcctcaccaccaaataggcaccagtttttggttcgctttctccactatgaactttgcccaccgtaagtaacatcaatcaagaactaagtcggaatagcctagtggtatttgttcgagtcttagtttattcttctttgtgggataccgctaggaaacgagtcccatcttctatgatcatcattaaagttcaaccttggtcactatagaaacttttaaccggcaagatttccgactttatgttacaaaaattggcagatgatgaaagaactctaaatacggtttttatatagtagatattgtatctcaaattattatcaataagatgttccaaaataagaaacaagataataatgatatacttacaacttgtttgcgtgtataggtgagaaggtggtgagtaatttagcgaggtttgtggtgttggtgtggtgcttcgtggtgcttgtgctgattcagagctatacagcgaatctcacatctttcttcacagtaaaactgttgcaaccaacggttacaaattggaaagatctcataaaatttaacaaaaatattgggtaccaacggggcactttcgtgcgtgaacttttgaaaagtcaaggatttgatgaatcacagctcaaaccttttggttctgccgtagaatgtgacgagcttttttccaatgggacaatcacagcatcttttgacgaagtggcctacattaaagttatcctttctcagaattcctccaaatatactatggttgaaccatcctttaagactgctggttttggctttgtaagttcttttacccttacactagatacagccaaagaagtacgtatattgatgatataggtattttcattgctttgattttcttcttccatgatcgttgtgtaggtattccccaaaaaatcacctttgacggatgatgtctcaagggcgatcttgaatgtgacacaaggcgaagaaatgcaacatattgagaataaatggtttaagaaaccaaataattgtccagatctaaacacttctctgtcctccaaccatctcagcctgagtagcttctggggtctgtttcttatagcaggcatagcttcattcttggcacttctcatcttcgtggccaacttcttgtacgaacacaagcacacgctctttgatgactccgaaaattctttccgtggaaagctaaaatttttggttagaaactttgatgagaaagacataaagtcgcatatgttcaaggagaatgccgttcataatgtgagttcacctattactcaaggaagttcaagccctttgaccgatcagagcactccattgccgcgaagtccggaacagtatagggaattagagctaagaagagtgtcttccatctcgagcggtgaacttttcactacgcaatcagaacaagttgaagatgaggaatctgctataattcaatgtgaaggtgaatgatagagagaagttgctaaagtgcataacaagttagccagtgtggttaatgctttcttttaggagtactttcttttctcaacacttgtattcctatgtttgttttcaaactcaatgtcatagttagatttctgaatttggattctaatcttcttcctttttgagttatataaaaattagggagattatgaaaataacgcaaaattttataatctgcaaaataacacaaaaaactattaatcttttgacatggatgtctttctcgatctcattgttttggaaaaaccaaatgttgacaaaactaacatttgttttggatctgcccacattatacgtcttcatgtctccgagacgtgtaagaaaatgtggtcctccaacagccaatacattgtgtttgatgtgaaatatggcatacccaaaaacgcgttgaacaaacgaaatttgttttaatacaaatatccttgcactaataatatgataaaataatatatttttttaaattactcttgcacttaaaagaaagaaaaacacattgtgaagtttcaagacagagttagccttcataacggaattgttaggcaatctttccaactgaagtacaaattttaacttgaatcatcacgaaccatgtacctcaatgattaaggtagttatataactcgtataatagaaattttgtagccttgctttgccgagaaacatcttcggcaatgtctcatgactaaatcaaaccattttttatttttttctagtcaacactaatctttattattttatcactcttttcttgatgagtaccaattttgttatagcattgtaaagtcttccaagaccttttcaaacctatttatttcctctgtatttataacagaaaaagggaagttttagagaaccacataacttgtctgtctccttatctttggataatgatg

SEQ ID NO: 12463 - DNA, 3000 bp, Unknown; identical to SEQ ID NO: 12453
  misc_feature (1)..( 3000): cDNA_ID_2712064_gDNA_ID_2214552_Annot_ID_134710 3000 nt of promoter + ATG

SEQ ID NO: 12464 - DNA, 3000 bp, Unknown
  misc_feature (1)..( 3000): cDNA_ID_2712153_gDNA_ID_2214553_Annot_ID_134712 3000 nt of promoter + ATG
aagttctactgattgcccaagacagaaaggagtgtcaagaagcctagtttggtataaaggtttcctactttattcaatagtaggccatgccttatatatacatgagatgagattaaacctaagcacttacatataaattacacaattgtagttagactatataatatttgcacatatgacttacacaattgtacttagactatagtataatatttgcacatattgtgtattatgaatcattaatgatttataaattgtaatgcttaggaagtagattaatgtgaaattaaggtccatcttattactataaagtttttcaatattttcttttaaaaaaacgaaagcaaatatagtagacaaaatgattttacagaagtagagaaacccggaaaggaagagtgactgagaagtaatgagacatactataatttatgacctcccactagaacaaataaaattaactcaatgatcctaacttttcttttcatttgtttacaatgctaagccacataatctcatcatttaaaagaaggtctaaagaaaccgaaggagaaaagaaaagtaaacttaatacaagagaaagcgtgtttctcggatccgtgtgggatcagcgaagcgacaggagaaagaccgtgaaagattctcaggctcatcgtggtcgtgccatcctggaccttgatcaaaattcaaagagtaatcacaaggctcataagccacgaccttagtggaagaagcacgagaaggcaagagcttaagcttcatcaacaaaaccttccatttgggcaagagcctttctcttcgttggtgttgcttctgttctctgcaactcttgctatatcttccaagtacaattgtctctctgtgagatgaagctgatgataacacgttaacgttccatctctttttgcttgaagattctaacatcatttcttccttctgttctgttctgtctttgttttgttggttgaatatttcgtcttgtgtctttgtgaatatcttagctgtgttatttatattttgtagtagatggatggataaggagacgtaaaactgagactaattcaaagtcagctttgaaaggcttgtgaaactgcgttagccaacttgtatgaataattaattggtgaaagggagcattttaaatgccggtatctaatctgactactgaactacaaaacaatagtcaaagtagacgttgttttgtctttaaatctgacttcgttttgctggtgacaactaaatatacaattagtgaacattacagtaattagagtaactgagtttataactttataataaaattacattggtcttataaacgttttgtattttttctgcgtcttataactatgatatgtgtagacatatatttctgcggaaaacatccaaattcctgctgaaacattacgaaattttgtgacatacattctgttgaaatttctcaaccaacttgtgacaaatttatgacaaaactttaaatctgttgaaaattccagacaaaaataaatagtcaaaatgtatgtcgcaaatttttcgatgaacaaaagatgtcaagaaagaatcgtcaactgggcttctccaagaacatatctacttgggcctataactctttaaaaggtccatctgttaacttagcccacatacgaaattgagtcttatgactcataaggtatataatatacctttgttttttgggcaaaggtatataatattaccaaattctaaaaccgatcggatatttagaattatatttcaagtaatccaaatacataacggttcccgtatcgattccaattctataaagtttcatttgtcaccactagttactatctcttctcaattggagtttgactctatagatgtagaaaacggactaccggagtttggacccagtccttgtggcccggccgacaaaaaaaaaaaaaactcactttagaatacacagacacattttccttcagtctttcattttttccgccaatcctccaatacaaaccatggcaggtggtccgaatacggacatttgcttgtctaaataaaactataaagtacagataaaaaataaaaaagtaattgtattacgtcattacgtgatctagtgtgtgtcctaattgcatcatcaatgataacatcatacgcaatcactcgtcgtcttggcatttctcataaaacaaaaattcgagacctcctctccacttcgaaatttcattttttttttctcaacagagtaaatttggctcttatgcacctgtcgtgtgaatcctgatctcgctttagattgtggaagccttcgacacatttcccattttgaatttgtcttcttcttcttcttcctttagtttttggggatatttcaccatcctcgttgaaatcagtgtgattcttcttcgtatacaatgacgaaattgagatcgaaatggttaggtttaagatctgtaaccatcttcttaatcaatttctctctagcttttgctttcgtttccgctgagagaagaggaaaatctctgaggttaagtacagacgaaacgcgggaaaatgaatcaagtttcttccttaaagctatcaattttctatgggaatctgatcaaataggttatcgtcatgtttggcctgtaagtatcattcttcttctaagtttcatctcttgtgtcagaattatatgttaatggttttttttttgtcagtcaaaagagcgaatgttgtttacatttgtgatatgacgcggaattacatgtattttgttatttgtataaacaggaatttgagtttaattggcaaattgtattgggaacacttgttggattctttggagctgcgtttggtagtgtaggtggtgttggtggtggtgggattttcgtacctatgcttagtttgattattgggtttgatcctaaatcagctacagctatttcaaaatgtaagtttttagttaacaacattatatgtttttgtcttgatgtttttttgactaatattgacatgattttcttaggtatgatt

SEQ ID NO: 12465 - DNA, 3000 bp, Unknown
  misc_feature (1)..( 3000): cDNA_ID_2712145_gDNA_ID_2214553_Annot_ID_134714 3000 nt of promoter + ATG
gttccaggataatccatttttatacaatatcttaattggttttatacttaaaccatggaaaaatctcttagtatatcctatgattatgtaacgatgtcaataaaagatgatcatactccctaaagatactcccactgggtcgtgcaaagaaatatagtaactatgcatggccgcatgggtatgtgcatacccacgaatggtgacaaaagtaatggtatgctgaagtcttttatactttattccttttctgtccaaataccttttttatccttacgaagagctgagtgatcttaacagatacttgtgctagtgatatttagacgttggtgtaaacacaagagcagttttatcaacaatgcatttttaccttgagcataatccaatatctttgagcaacatccttaaattaattagcatcatccaatatcaccttgagatttcaatagagcatgttcctaagttacttacatgctctcctatatatcttttatacatacatcttttggataagaaaaaaatagacatacgacattaaatgtagaataacaagcgcaataaaaactcacttatcctttgattataaagttggctgaggacataagcaaaatgtgagacttgactacccttgtgttctcgtatttcgaataatttatctgtttacactcgctacaaaagttatcttttcaaaatagctgtgatttttttgaaattgatacactgacttgaaacattaccaaatgacaaatatctatcacttcaaagaaatccttgcatttattataagatactctccataaaaagagattgtcatctgcaaaattggtaggttagtccgaaatattttgaaaacatgttaaattattattttctcctatataaagatagttcaacccattctttagatgtttcatgttcacatctttccacgtattgcagattttttaagtttgatttgttcttctcaaaacatagttatgaatatatagtttatgatgcactattgtgacctcatcacatgatgcaaattgaacatctcttccaaacacaaatcgatgattaacattccaatggatgtgttcagcaaaagctttcctaatggtcaacccataaacaagatcatggtgaggaaatctagacgaacactcgaaccccaacattttgtcgtgatcattcatagccgagaagagatcatattccgagtcaaactttgaaaatttgacatttctcttttacaaaaaaaaaaaaaaaaaaagaagacaaaataactaaatggatcatttgcaaaaataaccatatttgataaactatttaagtatatagcactatatatgtataaattaaaaaactaacatagagggcaagtataatgaccaaatgtggtggtggtgatcaaaagtgatggtggtagtgactagtgaccaaagatggtgatgatggtggttattgtcacggtgctggtgggagtggcaaaaggttgtggtgctgatgggagagattaaaggtggtggtgatggtgatgatgattaaaggtgatggtggtgagtggtgacggactgtggtgtgatggtggcggcagtgacggtggctgtaatgacggcggcagtggtggtgatgactgtgacggctatggtggtggtgacggcgacagccgtggtggtggtgacggcggcgacggtagcccgtggtggtggccgtgttatgatttggtggtggttgatggtgataatgatgaggacaaaattgtaaataatatatattacacacaaaatataatgaaagttttttttttaggttagtttcttaatttataaatttttgttggttatacacccatatttccctaactaaatactcttttaaaccggcgatttaccattctattgatgaatcgattcacgtcaaattttgaataaattctacccaaatcttcttcaatattgaacctggttttgaaaatttaacatttctcctttacaagataatgaaagaaagccaagatatatcatttctctttttaaccgaccaacattcacatcgggcttttggaaagccttaagaaagaaaaacattccaacaagaaacttgtttacaagcccccttcaagtcacacagagttggtccattaacaattttaagtattgtagatttgattaatctatgttaatcatgtccaatgtccatattgttagataaaagaaagaaaaaaaatcattaaaaacccatagattgtgtgaagaaaccaaaaaaaaaacatcccataaataagaagatcccttaacagaaggttaaaaaaaaaagatcagagtcctttggattcttcaattgcttagtctcataaatccccaaaatctctccacccagttggatttgcagctctctcagattcatcagtttcttgatctctttgttatattcaatttcacgaagattgtatccagagcagatgggtctggaagcttctttctttctcagtgatttcgatcgttccatggaccagacgtacgatgcctgagctgcgtagcaacgcacgcagagatcgggataagaagaacccgaagcagaacccaattgctttgaaacaatcacctgttaggagaaatccgaggcggcagctgaagaagaaagtggtggtgaaggaagcgatcgttgcagctgaaaagacgacgcctttggtgaaagaggaagaagaacagattagggtttcgagtgaagataagaagatggatgagaacgacagtggtggtcaagcagctccagtgcctgatgatgaaggaaacgctcctccacttcctgaaaaggtgtcaactttattgttggttttgttgtttttatgaggttttagttcatcggaattgtctcttgcattgtgtgttgtgttttttgattaggagaaagctctcaaacttaggcatgccacttaaagttaaaactttctcttgtaggatgatttgattattgactccttggtttttacaggttcaggttggtaattcacccatg

SEQ ID NO: 12466 - DNA, 3000 bp, Unknown
  misc_feature (1)..( 3000): cDNA_ID_3025349_gDNA_ID_2214553_Annot_ID_185618 3000 nt of promoter + ATG
atagatagctagaaaaaaacaaaaggttcacgatgtaaagaaataagatactctgaaatctcccaagaaaaagtagtatcactctattaaccttcgtcaagaagttttaggatcctacatttggtaattgcaggttaagaaaggggtgtggaataataatctggaacaacttttagcttttgtttttaattctctgtttctaatttatggtttgtttcgcttagatttgtctaatagttctttataaaatgttttcccttgtgtctgtttttactagctttgttgttgtaacttttctttggttggtttagtcttccgtattgtttgtaatgacattttgatcattaatataaattcatcaattgacctataataaaaatattccactacgtactcatcaatacaaaggaacaatgcaattcattattcaatacaaaggaataatgaaaaacaaaactcttaaaccaaaaggtgaaaaacaaaaccaaaatctaacaatcaaaaatgtgatagtcttcctctagtgtccattgttcaagatgcacacgttcggtctcaattgttcttcgagtatactatgcatagttgctgcataaaggcatcaaagttctactgattgcccaagacagaaaggagtgtcaagaagcctagtttggtataaaggtttcctactttattcaatagtaggccatgccttatatatacatgagatgagattaaacctaagcacttacatataaattacacaattgtagttagactatataatatttgcacatatgacttacacaattgtacttagactatagtataatatttgcacatattgtgtattatgaatcattaatgatttataaattgtaatgcttaggaagtagattaatgtgaaattaaggtccatcttattactataaagtttttcaatattttcttttaaaaaaacgaaagcaaatatagtagacaaaatgattttacagaagtagagaaacccggaaaggaagagtgactgagaagtaatgagacatactataatttatgacctcccactagaacaaataaaattaactcaatgatcctaacttttcttttcatttgtttacaatgctaagccacataatctcatcatttaaaagaaggtctaaagaaaccgaaggagaaaagaaaagtaaacttaatacaagagaaagcgtgtttctcggatccgtgtgggatcagcgaagcgacaggagaaagaccgtgaaagattctcaggctcatcgtggtcgtgccatcctggaccttgatcaaaattcaaagagtaatcacaaggctcataagccacgaccttagtggaagaagcacgagaaggcaagagcttaagcttcatcaacaaaaccttccatttgggcaagagcctttctcttcgttggtgttgcttctgttctctgcaactcttgctatatcttccaagtacaattgtctctctgtgagatgaagctgatgataacacgttaacgttccatctctttttgcttgaagattctaacatcatttcttccttctgttctgttctgtctttgttttgttggttgaatatttcgtcttgtgtctttgtgaatatcttagctgtgttatttatattttgtagtagatggatggataaggagacgtaaaactgagactaattcaaagtcagctttgaaaggcttgtgaaactgcgttagccaacttgtatgaataattaattggtgaaagggagcattttaaatgccggtatctaatctgactactgaactacaaaacaatagtcaaagtagacgttgttttgtctttaaatctgacttcgttttgctggtgacaactaaatatacaattagtgaacattacagtaattagagtaactgagtttataactttataataaaattacattggtcttataaacgttttgtattttttctgcgtcttataactatgatatgtgtagacatatatttctgcggaaaacatccaaattcctgctgaaacattacgaaattttgtgacatacattctgttgaaatttctcaaccaacttgtgacaaatttatgacaaaactttaaatctgttgaaaattccagacaaaaataaatagtcaaaatgtatgtcgcaaatttttcgatgaacaaaagatgtcaagaaagaatcgtcaactgggcttctccaagaacatatctacttgggcctataactctttaaaaggtccatctgttaacttagcccacatacgaaattgagtcttatgactcataaggtatataatatacctttgttttttgggcaaaggtatataatattaccaaattctaaaaccgatcggatatttagaattatatttcaagtaatccaaatacataacggttcccgtatcgattccaattctataaagtttcatttgtcaccactagttactatctcttctcaattggagtttgactctatagatgtagaaaacggactaccggagtttggacccagtccttgtggcccggccgacaaaaaaaaaaaaaactcactttagaatacacagacacattttccttcagtctttcattttttccgccaatcctccaatacaaaccatggcaggtggtccgaatacggacatttgcttgtctaaataaaactataaagtacagataaaaaataaaaaagtaattgtattacgtcattacgtgatctagtgtgtgtcctaattgcatcatcaatgataacatcatacgcaatcactcgtcgtcttggcatttctcataaaacaaaaattcgagacctcctctccacttcgaaatttcattttttttttctcaacagagtaaatttggctcttatgcacctgtcgtgtgaatcctgatctcgctttagattgtggaagccttcgacacatttcccattttgaatttgtcttcttcttcttcttcctttagtttttggggatatttcaccatcctcgttgaaatcagtgtgattcttcttcgtataca

SEQ ID NO: 12467 - DNA, 3000 bp, Unknown
  misc_feature (1)..( 3000): cDNA_ID_2712136_gDNA_ID_2214553_Annot_ID_134717 3000 nt of promoter + ATG
attgttcttagggttctagaaacgtaaaaaaaatatgaagccaacagtttttccaaatggttctgatcccatttataaccgttctggtcttcatttaaaactaatttaatttggaggtcttggactgagacccataaatatttttaagcctcagttagttttttttttgctttctttggtgtagctttggagaaaacaaattattcaaggttcatgatcttacataaaaaaaattccatatatcttttgtattctttcgaggactggttcttatatgctttagcttatgttatcacatgtttatggagttgttcttttctctacatgaaattgcctatttatatgataagggatatatgttacccttatatggatattcttagtttatcagtctatttagggaggaagttggaattatttcattaaattaagggaagaaaacaaaaggaagagaacaagcgtggggtgggagaaagtgggcgtgtgggggaattgcaaaaccctagaaaatggaattaagcaaagcatgcccttccatgacaatgaccactctctgtatattctctccataaaattcattctttttgttttatggacccatttttcctttgcaattagttctcgatgtgcgttttggtggtacaactctattcataaactatacaatttcgatacgataactcaaaacgtttattttcttaccttccgggtggtacactcatagttttctcatcagaaataaaagcaattaaaatccattggaatttggttagaaatgctcttgttttatatatatatcatcaaaacaagagctataccagtgaaactaaactatataacgttggggtttaaatgtaagatgactcgttaaacagttatatatgttcagaaaacataatatatgttaatagaaaacattaggacgctctatgtttaagaaagatgatttggttaagcttgatgagagataaggtaactacgtagataagtcgtttaaaaaaagacatatgggttagaccacagaccactacatataccacataaattggaattaactcatcaagtttatgtgtgaagacatagtttatgtaaagtaggtgaaacatgattgggattgatatatagcatgacttagtctatgctaatatttggtctaagcttaggttatttaagccaagctgattagacaagaaccaagtggttatttttttatcaagtggaaaatatatagtagtatgagagctaattgaataaattagacatgaattgattatgtatttacctaggtagacgagattattatactcactaagcttaatagatcagaatcctgtttaattattaagacggctagtgagcgagaccaaagattcaataaagaaggacaatgaggataggtagtcaccgaatatagcacaatgttgtagcctaagaccattgcaaacattgtatttaaaaacaatggttaataaggaatgatttatcaataaagttctaaatttgagacttatatagtgcaaaattaaatttaagtacaacatgaatttaaacaaagaattggactcgaagtgaatctacatgaattactctataatacagtgattgacataggttatcacatttttacgtacatatatttatattcgtacaaattgttttgtagccaggatttgaatttctatttatataaatttatacttaaaaataacagaaatactatagagaaggtcaaattaactaggaaagatttaagtacaaaaaaatgattaagtgcgtagagtgggaaaatgcttttcaacgttcacataagatgtttagtcacaagaaaaagtgttttgattttcttcagtcaaaagaacatttcgatagtaagccgacaaacatctcagaggctttttgacgacatcaatcccatcctcatctgtccgtgttcaaatgtccgattacaaaagtgattgagaaagaaaagtaacagtgatatttctatgattactcgcattagttcttaccataacaattataatctgattagcttcccataacaactaatttatgatgcaagtgtttttaagcatgctatttttaagatttcttagctctctaatataaaattttattagcgtttttaacgtacaaaaaataaaatacgatgtcgaatataattatcctaaaacaaattaataagccacagaatgtttcttttttcctaaattaggtcttaatattaaatttactctaacatgcactaagttgaatacaattaacctaaaacaaattaataagccacaaagtgttttttttttctttctaaaatttggttttagtttttactgttgaagtaacactaagttgtgatagagtaggagtaccagccggtgattcaactaattcaattcggaaaagagaaaattatataacaacgtaaacaacattcttactttgtgttttgagggtaaacaaattagtttttgttctagttcataatctaaagaacgatttttgtttaacaaatgcttaattcaatattatttttctttatatttttactgaataatatctatattaaataaatcagccataatttaaggtgccaaagtgctcgacaccttttttgtttctttctattttaaaatttaaactttggtaatattcccctttttgtagcccatcctagcactttttatcccttttccatctagtacaaagaatagtgcacactgcctttcttatgaaactctctaagattttatacatgaaggaaaaaaaaattaaaagtctaatttgaaaaaaaaaaaaaaaagacaaagaagactattataatctttctaatcaaaggtcatcattgatccccctttaatttttttctttcttctgttttacagctaaggttcaaagcaaatcacagtccttaagagcaacacattcaacacaagagcatatatatacatatcaaataacctcatgtaataatagagcaaagccaaagaaacaaaagcaaac

SEQ ID NO: 12468 - DNA, 3000 bp, Unknown
  misc_feature (1)..( 3000): cDNA_ID_2712132_gDNA_ID_2214553_Annot_ID_134718 3000 nt of promoter + ATG
acaatgagggctttaatgcagtccggtttagccgcttcgctatggtgccctaactcgatcttcttcatggcttttgaatgaatttaaaagttctaatctaacgaaattttgatatatggtttagttgatgttgtgatttgtgcgtaatacaacgaagctacttataatgagtttttttttttaattgtaaggaaaagaaagtgaaaagaaaatggtaaggactaaggagcacatggaatgaaattaatgtatgatgatgagtgattgatttgagtttcgaaagttgacttgtattatgttctttagtgagttctgagatgtattactttatttgacatattgtttttggagattgggtaacaaatttgaaatatgcttacacagtacagtactctgatttgtgtccttcaatatcaaagaggtgttactggttggatacgtttaaattgtttccattggatataaagtagttcagattgttaaaaactaatttatttgtaatgatttgttattcattttcattttataatccactgcataagaatgatcatagtctcttacaatccaatccaatgtaacaacgatcaagaaaaatcattaatcaatagaggatgatgaattaacaaacgtaaatagaagaaaatcaagtagttgcataagagaaaatttaataggaatttttggactgcaaagaaggaaaacagatcaaggtatatgtatgtgatctttatcaaagaacttgtgttatgggatatatggtgaggcgatgaaagctttaacaatgtggagccatgttcgactccaaaggacaatcaaagcacatataagtgcaaaattgcttataaatgcaatcacgtaagttgacacgatactaatataaaaattagaacatcaacatgtcataagcaaattgtccattttcgaccatggattatgtgataaattggtcaaataatgggttagtaaaaaatttaacactttacgtaagaaaagttttactaattatcgaaaacatcttgacgactttatgaccattctaaaataactacaaacacttataatgtcagatatctatatatatatatatatatatattttactaaccattttttgattaaaacttgaattcgtcgtcaatttgttttgaccatttatctactcattatatgagtccaaaaaatttcaccaattactgatcatttcatatattcgtcttagtttgttcgaaagtttttcaataaaaagtttgaccattttgttggtaagaaaattggtcaaaatttgacattgtatatagcagctccatcggcttcttctccttctccattacctgattcctctgagttcttcctaccctcacaacttttgttggttaactacaagaaaacgtagatagacattttttggtccatttgcaaagtctcgatatatggaagaaaaatacttccatgctgtacccaaagtatgtgaaatctctcatgtgaatgcatgttctgcatgccgtcgtctcataccgccgttgtcctctcagactaatactattgcttcaatctatcaaataaaggcaaataccatatatgcttatatgttatcttacatagccacaatctccacaatcttagtattcactagttactataaaatcttgatgctgaaaaattcgtacattaccttcatgaatatgtgtaaaatggcctctttttttgtcgtttgtagccttgtaaaacataggaacggctctgcatttagacatgcagaatggacgagttattaaaaatcaacgaaactaaacaaaaaaaacaatgtcaatttttgtttaacctaaactaaaccgaatctaattttaaccgataatacctcttgatagacttttactaatcaattaaccttccttgtcttctaccttgatttggggaaagtgttgtcctagattcatgtagatcatcagtacatagaagaaagttacttgtaacataatctgaccaaacaaaactaaccacttaaatatcctaaatctctctttctaagcctatctaaatactttgaatttgtatcatcgtttgaaacaatttaatatagaaaagaaaaagtaaacaaatactagtatgtatttatttatatgtggtccaatttgcccacagaaaaaggatcatgagacataagcgtgagaccgtctccaagctgttcgtctctgatgctccagctccctttcccactttatttttatgttattttaagtttgaactacaatcaacttacatatatacccaaaaaatattaattactgtatacctattttcggatatttcatctattattgcatatattttgtcacaaattttgttttggctattttgtgtagatttgagtatatatagttatacaattataattttctaatattttggtttttttttttttgttacatgaagatacatttggattaaaaaaagtaaggaatatgaaccacatctaaattttgtttgtccatgagaccatcctcaacgtaaacactagaattgtcccaaacccaaaaaattgaaccaaccaaataaaagaaaattataatagccgaatgagacctaaatctctaaaaccaaaaacctcgtaattggaatagaaccgatctaaacttaaacgaatatccaatacgaaataaaaagccactatttaatagcaataaatcataaattcttttctttttttgtaaatcataaattcttacgtctatttttttacttattagttacctaattcactcattagcttgacttaatcgataattatatttatagatacagtatatggtaaacatcaaataactaacgcttattgaaaatttcctttaaaatgactaatgagacgaaaaaatcaaataattaaacaaaattacaaaactgccatttcttcttaaattatttcaagtaataactgtactaaaagctgtttttgttctttctctctctctctctctttcgctgctctcacacgcaaataatg

SEQ ID NO: 12469 - DNA, 3000 bp, Unknown
  misc_feature (1)..( 3000): cDNA_ID_2712120_gDNA_ID_2214553_Annot_ID_134721 3000 nt of promoter + ATG
attatctctttctccatacctcttttttcttgcctgaaacaatctgatatattgagaggagattgttgcattcaggtctctcagcattgtcaaattcaagcctgttggaacaacaagaagcagaagctttcaacattagatatctcaatttgaaaactgaaatggtaacaagaaaaaggaaaaaaaaaaaactttgtgcattgcaagaaattttttagcgacataagtagcgctcacccagcaaatgagtctgtcttgcaccgttttatcttgtccacaatcaactattttcgaaaggagggatgagaaatggatttagtagcagaacaagaacacatacaaagaacatgagtgagttcattttacttacatcttttgagtcaaggagattaatccgggactgatcagaaggggcagacttggacatctacaagattacatgacagtaagaccttagcgataagtataaaattcctcttgatcatttgaaaacaacaataagtaagcccaaaaattggattagttcaatatgatattctgaccacagttagggaggcaaatttccagaagtgtgttaatccttacaatttagagagaaactataaagaaacagactagctagtagtaaaactctatttgatgttaaataacatgaaggattatctcaatatatttccaataggatttgtgaacgttattcgtcttctctacaattttatctattgaagaccaatagtgacgcaactgctgaatgcagaaagaaaaaataaatgaccagaaaccttaaagtagctgtgaatgaaaacatactaccttggaaagaccatcagtaagagacataacacgagctccagcttgtggtatgagtggttctggtatctacaaacaagataaatatgaagaacaattaaccatctgtgataaataaaagctacgaggatagacaaaggatttcgaaagtctcaccttaaagagcgaaccaccgcggctgaaaatgaaaattgacaatgttatacggatgagggaatacaaatgaaggggaagttaaaccaataagaaacatgaaaatcatagatcataaagacttgtatgactggtatactcaacatactaaatgcacatacaaaatttcataccctccaagcttcttccacttctttccaccatataaatgattcacacgctgtgcaatttcacgggcaagttctatgtgctgcttctggtcctcaccaacagggacaaaatcagactgcagaggcatatggcagagaaccaaacaattcagtaaaatggtcatcccgcaagcaatcagcaggtatttctatgcactttttaacagaacaacgaaacaatcccaaaaatgatcgccgaaaaaatcttacatgagcttagctatataagatcattgttttacttgtgttccttcttcattacaataattgcaacacacttaaactactttaaagcatcacctgatacaagaggatatcagcagtcatcagatcaggataagtaaacaaaccgacactagcattctcaaccccctgccaaaaaagacgaaaatggaatcagtaaacagaattctaaatgtatgcccaatacattagaagattacatatgatatctaaacaagtatacaaagaaatcaacaacaaaccttaaatactattaagcaggatttcgctttcatttatttaaagcacataataatgtgataagaccatgaagcaaccatatacgcacctccttgcgtgatttctctttgaactgaatcattttctgtaaccacccaataggtgtggatgaacataaaagccacattaactcgacatgagcgggaacgtgagattgcacaaatactgaagccttagagacgtctataccacatgctagataaagtgctgcggtatccgttgttgcctttcctagttgacgtgtatcatatggaagtgttatctacatagatcaagcaagatatagataaacaccgcgagagatatatcaccaaacaagcttccgaaaggtagataactcataccgcgtgatggtctacgatgataaagagtgtttcatatgtatcctgcaaacatataaacacaaaacgcctgaaaaaaagattaaatttttgtagcaaccagaaaatataaaaactgaatccttttcctaaagtctttaactttacaacaaacaatctacttctcacacactagtgaatgaggaagtgattagaaaccagaaaaaaaaaactgaatccagttcttaaagtctttaactttacaagaaacaatcttaaagtgataaactttgcaaatgtctcataccattggtgaatcagtaagtgattagcataatggcaaaggagagagagagaacctgaagagcgacccagtttttgatagccccgagatagttgcctaagtgaactgaacctgtaggctggacaccagagaccacacgtttcctaccatcaaaatgggatcagaatgaattcaacagagaatgcatagctaagaagtaatagaaactagaagcaggtagaggccattactttacagaaggagaagtgtcatctgtggcgacggagcaacagcatcggaacccttgtccggtgaccgaaatggaagaaaaagagccggagagagaggtgggtttggagagtaatctagtgagagacccgagacgagagaacctggaggaagagaggatgaggaagtgagagagactcgtggcgtgtcccattgtcgttttcttctctttcactctctctctcgaagaagaagattggggtttataagcaaaggaaggattggtttttgagtccgtgagggtcacgcggctcaacaacagatttcaagtcaaaatcacaatcgcaactttttccaagcaaaaagaagttttttactcgcttatcctagtttcttaccttaaaccaatataacattgagaaatcgattgattacctcattccctctattctcaatccacaccaaagactatatg

SEQ ID NO: 12470 - DNA, 3000 bp, Unknown
  misc_feature (1)..( 3000): cDNA_ID_2712116_gDNA_ID_2214553_Annot_ID_134722 3000 nt of promoter + ATG
ttcctgtaatgtatattcttttcatttttggtcgatataaacagcatcaacatcatcaagttctagtagtttctgcattagctctttgttcaattccatggcctcatcatccacctgcaacaaccaacaacaatcccaagtgattacattttccaagtgaatcgttgatgaatactgataagggtgtgactcttatttgggcggaacaagaagttaaaattaacgaacgaagaacacaaacaaattttctataagtttattgccatttccaattatgcttatgtagcatatgcaatttacaatgtatttaacacgttaagagaagataaactacatgttgacgataaaaatagaatcaataagttaatattagacagggcacagaggttacagaacagagcgggagatttgatacctcaactgtagtcagagggagcagttcagagccattgtcaggctcgaagttcactccttcatcacgtagctttgataatattgttgagtagttctcattagaagttacaattttgtagtacctgaacagatatagagacaagaagctgatgaaacaaaaaaagagcataatagttatgagtcacctaggtatcatctcgtcttagattggcaagatggatttcttatttcaaatcgtttggtgtgaaacttttattgcaatttagctgtttatgagaagaaaatacactaggtctaccttcagtcgcttgattactttttcaattcaatcttgaaagaaatttctaacgcatttgaataagtgagtcgactatctctatcttccctaacttaggattcaccagcaacagaaaataataaatgtaatactgacaagaagaaaagaaatgcggaaagacattatattggttatatacctctcttccctgtcttcatcagtatcatcttcataagttgggggttcaataacatcctctgctccagcatctaaagcaataataaggagctgatctttgtcagcttcggtgacctttatattcactaccctaactcttttaaacttgaacatgacagatcctgaatcagccatttttcccccataatccttaacaaccgatctaatagctgccactgatcgattaattttgtctgttaagacctcgactaccatactaacaccaccgtagccatatacctaaagcattgaaaacaagtttattttagagtcatcaaatcttataattggacccaaagaaatgataacgaggaactggatttatggtcctgtaaattgaacaaggtgctgaggtagtgaagttatattagctacagtaaccacatacttggcctgatagagtgatgaactaaaacagattcataggttttaaattaccaggccatttccccaccttactaggatgattcaccataacggccccacttacaaacataaaactagaattgaagctcatgacctcacctcgtaaatcttctctataaaagcttcttgccccttctcagaagccctcttaatattacgctccacaatgtctttcggtacatccagttctttagctttgtcaagaatagtagctagagtcgtatttgaaactgggtttggaccccctttcttgacactgcatgatgataaacccacagatgatactttttctagtaagcatatgtccataacaaagtaagaagttgaatccaacaaactaaacaccatctatatctacaactaatgtgcaaaatttcatctcaaaaaaaaaagatgcaacattgtgaaaaaaatgttgaagacttacgcagatacaacctccttgccaattctacagtatagcttcgccttctttgaatcttgagcgccctgtaattcaccagaaacttcaatctcaaaagttcttaaatacaatcttcgtcttggaaaaagagttttatctttctgctctgctgtaatatgtaattctcatttacaaaaacaaaccacaactttcaagaggaagattgttattcacattctgaaattcatactacacgagcaagagaaacttccactataggcttcacaattcaaacatggtgaattagctaatagctttcaagagtgacataacactgaaagctagactctttacaataacacaattaattgatataaacccataatcaaaacaactctctctatctgaggcatttcatcaaacaggtgtttggcataaacaattacgagctctagactcatcaaaacctataaattttatatttttaaaacctagtaatagcaccaacgcacttctaatctatatgaacccacaaactcagaagcttaacgaacctttcgaccagcgattttggaagaacgacgacccatacaaagaggagttgaaatcgaaatctttctgagttgaagcttgcggaagcagttctggtcatctgattgttgtgacgcagccgtgaaatgcgaagtagtagtgtggggagagattgaggaaagagacgagagagtgttggtcatggtaagactaagaagacgatggttagtggagttgagaatggatctggaagagacgccattggagaatctgaggaggattactctcatggagcaatgggaggccatatagtctttggtgtggattgagaatagagggaatgaggtaatcaatcgatttctcaatgttatattggtttaaggtaagaaactaggataagcgagtaaaaaacttctttttgcttggaaaaagttgcgattgtgattttgacttgaaatctgttgttgagccgcgtgaccctcacggactcaaaaaccaatccttcctttgcttataaaccccaatcttcttcttcgagagagagagtgaaagagaagaaaacgacaatgggacacgccacgagtctctctcacttcctcatcctctcttcctccaggttctctcgtctcgggtctctcactagattactctccaaacccacctctctctccggctctttttcttccatttcggtcaccggacaagggttccg

SEQ ID NO: 12471 - DNA, 3000 bp, Unknown
  misc_feature (1)..( 3000): cDNA_ID_2712112_gDNA_ID_2214553_Annot_ID_134723 3000 nt of promoter + ATG
tcagttattcaatcacgatacacagggataataagttgagcactatcataggtacttaggtagctttttgctgcttaacatggtagagaattacatgatgcaaagagactgggttccagaattctaatgcatggtttgtgaactaagccgaggatgtgagaattaattctgtgagtcgttgtagtctaaatcctaagtggacttacctctctgcagacatctcggtctaagtttcctcgatacacttctttcccttgtctaccatagacaagtaatccctgtaattaaacagatatttagtgagactacattgatattggtgcacctcactagttccctgatgttagagcaagtaaacctgaacgaaaacgcctggagaggactctgagataatgccatcggatccagttagatcagccgtcttcaagattctgatcgcacctgggcgggactgtgataaataaataaatttaggaacatatcctatctccaaaacatttcaaagacaagcaaatattaaaaaataaggaaagatattgttggacagatcaaagaatagtccaaacatgaagtcattgtaaaactgctgtcttctcaccttccccgtagctatgactactttaagtcccctcagaagggcttcttttaaagcttttgcatttgcctccgaaatctgacttttactgttaagcagtgtacctaatagagttcacatcaaaatcccatgagaaagcgaagaaaaccgaaacaaacaactacacattattaaataagtaaccttaccatccatatcacagaatatataggagaactttggtttgtacaatcttaggccatccccttccttcctgtctaataacagtagtctgtaagtttatcttagcaagaacaagaagataatagggggagtgtaaatgatcgttacacagttgcaatttagtatacacaggaaaaataccatctgatttctccggctgaactgtagttgttttttgaatgtcatatgcactctgaatgagtccttttcctttccacccaaggttttttagcaacaactcctcttcctcttccatttcttgctcagcctcgtcgctgatttcatgatcaaatcccagtagatgtagcaacccatgaatctttgaaaaaacatttaaggtatcagcaaatagagactactacacaaaccatatgaaaccacctgaataaaaaaacaaaaattggctcctacccttctaatatctttctaaacattatggaaacacagtactgatttcttacatggttattgaaacaacaagaatcctaaaaacccgcctagaaacttcacattatacttcaatgttttggttcacagtaagtcagtaacggatacaaactccacaactattaatcttaccacaagaatgcgtatttcatcaagaagagtatgccctctctctgcagcttgccttgcagctgtctcaacagaaatgacgagatctcccatcataagctacaagaagaacgaccataatgagtaaccattggaaccatcctgttaaaaaccagtaaatcaaaaacaaacacttactactggaagcttcagttcagggacatgttgtgacatggaaagcacatcagtagcatgatcttcacctctccactctttgttgagtttacaaataaaatcatcattacaaagcatcaccgataattcaacagtttcatacccaccaagatcttctatatcagtctctcttgttttatactttgaatctttcaaaccattgaaagccaatgtcattgccataggtacattgagacgaagcatttctgcaatattctacattgattggaatttgataagaatctaaaacaacacaactagaaatggctaattgattccaaattcgattatcaaagaatactcaaacctgaatctcgagatcatcaggaagctgttcttcgatgcagatactaacactaagctccaattcctgtttcttcttcggagctctccttctaatcttcctgtattctctcctctccgcaaaaacctgacccggcggtttcggaagctttctccagtctcctacggtgctgcgtaaagcgtggaagctccgacggaacatggaagaaaactccgatgaagtaacatcgagacgattcacaagagcagttttgggggaagagtggaagaagttgggttggaggagaaggagggtggcgcgtggcatttcacgcgcatgagcagaccagatacgattatagcggagggttgggcagacacgagagagcattggagagacacggaggcgagagaaggaggcgtctctgcacttctggcttaaagggtggggagatacaaatactaaatcgaaccgagattattaaaatctaaaccgaaaatgatttttatcataaaccggatggtcaacatttttaccaggaccatatgagaaaaatgaattgggggctgggggataagaaagaaggggaaatcatgaaattcattgctttttaaaccggatcaacgatcgaaccggaaaaatccttgggtcgcattcgcatgtcaacacagttgggaccgggtttgaagatttttacctccaaaatcagatgaccaataaaacatattctgttgaattcgatttaaccaataaaaactattgtcctttgcttctccttctctcccttctttgaacaagtcaaaattgattttaatccgtatgatattttccgctttctttgacttccctttgaaaattccagtcgagagctttccctatccatcgatttagggtttccgatttcgttttcgagcttttctcgctcttctctcactttttctttcctcctttggctcttttctccttcttcaatctctctcccatgactctaaagtctccaattcctgttagattccgaattatcatgatctgggtgcttaatcagatcgagatatctatattttgtgcttgaatcgcctaggattttctagtgtttacgcgtcttgtcatg

SEQ ID NO: 12472 - DNA, 3000 bp, Unknown
  misc_feature (1)..( 3000): cDNA_ID_2712108_gDNA_ID_2214553_Annot_ID_134724 3000 nt of promoter + ATG
catgggtatgcaggagttattattggcataagatgatagcggtcacgatgattttttcgtgggtcccaaacaggaaagctaaggtcatcttcttctattgcacaaagcatgactggattcggccagcgccattgtgtatatactctaaaaaatcgagaaaccaacatactaggaatagcatttggataaaactggcaaaggcgtgcaaccagaagtgcccagtttacaccaccaagaaatccagtaacctgctcaatataacagagattacaagagctttaacctaagaatattgtcaacagatgtaatattcagaaagacaccaccttacatttgaatagaccccacgcttcttagcccagtacttcaggcatcttaatgttgtccggaagtgctacatttgcacatcacatcagagatggcttacatgattccttagtttataacataaacaactggcactcaacgactttacctcggaatttggaacaagtttaagaatctgatcagcaaccctacaaccattaagactgcggacagtttgttcatccacgtcacacagcacagaagagttggagatatccagatcctgttaataaattgattccagaaaaaaaggggatctgcctcagcaagaacttataaactttgtcgagaactcatctcagtactcatatataaatcaagcctgatggtgctaacacggcagttcaacatctccatgttcactaaggctaacaatttcttataagaagtttctttgacacctcaacccttggaggaagtgtataataatactatgtgaccatcaacacgcaatcaatacacgcaccaaacccaccaaatgaaatccaagataaacatacaggtatcatgaaccaccccctaactttcaacagaaactgaaaaaggctatattgatgttacctgtgggataactagaagcgatatgctagcatacagaagatcaattgatattccttggaacttaaatttcatgactgggacatgggcatcagtaacaggttgaagttcagtcacttcttccatttcagccaatatatcacggaagaaaatgaagaaatcctcctgtaaaaataacctgttagcaactaaactaacccaccagacctttacatcagtaagacgaaactcaatagttacctctcggttaacataagatgggccaacacacaaagtatcaatatcagccataggtccgtgaacctgcaaaccaacaaaataaaaatttcaccctcaactagtaatgtagagacgaatacaatgctacttctcttcatttcagtgataattcaagatactcacaaggctcaatagaaaatatatgatccaagtaaaacctttccccaaactgattagatgcagttgatcttttaactttaaacttaaaaagaacttactccaaggcggtaagatccaaaagtgaaaatgacagcatttgcatcctccaccatctgatcagtatagcccctctgacgagttaactgtttcacccagtgttttacaatctatacaagaagtttaaggaagaagatgtgttagattagatagttagtactgtaaacaaaacttgaccattatgcatttcagtaaacaccactgtgagcctctttgacatcgaagagaaagcagctaacccaaaatctacatttcagtaaagcagagtaaactatcaaacaaatgattagcgcctataagtcacttgtgttcacatggcaaatgagccaataggattaatagaaggactagactacatattgctacaatcatcttataattacggcatagaaatcgttggtctacaacactataaaaagaaaatgtgagaaccagtctaagcattatcatcatgagaaagcaataaaccagacgctcttaatcacctgatcaatgcgaaccacaacttcctctctccgcatagtttcttccttgctctcgtagagcccctcatcaaccagaaacttcacaataaatcagccaaaacgcaagtcaatatcacattgttcctgaaagcaatttttcattggaacaaaaaaacaaacaaacacaacgctaaccttctctagttccaaattacgcttaacatcagcagcagaaggtccagcaatagacagtggctccgtgatcccatagctcttaagagaagcttttaccggttgagaagagtcatcgtccgtgcgttgttgagtactcaccatgacaagacgcgtaaacactagaaaatcctaggcgattcaagcacaaaatatagatatctcgatctgattaagcacccagatcatgataattcggaatctaacaggaattggagactttagagtcatgggagagagattgaagaaggagaaaagagccaaaggaggaaagaaaaagtgagagaagagcgagaaaagctcgaaaacgaaatcggaaaccctaaatcgatggatagggaaagctctcgactggaattttcaaagggaagtcaaagaaagcggaaaatatcatacggattaaaatcaattttgacttgttcaaagaagggagagaaggagaagcaaaggacaatagtttttattggttaaatcgaattcaacagaatatgttttattggtcatctgattttggaggtaaaaatcttcaaacccggtcccaactgtgttgacatgcgaatgcgacccaaggatttttccggttcgatcgttgatccggtttaaaaagcaatgaatttcatgatttccccttctttcttatcccccagcccccaattcatttttctcatatggtcctggtaaaaatgttgaccatccggtttatgataaaaatcattttcggtttagattttaataatctcggttcgatttagtatttgtatctccccaccctttaagccagaagtgcagagacgcctccttctctcgcctccgtgtctctccaatgctctctcgtgtctgcccaaccctccgctataatcgtatctggtctgctcatgcgcgtgaa

SEQ ID NO: 12473 - DNA, 3000 bp, Unknown
  misc_feature (1)..( 3000): cDNA_ID_2712102_gDNA_ID_2214553_Annot_ID_134726 3000 nt of promoter + ATG
ctttctcattagaaagaaaacgtatcctaatttgttgttttctctatgaatgttaatatcatctaataagtccatatagactatatctaataaatccatatagactattgtctctgaatatcaatggatttgaatctttggccaaaaaattaaacaaagagacaaatgatgtagaagtcacattacatagtgggagttaaaattaaccagagtttgcattaggttgcaataacgcttgcatttacgtcttgcggtgcttacgttctgaatctctttgtcgatgagcttgaagatagttgatattgggatcgagacttggttgtgaaccacatcattcctttgcttccacatatatcctaacatttatctaaacaatctggtgctagaagaaagagattatcaaactgatgcaatgacaaactacgaaacaccactccataacaaaaaaacttaaccgtatatcgatcctcaactttaggaataatcctaacgccgcacccacccggcacctggcacccaccacttgaaaaattcatagctcatggccagtagggaaccgcggaggaaacttactcagtccattgcgaggataaggacaaaagtactccttcaattattctagaaaaccaatcagacgttgacaaagaacctcgtttgaaagtacaactgctctacaagactgcattgcccactacaagcagtgaatgttgtccaccctcagcttctttatacgttcgtgaagcatgcatgtgcattttgttggtgcgcgcatagtaagccatgccatgcaattcaatgccaatggtttacgaacatatagacaagtaaagttttcaattatttcatgagtacctaaaaaccacattcatagaacagtttgcaagtattcgaaatttgggaaaacatgcatacgacctcaccgcatctctcaaaggccgaatacaatttttgaggaatgattaaacaaagaaatatttttacaatcacactaactacaatacgttcatgaagacaacgtaaatgacacgagccatttagcgcagccttcgaaatttatttagcgagtatagataaagtggttcaagccttggtattgatacacaaaattcacaaaccttgcaattttctttttgaacataaaaacaacaatattatttcaaatcaaacggaccacactcaaaactacatttacatataccaagaaagccaccatataattctagaagccagacggtgaccaagtaattggcatttattaatttacttaattcgttatcatctttccttacactagctatttcacaatcataaaacagaaaataccgatcagcaattaaacacacaaaaaattgtatggaaaatagaaaataaaattttagatagatcttttcaaaaaggtaagaacagtattaaaaaaacatacgtaggataatcataaaacttaatacaacatatagatccatataattattaaactctaatgagtagttgttgtggtttggtgtgtttgttgtggctgcgagtgcgtataatgtcccaactctttggctttctccgctatcctcatcctcgcgtaatccaccttatccgctcccatcgggtgttttccggtaacgtacttataaatccacgttaacgccgtagctgctgccaccccacaaccaccggagaataggaatcccatcgtcaaaagccctatcgttatcactgccggtaccaacaccgggctgaacagaaccatcaacggcgtcgctacgatcaaaccgatcaccgttccggttagtgttagtcctgagagcacgaggagtgataggccgatcgtagctgccgttacgaatctcactatctgccgagtcgatggtgatgattcatggagactcctcattattggttgttgttgttgctgatgttgttgatgatccgccatttctttttttctttttctaagagagtatggatttaatgttctatgttgtttttgtagctttaataagcttaccatttgtgattattatgaagaatgaaaatagactagtatgaaggagaggctaaacttaaacgagacatgtgtcgaacgacgaggcgtgttaggcaatggagaagagtgtcacgcgggcgtgtcagttctgcatggagctactttgacgaggtactgacacgtggttacttagttccgaattaaaatctcatcgtcaaacgatcttgaagcttattgggctattatctgggcttgtagtgactgtatattatcctagtgattatgaagttggaataccgtgggcttaataatatctgggcctgtagcgactgtatcatctcgggagacaaattatttgaaaataaaaacctcgatgcagatgtatcaacacgtggcagcatctggattcgaccgttgctgctttgctggtggtttacgttttttcccctttttaaatttctcaatttggatctgttccctttgtgaaaattactctctcttctctctttctttcttctctttctctcgctatcttggctcatcaacgatctcttccatggggatttctacagagacgcagcaaattgtaagaaaataacttgttcttggtttcacaaattccaatttcatttggttcttttgtcgaatttgtttcaatttagggttttacttccttgttggtttgcgttttttctctgcgtttggtctgttctaatggaatgtgatctgggattatcgatttggttgcttgattttctttgcgccagaaagaatcttgtttcaatgttctctgtttaatttgagaaagacttgttggtatgattttgagaaatttcatgatatgattgtggatttattcgtttacagcgaggaccctagattaattgacaaatccgtggattagtgttaaggagctgttgattttatccttttatcttcaagttttaaagtatcaatgattgtttgtcgtttatgattaagtgtatctgagagttgattggatttcaatctttgtgataatg

SEQ ID NO: 12474 - DNA, 3000 bp, Unknown
  misc_feature (1)..( 3000): cDNA_ID_3025327_gDNA_ID_2214553_Annot_ID_185633 3000 nt of promoter + ATG
taatatgttgaatttaataatccaatttgacctctttcagatagggctttggggacaaatcttcttaaatcgcaccaaacttttattataagataatttttggttcgtggctattaaattaagcctgaaaatttaaacatatgtttcacttacaagcgtcaagtatggataaacaatgattaatcataagctatcataatgacaaaaagaagtatgatcgttatcagttctcttatgcataaactattgataaaattataatagtcacgagatgattgatcgagcacgataactattataatagtcacgagagaatgatgtgaaagtttaagaatgcgtctaaaccaacaataaaataatttaaatagttataattgaatacacattctatattagtaaacattcaaattatttaaaatatctacgagacacaatagcctcccaacaaccattcgtacattcactttctcattagaaagaaaacgtatcctaatttgttgttttctctatgaatgttaatatcatctaataagtccatatagactatatctaataaatccatatagactattgtctctgaatatcaatggatttgaatctttggccaaaaaattaaacaaagagacaaatgatgtagaagtcacattacatagtgggagttaaaattaaccagagtttgcattaggttgcaataacgcttgcatttacgtcttgcggtgcttacgttctgaatctctttgtcgatgagcttgaagatagttgatattgggatcgagacttggttgtgaaccacatcattcctttgcttccacatatatcctaacatttatctaaacaatctggtgctagaagaaagagattatcaaactgatgcaatgacaaactacgaaacaccactccataacaaaaaaacttaaccgtatatcgatcctcaactttaggaataatcctaacgccgcacccacccggcacctggcacccaccacttgaaaaattcatagctcatggccagtagggaaccgcggaggaaacttactcagtccattgcgaggataaggacaaaagtactccttcaattattctagaaaaccaatcagacgttgacaaagaacctcgtttgaaagtacaactgctctacaagactgcattgcccactacaagcagtgaatgttgtccaccctcagcttctttatacgttcgtgaagcatgcatgtgcattttgttggtgcgcgcatagtaagccatgccatgcaattcaatgccaatggtttacgaacatatagacaagtaaagttttcaattatttcatgagtacctaaaaaccacattcatagaacagtttgcaagtattcgaaatttgggaaaacatgcatacgacctcaccgcatctctcaaaggccgaatacaatttttgaggaatgattaaacaaagaaatatttttacaatcacactaactacaatacgttcatgaagacaacgtaaatgacacgagccatttagcgcagccttcgaaatttatttagcgagtatagataaagtggttcaagccttggtattgatacacaaaattcacaaaccttgcaattttctttttgaacataaaaacaacaatattatttcaaatcaaacggaccacactcaaaactacatttacatataccaagaaagccaccatataattctagaagccagacggtgaccaagtaattggcatttattaatttacttaattcgttatcatctttccttacactagctatttcacaatcataaaacagaaaataccgatcagcaattaaacacacaaaaaattgtatggaaaatagaaaataaaattttagatagatcttttcaaaaaggtaagaacagtattaaaaaaacatacgtaggataatcataaaacttaatacaacatatagatccatataattattaaactctaatgagtagttgttgtggtttggtgtgtttgttgtggctgcgagtgcgtataatgtcccaactctttggctttctccgctatcctcatcctcgcgtaatccaccttatccgctcccatcgggtgttttccggtaacgtacttataaatccacgttaacgccgtagctgctgccaccccacaaccaccggagaataggaatcccatcgtcaaaagccctatcgttatcactgccggtaccaacaccgggctgaacagaaccatcaacggcgtcgctacgatcaaaccgatcaccgttccggttagtgttagtcctgagagcacgaggagtgataggccgatcgtagctgccgttacgaatctcactatctgccgagtcgatggtgatgattcatggagactcctcattattggttgttgttgttgctgatgttgttgatgatccgccatttctttttttctttttctaagagagtatggatttaatgttctatgttgtttttgtagctttaataagcttaccatttgtgattattatgaagaatgaaaatagactagtatgaaggagaggctaaacttaaacgagacatgtgtcgaacgacgaggcgtgttaggcaatggagaagagtgtcacgcgggcgtgtcagttctgcatggagctactttgacgaggtactgacacgtggttacttagttccgaattaaaatctcatcgtcaaacgatcttgaagcttattgggctattatctgggcttgtagtgactgtatattatcctagtgattatgaagttggaataccgtgggcttaataatatctgggcctgtagcgactgtatcatctcgggagacaaattatttgaaaataaaaacctcgatgcagatgtatcaacacgtggcagcatctggattcgaccgttgctgctttgctggtggtttacgttttttcccctttttaaatttctcaatttggatctgttccctttgtgaaaattactctctcttctctctttctttcttctctttctctcgctatcttggctcatcaacgatctcttccatg

SEQ ID NO: 12475 - DNA, 3000 bp, Unknown; identical to SEQ ID NO: 12472
  misc_feature (1)..( 3000): cDNA_ID_2990871_gDNA_ID_2214553_Annot_ID_185632 3000 nt of promoter + ATG

SEQ ID NO: 12476 - DNA, 3000 bp, Unknown; identical to SEQ ID NO: 12471
  misc_feature (1)..( 3000): cDNA_ID_3025329_gDNA_ID_2214553_Annot_ID_185631 3000 nt of promoter + ATG

SEQ ID NO: 12477 - DNA, 3000 bp, Unknown
  misc_feature (1)..( 3000): cDNA_ID_2990145_gDNA_ID_2214553_Annot_ID_185630 3000 nt of promoter + ATG
tggaaactagaagaagtgaaatgtaagtgtctaccaaaaaccattattccttcttcagaatatatgcagagttcagcagaaccagttcagagattgacataataactttctcgtgagctgtgaattcacagatcttgaagtggagcttcctgtaatgtatattcttttcatttttggtcgatataaacagcatcaacatcatcaagttctagtagtttctgcattagctctttgttcaattccatggcctcatcatccacctgcaacaaccaacaacaatcccaagtgattacattttccaagtgaatcgttgatgaatactgataagggtgtgactcttatttgggcggaacaagaagttaaaattaacgaacgaagaacacaaacaaattttctataagtttattgccatttccaattatgcttatgtagcatatgcaatttacaatgtatttaacacgttaagagaagataaactacatgttgacgataaaaatagaatcaataagttaatattagacagggcacagaggttacagaacagagcgggagatttgatacctcaactgtagtcagagggagcagttcagagccattgtcaggctcgaagttcactccttcatcacgtagctttgataatattgttgagtagttctcattagaagttacaattttgtagtacctgaacagatatagagacaagaagctgatgaaacaaaaaaagagcataatagttatgagtcacctaggtatcatctcgtcttagattggcaagatggatttcttatttcaaatcgtttggtgtgaaacttttattgcaatttagctgtttatgagaagaaaatacactaggtctaccttcagtcgcttgattactttttcaattcaatcttgaaagaaatttctaacgcatttgaataagtgagtcgactatctctatcttccctaacttaggattcaccagcaacagaaaataataaatgtaatactgacaagaagaaaagaaatgcggaaagacattatattggttatatacctctcttccctgtcttcatcagtatcatcttcataagttgggggttcaataacatcctctgctccagcatctaaagcaataataaggagctgatctttgtcagcttcggtgacctttatattcactaccctaactcttttaaacttgaacatgacagatcctgaatcagccatttttcccccataatccttaacaaccgatctaatagctgccactgatcgattaattttgtctgttaagacctcgactaccatactaacaccaccgtagccatatacctaaagcattgaaaacaagtttattttagagtcatcaaatcttataattggacccaaagaaatgataacgaggaactggatttatggtcctgtaaattgaacaaggtgctgaggtagtgaagttatattagctacagtaaccacatacttggcctgatagagtgatgaactaaaacagattcataggttttaaattaccaggccatttccccaccttactaggatgattcaccataacggccccacttacaaacataaaactagaattgaagctcatgacctcacctcgtaaatcttctctataaaagcttcttgccccttctcagaagccctcttaatattacgctccacaatgtctttcggtacatccagttctttagctttgtcaagaatagtagctagagtcgtatttgaaactgggtttggaccccctttcttgacactgcatgatgataaacccacagatgatactttttctagtaagcatatgtccataacaaagtaagaagttgaatccaacaaactaaacaccatctatatctacaactaatgtgcaaaatttcatctcaaaaaaaaaagatgcaacattgtgaaaaaaatgttgaagacttacgcagatacaacctccttgccaattctacagtatagcttcgccttctttgaatcttgagcgccctgtaattcaccagaaacttcaatctcaaaagttcttaaatacaatcttcgtcttggaaaaagagttttatctttctgctctgctgtaatatgtaattctcatttacaaaaacaaaccacaactttcaagaggaagattgttattcacattctgaaattcatactacacgagcaagagaaacttccactataggcttcacaattcaaacatggtgaattagctaatagctttcaagagtgacataacactgaaagctagactctttacaataacacaattaattgatataaacccataatcaaaacaactctctctatctgaggcatttcatcaaacaggtgtttggcataaacaattacgagctctagactcatcaaaacctataaattttatatttttaaaacctagtaatagcaccaacgcacttctaatctatatgaacccacaaactcagaagcttaacgaacctttcgaccagcgattttggaagaacgacgacccatacaaagaggagttgaaatcgaaatctttctgagttgaagcttgcggaagcagttctggtcatctgattgttgtgacgcagccgtgaaatgcgaagtagtagtgtggggagagattgaggaaagagacgagagagtgttggtcatggtaagactaagaagacgatggttagtggagttgagaatggatctggaagagacgccattggagaatctgaggaggattactctcatggagcaatgggaggccatatagtctttggtgtggattgagaatagagggaatgaggtaatcaatcgatttctcaatgttatattggtttaaggtaagaaactaggataagcgagtaaaaaacttctttttgcttggaaaaagttgcgattgtgattttgacttgaaatctgttgttgagccgcgtgaccctcacggactcaaaaaccaatccttcctttgcttataaaccccaatcttcttcttcgagagagagagtgaaagagaagaaaacgaca

SEQ ID NO: 12478 - DNA, 3000 bp, Unknown; identical to SEQ ID NO: 12469
  misc_feature (1)..( 3000): cDNA_ID_3025333_gDNA_ID_2214553_Annot_ID_185629 3000 nt of promoter + ATG

SEQ ID NO: 12479 - DNA, 3000 bp, Unknown; identical to SEQ ID NO: 12468
  misc_feature (1)..( 3000): cDNA_ID_3025339_gDNA_ID_2214553_Annot_ID_185625 3000 nt of promoter + ATG

SEQ ID NO: 12480 - DNA, 3000 bp, Unknown; identical to SEQ ID NO: 12467
  misc_feature (1)..( 3000): cDNA_ID_2712136_gDNA_ID_2214553_Annot_ID_185624 3000 nt of promoter + ATG

SEQ ID NO: 12481 - DNA, 3000 bp, Unknown
  misc_feature (1)..( 3000): cDNA_ID_3025345_gDNA_ID_2214553_Annot_ID_185620 3000 nt of promoter + ATG
tggcagttttttctctctctacatactaaagaataactgaaaatttagtagtaaataaaataaaataggcattagttgaactcttttgtaaattatttcttaaacaagtatttattttgaaaacctcttaaattacagttattataaatctattcaagataacgatacaaatattcatggattttatagtttttttggtttttaataatgtaacgatttcaaaaatatcatggttaggagtaatttttagctattagaaatcacctaatcatattttaaattactctaatataccaaaagaaatgtcttcgaagtaaagtaacgatttaaaaaatatcatggttagaaataatttttagctaatagaaatcagctaatcgcaatgcacaataaacaaatttcgtataaatatttttttttgtttagggctgtatacatcaagcaaaacaaagtgtaaatcaatagttgtggtagctagtgttcatttatttgctgaaaccaaggcaaaaccgaccagacctcaataacactcccgagaaggacctggtgagggaaccaaaggaaacaacccaaattttcaaagagagcaaaatccgaactcatcttcttatagaagagggaaacatgtggaaggcattcagagagcctaacttgtagggatctctttatcttactatgttttaagagagtcctcatatgtcaaccagcaaaaggaatattcgtatgcgaggagaagaatgtagatcttacatgtagatgtgtgaattctgatggatcccaattacaggacaatcaatgttgatcaagacaaaaacactttggttctcaaagactttagaacaagttactacaatttttctcttcatattagattcgccacaacagaggatctttaaatacacaagaatataaactaactactaattaaagaacatgaaacatgggaaagaaaacacatttcggcaaactaattaaaataactaaaactcttggccacgtcatcttcttcctcaagttgcatctcatcattctcaagaaggtagaagcaaaatcacttttaatttactagaaagccttagggcaaggttacacacaaggtcacaaacaaagaagcaaaaataagaaagaacgaagacaagcaagttgatcgacgcaagacctaagaagtatttaagactaatcctagattcactacccagatattcacaaagtgagtgaacgtggaaagagaaagtacacgaagccaacgcctgccacaaagtggtgcattgagatagtcttactttgcgagaggagcatggagcccaatcacatgtttcctataagatatttgaatttttttcaacattttaatcatccatgcatacaaatgcgcttaaagagtttactgatggctattgtaaagatttttttagttgctacgttgtaccttgatacaaaagtattacccgtcgtttttggaaacgttccaggataatccatttttatacaatatcttaattggttttatacttaaaccatggaaaaatctcttagtatatcctatgattatgtaacgatgtcaataaaagatgatcatactccctaaagatactcccactgggtcgtgcaaagaaatatagtaactatgcatggccgcatgggtatgtgcatacccacgaatggtgacaaaagtaatggtatgctgaagtcttttatactttattccttttctgtccaaataccttttttatccttacgaagagctgagtgatcttaacagatacttgtgctagtgatatttagacgttggtgtaaacacaagagcagttttatcaacaatgcatttttaccttgagcataatccaatatctttgagcaacatccttaaattaattagcatcatccaatatcaccttgagatttcaatagagcatgttcctaagttacttacatgctctcctatatatcttttatacatacatcttttggataagaaaaaaatagacatacgacattaaatgtagaataacaagcgcaataaaaactcacttatcctttgattataaagttggctgaggacataagcaaaatgtgagacttgactacccttgtgttctcgtatttcgaataatttatctgtttacactcgctacaaaagttatcttttcaaaatagctgtgatttttttgaaattgatacactgacttgaaacattaccaaatgacaaatatctatcacttcaaagaaatccttgcatttattataagatactctccataaaaagagattgtcatctgcaaaattggtaggttagtccgaaatattttgaaaacatgttaaattattattttctcctatataaagatagttcaacccattctttagatgtttcatgttcacatctttccacgtattgcagattttttaagtttgatttgttcttctcaaaacatagttatgaatatatagtttatgatgcactattgtgacctcatcacatgatgcaaattgaacatctcttccaaacacaaatcgatgattaacattccaatggatgtgttcagcaaaagctttcctaatggtcaacccataaacaagatcatggtgaggaaatctagacgaacactcgaaccccaacattttgtcgtgatcattcatagccgagaagagatcatattccgagtcaaactttgaaaatttgacatttctcttttacaaaaaaaaaaaaaaaaaaagaagacaaaataactaaatggatcatttgcaaaaataaccatatttgataaactatttaagtatatagcactatatatgtataaattaaaaaactaacatagagggcaagtataatgaccaaatgtggtggtggtgatcaaaagtgatggtggtagtgactagtgaccaaagatggtgatgatggtggttattgtcacggtgctggtgggagtggcaaaaggttgtggtgctgatgggagagattaaaggtggtggtgatggtgatgatgattaaaggtgatg

SEQ ID NO: 12482 - DNA, 3000 bp, Unknown
  misc_feature (1)..( 3000): cDNA_ID_3025324_gDNA_ID_2214553_Annot_ID_185634 3000 nt of promoter + ATG
gaaggaaaatgattgattgcagagtgcgtctcttgttgttttgttcatgttcggttaatctttcattcgtttgcctttgcacctttgcatcttacaacataaaaaatgttccggatctcttgtgaacaaatccatctcatttggttacctgcagtaacatcagttaacgttaaccaatcaattggtgaataagttaccgatgaacaaaagctgttgtaagtttgaaaccattccgaacaatttttatttaaaaagtgatgtaggattcgaaaataattggagtaaagttacacgaatcttgtggctatataaacttcgtagaaaaatgtagtacaaatacttttggaacacagcaattacatatatagaactatgaaatggtcagactttttgcagtaagtggtgcaaagtgccaagaatgcaatcttaaatcttttcctagcttcatcgcttcatcctctgtaaaggcctgatgggtctgcgttttgcacaatccacgggtgttcaagaagcttgtgcaaggccaaacgttgcgtagactccttaaccaacatctgtttgatcagaaagtgtgaaaatcagaattcactcttcaaatgcacaaacacttagagagatttacgaggaatgcgagtagaaacctggctaatcaggtcctttgcagatgatgacacaatgggtttgggagggaacttgagatccacttgaacaatcctgtatcatttgtcgaacaaaacccttctttaatgtacattccactgaccaaacatcatatactaatcccattctacgcttaatgaacatgttaccttttgtatgtctctgaatgctccctggcctcaaaaggaggaacaccataaagaaattcgtagcagagaattcctagactccatatatcgacactcgcatcatgttcaacgctttccactgtgaatccaaaagcagaaaagtcaattagctggttgccgaagaaagtaatttagaatcacacaagagagagagagctttctcttacccatctcaggtggaaggtaatccaaagtgccacacatagtccttctacggttgaatgtgtgtactgaccatccaaaatctgcaatcttgagctcaccctgaaaacatatatccatgaatacataaacacataagctaactgcaatcacatggcgttgatggagaaagataaccagattcaatttgttacctgagcaccaatcaacagattttcaggttttatatctctgtgaattacatgctttccatggcaatagatgagggctctagccaatgacgcaacatactgccacaataaacgtaagggtatgactacacagattcacattaacatgctagaataagttcaattatcactaggacttacagttgctgctcgacgttcgctgaagtacttgcacttctgaagctctttataaagctcaccccttacagcatactccaaaatcaaataaactcttttctgcaacaacggtatcccaaaaactatgttaacctcacagagccaaacattgtatgtcaacaagaagttcttttacaagcacagataacacaaaacctgatcatagaagtaaccgtagagccgcagaatattgggatgccgaagatgagattgaatctctacttcccttcgtaactggtgttcaacttgagattgttgaagctgagccttaaaaagaacctttaaagccacaatgtgatcgctctgtttgcaaagacacatagaagacagcttggttaaaaaagacatcaaattaattctgcttgtttaacataattgtgaagaaacactaacccgtttctctcttgctagataaacatggccaaactttcctctaccaagtggctttccgatatcgaaatcgcttgtagtccatctcttttgtgcagcctctgaagccgcctgatacaacattatcacaaagattgaaatccaatcaactctcagatacacttaatcataaacgacaaacaatcattgatactttaaaacttgaagataaaaggataaaatcaacagctccttaacactaatccacggatttgtcaattaatctagggtcctcgctgtaaacgaataaatccacaatcatatcatgaaatttctcaaaatcataccaacaagtctttctcaaattaaacagagaacattgaaacaagattctttctggcgcaaagaaaatcaagcaaccaaatcgataatcccagatcacattccattagaacagaccaaacgcagagaaaaaacgcaaaccaacaaggaagtaaaaccctaaattgaaacaaattcgacaaaagaaccaaatgaaattggaatttgtgaaaccaagaacaagttattttcttacaatttgctgcgtctctgtagaaatccccatggaagagatcgttgatgagccaagatagcgagagaaagagaagaaagaaagagagaagagagagtaattttcacaaagggaacagatccaaattgagaaatttaaaaaggggaaaaaacgtaaaccaccagcaaagcagcaacggtcgaatccagatgctgccacgtgttgatacatctgcatcgaggtttttattttcaaataatttgtctcccgagatgatacagtcgctacaggcccagatattattaagcccacggtattccaacttcataatcactaggataatatacagtcactacaagcccagataatagcccaataagcttcaagatcgtttgacgatgagattttaattcggaactaagtaaccacgtgtcagtacctcgtcaaagtagctccatgcagaactgacacgcccgcgtgacactcttctccattgcctaacacgcctcgtcgttcgacacatgtctcgtttaagtttagcctctccttcatactagtctattttcattcttcataataatcacaaatggtaagcttattaaagctacaaaaacaacatagaacattaaatccatactctcttagaaaaagaaaaaaagaa

SEQ ID NO: 12483 - DNA, 3000 bp, Unknown
  misc_feature (1)..( 3000): cDNA_ID_2708989_gDNA_ID_2214553_Annot_ID_134729 3000 nt of promoter + ATG
agatcaaataggaaatttgtgacgtatgtttgagaacaaaaatgaatatgaaaaaatagaaagtctgcattttattacatgatattaaatttgtgttttttttttaattttagtacaatttaagtttgtaaaaaaaaaataaaggtcaaatggacccatagagtgagggggagcaaaacatagcttataactactttaacaatcaacgaaattttttttttctccgagaaactaaattaaaattataaaaaatgataattatttaaaataatgataaatgatgcatcgttatgaaagaaatttaccaattaaatgtttttttgtatataccttataaatataactaaattttttatgtacataatgtcatgagtattatttaattactaaaagaaaattgtaaagtagtttaataacaatgtcatgtgaattatttatttaaggaaaattagaaaataagtataagaaaacatgctaaagagagatgtaaaaatatgcaaatgaacactatttgaaattcctaaagcaaaacaatgtatttaaattaaaataatagtataaaataatatttgtgtggttgatataaaaaatttataataataatattataaaagaacgtggaaaatatgtataatttataggcaatgtgcttatgtcaaatatatattggaacctttgaaattttaaaattattataaatttttgagatatatatattgattaagaatgactaaaatcctaatacaacccaatccaaatatgaggataactttataaaaaacggtctatttccacacgagaactatcacatcatactagatagagcccattctttaactctggtctatatatccatgaaatcaaagttgtcttcttatttccctctgaattgaaagttctatagcttaatgtccctaaatctgggttatatcggtttgtgctttaaacccaaagtaaaccgaatatataaaccattaagtttgattctaaaccggtatcatcttcttcttcacccgattcttcaaacaatcaacaacaattgtgataaatttgatatcaaaattacaaaagctcattggagcttcttcactcgtcttcttcttcaacaacctccgtatctccgatggcgtcttcgccccacacaaacgacggcggtctcaacaaacgtaagaatatcttaaacaagatcagatcgttgatgaaacttatgtcatgggaaagaaaaatgagcttagcaatgattctagaagaatcgaatttttgattgcaggtcgagatggtggtaatgggatatgctctggttttttttattcgattgaatttgttcttgattgttttaaaagtatggctaatgattttgattttgtaaagacaaacaaaaacacatccctttaagaattgtttcgattgaattcggattattgattttgtttctatagctattgagaatctaaaagctctcagtgtttctgagatttgattaagaaatctgaatcataatcgagttatggttatgattatgaagtacaatttttcaattgtttataatcattttctacgtgatatgacgatggaacacatccgcaatgatatttgctgctcgcaagatctaaagctttgtttcttaattacaatctacaagaatgtttaaggggatgtatttttttgtttgtatttatagattttaagaaactcgtgcgttttattcttggtcaaattaataagtcaatgggtaaaattgggttcattccggttacaattaggtttagttggtttgtttatcggttttgtatatagtaaaccgattaaatctagcttcgtggggttttagctctcgaacatttagtacgggggcattaagctataaaactttctattcgaggggaaacaggaataaaactttgattttatagagatatagaccggaatcaaagaatgggctctatctggtatgatgtaatacttctcatggagaaatagaccgttttccggataaacacactaaaacaatagttacattggagacgaccaaatttaagaaggaaatgagctactttcattttttttactaactaaaaaaagttttacaaaaaagtttcttaaaaagcccaatcccaagcccaaataccatctcttttttttttttactaaacccgattccgtgggaacgaacccatccgttggtgaatctggacagtcccctcaaataaaagttgtgagagctgtttcgtcgctttgatcgaaatggcgtcgtcttctccaactcagctagctcacgtcccgattcctccagaaccaggtcccttcttctctttctgtttgcttctctatccctcaatttgctttgtgatcgtttcaccaagcttcgctactagttattatcttccttcattccattgcgatcgcttagcttcgctgtttttgatgttaccatattcgatctactaaaatccctcagattatccaatataattgtgtagtttccgcttttaatcaatttgattgaggataaaccgattagatgttcacgtcacttcgtttctgatcgaaaatgtgggtttagccatctattttcgctcgattcttgtggcgtatacatgcttaagttcttcgtgtatgagtttggatttgatcagttacaaaatctctgtttgcagctattagtgtatactaaaaagcgatttttcgtttgatttctggaatagcaaagattaagcgaaatgttgattgttagtttcattttcagcaatatgtttgtatttggtgtatgcaagtagtgggatattgtcatgaatctcttgtctcatgtttgagtttttcgcttcaggaggaaggtcgccgacacaagaagctaatgagccaccagttccgatttacattgtgacggatccgtttcaacttcctgctgatttcctaaacccttctcctgaaaagaaattggttatcggttttgactgtgagggtgttgacctctgccgacatgggaaactttgtatcatg

SEQ ID NO: 12484 - DNA, 3000 bp, Unknown
  misc_feature (1)..( 3000): cDNA_ID_2712165_gDNA_ID_2214554_Annot_ID_134738 3000 nt of promoter + ATG
aaagaaagtaaagaatggtcaaatctttttaacaatatactattagaagacactgaatgcgatcataccagcactaatgcaccggatctcatcagaactccgcagttaagcgtatcaagtgtcgttaaagactctaggcgaagcttagaggtcgccggttcgagtgacgcttgagacgaaactaatattacatgctgtagtttcgggcctggagggattacgggattcggcccaaaacctcctagtattcagaaaaaaaaaactattagaagacactatctcaacattaagactccatgtgatcgtagtcgtaggtgaggaagtgttgatgtttacaatatactagatccgtacgtgcgggattttatatttttaattcaatgtagattattttcttattttgtgatatatattatagtacaatgtattagatatctgaactcgcatatacgtacaaaatataattttttaatagattattaaaatatataatattttgttataagtaaactttgtaatagtatagatattataaagttaagagtaataatcaaaattcaattgtgttcctgtatagttatattttaagatccggactcacacagagaaataacccaaactaaaatcaaatttatatcctattttacactagtaattaaactgttataatgttttgattagtttagaaaataaaaacgtatacttgacttatatttcttggaatggaaaacctgtgatgtatctatcataaattcttcgtcacataacccgtctgtatatgtgaaataaaaatactaccaacctgtaaccatcacaaatagaatttgtgtcacaaaatacgtacatgcagggttatgtgtgtaaacaaatttattttatatagtgctcataacccaaactcataccagttagatatttaatttgatgtccagttggatttcaaattattttatatagtacttccgtttcttttcatgtcgtttgtgtctcataattcctattttcatttcgttccattaaaaatacgttccagaattcttatttgcttcctttaaataccaatgtatatatgactgagttttgcggattaacatataggatgttaaagtttacaaatatatcataaataaaaacacacaaatatattttcttgattttttttccttcttcaaactcaaaaatatgaatagcattataacatataattttgtaaaaaaaatatattttaacaaatgtaataatgtttatttccttagctacattttagatattcttctttcccttgtttaatcataattaattggagttttggaatataattaaaattttgaaatacacctataaaagcaatttattttgctggataattttttttgaatgaaaaatgtataattagtttacattatttctcaagtttgtttaataatatattatggatttatttaaaaaaagatctggttgaaaaaaataaaaaataaaacccaaaatatttggaaattagtatgtacaatttattgcttagatatttctaaatgtaaggcataatgataattacttgaaattaattatttttgttttatttatagtaaatataaatctttgtaacatataatctcgtttttagaaattttgaaataaattttcgttttatatttcaaaatacttaacccaaaattctaaaattaaatttatttatctatcacaaattatgattttttattcatggtatcaagcaagtgttatgatttaaaaaaattttaaaataaaaattaacttccaaaatgttagtttaataatatagtataatttgatatgaaatcttagtttttcaatttttattggttaagaaattttaagaaataaattttaatttttcgtccataattaataggaaatagaaagtgagtttaattttggaaaactaataattgcttaaaagaatattaccattttttatatttaaatctattaattttgtgattactattgtatctttaatgaatttatttaaaaacacttaaagtcaatagcattctatgtaatattttacccttcataaggttgtttattttcaatgattccgaattaatagtatagatacaatggactagatatatgtatacttgtctatacaatatttattcgtgacatgattggttgatatttgttagaaagttcaaatatcatgttataaaatacagtacgaaagccttcaaatattaagtctttgtttttcattttgggctaaaatccaataattgcaattttttaattttttttctgctggtgtacagtataaataaagactttgcggttgcaatatatcaaaatatatgaagcaaagcaaaacaaaacaacaacaaaaaaatgatagatgagaaagatattccaaagaacttgagggaagaagaagttagagacgataatgtagaatctttgaaaatagtggggcatgtagaaaatcaattatcgagtctaaaatttttcaaaaaatttggatgcatatcgagaagacgccactagaaatttttgatgcaataagaaaaattagagatgaatttcaacgagattcgagctttaagaaaagacaaacaatactatagttatattatattatattagcgtagaatgtatgcttaaaaattataattattaatttatgatattattgagatcatatttttatataagaatttcaaaaaaattataatcttattattttaacaatttcggttaatttttacattgaccccagcttgaaaccgataagatttattaatttatcatgtttattaatttatcgactattaatttatagagttgctacggtagtacgaaagcttcatatcttaagtctttgtttttcattttgggctaaaattaataattccaattttttttttttttttttgctggtgtgcagtatatataaagacattgcggttgcaatatatcaaaacatatgaagcaaagcaaaagaaaacaacaacaacaaaaata

SEQ ID NO: 12485 - DNA, 3000 bp, Unknown
  misc_feature (1)..( 3000): cDNA_ID_2712161_gDNA_ID_2214554_Annot_ID_134740 3000 nt of promoter + ATG
cacgtagatttattctatccatactaatgcatgtagcaactttgtatatttttttcattagctaggctaaggtgtgtatatatatgagttaaatctatttaacacgtcggctctggaccattgtaaaccataatcagtacggatcaatgctaagtcacaaattcatctttggcttttgagccataaaaattatatttagctgatatgagttaaattacctcaagtttaccgctacaaataaagagattgtcatttataattaaaaataggatttacaaagttattttattcacacataaatctaacagtttcgaaattaagctaaacagattaattgtgaattaaaacaagaagacgattaaagtttttgtcaattcagatggataaagagttaggtttaaaaaatttctaaaacaataccagaatcatagaaatagcaacattgttaggaattctattttaactgttctaaaactccattcacaaaacaatatttaatcaatctcatctgtactgattatctatgcttaataatcggaatcccaacttacgtatgtaaatttctaatactaaacaagcattaatgttcaagtttgatatattcacaaaagtatctaaacaaaacctatttgagaatagctactttttcctacttaagatagttcaagtactaataagcacactctcgtgtcaaacttattatcgtaagatcaaatattagttagctacactagaattagtattaagaaaaatcaaaagtgaagaactctatgtattttatcataacaggttatcgatctataaattcatctaaatctctatcgagaatccctaaacctaacaagaaaacgactcagacatgatcatgaaagcacaaaaaggatttgaatagaatcgcataaagaacataagaaataatagattttaaacagtttttttctatattgaaggttttgaagtctctgaaaagattcttcaaaactcttagagaattgcaaagtagaagaaaacttgataaaaaaaaagtgatatttgtaaacaatgacctgaaaaatctatttataagcaataaaacgttcagggactaagtggcaaataaggatattttcttggagcaaatttgttaatcttcaaaacttgtgctttacgtgtggcggtctatggttgcaaagagtgtcgaccaacattaatgagtgtcgatcaacacggatgtcatggtatgactccaaattcatttttttacctaaacttctttggtttcactctaaaatgctccataatctccaatctattccagatcgtgtaaacatctgaaaagactaaaaattaactctagaaataattaaaaaaaaaaactctaaaaataatatatataccatggttaaaaactgtaaaaaccataatatattacctttctaccctattaccttgatcattctaccaaatccatattcctagcaaatcacatcaaatcccaactaccatataattctctctaagtattcacaacattccaaattccaaaccaaattccacaactatatccaatcagcattaattgttggatcttatcaataaagctaatatccaagaaccttctacattcattcttgtaatgtactttaatactttaatactctttttttcccgagacttttttttcaaatcattctttcttttaatcaaaggattacttatatcatcagaaaagatcatcgacatccttccaacctctgtgtgatcaatccacttttacgtttagggtagaccataactctcacgttgagggtagaccattacaaatagtgtgtgtgttgtatttttgttgctttatttcaatttcttacagccgggccagatttttgatataatttgggagttagttcttatatctcgtgctcaataactctttatctctgataatgaaccgaagcatctacagaaatatataagggttttctgcaaaataaccttccaagtcgatctcgttgcaagtttaccctccaagtccgaattatataagtcaatcccaccatctctacagtcacccgcaatacaaccctccggtatatcgatgacgtggcactcgataactccgttgaaaaacataatgattttgtgcaaaaaaaacctcaatataatttttttttgcaaaataaaccttcatgtcaaataaatacaaaccacaatctgaaaaatctcctgcaacatagcccttccatgtatcgatgacgtgacagtcgataactcatttagagcatgtgcaatggatagagattttatgagtcatttatttaaggtgcaatgtgcaatgggtaaacactaaaacttaaataaatgataaccgtaattttaaataaaaaaacaaaattaaatttttgaatcaataactgtaattaggcctgggcataataaccggacccgatacccaaaccgatacccaaactgaaaaagctgggttggggcgggttagggtaaaaggatattacctcattgggtttggttttggttaacccgtgggttcgggttcgggtagggtattactcattacccattccgggtacccatacacccgattcttgtgcttatatagatatccctatatatcatatataacctatacacctatacaccactacttactttttgtcgattcagttttcttcacgaatcccttgaatatcggcttctcttgttaaattctctttgaaccatattctatcaaactggaaacccttgtcgaaacactctcggcgacctcaccgtcaccgacgatcctgttaaacccaccacagacagctcaatcgcgaaatcattctaaggtaagtacgttcatgcaatttcaattctaggtttcgattattgatctcaatctctgattagtttcaaactttcaagtttcaattctcgatttctcagttcctagtttcgattgttgtttgcttgtttcaattcaattctcgatttctcagttcctagctccgattgttgtttatgtag

SEQ ID NO: 12486 - DNA, 3000 bp, Unknown
  misc_feature (1)..( 3000): cDNA_ID_3025373_gDNA_ID_2214554_Annot_ID_185661 3000 nt of promoter + ATG
atccctaaattttttatatttattaattaagagaatgaatatagaaattacacctaaaattaaacccaagaattatgcgcaaataaaagtctcttactagtggttggttggattattctctaaatctcgattattgactttcttaattcagttttaaatgttttcaatgaaagtctattaattatcgactttttgaattgagttataagtacttaaaatgtttaataaaataaaagtagtataaaattttgagttttataaacgaaattatagttaaagtataaaaaagaagtggtgtattgaaattttggattttgttttcaatgtctaaaatctagaagtgataaagtaattatataaactttatgttttatatttattttctaaacataaactaaagtacaaagtaaaatttagaacctgacgtttcttatttaacgaggttgattttttctaacttcatttaatacacttagattcaatacctttatcaaatggattcaactatttaatcctttgttcaacacccattgtaactagttttaaaatcctacttttcaatattcacaaaccaggaaaaaatgatgaagaactcttctattatattggtactagttttctttttcttcatttcttcttcaggtatttttaataaaaattattcttattgtttgatatattagttttggttatttaacttgcaaaaatggcatgcaaatcttgttgttgtgttcttgtagtaaataatttttatattttcattttgatagtaggagaagcaaaaacgtgttctgatggatggacttgtgtaggagaagacaaatgcaaagtaaactgcatggctaaacacaaaggagttggaacatgtactttgtatattattccttctttccctgctccgataacttcttatatttgcgattgcatgtttgattgctaacctttctgttcaaactatctttgtaaactattaaatcttatgataaaggaataaattaaaaatattttttttaatcaccttttttgtatcatttatcttttatatattcaaggtgctattatataaaacttgatatttctcaaaagaattagacataaatcaagattataattaacaagattatcaagatacatgatttacttaagttgcatcatccttgatggagcaccggtcatcctccatgctaaaggtctttgaaattcaaagaaaattaagagtttttttattattattaaaatctcatattaatcaatataatattggaggattttcaaaagtaccatttttctattgttcttttgcaacaatatatatcttttcttgttggtcattttttgaaatatctcttttcttgaacaaaatgatcaaattacttatcattttatgagaacatgtgagtagaaactaaattttttagcgcaaaaaaattatttcctcgccaaaagaaattgcatttaaaagctcttgtaaatcctttaacaactcttaaaaaaatctttgctaagttttttaaaccaatttaaaagctttgtaaagttgtaaaaaatgcttgtaaatcatttgaaaacctattaaaaattttataaattctttaaatacacatgtaaaatacttgaaaaccccttctaaaacctttataaatatttaaaatccttgtaagtgttttaacaccattgtaaatgttttttaagggtttaaaaggctttaaaaaaatattaagactttaatagatatttacaagaactttttaagacttttttaaaggatttacaagagttttttaaagggttttaaaagaaactaggggaaaatccggactacgcccggtaaatgtttaaatattttttatatcttcatttatttaaactttttatatatttttatattaatataatgaaatactttacattaacaccatttacccttgtttttatatattacaatttacataatttcactttcaaaaatctaatttaagaagatgttaaaaaaatttctctttttttccaatccgtaattaatgtatactaacttgaatagttctaacttctaaactttgtatgtaacagtaaaagaaaaattaaaaaaatataagaaaagttgaagaagcattgtaactttgtacgataaattttaaaacttatctttttaaaacattgggagaatatgtatactatatacgttactaaatctcttagactaaataatttgattttttaacattttttgacagtatagtttatgaatcaaacatgacatgacaaccgaatacgaaggaggaaatattatttcaattgcttctttatttttttaccttcatttcattaaattttgtatcattctcaaatagatttttttaaagagatgtttaggtttttagaagggttaaatctaattcggcctaaaaattgttttttttaatctaaaacaatttatattttagatgtaatctaaaaggaaggacgactttctctcccaggcacggttttcgaagttctattttcggttaagagtttttgaaaactagatctaaaccacttcctcttaccaaaacagcaaaaaacaaccatccttatttccaaaactagacttttcggttgacttacagatctagattacaagcaaagtgttccctcaggggagaccggcataggggagaccgacataggagatgcccctcaccctgagcacttgatggttcttatctcaaatcttgtggttaaatctttcgaagaagtttcaagtgtttactaaggccagaacattaaattcaacctaccaaaggtacacttcgattctctctttatgacaacaattattaacctcttgaatgctctcacttttaagtgaagaatcttgttaaacttgtaaagagagatcttggtccacctcttaaaggacagatcttggtcaacgtataaaacctctcaccttgtgtgaagaacttttgaaacttttcgtcacaagcttctacttcaagccctccactccactcagct

SEQ ID NO: 12487 - DNA, 1208 bp, Unknown
  misc_feature (1)..( 1208): cDNA_ID_2712157_gDNA_ID_2214554_Annot_ID_185663 3000 nt of promoter + ATG
aacaaagcgtataataagctcttccacgaaccacattaactcaagagtaaaatagtcgctactaccactctccgaatttagtttctctctatggtaattcagctaagatgctattaaaacaaataaataaataaataaagaagaagttgggagagatgggaaacgcgtagaccaaagatggtgaggtggtataagctttacatggctatgacctaaccccacatgcgacctcctcctatcgtgccatgttgacgttctctcttggtcctacatgtctccttcatcttcaacatcccctcctttcttgcctcatttcttgtgtttctccattttcttatcactatttgtttagttttttatttccccacaacaaaattctccagcaagtgtctttccagtctccttcctgtcaaaagcccgactttaattcgtaattttacaaaaaaacaattatgtaatatttgagtttcacgtccaagctaacatttcatataaattattcacccagcaaattacccataaattctttgcaatttccttaccaaaaaaaaaaataattaaaattttatttaccacggtccgtggtctctttttgaagtttcaacactttcaaactttattcttaaattattacaatcacgattaaaatgtgaaagcaaagttaaacttttatttttatacaagtcatttacttcagtcaaattttcttcgcgtcaagttttccttgtaacttatttgtgactactattgttttgttcaaatcttctgtgcaatgtaaagttatcatttaagaattaagataatatgtactactacaaaatcataacaaaatgataaaacatcaattgttcatgaaggtgtattaactgcgttgaatttttactagctcatatttagtgtcttaaagagcgcatgcaatatcgtagttaagactgggaggtaataaacttagatcagttgatgttattgtccgaagctaatctttgtttggccgtctgacgtggcacgtaaaaaccaacttaaaagcttcctctatataaataccaacaagctcttcaatcccaaaacacatccattccattaccaaagtacaaaacataaactccttctgtctctctcctctctacctcaatttaattctcctgatttgtttttttttccaccaaaaaaaagagataacaaagaaaaacaaatagctaaaacatatg

SEQ ID NO: 12488 - DNA, 1208 bp, Unknown; identical to SEQ ID NO: 12487
  misc_feature (1)..( 1208): cDNA_ID_2712157_gDNA_ID_2214554_Annot_ID_134741 3000 nt of promoter + ATG

SEQ ID NO: 12489 - DNA, 3000 bp, Unknown
  misc_feature (1)..( 3000): cDNA_ID_1387805_gDNA_ID_2214555_Annot_ID_134745 3000 nt of promoter + ATG
aacgcctaaatgccagtatctgggctttgagaacatggagttgctgtttggtaaatcctgatcgctgctgtgcttgttgggtcccctgtccactctgaagggacgagttactgagtggaccagtatcagatggcgctactaaatttggagtcggtgtattcagttgcctaggctgctgcatttgcaaatgttcagcaggacctaaacttttttttgtagatgcattctgatccaaaacaggagtctcatttgcagaagtctgcaggggatttcctgagggcatcccatttgtaggctgaactaaatgtcgaggatacattggattctctctcccttggccggagaagggattcatagcaggattgaccattctgggactggaagtcgaggcaaatgagccagtagataatgcatgtctggccttcgctgatcctgactgcccagagatatcactagcagagttggcatgtggtgaattctcacctggaacaaccgaagatgaagccggctggctagagattggaatagatggtgactgtgaggccacattgccttcaccagctttctgttgagcagccattcttgcctgaaggatgtgtgccatttggctggcgttggcaggatgtgagagatcgatattacgctcacgcgcccatgcctgcattgcctgccactgttgtgcaaatgcgagttggttgtttcccatgttattgacaagctgctgagcctgtggtgcttgcattggccttatcatatttccaggcattagttgtccggtacccacctgctgctgaggatgagattttgtttcgttcctttgctgagaacttgattcagtctgcctttcaccgcgagcaaactgatcgcccgatggcttcgatgatgaggcctggggctgactagacggattcaagtcttgcatattcaacattcccattcgtgcatcttgatcctttcccacacttgatgaacccaccattcccatcctagcttgctgctgtgctttttgatgctgagcctgcatagcaaactgaatatacgcttgctgcattggattaaaattttgctggccctcttgggtagaagaaccctgttgttgttgttgttgttgttgctgaggagactcaaaaaaatttctagactgctgaggcatttgcatagagcccggagacgaagcaaagttgccaccgcccatcattccctgaaccccaccaggttgatatgcaaacatattttcgtttgtatctgagtttctgtgctgctgctgctgctgccatatcagaagcacgataataattagtaacaatcaaatgaacaataatccacaattcagagcaactatatatatatgtggaaatgaacaaaacatgttctccaagtggctaccattacacaacttcaatttaaagatattggttactttccttttacacagaattgataaacagtcaagtcccactaaaattgaatagccgcaagtttaacagacaaacattagccactacaaacaagcattttatccctcctaagtcataacgaaccaaacagagacttgagaatcctttacctgcctagacgccagctgctgttgctgttgctgctgttgctgttgctgttgctgctgctgcacagatgaagaggaagaagaaggagaagcagcggatgacgtggaagcagtccgaccagccggacccatggccggattccgagcgggccctccgccactgcctccagattgcatgcaattggtcgaagaatctgacagtcactacactggaaacaattaaacccaatgcacaacgaagctagtagaagaagacaaaaaaaaagtggaaaaaccctacccaataaatccctacaaaagaattcggacagcgagagcccccgaggcaaaggaaaaaacctcaaatagcaacagagagagagagagagagagagagagagagacactgagtcggttgaagcgcacacacctttctatttctctctcttcttagatttgcatcgaatttgggggaaatcggaaaacgaaagtcgcgggggatgcaacggtataaactcagatcctttgagatggcttctcgaaaaataaaaataaaaagggagggaaacgaaatccacggaatcgatgatcgattcctctctttgagaaattcacgcagatcagaaatttctcgcagtcaaaccctagctggcttcttacttccctttttcttttttttctctttctttttttttttggaaggggcattaattttattttatttttgattgtaggtcccacgcctcgatacagttggaacacggaaaatgcgtttcacgaggccacccctcggttttcgcttttattaccacaagtacccttccttatacaagtcagttgcacaaatgacgatgagacacgtgtgaatttaccaaacgttccttttgttaaccaaatggaatgacttttaatttttccatgtttatttcaaatatttgtttccgtattgggtaataagaatactaaaatgatactactataaacaaatttggaaatcaaaaaaagaaaaaaaaaaacaaatttggaaatcaaattagacttatgtttgttttacttgattaattaatttgaatttaaaattagacaaattttgacttttagttttaccttctgtagtgcagtagtagattagagagaatcatacaattacccttgttttatttacggtgcaacctcgtgtcgttttcatctttcagccttgatatgcttgccatctttacgtcaatagttggcacgcagttctattttaagatagaaaaacggcgaacagttttgaaccagcaggttcagtttatgtcgttaatagttttttttcccgaaacaagtaaaaagtcacattattatggttttgtgacttgtgtgcgagtttgtagaagctttactgatatagaaatgccgttgccgatgcagtctctcttcctctgtttctgattcctgaataaatttgttaaacgatg

SEQ ID NO: 12490 - DNA, 3000 bp, Unknown
  misc_feature (1)..( 3000): cDNA_ID_2708261_gDNA_ID_2214555_Annot_ID_134746 3000 nt of promoter + ATG
gtgcagtaatgattccaattctattcaaaactgtcctggatacacatactgtctgtcactataatgagctaaactttgttagtatgggtgggttaaattgcagggccgctttgcagaagcgttactgcgtgaaatagcaggtgtaatcataccatcagaaaggatttatggtttgggttcagggtcagtatcattatgaggtccaccaatgattttgtttctcatccagattctacccttaatctagttttattttctgtgtgatatcccatcaggccaaaggtggaagttctaaagctacttcaagataaaccagaacatcagggcttgacgctgcagtaactcacgttctatatatctatcaataattcttctatctgcatgacttggtaatggtcaccattagtttacaatccctatgcatttttaatttggccagtttcgtggaagacagactcgcaacgctgaaaaatgtcataaaagagcctgaattagacaaatggagtttatacctaggtggtctcttccctctcccatatcatcacttctggttccccttattggttattctgacaaaaacttatctcaaaacaggaacctggggatacaacactgagaaagagagagctgaagcagcaggcattcccaggattcaggttattgagctctccacgtttagcaataagcttaaatgagtgcatatactcattggaaaagaaacaaagctttcctctttattgtattctacggcattcaacggaaactaaaaaccaaacatgtttaggtaagattcagtaaaagagttgaactttcagtactacccattatagaagcttttctgtgacctataattcatccttagtaagatcattcttgttaccatcaccatcttcgtgatctttcctttgctcagcttgaaatttgtcaaagacatcttcaaatggaggatctccaggtcttctaaactcttgcttccctatcttgacctcgtaagcttcttcttggctcagcacgaattcccttagctaattgaaagatatgattgtgatgttagattttgactaatccactaaacaaagttttcagcattgtgtgttttctgtggcttttacctcagtcacaagcttcccattttgcatattgaacatcactgtgcttcgatctacagccatgaatcttactcctatccctcctgttcttaaaacttttgtccatttcatagcaatatcaatcaccacatcctgattgaaacatataaacagatcactattcaatcccctgaagcaactggacccatatcgaattcagagaattttgaacagtaactgaaactataacttaaggaccccaaattcacgattcgatttggattttagtttaccttggtacgggggacgcctaaccggagcttgacgaaaccgacgacggttccaaaagtccgtttagccatttcctcttggatctgatcgaatcccatattggtgaaatccggaggcggatcaaattccggggtcgttgctttcttcccccactctttccatgactcgtcttcttcattgtcttcaacgtcgtctaggtcatcggagatctcgatccgtcgcttcgttgcttcggcgatccggacaaatccgtgaaaattcataaaaagaaggaggccaacaagtagaatcagcgaagaagaacgaacgatcttctccatcgtttaacaaatttattcaggaatcagaaacagaggaagagagactgcatcggcaacggcatttctatatcagtaaagcttctacaaactcgcacacaagtcacaaaaccataataatgtgactttttacttgtttcgggaaaaaaaactattaacgacataaactgaacctgctggttcaaaactgttcgccgtttttctatcttaaaatagaactgcgtgccaactattgacgtaaagatggcaagcatatcaaggctgaaagatgaaaacgacacgaggttgcaccgtaaataaaacaagggtaattgtatgattctctctaatctactactgcactacagaaggtaaaactaaaagtcaaaatttgtctaattttaaattcaaattaattaatcaagtaaaacaaacataagtctaatttgatttccaaatttgtttttttttttctttttttgatttccaaatttgtttatagtagtatcattttagtattcttattacccaatacggaaacaaatatttgaaataaacatggaaaaattaaaagtcattccatttggttaacaaaaggaacgtttggtaaattcacacgtgtctcatcgtcatttgtgcaactgacttgtataaggaagggtacttgtggtaataaaagcgaaaaccgaggggtggcctcgtgaaacgcattttccgtgttccaactgtatcgaggcgtgggacctacaatcaaaaataaaataaaattaatgccccttccaaaaaaaaaaagaaagagaaaaaaaagaaaaagggaagtaagaagccagctagggtttgactgcgagaaatttctgatctgcgtgaatttctcaaagagaggaatcgatcatcgattccgtggatttcgtttccctccctttttatttttatttttcgagaagccatctcaaaggatctgagtttataccgttgcatcccccgcgactttcgttttccgatttcccccaaattcgatgcaaatctaagaagagagagaaatagaaaggtgtgtgcgcttcaaccgactcagtgtctctctctctctctctctctctctctctctgttgctatttgaggttttttcctttgcctcgggggctctcgctgtccgaattcttttgtagggatttattgggtagggtttttccactttttttttgtcttcttctactagcttcgttgtgcattgggtttaattgtttccagtgtagtgactgtcagattcttcgaccaattgcatgcaatctggaggcagtggcggagggcccgctcggaatccggcc

SEQ ID NO: 12491 - DNA, 3000 bp, Unknown
  misc_feature (1)..( 3000): cDNA_ID_2712230_gDNA_ID_2214555_Annot_ID_134747 3000 nt of promoter + ATG
agggttcttctacccaagagggccagcaaaattttaatccaatgcagcaagcgtatattcagtttgctatgcaggctcagcatcaaaaagcacagcagcaagctaggatgggaatggtgggttcatcaagtgtgggaaaggatcaagatgcacgaatgggaatgttgaatatgcaagacttgaatccgtctagtcagccccaggcctcatcatcgaagccatcgggcgatcagtttgctcgcggtgaaaggcagactgaatcaagttctcagcaaaggaacgaaacaaaatctcatcctcagcagcaggtgggtaccggacaactaatgcctggaaatatgataaggccaatgcaagcaccacaggctcagcagcttgtcaataacatgggaaacaaccaactcgcatttgcacaacagtggcaggcaatgcaggcatgggcgcgtgagcgtaatatcgatctctcacatcctgccaacgccagccaaatggcacacatccttcaggcaagaatggctgctcaacagaaagctggtgaaggcaatgtggcctcacagtcaccatctattccaatctctagccagccggcttcatcttcggttgttccaggtgagaattcaccacatgccaactctgctagtgatatctctgggcagtcaggatcagcgaaggccagacatgcattatctactggctcatttgcctcgacttccagtcccagaatggtcaatcctgctatgaatcccttctccggccaagggagagagaatccaatgtatcctcgacatttagttcagcctacaaatgggatgccctcaggaaatcccctgcagacttctgcaaatgagactcctgttttggatcagaatgcatctacaaaaaaaagtttaggtcctgctgaacatttgcaaatgcagcagcctaggcaactgaatacaccgactccaaatttagtagcgccatctgatactggtccactcagtaactcgtcccttcagagtggacaggggacccaacaagcacagcagcgatcaggatttaccaaacagcaactccatgttctcaaagcccagatactggcatttaggcgtttgaaggttttcagctctgactttttccttatgtcttcatttttattgtatgttttgctggagatgtatgcctataaataacgtgtctgcaagccaggttgaatgtttttaattgcttttttttgacagaaaggggaaggttctttgcctccggagcttcttcaagctatttctccaccaccgcttgaactacagacgcagaggcaaatatctcctgccatagggaaagttcaggatagatcttcagacaaaactggagaagaccaagcaaggtcgctagagtgtggcaaggagtctcaggctgctgcttcttcaaatggaccaattttttctaaagaggaagataatgttggagatacagaagtagctttgacgacaggccacagccaattatttcaaaacctgggaaaagaagctacttctactgacgtggctacgaaagaggagcaacagactgatgtattccctgttaagtcagaccaaggagcagattctagtactcaaaagaatcctagaagtgattctacagctgataagggaaaggctgttgcatctgatggaagccaatctaaggttcctccacaagcaaactctccccagccgcccaaggatacagcctctgccaggaaatattatggaccgttgtttgattttccctttttcactcgaaaacttgactcttatgggtctgcaacagccaatgccaataacaatctcacattagcatatgatattaaagatctgatttgtgaagaaggtgcagagttccttagtaagaaaagaacagacagtttgaagaagataaatggtctgctagcaaaaaatttagaaaggaaaaggattaggcctgatcttgttttacggcttcaaattgaagagaaaaagcttaggctatctgatcttcagtctcgtgttagagaggaagtagatcgacaacaacaggagataatgtccatgccggataggccgtaccgcaaatttgtgaggttatgcgaacggcaacgcctagaaatgaatagacaagtactggccaatcagaaagctgtcagagagaagcagctgaaaaccatttttcagtggcgtaagaaactccttgaggctcattgggctatacgtgatgcacgcactgctcgtaacaggggagtggccaaataccatgaaaagatgttgagagagttttcaaagagaaaagatgatggccgcaacaaaaggatggaggccttgaagaataatgatgtagaaagatacagggagatgttgctggaacagcaaactaatatgcctggtgatgctgctgaaagatatgctgttctctcttcatttttgacccaaaccgaagattatcttcataaacttggaggtaagattactgccacaaaaaatcaacaggaagtggaggaggcagcaaatgctgcagcagtagcagcgagattgcaggtatacatactgctttctctactccacagcgaatatccattacactctgtagataattcttcaaactttaacttaaatgttgacttttgcgtgtttcagaaaatagaactttttcttttcaaaggtatagtggatatatagtaccttacctgtttccgtttttgacgcaggggttgtcagaagaagaggtcagggcagcagctacttgtgctcgagaagaagttgtgatcagaaatagatttacggaaatgaatgcgccaaaagaaaattcatctgtcaacaagtaagggcattagtcacacaaaaaatgattaaaatagggaattagcaaagtactagttgtaactcataattaccaatgcagctgaatacttaaaaagtatgtgcttatctgtaaaatgctgataatcctgcacatccatatgtgagagaattctacagatcacaagattaggaataggcgccgtgggtg

SEQ ID NO: 12492 - DNA, 3000 bp, Unknown
  misc_feature (1)..( 3000): cDNA_ID_1807129_gDNA_ID_2214555_Annot_ID_134748 3000 nt of promoter + ATG
tatgatgatagtgctggagctagttacaatctaagagagagactgagttacgaggattacaagaggggaaagactgggaatggctcggatataggcagttcagatgaggaggatagaccatgtgctctagttgggtcaaagtttcaagctaaagtaccggagtggactggcataacccctgaaagtgattcaaagtggttgggcactcggatctggccactgaccaaagaacaaaccaaggctaatcttcttatcgaaagagatcgtattggaaaaggaagacaagatccttgtggctgccataatccaggatctattgaatgtgtcaagtttcatatcactgcaaaacgggataaactgaaacttgaacttggtccagctttctacatgtggtgttttgatgtcatgggtgaatgtactctccagtattggacagacttagaactgaagaagataaagtctttgatgagttctccaccgtcacttagcccagccttcatccatcaggccaagatgattcttccttcgaagagcagaggaaaaattgtgagctacttctacaacgtgacccttttgcagtacagagcaagtcagagtagaataacacctcacgatatagacagtgatactgatcaaatattcctccgcgcaacagagaatgaaaatccagcccccgaagcaaacacatttcagaaacccgccctgctttcgcctaataaaaaaagatgtcgatagagctatcacccggttgagattcaagtaggagcagctcttttagttttcttcgtttttggggcttctattgccattgaaactgctttagactctgtggggaaaaggcttcataatagcatcttcttagcaaattctggttttagttttgaggtaaatacttgcatctcttccttgatgatcctacagtaggattcctttttgttggcattgcttgaaatgctttgcggaaactggtgaatcagagagatgatttctatcagtacagtgagagaaatttggattagtttggtgaatacaacagaggcaaaatgtaattgctatatgtttttttttctgtttttttccaaggaaaatgaagaaatgagtaaatctctcttgttattaatcgagttctcagtttcatgatttcgactataaccccctcatcacaagataaatttaaacctttacacgagcaaagttaatcataaattcaaagattggtagcttattgggaggttatataacactactaaatgatttgctatttttacttagagaagcataaaccattttctgtatcaaataaatgatattttcttttgaaataatagtgttaaggattttgaagaaataaaaattaatttagttacattgtacaatgtgattttcttcaggaattcttattttttaaaaattaagttaaacaattaaattcagagatactaattagttcatattgtagtttagagagaatacaattgtatttaaaccaacaaaactatgataagatttgttgggtcagatattggaaaaaggactaaaaattgtcatgatgttttgggccaatgattcactcttcggcccataaaggaacccatgaaaaatccagatcatcatagttatcccacgcgcatgtaaatcgcgttgttaaaagcgcccgtttttcgcagtctaacccctacggaaattggcctaaaatcaactgaatccaataatttggagtccaagggcgcgtgagctaatattctcttcttttctttctttatcgtttttttttttttttttgcttaaacgatatttcatgcctaattactctttaaaacctttttccctccaattttctttaaattactgatcattattttatttgtcgcaactaaatttttatctactgaaattagtaatggtattattctataaagctaaaccgtgtatgttaagagattggatagggttaatgcatgtggacacgttactcatttttcatttaaaaaaaagacatgtaatttgttgtcctcacgtctactatagtcgtaactcccgtaagtttatggctcacgtttctcttaaaatcattcattcttttggttataaaatactattgagaaatgataattgtaggataagtcccaaccccaccatcattttccttacaatatcatccgttgttttattgtaataaatcatcgatgtccatttttatattttatcgtagtgtgttcatgtttggatttgaaaatggaatatttatgacgacaacaacaacaacaaaagaagaaaatgaaatatattagtcaatattaactaaatgttctttcacatagacttatattgaaaaatataatatatgtccattttgatttttaaaaaagtaactacagtatatggaaagtagattaaaggattaacaaaaagaaaagataaagataaagcaatgaatgaactcattttttggagaagattggagattggaaggtttcggaggaaaaggtcggttttaacaggggagcttttcttattgctcagagtgttgttaaaggagataggtttcaatcttatgcggcggttggacatccttggtggctccatcaactatttgagggtgagagaatctcttcctaggccttgtttctttgttttggtttgtttgaccattgtcaatcttcggtccttttggggaatggttgtttgcacgactattcttgtaaccttaattggtctttttgtaaaggttctgtatctcaaacaatattcatcaatatatcattatattggagaaaaaaaaaaaaaaaagataaagcaatgaatgaaagacaaaggcaaaagggtaaaaatggaattttgagggataaatgaaagtaaggcaaatgtccatttcattgatcttttcttataatatcatattttttctttcattttggaatctttctctctctctctctctaaaaccagattcttaatagaagaagaagaagaagaagaggaaaggagaaatctgccatg

SEQ ID NO: 12493 - DNA, 3000 bp, Unknown
  misc_feature (1)..( 3000): cDNA_ID_3025424_gDNA_ID_2214555_Annot_ID_185705 3000 nt of promoter + ATG
atcttcagtttcttagggtttgatgcgaatctttgaaacagatacgaaatcgaatcaatcaaaagacaagaaaaataattgaagaaacgattacggaaaacggctttcttcttcacctgttcacttgaagacgagagagacgacgaggaagaagtgcaaaaaccctaggaaatcaactttgtcctctcttttgacacttttacccttttgtaattttttaaattactcgagatgccacagtttagcaaagctcagtggcttcagcgtttttagcttcttccctatttgatgagttcgaacctcgcccgttgcgcctattttgtttttttcctttctcaaaagcagtttcatacgttttttttttgtgggtgcatatgtctatttgaaaagacaaacaacaagctttatcatcaaagtagtatattggtaatttggtagtacatcaattctgaaaatgttaaaaagagagaaaatattatgtggaatgatgaaaaaatggaaagacatgttcaaagaatctaaatcttgatgttgaagtaattggagtcaaaatgatgcagtctcacgtagccgtcttcacctccactagagaaactgaaaatacattccaaaaaacactcagcaacaaagcctaaaaaacactctcatcaactgaggattgtatcaatcaatcaaaatcaaattttgttagtttacctcttcccatcaggactgaatgccaaagcattaataggtccaaaatgacctttcacgccaccaatttcctcttgcagaatctatatattataagaccaaatacacagttacatatctctttccaggttacaagtttttaaataaaactgttttactgcaacactaaccgtgtcgtaaaacttagcttcaaacttcccagcacgatgatcagtggtagtcacagctgatgcatcttgaccacctccaagcacaacctaaaagagcgagagcagaaacattcacaaagataacatcaagacttgttgcttttgggaaccgaatttgaatttcaagaagcattagtgcatacatggttgagaagtggagacatggcgacagcatttacaggcaccacagtggtgtaagtcttaataagagtcagcgttctcatgtcccaaagctgaaagaatcaacaaaaagaacactctattagatgatttatctctatatgtaatatgtatagagcatatttttgaaacaagtaaaagaaagaagcacatgcctttgcagttttgtcatgtgaacctgtaaggaagtgagagtcatcagctgctttgcagagggatgtaatggcctccttgtgacccacttcctcatctgattgcttaagcaattttccagtctagtaacaatggcagtagcaccacataaggtttaagctaataaaaaaaaaaagagagatattgatagacaaaagaaaggccttaagaaagttgaaatacctctgcatcccagattctgatagcagcatcttcaccaccactaacaatggtttggttcaggggaccccaaacagctctattgatcttcttctttccatcaggactttgaaggacaagcacagaatcaccaacctctacatcaattacattaaatcaattccttttacccatacaaaaaagacataggctaaaaaacataagtagattttaacttagaattgacaacttacggtcttcgggatcttctgcaatgcgtttgacatgaatagcagaggaagttcccacgaagtgatcagtggtaatcactgcaagatgatcaccaacagagaaatccacagaccttgcaggggcaccaaacttgaaagtgaacaattctttgccagatttcacatcccacagctttgcagtctgatcagcactaccagtgatcaatctagacgagtctcctaagaaatcacaaacaaaacactaatcgttaagctatgaaagactaaaacaacaaagacaacgacttaaatcctaaactgaatccattccatccactatatactatttgaatttgagaggctgagaccacttactggagatatcacagcaccaaacagcaccactgtggccacggtaagtgccaagacgctcgccgttatcggcaaaccagactgtgggagtgtggtctttggcgcaggagaaaagcagatcaccatttctgttgtacctcaggaacgtcaatggacgttcatgtcccttcatcaaaatcggcctcatcctcgtttctagggtttgatgagaggagcttttcatcttgcaaacagatacgaaatcaattcaatagaaagaacaaaagataatacattaatcggaaacaagtacatgaccaaacggaggaagagatatgtgcacatacttggttgaatcgaagaccttcgggattaacgcactcaattgtcatgacggaggaggcgacggttgaaggacgacggatttgatcagcgagcgttctctgagattttgagggctttaagtggtgaatcgttaaaccggtgagcgtaccattggtaaataactccgaatagagccacgtggcagtaatgggctcgaaacagagtccacctggcctaaacatctaatctgtaggcccatgccactttggatgtatcaaactcaatatgattatcagttataaattaatcgactaatctaataactgaaatttgaatatttcaatgaatgtaggaagaagagaaaaaagagggaacacgtcagcaacaaaaacggcgcgcgtgagtctcgggcctaaaacgaaatcccttcctcacgtctcagccttcttccattaacgagagagaagagacaacgcaacacaaaaaaacattctcttctctctctctctcttccaaaaactcaaaatctcttagaaaccaagtttgcctgcaatcatcatcatcatagcatctctctctccattttgaagatttcgttttgatcttccttgatacgatttatcaggagatcgtcagagaggtgaataattaagagaaaaaag

SEQ ID NO: 12494 - DNA, 3000 bp, Unknown
  misc_feature (1)..( 3000): cDNA_ID_2994382_gDNA_ID_2214555_Annot_ID_185704 3000 nt of promoter + ATG
tcattgattgttattatttatctcctcttgatttgaattaagaatgtttttattttgggaaattatgatctgtttgcttggagatcaagtgattgcagacattatatattttgtttccttatactaatattaatcagctttgaaactggacactaaaaaggaaaaaaaaaacaaattttggataatttttctcaatatcttttgttttggcactttatcatgagaaataaaaaatatttaccacaaatttatagtggtattggatcatctgatataataaaagtcataaactagaaagacaaaaaaataatatagactcaatttctctttatttgttactgaatttctgaccaggtcaggttattgtgtatatttttatggggatctaggtggattcattttctttggtaagttgttgtaaaagaatctggggtcataatatataccaagtctttcgaagcagtttcggaagataatcaattcaaataattaagagattcgtagcgggaaataaataaggaatactataatcaaaaattaatttatatagtatgtggcgtgcattaacatgcattaatctattaatagaaagaaacaaaagatatgaaacaaaagagaaattggacttatcttattagggccacatgaacaaccttgaagacaaagcgataacaaaagaaattgccacgatatgcgttggacgttgaggcatgagatttatttgttgtaacctaattattatttgctttttggttatactacgaggtatgagttggtgtaggtaggaaacgagatggtctttgtattatcgtctacatgtttttctctctgttttattattgcatttagttgaagggaataaacatcgtgaacaatttacttcacatttgaagcagttcatgcatcatataaataaacaagataaaaacagtgatcgactctcttctccgacatttgatctagacatccatttttatcctaatcgtttctgtatagcgagaattttgcagaaacctgcagtcgtacgatagataataccaaaaatagtacattctcaactagactgtacatctaaaatattatctatcatttttacaaatcacattgaatgacagatacagctatctctctgtagtgatacacatgaggaaaaacagattaactgatataatggaattttgttatttttggacttcttatcctaattctgaaaaacaagccatttttttcgaattccacatttccacttgacattttaccaatttaggcccccaaaaatggcacaccatttcgatatctatatttttgtttacgaaacatttcagcccatatactttacgggcccattagtgtctaaagattcatacgccacctgaacaatattttcccaccaccattacacaaacatgtcgaaaatattcttaacataaaaatcaccacattacattatgtttactgcccaaataataacccacataaaatattacacacaaaataatctatctcacacaaaataataataaaacaaacactcgctaaatatgcccccctcagtgaatttgatcaaataccccaaaaataaaattaataacatgtgtggagtataaaacacgaaaaaataaaattacaaaagaaagaagataacatatctacagtaaagttacaagtatacagatgttagatcatcgtgtttttccaaatcctcgaatccttccgtcttgttactgtatagttaccctgcaacgtaataattaataatctcatataaaagtttagaaattttggatgtaattaacatcaaaaaccaaaatcctaattactgataattttgtaccatttgagtgtattgagaatgcatttaggtgaatcagtatcaagcttgttcaagctaacgccaccgcatctcaaattaacggcgagcattccgatcttaataccgccgacacctaatccaactttagtcttggcaacaacgttaatgaccaaatctttgctctgaaatttcgcagcgagtctcttagccaatcctctctccacgagctgattcttcaccgtcgtctccactttcacgctcgtcgagtttttgggaccttgtcggaatccattcatcgtcgtctctcccatcccggtctcatcgtttcccgaaccaacgctcaaatcaacggcagtgtttccgtagtaaaaaacgagtttcgagttcggattcttcatctcaacgcgggcaacggcggtggcggagagagacgcgccgtcgggatcgtcggcgagtttgaagccgtcgagacggaaggaagcgaggctgaaagtgggaagcttaggatcgaaccagaggtagaaaacagctgttccgaccaagaggaggaagatgaagagaacaagagtaatgcagatgcaacagcaacagaaacgacaacagcttctacgttttttctttggtcggtaagaagtaggcatagggacggcttttctcataggttgttgttgaatgggaggtggaggaggaggaggagaggacatgtttggatctctgtaacctggtggcttttgaagaaccgggttcatctgataatctgccatcttttttctcttaattattcacctctctgacgatctcctgataaatcgtatcaaggaagatcaaaacgaaatcttcaaaatggagagagagatgctatgatgatgatgattgcaggcaaacttggtttctaagagattttgagtttttggaagagagagagagagaagagaatgtttttttgtgttgcgttgtctcttctctctcgttaatggaagaaggctgagacgtgaggaagggatttcgttttaggcccgagactcacgcgcgccgtttttgttgctgacgtgttccctcttttttctcttcttcctacattcattgaaatattcaaatttcagttattagattagtcgattaatttataactgataatcatattgagtttgatacatccaaagtggcatgggcctacagattagatg

SEQ ID NO: 12495 - DNA, 3000 bp, Unknown
  misc_feature (1)..( 3000): cDNA_ID_1018052_gDNA_ID_2214555_Annot_ID_185703 3000 nt of promoter + ATG
ttttttctcttaattattcacctctctgacgatctcctgataaatcgtatcaaggaagatcaaaacgaaatcttcaaaatggagagagagatgctatgatgatgatgattgcaggcaaacttggtttctaagagattttgagtttttggaagagagagagagagaagagaatgtttttttgtgttgcgttgtctcttctctctcgttaatggaagaaggctgagacgtgaggaagggatttcgttttaggcccgagactcacgcgcgccgtttttgttgctgacgtgttccctcttttttctcttcttcctacattcattgaaatattcaaatttcagttattagattagtcgattaatttataactgataatcatattgagtttgatacatccaaagtggcatgggcctacagattagatgtttaggccaggtggactctgtttcgagcccattactgccacgtggctctattcggagttatttaccaatggtacgctcaccggtttaacgattcaccacttaaagccctcaaaatctcagagaacgctcgctgatcaaatccgtcgtccttcaaccgtcgcctcctccgtcatgacaattgagtgcgttaatcccgaaggtcttcgattcaaccaagtatgtgcacatatctcttcctccgtttggtcatgtacttgtttccgattaatgtattatcttttgttctttctattgaattgatttcgtatctgtttgcaagatgaaaagctcctctcatcaaaccctagaaacgaggatgaggccgattttgatgaagggacatgaacgtccattgacgttcctgaggtacaacagaaatggtgatctgcttttctcctgcgccaaagaccacactcccacagtctggtttgccgataacggcgagcgtcttggcacttaccgtggccacagtggtgctgtttggtgctgtgatatctccagtaagtggtctcagcctctcaaattcaaatagtatatagtggatggaatggattcagtttaggatttaagtcgttgtctttgttgttttagtctttcatagcttaacgattagtgttttgtttgtgatttcttaggagactcgtctagattgatcactggtagtgctgatcagactgcaaagctgtgggatgtgaaatctggcaaagaattgttcactttcaagtttggtgcccctgcaaggtctgtggatttctctgttggtgatcatcttgcagtgattaccactgatcacttcgtgggaacttcctctgctattcatgtcaaacgcattgcagaagatcccgaagaccgtaagttgtcaattctaagttaaaatctacttatgttttttagcctatgtcttttttgtatgggtaaaaggaattgatttaatgtaattgatgtagaggttggtgattctgtgcttgtccttcaaagtcctgatggaaagaagaagatcaatagagctgtttggggtcccctgaaccaaaccattgttagtggtggtgaagatgctgctatcagaatctgggatgcagaggtatttcaactttcttaaggcctttcttttgtctatcaatatctctctttttttttttattagcttaaaccttatgtggtgctactgccattgttactagactggaaaattgcttaagcaatcagatgaggaagtgggtcacaaggaggccattacatccctctgcaaagcagctgatgactctcacttccttacaggttcacatgacaaaactgcaaaggcatgtgcttctttcttttacttgtttcaaaaatatgctctatacatattacatatagagataaatcatctaatagagtgttctttttgttgattctttcagctttgggacatgagaacgctgactcttattaagacttacaccactgtggtgcctgtaaatgctgtcgccatgtctccacttctcaaccatgtatgcactaatgcttcttgaaattcaaattcggttcccaaaagcaacaagtcttgatgttatctttgtgaatgtttctgctctcgctcttttaggttgtgcttggaggtggtcaagatgcatcagctgtgactaccactgatcatcgtgctgggaagtttgaagctaagttttacgacacggttagtgttgcagtaaaacagttttatttaaaaacttgtaacctggaaagagatatgtaactgtgtatttggtcttataatatatagattctgcaagaggaaattggtggcgtgaaaggtcattttggacctattaatgctttggcattcagtcctgatgggaagaggtaaactaacaaaatttgattttgattgattgatacaatcctcagttgatgagagtgttttttaggctttgttgctgagtgttttttggaatgtattttcagtttctctagtggaggtgaagacggctacgtgagactgcatcattttgactccaattacttcaacatcaagatttagattctttgaacatgtctttccattttttcatcattccacataatattttctctctttttaacattttcagaattgatgtactaccaaattaccaatatactactttgatgataaagcttgttgtttgtcttttcaaatagacatatgcacccacaaaaaaaaaacgtatgaaactgcttttgagaaaggaaaaaaacaaaataggcgcaacgggcgaggttcgaactcatcaaatagggaagaagctaaaaacgctgaagccactgagctttgctaaactgtggcatctcgagtaatttaaaaaattacaaaagggtaaaagtgtcaaaagagaggacaaagttgatttcctagggtttttgcacttcttcctcgtcgtctctctcgtcttcaagtgaacaggtgaagaagaaagccgttttccgtaatcgtttcttcaattatttttcttgtcttttgattgattcgatttcgtatctgtttcaaagattcgcatcaaaccctaagaaactgaagatg

SEQ ID NO: 12496 - DNA, 3000 bp, Unknown
  misc_feature (1)..( 3000): cDNA_ID_1807355_gDNA_ID_2214555_Annot_ID_185702 3000 nt of promoter + ATG
gcagtgattttgagcatgaagtagcatcaaagcaagtattagaagcgctcttcttcaaagcagaagccccacacaggcaacgcatcctcgcagctgaaggatcggactccatgaaccgccgtttcatagagagggcttacaaatacagacccgtaaaagtggtggagtttgagcttcctcgcccgcaatgtgtagtgtacctggacttgaagcgagaggaatgcgcaggactattcccttcaggaagagtctattctcaggctttccacttaggaggtcaaggtttcttcctctcagcacactgcaacatggaccagcaaagctcgttccactgctttgggctattcctcggaatgcaagagaaaggggctgtgagttttggtgtggactacgaatttgcggcaagagataaaagtacaaaggaagaatacgtaagcaaatacaaaggaaactacacattcacaggggggaaagcggttggttacagaaaccttttcgggattccatggacttcgttcatagccgaggacagtcaacatttcatcaatggcattctccatctcagagccgagctcaccattaaacgttcctcagacctgcactgactgttttcttctctctctctctctatgtcgtcacatttaagttgtataatctcgttatgtagcagctctaaccacgagtgtcctttgtacaataattgcctaaggagcaaaagtatggcttaaagagtacctcattctgtaaattctttgattggatttttttacttttctatatgggtctttataaatagtccaagatagaatttgggcctagcttttgaggttagtcttaaaatatgggctcaaggcctactacgatgcgtaatgatgaagctaaattgcctatagtgtgaacattaggcttttatattcaaagttcaaacaatgcggctatagcaatggtacatcgaggaaatagaatgaagtgacaaggataatttaggaaatgaggatagaggaattgagtcctcgtcacatggggcccacataaatgcgtaagtaagactatccgcttaccagacggacacgtcattttgtcgggacacgtttgagccgttggatgattaatctccttttctgacttatcgaccccactttttttttccactacaaaatattgatggccacgtcagatgattcgaagttatataaaacacacgtttttattgcagcttaaccgtcgatttttttctaatcgagaaaccgagatcaacggtctatattcaaagctgatgtggtctgtacctttgcttacgtcaccgaaaacctaagttgaataatactagtactagtattatgctctctgatttctttctacagtacacaaaataaaaataaacaaaaatagagagcccagacaatatttactacatcacccaatggataaccgacacgtagatacatccatgtgagtcgcattttgtaatgtagggaccacttcgtggatagaagctcttttacgccaacgcaaaaaaaaaaagcctcgttggccctttagcctctaaatgccaataactatctactggcgtggcttagtttataccgttggatcatttgtttatcccagccgttggattcgaagcagttgtcgggcttgtgggccttttctttattgttttgttttcataataatgaaagaaaataaactaaaaaagtattttttatttttccttttatggtgattccatgatggcaaaaacgtggccatacacgtgggtcgtctcgtggcacctttggaagatacgaatcggtagtgaataatggacggttcggatctttagttttgtcgacagaagtgctctccgcgtcggagatactactagtcaaaggtcttttcttccttcgtattttaccataatgtcccttctttctaatcaaatttttatcatgtatccaaattattcgaagcaatattctatataataaacaaatatgcccatcggtaagtagcaaaagttaaattgtgtttattttcatgccatacaaaaataatgattctgaaaattcgttggaaagattgtttagttttcttatttttatgttgcacatgacttcactgacgtgtgaatgtgatgacggattttgaagaggattatacactatggtaaatatcgactataaaaataatctaaacatgagggaagcgtagagcgactagaaatcgaacacgtgtacggtagagatgacataagaaatggctggcactaaactcgatgagccaactcatcaaacaccaccgtagtttacgctgttatatattctcatgacacgtgtctgatgacgtggtcatcgtcttggcgctccgttttttttctctctctctcgcgtctcccttccctcaaaaaaaaaaactgaactctttttcgctctggtttttttagagagagagaaagatgaaaatgcgtttaattgctgtttaggtttcgaattcgcgatttaaatttctgggtttctctctgtttaagcttcttcttcttcatcttctgcttacgtttcttcttcaaggagctttcggattcttgtaggtattgcgtaacttaaatggttcaaatagagattgtttggtcgaatagttttgtgatttggtttctctatcattcattgatcttctaagttttgtgaaaattttgccatttttgatcgtttgcttttgcatttacttgaattgaatgaaaaattataagttttgaatttgaacaaaaacagctaaagcgtagagaagaacagagtttctttttttgggtgcatgtgattgtttcaggggtagaattgtccagtagtgtctactttgttgattccttttgtcttcctgaaagttttctgaacataggatgtgagagagaaatactattttacccttctctgtctctatatttctcacacaacaacacccatccccatgattttgcagaaagagtcattgttctcttgagtgggaaaccttgaaaccattcct

SEQ ID NO: 12497 - DNA, 3000 bp, Unknown
  misc_feature (1)..( 3000): cDNA_ID_2994378_gDNA_ID_2214555_Annot_ID_185700 3000 nt of promoter + ATG
cagggaagataatcatcgtactctcaaggataagctgatggaagctcgtgtagaaagtcgacgtttacgttcttctttgaaaccagagtgataattccggttcgagcaaataattaactcgtgtcttctcatgtatgttggattaattatttggttgtggttaatattaatgctcgttagtcgttaaaaaaactaaatattttaattgtcccagtgacagaaaccaatttcacatgaaaaaaggaaaaagctaattttgtcaacagttcacatatattgacattgaacacaactccggttcgacaaaaaaaaagaacacaactccggtcaactatttttggcagttgtaattaagaacaaaaagatgtaacttaaagaagagacaatttaaccgattagttcaaatctttggtcatcaaaaattccacaagttttaagaagactgattggtgattaataaacgttaaaaaaaaaaaaaaagccaagtcaaagatgtgtcggtaatagcgattgaccaaactctatctgttttagagcatcattaatggtagtttcttagcataattttaatatagtttttatgaatatttttataattgattttgaaaattctgaagttaaaaacttggttaagagattgaaatttaggcaatatgcaatggtggaatcttaacttggagttcttaaaaagaaaatttgaaaaaaaaaatagaaacattataattttaaaaaacttaatagttattacaactcataaaatttaaaacatacatgacataaaattttaaacaaatatgacaaacaattctatttaatacttaagttatctaaaaattaagattaattaaattaaaatattatatttaagacctaatttatctaagaattaacttaaaaaacattagatttggctcttatataagagctattcttaaccattaattgaattataacattaaatttaagatctactttatctaaaaactaacctaaaaaactatcaataatgatggtcttacgaatgcctagattctcttcaatatacaaaaagtacggtttagttattgtttggacatttgaaatctaactaattctctttttagtcttaatgcaatggaattgcaaatactccataaaccatagtgttgcaccctaaccgtatctctctctaaaagagaatctagtcaacaagattatgtttaatctctaattaatgacaataagatttactgccaaaataaataaataaataataataataagatttactgccatttattcttctatatttttcaattttttatttacacttgttccataatcgtcccaaggagtagactagggttgatgctctttcatctataaaacgacttaacacaacatgttctttcacatcatcatcataagcctcaacaatccatcaccatacatattagattctccctctttccatagtttatttttggttcgttttattgtaaaaagatatcaaactctttttgggggacattcgttcttcaagtgtaacagaaggagctcccttcctccaaaacgaagaggacaagatttgaggaactaaaatgcagaatctaagagttcatgtcttcctcatagagagtgcgcggtgttaaaagcttgaagaaagcacactttaaggggattgcacgacctcttagattctccctctttctctacatatcattctcttctcttcgtttggattgaagggagctccttttcttcttctcttaattagtctctgttcttcaaaacttggtttcgatctaacttgttttctttttctctagtgcattttttttttcaggttgtcatgtttatttgcaggtgtttgtggttgatgcttgcatggaagcaatattaatgttgtttatttacgagaagacgttcgtgtgccaatttgaaaatatgatattaatggaaatacagattaaaactgacaaatgtataaatatttcttgttccttgttttaattttaacattagtcgtgtgtttgtcgtaaatacgaaggggacatttcacctaaaaaaagaaaaaaatatattcatcaaaactggtcttggatacgtttttagttaaaacaagaacaataataaagttaggtttaacttcgatcagatcgaaacaagtacactataattgttttggtttgagaaaatataccatcgatggtttcaagaaataatagcagctgggttgcttgtagtcgatacgttaagtcgtatcatctcaaatgatccctagtagtacacaacatagtcaactggtttgtcatgtgttggcctacgaagaaatgtataccggccggatttcaatttataaattagtccttttttttttgtcaagttatcattgcatagccaagtttcactcggtcaaaatctaattaacaaagtctgtaaaacgttgaagtaattgtattttattaaaagaaaactccaaattagactttgattccaacgaatatttaacgacataaaaggcattgccgtttgttgaacgagttgtcttcttaccaaatttgacgctttccaactaaatacactcctaattttgcctattacctttttcctcctctaattaagtaaatgctaaatttcccccaaatactaaaaatcgaatccgataagtcaaaatcaaaatcgtacctacgcgatttatgcaaaataccggaaaaagaaccaaagtgcttattacaatcaaaagaccaaaccggttaaacaattagttaggctggcattaacgaacctctttgtctttaattagcctttatccgtcaccgccctgttaccataaccgttcaacgtcgacccgctctttgtttcagaaaaaaaaaacagagaaagacttttttagtgtttctttgtcattttcgttcctcaaaaaaaccttttcgaatttgacccttattgttatcctgattcttctgctcggttctcgccggagagaagacacggagaagagggttttcgaaaaggagg

SEQ ID NO: 12498 - DNA, 3000 bp, Unknown
  misc_feature (1)..( 3000): cDNA_ID_3025428_gDNA_ID_2214555_Annot_ID_185699 3000 nt of promoter + ATG
tggaaaaatctaaggagactaagatcgcggctccactgtcctccaagaaggctgaatcaaggactgttcctgaggcttgtaatgtaaaatgtgaagacgcaaacgcagaaatgaagatggctgagggaagcctaaacgcattaagaacagaaaaaggatcagttgagagcaattctaatcttcaagaagaatcaaacggtgagattattaaaccttgtgaagctaaggagaatagagaacagcctgcaaagaagagctttacagaagaggaagctgctagaattatccaatctatgtaccgtggatatgacgtgagaagatgggagccaattaagaaattgaaggagatagccactgtccgtgagcagatgggagatgttaaaaagcgtattgaggcgctagaagcttctactgatcagcacattgaagagaaggagattgttgttaatggagaactggtgatgaaccttcttttgaaattggatgctgtcgaggtaatgcatgaaagactaatttcattggttggccgagatagtttatctcagtatgtactgctgtgtaggatttttgctgacagtttcctatactgatgtttatcttccagggattgcatcctagtataagagagttcaggaaagctttggccacagagctctcaagcattcaagacaagcttgactccttgaaaaatagttgcgccagtgcagagaaagaggctgtaaaggaacaagtggaaattaaatctcagcctagtgactctccagtgaacttggagcactcccagctcacagaagagaacaaaatggtatctgacacgaatttagagaaggtacttcgtctgtctcccgaggaacatcctatgagcgtcttgaatagaacagatgaaaaacaggctgaatcggctgctgaaacagaagagggatatggattgtttgaaaccctggcaacggattctaagcaagctactgaaaatgcagcggctgcttcctcgacaacaattccagagaaaattggagaggttgagactgttgttccgggtaatccaccgtcagctgatggaaacggaatgacagtgaccaacgtagaggaaaacaaagccatggtggtggaaagtttggaggagccaataaacgaattgccgcaaatggtggaagagactgaaacaaactccatacgggacccggagaatgctagtgaagtctctgaagccgaaaccaactcatcagaaaatgaaaaccgaaaaggagaagatgatattgtattgcattcagaaaaaaatgtcgagctctcagagctacctgttggagtgattgacgaggaaacacagcctctttcgcaagatccatcgtcatcatatactcgtgaagggaatatgactgcaatggaccctaaaacagcgagccaggaggaaacagaagttgatcactcacccaacaactccaaaggcattggccaacagacttctgagccacaagatgaaaaagaacagtctccagagaccgaagtcattgtgaaagaacagcctctagagacagaagttattttgaacgaacaggctccggaaccggaaatcactgaacctgggatatcaaaagaaaccaaaaagctgatggaggagaaccagcgattcaaggaaacgatggagacgttggttaaggcaggcagagaacaactagaagtcatatcgaaattaaccagtcgggtcaaaagccttgagaagaaactgtcacataagaaaaagacacagatcagacgtcgtgcaagcaaaccaatgtccgtaagtccaaccgatgccgtattatgacccccataaacattgatatgtctcaattcctcatatattgtatccatctccatcctattgagtacagaaaagagaacgagaactcaaaaattgtcttaacgaaaatccaaatatttgcctctctgttttcttcgacgttcatggataacctccttaaacgacccattcgctctgacagattcgactaaattttgtgtcaaggcccaatatataactatataaggcccatacaatgatcaacccattagttatttcaaatgtttttattatttatttcaaatttttgctataggtgtaaatttcatgtattattactttaattacatttaaaatttgtatctttcaaatttgttatgggagaaagaaagagaatgattgtgtggtttgtgcggacatagtgatccttttcatgccataactcactcttcgttttcttctttctcatcgtcacgttaggttgtctctgagccgccaaatattcatctcttgtggtcccgttcacgtcccaacgccatttacactcatctccgtaacctctctcttatgtgctttctcattacaaacaactaaaattctcaaagattaacatgtgcaagagaaataacaagtaatgatatgatctcattctcacctaatctatggttgaaaaaaaggaaatggtgtcagtattagtcataataaagccttggagttgtagactatagcatgaaaggaccaggaatcttcaagcatggttattttctgatacgaatgatttatattttaatcgtttattaacacccatttaacctcataatgactctattagcctactctcaatccccaaatttactagcataattaactaattcaagggattatcttcacccacttgtgtgcatccatcaaaagttaatttcttatcttagaaatacatttcatctaaaccaaacaaatgatatacactctcatttctattcattagtgtcatttctacaattgtagcagtatgttaactactgtaactattgtgatccaaatatacagtaaaaggttgcacctctactgtaactattttaacaagttcgcaaaatgtacataggagaaataggttgatttccatggagaaaagaaaatagtaaaaggtgaaaaaggttcactcacacgcatcctctgtctctgagagatatatttccccttgcagtaaataaaaatct

SEQ ID NO: 12499 - DNA, 3000 bp, Unknown
  misc_feature (1)..( 3000): cDNA_ID_2712184_gDNA_ID_2214555_Annot_ID_185698 3000 nt of promoter + ATG
atctggagtgttccatctcttaggtacgagaaacagggagtcggggaagtatcaaacatagcatttcttcttagacaactcttgccaagagattgatgatatacattgaaactcatgcaggtgatgatgaaaacatagcaaacaagaagcctttggctggttctcaggtctcaggtgttcctgctgcatccactgcccataaggtaaaaaaatttagaacacatgaaactaatctttcatgaatcgggcagttcatgtagaaaaatgcaactggattagtaagctgtgtatttgtaatcatggttttgatgagacaagtttgtgattcaacaggatttggaggttccgaaacttctaactgcacacaggtcacttgataacaacccgcgacgagagatcattcaagctcctgtccggacaaagagtgttctttctgcgttctttgttaaacagaaaactccaaagctcaaagctggctatgtctcgtgaaaacaccaactctttgtactgagaaggaaatttcaatctcataccacgtttcttttaccttatataataacatgttgattttcatgtaattatcttaatcaccacatcaacgtacgaagtccagtaagacatgattttggtctatcattaacaaaactgtgtaatagattaagaatgtgtttttagaatgtaaaagcttaataaagatttctgttgagttattaattaacattgtatcaaattaacaacagagaaaccaacatagagaacaaaatggctcacaacatagccattccaactcagttgattcagcgcgtaaaccgataccaactcaggcttgaggcttcagggcttcatggaattcataaggtctctaataaattatcagtaccttggagctgcaccaaaaaaaaacagccaaaggttacaaaagcgaattcacatagtctaataccatagtagcagtagattcagatgtctcagccggaagatacatacctccaccaagtgtagcttcaggcaacttctctattgagtacttgcgattagtcacatacatgatgggcacaccaggaatctgcaaacaaacatagaaaaaagttgataatatccaaagacttcagccatggatataaacaagagcactgatacaacaaactatctttacctttcgaatccttcgctttaagtctctatcacatgtagccactatgaagcatttatgctgtatattatgagaaatgaatattacagaaacatacaaaagataaaatgtatacaccaagaaccatgggaccagagcatcggtatatcatttcagagtcttgaatacaaagttcaacaagccgggaacgatgtattacctgagtaactctgtcaacgagacagtcatcagcatatgtccctttgtgtatacaaggtagtctttcgaagtgaggatctttcgcaatcctaccaaatattatagtaaaccaattacgaatccacgaaacaaaaccataaacagaaaagccttgttcaaaaagtctaaaagatttaccttagagctacacgatacttctgacctaacttctctaactcagccatgacacaatccgtgatacaaggagtgccttcaaaccagaaacaattacaggtggttaacaagagagagaacctatatagacctatcaaaatctttaagtaactcacaatttgcgtacagacagtctctcattcccttctcaagatcgatctattagatacaccagagcaaaataagtcaaaaaggatttcaaacaatgagagattccaatcaggttcaccaagactataaactctacaaagatcgatacacattctgattatagctctgtgatagagaaatgcaattgaagatgaaccgaccttattctggatagagaagttgatgaagttagtatccaccaaaacacggtaaggaggaaccaatgtagagttgtaagaaaagaaaagccctgcaggaacactcggtctgatccaaaaacaaatcaaacgaaacccaaataattacaacttggcaacgaaagctaacagtggtaggaagcttacacgtttctcggaagttccgtgaggtccttcttgtttggattcagaacctcttccttgtaactatataaataaaaacaaaactaagaatctctttaaaaaaggatcaaatttgaaggaagacgaatcgtttactcactgcttcaaagctttgtggctaatcatcttcttcacgacagcaaacttttgaggtttctttgcctttcccatcttcgaagcaaagagtaacaaaaaccctagaacgacgcagagagaaagactgggaagctgaatatgcgaggtctgaatcggcggaggctgagaagtggttttcgaattgggtatcagagacggagactaacgctcaatatacagcctaattataagcccaataataaaataaatgggcctaatttatatggcccataagcgaagcgagtttcttaaatcacgtgttagtaaaggttaagaaacgaagagaaaattccagatttttcaaagtgatgcgagaatgatctggagagcagaagaaatatcttttccctctgaacgttgttgttcgtctttctataaatcaagaaatgtctttggattgttcactacccatagaaaaagctgcaatcatctgaatcagaaagtaattcgaagaagaaatctgctttttttaattggtggagagagtgagagagcttcgcaggaactgagtcatcggaatttacggatcgtttctgtttcgtgtaagctccgtcattttcccttcttagtttaatgaatagctttgagaatcttgagttcattgctcttagtttaatgaagatgcgattgatttagtttggcagattttggtgattgtggtaacgaaataattctgaatgaaccaaattcacattgtatttttctaatgatatatggatttgggtatttgctgcagttttactggaattggttaagtgatcttgattaaag

SEQ ID NO: 12500 - DNA, 3000 bp, Unknown
  misc_feature (1)..( 3000): cDNA_ID_1031360_gDNA_ID_2214555_Annot_ID_185696 3000 nt of promoter + ATG
actccaccgaaaaacccgagcttttgaaccaaattgtttgagttcacgtcaatgtaaagttttatctggaagggttcatgcttattatacaacaaatgaaagaacattttgccaaatgaatttggagtttaggaagaaaacaaaaaactagttgggcctctttgaaaccgtttcatacacacagatataagtgaggcttcctataattatttttgtaatcaaattataataatgaatgggctttacttaaaggtacgtgaagccctaaccataaatggaccgtcatataatttcaattttgggataatcatcagaaccttcaacgagtcattgtcgttgaagaattgaagatgacaagtccgagaatcgttatccatgcggacttgaaaaattatccttaggagatttttcctgacctatcctcgcgtcgcgccttcttgtcttctctctcaatccagcatattcctacgcaaatcccttatcgttttcatgtttgtcctggtttaaatcttcaatctcctacccggtcttttcatcctccgatggcattccttgttcgttcgccggagatacccaccgtctcggcgagaatcttctccgatgcgaattcgagtgttattagtcatgtgtttatgaggaggaaggctacggtttcggcgattgacgccagagatttgcctggtgttaagaatccgaaatcgagattgtactggcaattctcagctccggtgaaagaagactacaagattagcagagaggaggaagaagaagaagaagaagataagcagagttactacgtgaatatgggtcacgccgttcgtagtatcagagaagagtttcctttgttgttctacaaagagcttaattttgacatttacaggtttgatgaagattctcgatttaaattgaactgctctttgattagctttctcaaagaatctttttgcttcagagtcatgcttatatcccaaatttgatctgttcttggttaggtttcttagagaatgatctgttttatcagttggtgattagctctttctcttgtctaatttcgcagggatgatattgttttcaaagaccctatgaacactttcatgggaattgataactacaaatccatatttggggccttacgtttccatggaaggatcttcttcagagcactatgtgtggacattgttagtgtttggcaacccacagagaacactctgatgatacgatggactgttcatggaattcctcgtggtccgtgggagactcgtggtcgattcgatggtacttctgagtataaattcgataagaatggcaagatttatgagcataaagtcgataacatagccattaattcgcctccaaagtttcaaatgctcactgttcaagagcttgttgaagccattagctgcccttcgactcccaagccgacctactttgagttcggagattgattcatcatcatcgtctgaaacatcatgctggtgttatgtatactagtagtcttttgtgtggttataaatagagtggtactgtaatatagatgaagaaggaacgatttaaaataaacccaatagcatgaatacattacacgctttttttgcgtataataatcaataaaacgcctatatgtacataaatttgtaaaataacagtatagcatcatgatacataaatatgttgactttgattactattatattttgattcaaaaatattgacaagtcactgcaactccatgaggcaccgaaactagtaagcctggttgtggaacttggtccacgaagtcgtgttgacggtagatgtcaaaaagagttgacaaggcagttaagcaaggtgtgaagaagttgaatttcaagactaaatgtaagtacaaccatagctactttgaacatttcttgcctttaccgcaatctcctcaagcgactgagctacaggcttgaaattaaattcgagcaactcgtacatttgtgtatatccatactttgacaaaagctttttatttatagaatatgatttatacagcctacatttgtgtatatccataatttaatcttaaaaaaaacgcatatttttctaaatagaaattcgaattatataacatgaagacaacattggcacaaaccaaagaaaaaaacttgtttggtcatttacggctgtcttttaattcacctgaacagaatcattgaaagcaaatggcaaaaatgatttgtaagactaaagttggggccaatgatttttgcccagtaaaaccatgatggacccatgggcctttgcacgtgcaggtccgttttgacagctagtccacacgtgtggatctcatgtgaatgaagctggcttaatgctgacgtgtccgccagcgttactttttcatgcaacttgccggagtcaattataaaatccagttgaccggtccttttggcaaggctagttccgtcatttcaaatcctatagatccacctccgtttactttaaatgcttgcatagaatctaaccacaaacacataaataatttaatgtgttatcaacaaccgcaattaaagcagcatatacaaagacatgtgattttttttacgggagtatttttaatgtatactcgacaaaaatattaagttaatgtcctttcaaattatgctgtattaattttgtaattcagaggtatcttatagtatgatcaaattattaattaatcttgtttttttatgtgttcataataacttatttaagagaattatattcaaaaaaaaaaaaaacatagtgcgtctttcccaaagtcgttttcttctatacaccttttttaataactctggaagcaaaaatggcataagagtcctttggatttggaatcgcttctacttcactctcaccttcctcctattctctctctctttctatgtcaagttagcttagccgtctcaccagaaagctaaccttacctcacaaacattgattgtgttacactaatctcttaaatagagagccgtaatttctacacactctgatcgctag

SEQ ID NO: 12501 - DNA, 3000 bp, Unknown
  misc_feature (1)..( 3000): cDNA_ID_3025436_gDNA_ID_2214555_Annot_ID_185695 3000 nt of promoter + ATG
ccctcttaccagaaaaccccaaaatccagcgatttcagttccacaacctaatgtgagactcagcaacgaaaacaaaaaatatggatatatggaagttagcttatagattaaaaaatcactaccaacatggaagttgataatcgtgagactaactgagacttacagatagataatttctacggaggagactttgccgagatccgacgccggcaaaagcaaaacagagcgcgcgaggttgagaagatgcttatgaaataattgggctttaaatttatacactttggcccattaggaaaaatataagcccatttaaaaggttttgtatccgccactaaagttcattgaatcacaaaaataggatgctaatttttaaagtttagaactaacagtacttttccactttttcctgcttttgtgattttattctgttattgacaactttaaagttgctcttgaggatactctagtttttctgagtcaaccactaaaagaaattgatagacccacccaaactaatgacaaattgacatattaacatgtaagacaaccttgtcaaatgtcactggagttttcctctaatcaacaattccatttatagagttaaaaggtaattaaaaccagtggattttttattgcttaaccatttaaaacggttctaaaaataaaacacaagtgtcaaagattcgaacatcgattccaaaacagtaaacaaacaaaaaacacacacacaaatataaggaagagaaggcgtagaatcgattcagaatctgtgaattacgaatccatagagagaaaggttttgcatttgcaacctttctcaaattgggttctgtgcatttccttgcactttggataataggaactaaatctctttctctggttcatcaatggcggatcaaacgaagaagagatacgttacaagcgaggatttgaaaaaacacaacaaacctggagatttatggatttcgattcaaggtaaagtttacgacgtttccgattgggttaaatctcatcccggaggcgaagcagcgattctcaatctcgccggccaagacgtcaccgacgcgttcatcgcttaccatcccggaaccgcatggcaccacttagaaaagcttcacaatggctatcacgtgagagaccaccacgtgtcagacgtctcacgtgactaccgtcgtttagccgccgagttctccaaacgcggcctcttcgacaaaaaaggtcacgtgactctttacacactcacgtgcgtcggcgtcatgctcgcggcggttctctacggcgttttggcgtgtaccagcatctgggctcacctcatctccgccgttttactcggtctcctctggatccaaagcgcttacgtcggccacgattccggtcactacacggtgacgtcaaccaaaccgtgtaacaaactaatccagcttctctccggtaactgtctcaccggcatctcaatcgcgtggtggaaatggacgcacaacgctcaccacatcgcttgtaacagccttgaccacgatccggatctacaacacatcccgatcttcgccgtctctacaaaattcttcaattcgatgacgtcacgtttctatggcaggaaattaacattcgatcctctagctcgattcttaatcagctaccaacactggacattttacccagtaatgtgcgtcggaagaatcaacctcttcatccaaacattcctattgctattctcgaaacgccacgtcccagatcgggccttgaacatcgccggaattttagttttctggacatggttccctctcttagtctcgttccttccgaattggcaagagagattcatcttcgtcttcgtgagcttcgccgtcacggcgattcaacatgttcagttctgtttaaaccatttcgcagcagatgtgtataccggtccaccaaacggaaacgattggtttgagaaacaaaccgccggtacgcttgatatatcgtgtagatcgtttatggattggttctttggtggattgcagtttcagttagagcatcatttgtttcctcggcttcctcgttgtcatctccggacagtatcgccggtggttaaggagctttgtaagaagcataatctaccgtataggagtctttcgtggtgggaagctaatgtgtggacgattaggactttgaagaacgcggcgattcaagctagagatgcgactaatcctgtgttgaagaacttgctttgggaagctgtgaacacgcatggctaaaaaggtgtttcgtttgtcgagtactttttaattagattgaactgttttaggtgtaactctaccgtgataaaaaactacatatttattttgattttctgctgagtttataattttctaatcgctaagcctaagaatctatttttgataaacaaatttgtcagacatgcgtgcttgttctacgtttaagacggatcgtgcgggtctaatatacatgacaaagtactccaccgaaaaacccgagcttttgaaccaaattgtttgagttcacgtcaatgtaaagttttatctggaagggttcatgcttattatacaacaaatgaaagaacattttgccaaatgaatttggagtttaggaagaaaacaaaaaactagttgggcctctttgaaaccgtttcatacacacagatataagtgaggcttcctataattatttttgtaatcaaattataataatgaatgggctttacttaaaggtacgtgaagccctaaccataaatggaccgtcatataatttcaattttgggataatcatcagaaccttcaacgagtcattgtcgttgaagaattgaagatgacaagtccgagaatcgttatccatgcggacttgaaaaattatccttaggagatttttcctgacctatcctcgcgtcgcgccttcttgtcttctctctcaatccagcatattcctacgcaaatcccttatcgttttcatgtttgtcctggtttaaatcttcaatctcctacccggtcttttcatcctccg

SEQ ID NO: 12502 - DNA, 3000 bp, Unknown
  misc_feature (1)..( 3000): cDNA_ID_3025450_gDNA_ID_2214555_Annot_ID_185690 3000 nt of promoter + ATG
gaaaagtgcatttgaacgcactaagccgatacacacatatctctgcttttggaattttcaacagtggtgttgaagttcaagtagatcattataagttcaaaacatcacagataacttgcaacaattgctaaattcacaaatttccccgtcaaaatgtatatctaatctaactaatacaattagagtaaagttgaatcaaacgaattgtggggaagatgattgttgagctattcaattgacattgaatcacaactgcccatctgccccaaattaatgtcgcagagaaatctttcgtacaaagcgcattacatcgcactaagccgatacacacaatctctgcatttaaacaaaaccaacactgaaacttcatatgaaactagctatacaccaaaaaacacaagagaacccacgaaaacgtagatcatcaaagagctcttggagattcaatctacgaaggttaaataaattgttagagaagcctcatttcatgagtttactcgcttccctgctgggtccttcgcttttgcttctaatcacattctcatatcacaagaatttaatcgaaaaccaaatccataagggatgaaaaaccgaaatccggaattgaaaacacagatctcggataaatccaccaatctccgattatgaatttccgaaggtaaacttggcttgaatacgcattgattaaagcgtttcacccataggtccttcgttgcctaatttctaaacatgctacaacgaatacgatgctcagcgaatacgaaccataatattatcggacatcaactcgcgagacgagatttgtcccacgatctgtttatttccgatattaactcttcatcgcatcgctcgataatcaaagatatttataaaaaaaaacgtatttgaaagctaagtaaagttgccgaaacggcgaggaagaagatgagctataaaccctagatgagctgtggaagtaatagaaaatttagataagtttatatagagcatctattatttagggttaatgcgacgtatcatagccgttagaattctaaatcaacggatgtggattaggcccatctttgtgatctggacgtttattcaaaaagcctatctttgtgcaatgaatctcattgtgtgagtgaggcctatattgggccttaatggtaaaaaaatgtcatggagaattcacaatcgattttaaacatttttcaacaagtaacaaatcatatataggttagtgccatgactactagttactaactagtacctctggtgatgggttatttcactcgtcgttttatttttggatttgagtttgggaaactaaaagtgaataataccaaactcgcatctgaactccaaagtcattaccatatatataaattctcaaaaagacactgcaaaatgcttaaacacatgtgaaagattttatgattctcttcaagtatcgtcgaaatcaattaagctttcattcctccaaaaacttcttaagatgtttcaaccataccacgtactttcgcgtgcctgtcgtcatgtacttgtacaaggcaaattttgggctataatcaaatatcatacgcaaataactgtgtctgtaatccacgtttctgcaaaaggccatgaaagaaagaaagaaagaaagaaagaaagaaaacaagattaattataacatttctgctgtgctcatgcctatctgactatatatacaaacattatggtgttttcttattcacaaagcttacttggaattagacaacaaatcacacggccgttgatcctcccaataattcccccgactaatcacagatacaccattcatggaagtaccattaagaggaaaagccgtgcacctaaactcgaggctgaggccactgatcttcttggtaaaattcacagttagtggaaaacataatccatcatattcttcatagggcatacctgctacaactacaatatattcctcttggtagtctctagtcaatgtcacagtcttacctccatcatcttcaattgtgtaagggtttattcctggagtcggctcatcatcctggaagcatattaattatcagtaaacttagatacttttattgcaatgtaagaaaggagcagagtccaacgctagtgggaataataacatatatgattatagaatgaacaactttaggtggtataaagccagagcagagcatataaagaaacctaaaccattactattagttttggaaggaaagcaaaatgcagaaatatttacaaaagcgagatcatggagttgcaaagcagaatagatctcggagtcaaatcaatcggagaagcatttggttggagctctggcgatcatcaatagccgtcgaggaaagaaagccacgagagaccatgggacgcggcggagccaaactcacaacggcggagatagataggaatcgaccacaaacggaagcaagcttagatgctgacctgcaccaagcgaaaaccatggtcggcgattgatttctctctacgaaaatggagttttaaggttttttagttccaaataaatatttatattcttatgattatttagttccaagccaacatgtcatcacttatagtgttgaagttgaatttctatcataaggaaacaaaagattttagggctgcaatcacttgatctccaagctaacgtatcatttcgtgaagtttagatagagcatgcattaatgagacgtaatcatagccgttagaattctaaatcaacggatacggactaggcccatatgtttgatctggacgtttactaaaggcccatctttgtgcaatgaatctcagtgagtgagattgggccttagttataaaatagagccacaggtaacccgacccgtccgataagttgacccgacaattgaaatcatgaaaatcatattggtgttgttgttactccgatctacgataataatcttacagaggaagattcttgtctctttgataaattctcggagtaggaggaatctctgactccttcgggcgagttgagctatg

SEQ ID NO: 12503 - DNA, 3000 bp, Unknown
  misc_feature (1)..( 3000): cDNA_ID_1807601_gDNA_ID_2214555_Annot_ID_185689 3000 nt of promoter + ATG
atcatatgtactaaaccgactcgttgtagattagttagtacgcgttggctaactggtcgatttaacaatttcattcatacaattttgctagtttaaccataacccattgtttgctttagttgtaattttgtatgatctagatacaagaaatacatcgttttcctacgatcttcgtgattagtttacatactcattaatcgtgaccattatcagtttttcaaacctcgggtccttagttagtacgaaccccgagccaagagtgtttagtaaattgtagtgggaagccttgaattactcaaatgtaaccaaaacgaatatcaacgaaacatgacaacgaataagtgtaaaatattttcaaagaggacccatcaaacgaatattgttaaacagtcaacgttacatggctcgaacacattttatacaataaacaaaaaaaattacaaagtaaaacaagaaaatatattattccttggggttgggccacttaattaataaaaacctaacttactaataaatgcaaatttcagtttccaaacaatattaaatgcatcagctgcaattcccacccacctctttttctcttcccctaactaaattaattaaaattaaattttcaaaaaaataaaaaaataaaaatctctatcactctcttctctctctctcccacatggacccagtcttcttcttctttaccatcaaatgtcaacactcgcctcctccgcctccgtcttcctagtccaccctccccttccaccgtcgccaccacaagcaggcaaccactcttacctcacaactctaggctttggctactccatagccatagctctcggttttctcgtccttctctcgaccgtccttttatcctcatacatctgttgccgtgactctcgccgccgcacaaccgccgtggaatccacaggcgatcgtggcggaagtgtaatcctcccccgcataatctttgtcgccgaggaagacaatgaagatctcgaagcaggtgatgtcgtggtgggacttgatcaagccgtcatcaactcataccctaagttccacttttccaaagatacctccgccgcgtcctcagatggctttggtggcggaggagacacaacgtgctcgatctgtttatgtgagtataaagaagcggagatgctgaggatgatgccggagtgtaaacactacttccatttgtgttgccttgatgcgtggcttaaactcaacggatcttgtcccgtttgtcggaactcgccgcttccaacgccgacttcaacgcctctgtcaacgcctttgtcagaagttgtgcctctctcccagtacgcggccgatcggaggagagcaagaagatgatattattattacatagatccattcgcctaaattagggtaattcctatttattatttttgctccgtttcattacaactttactgatttgtaattaaaaaaaatccgtcaaaagtggagtttgccattaatttcatcgaaatgaaatctagtttgaatcgtttactaaccttacaaaatttatccttttctattggcgtttttgaacgtttttttccgtttcccctatcaatatgagcggttcaaaataaaatacgcgtccgtgttgtgtaacttaaataaaagagtttgagtttgaacaaggcaacttacttttagttttttgttgttttttggtcaagggtcggaaactaagtttagttaaaatattagatttgttgaatgtcggaaatagatgtttctaaagttgggaacaaaaagagttacgacttaagatagtatagttttttttattgcatagcgagtacagaagatgaattcaacgtcgtaaactcgtaggtccaaatgttggtcgagttaaagtgtactctaggacaacttttctaaatgaaattaacatttttatagataaaatgtttttgtttatatatatcacatgtgatttttgtttcaaactaaccgatcacaacatacctatgtttgaagaagcgttgccttcaagcaattctgcatttcttctacgtgacctggatgtttctggttcgatgatagccgaaaactgttatatttttcgtaaggcgcacgttagtcacacgaatcctaaggaaggttggttggtgtgaacactttatattaatacatttgaaaattatggttagtcaatatatagtcataatgaaatgcgaatgtgttatttgacttacactagtccacaaattcgctttttcctacacggcactatcctgtggagcgtagtggtaatatgtttttgtaattaagtaattaacctcgctttgattttgatttattctctttctagcaacttgtatataggatacataattagatgtatatcacctacggaatgtaatagagtttagcattattacattacatctgaataataaaaaaagcagtagtagattaatacatgttaaaacttaaaataactcgacctatcaaagccgcttacttaaagagagagttacgtcgtgagcttgtatttttatttttttgacggcccagtaatatattaaaagcccaaaggcaaacattatagaaggccctcttaaggggatacaagcgaaattacgtcgtgagctttaatgcttcatcataattaagtttgagccgtaaatttcgctatacgatatgggacacgtgtcgtgaatctactcgtggtatcggttacttaatgaaaaggcaccattcaacgttttcttccttatcgttgcctacacgtttcaaggctctgcttctccgtcaattaacgtccgttttcgtcatcaaaatactaacgccgttgatgaccttatttaaaaattaactccgaaccacgacgttcgggttttggaacctcaggctcgtggttataaaagtcttgtgtgaaacctattatatttgccattgcttaatcctctcctctccttcacgttgagatatttttgagttttctgtgttgaattttggggaatcgaagaaattgaatttcaaaaatca

SEQ ID NO: 12504 - DNA, 3000 bp, Unknown
  misc_feature (1)..( 3000): cDNA_ID_1807856_gDNA_ID_2214555_Annot_ID_185683 3000 nt of promoter + ATG
ggcactcttgaggatgtaagagatctggcagatagggatggattgagagtaaggattcttgacggagaccttggcgtgataatctactccatcacgtgtcacgcctttgaaatcaacgtcgtccacggttgcttccggcgtcggaatattcgccagcttctccgcaaagaaacctttggctttgtccaacaagcttgaaatcaccgaagccttctcttccaccaccttttcatccgctgatgccattcttttttttttttttttggtgttgtttcttcaaaggatcagatctctctttgtctctctctctcttttctaaagtttatggcgctgtcggttctatatattttggtacctcttttaaggatgataaataccttaattgccggagcgtgacatttttgatttttctttggttgttggaaaaggaataatataataatttttccatcattagaaaaggaataagatcctttttttagagcatcatggtcataacgtgcgttcttacttctttgctcgtccgaaaaaaagatgaaacatgtttattatagaatatactacaattatattttgtatattatgacttttaaattagcaatatgttttaacttttaagcaatatcctaaaaaattaattattagttgttttactattatgaccaattatttttaatagattttaacattatcaaaacttaaactttaaagatatttaacaactacatgttgagtagtactactttctaaacattaatttttggtaaataatcccaagaagatgaaaatataagagattattttatcttcctaaaattagtcaaaacatatatattttataattttaaagattatttgagatttagaggtatacatacttaccttcccattgattgcatttgcttaagttgaaaagtggatttatatatggaagaagaaaaaaaatatgaaaatgtagtttttttgtttcttcttttaattcggcaatccatatttattagtacactttgtggcttcaacttcgccaagacttgttcgcttcttattttcggtgactatttaaggatgctgatcaaaacttgaaagcaattcatgtaatatatcggaactgacttcgtacatgtgacatgtctcattgacattgttcatcgtgtaaataaacaaaacaataatcactcacgataagccaataggtttattcaaacgaaaggaaactgatttggcttgagaaaaatctatggaaaccaaatccggttttattcagtttaccagacgatattgctctatgcctctctataatcatcacgtggtaatcgttttaccggaatattacaattgatttgtttttttattttggttatatgcttaaaactgatttataatcaaaacgagattgcaactatgaacatgcaaacatatatgattacaatgctttaatttgctccgttatatgaaccatggaacattagaccatctccaccagtaaaaataaagaaagtttctcaaaaacatattaattaatattttaatcaaaacagatacattaattattatttaatagttgaactaatagtgtgattacacctgtccaatcatccgagaaatttaactctccttctctcctactttttctcccttctctcatattttttttttaattttttttcttttgttaggtatctcattgagatacttccattggagatgctcttagaacgttaatatatatacaaacataattaggtgaacttagagaggaactgcaattgatgaagaagaggagttagggtttgcatgagctcctcacaaggatggttatggattccttcataagttgtctccacaatgctcgtctccttcgacagcctctgaacttgcttcttcacgttacacatgtgttgtgtgcatctataatagctccttttgatgatcataagtgagaagaaacacacaaaaaaacaatctttttaaaaacaatttcagattatttatgttaaaaagtttacctgggatacaagctgttcttgacggatttctgaccgtactttctccatcgataaccatcatcgagaatatctgcatcactctttgtgcgaaacgaaaatcgcggatttttcatcttcttatctcgagaagagtcgacgaggccattcattaatgaagaggagatatgatgaatcaacgaattgtgtgttagaattcttcgtgtgatttatattgaagagatatataaaaaggtttagaagccaactacattcaactacttcagaccaacaacaacaaaaaattccttcacgtcatctcacacgtgtgtgacttaaaaaacagagacatggtttggtctttacttgaactcctggaaactgtaaacagtagaatccggttttggtatcacaatgcgcaatctcataaaaaagaaccgaagctacgatcttaaaggagctcgtgcagaaccctcggatgctctccaactccaagagagttccaactagtaaccgcgatctcaatctctacatttctctatctaaacccagaaacggaaaaataaaaaaggaatcgcctttggaacagaagttcaataagatcgaaacagagactgggttaggctagagcctagagagaaacagagactgggttaacataaccagactgaaccaaaatccggtttaatatagtaaagatattttaaaactatctccgttgccgggactcgaacccgggtctctcgggtgagagccgagtatcctgaccagctagactacaacggatcttgttgatttcgttaaaatattgaatttatagttaagctatcacaattcctaacagtgtcattgctatgcttgatttgtgtgtgaaacccagaactgaatcgccacttgccagaatctaaacagcgtcctcactcactaggaattgaatcttcttaaaagtaaaattccttgttcttgtaaacacagacacagtcacagataagagggtttcttcatcttcacaacaatg

SEQ ID NO: 12505 - DNA, 3000 bp, Unknown
  misc_feature (1)..( 3000): cDNA_ID_2712215_gDNA_ID_2214555_Annot_ID_185681 3000 nt of promoter + ATG
ccgtgaatctaaagatcatgaaagattacatacgtgtatggtaacaagaagcagagtcactcgatattagctcaatattgcatttttcatttgttactactaattgcacttaactatagatcaaagcctctgatttgttcctttgattgaaacaggtttagaaagattggatcactacaaagagagcagtgattttttcaagccaaacagatgtattctatatttatattttattgcagaattgatttcatacagtcacacatacaagaccaacacacctaaacggaagagacaagctcgacagatggactcaaaacaaagaaaaaagagaaaacactatttatagaacctaaagctgccttttgtaagggttaaacttgtttgtttacctcactattttagtctacatcttctccaactgcattgccagagattgagtcacttgacctaagattacagagcaacacatcgcgccctctcaaagtcagtttaaagaaactatcaacttcctccagtaactgatccaacccttgagacaatttctcagcttgtgtccccaattccataacattatctttgaagaattcaacttcgacaggatcaacgccatcttggatcatcgggtatagcttctcgacactagcatcaacgctctccagctctttgagaatcgtggttctaccggaagacaacatgtctctgatctcagcatttacaacactctgcatatcagtaaagacctttgcccataatggtttttcagagacaggtaaatcgaaaagatccttggtggaatcagaccaggctgcggtaaatacactgcagatataaactgtttgaaccttcacaccataaaaagctcgcatcagaacctttcctttaggcgagttcttgactttaggcagactcagagatttaacaagactgtctagaaccgcacggcagttttcaattctagggttgtttgtattaacatgttgcctccagctatcaagcgaagatcgagcctggagatacttctccccagaatccgattgtaaattgtgcagaacacacttgaggaagagatctccctggttgagacgtgtgagctcagagctaaaggcattacagagatctagtaacctaacgcttatgttgaggtaaacatcaacccatttctcttcccaatcagagacaggaagctggagatcagtaatgagagtgttaatgttcttatgagtctcgcagagtgactccatagctagcttcatccaggataaagtgaggatgtcatctttgttcttaggcataagtttcttcagtctctcttccaaacgtagctcaaagccgttcaatagagaaagtagccatggcgataaatctgatccctttgatgataacatccgaaagggatttccaaatgggaagaaacctcggggtggatcttgtggtcggctcattttgctagacacctgaaaatgaaaagagaaatattgttagaataatgataatgattaatcatacaaaccgatttgctgtgaactcaatgtatcttctgtgttgttgccacacatagaaggactaatcgaggaacaatacaatcccaagtcccaaccttaagagtcccaaaaagctgacaacttttgagatcttgaaaaaaaagaagttaccacctttattgaaatgatgtaaaatcaaaatttgaagatgaaaacaaacacataatcaattgttctaagccataatctacacttgaagatgtccagaaccaaggaattaggataaaagtttcaatctttccaaaattagaagaaccctaggagttaattatctacacggaagttttgaacacagaagttcggtacaaactcttcatcgaacagtaaaatctatcttagaactaaacacacaaacttcgatttacagaagaacacacacaataaaaggagaattatagataacaaaaaaaaactcaatttccacgaaacttaccgttttaagtcgccggaaatgaagaaatcacagggaaaatcgtgtggaaatgattcttctaatgcttcattgaattttctgagtcgatcggctgagaaaaatgtctggcggaggtcgagtttgataaagctacggcccgtcacataaaaactagttacaaccttacaagtataccattagtgaatggctgttacgttttaattggtcacagccttgtgtgtagttaaattcttagcggaaagtggacggctataaaataattaaaagttttatcgaagggccaaaaatgagacgatttcgtgggattataaaataagtcattggtcgattggcgtagtctttgtttattttaattattataaccaaatctaacggctaactaatacataccacgtcctacagactcctgttattacttttaaaaataaaaactgagaagatttaatcgaaaattaattttgacgattcattattatttttggtagtactttgctttttaaaaaattgtaaaatcctcatcaaaaaaatttcagcaactgtgaatattttttaaaaggcataacaactttatttgttttacgtaacgaattccttggatttgcgtaaaacatgggcctcaaagcccaaatgacagctgtcaaggaacaaatcggtcgacaaaagtatggaccccacttttaatttacatccggacaaagactaaagagctgtctttatctcaatcgtttttcttgtttctttaagcccattaggtatagctacctcaatttatgggccatcaggtccaaagggcatttttcccaaaagattcctaatcgaattacgtcgatattgaataccttattgactttgagacaactccaccattgtgctagataaaataggcctttttaaaactttgaagataaaaaacggcccataaacgttgtgaaaaagcctctcgctgaaacagaaggtctctgtaagtgtctaatcgcgcgatgaacttgataacggcgatgaccggagctaaattgcggccataca

SEQ ID NO: 12506 - DNA, 3000 bp, Unknown
  misc_feature (1)..( 3000): cDNA_ID_2709020_gDNA_ID_2214555_Annot_ID_185679 3000 nt of promoter + ATG
gcgattagacacttacagagaccttctgtttcagcgagaggctttttcacaacgtttatgggccgttttttatcttcaaagttttaaaaaggcctattttatctagcacaatggtggagttgtctcaaagtcaataaggtattcaatatcgacgtaattcgattaggaatcttttgggaaaaatgccctttggacctgatggcccataaattgaggtagctatacctaatgggcttaaagaaacaagaaaaacgattgagataaagacagctctttagtctttgtccggatgtaaattaaaagtggggtccatacttttgtcgaccgatttgttccttgacagctgtcatttgggctttgaggcccatgttttacgcaaatccaaggaattcgttacgtaaaacaaataaagttgttatgccttttaaaaaatattcacagttgctgaaatttttttgatgaggattttacaattttttaaaaagcaaagtactaccaaaaataataatgaatcgtcaaaattaattttcgattaaatcttctcagtttttatttttaaaagtaataacaggagtctgtaggacgtggtatgtattagttagccgttagatttggttataataattaaaataaacaaagactacgccaatcgaccaatgacttattttataatcccacgaaatcgtctcatttttggcccttcgataaaacttttaattattttatagccgtccactttccgctaagaatttaactacacacaaggctgtgaccaattaaaacgtaacagccattcactaatggtatacttgtaaggttgtaactagtttttatgtgacgggccgtagctttatcaaactcgacctccgccagacatttttctcagccgatcgactcagaaaattcaatgaagcattagaagaatcatttccacacgattttccctgtgatttcttcatttccggcgacttaaaacggtaagtttcgtggaaattgagtttttttttgttatctataattctccttttattgtgtgtgttcttctgtaaatcgaagtttgtgtgtttagttctaagatagattttactgttcgatgaagagtttgtaccgaacttctgtgttcaaaacttccgtgtagataattaactcctagggttcttctaattttggaaagattgaaacttttatcctaattccttggttctggacatcttcaagtgtagattatggcttagaacaattgattatgtgtttgttttcatcttcaaattttgattttacatcatttcaataaaggtggtaacttcttttttttcaagatctcaaaagttgtcagctttttgggactcttaaggttgggacttgggattgtattgttcctcgattagtccttctatgtgtggcaacaacacagaagatacattgagttcacagcaaatcggtttgtatgattaatcattatcattattctaacaatatttctcttttcattttcaggtgtctagcaaaatgagccgaccacaagatccaccccgaggtttcttcccatttggaaatccctttcggatgttatcatcaaagggatcagatttatcgccatggctactttctctattgaacggctttgagctacgtttggaagagagactgaagaaacttatgcctaagaacaaagatgacatcctcactttatcctggatgaagctagctatggagtcactctgcgagactcataagaacattaacactctcattactgatctccagcttcctgtctctgattgggaagagaaatgggttgatgtttacctcaacataagcgttaggttactagatctctgtaatgcctttagctctgagctcacacgtctcaaccagggagatctcttcctcaagtgtgttctgcacaatttacaatcggattctggggagaagtatctccaggctcgatcttcgcttgatagctggaggcaacatgttaatacaaacaaccctagaattgaaaactgccgtgcggttctagacagtcttgttaaatctctgagtctgcctaaagtcaagaactcgcctaaaggaaaggttctgatgcgagctttttatggtgtgaaggttcaaacagtttatatctgcagtgtatttaccgcagcctggtctgattccaccaaggatcttttcgatttacctgtctctgaaaaaccattatgggcaaaggtctttactgatatgcagagtgttgtaaatgctgagatcagagacatgttgtcttccggtagaaccacgattctcaaagagctggagagcgttgatgctagtgtcgagaagctatacccgatgatccaagatggcgttgatcctgtcgaagttgaattcttcaaagataatgttatggaattggggacacaagctgagaaattgtctcaagggttggatcagttactggaggaagttgatagtttctttaaactgactttgagagggcgcgatgtgttgctctgtaatcttaggtcaagtgactcaatctctggcaatgcagttggagaagatgtagactaaaatagtgaggtaaacaaacaagtttaacccttacaaaaggcagctttaggttctataaatagtgttttctcttttttctttgttttgagtccatctgtcgagcttgtctcttccgtttaggtgtgttggtcttgtatgtgtgactgtatgaaatcaattctgcaataaaatataaatatagaatacatctgtttggcttgaaaaaatcactgctctctttgtagtgatccaatctttctaaacctgtttcaatcaaaggaacaaatcagaggctttgatctatagttaagtgcaattagtagtaacaaatgaaaaatgcaatattgagctaatatcgagtgactctgcttcttgttaccatacacgtatgtaatctttcatgatctttagattcacgggtcccttgagagatcttttacagttgaaaaaagcttctctcttcacatg

SEQ ID NO: 12507 - DNA, 3000 bp, Unknown
  misc_feature (1)..( 3000): cDNA_ID_2712226_gDNA_ID_2214555_Annot_ID_185676 3000 nt of promoter + ATG
ctgccaaagcatgtgtgcttggttctgtgggcattgaatttaaaacatcagaagcctcgtcgatgaaacctgctcgaccaagaagatcgatcagacacgtgtagtgttcatcctctgcttctatcttgtaaaactcagtcattcgtttgaagcaacggagcccttcttgaactaatcctccatggctacaagcagacagaacctctaaaaaagtgatcttgtctggttgaagtttctgcagcatactttcaaacatttgcaagctttcttctgcgaatccatgagaagccaaagctcctatcactgaagtccatgaaacaagatcaggttctcggatcgaatgaaaacataaaagtgcttcagataaatttccattcctggagtaggaacttatcagagaattagcgaccgacaaaaaatctgctgagccctttttagtaaccatcgcttgcacttgcttaatctcccaaattgcagaaaatttggcgcaggaacttagaacacttgcaaaggtaagctcatctggttgaagattctcaaggagcatttgaccaaaaagtctcatagcttctcttccttctccattttgtgcaaaacctacaatcatcgcattccaagacactacatttctcacaaccatcgattcaaaacactcccgagcatcactcaaatggttactcttagcatacatattcagcaatgcagtcgccaccggaatgtcgaattgatatgacactttgaagagaatggcgtgaatctgcttcccttgttcgatcctgcatgcactgagaagactcgagaaagtaaaataatcacccctgaatctgtttttgtcagaacccatcagcttgagtaaaccaaaagcttcatcaatcataccgttaagaacatacgacgaaactaaagcgttccatagcactaaatctctatccaaaaccgcctcaaaaactcgtcttgcttctacaatgagaccacatttcccatagaaatgaactagactagtactcggaaagcaactcgattcaagaccttgtttcaccatcagacagtgtaattggataccagctttcatattggtcgaatcagtacacaaccgtatcaaccccatgaacgacacatgatccaaactcacatcagtgaaaagaatccgactcaaataacaaaaacctagatgagctctgtggttggtgtcaccgtctcgttgaatgaccccgtgaatcagtatgttccaagtaacaatatttctcaaaggcatttcgtcgaagagcttatctgcatcatcgaattctctgattttcgtgtaagcttgcaagagcttgttttgaagaaacagagaattgtaaatcccttgttttaccatgaaaccatgttcttgtttcacgtcagagagatgatccaagctagcagataacttcgatacagaggatatagctacaggtgaagaagaagaagaaggaatggttctaatgttttgcaaggatgataagtggttctgatggttcgcaaggaagatccgagttgatcggaggaatgtaaaacgcatctctcaaacaaaaaaaaagagacggcgtggcgggaaaattggttttacatcactgtaataataagtgactctatctatattctataagagttgaatttttttatatctattttcataactgatgatataaattttgcattagttaatataattgacgttaatatttacatcatttgtaaataattgatgttaaaattagtatcaatttaattaagtgatttttaatattaagataaattagacgattaaatcttttagaagtacatttgaagttgtaaaagcattgaaacttgatttgataaaattaatcaaactgaaagtttcttaagctatcatcacttcttagcgagttaaaaagaatatattaattatccaataattatatttaagactttaacagtattttttcagaaattaagaagtaaattaaatattctattattattcttctaaagaagcagtcttaaatgactattcaaattttccattattgattaatagccactcgaacccagagctagctggttctccccgaaatgcgttgatttaaataaaatagaattaattttatattaaaaatgtacatcaaaatcttaaaataaaacttattttgcattataaaaataatctaaacatgttacaaggccccaaaaagagccaataaaaccacaaggtgcaacctctcaatgtctcttgctttttggtttgcaaaaaaaaattaactcaaccagtggtgggttaaataattaactagagttaaaacgtcatatgacagctaatatatatttgatggtatgggtctctctctctttcattttccaatgagtctctttatatataaaccgtcgtgctgcttcattcaataaaacccattttgtctacattttcttaataccagcagaaactacagaaagaagatttatataaataaaaaaattactagacaaaaaggttagtgattccgcaatattataatctaatcctcttcgtttgcaagtttcgtattttcacattgtttagtaaccctaattttgggggaaaattagtttattcgattttttgaggaataagggtctgtatctgtgggaaatttgatttttgaccctaaacttcttcttcggtcaccatccatcgaaacccaaacctcgaaagagagagagagaaatggcgggccaaggggaagtggggaagccggtatagggttttgccaaagggaaaaaacttccttaaaatttcgattttttttatgtttcccgcttaaaaaaaccctaattccgccatggaatctctgaggtcttaatcgtaagttcgtgattctttagttccttgatcttcttgggatttcatttttcgtttctctttagattactgcttcttcttttttttgttaggtttgttagagataacgagaaatgggatctgttaattgttgtagggttcgtagttcgttgttaatg

SEQ ID NO: 12508 - DNA, 3000 bp, Unknown
  misc_feature (1)..( 3000): cDNA_ID_3025463_gDNA_ID_2214555_Annot_ID_185675 3000 nt of promoter + ATG
gatcagagtgggtatcttatggaagtgaagagccatggaaacaacttcttctgtttagggcctcaagaacaaacaatgattcagcttgtgaaaagacttggcaggtgggtatataggtacagttattccataatctgcagttactggtattaaaaaaaaaaagcctataggtagatgcaccaactttcctccttctatgtcgatttgaaaattcgttattgattttaactgtggtgatgtgaacttttgcctgtagaatcatgaattgcatgtgtcattgaagcattctaagaagttactagtagaaaattctccatcagattttagcagaagaaactcgattcttcataatgtccgcttccctgtatccaacaatgaactttctcgatactgtctcactgtacttagactgtgaaccatgtgattgaaatagaatctaattagtctgatggtgattgtttgtcagtactctctgatttaaccactgttcttccatgtttatgccattcaagtcttgataaattgctcatgtgtttcagaaagtccagaagatgcacccatgcctgtatgatgatagtgctggagctagttacaatctaagagagagactgagttacgaggattacaagaggggaaagactgggaatggctcggatataggcagttcagatgaggaggatagaccatgtgctctagttgggtcaaagtttcaagctaaagtaccggagtggactggcataacccctgaaagtgattcaaagtggttgggcactcggatctggccactgaccaaagaacaaaccaaggctaatcttcttatcgaaagagatcgtattggaaaaggaagacaagatccttgtggctgccataatccaggatctattgaatgtgtcaagtttcatatcactgcaaaacgggataaactgaaacttgaacttggtccagctttctacatgtggtgttttgatgtcatgggtgaatgtactctccagtattggacagacttagaactgaagaagataaagtctttgatgagttctccaccgtcacttagcccagccttcatccatcaggccaagatgattcttccttcgaagagcagaggaaaaattgtgagctacttctacaacgtgacccttttgcagtacagagcaagtcagagtagaataacacctcacgatatagacagtgatactgatcaaatattcctccgcgcaacagagaatgaaaatccagcccccgaagcaaacacatttcagaaacccgccctgctttcgcctaataaaaaaagatgtcgatagagctatcacccggttgagattcaagtaggagcagctcttttagttttcttcgtttttggggcttctattgccattgaaactgctttagactctgtggggaaaaggcttcataatagcatcttcttagcaaattctggttttagttttgaggtaaatacttgcatctcttccttgatgatcctacagtaggattcctttttgttggcattgcttgaaatgctttgcggaaactggtgaatcagagagatgatttctatcagtacagtgagagaaatttggattagtttggtgaatacaacagaggcaaaatgtaattgctatatgtttttttttctgtttttttccaaggaaaatgaagaaatgagtaaatctctcttgttattaatcgagttctcagtttcatgatttcgactataaccccctcatcacaagataaatttaaacctttacacgagcaaagttaatcataaattcaaagattggtagcttattgggaggttatataacactactaaatgatttgctatttttacttagagaagcataaaccattttctgtatcaaataaatgatattttcttttgaaataatagtgttaaggattttgaagaaataaaaattaatttagttacattgtacaatgtgattttcttcaggaattcttattttttaaaaattaagttaaacaattaaattcagagatactaattagttcatattgtagtttagagagaatacaattgtatttaaaccaacaaaactatgataagatttgttgggtcagatattggaaaaaggactaaaaattgtcatgatgttttgggccaatgattcactcttcggcccataaaggaacccatgaaaaatccagatcatcatagttatcccacgcgcatgtaaatcgcgttgttaaaagcgcccgtttttcgcagtctaacccctacggaaattggcctaaaatcaactgaatccaataatttggagtccaagggcgcgtgagctaatattctcttcttttctttctttatcgtttttttttttttttttgcttaaacgatatttcatgcctaattactctttaaaacctttttccctccaattttctttaaattactgatcattattttatttgtcgcaactaaatttttatctactgaaattagtaatggtattattctataaagctaaaccgtgtatgttaagagattggatagggttaatgcatgtggacacgttactcatttttcatttaaaaaaaagacatgtaatttgttgtcctcacgtctactatagtcgtaactcccgtaagtttatggctcacgtttctcttaaaatcattcattcttttggttataaaatactattgagaaatgataattgtaggataagtcccaaccccaccatcattttccttacaatatcatccgttgttttattgtaataaatcatcgatgtccatttttatattttatcgtagtgtgttcatgtttggatttgaaaatggaatatttatgacgacaacaacaacaacaaaagaagaaaatgaaatatattagtcaatattaactaaatgttctttcacatagacttatattgaaaaatataatatatgtccattttgatttttaaaaaagtaactacagtatatggaaagtagattaaaggattaacaaaaagaaaagataaagataaagcaatg

SEQ ID NO: 12509 - DNA, 3000 bp, Unknown; identical to SEQ ID NO: 12489
  misc_feature (1)..( 3000): cDNA_ID_1387805_gDNA_ID_2214555_Annot_ID_185672 3000 nt of promoter + ATG

SEQ ID NO: 12510 - DNA, 3000 bp, Unknown
  misc_feature (1)..( 3000): cDNA_ID_2712226_gDNA_ID_2214555_Annot_ID_134749 3000 nt of promoter + ATG
tggattctcttttctcatggatgttacatcctcctgtgaaagctgccaaagcatgtgtgcttggttctgtgggcattgaatttaaaacatcagaagcctcgtcgatgaaacctgctcgaccaagaagatcgatcagacacgtgtagtgttcatcctctgcttctatcttgtaaaactcagtcattcgtttgaagcaacggagcccttcttgaactaatcctccatggctacaagcagacagaacctctaaaaaagtgatcttgtctggttgaagtttctgcagcatactttcaaacatttgcaagctttcttctgcgaatccatgagaagccaaagctcctatcactgaagtccatgaaacaagatcaggttctcggatcgaatgaaaacataaaagtgcttcagataaatttccattcctggagtaggaacttatcagagaattagcgaccgacaaaaaatctgctgagccctttttagtaaccatcgcttgcacttgcttaatctcccaaattgcagaaaatttggcgcaggaacttagaacacttgcaaaggtaagctcatctggttgaagattctcaaggagcatttgaccaaaaagtctcatagcttctcttccttctccattttgtgcaaaacctacaatcatcgcattccaagacactacatttctcacaaccatcgattcaaaacactcccgagcatcactcaaatggttactcttagcatacatattcagcaatgcagtcgccaccggaatgtcgaattgatatgacactttgaagagaatggcgtgaatctgcttcccttgttcgatcctgcatgcactgagaagactcgagaaagtaaaataatcacccctgaatctgtttttgtcagaacccatcagcttgagtaaaccaaaagcttcatcaatcataccgttaagaacatacgacgaaactaaagcgttccatagcactaaatctctatccaaaaccgcctcaaaaactcgtcttgcttctacaatgagaccacatttcccatagaaatgaactagactagtactcggaaagcaactcgattcaagaccttgtttcaccatcagacagtgtaattggataccagctttcatattggtcgaatcagtacacaaccgtatcaaccccatgaacgacacatgatccaaactcacatcagtgaaaagaatccgactcaaataacaaaaacctagatgagctctgtggttggtgtcaccgtctcgttgaatgaccccgtgaatcagtatgttccaagtaacaatatttctcaaaggcatttcgtcgaagagcttatctgcatcatcgaattctctgattttcgtgtaagcttgcaagagcttgttttgaagaaacagagaattgtaaatcccttgttttaccatgaaaccatgttcttgtttcacgtcagagagatgatccaagctagcagataacttcgatacagaggatatagctacaggtgaagaagaagaagaaggaatggttctaatgttttgcaaggatgataagtggttctgatggttcgcaaggaagatccgagttgatcggaggaatgtaaaacgcatctctcaaacaaaaaaaaagagacggcgtggcgggaaaattggttttacatcactgtaataataagtgactctatctatattctataagagttgaatttttttatatctattttcataactgatgatataaattttgcattagttaatataattgacgttaatatttacatcatttgtaaataattgatgttaaaattagtatcaatttaattaagtgatttttaatattaagataaattagacgattaaatcttttagaagtacatttgaagttgtaaaagcattgaaacttgatttgataaaattaatcaaactgaaagtttcttaagctatcatcacttcttagcgagttaaaaagaatatattaattatccaataattatatttaagactttaacagtattttttcagaaattaagaagtaaattaaatattctattattattcttctaaagaagcagtcttaaatgactattcaaattttccattattgattaatagccactcgaacccagagctagctggttctccccgaaatgcgttgatttaaataaaatagaattaattttatattaaaaatgtacatcaaaatcttaaaataaaacttattttgcattataaaaataatctaaacatgttacaaggccccaaaaagagccaataaaaccacaaggtgcaacctctcaatgtctcttgctttttggtttgcaaaaaaaaattaactcaaccagtggtgggttaaataattaactagagttaaaacgtcatatgacagctaatatatatttgatggtatgggtctctctctctttcattttccaatgagtctctttatatataaaccgtcgtgctgcttcattcaataaaacccattttgtctacattttcttaataccagcagaaactacagaaagaagatttatataaataaaaaaattactagacaaaaaggttagtgattccgcaatattataatctaatcctcttcgtttgcaagtttcgtattttcacattgtttagtaaccctaattttgggggaaaattagtttattcgattttttgaggaataagggtctgtatctgtgggaaatttgatttttgaccctaaacttcttcttcggtcaccatccatcgaaacccaaacctcgaaagagagagagagaaatggcgggccaaggggaagtggggaagccggtatagggttttgccaaagggaaaaaacttccttaaaatttcgattttttttatgtttcccgcttaaaaaaaccctaattccgccatggaatctctgaggtcttaatcgtaagttcgtgattctttagttccttgatcttcttgggatttcatttttcgtttctctttagattactgcttcttcttttttttgttaggtttgttagagataacgagaaatg

SEQ ID NO: 12511 - DNA, 3000 bp, Unknown; identical to SEQ ID NO: 12506
  misc_feature (1)..( 3000): cDNA_ID_2709020_gDNA_ID_2214555_Annot_ID_134752 3000 nt of promoter + ATG

SEQ ID NO: 12512 - DNA, 3000 bp, Unknown; identical to SEQ ID NO: 12505
  misc_feature (1)..( 3000): cDNA_ID_2712215_gDNA_ID_2214555_Annot_ID_134754 3000 nt of promoter + ATG

SEQ ID NO: 12513 - DNA, 3000 bp, Unknown
  misc_feature (1)..( 3000): cDNA_ID_2712213_gDNA_ID_2214555_Annot_ID_134755 3000 nt of promoter + ATG
gagaagatttaatcgaaaattaattttgacgattcattattatttttggtagtactttgctttttaaaaaattgtaaaatcctcatcaaaaaaatttcagcaactgtgaatattttttaaaaggcataacaactttatttgttttacgtaacgaattccttggatttgcgtaaaacatgggcctcaaagcccaaatgacagctgtcaaggaacaaatcggtcgacaaaagtatggaccccacttttaatttacatccggacaaagactaaagagctgtctttatctcaatcgtttttcttgtttctttaagcccattaggtatagctacctcaatttatgggccatcaggtccaaagggcatttttcccaaaagattcctaatcgaattacgtcgatattgaataccttattgactttgagacaactccaccattgtgctagataaaataggcctttttaaaactttgaagataaaaaacggcccataaacgttgtgaaaaagcctctcgctgaaacagaaggtctctgtaagtgtctaatcgcgcgatgaacttgataacggcgatgaccggagctaaattgcggccatacaatgctacgatccacttgctgcactccactttgccctttcacggcgaaacaaccttctttccttaggaaacagcaacgtattacctctgatcgcttcacctttcgcggtggtggtggtggcgatgccgccgccgtcgtctcctcctccggcctccgtgatctcgttttcgtcgtaaaccctcaaggtgtgtttgcccttttactcactggatgaaaaaaaactgagattcgaaattcattggatttaaaaatgatgtttttaatatgagaatcaatctcgatgtggaattgaggtttagtattatcgtctcttgattcttttcaatgtcttttatatgagtctaggtgctaatggtagaacagctaaagaatggaagaagttgcttcctcaccttcgatctcgtcttggtaaagactgtaatgtgagtttttgattcacttgcctttttgtgcccctgtgttagtgatgccatctcctttcgctttcttcagttccttcaactgagtttacgtgtcttcttgtttgtttctccaggtaagtgaattattaacatcgggtccttctcatgccattgacattacaagagaggtaaggagtagtgaaagtaatatactactttgctgggtacagtattctctgtcttgtcgatttggttttatgatgatcctctgttgcttctaattatcctctcaggctataagggatggtgcagatgctgtcattgcggttggaggtgatggaacacttcatgaggtaggaattgccatttttggttgctagaactgcgctctggagattcttagctccactcattctgtcctttttttttttatctacaggttgttaatggtttcttttgggaggggaaacctgtcggttatctcagtggggaagctagtcgatcgactgcacttggtgtgagtagcttgagttgactttttgacttgtttttgtgtatatctcttgtggagttacaacatacaatcttagtccatcctttttattttgcagctgattcccttaggtactggctcagattttgctagaacatttggttggttagtttttgcaacttctgtttgttgtgtttttttgaaacttatgttgagccatatgttaagtgtatcctgcattctttaggaacaatgatccttgtgaagcagtggagcgcattgctagaggtatgtcactgaattcatttgaggagttaggacttagttactactgaactgtctatctatgtctcatatatcacataaccagcattttctcagggatgcgatcacggattgatgttggtgttatcgacaaggaaggaaaggatttgcattacttcatcaatgtagctgatgttcatttgtaagcatatcgtggaaattttcatctgtgattgatccctaatgatgcaaggttgtaaatctgtccttttgttgctcattacttgcaggagcgcaaaggcaggattttacgcttcaaaatacaagaaatttggaaacttgtgctacgtaattggtgccctacaagcgttcatgggccatcataaccaagatatgagaatcagagtaagcaaatttttttctgcgaaatcccttctgcaccgtagcaagtaacttaaaagcattctgttattttctcaggtcaatggaggcgaatgggaaatatatccccaggtcactgctctctgcgttggaaacgcaaaatactttggtggtggaatgaaaatcacacccaacgccatccctggaaatggaaatcttgaggtgcaactattcgttttcttcaatctcaaatcctatgttgggaatatggtagctcttgagtcttgacttcttccctgtaggttgtggttcttcaaaacttcaaatggtatgatttcgtacttaaacttcataagctgtacaacgggactcatctttcggttaacaatgtgacttcaagaaggtaatatttttctttggcttcttctcattttgtcctttaaacgaccttagcactagaaaagtcaccacctttatgctacctctcttgtagtgtacaaagcatcgaagttgaagagattacagacagtggaagtatctatgtgcagtcagatggagaacatcttggattcctacctagaaagtttcaggtgttacccggtgccatagacataatcagctgatcaaaaccgcagatttcttaggataaacttgtcaagtaaagtgtagaatacttcaactttatattcttcctgtaatatgattcattgtttagcgaatcagatttatgctcgtgttacttgtgtaactcgttactatcactatttattgtgtggtctctgttaaccacaaatagatactttaaaacattttaaagcaaaaagtcgcatctcctaaatcaatcaatcacacaaaattgaatcctaaaa

SEQ ID NO: 12514 - DNA, 3000 bp, Unknown; identical to SEQ ID NO: 12504
  misc_feature (1)..( 3000): cDNA_ID_1807856_gDNA_ID_2214555_Annot_ID_134756 3000 nt of promoter + ATG

SEQ ID NO: 12515 - DNA, 3000 bp, Unknown; identical to SEQ ID NO: 12503
  misc_feature (1)..( 3000): cDNA_ID_1807601_gDNA_ID_2214555_Annot_ID_134761 3000 nt of promoter + ATG

SEQ ID NO: 12516 - DNA, 3000 bp, Unknown; identical to SEQ ID NO: 12501
  misc_feature (1)..( 3000): cDNA_ID_2712188_gDNA_ID_2214555_Annot_ID_134766 3000 nt of promoter + ATG

SEQ ID NO: 12517 - DNA, 3000 bp, Unknown; identical to SEQ ID NO: 12499
  misc_feature (1)..( 3000): cDNA_ID_2712184_gDNA_ID_2214555_Annot_ID_134768 3000 nt of promoter + ATG

SEQ ID NO: 12518 - DNA, 3000 bp, Unknown
  misc_feature (1)..( 3000): cDNA_ID_1985415_gDNA_ID_2214555_Annot_ID_134769 3000 nt of promoter + ATG
gagcagatgggagatgttaaaaagcgtattgaggcgctagaagcttctactgatcagcacattgaagagaaggagattgttgttaatggagaactggtgatgaaccttcttttgaaattggatgctgtcgaggtaatgcatgaaagactaatttcattggttggccgagatagtttatctcagtatgtactgctgtgtaggatttttgctgacagtttcctatactgatgtttatcttccagggattgcatcctagtataagagagttcaggaaagctttggccacagagctctcaagcattcaagacaagcttgactccttgaaaaatagttgcgccagtgcagagaaagaggctgtaaaggaacaagtggaaattaaatctcagcctagtgactctccagtgaacttggagcactcccagctcacagaagagaacaaaatggtatctgacacgaatttagagaaggtacttcgtctgtctcccgaggaacatcctatgagcgtcttgaatagaacagatgaaaaacaggctgaatcggctgctgaaacagaagagggatatggattgtttgaaaccctggcaacggattctaagcaagctactgaaaatgcagcggctgcttcctcgacaacaattccagagaaaattggagaggttgagactgttgttccgggtaatccaccgtcagctgatggaaacggaatgacagtgaccaacgtagaggaaaacaaagccatggtggtggaaagtttggaggagccaataaacgaattgccgcaaatggtggaagagactgaaacaaactccatacgggacccggagaatgctagtgaagtctctgaagccgaaaccaactcatcagaaaatgaaaaccgaaaaggagaagatgatattgtattgcattcagaaaaaaatgtcgagctctcagagctacctgttggagtgattgacgaggaaacacagcctctttcgcaagatccatcgtcatcatatactcgtgaagggaatatgactgcaatggaccctaaaacagcgagccaggaggaaacagaagttgatcactcacccaacaactccaaaggcattggccaacagacttctgagccacaagatgaaaaagaacagtctccagagaccgaagtcattgtgaaagaacagcctctagagacagaagttattttgaacgaacaggctccggaaccggaaatcactgaacctgggatatcaaaagaaaccaaaaagctgatggaggagaaccagcgattcaaggaaacgatggagacgttggttaaggcaggcagagaacaactagaagtcatatcgaaattaaccagtcgggtcaaaagccttgagaagaaactgtcacataagaaaaagacacagatcagacgtcgtgcaagcaaaccaatgtccgtaagtccaaccgatgccgtattatgacccccataaacattgatatgtctcaattcctcatatattgtatccatctccatcctattgagtacagaaaagagaacgagaactcaaaaattgtcttaacgaaaatccaaatatttgcctctctgttttcttcgacgttcatggataacctccttaaacgacccattcgctctgacagattcgactaaattttgtgtcaaggcccaatatataactatataaggcccatacaatgatcaacccattagttatttcaaatgtttttattatttatttcaaatttttgctataggtgtaaatttcatgtattattactttaattacatttaaaatttgtatctttcaaatttgttatgggagaaagaaagagaatgattgtgtggtttgtgcggacatagtgatccttttcatgccataactcactcttcgttttcttctttctcatcgtcacgttaggttgtctctgagccgccaaatattcatctcttgtggtcccgttcacgtcccaacgccatttacactcatctccgtaacctctctcttatgtgctttctcattacaaacaactaaaattctcaaagattaacatgtgcaagagaaataacaagtaatgatatgatctcattctcacctaatctatggttgaaaaaaaggaaatggtgtcagtattagtcataataaagccttggagttgtagactatagcatgaaaggaccaggaatcttcaagcatggttattttctgatacgaatgatttatattttaatcgtttattaacacccatttaacctcataatgactctattagcctactctcaatccccaaatttactagcataattaactaattcaagggattatcttcacccacttgtgtgcatccatcaaaagttaatttcttatcttagaaatacatttcatctaaaccaaacaaatgatatacactctcatttctattcattagtgtcatttctacaattgtagcagtatgttaactactgtaactattgtgatccaaatatacagtaaaaggttgcacctctactgtaactattttaacaagttcgcaaaatgtacataggagaaataggttgatttccatggagaaaagaaaatagtaaaaggtgaaaaaggttcactcacacgcatcctctgtctctgagagatatatttccccttgcagtaaataaaaatctatggctttgttgggaagaagaaaaagtcagagtaaactcgtaatctttgtcgggagagagtaacaggcttttgatgttgtaacattatactactattgttttaaaaagcaaagaattgtagtagtaagaattacaatcatacttaacaacaaatcacgtttttcgggtttttgtataaataaatgataaagcaagatggacaaattttaaggataagccattaataagtgatctgtgaatttttaaggaaaagacgaaagaaacagagagagtcgagacacaactgtctccaagaagacaaccttccacagcttaagggaaacagaggtggaaacagaggtgaaaacagagcgagtaaagag

SEQ ID NO: 12519 - DNA, 3000 bp, Unknown
  misc_feature (1)..( 3000): cDNA_ID_2994378_gDNA_ID_2214555_Annot_ID_134770 3000 nt of promoter + ATG
tcgtgtagaaagtcgacgtttacgttcttctttgaaaccagagtgataattccggttcgagcaaataattaactcgtgtcttctcatgtatgttggattaattatttggttgtggttaatattaatgctcgttagtcgttaaaaaaactaaatattttaattgtcccagtgacagaaaccaatttcacatgaaaaaaggaaaaagctaattttgtcaacagttcacatatattgacattgaacacaactccggttcgacaaaaaaaaagaacacaactccggtcaactatttttggcagttgtaattaagaacaaaaagatgtaacttaaagaagagacaatttaaccgattagttcaaatctttggtcatcaaaaattccacaagttttaagaagactgattggtgattaataaacgttaaaaaaaaaaaaaaagccaagtcaaagatgtgtcggtaatagcgattgaccaaactctatctgttttagagcatcattaatggtagtttcttagcataattttaatatagtttttatgaatatttttataattgattttgaaaattctgaagttaaaaacttggttaagagattgaaatttaggcaatatgcaatggtggaatcttaacttggagttcttaaaaagaaaatttgaaaaaaaaaatagaaacattataattttaaaaaacttaatagttattacaactcataaaatttaaaacatacatgacataaaattttaaacaaatatgacaaacaattctatttaatacttaagttatctaaaaattaagattaattaaattaaaatattatatttaagacctaatttatctaagaattaacttaaaaaacattagatttggctcttatataagagctattcttaaccattaattgaattataacattaaatttaagatctactttatctaaaaactaacctaaaaaactatcaataatgatggtcttacgaatgcctagattctcttcaatatacaaaaagtacggtttagttattgtttggacatttgaaatctaactaattctctttttagtcttaatgcaatggaattgcaaatactccataaaccatagtgttgcaccctaaccgtatctctctctaaaagagaatctagtcaacaagattatgtttaatctctaattaatgacaataagatttactgccaaaataaataaataaataataataataagatttactgccatttattcttctatatttttcaattttttatttacacttgttccataatcgtcccaaggagtagactagggttgatgctctttcatctataaaacgacttaacacaacatgttctttcacatcatcatcataagcctcaacaatccatcaccatacatattagattctccctctttccatagtttatttttggttcgttttattgtaaaaagatatcaaactctttttgggggacattcgttcttcaagtgtaacagaaggagctcccttcctccaaaacgaagaggacaagatttgaggaactaaaatgcagaatctaagagttcatgtcttcctcatagagagtgcgcggtgttaaaagcttgaagaaagcacactttaaggggattgcacgacctcttagattctccctctttctctacatatcattctcttctcttcgtttggattgaagggagctccttttcttcttctcttaattagtctctgttcttcaaaacttggtttcgatctaacttgttttctttttctctagtgcattttttttttcaggttgtcatgtttatttgcaggtgtttgtggttgatgcttgcatggaagcaatattaatgttgtttatttacgagaagacgttcgtgtgccaatttgaaaatatgatattaatggaaatacagattaaaactgacaaatgtataaatatttcttgttccttgttttaattttaacattagtcgtgtgtttgtcgtaaatacgaaggggacatttcacctaaaaaaagaaaaaaatatattcatcaaaactggtcttggatacgtttttagttaaaacaagaacaataataaagttaggtttaacttcgatcagatcgaaacaagtacactataattgttttggtttgagaaaatataccatcgatggtttcaagaaataatagcagctgggttgcttgtagtcgatacgttaagtcgtatcatctcaaatgatccctagtagtacacaacatagtcaactggtttgtcatgtgttggcctacgaagaaatgtataccggccggatttcaatttataaattagtccttttttttttgtcaagttatcattgcatagccaagtttcactcggtcaaaatctaattaacaaagtctgtaaaacgttgaagtaattgtattttattaaaagaaaactccaaattagactttgattccaacgaatatttaacgacataaaaggcattgccgtttgttgaacgagttgtcttcttaccaaatttgacgctttccaactaaatacactcctaattttgcctattacctttttcctcctctaattaagtaaatgctaaatttcccccaaatactaaaaatcgaatccgataagtcaaaatcaaaatcgtacctacgcgatttatgcaaaataccggaaaaagaaccaaagtgcttattacaatcaaaagaccaaaccggttaaacaattagttaggctggcattaacgaacctctttgtctttaattagcctttatccgtcaccgccctgttaccataaccgttcaacgtcgacccgctctttgtttcagaaaaaaaaaacagagaaagacttttttagtgtttctttgtcattttcgttcctcaaaaaaaccttttcgaatttgacccttattgttatcctgattcttctgctcggttctcgccggagagaagacacggagaagagggttttcgaaaaggaggatgagaggttccaataacaccgatctatttgaccctaagacggag

SEQ ID NO: 12520 - DNA, 3000 bp, Unknown; identical to SEQ ID NO: 12496
  misc_feature (1)..( 3000): cDNA_ID_1807355_gDNA_ID_2214555_Annot_ID_134771 3000 nt of promoter + ATG

SEQ ID NO: 12521 - DNA, 3000 bp, Unknown; identical to SEQ ID NO: 12495
  misc_feature (1)..( 3000): cDNA_ID_1018052_gDNA_ID_2214555_Annot_ID_134772 3000 nt of promoter + ATG

SEQ ID NO: 12522 - DNA, 3000 bp, Unknown
  misc_feature (1)..( 3000): cDNA_ID_2994382_gDNA_ID_2214555_Annot_ID_134773 3000 nt of promoter + ATG
ggttattgtgtatatttttatggggatctaggtggattcattttctttggtaagttgttgtaaaagaatctggggtcataatatataccaagtctttcgaagcagtttcggaagataatcaattcaaataattaagagattcgtagcgggaaataaataaggaatactataatcaaaaattaatttatatagtatgtggcgtgcattaacatgcattaatctattaatagaaagaaacaaaagatatgaaacaaaagagaaattggacttatcttattagggccacatgaacaaccttgaagacaaagcgataacaaaagaaattgccacgatatgcgttggacgttgaggcatgagatttatttgttgtaacctaattattatttgctttttggttatactacgaggtatgagttggtgtaggtaggaaacgagatggtctttgtattatcgtctacatgtttttctctctgttttattattgcatttagttgaagggaataaacatcgtgaacaatttacttcacatttgaagcagttcatgcatcatataaataaacaagataaaaacagtgatcgactctcttctccgacatttgatctagacatccatttttatcctaatcgtttctgtatagcgagaattttgcagaaacctgcagtcgtacgatagataataccaaaaatagtacattctcaactagactgtacatctaaaatattatctatcatttttacaaatcacattgaatgacagatacagctatctctctgtagtgatacacatgaggaaaaacagattaactgatataatggaattttgttatttttggacttcttatcctaattctgaaaaacaagccatttttttcgaattccacatttccacttgacattttaccaatttaggcccccaaaaatggcacaccatttcgatatctatatttttgtttacgaaacatttcagcccatatactttacgggcccattagtgtctaaagattcatacgccacctgaacaatattttcccaccaccattacacaaacatgtcgaaaatattcttaacataaaaatcaccacattacattatgtttactgcccaaataataacccacataaaatattacacacaaaataatctatctcacacaaaataataataaaacaaacactcgctaaatatgcccccctcagtgaatttgatcaaataccccaaaaataaaattaataacatgtgtggagtataaaacacgaaaaaataaaattacaaaagaaagaagataacatatctacagtaaagttacaagtatacagatgttagatcatcgtgtttttccaaatcctcgaatccttccgtcttgttactgtatagttaccctgcaacgtaataattaataatctcatataaaagtttagaaattttggatgtaattaacatcaaaaaccaaaatcctaattactgataattttgtaccatttgagtgtattgagaatgcatttaggtgaatcagtatcaagcttgttcaagctaacgccaccgcatctcaaattaacggcgagcattccgatcttaataccgccgacacctaatccaactttagtcttggcaacaacgttaatgaccaaatctttgctctgaaatttcgcagcgagtctcttagccaatcctctctccacgagctgattcttcaccgtcgtctccactttcacgctcgtcgagtttttgggaccttgtcggaatccattcatcgtcgtctctcccatcccggtctcatcgtttcccgaaccaacgctcaaatcaacggcagtgtttccgtagtaaaaaacgagtttcgagttcggattcttcatctcaacgcgggcaacggcggtggcggagagagacgcgccgtcgggatcgtcggcgagtttgaagccgtcgagacggaaggaagcgaggctgaaagtgggaagcttaggatcgaaccagaggtagaaaacagctgttccgaccaagaggaggaagatgaagagaacaagagtaatgcagatgcaacagcaacagaaacgacaacagcttctacgttttttctttggtcggtaagaagtaggcatagggacggcttttctcataggttgttgttgaatgggaggtggaggaggaggaggagaggacatgtttggatctctgtaacctggtggcttttgaagaaccgggttcatctgataatctgccatcttttttctcttaattattcacctctctgacgatctcctgataaatcgtatcaaggaagatcaaaacgaaatcttcaaaatggagagagagatgctatgatgatgatgattgcaggcaaacttggtttctaagagattttgagtttttggaagagagagagagagaagagaatgtttttttgtgttgcgttgtctcttctctctcgttaatggaagaaggctgagacgtgaggaagggatttcgttttaggcccgagactcacgcgcgccgtttttgttgctgacgtgttccctcttttttctcttcttcctacattcattgaaatattcaaatttcagttattagattagtcgattaatttataactgataatcatattgagtttgatacatccaaagtggcatgggcctacagattagatgtttaggccaggtggactctgtttcgagcccattactgccacgtggctctattcggagttatttaccaatggtacgctcaccggtttaacgattcaccacttaaagccctcaaaatctcagagaacgctcgctgatcaaatccgtcgtccttcaaccgtcgcctcctccgtcatgacaattgagtgcgttaatcccgaaggtcttcgattcaaccaagtatgtgcacatatctcttcctccgtttggtcatgtacttgtttccgattaatgtattatcttttgttctttctattgaattgatttcgtatctgtttgcaagatgaaaagctcctctcatcaaaccctagaaacgaggatg

SEQ ID NO: 12523 - DNA, 3000 bp, Unknown
  misc_feature (1)..( 3000): cDNA_ID_2712266_gDNA_ID_2214556_Annot_ID_134781 3000 nt of promoter + ATG
atacatatacacgtcctttatgtacgtgtgtatgcatgatcacatcattacttcattagtatggcttctcgttcacataattcccacgaggatcatagttgcaactgattatggttccaccattgttacacctcactttggcacatccgagtctcactgactttctccaaacaacttgagtgtagtgaccacaaactccattgcacgtgttcgcagcgtagttgtagttagccttctcgctaacccacatgttcacggcggagacgccagacaagtcaccgctaccccaggctaagttttccccgtaaggcccaccagagtgtatgagtctgcagttgcctcttagttgttctgcgtagctccgagcataggctgcaaccctctcgtcccactgcatgggacctacgcctaccgctcctcgtgcctggttgtgaacccttagataatcttgtgggctatcttgagctttcgagggaagaacaagagcacctacaagagctacaaagacgattaaaaatcgagaatagccagtaaaattcatttttctaagttgataatggttattgttgtgttatgattttggggttcgtaaacatcgcttatatagagatttgaaaactatttttttctttttttttttgttaactatagatctcacgtttttgtaaatacatggtccatgtgtgagtattttagtaatattcattgcaattgtccaaatgaatagaagttgttttcgtaactatttttttgtcaatcttgtccttacacacatttttcctaatattgtttcgtatcggtagctttgccattgttgatatatttttttagtatatatgtaagtataccctaaatgaagtttattaagaaacattgtatatagttgtttcatgtcattcagttgttttgtgttttttttttcttcatgattctaatttaagtcttctatttcaaatttgaatttcatatattacttcattcaaaatgttttgaagatatcttcctgtaaataatacagaaaaatcgtatcggacagtttggcaattaagattatatttacagtcagaaaaaataaaagtttatatctacagtcaattttcaaataaaagaaaaaaagtcaagaattatttgtttcttagtgtttcatgcatatgagtatctctatcactcttgcctatggctgaaaagtcctgaagaatatatgccgccacatctatgacgtaagtaaaatagtgacgtagagaaacagtcaatagatcacccattgagatttatccaaaaagaaaaaaaaaaaaaaaaaaaaaaaaaaagatcaccgattgacattgtatacactttgttttttttttccaaacactaatacgcagtttaaattgaaaaactctaggtgaccgatctacttttgtgttcttctatcttcagtatacctaattttgtaccgccttcgtatatcatttaccaattttgactactgatatgcactggctttaaaattttccaatcctgatatgaatctgtgattctaagcaataacatatactccctccgaatcagaaaaattgattttttaaagtttttttgtattaaaaagattgagtttatgtatatttttatcaatcaatattaaaaggttatgaatttcaagaatcaattaattgagaattttaaaatttgatgaattactattggttaatagttacgagaaatagtttagcatgaataaatagtaatttataactaagcattattatttttttaatcggtataaacattctataaaatcaaacttttttatatggagggagaatcattttataagttaaaacaagcttgtgctaacttataaaatgacaccataggatattattacgtaataatatcctatgatatcctattcaatattatatgttattaaaatataaagtaatttaagtagaataacatgttacattaggtaaacaacgtttcaatattttcaaaaaaaaactgttatcagtccaaaaattaacaaaatagtttaaatttaaactctaagttccgatcataaaccttaaactctcaaaactagaaaagactattgtacttttcttttgcaactaacaattacattttttttttgtcatcacactatagaaaagcttttaaaaagatagttgtctcctttcgaaaaaacacgaaaccaatgtaaattagaagatagttcgcatattgatttggaaaagtcagtcctaagattgatgaagcaaattagagtgagtgtttcatgaagcaaagtcagtttttggaagcttttctttggattgaataaatccccacgcgatgatatgttatctctctgcatgaaagtaatgaataaaccttttcaacaatctattaacaatgcaaagacttctaagcaagaaaagtcgtataagttttttctttttggtaaaatttagtttaaaatcgtgtccgttgtttatttgccagatggcattttctattagatttaaaatatgtcagcaatctatttaactttaatgcgaacggataaaatgagattttagcggttaacttgatcaaaatctaataaaaagttacaaactaaaatgaatgataaatgaaggttacatgcatggagaaattttttactttgtaaatgacttgctgcctaataaaaattagttatttttaatatttaaaagaaaacataatatgtaagttaataagtatgaattgtaaggaagcaaacattcttacgttttgaaaaaagaaaacaaaaagattcctacgtaagtatgtattctctttgcttctccacaaagatattctttgtataggacacaatttactttaaacacacaatacaatatgtatatatactaatcaatgatcgttatatatattctttgtataggacacaatttactttaaacacttttcatgcaatacaatatgtatatatactaatcaatgatcgttatatatgtccatcgtactcaacctcaaacatcttaaata

SEQ ID NO: 12524 - DNA, 3000 bp, Unknown
  misc_feature (1)..( 3000): cDNA_ID_2712250_gDNA_ID_2214556_Annot_ID_134786 3000 nt of promoter + ATG
aattagtatgaaatgagagagacctttgctacttctccagcatgtaaatctgctaactgagcctgaagagacagcttgtaaacatttgcttcggaacatttttaaaatcaaaatccttttattttaaaagcttcaaagaaactgactttcacacggtaagcttctgcaagctcctcttgaagattgtgtttctcccttgtgcaagcagccaacttcagttttaagctctctatttcctgctccaagctagctgtcctaatagtattacccaatatcatttaatataattgttagcaacaaggctcttattttacacatctatgaggtaaaataagttatgaagtatctttcattggctaaataacgaacttaagtcaaaccataagatacctctggaaatgcatccgagcagccacaccaagaatgctaggtccaccttgttgcatgcacaactgttcaatatctttctgtagttcattacgctctggtgataaaaaataaaaaaaaatactatgttcatactcaacatacatcaggtaatcaacctgcagatataacatggagtctcaacaaccttgatacataatatcttcaaacaagcataacgcacacagtagcaaaagacatatgatataagtacataacccaaaagagaatgagaacaacttctacaagtgatgtcttcaaatgtttcttaactcatccccatttgctaaagataactcatttctaagattataagaagaagaaataactaaaaggaatcatcttttgcatctgagaaggcagggaaatgggaaaagctaagtggtcatgagaataagaaatagctatcgtatgaaatagattggactagatgacaaactaatggagcagaatacacttcaagaaggcttcagagaagcaaatgtaagactttagaaacccatttctataagcttataaacatgtccagggtctaaataactaccacatagagacttgtagagaaaacgtaccatgttcaagttgtttgatccgagcctttagattctcattttcatctaaattaagatccataatttgatctgcagaagatcaaatcaacactatgaaaaagtaaacaacttgcttggaaatttacagactttttgagcagattttggtgcttagaagacataaaaacaaatccttagcaaaaacccagaactcatctcaaatcaacaaagaattcagatgagaccctgaaattagtttacagatcaaagcgaagtcttaaaattcaacattccaagggcaattccaaaccctaatcgagaagattgaaattgagaaaaagaaattaaaaaaaaaggatcagagagaaagtgtttgtacctttttgttcttcttcgttttgaccaaaaatgactcctttcgtcagattattatgttcgttgggatattcctcgtaattttttcaaaaccgaatttctccttaaccgaggatcaatccggtttagtaagtgttttctatcttattctttttcctaccttatctattaaaaaaagtgagatttatacacaaaacttttgattagactatttattacgtaacctataattagttctatgttaaccattatgtcattttcagttaattccctaattttttaaaaaaaaaattgtacaaaaaaattcagtgtagctatagacttatgcaaatttcttattcaagtgacagagctttgtggatttgtttggatttcttttcttatttaagagagattttgcattaataatctgatattttggttgtaaacgattgtcaaatatgtatttgttttgactaactctaatcttaggaagatatatagaagaatagttctctatctagtaatgacgttaaaatcaaacgatcatatattaatgttagaataagattaaagaaaaaaaatgttagaatatgattaagaaataagaacttaatataaaagcttgagattagaacttttgagataagcttgtgtatgataaggatttaagagaccggtgaaaggtgttagtgttttggcaattggttctatctttgcttcggttttgtcattggcaaatattgtcggactacggaccagtcagtgagtctgtaaccgtaagagtttaaaaaggctaagagaggggcaatcatgaacgtgatcaaaatatggtaccatttgagctgatggaagatgtgtggaatgataatgattgttaaaatgacttttaaacgattaaatcttacaaattcgaaatgtttctctaagcttttcatacaactcataaaatgttaagtttacatttaacaaaaaaaatattatgtttacttagaccaatacttttttgcaacccttaaataatgagaatactataataaaacctaaaatcaaagcataaaccataaactcttaaccttaaaccttaaacccttctcttgaattctttcgcgaagagaaaactctaaatcttgttattatattttgtttgtcgattaacatctgatttctttagattttgttttatgttttagccttttaggggggtgtattgaattaagaattttagaagattttggtttttatttgaaatctcttgatttcaaaatatttttccaaataatctgttattgaacatggaatttacctaaaataagtcaaaatcatttacaacttgttgtcatttataaaagtcatacattacagaaacaagaaattgaaaaatctgtcacgatctcaaaataaattatataaagataagataataaaccgatttctgttatattaacgttagtcttgtcattattacaacaatcctataaggatatatgcgttatagccttactataaaagatttaccttcaaaactattgaaacacagaatcaaaacatttagatatataagtctcattcctcttcttcaccttgtctctaagagacaagccttgtttctttcatctcatccatcaccaacaccaaacacaacctctaagacaaagtgaagaagatg

SEQ ID NO: 12525 - DNA, 3000 bp, Unknown; identical to SEQ ID NO: 12523
  misc_feature (1)..( 3000): cDNA_ID_2712266_gDNA_ID_2214556_Annot_ID_185731 3000 nt of promoter + ATG

SEQ ID NO: 12526 - DNA, 3000 bp, Unknown
  misc_feature (1)..( 3000): cDNA_ID_3025540_gDNA_ID_2214556_Annot_ID_185727 3000 nt of promoter + ATG
cgcaaactccgttgcacgtgtttgtatcgtagttgtagttagccttctcgttaacccacaagttcacggcagcaacaccagacaagtcaccgccactctttgccaagttctccccgtaaggcccacgggaatgtacgagtctgcagtctccttttagttggtttgcgtagttccgagcgtaggctgcaagtccttcgtcccactgcatggggcctacgcctatctgcgatcgtgcctggttgtgagcatttacatagtcttgctggctgtcttgagccttcaagggaacaacaagagcacccacaagtgctgccaagattattagaattcgagagtagcttgtgactttcatttttcttagttgaaataatggctatttccaagctttgtttgtgttatgattttggggtttgtaaacattgtttatatagagatttgaaaactatctttcgttttgtttgccataataaataaacaaagtcttgctgaacatttaaacctcttttatgggtttaatctttcacctttggataggagataggagataaaataaacccaacatttaatacggtagctagtcgggaaccccctaacccataggtctaaatttcttctcacatcttcatatgaaaacaatttttaaaaagaaacataagaaagtaccaaaaatatataacagcctaaacaaaataacaaacaaatttaaaccaagattatcgaaatttttggttcaattcggcaagggatatctaactacaaccaaaccaaatttttataattttgaatttagttaagcgaagattttgttcagtctaactctggatacccttctttcaaattgaataactgaagttcataaattttgtgaacatgacttataagccccaatgcctaaccataattatctcttcaatcttgtaaatagtctgaactaaaattgccaaaatatttattacaacctaaattttagatatgggcatatatcgtattataaagtgattatctatgtggtgttggagattaatattataatgaaaacagttaaaacaaatcataagcaccctaaaaattcttacttgtggtttttatctctgatttaacaaaatcgatcatatcttcaacattctttaatgttgtagtttattttttgttttcctgcaaaagtaagaatttttcaaatctattaaaaaataaaattttcaaaatgctatttttacgaaaatctgacgaatttgccatttttaacatttaaaaatatatgtatttatgattttattttggaaaaatacgtacttatatcaaatactaaactctaaaaacaaatgaaagagaataaactcaaacataatgagtaaaatgtacgttaaattacatttttatattatgaaaaaaggcaaaatcaaactatttaaaagaagaaaaaatccacaaatgtcaataaaaaaaatggcgaatccataattaattcgatttttaaagcatttttgagaaaagtggaagcttattttctttattcattttccagtctccattgtattacaaaactttttgcctcactgctaaaatatgaattaatattgtccgtggacatatttaataccccattagaaaatcaaataattatgagaaaagatacatgcaattatttaaaagaaaatatttacaagtgaaatgttatgaaaatagtgtttcatgcatgtatttctttcctacggtcttgcttatgtttgtaacatggagccatgagggaataaaacaagaagtctttctttatgatttataaaaaaaaaggaaggaaaaaataaggaaaaaagatagtcagctacaccaagtatgacgaaatacatgatcacacataccaagtttaaaaatgtacaactaattacacaaattagatgtattgtatgcccacatataccaactatatgacgacatgtggtcaacatcacgaaatccggtgttgaccatcgttgatcggcattgaccacatgtcgtgatgttgatgttgaccacatatcgtcatatagttgatatatgtgggtatgcaataaatttagttcgtgtagttggttgtacatttctaaacttagcatgtgtgacccatgtattcccttctacttggtgtagctgagtattttttttccaaaaaataaagcataatccatgagggaataaaacaaagccatcttcacttgttaaataagtcattgatacaataattccacggtaatagttacttgcttcttgcaggggatggaataatcaaagctgcttcttgaatgaggtttgttaagttaggcaaatatgacatatcattttgaaagaaaacacaaattgaatggtggctaagctaatagataagaagtctaatagctttttattcatactggatgctgtcaatttgtcattattaaactattttcatataatttatacgtaattaaataaatgtaaaacaataaaatacgttaggtcgggtgagttaaatatatgtacatgcagcgtgagttaattaagaatatatatatgtaaatcagatatttaggtgtgataaatcatgcaaaacgaatattcctattttaaccctattgttcaggatacttgtaggggactgaaaaaagatttgggaaatatggatattgcgcatttaatgcggcgacaaaaacctgccaaaaaatcccgccggcgtaagttacagaaaaagaatcgtaatgatgagccatgatattatttgggttgcgtgtttggctatttgttactccactatcattgttgcttcaacaacaaaagtagaaacacatgacggaaaagaacctacatttactattgcgaagataacaaaatcaaagtaattagagactcagataagcagttaattctcgagttactttgttcaacttcgatagagggtaataaatagtccaccctgccttagggtttgtaacttctgtcatacttgtctgctaacgttgcggttatggttgattatcgacaagcacc

SEQ ID NO: 12527 - DNA, 3000 bp, Unknown
  misc_feature (1)..( 3000): cDNA_ID_2712246_gDNA_ID_2214556_Annot_ID_134787 3000 nt of promoter + ATG
tattttcttgctaataccttcaataccaagtgagacgattccaagaacgatagagttaagcatcaatcccaacgcaccaacgtgaatcccttggttgtatagtttcttcattttgtcatctccttttgagtctccaccgtacacttcacgacccatccaatcggtatcgtataaaagaaaagggaaccatgcgatccagttcaaggccgtgacgattaatagcatccacattggacgtttcatcaccttgaaagctccaaagatctcaccaaagaacggagttttctcgttgtccgagtctgctttaggcgaccattgcttgtcttccacgtaccaaagagctatgattgtgacgactaggaggagagtgatggaaaggaagaaacaactcttgagatttgcgcaatatatgtcacatgctttagtcattgtgaaagggaagatcttgtagaggttagtgtatgatcctgccgcgtatcccaaaacgttcccaacagccatgaagaaagagaaaaacgcgtttgctgttcgcgttttcttagcgtctccagcggctaaatcaccgaggaaagcgcgacaaggtccttggagagtgttgttagccacgtcaaggatccagaaaccgagagcgaagataacaacggctcgcatcttgacaggtttgtcgattttgtctcccatgctgtggccaaaatcagctgcgtatccgattagtacaacagcaacagctacaagcaaggcgcctgtggcgatgaaaggacgacgacgtccgaatcttgacgtgcatcggtcgctgaagtaaccgacggatggctggacaagaagaccagagacaggaccacatagccatatgaaagatgaccatttgtgtgggactccaagaagctgcacgtatggagttagcagagacagctgaagagcccaaccgaactgaataccggcggcaatagaagccactgatatcatctttctcagcggagatggtccatcaagatccgccaacgacgaggaagactgtctatctacagctaccacatcgttttttgcttggaggtcactcatcttcttcactttgtcttagaggttgtgtttggtgttggtgatggatgagatgaaagaaacaaggcttgtctcttagagacaaggtgaagaagaggaatgagacttatatatctaaatgttttgattctgtgtttcaatagttttgaaggtaaatcttttatagtaaggctataacgcatatatccttataggattgttgtaataatgacaagactaacgttaatataacagaaatcggtttattatcttatctttatataatttattttgagatcgtgacagatttttcaatttcttgtttctgtaatgtatgacttttataaatgacaacaagttgtaaatgattttgacttattttaggtaaattccatgttcaataacagattatttggaaaaatattttgaaatcaagagatttcaaataaaaaccaaaatcttctaaaattcttaattcaatacacccccctaaaaggctaaaacataaaacaaaatctaaagaaatcagatgttaatcgacaaacaaaatataataacaagatttagagttttctcttcgcgaaagaattcaagagaagggtttaaggtttaaggttaagagtttatggtttatgctttgattttaggttttattatagtattctcattatttaagggttgcaaaaaagtattggtctaagtaaacataatattttttttgttaaatgtaaacttaacattttatgagttgtatgaaaagcttagagaaacatttcgaatttgtaagatttaatcgtttaaaagtcattttaacaatcattatcattccacacatcttccatcagctcaaatggtaccatattttgatcacgttcatgattgcccctctcttagcctttttaaactcttacggttacagactcactgactggtccgtagtccgacaatatttgccaatgacaaaaccgaagcaaagatagaaccaattgccaaaacactaacacctttcaccggtctcttaaatccttatcatacacaagcttatctcaaaagttctaatctcaagcttttatattaagttcttatttcttaatcatattctaacattttttttctttaatcttattctaacattaatatatgatcgtttgattttaacgtcattactagatagagaactattcttctatatatcttcctaagattagagttagtcaaaacaaatacatatttgacaatcgtttacaaccaaaatatcagattattaatgcaaaatctctcttaaataagaaaagaaatccaaacaaatccacaaagctctgtcacttgaataagaaatttgcataagtctatagctacactgaatttttttgtacaattttttttttaaaaaattagggaattaactgaaaatgacataatggttaacatagaactaattataggttacgtaataaatagtctaatcaaaagttttgtgtataaatctcactttttttaatagataaggtaggaaaaagaataagatagaaaacacttactaaaccggattgatcctcggttaaggagaaattcggttttgaaaaaattacgaggaatatcccaacgaacataataatctgacgaaaggagtcatttttggtcaaaacgaagaagaacaaaaaggtacaaacactttctctctgatcctttttttttaatttctttttctcaatttcaatcttctcgattagggtttggaattgcccttggaatgttgaattttaagacttcgctttgatctgtaaactaatttcagggtctcatctgaattctttgttgatttgagatgagttctgggtttttgctaaggatttgtttttatgtcttctaagcaccaaaatctgctcaaaaagtctgtaaatttccaagcaagttgtttactttttcatagtgttgatttgatcttctgcagatcaaatt

SEQ ID NO: 12528 - DNA, 3000 bp, Unknown
  misc_feature (1)..( 3000): cDNA_ID_2712293_gDNA_ID_2214557_Annot_ID_134792 3000 nt of promoter + ATG
ctgattggtctgagacattgaaatccttctctctttctcgtggagaaagcgatgcgttcgagtcactatcatcgtttctgatggaatctgtctctatccgtacctctcctgcctccatatcatttcctttctctctctctttcattagaggttcctgattattgctacctaaatcaacaagaaaaatcactaagaattatagaaagcctaatcatgatcctgattaggtcactaacaaaactgtaaaatgtcataccttgtagtggcctaggcctaccatcaactacatttctccacaaagacgtaaatttagaatcattttgagattctgatggaaaagctctgtgatggaagctctcatggcggcaaaagaagatatctttagggttagtctcagcaaactcttgttgaaaactatctcctgttaggtttggtttctcttccaacggatcgtaaggaaggtcaaatgggtttcttcttggtaataaaacggaaggtgcagagcctggcatgacaagtccatcgatttcgtagtttcctttatcgaaaccataaaagtttcgaccaatacaaatccgaggaacttccatatcatccatcaagcttccttcagctgcaagtaagaaaaatctccttgaccttcttctagaaatcaaattctctaacctcttgtttcgttcgatctcagatgtcccaagatccatcaaattcttctgatcatcctctgtccacgccactacaaccttgcttacatcttcacgcctttcttcttcttccttttctccttccgatgatgatgatgatgaacattcaacttcactttcatcatcaccatcaacacttattagcctctctaattcaacaagatctctgtgattgtcaagaacagagtcaaatacgttttcttctgcaacaagcaacgtcctttctctcttgaatttctccatatctggtgtaatcgtctccggtaatacttctccatagagagtagtcagaataaccttacctctctcatcctcactagcttgagacgaatcccaatctttcccaacctcttcaactttccttcttgcatttcgtctaacactttgttgatgctttaacttagccttctctgttcttccctcttgagaaatcgtagataacccacgatcctttctcttgtcttcatcacaaatcttcgaactcagatcatgattccgtatataaaacgaagcaaaagctatcaaaggagaagaacagagcaaaaaatagaaaacccaaggaagaaaagtgtacaagatgatcaaaaacgtagaaacaccagaaacaattgggtatctcttcacgtatctgaaaattgttttcgttgagaatctaagaattttccaaacgataaagcaaacatctttagcatcaaattttcccattttcttctccttctagtgaatcaaacaaacctgaaacataaaaatcattataagacctaaaacacacacgaaatgatcaaaggtattgaaggaaaacttcaaaattgatgaagaagagaggtcaagcttacctttgaaatgattaccagtcaaaatagttttggaggggttttaattgcagatttagaaaaaaatttctctgttttcttaaaaacatgatgtcggtgtggtagagaggggatggttttatgtacggatcggatcgtgcggggaagacaaaatagaaaaacaacgagggagttagttgcttacatgttgtttttcaaagatattattttcttcttattacatacacttttgaatttgttgatcgtgttacttacataaaattgcaggttaggtccctttgttttcgcagtttttgcaattatttctcatatttcttaatattgggcttttcacatgtaataagcccaacgataagaccatgacaatttctatacgaaacatgatataaattctttggatatacattatgaatttacgatatacaattagtttgtttaaatatcaaaatataaatgcgtcaatggttgttgttacttgtgagattatctttctatttaagaagaataattctcttcgtagataaatttttaaaataattttccgagttttctaatgtttctagatatgatttgatttgaacaattaattcgtggttctttgaatgaatatatcgactgtatttgatttcagttaaactgataataattgtcatttacgtctcaaaagaattgaaatatcatgtctctcaagatatggacttacatattgttatgcattatttatcaaaatatgtggacaaaacataatatcaatgtcgctttcagaataattgaacaacagatattgagaaatcaatttttatggttatatcaattgtcattgccaacatctattacatagtaacagtccaatttacattacaatggtaattcaatgaaggtaatttactttttattggtttactcgtgaaacgacgttctcctcctcacgtaccttatcttaatatcctgatcaacggacaccaattttcgacaaaatatctgagaaagaggacacgtcagcaagcctttcgctttaggctgcattgggccgtgacaatattcagacgattcaggaggttcgttccttttttaaaggaccctaatcactctgagtaccactgactcactcagtgtgcgcgattcatttcaaaaacgagccagcctcttcttccttcgtctactagatcagatccaaagcttcctcttccaggttcgaatccttgatttctccatgaatgtgcatggtagtccaacaattgtcgatgtttttgatagagagttttgtagattttctccggcgaaattccgatttgttcttcaatattatgtgcatgaaactttttttttaagattgtgcgtttagatgcaatattcgactctttgttgttctcatgctcgtcgatttcgatgtgtttctgttaatccattgatcgtatcggaaactgtgattgattgattcatattttcgtttgtctccagct

SEQ ID NO: 12529 - DNA, 3000 bp, Unknown; identical to SEQ ID NO: 12528
  misc_feature (1)..( 3000): cDNA_ID_2712293_gDNA_ID_2214557_Annot_ID_185752 3000 nt of promoter + ATG

SEQ ID NO: 12530 - DNA, 3000 bp, Unknown
  misc_feature (1)..( 3000): cDNA_ID_2709073_gDNA_ID_2214557_Annot_ID_185758 3000 nt of promoter + ATG
tttcctatggtcaaacaagttttaagtttaaagttcgtatttgtcctccaggtgtagcaaatgcaatagaccttgcagatcgtttccttccaaaattgaagtctcttaattgtaagaatttctccatcactgtgtggtgccatttgaacactcttctttcttcaccatatgtacctaagctttgatgaagattaaaagttgagtatacttctgtaacttatacttccatccaatgcaggcaaacctttggttgtcactttccgtgcctattctaaagatcagatccttaggattctgcaggagaggcttgtggtaagtcttaaaagatgcctttaatgagagaggaatggctgattaatggtattcaaggaattatgaagaaaaaatgcatagtagattaacatgtcaataacaatttttgacccatttaaggaccttgaaactatatgatgatatatctaatctaaacttatggtacttctatgttgatcttaaattattattttcactatttgtaacaggcacttccatttgttgcatttcagtccaatgccttggaaatatgtgcaagagtaagaaaatatatgtcatttttttatttctctcaaccttgttttcattttgatattctttaattgatattcataatgtttgcattgttccagaaagtatcagctgcatcaggagacatgagaaaggctctatgtgtctgcaggtgaaatctcttacgaatttcgtttcctttgagtttgttcttgtattgcatatgatgaatgagatagaaatgggctttatactgtaaattcactcttaaaatcattacattaaagatgacaatctcagttaactcacattttttttcaatttccaggagcgctctagaaatcttagaaatagaagttagaggatcaatagatcaagaaccaaaaggtccagttccagagtgtcaagtggttagtattttactctctactttactcagttcacttactgacgatgcaaatatccatagaaaccgttgtcttatcccataattgtttttatcgaatctataggtcaagatggatcatatgatagctgcattgtccaagacgtttaaatctccaatagttgacaccatccagtctctacctcaacaccaacaagtaagttacacatcaaaacacacacacttattgatatctggttcttctcgtttttaactattaagtaactgttaggatatgcttacaacatgatcttacctagaattagcaaaatcgtagtattaagagaacaaacttgaagtcacaaagaaactaaagacccgtgttggttctctgacttagtggctaataagacctactctgaaagtatgtaatggactgaaataacatgcttctattgaaaacttgcagatcatagtctgttctgctgcaaaggcttttcgagggagcaaaaaggatagaaccattgcagaggtaaatcttcattgaatgagcaatacacaaacacaactcatgaatttatagacattgtacataatattcatctctgtcttcacactttgatgcagttaaataagctatacttggaaatctgtaaatcttcgatgataactccagctggaattactgagttcagtaatatgtgtacagtgctaaatgatcaggtacttatctaatcctataagattaactctcatgtttgtgtatggtttatgcattatataatagacatttgattgaaatgtcattgttttgtttggcacaggggattctaaaacttagtcttgctcgagacgataaactaaagagagtgagccttagagtagatgaagcagacatcacatttgctcttaaggtatatacattacactctttgtttattattccgaaaatgcagtttcttaagttaacaccttctcttttcattgcaccacaggagattcgattcttccgcaactgtcttctatgatgaagttactgagttatagtcttatagatgggttggttccttcattctttacagaatacaaagagttatatatatataaaaaaatcagtacacataaattgtttattctgtcatgtaaatgcaggaacataaacaaaatataatctttattagtttttactggttagcgcaaaagctgaactcatattatgtaattcttctctttttgtactattagtcatgctctcaatgaaattaatgccatcaagtgattgtccttgactccttgattcctgagtgttcgtctgatgcattgtggctattaattccgttcaaaatcttggaggtctcagctttagtctaaggcattttacagccactatgcgccgtggttcacaaaagccctcatatactgaagactcttttccatttgccatattcttattcattataatataaacaatctattaatctttttaccaactttgtcatgaacgaattcaccccaacggaaagttagaagtgtttaaaacatctccaaggtgctctggtgcaccattggttaaaataacatgtgcatcaagtatattacaactttttgttgatttgctatgattgaaaatgtttttcttcgtattttttaattttaaaatctctatgaaattattaaaatatccatgaaattattaaaatctatagcttaaatttcaaaatcatggattaaatattttaaattattgattgaatagcacataatttcaacttggaaattgaaaattaccaaaaattctgattaaattttaaaattaacacagatcatgaatccagcaaacccctaaggaataaatgttggttataaaactatgcttgactgttttttggcaataaaatccagatatgctttcgtttgcggtcccattcggtccgatcgccggtccggtttagaaaacattgctttatgggctttgtatttgtagtactgtagtgtatatattcttctcccagtccacacttaaaaaggtttaaactggtatcgaaagacttaaaatcaacgagctcacgggg

SEQ ID NO: 12531 - DNA, 3000 bp, Unknown
  misc_feature (1)..( 3000): cDNA_ID_3025559_gDNA_ID_2214557_Annot_ID_185756 3000 nt of promoter + ATG
gatcatatcgtcatttgtttcattgcccagctccatcatatcaatcttcataaaccaaacccccttactccttagtatatatcacatgatttattctatcattttctctttgtttttattaaccctccatacatttttggacatttagcgtttggttttatgatttgtcttaatactagtcttccttgtcgctgcccattagcaattagttccatcacttgcataatctataactaactttttcaccttttagaattgtacatttcccaaacgaacaaatcaaataatccacatgatcttatctcttgctaaattcaagtattcatattacatattttatatttacttaaattgacgggccatgccgaggatacgagaattttttaatagaactaagcggatctcacacccttagcctaccgtccgactatggtccacaccaacattgataataatgcatttagaaaatggtatggaaaaatatttctatgaactctccaataatatttaatcttttgttcgaaagcattttattatttagaatatttttaaagaaaagaagccaattatcagggatttattcatccaaataatatagttatggagagctaaggtaaatagagttacagaacaaggatttataagatataaattacaccttaagttggtcgagattacaatatgttatgtctattcaagaataattacaactgctctcagtacttattttctttctcatatacatctaccattcttcttctggtgatataatgattaacgttgaattcagttgctatttcatgtctatttcgattaagcttagtttctatgagggactggttataatcagtatatgttcctctagaactttctttcaaaacacatttcacatcctatattcataaaactcgtaacgagacgagctaattcgttttaaatccatgtgtaccctaaagtttttaattacgaaatattctcgatggtccaaatatagacgataataaaaaggaaaaaaaaaactgaaattaggacaaggtcagattccaccgtacgttttgtaaaatggaattgaataaactaagggaataaataaatatcaatgaaaggtgagaagagtccaatattgttgaaagaacaataaatatcaaccgttaagaaggacataagccgaataccaacgagagccgtcaattcttcaccttcttctaacgtcaatgtctcaacgacgtcaaattacggcaagttggtgcatacctttctctccttctccaccgtcggtttttttaccccctccatttggcacgtttcaacaagatataaccaccctataaacaaaacaagatataaaccacttgtgttattcttcttaactttcgatttttcggttaggtttggttacagttttttcggctgatttttcccgaactagaacttataagctcgtccattatggtctacattgtttaactcacgtttatacatatttatcaaattgagaccgaaattgtaaattggttcattttttgttgttgtaaatttcaattgcagttaatttggttttctttgttttgtttcagtttagttcggttttggtgttttgaattgtgtgttggttatgaaattattaaatacgttttgatatttgttcaatttaaaatataagttgttaaatggggcagctccaaatcttacgaaactagatatatatctcaaaaatacatgcatgcgataatttacgaagtcgtagttatttgttacaatcatcattgcacatgcacagaaaaaggtatcttataaattactcaaatcaagtaaaaaatagtaggatccactatatagtcaccccaactatataaccatatagagaaacagtgtaatcaaaatctccctagaacggagattattttctatcactactttggtaaaactaaaacataattttctataagcaattatttccttcattgcatcattacaaaacttgatctcacatttcatgaacgatttacgatttttcgaatccgtcgattttggatcagacgtatttacgttttctatacaaacaaaatttaaaagaaaaagatgtaaaaattttgataccaaagagggcaaaatgaacatagacgcaaatcgcaacacttaccacacatcaaagttaacgccagattacatggacactacgggacccactcttttagcataccttcttgcaaaactgttactattttcacactcctaattaaaccattttaaaataaattattatcttacagcaagtaaaatatctacatggcttttccaagaccgttgattggtttaaattttaaattggcaaaatacagtacgcaatacactagtactagttgtcagaaaatgacaaaagaaaacccaatagtctgggagacacttggtctatcttaaaccgtcagatgtaaaaataataaatcctaatgacatctccggttaatcatgtgagtcggttcttgtcaccggcttacttgtttgtcagattctttacgtcgctgtataaccggctttaacccggtcatatatttaatttaattaatttcgatattttcgatcataaactcgtgcgcaacaaacccttccttgacatctgtatataaaagctcatctcctcactctctctctctccgcgttctactaaaataaaagtgaagcgccttcctcaggattttcccgagtgagtttcgctttcctccgagaaaatttcagacttaaattttccggtgagtttttcttcctctctttacctattttttttcttactaattcgttgaacccatcgattctcgtgacattacctttccactatccgatttgccatcttcaatgattcaatctcaagataattagtggattcaatttctcttatgatttacaggaatctaataaggagaagccattgttgaagaaactagtctctctgtttcgaatcttcaaattcagattcaatatctatcaggaaaatttcgcatg

SEQ ID NO: 12532 - DNA, 3000 bp, Unknown
  misc_feature (1)..( 3000): cDNA_ID_1808235_gDNA_ID_2214557_Annot_ID_134794 3000 nt of promoter + ATG
cttatagtacattttggatgaaagttttaggtttatagaattctacttatgttttgtgaagaagaaaaaaacgaattcgaatgatgtttattatatatgccttttccctccatatatataattttttcttttatattatgaaactttggagccgaaattcatttatttagactggaatgagagtagataaattagttcattctataaggtgttgaactaggtaggggagttttaggtcacacaatttttttgacgaaaccttagttcgtcactaaaccacaagctcttctcataacatacttttgtggtatatatatatatactttttagttaacttggaaattttaggttttagactcatccgatgctgttagtattaatggatgatgatatcttctaaatttaattaatatattatataggcataaattattcctccatcttcaactaagttcgaacatgggtagccaataccaaactctacgtaccacacaccacatgagcaacccatgttgggtgtttagtggtattcattacacatttacactgatactcaatgttgtaacttctctatacagaatcattttctcttcatctttctatagaatgtattctccatttttttcttcaattatttgtacgatgttatgtaattacatttaaattattgtatacaatgtaaattataaagaagacaaactcgaaatttagaggaatccaaggctacacagaattattttattgatatgaatatttggtttcacaaatttttgttgcttaggatgcggacgtagacaggggaacacgtgcacatgtctcatttctaatctctgcgcctcatcagtgcatatgtgtttactaattagatccatgcacacatccatgcatttgatcataacaaattattaaaagaaaataaacaaagtgattttatttataaatgtttcattcagtttaattaggctttttatatatacagaacatgacaaaaaaaaattaggttaaggtttcgctttcaggagaagaaaagcgaaatattcaagtggcagttggaggtgctaagtttttgattcgtttagtttaatatgaatgttagtatataaatgttatcacgttcatgttttcatcacaatcaatcgtggttttgcctcaccattttatttttgttttggaaaatgtatattctaattactctgaatataactacatattgatgaaaactcgtcatatttgacactgagattatatataccatggaaattttgattagtagaaaaaagttgcgcctatttaaaattaattcgtaggctcatataggataacgattgaaggtcataaatcagattaattactaccacttggttggataaattattttcatcacattgtcggtagagaatatcacattgtacaaactaaaaaacgtattattttttctcatataaccaaatctagaaagtgtaatttggttatagcttagatgtcgtttagctaataaatatagaaataaaataatagagaaaggagagttagtgatgaatgattgaaatggtgaatgataattggagaagtgggccacgtgagagaagcatgtacttttggaaagtgggtcatttcgaagctcttcctgtctccatccacatgaagttggcattcttgtgtctttacggcctaagtttgcgtttctacctcttgagaaatgaatcttgccttcttgtttagtgactggtacggatctaatagtaacatgacaccatctcatatttctgaattggacgtctttgaattgaataccataacctaggttatagtctacacctacaatattacgtgccgatagatcaacatgcatgatccgtatagtttagtgatctcgttacgtcgttatatcaattggtgaaaatcatcaagtgtttttttaggagtgatgaattactggtacataaattttacgtttcgtttagattttggaagaccttgacgacacagtggtagatgttggtaaatggataacgcatgcaacaaagaaataacgatacaacaacaataatgatgacttaaaagaagaataaaataaataaaagtggcagtcataattcataaaagcctaagctaggaaattcttatggtagaccagaagggacaccttcgatgagtaaaatctgccgcaccacaatcttacatcattctcatcccctaaacttggacctcctccattaataaataagaaagctgcaaacgttaatcttctaattgtgattttgttacaagttttatagattctttgttctatctagctacatatatttcatacatttcactaatttacaaatatgtaagaatgtaatcaatgtaatcgactaagaatacatcaaacattaccaaatttgattgacatttacctctgtctattcgtcctcaacattattatcccatacgttcatacaaattgacattttacacttaattttgaatatcatgatcaatactctctcgcatgggatacttaatcaattgttggattaaatattctttcgcatctttgtgaacgcaattagtgggtggtttgggttccacctttggatcctgcctttattccacataaagtagatcactggtcatactcatatccttacggacaataaactattgttattggtattgccgtattattgtaattctattcataggtctacttccaaatctttgagatttttttttcattggggaagtaagatagatctcgcaatttatgctcgtaagctaacattatttgggccttatatgggctttatgttaaactgatagttaataatggacctccaatagttattctgttaaccgttacttcccgttagattatgacatcctcactcaaccaatacttaaacgccacatgtcgtcacatcagccacgaccttaaaaaaaaatcaattcctctctcttaaaacaaagaagaaaaaaacagagaagaagaagaaaaaatctatctccgccatg

SEQ ID NO: 12533 - DNA, 3000 bp, Unknown
  misc_feature (1)..( 3000): cDNA_ID_2709069_gDNA_ID_2214557_Annot_ID_134797 3000 nt of promoter + ATG
tcttaacggttgatatttattgttctttcaacaatattggactcttctcacctttcattgatatttatttattcccttagtttattcaattccattttacaaaacgtacggtggaatctgaccttgtcctaatttcagttttttttttcctttttattatcgtctatatttggaccatcgagaatatttcgtaattaaaaactttagggtacacatggatttaaaacgaattagctcgtctcgttacgagttttatgaatataggatgtgaaatgtgttttgaaagaaagttctagaggaacatatactgattataaccagtccctcatagaaactaagcttaatcgaaatagacatgaaatagcaactgaattcaacgttaatcattatatcaccagaagaagaatggtagatgtatatgagaaagaaaataagtactgagagcagttgtaattattcttgaatagacataacatattgtaatctcgaccaacttaaggtgtaatttatatcttataaatccttgttctgtaactctatttaccttagctctccataactatattatttggatgaataaatccctgataattggcttcttttctttaaaaatattctaaataataaaatgctttcgaacaaaagattaaatattattggagagttcatagaaatatttttccataccattttctaaatgcattattatcaatgttggtgtggaccatagtcggacggtaggctaagggtgtgagatccgcttagttctattaaaaaattctcgtatcctcggcatggcccgtcaatttaagtaaatataaaatatgtaatatgaatacttgaatttagcaagagataagatcatgtggattatttgatttgttcgtttgggaaatgtacaattctaaaaggtgaaaaagttagttatagattatgcaagtgatggaactaattgctaatgggcagcgacaaggaagactagtattaagacaaatcataaaaccaaacgctaaatgtccaaaaatgtatggagggttaataaaaacaaagagaaaatgatagaataaatcatgtgatatatactaaggagtaagggggtttggtttatgaagattgatatgatggagctgggcaatgaaacaaatgacgatatgatcgatgggcattacacagtgaaaaactttttggcagtgaataatgttaattaaatatgatcatgacgatatcaaaataagatgttagatatatatatatatatattcacattttttaacaatagaagatctcgatacggaggtgttatatgttatttaacaataggaatgtgttactttgtataccaagttgtctagggaggtaagctgttaaattgaccatattttttgtgtgagggtaaatatcagtgaaacgcatcgtatattggtcatccgataaatattgttgtattgcatgtcagccttctcaagaataattttgattggatatgtagtggttaattagttggcgattgaaataccacctaacctcgattttggggtattatggaaaaaatggcaaaaagtagagtttgaattctgacaatgagaagaagaacgttcgcaaagctcaaaatgtttgttgagaatgtgtataatcaaaatgtttcattgttttatatttatttttgccaaggttcatttgcttaggtcttatgttgtaacacctatctttcatctaatgatatttactctcttagcagcaaaaaaagagagtagaatttggattccgacaatgagaagaagaacgttcgcaaagctcaaatattgaatgcaatttaatttatataaggtaaataatttggttgattaatatgcaactcttatgtactttatataacacaacaaaatataaaaatcaaattaacatatataggaactaaattcttacatagttatgactcttgaaaggaggatatagccaatacgaaaatcaaaaggagagagacattacaaaggccaccactcttattatctcttatcttctttccacctagtatttatcaaaaaaatccttcattttatattcgtagatatctagtctacgcatgcattgatttttttggatacatgcacatcatataataaatcatcgtcaattcatgtggatatccttcttctatatcaatgcattgattttttttggcaacaaatcgtatgatatatgatcaatgtatgtggatatccttcttctatatcaatgcattgatattttggctacacatcatatgatatatcatcgatttatgtggatacccttcttccataaaaccttttatgaaccagatatacatgaaaaatatctccacgtcgtctttatatgttgatatgatgatatctcatacttcaatgattatatatatgaggaaataaataaatataagtgcattgacagtttgacacatagatcacctagctttcttatcttatattctgattcttttttgtcattatatgtaatttctgatctatcaagtagttaagagtgaataaactatatacagttgcttcatatttttttatactatatgtatataatgagaaaagctattataggttaagatacgtttactattgttgtgcacgtaattaactattatcactttttttcccccgccagagatggtaatgtggtaaatggtcatatatgggccgttaaagggctttaataggcgttaaattgttcaaaccataatgcggcccaataaaattgccgcgaagccgatggtttaaaacggtagccgaagaaaaccgggcggcgaaaaaattctgttccattgctatttcccgctacttccatttttccctctttgtttactttttttttttttttcatttatttttcttatctcattttcctcttaaaaaccatgagattgattcttcacttcgattccattggatctcaatctcaacatcgatctcgatctcccgccttttttctgcctccttctgataacctaca

SEQ ID NO: 12534 - DNA, 3000 bp, Unknown; identical to SEQ ID NO: 12530
  misc_feature (1)..( 3000): cDNA_ID_2709073_gDNA_ID_2214557_Annot_ID_134798 3000 nt of promoter + ATG

SEQ ID NO: 12535 - DNA, 1369 bp, Unknown
  misc_feature (1)..( 1369): cDNA_ID_1833587_gDNA_ID_2214558_Annot_ID_134817 3000 nt of promoter + ATG
ccacatatcgtgcaataagaaactgatcacttttatatacctaaacgatttacaatttacactactatgcttgacacgatatgtaatttttttttttttgccaaagggtgttgttattgatattaaacattgtacaatacaacgtacatagactgtttatataaaacaaggacgtctagataaaaaaagcaaataacaaatattacaagactagttaaggaaacaacaaactgagtaaggttttatgtacaaaacagagacgactaccaaagaagagggccagacgtggtagcagtgatggaagacaaacatcctgacatctcaataagaacatttatggctacttcaaatacatatatacacaatatgtaattctcttattacatttatggctacttcaaatacatatatacaaaaaaaaaaggcctaccttcgacagaagttataccaatttattgatcggaagctacaaaatgttatctagggtcaatttgtagcctatctctatatcaaaaccgatacggatacaaaatagtttgataatcatagaatttaacattctaataaatatttgtttctagtattctttaaatgaataatcttgtgttcaattagtctattcatagtagaattaagtctcctaaaaaatagattgaaaccaaaaacagccgcacatggatttaatatcgactttagttaggaggttttgctaaaaatagtaaaatactcacaaactcacttctaaatactaatcttttacactcatgtcatgtgctttaaagatatgagagaacctttcctagtacacctacagtcaaaattttcaagattccgaaattttctaggttttttgagcaagagccaagaatcccaaatgtttgaatttgtatttttgatccaaaaatactacaacatcgtataaagaataaatcatacgtgtcagaacgagacatatgaagatgatgaaagcattgagccgcccctcaaaaaatccgttcaacgtttgagagtcaaggccacaaggtctgaccaatctatctcttctccttcttcttctaatcatattttcaacggtcaaactttttatcaccttctcagaaactactcttcttcatatgtgaccctaaaaataaaaacgaacaattaaacaaaattttaaaataatataatattcaccaatcagacgtgcaatatgttttatatattcagacataaccaacaaatatacagaaacaagaagaagaacaagaaccatcacttctctcattttcttcttctccaagcccccctcctttctatatatatctgaaattggtcttttataaaacaaacttccatttttcgtatggctgcttcttttcttacaatg

SEQ ID NO: 12536 - DNA, 3000 bp, Unknown
  misc_feature (1)..( 3000): cDNA_ID_3025683_gDNA_ID_2214558_Annot_ID_134823 3000 nt of promoter + ATG
caatttttaacggattgttaatgatataggaaactttttttttttggcaaactaaaaataccgaagatagatttgtgtccgaactgttaactaagattttgtgaaaagactcagccatttaattggttgagcttagctttttctaacacgcagaagtatgtagtgagaacagttgtgacgaatctatcaaggatcaatcaagatcaatcacaattctacttatgtaaactatatattctgtaattagaagtctctagaacatctagtctgtatataaacaatgtaaatcatctcaatacaaatcatccaattctatattctttatatggtatcagagcatcatcgatacctaaaaataaaaaacctaaaaacagccgcctctctcctttctttcttcttctcccccgttgatttttttattcctctgtttttcaaacttcaaccatgtcgaatgtttcttctgaaaccgtcaacctcaacaacacctccattgttcacatgaacatgtcgaatgtgacaaaacttacggcctccaattacataatgtggagccgccaagtccacgctctccttcacggctacggtctcactcaataccttgatgcgacaaaagctgctccagctcgtgagattaccgtcaacgacgttgcctctgtgaatcctgagtatgaagcctggagtagacaagatcaattgatcttcagtgctctcatcggcactctctctctcaccgtccaaccaacggtgtcccgcgccgctacctctgctgatgtttgggccactcttgctggtacctatgccaaaccgagtcgtggccatatcaaacagctccaacaccaaatcaaacaatggaagaaagacacccgcaccatcgacgagtacgttcaaggctttatcaatcgatttgatcagttggcattaattggcaaaatcattgaccatgaagatcaagttgattacattctcgggggtctgccagaagactacaaacccattgttgatcagatggaaggacgtgacacaccaccaaatggatgtttaacaaacagttgtgacgaagatggatgttttatccaaatggctttgaatagtgtatagaacaagcaacaagcccgattcggcccaaacccaaccccatttaatcatatgtggttttagtagtttaaataagctactttgagtctttgacaactgttcttcatatccatcataaattgtgtagcattttacattttacattttacgtttgaaacttaatcataagttttgtgaatcaaagttaattgataaaaaatcactcttaatacttttccacgtctacatcactgtcattttcatttcagacttgaggcattcatttttcaccatgtttcaggaaatatactgcaatttcttacacgtatagagaggtccttaataagtatgagtagctatatcgtaatgtatttataccaatgtactttatgctcacacgtgttcggtgtacatataatatgttgcatgtggcatttcggtgcctaattatcaagtttttaccgaaaataagggaaaagtatataatcatgtagcctttcagacaccgacaaaaattttaaacagtaaatacgatttttctgttcttcttaaacagaaaatgattaaacatgaatgaaacttttaaaagcttattttgacgacgtgttctttagccaaatagacgacatttaaacacatcaccggaccggaaaaacaccagttgaaaataaaataaaaaatgtatttgtaaaagtctgttattacaagaaaatatggtcgatcgttccatgtttaattgtgtttcttgacactttttagttcttataaaacacctttactacataacttgataagttggatgagaataaagaattataatagattctcataaaaataactttataagatatattctctcttatatatatatatatatatatattatgagatttcctaatctaaaataaaaataaatgtaaataatatatataaatattactaaaactaatatatgttaatattttaaatctttctacaatctttatgatttttatattgttcgacgatcatctcaaccattgactctcgatctccaactacagataaagtaaaattttaccaaagaaaagtctagtgactcatcataccaataaaaaacacacaacacctagttttaccaaaataagactagaaatagtactatagtagttatgggacgatggagtgatggttttgcaaagcaaaagccaataattgtacatttcaggccgaaaccgacaatgaccccatcctacccatgtgtcatgcattcagtatttattatgtgtatcagtcaaattttcacataatgacgaaccatctacatacaatctatggcgtggcctgtggagggcaggacaaaccgacataatattgtgtatatccactgaaatttattattaaaaaaaactaatacaatgataagtactagtattagtgataaaaaaaacttatacaacgttgttttcatcttacaattaaagatattcataaacgataaatctctacttcgaaattttttaacatctccaaatgtttgttcaagctagtagtagtccacataaagtcacgttggggtttcaggctttcgttaaagattcacaccgtcggattgggatttccagacgtcacagatagacttatcttcttcgttaaatttagaatccaaagattattgtctgcacactcgttattatctaaaacagccttttttagttaaattgacgatattttagtgacattccaattttaaaattcgtatgggtctacattaaatgagtacagcgaccaactactccttccctcatagtagtatttaggtattgcattcacattacataagatgtactttcctactctatataaactctcactcccctaacactcttcatcatccatcacatctcctcttgcaaaccaacgtaaaacactaactaagagatcaat

SEQ ID NO: 12537 - DNA, 3000 bp, Unknown
  misc_feature (1)..( 3000): cDNA_ID_1375747_gDNA_ID_2214558_Annot_ID_134824 3000 nt of promoter + ATG
atatatatatatatatatattatgagatttcctaatctaaaataaaaataaatgtaaataatatatataaatattactaaaactaatatatgttaatattttaaatctttctacaatctttatgatttttatattgttcgacgatcatctcaaccattgactctcgatctccaactacagataaagtaaaattttaccaaagaaaagtctagtgactcatcataccaataaaaaacacacaacacctagttttaccaaaataagactagaaatagtactatagtagttatgggacgatggagtgatggttttgcaaagcaaaagccaataattgtacatttcaggccgaaaccgacaatgaccccatcctacccatgtgtcatgcattcagtatttattatgtgtatcagtcaaattttcacataatgacgaaccatctacatacaatctatggcgtggcctgtggagggcaggacaaaccgacataatattgtgtatatccactgaaatttattattaaaaaaaactaatacaatgataagtactagtattagtgataaaaaaaacttatacaacgttgttttcatcttacaattaaagatattcataaacgataaatctctacttcgaaattttttaacatctccaaatgtttgttcaagctagtagtagtccacataaagtcacgttggggtttcaggctttcgttaaagattcacaccgtcggattgggatttccagacgtcacagatagacttatcttcttcgttaaatttagaatccaaagattattgtctgcacactcgttattatctaaaacagccttttttagttaaattgacgatattttagtgacattccaattttaaaattcgtatgggtctacattaaatgagtacagcgaccaactactccttccctcatagtagtatttaggtattgcattcacattacataagatgtactttcctactctatataaactctcactcccctaacactcttcatcatccatcacatctcctcttgcaaaccaacgtaaaacactaactaagagatcaatatggctggagtgatgaagttggcatgcatggtcttggcttgcatgattgtggccggtccaatcacagcgaacgcgcttatgagttgtggcaccgtcaacggcaacctggcagggtgcattgcctacttgacccgaggtgctccacttacccaagggtgctgcaacggcgttactaaccttaaaaacatggccagtacaaccccagaccgtcagcaagcttgccgttgccttcaatctgccgctaaagccgttggtcccggtctcaacactgcccgtgcagctggacttcctagcgcatgcaaagtcaatattccttacaaaatcagcgccagcaccaactgcaacacgtatgtgatcttttcactcttataagtatatgttataaattttttagtttattttgttaaatattggaaacttatattaacgttgttatgttaatttgtatgtgaatgcagcgtgaggtgatgagcgacggtcaaatgaagctactagcggatgtttcgaatattatataatcgatgagataatattaaataaagatgttcgaatggctgtactcttttcaatttcctgtctttttttatcgtggcgtttctattatgtgatcgtctgtactatgttcgcaaacaacgttctttgaatttcagacttgaagtttaagttattctatactctatatctatactaacacttactttagtttaatcgatatgaccaaaatgattaacttgcattacagttgggaagtatcaagtaaacaacattttgtttttgtttgatatcgggaatctcaaaaccaaagtccacactagtttttggactatataatgataaaagtcagatatctactaatactagttgatcagtatattcgaaaacatgactttccaaatgtaagttatttactttttttttgctattataattaagatcaataaaaatgtctaagttttaaatctttatcattatatccaaacaatcataatcttattgttaatctctcatcaacacacagtttttaaaataaattaattaccctttgcatgataccgaagagaaacgaattcgttcaaataattttataacaggaaataaaatagataaccgaaataaagatagaatgatttcttagtactaactcttaacaacagttttatttaaatgacttttgtaaaaaaaacaaagttaacttatacacgtacacgtgtcgaaaatattattgacaatggatagcatgattcttattagagtcatgtaaaagataaacacatgcaaatatatatatgaataatatgttgttaagataaactagacgattagaatatatagcacatctatagtttgtaaaataactatttctcaactagacttaagtcttcgaaatacataaataaacaaaactataaaaattcagaaaaaaacatgagagtacgttagtaaaatgtatttttttggtaaaataatcacttttcatcaggtctttttgtaaagcagttttcatgttagataaacgagattttaattttttttaaaaagaagtaaactaactatgttcctatctacacacctataattttgaaacaattacaaaaacaaacaatgaaaatgcaaagaaggacgtaggcactgtcacactacaaatacgttaataaaatgtattttggtcgaattataactttccatacgataaagttgaattaacatgtcaaacaaaagagatgagtggtcctatacatagttaggaattaggaacctctaaattaaatgagtacaaccaccaactactccttccctctataatctatcgcattcacaccacataacatatacgtacctactctatataacactcactccccaaactctcttcatcatccatcactacacacatctcctattgcaaacgaacataaaacactacctaagagatcaat

SEQ ID NO: 12538 - DNA, 3000 bp, Unknown
  misc_feature (1)..( 3000): cDNA_ID_1985638_gDNA_ID_2214558_Annot_ID_134826 3000 nt of promoter + ATG
tgaagtcagttgttgactcaaggtttattagaacaaaagtcaggtttttagctcattaaagtcaaccggataaagacgaccggtctaattcggtttgggatttagaaagactctatatcgctcagagggtctaacgcagacgcttttcaactttcgagatatttttcttaggtatatatttccaaatgttacggcgtcgttttcaaaaacatatttttgttgttgcgtagtagtccttcggaaattctttgcttcctagttgaagcactcacaacacacagcttttgtaggaatccctaagcttaaagtctctattattctctaatctcttcttcgccgacgacttctctcaccaaggcgacgttttgatcaggcgatgatgagtatcccaatggagttaatgtctatcagaaaccctaattccaccttgctctatagagctcactctcgtccgcctgtgaagctctgtgctccacctcgttctctcctccctagccgacgccatttcagtgctcctcgagctgttgtttcgtatccaggaatacgtttcggctttacctcgccggaagtcttgcttaatcgatccgtcgttgctttcgctgcatcccacgaggattcggtgagtagtgtggttgtgctcaaaacttctaatttctctgttgggtatctcgaaattcagatgctttatcttgtaaattgcttgaggctagaaaaaaattggactttggtgaaatttatttgattaagcaatataatctgccaatttcaagtgaggtgcaatttggggtttgaaattatcaaatgatctgtgattagctaaagaacatgttttgattattaccctttatcgccattgttcaaatagggagaatcaggtgttgaggtggggaaggagaagagtgatatagatgttgaagatgatacatctaaggaagcatggaaacaaactcttgagtcttttaaagagcaggtatcaaagatgcagagtgtgtcatcggaggcatactccgttaactcccaaaaggcgatgacggtcttgaaagaaacttctgaacaacttaggattcaagcggaaaaggcgaaagaagagttgggtactaaagcgaaagtggttagtgaagagggtagagaatatattttgaaagcagcagaagaatctccatcagatgtgaaagagattgttgaagcatttgcctccactgaggatctgaaaaatgtgtcccgagcgaatgattttcatgttggaataccttatggtaaacatgttgtatatcttgttcatcttttgtaagctttcattgttcgtgagtaacgggataacaatgtttgtatactttacaggtctactcttgcttgtgggtggttttattaacttcatggtatcgggaagcattccggccatcaggtttggagtcattcttggtggagccctttttgcactgagcctggcaagtctaaagtctcataggaaaggagagtcatctacaaagttcttaaaaggacagatgggttagtaaagtttttcaatctgtattaaccctttctcatatcattcacaaaagctagccccagttactgaaatctagttttaacaaccagaattgtgctttgattaggaacggctttgataacccctctgatatgcatattagctaaccatgaatgaattagtttaagttgcattattgatttgtctagaaatgagtcttgttccaatagatacttgttgaatcctagattttgagtttagtcaacaaattaatttttcactaatctgatttttgaggctttccgacattctccggttgagtatagatgtaaagcatgtttagtgacgcttatctgttaccgtgttcttatgttcaacagctatagtggcaatcatatttttgagagagttgcggttgctactgtctcaggtaactttcattgctcaatgttatatttcaaatggtttgaagaatggctttgaatgaaacataattcactctcctttttctctttatagaaatcgacgttcctaggtttttttaccacccttacaaggtacactctgaaaaccatatcattaatcattgtacatttgcaatttgataaatgaaacacgataggaagatgattgatagaagaacctaaactaaaattcaaagagatatctgaatgaaggaagattagtcataccttttgaccaaacttcctgctagattcaaatattccacggggaaaagcaaaacacactttgcatataatggattaattaggattcttatcagaaagaaggcttaaaagtttgttggattactgttgcagtggtggtgtgctagggttttacttgtacaagatggtggtcaagagagaaaagggaccaaccttagaagatggcggagaagatgaatcaagcgatgggtttgtaagaagtgaaggataaagaaaaatggggtaagaggaagaagtgttgtcgtcaacatcagcatcatatatgccaaactcttttgatatctctttttaagttgtgtacaatttttgcgatcaatccttctaatttccgttgtatttggattagtgagtcgtttattaatatcaacaaaccaataaaaacgagaattttattttgtttgtgaaaagcccatcaaactttggcccaataagggcctgggtgagcccaagcttgatgcagtaatatcgggataaggagaaagagagcagaagcgtgaatctagtagtatccatagacctagccacgtgatccaaaccgttgattcttcaaggttttaactgaaaccgttgatcactttgtctcggtcgtataaaataaattaagaacacagtttcagtccgtaatctctatctatcttcttcgtcgtgactcaaacgaggttccgccgattataatccttctctccatacttgagagattttgttggattgttctttgttctgagtcgccttggatctatcggtgttggtgctttgttttttgagctagggattgtcggaacg

SEQ ID NO: 12539 - DNA, 3000 bp, Unknown
  misc_feature (1)..( 3000): cDNA_ID_2709138_gDNA_ID_2214558_Annot_ID_134827 3000 nt of promoter + ATG
tctctggatgacttctgcaggattaaatgtgtatgatgagtaaaacatgcccatcttattctaactcttaagagactcaacttaaaatgagtaccaagatttttatagtgtaagatagagttacctcctcagccaccaaggattcttcatcgtgttgaagttgttgaactttcttttctagactcgcctgattgaaatcatgcaatttttacaaggagaatgcattataacagaagaagatggaacccttatctccaatgaatgaagacatacctctttctgagtgaaggtagatctttcatctagcaattgtctcatctgggcttctgtgctagactgtcaaatttctataaatgtcagaactacacagcatcttcaggcataatgaaatgtaatgtaacatctatagcgatctgaaatgtcctgacaacatgacattctttcacgttagctaagaccaagtcctagtctagaatgctaaataccggtagtaggtcctaatctacatactggggagataattaagaaacaaaccaagttgaacagataaaaggaactttcatatgatcacacaaaggagaaactgtagtactaaaaaaatgatcccagtgttgaagatctctcaccatttcacgaagaagcatgtcgttcttgtttttatactgcacaagtctttcctccaacttttcctgcataaaatacaatgttattttgacctccaacttgcagatgatcctaaaaaaataagaaagctatggatacggctttatgcaattttcttcactaacttcgttttgtttgtgagcttcattttcagttctaaaatgtaagagcctttcttccaacagtgcctgtgaaaaaccatgtaattttgaccttcagcttgcagataatccagcaaaatagtaaagttaggggtatggctttatgctatttcttcactaacctcattttgtatgtgagcttcattctctgttctcaaatgcaagagcttttcttctaacagtgcctgtaatacatcatgtaattttgaccttcagcttgcagataatgcagcaaaatagtaaagttagggataggctttatgatatttcttcgctaacctcattctgtatgtgatcttcattctctgttctcaaatgcaagagctttccttctaacagtgcctgtaatacatcatgttattttgacctttagcttgcagataatgcagcaaaatagtaaagttagggatacagcctcattatttatgttatttcttcaccaacctcattatgtacgtgagcttcattctctgttttcaaatgtacaagcctttcttctaacaatgcctgtgaaacatcatattattttgatttttcagcttgcagatgaagaaggaaacagcaaagtaatgaaaaaggtttaaatctaatcttcactagcctctttctgaatgtgagcttcattctcggtttccaagcgtctaacattttcttcaaaaccagcctatcaagacaaggcaattcattctttactcttcaactgtggaaagaaatcatgactaggtggagagattatctctatgataaaaaatatgtttgagaagagaatatcacctctttctgaaggtaggaaccattttcctcacgtaactgtttaattgtttcttccaacagcacctacaacagcattacaaactagtcttgagacccaagtgaaaagatagaaaacaaaaaaaagcagactcttcatggcagtaaggaagaaaatttgtcaatatttcactcaggaaagatgaaatatactactgttaactaaaaatttatcaaccaatttatacagatagaaatgaaaagttctctttctgcatacaacaacatagttttgttgttgttctttaacctttctcttctacattagccaatccaaatttccaaagaacaattatctactctgcatacaccacaaaaaaaaaaagtacatacaagatacagtaaaaaatctcacctcacttccctgagacttgttctcaacaccagaatcatcttcctgttttaaacaagaagattttaagagtatcagacaacgacggctcatacactatcacataatttttgtcaaccatctctacacaaacctaatgaactctctacacatcagttacaacaaagtaaacacacacgtagtaaaaggatccgttccagtatatgaatcgaaatttcattcaatcaaatcatacaatgtagcataactatgtcaacaaaaatgcaactgcattgacattataaaataagaagaaatgaatcaaattgaccccaatgtcctatcatcaaccaagagaatcaatctaatgtagcaatgttccaatcaatcttagagatataatgaactcacagttgcgacgacatcgatctgatgagatgattgcgactcatcggcatctggacctccgctaatttgaggaacgtcaccatctccgatatgattttcatcgacggaggtcgttgcaccagaagctaaagcgtcgtcaacacgtttattattctgcttattcttctttttcttgtttctcttcttcttcttgtcgtcttccatacctgatccagcttcccaacgtatcagttatcgattcaaaccccaaaacaaaaatccaaactttatctcatcaaaatccaaactttatctcaacgaagtcagatctgaatgatttgaacaataggaggacgaagaagagaaatgcgtgattcttaagcttactttgcgatgaaggcgagtgataatacgacacgaaatcgaaaccttagcgccgaacgggaaaacggagaaaggacaaacgagaaagtggtcgccgaacgggaaatgttaaagtcctttcttttagtcggagcgaacaattttattaagagtttttttttttttttggcttctctctcaatttaataagagtttagaaagaacaaaaaaaaccatcttttccttgtccacgtagagttgaatttgtagggttctttagaaatg

SEQ ID NO: 12540 - DNA, 3000 bp, Unknown
  misc_feature (1)..( 3000): cDNA_ID_2709140_gDNA_ID_2214558_Annot_ID_134828 3000 nt of promoter + ATG
tggaggcgttgtgcagggttgctggagaagctgatgactatgagagagagtcagtaaatgctagtgatcctttacgtgttgctgtctcagtggaatcactgatgtttgagaaattgggtcgctcaactggagctcagaagcttaagtacagatctataatgttcaacctgagggatagtaacaacccggacttaagaaggagggttctcactggggagatttcaccagagaaactcataacattgtctgccgaagatatggcaagtgacaagaggaaacaagagaacaaccagatcaaagagaaagccctgtttgattgtgagcgtggtcttgctgcaaaagcatctaccgaccagttcaagtgcgggcggtgtggtcagcgcaaatgcacctactatcagatgcaaacaagaagtgctgatgagccaatgacgacttatgttacatgtgttaactgtgacaaccactggaagttctgttgaggagatctctgtgtcttttatttcatgagaccatgttaagacatagaggctctgattgattaatcaggagcttcgtgtccatttgctagcagcattcctagaatgctctggctccgatgtttgtttaaggatatcattcaatgtcttagagattagtaagtaggggtatttactaatttaggtgtttgtagttcttatttcttttgcttctcttcttccaaactgtcaactcaactttcttgcagattttaccaaattttgaagtttttttttttagttttagaattgctatttgtgtcctccatttaatcatcttgtacggctgaagcttcacagcctaatgtatgtgatattggtcgataagtatcattacttgaaactgattctgactcaactgcaacacaagagaacatatacagcttaaagttcccatcgcattgcgaacaagtcctgtttctttctgtttcattttcactatcaaatacagccgaagatatatgtcaagatgaatggcaacaaatggatgtatcacttctagcggaatatgtcccattcttcatcatccaaatctctcttttttcggttggatcgattgtttctccttcgccgtcttctatcagatgaactttcaagatcttcaacatcagggtattcactatcaaactgagcatcccagagtccctgtaattaaaagtctttcttcaatcatccatttgaaaagtgatgaaaatcccaaggcatgccattacaagacatatatataccttagtcaacctctgttttctagaagctgcatcttcttgaaccacaactatatcttgtaagacctcgattatatcctcgacatctaatctgtatgtactcacctgcattatcacataccaggtaggtaatcataacattatgctattccaagattaaatgcttgtgcttgtatctcacataaaccatttcaactttattagaaaaaagggaattaagttacccaccaggcttgatggtataatagttaccccgaaggaatcgagctcaagcgattcaactattcccgagttaatgttgaatgagtaacctcgaacctaaaaccaaccatgtgcattcagctaatagcaagatataagcaaagagacagatatcattaccgaagaagatctttattaacacacctttccaatgtttctccctcctggtgtaactactctgtaacctacctaaacaaaagatgagaattcaatcttagacttgcttaaaggccagtgattcacaagacatcacataaaaagagactatataccagtgtttcaagtccaaccatcttgaattcagtatccaagacagtctcattatcaacaaggacaacatcacccacctacagagatcttaatataaactaagatgtaagtaaacacatttccaaatgaaacaactttcaacgtagcagaaaccaaacatagtagtacccggacaatgtctgtgagcagaaatctctcagattctccagatagcaagcttggtttaacatcaaccaccaaaaccaaccactgaaatttcagaatgatagagctcattgcacttacttaaacagtcacaaatttggtaaaagagcagactttagactcgctaaggtgattggattcaagaaggaacttacagaagtagtgtcaacccaaagctgagagataaatcctaaactcaaagctgattgtatactaacaacttgcttagcaacaagattcgatcttgtcgtcgactgcttgaatcctcgcgaacccgtaatgctcagatcattatcacctactagtcgaaccaaatcactttctccaggtaattctacactatcactccccacagtttgatgcactacatcttcttcattagatagtgaagaactcaagcaacagatgaaattgtctctcggtttctctataaaactgaattgcccgagaaagggagagtttttcgaatcaatccaaaagcaattgaggattgaatgctgaatccgtttgagcctccatcgacaagtttctgaattgggtttcaccaatcgagcattgagaactggaagagaacagaagaaggaagatgagcaattgcacatttctaaagaaccctacaaattcaactctacgtggacaaggaaaagatggttttttttgttctttctaaactcttattaaattgagagagaagccaaaaaaaaaaaaaaactcttaataaaattgttcgctccgactaaaagaaaggactttaacatttcccgttcggcgaccactttctcgtttgtcctttctccgttttcccgttcggcgctaaggtttcgatttcgtgtcgtattatcactcgccttcatcgcaaagtaagcttaagaatcacgcatttctcttcttcgtcctcctattgttcaaatcattcagatctgacttcgttgagataaagtttggattttgatgagataaagtttggatttttgttttggggtttgaatcgataactgatacgttgggaagctggatcaggt

SEQ ID NO: 12541 - DNA, 3000 bp, Unknown
  misc_feature (1)..( 3000): cDNA_ID_2709148_gDNA_ID_2214558_Annot_ID_134830 3000 nt of promoter + ATG
tgatctctaatcttccaagggttttgatagaggagattttttttagggttcctttgaaatctttgagagcagtgagattaacttgcaaaagttggaacactctatccaaaagtaggagctttaggaagttgtacattagtaaaagagcaacaagagaagaggagtccatgatgatcgctatgatgaatttcgatctttattcaatgagggtcgtagttgacgacgacgttgatccatctaaagcgtttaaaaaaaaaaggaataaaaaatctatagcgtttaaacgtcaacctattttccttgatgaacaagtcaagatatctcaagtttttcactgtgaaggtttattgttatgcttcttaaaagaagacgatacaagggttgtcgtttggaatccgtattgcggacaaacaaggtggatccaactcagatattctcaccgtccacacaaagacaggttcatttacgctctaggatacaaggataaggaatctcgtggtagcttccaattattgaggtttgtagattatttcctaggagcacccaaaaatcaatatttttggtatgaaatttacgattttaactctgattcatggacaactcttgatgtcactccacactggtgtatatactgttgtgaccgtggtgtttctctcaacggaaacacttactggtgtgctaaagaaaggaaagcagaagacgatattgtcgatcacatcatatcttttgattttacaaacgagagatttgggccgcttttgcctttgccgtctaaggttatggaacatgaatatgaaattgtaactttatcttatgttaaagaagagaagcttgcagctttatttcagcattacgaagcagattggaatgagtttgatatatggattacgactaagattgatgctgaagtggtgtcgtggagcatgttcttgagaatggatacgggacctaggatagaggttccacatatatgtgaaggtttcttcattgatgaggagaagaaagtcgccatgggttttgaagaagacttcgatcgcaaaacatttatcatcattggagaagctggatacgtaagaaaattggatatcaaagcacatgtagacagaaaatgtcggccaactgtgtgttcttatgttccaagtttggtccaaatcaagaaacctgcacgaggcaaaaggaaaagacaaagcagcttagaaaagcgtctatttgatcaaaacatgttgagacttgaagcatttaaaaagctaggcggctacttctagaagcaatatgcaggaggagttagaagtgaaagggatgacttgtctcaatatataatttattatgttacaaaacttctatttattttctcaattactttattttggcatgtacgtcaatagatttttgaaccagaatctgccccacatgtgataattttctccaaatattttcttaatggtttagttttgataattataatatatatatatatatataaatatatatatacaggtttaaactccaaatctatttctaaaatatgaaaatctaaattttattaattatgaatctataattcgatatgtctaatatatattgtttgattttatttaaatatttaactcgtctaaaacaccacgattagatctctaagagttgggttgccgcccctccaacaacgaacaaatataaagcacaaagcattttcttcaacattgtctcacacaatattttttttggtaaagagatagaagaagaaagtgttgcgagtggcattcaaatctatgaaaattcaaagggacaggagaacatgaaaaaaaatatctaaaggagtgttaatgagatgagctaattggttagtgtgcttaatgggaatgttttagacttttagctgaattattctttttaagtttttaatgattaaaccaaagcaactcttaacggaattgccactttagtatatcgttgacaactcttagtttccattagactactacgtacgtgtcatccacttttctgttgacaaaaactaataacaatcccattccttgtcagcatccaatccataaatgtagttggtcggtccattttttgttggtttgacacatttgtgcacaatcccattaatttcttgataattagcaataaggcaatcctagttagctaagaaactatacgattatatttttggtttgtctactatataacatgtactgtgggagacacttacacatgtaactagtttaaccaaactagatgatcgttcaaaacagcatccagcttatctctcgagtgaaatcctaaaacttgggtagaatagtaccatggaaattgctttaagtgggtttatatcataaacatagaaatttatattatacgtgaggaaaaaactagtgagatcatccacttagtgttgttatatactaactaaaagatatcatatgcgccacttagtaaatgcaatgatgtattattagagatagtagaggattaacgtgaatgtgtttggaatacatatagtggcgatagatgtgtgttagtgaatatgttcggtgctggttttgaccccatatcataatttttaatgtaataaattcttttgcttacttcataattattaagttaattggtcgtaaaaatggtgctacttagtggatgaaacctcatccagaatcttctaccgaaccaaaactctttaaatactaatctataacacggctacattactattaagctgatccgatccaccaccacatcataggtattattactctgatcttcccttttcaagcattactactttctcctcttagttttcttgtttcaccaaccaagctctctttcttgatctctatctttatgtcaactctatgctctcttgtattgtgttcttttccttttcaacaaattttgttcactagtcactagtatttcctaacactttgtactcatgatgatctctacctatctttgcataaaaccctcacgggtacttaggaagaatattcaagagca

SEQ ID NO: 12542 - DNA, 3000 bp, Unknown
  misc_feature (1)..( 3000): cDNA_ID_1807259_gDNA_ID_2214558_Annot_ID_134831 3000 nt of promoter + ATG
gttttccggtggttttctccattgctttgtagacttttccataggttccttcaccgaccttttcgagcttctcgtatttctccattgatggaggattttgaattgagactgatgaatgttttttgtttgggtcttataaaccctaaagccccttttcgattttagatctggtaaataaaggcgcctctttgctataacgtttaacatttgaatccctcgcacgcttcacacgtaccaataatattttattagtcaaagactcaaagtcattttaaacagataagtatagtataagatatttgcttgattatgtttatagatttcaattcattatccatggtgaatgtttagttgaatgaatctatgcatgatctttgatgtaaagccggccctgagtacaaaaagctaagctcatgcttgcagccacaacccataataaagatttttcagtcatttattttgctaaactattaatattacttgaagagtcgatcatttcgcattaattggttgaaacttcgagcttttccaacttcattttaactttaatctagtatttaacatactaattaataagactataactgttttagcttgtatcccattagttttctccttatacgttaatgttcaatgtttggcacaaactcaaaaaaagaatttcttactacgtagttttttttcacttactcaaccaattggaaaaatgtttaggtttgattttttgtgttcgaatttgtaacttcaattattttgggactgtgaactcttactcattattcattaatggtgggttgtttcttgtgttctaggcttctagtatacatgattcaacttcatatgatattgattcagtttcacatttttgatttatttcaactttatattcttcttacactcattccaatttcatgtatggtaattgcatcagttttgatcgatagttacattaagaaaaccatttctttttacaataaagatactacaacaacaacaaaaattctgactaggtctacgaatgtgcaaggtatgcaatttcacaaactcataaaaatcatcataagaagttctatgtaaaggggaaagaaaaacaagattataaacaaattgtgtgtttcatgtggaaactaaacaatggctgaatattaaaaaattattggactactatacataaaagaaaattacaataatgaaaaagaaaacaaagataatattcaatgatagggcattgactaaacgaaagaaaatggcttaaagactttaaagttgattatgaaaaaccgttactgatttactagggtcaataaacttatttgcaaccattttattaagggaatttaatgaaaaaaaccgtcagctttggtcagatctatttttaaattctgaactatgtttttagtaaaacaaactctgaactaaaacctgttaataaacttaaccccatagtaattaaatattaatgggatattaatttccaaaaatcgaccaaagaacaatgacagaatccgtgatccaactgaagatcgtccacctcaaaaagttctttatacacgtgaaaaagtttaaatggtaaaatagagaacaatgaattatgtttcacaagatcttcattttcaaattattaaatttaatctttgcatatttagacttgcagcaattgtcaacaagtcggacacaacaaacgttcatgcaagtgtaaagcaatgccaaaaccacccaagaaacctcaaggacgaccaaggaaaaaacagaaaacaatggatgaagagaaccctatcactcagccaatacaatcttctcttcaaagttaatgcttgacaagtctttactttagaatatcttgtccatctgaaacgattgttttttttttgtgacaaatattgttgtgttgcaacagcttcgatagttatgttggttggatttatttaagcatgactctttggattattttaagttattgtgtctttctttcagcttttaaaatccaaactaattaagcaattcaaaattatttagaatgtttttttgtaataaattcaaaacagttttaaagaacatcacgtggtttttgcgctaaatacaaatgtctcattgttttctttttaaaaaattaatatctcattaatatttaattactgtgaagttaagtttattaacaggttttagtttaggatttgttttactaaaaacatagtttagggtttaaaaatggatcaggacaaagttgagagtttttttcattaaattcctttttattaatattttttctcttccaaaatattcataaattgctttgtcttataaaattctgtacacgtaaaatggtttaattgtgtgcgttacatttgggggacttggaagaccatgagcataataagagcactcaaaatcatcaccacctaacaaaaaattgcagaaacacatttattgttaataattaataattaaaaaatgtccaggccaaaaagacagctcaaatgagcgattgcatggttgacacgtgtaaagttttagcggcgttaaaagatacggtctacgtagtcacgcacacacaccaaagtttctctccattttcttatttccttatttatttaattataatacagaatcaatcaaacggtgacggttgaattatcaccaaaaaataatcactaaatttttcaacctttgtaacagagagatccactctgtcactttaaactttttagctgattttttctgcctgagtttaattaaaaatctcctttatggaaaataaaaataacttttaatcaaagaaacaaaaaaaaaaagagatttttcagacagaagaaaaaaagaaaaaaaaagtctggcgtcttctgcagaattcacatttggtgtctgctgctggcgttggtctttctctttctctttctacttttttttggttctgcgatttccatcaaaacccttttcccaacaatcttggttttgtacagagaagaagaagaagaagaaaggcacacaaaataacccatg

SEQ ID NO: 12543 - DNA, 3000 bp, Unknown
  misc_feature (1)..( 3000): cDNA_ID_1807782_gDNA_ID_2214558_Annot_ID_134832 3000 nt of promoter + ATG
acctgtcgatctcaggagtgcttctaatctgaggagaagcagctcgagcaggagagaagtaagatgagttattgtataaaccagacatgggttattttgtgtgcctttcttcttcttcttcttctctgtacaaaaccaagattgttgggaaaagggttttgatggaaatcgcagaaccaaaaaaaagtagaaagagaaagagaaagaccaacgccagcagcagacaccaaatgtgaattctgcagaagacgccagactttttttttctttttttcttctgtctgaaaaatctctttttttttttgtttctttgattaaaagttatttttattttccataaaggagatttttaattaaactcaggcagaaaaaatcagctaaaaagtttaaagtgacagagtggatctctctgttacaaaggttgaaaaatttagtgattattttttggtgataattcaaccgtcaccgtttgattgattctgtattataattaaataaataaggaaataagaaaatggagagaaactttggtgtgtgtgcgtgactacgtagaccgtatcttttaacgccgctaaaactttacacgtgtcaaccatgcaatcgctcatttgagctgtctttttggcctggacattttttaattattaattattaacaataaatgtgtttctgcaattttttgttaggtggtgatgattttgagtgctcttattatgctcatggtcttccaagtcccccaaatgtaacgcacacaattaaaccattttacgtgtacagaattttataagacaaagcaatttatgaatattttggaagagaaaaaatattaataaaaaggaatttaatgaaaaaaactctcaactttgtcctgatccatttttaaaccctaaactatgtttttagtaaaacaaatcctaaactaaaacctgttaataaacttaacttcacagtaattaaatattaatgagatattaattttttaaaaagaaaacaatgagacatttgtatttagcgcaaaaaccacgtgatgttctttaaaactgttttgaatttattacaaaaaaacattctaaataattttgaattgcttaattagtttggattttaaaagctgaaagaaagacacaataacttaaaataatccaaagagtcatgcttaaataaatccaaccaacataactatcgaagctgttgcaacacaacaatatttgtcacaaaaaaaaaacaatcgtttcagatggacaagatattctaaagtaaagacttgtcaagcattaactttgaagagaagattgtattggctgagtgatagggttctcttcatccattgttttctgttttttccttggtcgtccttgaggtttcttgggtggttttggcattgctttacacttgcatgaacgtttgttgtgtccgacttgttgacaattgctgcaagtctaaatatgcaaagattaaatttaataatttgaaaatgaagatcttgtgaaacataattcattgttctctattttaccatttaaactttttcacgtgtataaagaactttttgaggtggacgatcttcagttggatcacggattctgtcattgttctttggtcgatttttggaaattaatatcccattaatatttaattactatggggttaagtttattaacaggttttagttcagagtttgttttactaaaaacatagttcagaatttaaaaatagatctgaccaaagctgacggtttttttcattaaattcccttaataaaatggttgcaaataagtttattgaccctagtaaatcagtaacggtttttcataatcaactttaaagtctttaagccattttctttcgtttagtcaatgccctatcattgaatattatctttgttttctttttcattattgtaattttcttttatgtatagtagtccaataattttttaatattcagccattgtttagtttccacatgaaacacacaatttgtttataatcttgtttttctttcccctttacatagaacttcttatgatgatttttatgagtttgtgaaattgcataccttgcacattcgtagacctagtcagaatttttgttgttgttgtagtatctttattgtaaaaagaaatggttttcttaatgtaactatcgatcaaaactgatgcaattaccatacatgaaattggaatgagtgtaagaagaatataaagttgaaataaatcaaaaatgtgaaactgaatcaatatcatatgaagttgaatcatgtatactagaagcctagaacacaagaaacaacccaccattaatgaataatgagtaagagttcacagtcccaaaataattgaagttacaaattcgaacacaaaaaatcaaacctaaacatttttccaattggttgagtaagtgaaaaaaaactacgtagtaagaaattctttttttgagtttgtgccaaacattgaacattaacgtataaggagaaaactaatgggatacaagctaaaacagttatagtcttattaattagtatgttaaatactagattaaagttaaaatgaagttggaaaagctcgaagtttcaaccaattaatgcgaaatgatcgactcttcaagtaatattaatagtttagcaaaataaatgactgaaaaatctttattatgggttgtggctgcaagcatgagcttagctttttgtactcagggccggctttacatcaaagatcatgcatagattcattcaactaaacattcaccatggataatgaattgaaatctataaacataatcaagcaaatatcttatactatacttatctgtttaaaatgactttgagtctttgactaataaaatattattggtacgtgtgaagcgtgcgagggattcaaatgttaaacgttatagcaaagaggcgcctttatttaccagatctaaaatcgaaaaggggctttagggtttataagacccaaacaaaaaacattcatcagtctcaattcaaaatcctccatca

SEQ ID NO: 12544 - DNA, 3000 bp, Unknown
  misc_feature (1)..( 3000): cDNA_ID_1808299_gDNA_ID_2214558_Annot_ID_134833 3000 nt of promoter + ATG
gactcctgtttcccactatgaaaagatgcactggaagtgtcgatggattatggcccgtaggttttcgttactatagattctttactttttgtgtactgatcagcacattaatattctctagttataataacaaaaatgtagagggaaaccaagagagaaagattcgagaaatgttttatttttattttttgacatcgattcgagaaatgtttaacccgggaattgataaaataaaatagaggagagtgttagtataagattttaaaacttgggttatcaattaagaaaaagaaaatacaattgccaaactatatactaagttgctaacagtatagtttctgtaaaattcatgaaaatatagagcatacgaactagagttagtgtcaaatttatattattcatgagaccataagctattttgtagggccaatattggccagaacaggaatcaaaaacaaggtttcaatataatattttgttggagtctaggtgaatgaaaaccggccgttattataatatttgattatagaaaggaatcaatccattaatttgcatgaatacataaaaaaaaatggacctaaattgaagagaagatatcttatagtaatagactgaaagtgatatctctctagtggaaaacaagaagatgagagaccattcttttcatttgagaaccacattctctctctctttctacatttgtataaataaacccaaagacctcttctcatttgtcccacattcaaacatcatcaacttatcgatcttctccaacaagaatcatcaaagcccaaagaaacacaacagagaataaaaaaagaaatgacaaaagttcacccaaaattcccaagcacatgcgaagagagcttgtgtgatagcaaagcagcagttgttttaacggtgtggaagaagtcccttctcttcaactgcgacggattcacggtttacaacgccaatggagagcttgtctttagagttgacaactacatgaattgtcctagagacaacatcgtccttatggatgcttccggctttcccctcctctccattcgccgcaaggtactttttcttcttcttcttttttggtatttttcataacaaaaacatctatatatagtgatagacctatacgtgattccttaataattggccaaaaaataacactaatagttatgaaactaatcttaagttctcttgcttgctaattgacttgaacagaagttgagtcttggagattgctggatggtatacgatggagaaacagagagagatccaatattcacggcgagaaagaacgttagcataatatctaaccggaaaagcttggcgtgggttagcgcaaagaagacggtgttgtacgagatagaaggatcttacggtcaaagaagctgcaaaatattggatgagaggaggaacaagaagaaaacggcggagatcaagaggaaagaaacggtgatcggaggagttgcctttggcaaagatgtctataagcttatcgttgaatcggagatggaacctcgtgtggccatggcacttaccatcatcctcgaccaaatgtttcgatcttcttgattttcatttttttaaggtttatttttaacgtgtatattagttcctttttgtttatgtaatttatgcaatgtgttccttcctaaatgtacacatgaatagagaactttttttttcgtattgattttggcctttgatgatactacaaagatgcaatcaatttatcgatggatatttttagagacgattcaacgatgacggcttggtagagatgctgatgattaggccgcgggctatatttaataactgtcggtcatgaaagtttgatgtcaagttaacaagaaaaataaatgtctaattttgttactgttttattgccttttttttttttttactaaacgtttcattgcaaattgtctaatatatttgctaaaataagagtttgtttctaaaatttatcgtgaactaggaaatcaatatcaaaatttatgtcgaatgatatagattccacacttcacacgaattctctctagttcttgacttggatctaaataatggaattgccaaatcacgatttagtttcaaaagcatatttgagattttgcacctaaacacacataatctggttttgcattacgtgggaagcccaaaatcaatattttgggttgaaattttgatctgacaatcgaaaattaacaccaaaaatattcttgcaatcttttataacaaaacattaaagtcaatattttgatgttaaaatggattatttagaatacagtgtaaaaaatactaaatcgcataataagtttttttttttgtttgaaaataacctaattgtgtaataaaattttgacttaaagatttaaaactaaaatttagttttaaaattttagttcaaactaaaaattagcgctaaaatgttatttggcaaaaaaattacaaaattggggtttggcggtaaattgcgaattatgatttgataccaaatttattagttgaaatttgatggctaaaattgcaaaattacatagtcatacctttttgtttgcatcttaattatgatttcataccaaatccgtaaaacagcgtaactatagttttttcaatggttgttgtccaaatcgttgcttatttatttggctttcttggttgtattagatcagtgaattaacctatcaaaaaggcttaacacctgggcttcagacactttgtttctgttttggtcaacaatgcttctgtcttcagccacttagccgataaaaaaaaaaaaaaaaaaatgttacagattcagaaaaaatatcataagcctaactttcttatgatgatatttccggtttatgcttaagaaattctgcttgatactgaaatttcgtaattagccccattggtagcctttgctgctgcaacagttgcagtctcttcttcagtgttacggattcttattcttcagccctaaaaatcatcactttggaatcagaagcttgaatgatg

SEQ ID NO: 12545 - DNA, 450 bp, Unknown
  misc_feature (1)..( 450): cDNA_ID_3025650_gDNA_ID_2214558_Annot_ID_185819 3000 nt of promoter + ATG
aatactaatttaaaagaatgtaaagttttatgttatccgattgcataaatttggttttagtttggtttatttggtacaaattactgtttaatgttttttaatcataagaaattcagttttggttcgattcggtttacttggcttttgctcaccattatttatttatattaattttactcttaagattatttctagttccagtccagactaaaatacttctagcccaatatcggcccaagtccagctgtaattaaactagcatcactcgggtcgggtcgagtcggtcgtaaccgccttttatctttgacgtcgtcgatgaaactctcacctccgcttaagccctaaaaatcttactcttcttcactctaaatcccttctctgaacctcttcgtttgctgtatgtgttgatttcacttctctctgagcaagaagctttcgcgtgagagaatg

SEQ ID NO: 12546 - DNA, 3000 bp, Unknown
  misc_feature (1)..( 3000): cDNA_ID_1808620_gDNA_ID_2214558_Annot_ID_185818 3000 nt of promoter + ATG
gaactgacattgaagcgggagaactcaagcttgaggtgtctgacgaagtgatcatgacatttctcaaaagctctttcctcatcttcaacaaagaaacttttgcttgctttcctaaacaattttctatgttccttttgcgatttccccagtgtgcttatcaatgcattctcatcaactcccattcccatccctataaacaacaaacatacattttttagattttcaatctcaaatccaaatcattctttgtatcttccaagaaccataataaaatcaagaattaaatattacaattaccagctgagatggcttcagtgaggctttcgagctcgagaggaagagccattttcttgcagttgatcttttattactgtttttgatttccggctcttggtttggtttctgtggaaatctatggaagagggacaagacgttttatatgatgattaagggtaatgttgtggtttatgggagaagagaagggtgttttaggtattcaatacaagatttaagacaaatgctaggggcattgttgtaacaaggagtaacgcccacgcaattaattgcatatgttaacaactgttttacgcaaacggaatttacatacttcagtaagttcaagacaaattaacacttactgtttttctttgtcttaagtggaatttattaagtttgaccactataaaagttgtacttaagtgtcatcattcatatctataatccaaaacggaggttcttgaacacagataagaagaagagtttattttcttttacagttttcgaaaagtaggaaaattacaacaagaagtagagtctgacaaatgaaagtttctttagtataaaataaaatagtaaagaattatgtaaaagaaacagtaaagaatattatactttctaaagaaaattaagaaagtgaaaaagttatttggagaaattacgttttcagaatataggttctcaaaattagatgcaaagaacataaaccaaagtgattcaagtgatggtttaggatatgatcatatatcaaaattaagatccatgtgtcgaatagctcaaatctgaatttgtcaatattaaaggcaactaatctcactgaatcttaaaacatatataaagataatatctacgaaatagatagtctttggtgccaagaacaaggttttttttttgttactgcgaaacacacatggacctattacagaaaaataatggtttgaatatcatgggcaaaggagacagcttatctcttcttctctgttttttttcttctcattatgtccagactgtcccatttcataaattatgcacacaattgtagtagatggcaagcctcaatcacatttgtttcgcattattgtgacttgtgagactaataattaagcttctataatatatatatatatatatatatatatatattcaacaagtactatcacatgtttttttatagattatatattgctgaatatctatctgaatctgacaatgagatttgagaagattgtacaaccactacatgtgtcgcttaaccaaaatataatttggtcaaccaattaagacccgatttatatagtatatgagaattagtataagcgatttatacatcaaaacgtgttttgcacaacttccgctgaagctgtttaattagcatgttcctcatatatagttcaattttccacagctcaaatgccgccagcatataacccttacgtcaaatttcctcatattttattgtgtgtcataagacttgcgtatatccaattatccatacatgacacgatcgatactgaagaatataatttgaatattaatcacgagataactcactcattaaaattttaaaaagtttacaagattacgagatactcacttattggcattaagaaagtgtgaatcattaatcaacttacgtgtagattccagtactttcgcgccagggtcgattcacatttgtttacattagagtgatcagtttttaatctactacacacgaattttccatcgaaggatcaaaaaattctagagtatgattattttaaaaaagaaaagatcacgttttacacgacgagaggactagcaataatttggatcgaggacagctgtgttgagccgtatcatttgcaaatcgcaatctatttatttatttgatttgatttggttatacttagacttcactcataagatcatcccatcatgttcctaatcttaaatggtatttctatttcgcacatgtcacaacttagacagttgactaaatcataactttatatttaggttttaagtattaaaaatatatcaaattatattataagttttgtaatctctttttgttagtttagcctaccaaaaaaaaaagaaatctctttttgttagttcttcttgtcttttcgtaatcaactactatataacctatatatttatttatataaagacattgttaacttcgtcatcaaaaccatttatttatttgtccatttatttgctaccttagtttatttttagtactatatgaaatatcatacattttattttatcttaaattaaatacggtacaagttaaattcctcattaaaaccattgtacgttgtttttagtcctgttgtaatatcatttatttcattgcaagtttgcaaccttacaaaaagtaaaaatatgaaaaggttattttgtgttaattggaaattattacatagtatgtaggatatgaaaataggttaggagaaaagatgctccatagaactcatcaatacacacaactaatatatgaccctaattttaaatgtcctcaaaacgaaaaatctcgacagaaataggctaattgcgtcatattacagtttcgtcttcgggggcatttatgtcaaacaccatccccagctacataattacacctcctaagtaaataactccgccttgaggaaaaaaaactaaaacggctctaaattgaaaacaaaagaagagagagagagagagagacgaagaaacagagagattctctcgaaa

SEQ ID NO: 12547 - DNA, 3000 bp, Unknown
  misc_feature (1)..( 3000): cDNA_ID_1019319_gDNA_ID_2214558_Annot_ID_185817 3000 nt of promoter + ATG
cgtgattgagaaatgttagagaaataattaccatgaaatcaccagacagttcggaggatagaacatcgataagatctttgccataaatctctctaaaactttctctaatcttccttctctggctctggtctctttgccctaaaactcgtataatcgccttctcatctgttccccatcctacaagaatgagaaaactttcattcagagatttatgtcttaatgcatcgaatcacacaacaaatgcttgcggctatggatgtaacgtaccgcgaatagcttgtttgagagtttcagaatcctgagctggagaaggaacttcgtttggtactctaatggtggccattttcgagagaatctctctgtttcttcgtctctctctctctctctcttcttttgttttcaatttagagccgttttagttttttttcctcaaggcggagttatttacttaggaggtgtaattatgtagctggggatggtgtttgacataaatgcccccgaagacgaaactgtaatatgacgcaattagcctatttctgtcgagatttttcgttttgaggacatttaaaattagggtcatatattagttgtgtgtattgatgagttctatggagcatcttttctcctaacctattttcatatcctacatactatgtaataatttccaattaacacaaaataaccttttcatatttttactttttgtaaggttgcaaacttgcaatgaaataaatgatattacaacaggactaaaaacaacgtacaatggttttaatgaggaatttaacttgtaccgtatttaatttaagataaaataaaatgtatgatatttcatatagtactaaaaataaactaaggtagcaaataaatggacaaataaataaatggttttgatgacgaagttaacaatgtctttatataaataaatatataggttatatagtagttgattacgaaaagacaagaagaactaacaaaaagagatttcttttttttttggtaggctaaactaacaaaaagagattacaaaacttataatataatttgatatatttttaatacttaaaacctaaatataaagttatgatttagtcaactgtctaagttgtgacatgtgcgaaatagaaataccatttaagattaggaacatgatgggatgatcttatgagtgaagtctaagtataaccaaatcaaatcaaataaataaatagattgcgatttgcaaatgatacggctcaacacagctgtcctcgatccaaattattgctagtcctctcgtcgtgtaaaacgtgatcttttcttttttaaaataatcatactctagaattttttgatccttcgatggaaaattcgtgtgtagtagattaaaaactgatcactctaatgtaaacaaatgtgaatcgaccctggcgcgaaagtactggaatctacacgtaagttgattaatgattcacactttcttaatgccaataagtgagtatctcgtaatcttgtaaactttttaaaattttaatgagtgagttatctcgtgattaatattcaaattatattcttcagtatcgatcgtgtcatgtatggataattggatatacgcaagtcttatgacacacaataaaatatgaggaaatttgacgtaagggttatatgctggcggcatttgagctgtggaaaattgaactatatatgaggaacatgctaattaaacagcttcagcggaagttgtgcaaaacacgttttgatgtataaatcgcttatactaattctcatatactatataaatcgggtcttaattggttgaccaaattatattttggttaagcgacacatgtagtggttgtacaatcttctcaaatctcattgtcagattcagatagatattcagcaatatataatctataaaaaaacatgtgatagtacttgttgaatatatatatatatatatatatatatatattatagaagcttaattattagtctcacaagtcacaataatgcgaaacaaatgtgattgaggcttgccatctactacaattgtgtgcataatttatgaaatgggacagtctggacataatgagaagaaaaaaaacagagaagaagagataagctgtctcctttgcccatgatattcaaaccattatttttctgtaataggtccatgtgtgtttcgcagtaacaaaaaaaaaaccttgttcttggcaccaaagactatctatttcgtagatattatctttatatatgttttaagattcagtgagattagttgcctttaatattgacaaattcagatttgagctattcgacacatggatcttaattttgatatatgatcatatcctaaaccatcacttgaatcactttggtttatgttctttgcatctaattttgagaacctatattctgaaaacgtaatttctccaaataactttttcactttcttaattttctttagaaagtataatattctttactgtttcttttacataattctttactattttattttatactaaagaaactttcatttgtcagactctacttcttgttgtaattttcctacttttcgaaaactgtaaaagaaaataaactcttcttcttatctgtgttcaagaacctccgttttggattatagatatgaatgatgacacttaagtacaacttttatagtggtcaaacttaataaattccacttaagacaaagaaaaacagtaagtgttaatttgtcttgaacttactgaagtatgtaaattccgtttgcgtaaaacagttgttaacatatgcaattaattgcgtgggcgttactccttgttacaacaatgcccctagcatttgtcttaaatcttgtattgaatacctaaaacacccttctcttctcccataaaccacaacattacccttaatcatcatataaaacgtcttgtccctcttccatagatttccacagaaaccaaaccaagagccggaaatcaaaaacagtaataaaagatcaactgcaagaaaatg

SEQ ID NO: 12548 - DNA, 3000 bp, Unknown
  misc_feature (1)..( 3000): cDNA_ID_1012980_gDNA_ID_2214558_Annot_ID_185816 3000 nt of promoter + ATG
taattttctttagaaagtataatattctttactgtttcttttacataattctttactattttattttatactaaagaaactttcatttgtcagactctacttcttgttgtaattttcctacttttcgaaaactgtaaaagaaaataaactcttcttcttatctgtgttcaagaacctccgttttggattatagatatgaatgatgacacttaagtacaacttttatagtggtcaaacttaataaattccacttaagacaaagaaaaacagtaagtgttaatttgtcttgaacttactgaagtatgtaaattccgtttgcgtaaaacagttgttaacatatgcaattaattgcgtgggcgttactccttgttacaacaatgcccctagcatttgtcttaaatcttgtattgaatacctaaaacacccttctcttctcccataaaccacaacattacccttaatcatcatataaaacgtcttgtccctcttccatagatttccacagaaaccaaaccaagagccggaaatcaaaaacagtaataaaagatcaactgcaagaaaatggctcttcctctcgagctcgaaagcctcactgaagccatctcagctggtaattgtaatatttaattcttgattttattatggttcttggaagatacaaagaatgatttggatttgagattgaaaatctaaaaaatgtatgtttgttgtttatagggatgggaatgggagttgatgagaatgcattgataagcacactggggaaatcgcaaaaggaacatagaaaattgtttaggaaagcaagcaaaagtttctttgttgaagatgaggaaagagcttttgagaaatgtcatgatcacttcgtcagacacctcaagcttgagttctcccgcttcaatgtcagttcttttcttccattaatcttctttccatttttaacattttctaaatgtttttaccaaataaaaaatctttattttggggtcaaacctaataataaatggaaccattcttgtttttacctaataaaagtataaacccaaccatatgttacaatttaatacaaaaaactaaaacaattctaaaattgcttaatttggttaatgtaattaatacagaaactatataacaaaaataattattacagctggtttattttttctttatgaattagtatttataaaggatctcaaacatttctttaaaaataaaccaataatttactgctcaaaaaatcacagaagatgatacgatggaaatgatgaagtttttcattcataactaattggtcaatgagtagataaaattcacattctatttcaaaaatagttgacaatgagtgaaaaagtcacattctagtattgaaacgtatctccacttcagatatggaattttaagaacaatttggtgtgtgatgtgtagactgcggtggtgatgtgggcaatgcatccatgggagagagatgcaaggttggtgaagaaagctttgaagaaaggagaagaagcttacaacctcatcgttgaggtctcatgcacacgctctgctgaggatctcctcggtgcacgtaaagcttaccactctctcttcgaccaatcaatggaagaagacattgcctctcacgtccacggtcctcagcgcaaggtcaatatttttatatactctagtgtgttggtctctttcaaacttcttttatctcactcattgtctctgttttttgtgcagttgcttgtggggctcgtgagtgcttatagatacgaaggaaataaggtgaaggatgattctgccaaatccgatgctaagattctagccgaagcagtggcttcttcaggcgaagaagccgtggagaaggatgaggttgttaggattttgaccacaagaagcaaacttcatctccaacatctctacaaacactttaacgaaatcaaaggctctgatcttcttggggtaacataaatataacaacaactcacttcttgtatatactaatgttttgatattctctaatgaaaatcttgtggtttaatttggtcattagggtgtatctaagtcttctcttctcaatgaagcattgatttgtttgctcaaaccggctctgtatttcagcaaggtatatatgaaccatattcttcattgcggttgttttataacgccaatttctgcgtttgtgtttatgttttgtcgtgatttggttttagattttggatgcgtctctgaacaaagacgcagacaagactaccaagaaatggttgacaagagtgttcgttacaagagcagatcatagtgatgagatgaatgagatcaaagaagagtacaataacctttatggtgagactttggctcaaagaatccaagagaagataaaagggaactacagagatttcttgctcacacttctctccaaatccgattgatttcgtgttgagaaacctattaccaatacttttggttattgaagatttatgatttccctttttatggttttatgtttctaattcctaaatttgcgttttctctaccgtttggtaataaagacatgaaaatttgatgaactcggtgaatcgagagtaagagttttgcgattgtgacaatgagtgattaatacaaggattaagctccaataaaaaaatgttgcataaatcagaaatgaaacttgtaactcttcttttctttatgtgaaacttgtaactctatttgaaagattctatgtgaccactaaaccgaattacggattccaaccgaatttcacctctaactaaaccggttgaatgttgatgaattccggtttgaaatttcggcagtatgtgggtgacacgtggcgaagaatagtccccgaatcttcctctgacgaccatttgatacttttttttcttcagtttgttggttttgtcctcttaacaaaatattcttcaaactctctctgttgtttgtttgttgacaaatctctcaaaaccatttgttttgcaatcgcagatccgtttttcttcgggtctcatcacaatg

SEQ ID NO: 12549 - DNA, 3000 bp, Unknown
  misc_feature (1)..( 3000): cDNA_ID_2709126_gDNA_ID_2214558_Annot_ID_185815 3000 nt of promoter + ATG
aacaacaactcacttcttgtatatactaatgttttgatattctctaatgaaaatcttgtggtttaatttggtcattagggtgtatctaagtcttctcttctcaatgaagcattgatttgtttgctcaaaccggctctgtatttcagcaaggtatatatgaaccatattcttcattgcggttgttttataacgccaatttctgcgtttgtgtttatgttttgtcgtgatttggttttagattttggatgcgtctctgaacaaagacgcagacaagactaccaagaaatggttgacaagagtgttcgttacaagagcagatcatagtgatgagatgaatgagatcaaagaagagtacaataacctttatggtgagactttggctcaaagaatccaagagaagataaaagggaactacagagatttcttgctcacacttctctccaaatccgattgatttcgtgttgagaaacctattaccaatacttttggttattgaagatttatgatttccctttttatggttttatgtttctaattcctaaatttgcgttttctctaccgtttggtaataaagacatgaaaatttgatgaactcggtgaatcgagagtaagagttttgcgattgtgacaatgagtgattaatacaaggattaagctccaataaaaaaatgttgcataaatcagaaatgaaacttgtaactcttcttttctttatgtgaaacttgtaactctatttgaaagattctatgtgaccactaaaccgaattacggattccaaccgaatttcacctctaactaaaccggttgaatgttgatgaattccggtttgaaatttcggcagtatgtgggtgacacgtggcgaagaatagtccccgaatcttcctctgacgaccatttgatacttttttttcttcagtttgttggttttgtcctcttaacaaaatattcttcaaactctctctgttgtttgtttgttgacaaatctctcaaaaccatttgttttgcaatcgcagatccgtttttcttcgggtctcatcacaatgaatggcttctctgatcttaatccttctgagaggtacgctttgtctgatcatcaatgatgcttataataatctcatttatacatgatcttgcctctatatatttgttcatcttagtaatcttcggtctcagcttccattttcgtctcccactatgtttctaggattttgtgttacttttgttagaaaactgcgatttttgtgctagtgtttgtttctccaagatcaatggaactcgttgcctaaaattcctgattatagttacataaacatcaaatggttctaattggtctttgatcttaaacccatttgattatggtatctaaagtttgatccttttgatgcactctcatcgcagtttctcgtgattttaatattattgaactcttttgatttgtggtgaagcaaaccttctctgtcacaactagctccattagaagccattctgtttgatgttgatggaacactctgtgactcagatcccatccaccttattgccttccaagaactgcttcaagaggttccttgctttttttaatgtcattataacttccaaatttacaacaagactttagaaaactgtgaataatatgctatggaaccttgctattactcagtttcaagctctcgtgtcaatcaattttgtttctttctatcattcgcagattggttttaacaatggtgtcccaatcgatgagaaattctttgttgagaacattgctggaaaacacaattctgaaattgctctacttctgttccctgatgatgtttcaagagggttaaaattctgtgatgaaaaggaagctctttaccgcaagtaagctatttttctgtgtttcctccattcttttaatgtcacaaactcttttcaggtctgagttcatttggagtaactttgttttgttcttttttcttgatgattagaattgttgcagagaagataaagccacttgatgggcttataaaactgaccaaatggatcgaagatcgtggattgaaacgagctgcggtaacaaacgctccaaaagaaaacgcagagctcatgatatcgaaacttggtctgactgatttctttcaagcagtgattcttggctctgaatgtgaatttcccaaaccacaccctggaccttacttgaaggctcttgaagtgcttaacgtgtcaaaggagcacacgctagttttcgaagactcgatctctgggataaaagctggagttgcagctggaatgccagtgattggactgactacagggaatccagcaagcctgcttatgcaagcaaaacccgcttttctcatcgagaactatgcggatccaaaactgtgggctgtgttggaagaacttgataacaagtcttaagtctcacttgtttggcttatggaaacccacacatgcatgagcagcctctgaagtttaccttatgtcttagatgatcattgttgaataattcattgggagtttatgacaatgggagctttcaaatatctgattattttgtattgatacatgcacaatgctagatttgtatccaggagatagttgcataaaccaatatactataccctcggatcttagcttattttcattgatatcttgttgttttgtgctgtaaacatatcagcttttgaatacatttggtccatggcgcaaaataagactttttttttttttttaccataccttaattagcaaagtaacaaaattgttagttttgaaaaatactcttaattaaataaaggaaataaacacttgccgacagccaaaaaaaaaaggttatgaacaaattgaaagtattgttttcatcaaagcccaaatatgtaaagcccaaaaacggaaaacatctttatttcaacaatacatatattaaggcgtaggaaaaactaataagagaggaaaagagaagaaggagcaaaaaggttttgccgaagttgagagatcaatcaaagatttgaagttccgatg

SEQ ID NO: 12550 - DNA, 3000 bp, Unknown
  misc_feature (1)..( 3000): cDNA_ID_1028073_gDNA_ID_2214558_Annot_ID_185813 3000 nt of promoter + ATG
ctcggataatgtctaggctgaggcatccttttttcaaggcatcatcaggtagactagaaagtaagctgctgcaatggtcaaatcttctcctctcatccataggtgtttccattaggttccacagctcttgcatgcttcttcccaaaccttgtagctgaaataaaagaatcaagggatcaatccgtcaagctaaggtttgctttcttggagttgatgaattcatttccgtgagaaatagtgccaggttaaatagtaggctaccaataaaaactgcattttctaattgaatgctactgtgctcattgctcaagtgcagtggtaactggtaagacatgagaaaccacataatatatgtatatatacacttcagaagtgttatttttttatcaccttaagcagcctctcatgtttctccgccttcagagactttacaagttctgtgaacctagcaagagtatcattactaatgcttttcgaatgagtctttgaaaactcagtcaagctgctatggacactattcagggccttggagaaatcaaaagacagaatctctgacagctcatggacagcactgatataagagtttactttctgcagtcgaacagcctgaaattgaaataaagatgataagcaaataactacaaacattttaaaacaatcacttcgacgtgtgtgtgtgtgtaagaacaccttttcatttcgaagatcctgcagatctgctctaagttcatccaactttctttgtgtcaagtcactttcatcaacttctgaaccagaactaacagtataatcattccctgctatgttagacgtgatctctgctatttgattcagtgtctcagagagctctttccttcttcgatcctttttcatcagtagatcttccagtacaggctttacactggaaatctgctccttcaaagagccttctttcttctcaaacaaaaacaataacatatatcagacattatataatactctctatgagacaaacatgtagtattgctaagagtatcttaccttggcaaacgaaactttttcaccaagcgcagacatgaggctggcaatctcagcttcagcttgagctaatgatcgctgtaactcagctctgaacttacgagttttctcaaccttcttattgtatatatccagacattcctgctcaagttctagcagcatcttatctctttcattgtaactttcaccaatctcatcccatatcatctacatccgaataaaaccagtggtaaacatcaccagctcaagtttttcctcaattgacacagaacaagacattatcattagtagtatcctaatcctgatttcgattattgctcatactaaaaccatcccaagaaaaagtagagtacacgtctttcacaggaaaacctaaaactgtaagcaaatgtaacagcggaggcataactcaaaatggcctgaaatcgaatctaactgacagtgatcagaagcataaaccctataaaatcaaaattcgaaattcaattgcgttacccaacgaatcaatgaatcaccggaaactcaaaccaaaagagatagatgtaatcgcaatctcccgcagtcaaaatttcgaaacaatctggagaatgtgaagaagctacggagagaaaaaaaaaaaaaaaagaagaagcgaggaatctaagaacctgcaactcttcaagaagggaagtgcaagtagtggttgaagacggagacattttgttcacgccgccggcgagtagtgaaaatgacgttgctcagaaaccctagaaggcttatctggttacagcgtgaagatcccgagagatattgttttgaaggacgagagcaaatgtcgattttggaaagaatgtgtttttggcggtaaactataaaaaaaattagtatccctctcgaatttcgtgcccggggaagtccgaatgttttttttttttgccattttctttgttgaaattctagagaggttacaaaaataccaatattctagagaataatcaaacttgatttagtaaccaaaaaaaaatgtatctatttatgttgaataaataaaaattcttatttaaaattttcctttgctttgcatttgactatatgtaaaaattgttattattattttatatttggttgtatattgcattttattttttatgtaaagtaaaccgtctaaacaaaattagacgattactaacctagtttttaggaaagataaattatctttttaacaaatactataaccatatatgttttgataaatatgtttatatcttgtctttttttttcggtaagaccaaaattcttgtcttataaaattagtttatatcgaataatttaatttttctattatgtagtaatgacaaaataagttaaatagattatatattgaatcgataacttttaatcttttttacttttgaaaaaaaaaaatcttttgtgaatctagctagggcgacgtatatatatggagaaaaacaaaaactagctgcggccgtaactaagctcaaatagtttagttaacaagtctttgagaaaaagacacaccaaccaaaaaaattgtcactatactcaaaatcaaacaacaaagctttctaattaaacaaaacgtagacacttcatcttcctctctctcctgcgcttttctttactcaggttttctccgctctcttcttcatactcagaattgattccttatctcttttggtttcaattcttcttacagatcgatccataaccttttagattccatagcttttaattgatttccctcatacaaaacagatcaatttcatcgtcgaccatcacttttaaattttcaattttttaatactgctattgctaatttgtgcaatttggtatttgatttgtgagttgcttttgatagttagctctgggtagtgtttaaaaattggtatctttaagcataataagattttggttatttcaggttcacattacttgctgatttggatttttttcatctgcggttttctcttccaagcaacaatg

SEQ ID NO: 12551 - DNA, 3000 bp, Unknown
  misc_feature (1)..( 3000): cDNA_ID_1017185_gDNA_ID_2214558_Annot_ID_185812 3000 nt of promoter + ATG
tttctcttccaagcaacaatggtgtcggcgaacagagaaatggctgtttactgtttcgacactttggtctctcactacaacaatgaagagactccaccacctgcctttgaagaggccaatcagtaagtttttttccttgcttgtgttatgacatgcaagtttgaatctttctcaaagtatgcatttttttgtaattctctttgtttggaatttggatagagtactattgaacggacgatctgttcttaaatacaaaatcaaattctttttatggtcccaagttgttcttgatactgttatgagtagtcactttgagtatgtgaaactgtctgtgatgaggatattctttcacaatctaatattcagagactgtgatcagcagatccttgcaaacattgcatgccttatcgttgtgatgctagaaactaaccattttttgttttctgggtattttgtgttgaatgtttatggatgggtgatataatctgaagcgcatactttttgtgtccattcttactgatggtccagtctttttgctttttgtgtagtccattgtttgttacctggaagaaaatagtgaatggtggagagcctcggttgcgtggatgtattggtacactggaagcacgccgcttgatcagtggcttcaaggattatgccttgacaaggtacgtactcgtcctcattcagttttttttttctgattctcatattattttcttggccatattcatgatgtgcttttcgtctgctttgcttttttttcatggttgaaattgttctgcctcaactttgcttatcatatatctgtgttcttaagtcttagatagtatctcttaacaactttgttgaatttttcttttgtctgtctgctttacttctcttctttctcatttttctcttgttgtaatgtacttgtgttgcttgatactaagagcggtttaagatagactacaaattgataaccataaggtgacaaacaacaaactaatggataagtacacatgtacagatatacttttacatatgtaaataggcagttctttgtctaatttatcaaacagacataaatggcattcccctattgttttgagctaacagatttcatatcaagtatcaaaattttcagctgtttttgtactgtgtttggtgtgtaatttatatttttgttgcaacccatctgctgcagttgattaaaattttttgctgtatctttttcgaaactttgtgtatatcgatagcatgaatagcaatagtattacagtgaaagctaatcaggcttcaacctctgtaaaggaactgagtaattcagttttagagattttaggcttgacaccacaaatgaagcacatatatgtaggtgtttattgtgcagagagagcctctattcattagcatttcccatagcttatctgccttttatgtcatgtggttggtcgtaaatgcttgtgatatctttcttttgttgtcagttttaaacgacattagttttcttatataatattgcagtgccttgagggatcgcaggttcccacctatacaggccaaagaattgccatctctgcagtgtacggtgtctgtcttgactgattatgaagatgcagaagattaccttgattgggaggtatattctcttcactcttttcttacaatatgtcaatctcacgaattaagaatatagttgccaagaaggaatgcatactattcaatgtacacagccaataaactttccgttgtcctttccctcatatcattttcccgcttagttaactgctctgccttgctcatgacattgtagtttgtcgaattcttcttgtttgtagtttgtcttatacattgtcccgttggtgatattttgttttgtgatttcactctaaaggttggtaagcatggtataatcattgagtttactgaacctgagactaatacaaagcgaagcgccacatatttgcctgaggtgccagctcatgaaggtaccatttcaatacaataattcaagtacgtgttgttgctattggtattgttgatacaacgattactttttttatccccaggctggacaaagatagaggcaatcgattcgctggtgcgtaaagcaggatacaatggtgtaataacagaagcagtgcgtaggcgaatcaatctaacgcgttaccagagtacattattcagcatgcattatagcgaatacctttcatatgtgaaggcgaccaggggcgttgttggcccggttattaatgggatcaacaagcacgcctttgcctgatttgcacctgcaaatggatgccattgattatgtttggctacctcctaatttatcctctgtcttgttgtctggctctcataaaagaaacgagacttcgaacttggctgtttcactattgtaacattaattaaatcactttcatcccttctctctttgttcctcacttcctcttaattagactcgatgttaaaatcgtatcaggtaaacttgaacttagtgttgacaatgtccaaattgaccaaccgtttatcaacctcatactacagtaacaccaagtcaactgtttttgttaaaagtcaactcaaagttggaggttacttatggttaatttaagagtacacgcttatttcgtaagaatattttaaaagttggaggttatttatggttaatttaagagtacacgcttatttcgtaagaatattttaaaagttggaggttatttatggttaatttaagagtacacgcttatttcgtaagaatatttaaaagttgggggtgtttattttgattttttcgcatattaaaaaattaagaatcatgaatcgcttacgcatgtgcagtttggacgcaactgaatcgtaccaatgagatcatcctccttattttaatctcccacctgatttgagctgtttctttctctttcgaactctccgtcacttccatttcatttctatttgaatcttctcaaagctacacagatctctgaaatcgaaaaagcttgagctgtgttaatg

SEQ ID NO: 12552 - DNA, 3000 bp, Unknown
  misc_feature (1)..( 3000): cDNA_ID_1025340_gDNA_ID_2214558_Annot_ID_185808 3000 nt of promoter + ATG
ccggtatgcctagcgatatttttcaacgccattgacgacgctttatataccactggtaaatctctcctctgttttttcctattttccgatttcttctttgttaagaattctatgtatgatgaatttagctgagtgaagaagatgaattttagctgagtgaaagcttatgatagtctggtgaaatctttaatccatttaggttcaatctggtgcaagtttgtttttactgtattatgcgcctctttatttgtttgtgtggatgtaatgaagagtatggagctaaaaggatcaaattatggttttattctagcttaggctgacctgtctaaggttctcttgtctggtctgtacttttacattgacttttttcttgtgcttgatttgaatcagtgactgttcttttagttttgagtatgttaatgatcgcgaggaaagctttggcctcggcgcatactaaggcgtttcgtttggcaacaagggatgtacattgctttagttccatcttagtgtctcctcctctcgtgtcacttgacttgcctgaaaattggattccttactctgatcctccacctcctgtttcctttggtaatactctttgttgcattttcatggctatatatatatgttacaagaaaattctctaattgtatgagttgatttctgtgtgtatgcatttatacagagactgaacagaagactgtggtgatagatggtaatgttatcgctgaggaaatcagaacaaagattattagtgaagtggggaagatgaaaaaggctgttggaaaagtccctggtcttgctgttgttttggttggtgaacaaagagactcgcaaacttatgttcgcaacaaaattaaagcttgtgaagaaactggcattaaatctgttttggctgaattaccagaggattgtactgaaggacagattatcagtgtattgagaaaattcaatgaagacacgtctattcacggaattcttgtgcaacttcctttaccccaagtatgtttctcatttttttctttggacgttgtgatgggggatgttagtgttgttgatgtcaaagattagttctatgttaggaggtcaagtagttacgtttactttgttttcatacttgtatgtagaaattcttgattcatatattttcatcgaccatggactcatgcataacattttcccctttaaggtttccttttcgttggtaggtaaagcatttaatttacaggttatgcgatagagcatcttacttgtggagctctttttcaggagaacgttcttgtattttgttggtttcctttcctttttttttttttttctcatgagtccaatcatttaatggaagatatcttgtacagcatcttaatgaatcaaaaatcttgaatatggtgagattggagaaagatgttgatgggtttcatccattaaacgtggggaatcttgcaatgagagggagggaaccgctgtttgtatcttgcactcctaagggctgtgtggagttgttgataagaacgggtgttgaaatagcaggaaaaaatgctgtggtcataggcagaagcaacatcgttggactaccaatgtctttattattgcaggtattagttcttctttatagttcaagtggattcttatgcttaaacattttggtttgggaattaactatgcatttatgttttctgaaattctcggatagaggcatgacgcgacagtaagcacggtgcatgcgtttacaaaggatccagagcacattactaggaaggcggatatcgttatagcagcagcgggtatacctaatttagttcgtggaagttggcttaagcctggagcagttgtcattgatgttggaacaactccagtcgaggtaaaaacgaaactattttccttaactgatcaaaagtcttaatactttccaatgaaaaaagacttataccatagcttgaatccaatctgatatagaaaacgttaaactgaattagagcttgaaatgtttttccttcagattgttttcttgtttctgattagacattgaagcatgacgtgttataatattgcaggatagtagctgtgagtttggttaccgtcttgtcggggatgtatgttacgaggaagcgttaggtgttgcctcggctatcactcccgtaccgggaggagttggacctatgacgatcaccatgctactatgcaatactttggaggctgctaagcggatcttcctctgagtatggtatctctgtctattactaaatatattttgtaatgttagataggagactccatgctgttcgagttattaacgatctcttttgaattattgtataatagacctggcgattgtgatgccatggtttatcctaactcatcagcatctttagcatcaagttcaactaaacaagtattcatgttttcgtttcattggcttttagaagatgagaatccatttagttataatttaaaacttaaggtagttagatcactggtcctactagcagctaaagtaggaggaatgttgcgtcttacatcaacgatagaagatgactcaagcaagaggtgtcacatgaaggatcacgaaatatttgcttcctacgatattttacacgtcttctcaaagtttctcacctttacattgtttgctttggttcggtttagattctctcttttgctgcttttatcacttttgtaaaactcgaaaccggttttggttcggtttagattctctcttttgctgctttgatcacttttgtaaaactcgaaaccggtttttgattctttttttccttcgaaacttaaatgatatctttaaaccaaaacgaaccaaactaaatcacacaattacgatccggtttgaagatattttgttgtccgtaggattctgattccgagtctctagttccaaagagaagagaacatctgtgagagatctgagacgtctggaaatgtgaagaaaacaaaaaaaaaaaagatctgagagagagagtttcgaaattctcgtgttcgtaagcaaaa

SEQ ID NO: 12553 - DNA, 3000 bp, Unknown
  misc_feature (1)..( 3000): cDNA_ID_2709152_gDNA_ID_2214558_Annot_ID_185804 3000 nt of promoter + ATG
tattaactagtttgcacagtacatttatccatggtgttgaagcttcttctcagaaagcaaaaacaatcaggtcttatgaaggatttctctcagacagtgtgtctgttgcaatagcggaggaggccctttcctcggtaggttaaagtttcgcatccttgctcatgcgaaactaaatagtaaatagtaaagaaactttgaccatacaatgtgtctgtagcaacattacagcaggaagctacactaaatagtaaagaaagtttcgcatccttgcacatgttaaatgattcaagcagaaacattgttataaaaaaaacacaagctgcacaaaaaccaatccacacttcacaaatccaaacgcaccaaataactttgtcgacaactatggtctcaatagtttaaagcacagaggtaaatggatccatcgcaacctttacagtccttgtactttaattttgagctgatagtttttcccctaattgaggtaacgtacaaatcaagaaagacattgattactatgtaaataaagtgcagtgtaggtataatgttatatccgtatagagataatacatataagtaaagagcatgcatgtggtataaagaaagaagaaagagacctcaagcaaaattgtaacgatgaagtcccatcttagcataaagcttgactaagtggtaaggattaggagggagataaagacagttaaccttgaccattttataaccaccgcatacacgtccatatgaccatatacaaacatactttcatcgtcgtcggatgatgacgatacagaccaaaacaaatcccaatcacaatcatggttagacatataattaacaagaagatgagagaaagaatatcgattggttttgagaaatatacgatattcggatattcccatgatcaaattttcaatatcgatcggtttgaaatctggtcgatctcaacatatatgacaacaaaatttgttgtcaacccttcattcatttgtagtaatgtatattcatcgaatggaatcaaatgtctcatagtcatattttaaaaaggatctacttagaaaacttcattcacatactgtacttacccatttagtgatgacgtacgaggtaagatgcaaattgttttctcaacacaaaaacactaaagcaaagttgaggaataagttggtgtatagagtgaggaatcagatttggtaggaagacagaattattaggttgtattacatctgtataattaaagagaaagagagagaacatattcttcaaagtgcaacgcgtaattttcaatccatttgtttttgtgaaagtgggacgtctcttacctctcaaaggtcgtaatcagctttttgtacatatgacgcagaaaccgcaatcttttgttttaaaaacaaacgatagataatgaaagaaatttaaaataaatgaggtcaacgtaagtggaatactcatgataacaatggacgtggaaaaatatcaatagtaaaataatttcagaacttttaattgtataaaatttagtggaattttgttgggatggttttatttttcttcccaccgctaattgcttctccgccacacacctccttatgtttaatcatttattatcatgaatcatgatatagtggtcctccttcatcatatcaaaattaaaaaccaaagattggttcaaaactcaattttttcttaactcggttatatttttttgtatatattttaacttttgcaatccactcgttcttatcttccactagattatcttttcctcgactcaatgttcatggtaataaattattcaaaacttgattgtcttttaaaataaattaaatcggatgtttgatatataattggactaataaggagctcatgaccaaaaatattggaattcggacacctgcgagaaactgatccacaaagtgatctttaaactttctttctttttggttttaatagaaatccttaaacttcatatcaccaatatattgattatcttagagagtagatcatatatttctttctttctttttatttcggtttaaatcatatattactttcggttcggacacatgtagtctgttgttgaaaggaacaaatcaaatactttcggttcaatatggagaggaaacaaaaacgataatcctgcagaaatagaaatataagaacatggaaaatatttcaaatagagactcctgtttcccactatgaaaagatgcactggaagtgtcgatggattatggcccgtaggttttcgttactatagattctttactttttgtgtactgatcagcacattaatattctctagttataataacaaaaatgtagagggaaaccaagagagaaagattcgagaaatgttttatttttattttttgacatcgattcgagaaatgtttaacccgggaattgataaaataaaatagaggagagtgttagtataagattttaaaacttgggttatcaattaagaaaaagaaaatacaattgccaaactatatactaagttgctaacagtatagtttctgtaaaattcatgaaaatatagagcatacgaactagagttagtgtcaaatttatattattcatgagaccataagctattttgtagggccaatattggccagaacaggaatcaaaaacaaggtttcaatataatattttgttggagtctaggtgaatgaaaaccggccgttattataatatttgattatagaaaggaatcaatccattaatttgcatgaatacataaaaaaaaatggacctaaattgaagagaagatatcttatagtaatagactgaaagtgatatctctctagtggaaaacaagaagatgagagaccattcttttcatttgagaaccacattctctctctctttctacatttgtataaataaacccaaagacctcttctcatttgtcccacattcaaacatcatcaacttatcgatcttctccaacaagaatcatcaaagcccaaagaaacacaacagagaataaaaaaagaaatg

SEQ ID NO: 12554 - DNA, 3000 bp, Unknown; identical to SEQ ID NO: 12544
  misc_feature (1)..( 3000): cDNA_ID_1808299_gDNA_ID_2214558_Annot_ID_185803 3000 nt of promoter + ATG

SEQ ID NO: 12555 - DNA, 3000 bp, Unknown; identical to SEQ ID NO: 12543
  misc_feature (1)..( 3000): cDNA_ID_1807782_gDNA_ID_2214558_Annot_ID_185802 3000 nt of promoter + ATG

SEQ ID NO: 12556 - DNA, 3000 bp, Unknown; identical to SEQ ID NO: 12542
  misc_feature (1)..( 3000): cDNA_ID_1807259_gDNA_ID_2214558_Annot_ID_185801 3000 nt of promoter + ATG

SEQ ID NO: 12557 - DNA, 3000 bp, Unknown; identical to SEQ ID NO: 12541
  misc_feature (1)..( 3000): cDNA_ID_2709148_gDNA_ID_2214558_Annot_ID_185800 3000 nt of promoter + ATG

SEQ ID NO: 12558 - DNA, 3000 bp, Unknown; identical to SEQ ID NO: 12538
  misc_feature (1)..( 3000): cDNA_ID_1985638_gDNA_ID_2214558_Annot_ID_185796 3000 nt of promoter + ATG

SEQ ID NO: 12559 - DNA, 3000 bp, Unknown; identical to SEQ ID NO: 12537
  misc_feature (1)..( 3000): cDNA_ID_1375747_gDNA_ID_2214558_Annot_ID_185794 3000 nt of promoter + ATG

SEQ ID NO: 12560 - DNA, 3000 bp, Unknown; identical to SEQ ID NO: 12536
  misc_feature (1)..( 3000): cDNA_ID_3025683_gDNA_ID_2214558_Annot_ID_185793 3000 nt of promoter + ATG

SEQ ID NO: 12561 - DNA, 1369 bp, Unknown; identical to SEQ ID NO: 12535
  misc_feature (1)..( 1369): cDNA_ID_1833587_gDNA_ID_2214558_Annot_ID_185786 3000 nt of promoter + ATG

SEQ ID NO: 12562 - DNA, 3000 bp, Unknown; identical to SEQ ID NO: 12553
  misc_feature (1)..( 3000): cDNA_ID_2709152_gDNA_ID_2214558_Annot_ID_134834 3000 nt of promoter + ATG

SEQ ID NO: 12563 - DNA, 3000 bp, Unknown
  misc_feature (1)..( 3000): cDNA_ID_2709156_gDNA_ID_2214558_Annot_ID_134835 3000 nt of promoter + ATG
cttgcttgagtcatcttctatcgttgatgtaagacgcaacattcctcctactttagctgctagtaggaccagtgatctaactaccttaagttttaaattataactaaatggattctcatcttctaaaagccaatgaaacgaaaacatgaatacttgtttagttgaacttgatgctaaagatgctgatgagttaggataaaccatggcatcacaatcgccaggtctattatacaataattcaaaagagatcgttaataactcgaacagcatggagtctcctatctaacattacaaaatatatttagtaatagacagagataccatactcagaggaagatccgcttagcagcctccaaagtattgcatagtagcatggtgatcgtcataggtccaactcctcccggtacgggagtgatagccgaggcaacacctaacgcttcctcgtaacatacatccccgacaagacggtaaccaaactcacagctactatcctgcaatattataacacgtcatgcttcaatgtctaatcagaaacaagaaaacaatctgaaggaaaaacatttcaagctctaattcagtttaacgttttctatatcagattggattcaagctatggtataagtcttttttcattggaaagtattaagacttttgatcagttaaggaaaatagtttcgtttttacctcgactggagttgttccaacatcaatgacaactgctccaggcttaagccaacttccacgaactaaattaggtatacccgctgctgctataacgatatccgccttcctagtaatgtgctctggatcctttgtaaacgcatgcaccgtgcttactgtcgcgtcatgcctctatccgagaatttcagaaaacataaatgcatagttaattcccaaaccaaaatgtttaagcataagaatccacttgaactataaagaagaactaatacctgcaataataaagacattggtagtccaacgatgttgcttctgcctatgaccacagcattttttcctgctatttcaacacccgttcttatcaacaactccacacagcccttaggagtgcaagatacaaacagcggttccctccctctcattgcaagattccccacgtttaatggatgaaacccatcaacatctttctccaatctcaccatattcaagatttttgattcattaagatgctgtacaagatatcttccattaaatgattggactcatgagaaaaaaaaaaaaaaaggaaaggaaaccaacaaaatacaagaacgttctcctgaaaaagagctccacaagtaagatgctctatcgcataacctgtaaattaaatgctttacctaccaacgaaaaggaaaccttaaaggggaaaatgttatgcatgagtccatggtcgatgaaaatatatgaatcaagaatttctacatacaagtatgaaaacaaagtaaacgtaactacttgacctcctaacatagaactaatctttgacatcaacaacactaacatcccccatcacaacgtccaaagaaaaaaatgagaaacatacttggggtaaaggaagttgcacaagaattccgtgaatagacgtgtcttcattgaattttctcaatacactgataatctgtccttcagtacaatcctctggtaattcagccaaaacagatttaatgccagtttcttcacaagctttaattttgttgcgaacataagtttgcgagtctctttgttcaccaaccaaaacaacagcaagaccagggacttttccaacagcctttttcatcttccccacttcactaataatctttgttctgatttcctcagcgataacattaccatctatcaccacagtcttctgttcagtctctgtataaatgcatacacacagaaatcaactcatacaattagagaattttcttgtaacatatatatatagccatgaaaatgcaacaaagagtattaccaaaggaaacaggaggtggaggatcagagtaaggaatccaattttcaggcaagtcaagtgacacgagaggaggagacactaagatggaactaaagcaatgtacatcccttgttgccaaacgaaacgccttagtatgcgccgaggccaaagctttcctcgcgatcattaacatactcaaaactaaaagaacagtcactgattcaaatcaagcacaagaaaaaagtcaatgtaaaagtacagaccagacaagagaaccttagacaggtcagcctaagctagaataaaaccataatttgatccttttagctccatactcttcattacatccacacaaacaaataaagaggcgcataatacagtaaaaacaaacttgcaccagattgaacctaaatggattaaagatttcaccagactatcataagctttcactcagctaaaattcatcttcttcactcagctaaattcatcatacatagaattcttaacaaagaagaaatcggaaaataggaaaaaacagaggagagatttaccagtggtatataaagcgtcgtcaatggcgttgaaaaatatcgctaggcataccggagtttaggattcaacgagtgacaatataaaacgatgatgattaacaaaaaaagtaaaaagaattcaccaccgtgtgagaaaagacacgtgttatgatctggagatagatcttgcaagtgggttaaataataaacggcggagacatagccacacgtgtgaaaaaaaaagaggtgtgtgtgtgtgtgtgtatgtgtgtatgtgtgtgtatctctctctctcttcctccaagtagcaaaaagcaaaggggaaagagacgatgcgatcgggctaagtgcagaaacacttatacttgtgcattctgcaacacaacacacacacagagaattcgacgagagtatgatttgagtgtatcgagaacagagagagacattgatagagagatcgttggcaacgttttggggatccaatgcgttcgtaattgggaaagacatttcattcaattctaaatcgggaatatg

SEQ ID NO: 12564 - DNA, 3000 bp, Unknown; identical to SEQ ID NO: 12552
  misc_feature (1)..( 3000): cDNA_ID_1025340_gDNA_ID_2214558_Annot_ID_134837 3000 nt of promoter + ATG

SEQ ID NO: 12565 - DNA, 3000 bp, Unknown
  misc_feature (1)..( 3000): cDNA_ID_2709160_gDNA_ID_2214558_Annot_ID_134838 3000 nt of promoter + ATG
aaatcatattgattccccaaatccttccagaaatacaatgtgaaccgaaagcatcttagctaatatttggacagaaccatatccgaaatacaaatgacattgtcataattaccaaagaagtggaaaaataagtagctaaggcaaatatttgaaccaaaacattccacacataaacaagaggcagaaaacatgtttgaaattgagtattgaaagaagagataacataatcggtgatattggttcctcttgattcttaaacaaaacgtaagaaacaaacaactagtaaactccatattcaaactcacaagcaccagcatagagtcatagaaaaaatctaccaaaagaaagatttagtatatcacatactcttccgaaacaaacgggtttttcttgcttatcctattcttatccaacatttctcctagaaagaagagaacacagtgtgaaatctcaagttaaggaatgaatgtgtcaactagaggactaaagaagttgaaataggtataccttcatcacaggaacgctctgcctctgcatcagatttgttggaaacctaagaattgatgtgaaagacaagtacagataaagaggtaagagcacatttctaattcaaaacaaactgatcacaggaccaattctcaatcaaagcaaccattaagaggagaaaaaagaccaacattgtgactcaaggaggtaacaagtcggtgactttggttgaatacggagaagtgatgtggtagcagagattgagtgcgcttgccattggcgaggacgctaaaagtacggagagaacacttctgaaaagtggaaacagagcagcaagattagtaattcagctcaaacatcaggggttcgtgagagcaagagaaaataagagtaccggcgggagaggaagactaaaacggtggacgccggcgacactcatcagtccggcggtgataattcaatgttaggatgtcacaattatcgccggagtggtttttaaaccgaaattgaaccggtttaatttaatttgacaaaatttaaaaagtaaaaaatattaaatctttaaaccgcaattgaaccggaatctttaaaccgagtctatatatacttttcaacttccaagtctttcttcacattctctcaaacttattttcgttttccagagaaattattgacaatcagagaaggaaggaaggaagcaagaagacttaagaagatgataatggaagaagaacttcaagagcgtaacaacaatctcagcctcgacgacattgatctttctctcctccgtctcacttcaccaccgtacgactactctcctccatcatccttgttctccgccgatgaaatcactcctccattgaaacgcgcctcccctgtttccgacgaatccgatctccccaaacgcagaaaactctcccctcaaaacccaatctttaccacttctcctcctctcttcacttccccggaaacacaaacttcctctgttcatgacacgagccggtacacgaatctcactagctctgtttcggagaagcaagaagcgacgccgtctgttactgatacagaggttgttatataactattaagcgtttctctaatctttgttttcacttcttgttttgaactactaatgaagaatcttgaattggttttggtaaaatagacgatgaagatggttaacaaatgcgtagaggtgatgaatcgtggagagactaactatgcttatgaggtttgatgttcttctctaatcaattctgctttcttttttttagtcttaaagatcgcaagtactggttttgataagtttacggtgaaattgcagaaggagcaagaggagttggaagaagaagaagattgtggaggagggatgaggatagagagatctggagatgggtttgtaattagattgaagtgtagatgcagacaagcttttagggttcttttctctgatgatcatctctacttcaagcctctctaagtttcacttcacacacttgtggtgtgatttagtatctgcttctactcatttgttgcaacgttttttggttggacagttatggagactttgtaaataggaagtaaccaaaattaagatttacatttcgtgtagaaaaatgtgcaatgaaatggtaagagtaagagcaagaactcgttttgttgtatagagattacaaaaaggttactacttatttagagtcaaagtcaaaactttaaaattgtttatagagattatcaagaaacttttaatctcttctgaatacaaaaggtttcaacttttttttgtgtgtgtcaaaactcaaaccttttacacttgtttgggccttcttcacgggacccatggtcatctcgatcaagtcaatgttcagctcctcaaaacaagctcttgagagtggcaaagagaaattaagaccatcaaagaggggaattggcctctacagagactagctgctggcgacagagagctctcttagcactctcacatgccttgtggagcttaccataagccatgttgtctctgcttgaattctttttggtgttttttcttgattaacttcatgaactattctatgatcttgtggttaaagtccttaccttttttatacatagtagatttttttctaaaataattttcttgcttatttacatctcaattaagactttgaatatgtgatgataatttccttagttatgaattagaatgattaaaatcaattaagagacccaacagagagacaataaggctattttggcccatttagacgtaagtaatgcagaataaaattgctccgaccaaattaattgatgcgcgttatcagtttctgcacgcgctttcacgcgccgtcgtcgattcgtttctccatcgtctgccataatcacccgcaaacacattcttcttgctacttccgtcacgacgtcagtctctatctctctccctctcactctcagtttcaatagaaaaattctcaaacattgtccgttttttcccttgttttctctcagaatcatcaaatg

SEQ ID NO: 12566 - DNA, 3000 bp, Unknown; identical to SEQ ID NO: 12551
  misc_feature (1)..( 3000): cDNA_ID_1017185_gDNA_ID_2214558_Annot_ID_134840 3000 nt of promoter + ATG

SEQ ID NO: 12567 - DNA, 3000 bp, Unknown; identical to SEQ ID NO: 12550
  misc_feature (1)..( 3000): cDNA_ID_1028073_gDNA_ID_2214558_Annot_ID_134841 3000 nt of promoter + ATG

SEQ ID NO: 12568 - DNA, 3000 bp, Unknown; identical to SEQ ID NO: 12549
  misc_feature (1)..( 3000): cDNA_ID_2709126_gDNA_ID_2214558_Annot_ID_134843 3000 nt of promoter + ATG

SEQ ID NO: 12569 - DNA, 3000 bp, Unknown; identical to SEQ ID NO: 12547
  misc_feature (1)..( 3000): cDNA_ID_1019319_gDNA_ID_2214558_Annot_ID_134845 3000 nt of promoter + ATG

SEQ ID NO: 12570 - DNA, 3000 bp, Unknown; identical to SEQ ID NO: 12546
  misc_feature (1)..( 3000): cDNA_ID_1808620_gDNA_ID_2214558_Annot_ID_134846 3000 nt of promoter + ATG

SEQ ID NO: 12571 - DNA, 450 bp, Unknown; identical to SEQ ID NO: 12545
  misc_feature (1)..( 450): cDNA_ID_2709173_gDNA_ID_2214558_Annot_ID_134847 3000 nt of promoter + ATG

SEQ ID NO: 12572 - DNA, 3000 bp, Unknown
  misc_feature (1)..( 3000): cDNA_ID_2709197_gDNA_ID_2214559_Annot_ID_134851 3000 nt of promoter + ATG
tatctacatcacaggtctggtagataaagatgtgaatgatattcttacgactatatattttggttaccaagcaataatcattgttacaataacacatatatattgtggagagaaacaaaactataatttgttattaccaattcattcggatgccatacttcttcagtcggctacgatgtaagtttgattttatcgaaaatgttgagatcaatgatcacgggtcaagacggcttgcagggagctcgaagacaagttgaacgttgccttcggagatagtgaagccgatcaaaaaccgtttttcaatagttacaatatcattgaactgatctccacattctcacttttctatgtttcctggtttgtaagatttttgaacgatcattttaatttgcttccattgtatatttaaagaccaaagtcttgatggatgatgaagtagacttgaaaattgatgaaacccgttattgtgttgttgtgttacaaatcccatctatgatcgttgatctcatagatgatcattgatcatttttctcatttttctatgatgaagtagactttttccggaaggcttatgagaaaaaaatactattcttgttttgtaaacatatgtgttcaataaagaatctattttcatttgcaatcattcggattaattaaagtgattgctggatgaatgttttgaatctctttttaccatttcgctacaaaaataaaaaaattgcgaatttcgcatccagatatatactagtattaagcatgggagattattcactcctcgaacacatcctatgactatgagttacacaaatcaaaatttttacattccaacgttgatgatcctttggatttggtatttttccatgtcatactattgtaactttgtttgtaatttctttctggtcaatattactctattgtggatgcaagatcgcataactagtcctccatcgaatcaaacatgatcacaattttaagaatcaaactggacttttatataccgaaataaagttacaaagatttcgctgagatgttcttacttcttagagctagatgagtaagtaatattagggattttctagtgtacaattgatgcctctatacattactctccatcagatttataggacttgacctcgtctgcttctctgatatttcccagaaatctcgctccttttagtttctgcttgaatctatcaaatcctagtgattttgcgaccacctacttctttattctttcctttttgttggttatgtccaaactgatttaagagtatccacattggttatttttatgagtgtttttagatggctatttttaaatataaaagagtaaaacaaataaaaaatatgagggtcattaaaatgaaaattatatcttcctaaaacatttaagacatctatacctttaatattattttatatgaaatacatctatgaaaaattattcgatgaggatggtctaatgagtcggagagtctcagaccaacatctatctataactattttttttttcactggaaatatagatttcattgatagaagatctgagtacaagagctgacaagagaaacactcttctaaaagccggagagtacatgggaccttccaggaactaaaaacatatttaaatgaaacaaaggggaaaaaaaccgatctaacaaattacatcacatctgatcaagtacttcccagacccaaaatccaagagttcaaacgaaatatacaaagtctaaaacaacaatgataaactgatagatctgagactagaagcctcacttaactcaacctaaacacgaatgggcgatgagataaaaccatcatccagagacccaaaggagtgagagcctcatgaaggagagaacgagatcgggatcttcaggtggaatttcagaagtctgaggcgaaaatttggatagaaacgcttctgccttggatggatcggccagatctgactctgttcttgaaaaagacaaaagacaaacagcaaaaacctaaaaagaaaaagttttagactttaaatatctagatctgaaaattcagattcacaaccgttggaaaaaaatctctcagatgtgtctaaagaaaaaagatagaataagagcaaaacaaaagacttcggttccggtgctgagaaagccaccggaaccggtaaccctaaacgcaggcggcggctgaagttttagagataagggagagtaaaattttaagagtgagaaaatgacgagatgtgagcttgtaaatactttttgtaatataagtaactataagtaatattttttttgtaatacctcaaattttatttttaatgatatttacaagtttaacaaaacaaaaacaaaaaacaaaatattattctagtcatagcaagtgagaatttttgaaaagggaataaatgtgtgtaattaattcaacggtccaacagtggcttggacctaacactaatgacatttgttcttcttgtaatttttatgtggctgtcttcttgtaccaagtacgtagacaatagtttgattctatttggaatcaaaactcaaattacatttacaagaaaaacgatcacagatacagtaattcgtagtattcgccaaagttccttttgcaactttcaaaaagtgcaaaaacaagaccactttttcgtaataagatagtagcaaaaaagcacgactattccataaaactgtccacgtccctccagaaaactccccccacatgcgatttgccacgtgtccccactcaactacacacaaagccattttaaatcaaattattaatcaaacttaaaaaacgtaatcgtgtgctgatgatgatgatgacactgtcactgcctcaaaaacctctataaattagtcctcttcaccgaatccttgtaaatcattactgtacttttctctcttaacggtttctttattattcttcccattctacccctcttcttccttctaattccccctcaaatgccactgtcttctcactaaactccaaaacccaccggaaaaaatg

SEQ ID NO: 12573 - DNA, 3000 bp, Unknown
  misc_feature (1)..( 3000): cDNA_ID_3025741_gDNA_ID_2214559_Annot_ID_134852 3000 nt of promoter + ATG
ctttttcgttttctataagacctaatattttatactactatgctctttcaaattatttgctccttccatttccatgacactaataattgacgctttaaataaaatccatacaaatgaattctttgaactgttgaaacttgaaagagagtggtcactatagcactgttacacttaccgcgatatttattgaataacatactaaattatataaattatcaatatcttaactagggatggacataaaatccgaaattcgaaaactgattcaaaatcgatccaaaaattccggctccaaaaccgaaccgaatagtcacaaaacccgaacgaaaaataaattcttccactgatccgatccgatccaaaaaccaaacggatatccgctaaacccaaaataaaattatatatatatataatattagttatatttagctataatttatacccaaaaatatccgaaataaccttgatatcagatttattattagttatctttgttatacttatacaatgttttacaaaattaaacaattttttaggttttttttttcaaaaactgatccgaaaccgatctgaatccgacatcatccgaaccgaaaccgaaccgaaagtcatatcatccaaacggataataaactccctcatcagaattatccgaatccgaattatccaaatacccatgtctaattttaccattgctttttaagccattaaccataaattttgggagaacattgattggaagactgtgttttacagatatatatgtattcggttgttccagtaaaagaagtagacaatgattaatgtaagatgtgtttaatcgaccgcacaaagaatatggtggtggtgactacacaaatctggctgatgtaacaactgtctaaaacattttctattctttttgaaacgtaataaacgcaaatcatatcatgcaccaacaagtagaatcattctttccataaaaaagtaagaaaataataatgataatcagtagtaccaatttattttggaaatgtacactagataatcctgcatttataatatattgataattgaccttgacctttaaactacatttttgttgattactatttgaacaacataatttcacaaaagtgcatacaaatattttcatcaatccacacgaaaaatgacatacccctttatttcctattttgccaccatagtaaactacttaataaaggggtatatgctttatttaacctaatttaacctttattttgttgtgtataagtcctaatgtttgtataaacataagtataaatccttaccttttgaataataagctttttttgctgtaattaatttggtcagtatgattgtacaatgaaacattattctcatgcgtttcacgagctagcaggagaatatattggactcatggtgtttctcaaagcagaaaagagaaaatgattactatttttcttttgtcaactttttactaattttctctttatagaatatgaaatatgaatgagcaaatactatatgattgtcataatcacgaaactttgatatactaatctaatcgtggacacaactaaataattaagcagttagttaaaggaacgtgtgtgatcaagaatgcttattatatgcaaataaaaatatatgactcatgcaaatgaatgaccaagaatgcaccacaaaagttctagaccggtcaagtatgttatctttttttaattctcttaatgaaacgaacgatacacgtagaattgttaactagctagtttagtcaatatagttagagagtagttaagataatagacttttaaaaccatagatggaacgttacatgtttccatggttagccattggaatattgaccgagagttaatatataagctattactgaatctggaaacaaattcttatgttgtcttaaatgcgtctactttaaaccgtacaaaaattcaacaaacccaagttaatgtaagtaattaggatgattgaatatgcgtttctatctcaataatcttcaccagttatatatttctcactctcccattaataacaaacataatcatctagataatggaatgtaaaaaacctgctgggtcagtctcccacacggagtcagcattttactcctccatttcactgattgacacgtgtcaattttccgacgactcttctcataattcatcctttgaccggtagacttcagtcaacagccccgctctcttctatttattactatgactaaactttttttagctttttaatttaaaacccaattttccatactattttttttttttaaaaacttcttaaaaataatttcataggttgatgagataccaaacgcatcttaatattttctccttaatttactttggttatgtctttctatgataaaactactatttacgtacatatgcacatacacatataaactatatgctctatatcatatggattacgcatgcgtgtgtatgtataaatataaaggcatcgtcacgcttcaagtttgtctcttttatattaaactgagagttttcctctcaaactttaccttttcttcttcgatcctagctcttaagaaccctaataattcattgatcaaaataatggcgattttgccggaaaactcttcaaacttggatcttactatctccgttccaggcttctcttcatcccctctctccggtaagctttacacaagacacatatatacatgcttcaatatgattaaagaaactactatatgaaccaaccaagtatatatttatgatgaggcttgtgtttggattctatgtttcttttggtggatgatctgattatcttatttcgtttttacaaacaaaatctctaaacagatattgacaatcataaaaatataattagttttttcatcgtcttttttctttatgatcacatattttttcattttgtccttgtgaatataatttatacacgcaataagtttcagatgaaggaagtggcggaggaagagaccagctaaggctagacatg

SEQ ID NO: 12574 - DNA, 3000 bp, Unknown
  misc_feature (1)..( 3000): cDNA_ID_2116844_gDNA_ID_2214559_Annot_ID_134854 3000 nt of promoter + ATG
tggaaggagaaaaagttcaatagattggcccatataaggctttcaggagttaatgtcgaaggcccattagctaactctacaatgatgtcaacttgaaaacatattttcgaaaaatgatagagaaatcatagagtaaggcatatgtctacgagttgaatttggaattgggatgaaacttagataggtggggaaagaaatggtaggactcgaccattaattagcattttatttgtaatcgcgatcatcacctaacgattaagaaatcttaagagaaaaatttctagtcattattgtcgaaactaaattttgtataaagacatatcaattggtaaagatcgtaggcgaaacttaaaaatcgccgattcgattgacgtttgtgacgaaactaatattacatgtcgtggtttcgaaccaggggaattacgggcttcgacccagaatctcctgatattcaaaaaaaaaaaaaaaatcaatcgtatgacacgtgacgtgatcattcatgcaagacgagaccttcgtagtatggtttcccgcactgacattaatcggggagatagtcgtgatcgtctatatatggtgagtgttggaggatctaacgattcggaaagctaaagaaacgtcaaatgtgtgactgagagccataatatgtattagccttgtaagttgtacccggccaccatatataacaaggtcaattcacgtcattaagtcctactaagtactaaccacatatcatccacgtaaataaatcaagcccgcgagatccacgtaagttttaatccactactaacgcaaacgtacgtagaagtgttttcagaagacaccacatcgataggtccagagatcgaatacctttggagctcctatggaagagttattcagaataatttgcctccacaagtattatttcatttagtgtagttcttaaataagaaaaaaatatgaatgtgttttatgtccttatcgtgtttcgtacattatcttccgtcaagataggaagctttttcatttgatacattatcactttcaagtgaggtcaactctttaatcaatgtaagttgattttgcaattagaatttgtggcgtagcaaagcgcaattagtttattcatttatttcaattgaatgatgaaagttataagtattgaagatatttgacctttggtatagaagaaatactcaaaataaaacgttgactttagtgttgaatcatacttcctttgtttcttaatatttgtaatttaaggtttttacaagtaaattaagaaaatatataaattttatttaatttatctatttcctataaaaacatcattagttataactaatctaaccaataagaaagtaaaatataattagctaaaaactattaaatatatttttgtttgcatagaaaagtgagaacaacacttataatagaaaaaaagaaatatttaaattacacttagttagaaatcgagaaaatataaaacaatgcgtttcagatataatggctcttcagttcgtgatcggcgaccgaggaaaccaatctatatagaacttagatataggtttaagtatacttttcatccattttttgagcttcttaactcgtagaagaatgtttgttataccttactataaacatggatttatatgcactccttcttgggttgttttctcttcatttactaaaatcagttgaccaataataagatataaaaaaagtacccaagtctacgcagttgttacggcccattagagtaatgaagagacaaaaagcaagcaacacaaaaagcgacccaacttgagcaccgtcacaaaaacggcgtcgttccaaaggatggtcaacaatggtgggaacctctgcacaacaaagagactttcctcgagatttcttatattcgcctgctaaacgctgtcgtattagtgggtagatgaaaaagacagaagggcaaatgagccgtgtcttccataattctcaacaagataagataaggtatggctcgcatttttaggtattgtttaatcttcggttgcgtttcttatctttttttttctcctaattttcatttacagtgatttgatttcagctcattcctgattttcaattttctgatttcagcaaaaagtccttatctatttttttcatttatttaaggcaacttgttttctaaaaataggaatggaaaaataaaccgaaccgatatatttaaccgaaacataaaactaaactaaatcaaattaaaaattagaaaataattgaatagatactaaattctttaaccaaaagaatcgaagctgaatcggtgccgaaccaaagtattttggtaaccaaaaatatccaaaatataattatattttcaaactaaataattaaaaattcttgaaaaattatataaaatagtaaatttattagaaattaaccaaaaatattcacaaatattcaaaacaaattaaccgaatgaatactaaatttaaaaaaaaaaaaacagaatcgaattaaaatcaaaccgaaatactaaattttaaaatcgaaaaaattaataaccgaatggatacgaacggaaaccgaataaataaccgaaaacacatgactaaaaagaggtattttcctccataattaaaaggtgtttaataatagagtgatcggcgaaaggtgtgaaattagctgttttgtcttgaagcggattcatatataaaagagcgtgtgccctctttgcttttaatttcagacaatcttcttcttcgttgcagcttcgtggaaattattttctctttctcttccattattatcttaaaggtccgtcttttatccttcttctttttttgttgttgtcctaaaattagggttcttccttgtgaatattgcttgatctaggaaactaatcaggatctgggtttgtcttttggatctagggttttattatagcatttctgggttctttgttgaccaagaagaagatttgtattgatggaatgttgttgatgttgttgtgaacagtgagaaatcaataagatg

SEQ ID NO: 12575 - DNA, 3000 bp, Unknown
  misc_feature (1)..( 3000): cDNA_ID_2709193_gDNA_ID_2214559_Annot_ID_134855 3000 nt of promoter + ATG
tctcgaggaaagtctctttgttgtgcagaggttcccaccattgttgaccatcctttggaacgacgccgtttttgtgacggtgctcaagttgggtcgctttttgtgttgcttgctttttgtctcttcattactctaatgggccgtaacaactgcgtagacttgggtactttttttatatcttattattggtcaactgattttagtaaatgaagagaaaacaacccaagaaggagtgcatataaatccatgtttatagtaaggtataacaaacattcttctacgagttaagaagctcaaaaaatggatgaaaagtatacttaaacctatatctaagttctatatagattggtttcctcggtcgccgatcacgaactgaagagccattatatctgaaacgcattgttttatattttctcgatttctaactaagtgtaatttaaatatttctttttttctattataagtgttgttctcacttttctatgcaaacaaaaatatatttaatagtttttagctaattatattttactttcttattggttagattagttataactaatgatgtttttataggaaatagataaattaaataaaatttatatattttcttaatttacttgtaaaaaccttaaattacaaatattaagaaacaaaggaagtatgattcaacactaaagtcaacgttttattttgagtatttcttctataccaaaggtcaaatatcttcaatacttataactttcatcattcaattgaaataaatgaataaactaattgcgctttgctacgccacaaattctaattgcaaaatcaacttacattgattaaagagttgacctcacttgaaagtgataatgtatcaaatgaaaaagcttcctatcttgacggaagataatgtacgaaacacgataaggacataaaacacattcatatttttttcttatttaagaactacactaaatgaaataatacttgtggaggcaaattattctgaataactcttccataggagctccaaaggtattcgatctctggacctatcgatgtggtgtcttctgaaaacacttctacgtacgtttgcgttagtagtggattaaaacttacgtggatctcgcgggcttgatttatttacgtggatgatatgtggttagtacttagtaggacttaatgacgtgaattgaccttgttatatatggtggccgggtacaacttacaaggctaatacatattatggctctcagtcacacatttgacgtttctttagctttccgaatcgttagatcctccaacactcaccatatatagacgatcacgactatctccccgattaatgtcagtgcgggaaaccatactacgaaggtctcgtcttgcatgaatgatcacgtcacgtgtcatacgattgattttttttttttttttgaatatcaggagattctgggtcgaagcccgtaattcccctggttcgaaaccacgacatgtaatattagtttcgtcacaaacgtcaatcgaatcggcgatttttaagtttcgcctacgatctttaccaattgatatgtctttatacaaaatttagtttcgacaataatgactagaaatttttctcttaagatttcttaatcgttaggtgatgatcgcgattacaaataaaatgctaattaatggtcgagtcctaccatttctttccccacctatctaagtttcatcccaattccaaattcaactcgtagacatatgccttactctatgatttctctatcatttttcgaaaatatgttttcaagttgacatcattgtagagttagctaatgggccttcgacattaactcctgaaagccttatatgggccaatctattgaactttttctccttccattttgggctgatttattaagttcacaacacaccgattaggacgtgcttagtttttacttttctccttccattttattatccatcacataaaggcatgtttaagagatgaattttacataaatccttttttctctgcaaattcaagctcttctttaaaaaaaaaaaatcatttcatttcctctagtaagaattaaatttatatttagcgtgttcttttagtgaacgcagccacaacaatagcaaagaagaaaaacagttctacggtgagaagaaaatatagtgataagagagaactatcacaaaagatgaactacgatgaagattgaagtgtcgctggttaatttcagcgattcatcgaatgcagttgcaactcaatcggcgactcatccaaagttgttattttaagttctaatgtcgttttacttacctgctacttctcatgacaattcgtcttactccgttgttgccgttgtcgcaacgttcagtaaaagcacacgctaattaatttttaaaaaaatgaaaaaatagctatattcacacctataatccaatccccttaatagaaacgtaactacttttcctttttttctttttttctttgtcaaccattgaaaatcagcctaactttaaatataattaatattacaatggaaattaaccaattaattatagaaatataattaatattacattgattaatatatttttttaaaaaataaaccaattaaaatggtataatagttacaaaatcttaaaaatagagttaatttcagctaaaaatttaatttctttttggtttgaggcattttgagtttgagtgctgagagagttgaagcggacggggaagaacaagcgggagacttgatgcttgcaagcaaagtgttcctcctaatttttacatataactaaactcttaattaattagaaaagcaaaagaaaaaagttgagaactctctgtttttttttcctttctttttaatttcactttgattcctaattttttttgtttgttcgatcttcaaacccaacactctttcttctctcgatccttcccattttccgatcctcggattcatcggaatcgtcctttgatttgctccgaagatcatcccgactagctgaagccac

SEQ ID NO: 12576 - DNA, 3000 bp, Unknown
  misc_feature (1)..( 3000): cDNA_ID_1807367_gDNA_ID_2214559_Annot_ID_134856 3000 nt of promoter + ATG
agaaattgctaaggattcactaagaatcaaaatctctatgtaagacaatgttggagctggaaaaagagaactcacggcatcagcggtggaattatcggcgtccatctcaggacggagcttggcgtaaacctgagggcttttgtaaacggatcctggaggaggtcgacgctgaatgattggaacaacgtcgaaggagacggttcccatgtaaagcagcatacaagagatatagattagaggagcgaataagaaaatcccctgacgacggagaagaaccgataagaggatccacgagaggcgatgagcgagggtccgacttggttgaaccgtaggaaatctactaccggcggcggctttagaccgaccgtgacgataacgaggagaacggcgaggagatgccggaggagacggagtagtgtggccgcttcccggcagccgattcttcgctagcatatcgacagatctcaatctctcttctctctctggccaacgccttaattcatcattgaaacctatcgccggcggtggcggcaggtcgtgaaacgcagagatataagtccaccacggcggcggaggacggtggcgaaataagaagaataaacgccggaagagagagaaagagagtgtatgtatctgtgaagggagctttatgcggtggaggcaaagccgtgatcagtcacatgcccttcctttgcttttctttctcctcttgtcttttttttttttttttggttgccctttagatttcaaatttttttctttaataaaattcgaaataaatctctttaaagatatatattgaagattcttgatgaacagttttagttaatctccatattttagtagtatatacctttttttttattatccaaaattaattaatgcaatttttgaaaaatgttgtttacgtaaataatatgttgcggttgaacacgaattttacgtatcaaattaaccgctttaatatttgcactacgagaaactaaagataaaaataaaaaatttgccttttgatacttaattttttggattgtttgtgtcttgtaatctttttcaatttttgatttatttgtgtgagatatggaaaatacccgacaagaactcaaccaatttcttttgtcatgttttgtattatgaatagataataatacaatttgtaaatatatatgatggtatatcttctggttacaatttttatctatttaaaattgtgaattattccttttgacgaaattttttttaactattaatgtcatattgcaggtcacaaattttatgattattttttataaaataataatcgttggaaacaaatatatttcaaatagttgccaaaaaaaaaaagtcaacatctacgtattttataaatgattagaatatctttatcatctaagtcttattccaataatgattgtttaatacaattattattcgtattcaataatgtgatgaaaatagtaaaaatattaaattaaaaattaacaactccgaagagaaagccaacacgacaagcaatgttgattccatgctctatttagctaatcttgaaacggcacgtatttttggtaaggaattagggtgtaattgtattgataacaatattataattttctaagcatgattgcttgttaatactataatgcagccacataatttcatagatcgaaaacaattatttttctaagcatatttaaatgttgacttgtgagttaattagtagatttagatctccatctttggattacattttatacacaaaaaatatttatttaaatttggatacgtggaagcttatgtatgtggaaattattgtataactctataatctaaagatatgttttttttttaaaaaacgtagatatcatttgtttgataaatatttagggagttaattaaacagtatgagagtttcactagcaattagcatgtggttgtgttgcatgtgcaaactgagatggatagagagtggttggcaacagcgacactattttatttttttactatataaatgaaaagattcctaaatttagtaaaatactatatgtcattttatatatagttttaggagattttcaattgagatatatgaccatgacaacaaggcactaatactctctagcatagaaacagtaatgaaaacgcggaagcgaaacgtttcagaaacgagaatcgtttttttccactttttgtggtcatcattggaaacctaaattttttgtcgagaaatgaagatttttcgaaagggaagaatgtcgtgatttatagttagtgacacttgcaagttgcaatttttgtaattttcgtcgtagtttacaaactatttgatcttcgaaatctcactacttgagttttattcgtgtagagttttaacttatataagtagcacactaaatacaaagatataaatcacagaaaacgattagacataagataaagacagttataaaagggccaaatttaaggaggaacaaaatgatgagaaataacaaaactttcaaatttcaacaacatgtatcgaaacgagtcactgaaaaattattattccaccaagaaacccactagctgactcagagacttcctttgcattttactcgtgcaatgtaccaaggatgtcctcgtcccgaaacagatgatacctacgtcaaaaatcaccaacacatcgatttaagaattttacacaactatagggtgtttttagatcaaatcaatagtattggggtgataaatgaaaatattataaaaattaaaggatccggtatacgtactctttctcgccgagtttgacctccgtaccgccgtactctttcccgtctctatcccgtgaaccgggtccaaccgctatcactttaccggaattcagcgataaatgaaatattatgatgggcctataaatactgtaatgggccttaagttagcccattaatatttttttttgtatttagtatttttacgaatcagtggggacttggcattgagctcgagagacagacacggaggatg

SEQ ID NO: 12577 - DNA, 3000 bp, Unknown
  misc_feature (1)..( 3000): cDNA_ID_1808283_gDNA_ID_2214559_Annot_ID_185855 3000 nt of promoter + ATG
tcagaatccaaatcatctcatgcatattcgttactacgatcactgactacttagaattctcattaaccgaatctattacacaacccaagaatgtatatactgaaaaacctaacccacatattgaatactgatcgatataatatacatatttttatcatcaaaaggagattcacaagattgaatactggcaacgctgatcactacttaacaagctaaacattgtttagtaattgattaaaaaaaagaacatggtttagtaatcatttgaatttgttcatgaccaatttcttattcacttgtacgtctttcagcagctattaattatctatagcttgttgtcaatctccatcaacaatttttcaagtttcttacgtttgtatatatagatggatctcgattatctaccatgtcttattcaaacaatctgcatcaaaagccccgtatcttttaacttttcatatgctacatataatttgattcaaaagtattcaatgcttttgcgttaaattagctgttctaattcatataacgcatactatatattaacaaaaactctcctactatctttcaattgctttcacaaaacattttttctacttttccacaaattataaattcacgaatactatggtctatggctgctcgcgctctatgtaacttttggagctagagcttaaatggtatggtgtaaaaatgcaatggtctaaaggccatgttttatataaaaaaataatttaatgtttggcgtcaaagggatgaaaccattatatatatacgctactaattagtaaattcattatgcacgaaagaaagtcaaacatgattgataagtagcttcttgttttggtaacgtattttttttggatttaccaaatatagaccaccatattcatgattccaagtcatcaaaaaatgactacaaaatcatgattccaagtcttttatttgggaatatctaatcatatacgtaatcgtaatgtactaatgtggattggaaatgttagtgcaaaaaagtcttgtgacacctgatgtaacaagtaccaaccgacgtcgtttaatttatccatcagaaacatcacaggtaagaagcaacccaaaaacatcgtcgtatttgccatcaaatgagtaaaggcaattatgtgggtctttaagattcaaccaactacacagcaatggaacggacgggttcgcacccaaagcccacccaaagcccaaagggtctcgagagagcttcaaggaaacactttgcaacgattacctaatttccaaagattacctgatacctttggtatgatcttttagtctctactgatgacctaattatcgagtagacatattatataattggttttgcaagagaatggcctagtttcgcagacttttacattctcggtaacaatcttatcaaccgatacatatatgtttgcattatgtttttaaacattatcgagtagacatattatatatcgcttatttcacaactatttgttactctacaactatcaatcatttcctgaaagagtagaacactgtgaagatataaacactgagagcagaagagaccaataccacaagcaccagcacggtatgaatcgccaaagcattgccgcaagagagaagccccagacggagttgtataacatcaacaattgacaacagaagaaatacacaacccaagatagatccaccagctgcaccaaccacaccgaaacgaagcacatctctgttgatattcgctttaaacacttcgtccgtttctttgctgttcaaaaggttgatggctagcttcatcccttgagccacaagggaggagaagagaaagaaggcaaatgagatgacttcaaacacaaccaggtcacgttccacgtctcgtcctgcactgcactctgttctgtccgtgagggtgaggtcacttggctggtcgaaggagattccgacaaagactgcaaccgtgaagagagaattagcacttacaatcccatcgagagccgtaacatgaacactcgtggttgaagtagttgaatggctggtgttgctattgctattttggttgctgctcgtctctatgtcggaatctgccattaccaatgaatggatctctctttctttcttttttgggatagctaaaagcttctttctaatggtggatcataatcttctgttgtgttcttatgattcccttttgaatatgatttggtaatgttgtttaagagtgggtggtgtttggtttagaacgattagccttttggaaaacgatagctctatgttaattgataatttaatctttttcaagtcttggaaggtacacacacctttctccttttgttatgaaagaaaatggtttcttctagtaaccaaaattttgaactttattcacatgtaaaacaacacaatcttgtagcaaatttacacgttaaatttaaaacggtgttgcgtatttgaagagacaatatcctaaacgttatcatattaatattatttttgttatttttccgtcaaacaccatttttattaagttatcgaaaagatactatccgttagagaaaactattaaggaaccgacgtgcttacatgagagaaaataacattttcagttttaacttttttggctaaaaggtctactcgagtgttaaatttttgagaaaaaaatctaatacgaaaaaaagaaaaataaacaataaaacaccgaaaaagaggcgaattccgctgcaaaagttggctaatctttttggttatccagaagagatatcaaatcggagcatagtactattattaactttgttttaacctaagcgatgtgggataaaaatcctcttaacaaagacaaacaatcaatgacgtcatcaatccaaaaattggcatgtcctcaagattaaaaagacagtcttagctgacgtggcctgttctcaagttttaattggctggagaattcaagaggatgaaacatagaaatcctctttgactaaaatattttaaaccacacaagagaaggaggaggca

SEQ ID NO: 12578 - DNA, 3000 bp, Unknown
  misc_feature (1)..( 3000): cDNA_ID_3025714_gDNA_ID_2214559_Annot_ID_185851 3000 nt of promoter + ATG
caagcctcgaagttttggtttaagagccttgagcttcttagtgaaccggaacagggacgacgtggacatgtgtataggctctgtttctctccaaaaattttccaccaaaggtttaaactcctccatatcggccacagcattcacaaacttaaaaggcttatttcctctcacttgtgcaccagagttcatatttaaattgatacgacaccgtaaatggtcagaacaccctcccgcttcaaaaacattataagattgtgggtagaccatcttccaagcctcattcaccataactctatccagttttttccaaattgggtcattatctctcttattgcaccaagtaaaaaggggcccgtgagatgccaagtctgagaatgagcagtagttcaccaaagactgaaaatctcgcataccggaggtaactgctgggtgatcttccattcgagagtgctcatccatatccaaaatctcattaaaatctccaaaaattatccatggtttatcacgaatgatcggagagtccatatggtctcgaagatcattccacaaaatctttcgttcctctgcaaagtttgaagcatatacaaaagagtagaaaaattcttcttcttggctttctagtttcaccgaacaagttatcaactggtcactcttgtaaaacggagtaaaccttacattctccctccacactacccaaagacgacctcttctattaaactcatagttagttagcatggaccaatccttgaacaacttagaacccaaccactgtgaattttcctccttaactctcgtctcaatgagacaaccaaactgaaaattctgctcgtccacccatttctgaattacggaatgtttatttgatttgttgaggccgcgaacattccaaaagaaacccgacattaatgatgttttggagggagccctttactctgatctttaggattattcctagtagaagggtttgataatactttatgtgctgactttgatcccctaggcaaagaatgacgcaaaatcatctccttctttgctagtcgattctgattttctaccttttcctgaggcgggtcttgagttgagttttgtgtttcctccgcttgtttctcaacactatccgctgttatgatgtcctctccactttcatccttaccattcagagcagagtaactatttgatagaatagagacctccccaaattgtaaaccttcttgctttttcggtggactacgaccaaatttaggggtaatccatgactcagctcctttctcttcttccttaccatcttcagagattggtatgattggtatattctctgtcacacattctgcagtcacagaggctgcagtctgagaattagacaagacctgacccgtctctgtttcttcaacatgaattgggtctggatttggcgtgtctcgagagcaggtttttaaggcagagagacaagagtcacggaggtgaccccatttatcacaacaactacatcttggtggtaaccaagggtaggagtattttatcactgcagctagttctccctcctcctcgccggtaaacacaaactccttaggtaactctttcgttaggtccgcttccaccagcaactgagcttcatcgaaactcgaacaagattcagtcttggggtgcaatcgaattggcttacccactgcactagccaaaaactcaagacctttatcagtgaatagtgatggaggaacatccgttaaagtgatccagagctgaattgacttcatagctggctgagtttcttccgcaaaaggagaccactttgacaccaccattggcaaatccatgatattccacatgcctctgtttaaagctcttcgtcgcatggcttcgtttcggatacgaaactttatcgtcgagtcattgacggcataaacatcaatcagatttgacttgtcccccaatctccaaattttattaacgatcatgtgaattttcccaacgtgtggggcctttgcattgagaaagtgaccaattagaaaatcttcccatagtggtttagcaccgagaaagacctcttttggtactaccaccgtcgcttgaccatcaacttcttccgatacgaacttttgttgagtgaaggtgtgttttcgagcagcgtttacccacgatttcttcgcaggcggatgtgacatcctttgagtcgtctctaaagcactctgactgagtgcaggaaactggtctgaatctgagacaagtaaaaccctatatgtgctttggtttgaaacgatgagatcaccgtcctgtctctccaaagagaccggagaagatacaggagacccctctcgcaacggaacctctccggagaggcctggaggagccgccgccggcagcatgcttgtgagaaacgtaagaaaaccctagaacgcttcttttttcgcccctgccacgtcagctgtccttccgacctagtaaagacaccccttttttaaaactggatttccacgaccacaaggttaagagccttgcgctctaccaactgagctagatgggctttgtggtgcttgtaatgggtttgtctttccttgcggaagaagaatcgggtcaaccattctcatccttcctctacatcaaaaccctaatttctatattacatctctaacctcattcatatttgatatataacaccattcatttccttgatctctcactcatcaccctcacccaccaccaccatcaaaccctagttttgtttttcccccaatttcgtttccttgatcgtggatcattcttgctcagatctctgttagcgtctttgaatggtagaaacaactccgatcaccagagaatatatgctttcccattgcacaaccgcaagggcgagctttttccttcgtcgtctctccgccgcatcttctttcaaatttggcttctccaaagaaggctggtactaccgttgcatcggcgtcgacccttgaactcctcaacacggtttgtttttttaataaacctttctgattttgaaatttgata

SEQ ID NO: 12579 - DNA, 3000 bp, Unknown
  misc_feature (1)..( 3000): cDNA_ID_2781800_gDNA_ID_2214559_Annot_ID_185848 3000 nt of promoter + ATG
cagcaactacatgaagttcgtcaagagcctcgctgctgacatggatgatcacgttctcaaagcctaaatatccctttcacatcaacccatcatcacctaatatcatgatcatcatcaccctcatacgtacattgctccttttgtgtgtgtgtgtgtgtatcgtttttatggtgttttcaatataataaatgggggtttacatgtatggtttcatctactataatatgctttgatgttgtttattatggttgaggtttcatgtatgctcatctacgcatgtatccttgttaattaatgattttcaagagttatcaatcaatactgcccttttttaaagtgttgcactacgtatgtatcagcttccacaagctcacattgtatacagcatttgtggttgtattattcatcattttgtacgttcaattatggttattattcatacacagtattcattatatttatagtggttgtatagtatatttagttgctgttgctgtctttgtatgttcatttagtgtatagtaattaatgctgactttataagttcatatagtggttgtaacatttatcatttctatgagtatatattattactcatgtcctccgaaattggacaacatttaaacgatacaagcaaggaagacaataaaaatacaaaaatatttccttcgaaactctagtaaagaaagcatataatgaaaccagcatttagcaaagatgaggggtctatgtgggatgggggtcttgttggttcaatgatgtaaaaaatcattacgatttgttttaaggctattgtttttaatgggttgatatatgaatgacgaggacaatggtcatgtatatggattttgtcaaacctactaattagaattgtgttgtatgataagaacttggaaaacgtgaattatgtatggtatacagcacaatcgcaagtatcagtaaatatctattaatctaacatataaattttgagtttatatgattctatatatctttgtaaataaataatgtttatgctgtgcttgacaaaaaaaatgattatgtgtacgtacgtatgctaagagatgatcaaaattataactagagacattattagagcaaagtaccagataagacttttaaagatatttggaatattatatgaaatatgaaagtatcagtttaataaatactaaatgtagaaaaattacaatcgtgacagttagcttaactcaaactttatactaaaaactatctatactattaattgggaatcatcggaaaatttacaaccttttgaaacccgcacgtatgtgcgggtcaggatctagtgattctttaaatttggaaactcgaatatctcaaacgatattaattattcaggatattgatattacatggatggatcatggaaataaagcgacaaattgtttggagcagaatggtactatacatcatcaaatggagagacgtcaaccatgagaactgcaaatctttaagaagtctatcctcactacatgcagaagtggaagcgcttctctgatgatgaggtgtatgattggcgctaacaatcaagacgtagcttttctaatagactattcagatcaggtgaagatggtgtctttcctaaccgaatgaccagccttctcagtgtatttggaggatttgaaaaacgacaatgaagaatttaaaagttttcttttatctttaaattttagtacaaatgttaaagcggataatttggcacgaaaagttctataccaaatcacatcatatcacatatgcaaacaacattcttcgggaatggatctttaatttgagttctaactaatatcggttgacaaaagaaaaaagtttagaaataatattatctcatttaaactagatacataaatgaaacaacaacacacccatacacacaaaaagcgactctattttgttaaatagatgaagagcctcctctagaagatgaagtgatatctctagaaccagcactttcaacctagccacatagtgatggattgattaaggacaacacctcagaaaaagacttgtctatgccatgtatactttcgctaagaagtaagaagggagtgatttggcgccaggtaattgcaatgtttgaagcggtctttttgggggtctagctacttcatccttccaactgtagctatcttgagtctcagggaagatcataaccattgtgagcttgtagaaaaaggcttctacattgtcactgtgggcactcgtgaactgccagccaattttagaggtctatatagaatcttttttatcaagaaaatgtgtataacatataagagcaccctcaatagtgtatcttagcaaaatcttaggattaaaagcaattaaaataaagcaaaccaacaatccaaagctaagaagtgtatttttctttagatgtttttcttaagttaagatgtttttcttaagttaagatgtttatatgtgttatttgatgattggtttaaaaaatgaacaaaaatagaagatattgttttagaaaaaatgaacaaaatagaagatattgttttaaaaatatcaatgaaagtcacagctggcaggaaatctacggtatcgttatctggtggacttttcggcattcaaggaacaatacatcatatcaacaaacaataattatggtttgtttaaggtttaaattaaaattgatgtatgcatttgtctactctaatccttatcattgattcattatatgcttctttttttgttggtaaaaccattatatgcattttgtcaaacctatccttatcttaataacaaacaaaatacattgtatgataagaacttggacaacgtgaaatatgactcattctaaatatattagcagtagatatcaaataagtataaaacccggctcatctattttacgtctaaaccgttacacactctatatataaacgaaggaagatcacacgtgaaaatagtcatcaaccaaagtaagaagcgcacacacacaacatatttctttcactacccaaagag

SEQ ID NO: 12580 - DNA, 3000 bp, Unknown
  misc_feature (1)..( 3000): cDNA_ID_1974269_gDNA_ID_2214559_Annot_ID_185846 3000 nt of promoter + ATG
gttttgttttgtggttctacgaccatttttgcaaaatgtaaataattttcagttgtgtgtatattatatatctaattgcagcttcattgtaaaatgtaaataatcttcgattaattttatacttttatttttttgggacggtttttgtgaaccaaaaatattgtttaggtcttgaacactttcatagactacatataatccatcaagactggagaccggagaacgtgatgattatgtatgataggaagactgtaaatgaaaaaatagatgacatggacattgctaagattgaacatggacattgctaagattgaacatgcaccattcttgagtcaccttgccagaggttgttatgtttcttataccttatattgatttgataaactaaatgatatgccgtaattgtcaacacgtgattgagttttcaaacaatctttaagaatgcatgtgtaaaaattgtaggtgagcggagtctgggtctccaaccactagagcaatttgacggcaaaaaggaaaccactgcacctgattctcggtaatataatctccaatctcttttcaatttttattccgctgattattcgctaaaatgtatatactccttatttgttgtctgatcgttaatgaagtgcttcttcaccccttttttgaccttacaacagttattggagatgcaaagtagaatgtaaagctagatcgtaatttcttagaacatagcgacaaaaaacagtgtaaagaacttgaacgctccaaataatagctacatatatttgataaaagattacaagtatgacaatgtgattgatttgttaagaattattcccaacattgtgcatcactttggttgactcccgaaaaacataaaagtatgttatttcaactctaattatttgtccatatctagaactagatcggaactttctacacaaaaaaaaaagaactagacgtgaaataatgaaacaattcaatgagaccttattagtgttgtaataaaatttagtattattacttattagtgttgtaataaaattagtatgttaaaatttatattttaatatagccctatattcatttattcactatggttatttatctatattttgatatatgtgaatatttgtgggtccaatgtcctcttaaaggcatgttctttgattgctggtttgattataaaatcatttttcttgtaccatttttattttgttttgtgatttttcttccacttttgcaaaatgtaaataatcttcagctatgtatatattattagctaatttggtcatataaacgtagcttagtctatagtaaattaatcatctacatatgacttatacatgcataaagtgagtataaatgtatgtttacatgcgtaaatcagaagaacctaaacatatttcatttagtactacatgttattgatttttctacctagacatggacgttgaaccccatcaacatattaaattcattgtctgatattttctcagaacatatatacttttattgtttttctgccgatgtggacaacaaaagcatggaatacgttcgaccaataaatcttcgtctcttatttgattaatgtgagtgtatcaccaaaacttgaattatttgccatttatttttatatccgaccgtggactataatttctttttattatttggttatatattgtctccgtttttggtttaaacgtcgattcaattttgattgacatttgaatcgaagccaaatcacgaaaacacacattcgagaaagcttagaactgaaatgaaagagtgcaaaaaagttacaccaatataaagttgttgaaatttcggaatcttgtaagattaaaagattgttagtagaaaaaactcaacctcccaatcaaaaattacaaaaatagtaaaatattcatccacaaatttcatttttttaaaaagagaacattcacacacacttctagattgatcaaagataaaacacttatataagttcgactaaacctaaagatattatcctcattaattagtcacaacttccccaaccaatttcttaagtcaagtaattcctttgctccggtggaggcattctcaatgtttaaggaattagtggcgggaccaagaaaaatcttatcaaagtcaaacaataaaatggagacaaaattaagtgcaaaccttaaacttgaacgggtcatacacaaccaaatctgccaaaaaaaaaagtattttattcaatgaaaaaaacatatattctataaaatttgaaggcatcattttcagttttttcaccctcttctcataacgtaggtcccgaccatatttgagattttatccatcataatgaaaaatgaactaaacggctccctttcaacaccacattaccgacacccaatcagctttaaaactcaattctatggttcatttattttgaatctaaccatattattaagatgtggttggcttacacaatcaatagttatgtactataccaaataacttattgaccaatcctataaagaatcgtttcaaaacacttttagaaagatgctttactttctaaaacgatcgttttcagtcaggttttctatcggttcacctattttctcttttgtagaaaggcgatcgtgattgttaccggcctcactaaattatggtttatatattataattatctatggattgattatgatttcctaggcatgtacgtacgtaatattttttttgtgcgacgtttcagtgaaagtgtagttgatagtgaatgtttcgagttcaagttataaatcatatcaatagtaatccaaatctttttttttgtgatacgaacttggtaaacgtgaatcacattttgtaataatgcaagatgacagaatcgtggtaagaaaaagtaactaatgtaacttatttttacgttttaaccgttatattctctatataaacgaaggagaaatgaaagtattcatcaagtaaagaaacaaacaaacaaacaaaaaacacacttcactcgctacacaaggaagagag

SEQ ID NO: 12581 - DNA, 3000 bp, Unknown
  misc_feature (1)..( 3000): cDNA_ID_1442067_gDNA_ID_2214559_Annot_ID_185842 3000 nt of promoter + ATG
aacagagatgaagtttataaagacgacaagagattagttcacacaggtccaaatcctcttcacaactgaaacactaattagcaacacgtgtctggtctctctccaagaaactgccttgagattctgctttgaatcaatctttatgttttagtcataatgagatgtggatcattatccttagccttgtttaattttctgtgaggctaagagttaatgatcttgtttctcacttgttgtaactccttttgcttcaatggctatcatcaagatccaatgaattattattgattatatagttttgtatttatttacttaaatcagtatgttttcggaatttgtaatttttttatatactaatattgtaagcaagaaaaaaaaaatggttgaagattcgaatgcatggatttcttcgaagatcatgttctatgcagaaaaagaaggttgtctttttgtgttaaactgattaattattgttatttaaccatataacatataagttattaaaatcaatgttgaatgggtccaaaattgtgtattgttaaatgataaatttataaatacatgaacatggaaggtgttgactgctccttcgagcatgacaaagggagaagcagagacttgaaattgggtgaaactcatgcattttcgatttttcctacatattataaagctagctagaatatggtagactctaggtgaaaaatacttcttaggtcgtgcattaagcatccgatctttctttttaaaacggccatggatgtaaattcagcctaatcatcatatacatgctgagtaggtgccctaaaagttcctaacaatatataaaatcgatcaaaagttatggatccaaaaatatgtggtggtctagtggttcttgaaagtattcaaggtcactacttcaactatatttgtagcttacacgtagtattgttaattgttgaatttggacattgaaaaagattatgaatcaaagattcggaacttccaagatttatatcataaaaagcctacaaatgcaattattagaaaactaaatctaacatactcatttttagtaaatcaaagtattttctttttgttagtagtaaatataatcaatgtatagtttgattaatcaaaattacatattctgattgactacatctaatctattgtgaaaacaagtccatacacaaagatataagttaaaaaaacgtacaataaacttatgcgaaaaatctgctaaatgattattgtgacgtgtggaaaaagatattatttaatagagtaggccatttagctttaataaaatttgtatcatttgaatgtgtttgaacttaatgcatacggttctctcgatggtgatgcctcccctctatatttttttctctcttttttgagtattatttacaaacgtacaaacataagtaatgctcatatatgaatacttgtttactactattcactcacggattaaaattctattttgttaaggtatatgagtctttaaatacagaattttccaattatacacaaccaaattaatatttgaccaaatatatgcaaacttcgatacttgtccctgtttttttttattacattaactaatatacattgattataaacaacaaacacatcaaaatgtatacataattagatcaaaataaaaatgttcttttcttcatccttgaaatctattactcattatgaatacaataatttaaaatttgggtccattttggttaaagaggaatatcctcagagagaggttgttgaatgtggaatgaatgtttgcacagtgtggtgagccataaatggagagatttaaggagctttactcattattcaactacccccctttcccatctccattttgtttctcaaaacaaattcatcctaacaaaattatagaaatttcttctaaaattcaattttttggatggtatttttaatattgatagattccctctgttccttaatacttgaatttctagaaaacacacatattgaaaaaacatattaaaagctgattataaatatattatttttgtgatttatattttttttttaattctaaaccaataatatttaattgtttatcttgaaatttgatattcatcaataataatcaattaatattatatagaaaacctaaaaatcaaaaacaaaacagaaagaatatttatttatttattactgttttagaacatgtaatatgggctacaaaacgagtcattcggtccgtttgatttgattagtccaatttaaagcccatttaagatgggaaaaggaaaaaactcgacccacgcgcgtctattgggctcagttgtggattttgctaaaaagtggcctaaatccgtggactatagctggcgattatgacgcaacgcgcctcccgcgtgaggaccgcgcgtgggattttcctgaaacactctcaggttgtgacttgtgagattttttttttttgtttggtaataaaattttctgagagagttgtttgataagaagaatgcaaaagttctacatagtccaaaagtaattcgtaaacccaatctaatcttattattaacttattaaattttggtgtaataactcgataaagttttcgcgccatattgaaatcatgtttactcatttccttttgatcttgcaaattatacgcataataatacatgttatttctattgtcaagcaagtacaagagtgtaagtgtatatctctctctatatatacatatatgtcacatgtgcataaagattttggtttatctataaaacaggacaaaaggcaaagtatagtagacccgaaaaacaatctcttggtagccttttcatctctcttgcatcacaagtaaacctctcatcattcatttccacacagcactgaaactcgagcatttgctctctcgaatcccatttccctagctaaaaggttcggaattccacaacaacaacaaaagacctattttgtgaatcttttctctaaattaagagttattagggcaaatttctacatagcatg

SEQ ID NO: 12582 - DNA, 3000 bp, Unknown
  misc_feature (1)..( 3000): cDNA_ID_3025728_gDNA_ID_2214559_Annot_ID_185841 3000 nt of promoter + ATG
cattttagcaatcttgtttatgtcaaagctgttgacttatctctaccatgttatgcttagatatgcaatgcggttgctgtggcaggatatcttaatgcaactctagtaattcccaactttcactatcacagcatatggagagatccaaggttttagattgctttcttctgaaaatcttgtttgtgcaaatcaaagccatcttttgtagattgctttctgacagaggtttttctttcagtaaatttggggacatctacgatgaagagttctttgtcagtaccttatcaaatgatgtgcgggtggttgatacaattcctgaatatctaatggagcgttttgaccataacatgacaaatgtctataacttcagagttaaagcatggtcacctattcaatattatcgagactcgatcttgccgaaacttcttgaggagaagtaagttacaaattgttctttagaagtttgttttcatgtggtagagttagttacacattgttggtagggttaaaaatatagtaacaggataaaccaccttttttctagcggaagatatgttttggatctgtttagcacttgtcattgaagaactgttctctttgcatggcacaggattatacgaatatctccatttgcaaatagactttcttttgatgctcctcaagctgtccagagacttagatgtttggcgaattacgaagccctgaagttttcgaaaaccatactaaccctaggagaaacactggtgaagagaatgaaagagcaaagtgcaaaccacggtgcaaaatacgtgtctgtacatctgcgttttgaagaggtttgttccatgtaaaggagagacatctatagaatccccactggtctttatcatggttgtaaatttttgaatggagagttttgtgtctgagttgaaagattaaataagctatatctacatgttgcaggacatggtagctttctcctgttgcatatttgatggtgggaaccaagaaaaacaagatatgattgcagcaagagaacgaggatggaaaggaaagttcacaaaaccaggccgtgttatacgacctggtgctatcaggcaaaacggaaaatgccctttaactcctttagaggtatactatcaccacaatatattagcattctcggatattttcttaagctaatcatccatcagaatagttccacaaacccttgtgagcaatagtgtgacttgttctgtttggattatacttttcttgtaaattattcaggtgggtttaatgcttagaggaatggggttcaacaaaagcacatatattttcctcgcgtctggtgaaatatatgatgcgaatcgaactatggccccgctactagagatgttcccaaatttacaaactaaggagatgcttgcatcagaggaggaacttgctccatataaggtttgcttctttcctggtgtttgttccagagtatatttctcgtgatgaatgataaatctgacttgaaactctgtgttcagaatttctcttccagaatggctgcaatagattacacggtctgtctccacagtgaggtatttgtgaccacgcaaggtggaaactttcctcatttcctcatgggtcatcggagatatatgtttggaggacattccaagaccattagaccagacaagcgaaagttagcaatcctctttgacaatccaaacatcgggtactcacttcttctactcttcgtcttcgataaaccctaccaaatctccacatgaataaaatttgaattgttacctttttattcaccataccagtgttgcactcacctgcaaaccttacaccctgttactgtgttatcacttattgctcaaacgatgttttgccccgcagatggcggagttttaaacgtcagatgctaaacatgaggtctcatagtgactcaaaggggtttgagctaaaacgacctaatgactccatttacacattcccttgccctgactgcatgtcccgtaggaacaaaacaacaaccccagaatcgagaccacctcctgccacctgaaaacacacatttgattaccggccttccagaatctgcttctacaggctacgttcattccttgtaattctaattctttcaaatcagacacaggaccttagtgactcggcctgcccagaattttagggaagacagcgtttgaatgggccgtggaatcatctatttattctccggcgaggagtaacagccacaacattgtttgatacctttgacacattgaagctgatgtatctaacaggaaagacgagattgaagttttaacacattccctagctgctgctgggcaaagaataggacagcgtttggattttggtgtttttttcttggggtgttttggtggtttgaagaagcgtttgcgttttgtacattttgtgaacgcaggctttgtgttaggagatatgtagagagagacggacaagggggagaaaagaagctgccctaaaagttttgtacattgatttggttagagatcattgtctcttcttttcttttcttttctctgatcatagggttttttaattgtttcatcatcatattcttatgattcttttctttcacaagataattttttcaatagtgatttaattcatttttgcttcttccagtcgtgttcatgtttttcatttgttcttatatcagttttaaatttattcacttcatgtacaatggggtttgcttcatctctaatccaacaaatacaaacaaacaaaaaaagaatcaccttcctagtttatttctatgcgctacttaagcgcgtgagaaagtacgatccacgtggaactagcttctttcgccaacacaacacagagtttggctcacgaaaaagtgtgcgcgtggggaagaaaagggtctcatatataattggagtgtaaaatgtttgacctttttgtttgggtttatctcttttagactcaacaacagataaatttgttggtttcaagtattatcaatttcccggcgaaatctccaccagagtt

SEQ ID NO: 12583 - DNA, 3000 bp, Unknown; identical to SEQ ID NO: 12576
  misc_feature (1)..( 3000): cDNA_ID_1807367_gDNA_ID_2214559_Annot_ID_185839 3000 nt of promoter + ATG

SEQ ID NO: 12584 - DNA, 3000 bp, Unknown; identical to SEQ ID NO: 12575
  misc_feature (1)..( 3000): cDNA_ID_3025736_gDNA_ID_2214559_Annot_ID_185838 3000 nt of promoter + ATG

SEQ ID NO: 12585 - DNA, 3000 bp, Unknown
  misc_feature (1)..( 3000): cDNA_ID_2990201_gDNA_ID_2214559_Annot_ID_185836 3000 nt of promoter + ATG
aactaaattttgtataaagacatatcaattggtaaagatcgtaggcgaaacttaaaaatcgccgattcgattgacgtttgtgacgaaactaatattacatgtcgtggtttcgaaccaggggaattacgggcttcgacccagaatctcctgatattcaaaaaaaaaaaaaaaatcaatcgtatgacacgtgacgtgatcattcatgcaagacgagaccttcgtagtatggtttcccgcactgacattaatcggggagatagtcgtgatcgtctatatatggtgagtgttggaggatctaacgattcggaaagctaaagaaacgtcaaatgtgtgactgagagccataatatgtattagccttgtaagttgtacccggccaccatatataacaaggtcaattcacgtcattaagtcctactaagtactaaccacatatcatccacgtaaataaatcaagcccgcgagatccacgtaagttttaatccactactaacgcaaacgtacgtagaagtgttttcagaagacaccacatcgataggtccagagatcgaatacctttggagctcctatggaagagttattcagaataatttgcctccacaagtattatttcatttagtgtagttcttaaataagaaaaaaatatgaatgtgttttatgtccttatcgtgtttcgtacattatcttccgtcaagataggaagctttttcatttgatacattatcactttcaagtgaggtcaactctttaatcaatgtaagttgattttgcaattagaatttgtggcgtagcaaagcgcaattagtttattcatttatttcaattgaatgatgaaagttataagtattgaagatatttgacctttggtatagaagaaatactcaaaataaaacgttgactttagtgttgaatcatacttcctttgtttcttaatatttgtaatttaaggtttttacaagtaaattaagaaaatatataaattttatttaatttatctatttcctataaaaacatcattagttataactaatctaaccaataagaaagtaaaatataattagctaaaaactattaaatatatttttgtttgcatagaaaagtgagaacaacacttataatagaaaaaaagaaatatttaaattacacttagttagaaatcgagaaaatataaaacaatgcgtttcagatataatggctcttcagttcgtgatcggcgaccgaggaaaccaatctatatagaacttagatataggtttaagtatacttttcatccattttttgagcttcttaactcgtagaagaatgtttgttataccttactataaacatggatttatatgcactccttcttgggttgttttctcttcatttactaaaatcagttgaccaataataagatataaaaaaagtacccaagtctacgcagttgttacggcccattagagtaatgaagagacaaaaagcaagcaacacaaaaagcgacccaacttgagcaccgtcacaaaaacggcgtcgttccaaaggatggtcaacaatggtgggaacctctgcacaacaaagagactttcctcgagatttcttatattcgcctgctaaacgctgtcgtattagtgggtagatgaaaaagacagaagggcaaatgagccgtgtcttccataattctcaacaagataagataaggtatggctcgcatttttaggtattgtttaatcttcggttgcgtttcttatctttttttttctcctaattttcatttacagtgatttgatttcagctcattcctgattttcaattttctgatttcagcaaaaagtccttatctatttttttcatttatttaaggcaacttgttttctaaaaataggaatggaaaaataaaccgaaccgatatatttaaccgaaacataaaactaaactaaatcaaattaaaaattagaaaataattgaatagatactaaattctttaaccaaaagaatcgaagctgaatcggtgccgaaccaaagtattttggtaaccaaaaatatccaaaatataattatattttcaaactaaataattaaaaattcttgaaaaattatataaaatagtaaatttattagaaattaaccaaaaatattcacaaatattcaaaacaaattaaccgaatgaatactaaatttaaaaaaaaaaaaacagaatcgaattaaaatcaaaccgaaatactaaattttaaaatcgaaaaaattaataaccgaatggatacgaacggaaaccgaataaataaccgaaaacacatgactaaaaagaggtattttcctccataattaaaaggtgtttaataatagagtgatcggcgaaaggtgtgaaattagctgttttgtcttgaagcggattcatatataaaagagcgtgtgccctctttgcttttaatttcagacaatcttcttcttcgttgcagcttcgtggaaattattttctctttctcttccattattatcttaaaggtccgtcttttatccttcttctttttttgttgttgtcctaaaattagggttcttccttgtgaatattgcttgatctaggaaactaatcaggatctgggtttgtcttttggatctagggttttattatagcatttctgggttctttgttgaccaagaagaagatttgtattgatggaatgttgttgatgttgttgtgaacagtgagaaatcaataagatgttggagaaagagtttttcacggagtatggtgaagcaagtcaatatcagatccaagaagttgttggcaaaggaagctacggagttgttgcttctgcggaatgtccacacacgggaggcaaagtagccatcaagaagatgacaaatgtgtttgaacatgtctcagatgctattcgtatcctcagagagatcaagcttctcaggcttcttcgacatcctgatatcgtggagatcaagcatatcatgcttcctccttgtcgcaaggaattcaaagatatatatgttgtttttgagttgatg

SEQ ID NO: 12586 - DNA, 3000 bp, Unknown
  misc_feature (1)..( 3000): cDNA_ID_3025741_gDNA_ID_2214559_Annot_ID_185835 3000 nt of promoter + ATG
tgactaataaaattttacattttggatatatgagaaactagcatgggaggtgggttgataaagacaatcatgaaaagacaattctcatgtttaatttgaacactacaagaccaaaagttatctatcacacataactatgccggcttttaatccctgttttgttaactactatagtttaagaatcccttaattgaaacctgcttatgagtagcaaaagaagatgaaataggtaacaagaggtttggatccaaagagtagaaagaaaatgattaagagacaagacagaaacttttttgactttagaagatagcgatgtcggaagttaaatctgtgtacgtcccaagacgaatgatttgctcatcggaagctacaaaagctgtttgtacaaattggggatcattctctttttcgttttctataagacctaatattttatactactatgctctttcaaattatttgctccttccatttccatgacactaataattgacgctttaaataaaatccatacaaatgaattctttgaactgttgaaacttgaaagagagtggtcactatagcactgttacacttaccgcgatatttattgaataacatactaaattatataaattatcaatatcttaactagggatggacataaaatccgaaattcgaaaactgattcaaaatcgatccaaaaattccggctccaaaaccgaaccgaatagtcacaaaacccgaacgaaaaataaattcttccactgatccgatccgatccaaaaaccaaacggatatccgctaaacccaaaataaaattatatatatatataatattagttatatttagctataatttatacccaaaaatatccgaaataaccttgatatcagatttattattagttatctttgttatacttatacaatgttttacaaaattaaacaattttttaggttttttttttcaaaaactgatccgaaaccgatctgaatccgacatcatccgaaccgaaaccgaaccgaaagtcatatcatccaaacggataataaactccctcatcagaattatccgaatccgaattatccaaatacccatgtctaattttaccattgctttttaagccattaaccataaattttgggagaacattgattggaagactgtgttttacagatatatatgtattcggttgttccagtaaaagaagtagacaatgattaatgtaagatgtgtttaatcgaccgcacaaagaatatggtggtggtgactacacaaatctggctgatgtaacaactgtctaaaacattttctattctttttgaaacgtaataaacgcaaatcatatcatgcaccaacaagtagaatcattctttccataaaaaagtaagaaaataataatgataatcagtagtaccaatttattttggaaatgtacactagataatcctgcatttataatatattgataattgaccttgacctttaaactacatttttgttgattactatttgaacaacataatttcacaaaagtgcatacaaatattttcatcaatccacacgaaaaatgacatacccctttatttcctattttgccaccatagtaaactacttaataaaggggtatatgctttatttaacctaatttaacctttattttgttgtgtataagtcctaatgtttgtataaacataagtataaatccttaccttttgaataataagctttttttgctgtaattaatttggtcagtatgattgtacaatgaaacattattctcatgcgtttcacgagctagcaggagaatatattggactcatggtgtttctcaaagcagaaaagagaaaatgattactatttttcttttgtcaactttttactaattttctctttatagaatatgaaatatgaatgagcaaatactatatgattgtcataatcacgaaactttgatatactaatctaatcgtggacacaactaaataattaagcagttagttaaaggaacgtgtgtgatcaagaatgcttattatatgcaaataaaaatatatgactcatgcaaatgaatgaccaagaatgcaccacaaaagttctagaccggtcaagtatgttatctttttttaattctcttaatgaaacgaacgatacacgtagaattgttaactagctagtttagtcaatatagttagagagtagttaagataatagacttttaaaaccatagatggaacgttacatgtttccatggttagccattggaatattgaccgagagttaatatataagctattactgaatctggaaacaaattcttatgttgtcttaaatgcgtctactttaaaccgtacaaaaattcaacaaacccaagttaatgtaagtaattaggatgattgaatatgcgtttctatctcaataatcttcaccagttatatatttctcactctcccattaataacaaacataatcatctagataatggaatgtaaaaaacctgctgggtcagtctcccacacggagtcagcattttactcctccatttcactgattgacacgtgtcaattttccgacgactcttctcataattcatcctttgaccggtagacttcagtcaacagccccgctctcttctatttattactatgactaaactttttttagctttttaatttaaaacccaattttccatactattttttttttttaaaaacttcttaaaaataatttcataggttgatgagataccaaacgcatcttaatattttctccttaatttactttggttatgtctttctatgataaaactactatttacgtacatatgcacatacacatataaactatatgctctatatcatatggattacgcatgcgtgtgtatgtataaatataaaggcatcgtcacgcttcaagtttgtctcttttatattaaactgagagttttcctctcaaactttaccttttcttcttcgatcctagctcttaagaaccctaataattcattgatcaaaataatg

SEQ ID NO: 12587 - DNA, 3000 bp, Unknown; identical to SEQ ID NO: 12572
  misc_feature (1)..( 3000): cDNA_ID_2709197_gDNA_ID_2214559_Annot_ID_185834 3000 nt of promoter + ATG

SEQ ID NO: 12588 - DNA, 3000 bp, Unknown
  misc_feature (1)..( 3000): cDNA_ID_2709189_gDNA_ID_2214559_Annot_ID_134857 3000 nt of promoter + ATG
gaccaccttcccgaggatgaacagccatccgataaggcagatcagagccaaccacaagcctacccagctgaaaataagtatccgatctagttataggaaatacaaaaccttgcaaatgcataagatctgctcctatacactcatataagaacagaatataaaacctttcctacttacaggttgttccgagagagaattggtgtttagatcaacacggcatattaatatgacattagagattccacttcgtccctctccgcctccgccggacaaaacgatgcagctccgggaagaagaagaagaagaagacgactcatcatcatcttcagatttctccggatccattatgattttggatctgacatctacctccggaatccagtcggcggcgtaaatcggtacaccgtaagtctgcatattcgacggttgattcgtctctgtactctgattcgccatcctccgtgtctgtctctcgagctcaatgccaagtccccactgattcgtaaaaatactaaatacaaaaaaaaatattaatgggctaacttaaggcccattacagtatttataggcccatcataatatttcatttatcgctgaattccggtaaagtgatagcggttggacccggttcacgggatagagacgggaaagagtacggcggtacggaggtcaaactcggcgagaaagagtacgtataccggatcctttaatttttataatattttcatttatcaccccaatactattgatttgatctaaaaacaccctatagttgtgtaaaattcttaaatcgatgtgttggtgatttttgacgtaggtatcatctgtttcgggacgaggacatccttggtacattgcacgagtaaaatgcaaaggaagtctctgagtcagctagtgggtttcttggtggaataataatttttcagtgactcgtttcgatacatgttgttgaaatttgaaagttttgttatttctcatcattttgttcctccttaaatttggcccttttataactgtctttatcttatgtctaatcgttttctgtgatttatatctttgtatttagtgtgctacttatataagttaaaactctacacgaataaaactcaagtagtgagatttcgaagatcaaatagtttgtaaactacgacgaaaattacaaaaattgcaacttgcaagtgtcactaactataaatcacgacattcttccctttcgaaaaatcttcatttctcgacaaaaaatttaggtttccaatgatgaccacaaaaagtggaaaaaaacgattctcgtttctgaaacgtttcgcttccgcgttttcattactgtttctatgctagagagtattagtgccttgttgtcatggtcatatatctcaattgaaaatctcctaaaactatatataaaatgacatatagtattttactaaatttaggaatcttttcatttatatagtaaaaaaataaaatagtgtcgctgttgccaaccactctctatccatctcagtttgcacatgcaacacaaccacatgctaattgctagtgaaactctcatactgtttaattaactccctaaatatttatcaaacaaatgatatctacgttttttaaaaaaaaaacatatctttagattatagagttatacaataatttccacatacataagcttccacgtatccaaatttaaataaatattttttgtgtataaaatgtaatccaaagatggagatctaaatctactaattaactcacaagtcaacatttaaatatgcttagaaaaataattgttttcgatctatgaaattatgtggctgcattatagtattaacaagcaatcatgcttagaaaattataatattgttatcaatacaattacaccctaattccttaccaaaaatacgtgccgtttcaagattagctaaatagagcatggaatcaacattgcttgtcgtgttggctttctcttcggagttgttaatttttaatttaatatttttactattttcatcacattattgaatacgaataataattgtattaaacaatcattattggaataagacttagatgataaagatattctaatcatttataaaatacgtagatgttgactttttttttttggcaactatttgaaatatatttgtttccaacgattattattttataaaaaataatcataaaatttgtgacctgcaatatgacattaatagttaaaaaaaatttcgtcaaaaggaataattcacaattttaaatagataaaaattgtaaccagaagatataccatcatatatatttacaaattgtattattatctattcataatacaaaacatgacaaaagaaattggttgagttcttgtcgggtattttccatatctcacacaaataaatcaaaaattgaaaaagattacaagacacaaacaatccaaaaaattaagtatcaaaaggcaaattttttatttttatctttagtttctcgtagtgcaaatattaaagcggttaatttgatacgtaaaattcgtgttcaaccgcaacatattatttacgtaaacaacatttttcaaaaattgcattaattaattttggataataaaaaaaaaggtatatactactaaaatatggagattaactaaaactgttcatcaagaatcttcaatatatatctttaaagagatttatttcgaattttattaaagaaaaaaatttgaaatctaaagggcaaccaaaaaaaaaaaaaaaagacaagaggagaaagaaaagcaaaggaagggcatgtgactgatcacggctttgcctccaccgcataaagctcccttcacagatacatacactctctttctctctcttccggcgtttattcttcttatttcgccaccgtcctccgccgccgtggtggacttatatctctgcgtttcacgacctgccgccaccgccggcgataggtttcaatgatgaattaaggcgttggccagagagagaagagagattgagatctgtcgat

SEQ ID NO: 12589 - DNA, 3000 bp, Unknown; identical to SEQ ID NO: 12580
  misc_feature (1)..( 3000): cDNA_ID_1974269_gDNA_ID_2214559_Annot_ID_134861 3000 nt of promoter + ATG

SEQ ID NO: 12590 - DNA, 3000 bp, Unknown; identical to SEQ ID NO: 12579
  misc_feature (1)..( 3000): cDNA_ID_2781800_gDNA_ID_2214559_Annot_ID_134862 3000 nt of promoter + ATG

SEQ ID NO: 12591 - DNA, 3000 bp, Unknown
  misc_feature (1)..( 3000): cDNA_ID_2712314_gDNA_ID_2214559_Annot_ID_134864 3000 nt of promoter + ATG
agtcaacagtcaacacatttatataagaaagtcaataaatattcaatcaatcaaagaagcaaaataatttcccgctcacatttttgtctctctattttttcttcggtaaacctctttgactaactatcttatcagaatctctctttccttctcaaagattggatctttcttcaaacttcagaaaaagatcgctaagagatttcttgatctgtgaaatcagaagaaatagtttttcagaaaatgagtccgcatgttttagatcttcctaagggttgtgaaatctctaacgatctcacagatttcgtaagattcattcttattatatccaaatctcttttatctgaatgatccaaattcaaattacaatttctctcttctttctttgctatgttttcaggttcactatagagtcgaggaatgtatacaaggctacatgagcaaagaagaaactgcgagttttatattcgatacatttggagtctcactaaagtttaccagatttggttaattcttcatctaaaagcaacttcatttttattcgatcatcaatgggtctgagacaaaacgtttaaaaattgaatctttaatgttgtagtttggtatcttcttgaaaaagcaaatccagatttcttcagatgtttcaaaacacattgcgagaatattcagaatgcaccaagtaagctataacagaaaccaataaaccctagaaaaaaaccctttgtttcttctcacccaagtttcatttgttgggtacaggtgaagaagtaacgtctaatgtagagattgaaaattgtaagtcctgaaaaacgaataatcagaatcggttttgagttctttttgtttgaatctcttgttattgttgtgtagcttttgaagatttagcagaggcaagtacaagctttacaaaaccagataacaaacctagagcaaagcgttcaaaggggaaaaataaacagaagcaacatccaatttctcctattcattcttgtaattaaacttctcttgtttcttattgtggtttccgaaatctagataaatttgtttgttgacatggtctttgcttctgttagtgatcgagactgctccaaatgatgcatcatcacaagtgcctcaagaagcagctactgctaattctagtgataccccaattcctgtggagaaggtttcaagtaaagcaaggcggttcagggctcgaaagaaagcgaaacaagaaaagtcacaacaagctccatgttctccttgtaatcaaaacttctctgtttttcctcagtttctcatcctgtgtttgttttgctaacaacatttattgtctttgtctccttttagcaagagggacttctgcggatgttgagagggctgaggtacctattgctgatgctgagataattttgaagcagatttcaactagaatgcgactgcttgagagtatcatagaacaagtacacaaactacttagtaatgtacttggaccacctccttctgctgctaaagccctcaagaaacagagatcatggaaacaagtgagaggtgattatgaacaagcagagatgcttcatgatctgaatcaacaagtccaacaagaaatgccgagaatggacatcccggggaatcaagctagcgacaactccaacgaagaagatacactatatgattgatagagagcatattcttacattagcatgcttagtttgtgattaccagaatatattcctaagctctatgagactttatattgttggttacgttaccatgtaccaattacaaaagagaagaaaccagtatatatattctatcaaatctcaatccatattattgtatggccaatcacaacaaaaaccagaacaaaaatgttgtgatgcatgatcttaatgagaaggaaccataaggccaaaagacttgttgagccaagccttccatctccctgaagtcttccgggttgttgttgttgtcatcatagagtcttcaaggttttgagtctctaacttgttagacaacacaaagttccttgatcccgttgaaccgattttcccctatggatcgaatgctacataagagattcaaaaacattaaccttagtaaaactgatgaaaagtcacaaattcaaagaggaaactgtagataccttcagaggcacagtaagggcaataaagtcggaaaaagctggaatctgatccgagaagtggaagcctgctttcacgaacataacatttgagagcataatttatgacattggatacagtttcatcttctttgacaacgaaacgaatcggaccagcacttcctaagacattgatgctaacaaggaacctgttggtagtcttcgatttctggtttctctgatgcttgttgttgtacaacattatcaaatttcaaaatcagaaaggtttattaaaaaaacaaaccgtgttgaggagttcaagggtcgacgccgatgcaacggtagtaccagccttctttggagaagccaaatttgaaagaagatgcggcggagagacgacgaaggaaaaagctcgcccttgcggttgtgcaatgggaaagcatatattctctggtgatcggagttgtttctaccattcaaagacgctaacagagatctgagcaagaatgatccacgatcaaggaaacgaaattgggggaaaaacaaaactagggtttgatggtggtggtgggtgagggtgatgagtgagagatcaaggaaatgaatggtgttatatatcaaatatgaatgaggttagagatgtaatatagaaattagggttttgatgtagaggaaggatgagaatggttgacccgattcttcttccgcaaggaaagacaaacccattacaagcaccacaaagcccatctagctcagttggtagagcgcaaggctcttaaccttgtggtcgtggaaatccagttttaaaaaaggggtgtctttactaggtcggaaggacagctgacgtggcaggggcgaaaaaagaagcgttctagggttttcttacgtttctcacaagcatg

SEQ ID NO: 12592 - DNA, 3000 bp, Unknown; identical to SEQ ID NO: 12577
  misc_feature (1)..( 3000): cDNA_ID_1808283_gDNA_ID_2214559_Annot_ID_134868 3000 nt of promoter + ATG

SEQ ID NO: 12593 - DNA, 3000 bp, Unknown
  misc_feature (1)..( 3000): cDNA_ID_3025755_gDNA_ID_2214560_Annot_ID_134870 3000 nt of promoter + ATG
agaaattctctccaaaatttcttatataaggtattttggagatgatttcttcactaatcaagaaacccacatattttttataataaaatttatctctctaaaataagagatttatgtttagaaaccattggtggagttgctctaacattttgcaagttttcgctaacagtttctatcatttctaggaaggtcaattttaaccctttcaatcttgtgatcataggttttataggtaagtttgtaagaaaagatataaaaatatgaaatactttaatattaaaattaatttcaacacaaaatactttcaaaatttagtttcttacacatcataaaataagaagatagatatctataataaaactaatctttttttatctattattaattacaatatcatatccatgaatcaatctgttatccatacatttttagagcagctcacgtgtactaacctacaaaatctcttttaatctaccactataaaattagatatttagttgttttgtgcgtaattacaattgtcattgtgataggaggggacatatgttatcggtcgattggtagtaggcaaccatggtaatcttcatttacaggttcttgtaaagaaaatgttgatttgcttgagtggtcctagttttcttctttggattaaagttagtttgcctactatatggtttcgatttcttccgatttcggtttaattttttttgctttgtaactttagtacttatgttttccttgcataggcctttgatcccagagaactctcgttttccttcggttttgtttccgagtactttaattttgcctattcgtttaatttttcttgtttggattgtgttgtagtttggtttttcagcaaatttcagttaaaaaattcagatgacaaaacaaaagaaagtttgtattaagaagaaaaataacaattatgtgtattggctgaaagataatactctttttgtttcttattattatttttttctatcaaatatttttcttaacaattatgtgtattggctgaaaatgttgtattattttctaatgcaacatttattaaatttcaagaaaaataattaaatactattggtttagaacaataagaaattgtaaatcacaaaaaataatacatttatacttaacttttactattttttttatttgttttaaaattttagaaaatatattattaaaaagaaatagattaataattaagttcatttttaattggttgatgttaaaaggaatcaattatggattttctatttttttggatggcatttgtggattttgcctctttttgaatagtttgtggattttatcatttttaacctacaaaaatataatttaatatgtgttttatcgtcatatttaggttagttagttgtaattgttcttaaaatttagtatttggtataaagtatatacttttaccaaacaaatccaaaatttgtatattttttaatattaaaagtggtaaaccataaaattttagtaaaaataataattttaaaaaaaaatcgacgaaatagggcaaaatcaacgaatctctgtaaacagtaaacttataggagtagaaactaaatttttattttaatatagttagaacctgcataggtcggaccctaaaaatatgttctggatttaattatttagaaagaaaaatatagaaaatgtatgtatgtcaaaaagtcttggaccataattggcggagagagaacctggggacggacaaaaaagtgacaatttgctccgacattaaagataattaatgaaatcaggtataattaaatgaacgcataaataaatgaagagagatgatgatatatgtataatcgtaaacgcatagagtagagaggacacatggagccacccttgtggtgtccgacaattacttttaataatccttccttttaatgaacttctattattttgcttagatatcatttttttttcttctatgtatgataaagttctacatttctggtttgtaatcttctaatattttgatagtagagagttggaataccataacatgttggaaatgttttccattttgaaaaccaaaacttttttttttaaaacaatttttagctatcgttatcaataagttcatcacttaaatgtttttgggaagttcacagtattttggaagatattctattaaatatcaactatttttctagttttgtgtgctaattttttcctcggttatctaatgttgtggttgattttattgcaaaactatgtctaagtttgtatggttagaacatcatttgagcaatataattaagtttgtgcaaaaaagaaagttgatcacttagtattaatttttcattatataatttgatcaagatgcttgcttaatccgatctagataataaacaaaattatctaaacagtatgaaactacaagttcctaatagttaatgttttgacatttacaaagcaactaagtaaaatgttattaatgaattggttactttttttttggtaaaaagttaaattcatatcatttttaaatttttgacagaaaatacagaaatcacagaacaaatgaaaacacgctattgaaaaattaaaaacaacaatattattcaaaaagcttttggttgctactgaatgaattggttacttgtttagattgggtaacaaaattctaaccaaaactagaatcactaatactcattctttaccaaataatacttcaaattcaaataagagtttgattgtgaaagctgtatagctgtacgtatcatgtccatattacagttgtaagccattgttacaaaactactaaaaacaaaaataaataatagaaaggtccgagaaacttgaataaaaatttagaatttttaaaacattattatcgtaaataaaaagagaacctcccaagaaacaagtcgtccttatataaagccaaccacacccctttagcttctctcaccatcatcatcatcatcatcatcatcatttctctctatctctttctaaaacacaacc

SEQ ID NO: 12594 - DNA, 3000 bp, Unknown
  misc_feature (1)..( 3000): cDNA_ID_2709213_gDNA_ID_2214560_Annot_ID_134871 3000 nt of promoter + ATG
gtatagctgtacgtatcatgtccatattacagttgtaagccattgttacaaaactactaaaaacaaaaataaataatagaaaggtccgagaaacttgaataaaaatttagaatttttaaaacattattatcgtaaataaaaagagaacctcccaagaaacaagtcgtccttatataaagccaaccacacccctttagcttctctcaccatcatcatcatcatcatcatcatcatttctctctatctctttctaaaacacaaccatgactgtttcttcatctccatgggctctcatggctctctttctaatggtttcttcaacaatggtaatggctattcctccacgcaaggccattgatgtaccatttggtcgtaactacgtcccaacttgggcttttgaccaccagaaacagttcaatggcggttccgaacttcagcttatcctcgacaaatacactggtacaattactattaccaaatctctgcctaatgatcacaatgcaagttttgatattcccattttttatttggtatataggctaaagcttaatttttaaaggttaaattttcttgagtttaaaactacatttcatttacagattaagtaattagcattaatcatctctattattttacaactcaatatatttaaattttatttaggctttgttttgtaaaaatatatttagatttaacatggtcctactagtgataattatttttaagggctaaattttcttgagtttaaaactacatttcatttcacagattaagtaaatagcattagtcatatctattattttacaaatcaatttatttaggatttgttttgtaaaaatgtataaaacaccttacttttatctttcattaggccccaagatcttaggtacactcactcactaactatgttacatgtgtataaaaacaggcacaggatttcaatcaaaggggtcatatttgtttggacattttagtatgcacataaagcttccagctggtgacacagccggagttgtcacagctttctatgtaagtctctctcactagtcactaataatacttagatcaaatttaaatgattaacaatatttattacaaataaattgtgtgaagctatcatctaccaacaatgagcatgacgagatagactttgagttccttggaaacagaacaggacaaccagctatattacagacaaatgtattcacaggaggaaagggaaacagagaacaacgaatctatctctggtttgatccttctaaggcttatcacacttactcaatcctttggaacatgtaccagatcgtgtatgaataattctatccttcacacttacttacattacactttttcgtatattattatatagtgaaaagttgtcagaattaacatggtcctactagtgataattattgtttttttttcatattcggtgcagtttcaaattattagtattatttttcttaaccttggggtggccaaaaatcttgatcttatcaaaagtagtggggtcttgtaagattatcttagacagagactcttgagtcaaaaagttgtagactttttcagcttttagattttctaaatgttcaaataagctagactacgtggataggtaacataagtgactcactcattagtctttattgtggggtattcaaaatttaactaaactctaagagtcatgtgttgtaaaccggtgtggtttactaaaaattgatttttctttgatcagattctttgttgacaacataccaatccgaacgttcaagaatgctaaggatctaggagtacgtttcccattcaaccaaccaatgaagctttactcaagcctttggaacgcggatgattgggccacgagaggcggtttagagaagaccaattgggccaatgcacctttcgttgcatcttacaaaggattccacatagatggttgccaagcttctgtggaagccaagtactgtgccacacaaggccgcatgtggtgggatcagaaagagttccgtgaccttgacgctgaacaatggcgtcgtctcaaatgggttcgtatgaagtggaccatctacaactactgtaccgaccggactaggttcccggttatgccagctgaatgtaaaagggacagagacgcataagttactactcttgagggttttaatgaatttatgctatcattattatttgaattatgcttgttcaagagattgatatatgtattgtttgttggcccatgatgtttatgctatatttgggcctaaaattacatgttataattcatatatgtattgattagctatgtattttcatatgttatgatctacttacaagttttattctttaacgtggtaaaagtgcatttggtattaactaacataaacgtgattattattaactattattgagcggccgctttttctctaatttctatgtaagacacatgaacagaagaaactagtcccttcctcacatgcctgctttgcgagactgtttaaaatttacacattttaaaactataaattattgagaaatatcattctatatggatagaaaacttgttatttaggtcttttcaaaatccattgttaccctaacactgttaacataactttttacgcatgtatccttacgttattgtttttgtcagttgtaaagtatacgcgaattattgcatgttgtaggattctaagattgtagtggaatattgcgttcgggagttttttttttttttttttatgttttcttctctcctactaacgaacattcgtgtgctttcattactatataaaggagagagattgcgattgaggcagaagaacataaccctcgtcttaaaattttcttgtgttatcagggttgattgtcaatcgatatcatttccttccgattagagggttcttcattcgttttgggtaattgattttagtctcctctctttgattttgtttcttcatttgttttatctcgctgtgtcttattagggtttttcactttgtgtagacg

SEQ ID NO: 12595 - DNA, 3000 bp, Unknown
  misc_feature (1)..( 3000): cDNA_ID_3025745_gDNA_ID_2214560_Annot_ID_185873 3000 nt of promoter + ATG
ccctcgtgttgaaggaagaaaattatccagaatttatattattccatcacccgtgacgtaatcggatggcacagcctcacaaaccaccaaacgtggcactctccctctaagctctacccataaacttcgctacgtcttatttttcctagattcttattgcactttgatctttgtctcctaattacttaaatagatagattccattgcaatctaacatgacacactctgtttcttacaagactatattttgagaactttgattgaggccagggaagaacgtgaaggagtgtactactatacgggtgttttggctgctcaagttcacaaagcctcgtctgatcatgcatcgtatagagccttgtggcattgtagattaggccatccttgtagtatagtgttttatcttctttatgagaatgtcatcaatcttcacaagatgtttgcaaacttaatagttgtgtatttattttgggctaaacaaagacgagaggtttttcctattattattaacaaaagtttggaatatttttctttagtccattgccatgttttggtccatatagaattccaaccacgaggggggggggaggtggctctctcgttcaatatagacatatctcatgcagccaaatctgaagtttctcaaataatacgaaatttttgtggcatgatccaacaccaatttggtaagctggtagtgtcaatctgtatgacaacgacacaaagttcatgtgtcttacctcctactttagagaacatgggattctccatcaaactttttcgattaatactccacaacaaaatggacgattttaacggaaacacgatcatatcttgagtgtagcccacatctgtctatttcaagggaatcttcccattacattttagttaaagagcatactaaaagcgacacatcgcattaatcgaaatccatctttagtactaaagggataaagatcttatgaaatctagtttggcaaacaccttcatacgttatgctgcgtacatttggatgtttgtgctatgctcatatcccatcacgtgataaagttaaatttgcatctcacagtcgcaaatgcgtgtttcttggttatccttatggtaaaaaagtttggcgggtatatgatcttgaaactgacaagatttttatgacgcaatgttcgatttcaagaggatttctctccctttgcttgccatccatcaagcctattatcttttgtttgcaattgaatctcaatttcatttagatgatgacgattgttttatgtttgtgattattgttctggtttccattgatttatcatctttggaagttacacctacttactatagatattgtttcttggtctatcagatcgattgatctcataccagaaacgatcgatccttctactccctcaacgatacctgtaagcacaagatcgatcaattccacaacatgaatgattgatatatatctctacctcgacaacattacttgcaagttttggaccggtcgatcagttctctaaaccgatcgatccatcaaaaacaccgatccctcaatatgttggccaggtcaaatccgcctcttcgggtcttcctgaactattggacaaaggtctgagaaagaaaatgttgttaatattacttaaagattatattatccctccaagacattcttcttctcacggtctatctcttacttttcccaactcaacttcctcaactttggtttatggtaaggtcctatatctcctttcaaattatttaatagattgtggatttgtagtagaccacatagcatttttggtggatgttcttgatagcaaggaacccaaactttttaaggatgcaattctttattaaaaatgatgtgaagctatgtaaaaagaaattgatgcttttgaagcaaatcatacttgagatattatagagttaccacatgggacaaagtgatcagtagcaaatgggtttataaactcaaattcaaatcggacagttcacttaagcttcacaaggctcgtctagtggttatggaaaatcatcaaaaggagggtattgattttaaagaaacttttgctccactcgcaaagttgacaacaatttattctcttttagtgttgctgctgataaagattggaggtccctcagatggatgttcacaattcttttctacatggtaatcttgaaaaagaggtctacatgaagatgtcatcatgttttaaatgtttggatctatctaaaacatttgtcggttacataattctctatatagcctcaaacaagctacccgttgttggttcgccaagttatcaactacactctgtcacatttgtttcactcagagttatgaaactttctcattgttcactctcaagaatgggaatacgatttttcgtattctaatctacgtcgacgatttcattatcacctgaaacacccatcaatcgattcaaacaacaacttcatcaatgttttcacatgaaggatttaggaaagttgaaatactttctaggcattgatgtgtctcttggccggaatggtttcgacctttctcaactatcatatgctctagacattattaatgacgtgggtttgatctgttgtaagccatctgttgtaccaatggaactcaatgaaaagcttgttttggtagcaagtctgtcatttcacgatccccatcaatattgatggctcgttggtcgttttatctacctcaccatcactcgagcatatctttgctacggtctcccaatttatgcaattaccgcttgttgctcattgaggcggcactcagtcttgtttgttatctcaagggtacaccatctcaaggtattcttctttgttcaaatagtcaattatctcttatggcgtactgtgactgtcattatggggcgtggccgcttacacagtgttctctctacctctattatttatcgttgggattcttcacattcatggaaaacaaagaagtagaaaactgtattttcttcttccgctgaggctgagtatcgtgcc

SEQ ID NO: 12596 - DNA, 3000 bp, Unknown; identical to SEQ ID NO: 12593
  misc_feature (1)..( 3000): cDNA_ID_3025755_gDNA_ID_2214560_Annot_ID_185870 3000 nt of promoter + ATG

SEQ ID NO: 12597 - DNA, 3000 bp, Unknown
  misc_feature (1)..( 3000): cDNA_ID_3025760_gDNA_ID_2214560_Annot_ID_185868 3000 nt of promoter + ATG
aatctgttttattttcattccaagagaggaaaatcgtgaggctgatgccttagcgaaacaagctcttcgtaattttgttgagttgccttaatggccttaataaaattaatttctttgccaaaaaaaaaaaactgaagccggacattaaaactctttgagatcgcactaacttggtaatcaacctttttaggaaacgtcaagcagaaacgaaagataaaaaaaaaaagattaataactctgatattcaccagcttataataccattaattgaccgataactaacataatattctaagggtaaatacctaataatacactaattttgcttagaacacgtcaaacaaacgctttttatttatttttattgataataagcagtattattggttcctaatttaaaaaaaaattgatgaataccttcaaatcctagaaagtaaataaatgaaagattctaaactattattaaagagttttttataatcttgctgattagtttttcataatcttgtaaagtttctcaaacaatctctctattttgataatacttttcatgactttactttgtaaaaaaaaaatgtaaaaagtcatgaaccaataacatagtaatttacatcattaacaatcagagattcttttgtttgaattaaataacacaaaacttttactgactttataagagtatgaatccaataaccccaaatttatgaagattttagattaccttttataaatcttaattgaataacacaaaactttaacataccttaaaaaaatcttgattgcataacaagagatttacatgacactttaagtaactaaaactcttttcaaatcataaacaaataacaccacctaaatcttttacaaggattctattatctcggcaattatttgatatattttacccaaataatcaaccctgactaaaaataaatacaagccaaattctcttctttgttttttatcacacgcctgtaaagaagagaattacaaacatcaaccttctaagcttttgctaggcttcaaaggctatacatgtatgactatattatagagtactctggtggctcaatgcctactcatttatactatactctagaaccctagtccctaggatctctaagaatcaatgagcaaaaatttccttgatctttcaagcatatccatttccttgtttgggatcttccttgatattcaagtctatccctttccttgttcgagatcttccttgatattcaagcatatcccttttattaggatatacatgaatatatttacttagatatagtcttattaagatcaggcaacatgtatgtgtataaataatcttcttcttctattgaataaaggaacgcattacaaaatatttcatggtatcagagcattctgacctaattttttcttcttcttcttctttcctgccgtgctgtcacgtaacttgaccaccgcattttctaaaatcttctaaattcttctatttcgatactaccttctatattttttacacccaccatgtcaacagaagaagcttcttccaggaatcaactcgtcgtcgccaacacgaaaccttccaatccctattcactcagctcatcagacaatctctgagccttgatttcttctgttgtgttaaaggaagacaattactcagaatgggcaatgatatatccctatttttactgtttttaactatgttttaggtataggttttagagtctaattgttatttctagagtcttttctagtctttttcaggtctttacatgtttggatgcatttggagataattaagcattctggagatcaacagacaacctaagctgcagaatcaatccggagacaaaaatgcacgtaggtgtcgaacgacaccacccctggtgtcgagcgacaccaatacctgacggcaattttgagacgcaacttattaatgttttgaagattttcaaattcggcccagaactttctcctctgtttaatgaaggcccatcccgtgttttagacatataattaggtttttaggatcattgtttagacctaagcttggagaggctattctcctcatcttttttgtactttgggagcaaaaccctgtggagactcctttggagaagatcttttactctttctcttgctattattgatttcttatttagactatgatttgtgtttctttgattatgtctgagtaatccacttgttaggtttagggtttctcattagggattcatatggtttaatagatctccccctgctaggttatctgtagaattcttcatctttaattgttcttaatgctagatctagattgatcacctagaacttgaatccaaacaatagatatgcccgccataggtatctgtagttggatctattatttgatgagcctggtttataggtgtgtaataagaatcggcctatctactaaggtgaacaatcgaactcgttaagaatgcatatttaggttaataatctctcggcttctccggttattcttagctatagatatagggagtttcgcggcacgcccactggttattccataattagagtttgagtttaaaaatggttcgataacaacctagctattattagatctactaaccaatagtttcctgagaacaccctaagcctgacgtttttactttcttgtcttacaacctcacaatctgctattgcttccttttgtttctttttgttttcattactatcttacttagcttaattcaaaatcttggtctattgtgtgatccgagagttttgtggaattcgaccctaaagtactacaatcgatctgttatttgagagagtggtcttaaggcaatttgacctatatcaaatttggcgccgttgccgaagttctctacgattcaccattagattaggattagaattttgtctaagcatttatttttattttttttacttaatctttctcttttttttttttcttgtgtgtttcaggtctttgtctaatcacaaaaccaggaacaagcgagaaac

SEQ ID NO: 12598 - DNA, 3000 bp, Unknown
  misc_feature (1)..( 3000): cDNA_ID_3025764_gDNA_ID_2214560_Annot_ID_185867 3000 nt of promoter + ATG
ctctccaagcttaggtctaaacaatgatcctaaaaacctaattatatgtctaaaacacgggatgggccttcattaaacagaggagaaagttctgggccgaatttgaaaatcttcaaaacattaataagttgcgtctcaaaattgccgtcaggtattggtgtcgctcgacaccaggggtggtgtcgttcgacacctacgtgcatttttgtctccggattgattctgcagcttaggttgtctgttgatctccagaatgcttaattatctccaaatgcatccaaacatgtaaagacctgaaaaagactagaaaagactctagaaataacaattagactctaaaacctatacctaaaacatagttaaaaacagtaaaaatagggatatatcattgcccattctgagtaattgtcttcctttaacacaacagaagaaatcaaggctcagagattgtctgatgagctgagtgaatagggattggaaggtttcgtgttggcgacgacgagttgattcctggaagaagcttcttctgttgacatggtgggtgtaaaaaatatagaaggtagtatcgaaatagaagaatttagaagattttagaaaatgcggtggtcaagttacgtgacagcacggcaggaaagaagaagaagaagaaaaaattaggtcagaatgctctgataccatgaaatattttgtaatgcgttcctttattcaatagaagaagaagattatttatacacatacatgttgcctgatcttaataagactatatctaagtaaatatattcatgtatatcctaataaaagggatatgcttgaatatcaaggaagatctcgaacaaggaaagggatagacttgaatatcaaggaagatcccaaacaaggaaatggatatgcttgaaagatcaaggaaatttttgctcattgattcttagagatcctagggactagggttctagagtatagtataaatgagtaggcattgagccaccagagtactctataatatagtcatacatgtatagcctttgaagcctagcaaaagcttagaaggttgatgtttgtaattctcttctttacaggcgtgtgataaaaaacaaagaagagaatttggcttgtatttatttttagtcagggttgattatttgggtaaaatatatcaaataattgccgagataatagaatccttgtaaaagatttaggtggtgttatttgtttatgatttgaaaagagttttagttacttaaagtgtcatgtaaatctcttgttatgcaatcaagatttttttaaggtatgttaaagttttgtgttattcaattaagatttataaaaggtaatctaaaatcttcataaatttggggttattggattcatactcttataaagtcagtaaaagttttgtgttatttaattcaaacaaaagaatctctgattgttaatgatgtaaattactatgttattggttcatgactttttacattttttttttacaaagtaaagtcatgaaaagtattatcaaaatagagagattgtttgagaaactttacaagattatgaaaaactaatcagcaagattataaaaaactctttaataatagtttagaatctttcatttatttactttctaggatttgaaggtattcatcaatttttttttaaattaggaaccaataatactgcttattatcaataaaaataaataaaaagcgtttgtttgacgtgttctaagcaaaattagtgtattattaggtatttacccttagaatattatgttagttatcggtcaattaatggtattataagctggtgaatatcagagttattaatctttttttttttatctttcgtttctgcttgacgtttcctaaaaaggttgattaccaagttagtgcgatctcaaagagttttaatgtccggcttcagttttttttttttggcaaagaaattaattttattaaggccattaaggcaactcaacaaaattacgaagagcttgtttcgctaaggcatcagcctcacgattttcctctcttggaatgaaaataaaacagattttactgaaactgaagatggatgaagaatatcatgaagaatcccatggagtccggcttcaggtttctctaccccatatttcaggattaatacatatcacactctatgtaatgggttttctaagcccattccaactcccatttagtatgatattgtcctttttgggcttacatgctcaagcccgcaaagatttgttacttgattctttcccaaaaggcctcatattagttggagttggacttagcttatatattagaaactctttttctaaagaccacgaacttggacctttggtttgtacctaaagaccacgaacttggacctcctctttaacgaaactttagcacccttaactaggcacccttcttattcgtgaaattcttgagacacctttttatcgtgtcatgtttgagaggttctccccacaccaatcatagtccaagccctagatccactttttcaacctaggttctgtttaataggctttctaagcccattccaacttctatttaatatgatattgtcttctttgaccttagatattcaaacctgcaaaaatttgttattagatttcttataaaaaaatctcatattagttggaattgaacttggtttatatattaaaatctaaatttttaaaatttttgatgtgtgacatttggtctttgtcaaggatactaattgatcataagaatattttgattgacacacttatggaaactgtgtaaatgacgatagtccagaatcttcctctgtaattcctttataaaggattgtacattctcttgtgaataataagaaaacatatcttctttacatggtatcaagagcaaaaagataccctagaaacctctaaattctttttatttctcgcagccgcctctctcctctataatctcttttctttttcttctcctctgttttctatctcctgtttctttctctcacacaatg

SEQ ID NO: 12599 - DNA, 3000 bp, Unknown
  misc_feature (1)..( 3000): cDNA_ID_2712367_gDNA_ID_2214562_Annot_ID_134879 3000 nt of promoter + ATG
tgtaagtttggtgtggttaaatgtgatattgtgtgtcgctctgcaggtcatcgaattcgtaaagaagcatgttggttccggaaatccactgttagctggaaactcagtctatgtcgatttccttttcttaaaggtagctagaacttggatatatccccactctccgcatataaaagctaaacagttgcttcttgagcataatcaatctgtgtattttacagaaatacatgccagaattagctgcccttttccctcatatactcgtcgatgtcagtagcgtcaaggctttatgcgcccgatggttccccataggtaacgataaatactgtaaaactgcatgctatcaatgaggaaaatacttaataagcataatttggatttgttttgtgggggtgaatacagagagaaggaaagctcctgccaagaaaaacaatcacagagccatggatgatataagagaaagtataaaggagcttaagtactacaagaaaacaatattcaaagctaggagatgagtggagttgggtactgcaatatgcttacttactagttagaaggatccgttttagttttacgaattcggcattgttattctcttgacgattgtatcctcaaaacctaaattgtattggtctcttgataaagaaaaacctttgaagatggtaaatattgtttcgttggagatgaagataaaaactgtccattgatcgttttgggttaaattgataattttagaagttagtaaaaaataaaaaaataatttcagaaactagggactaaagtgcaaaaacgagaaaacctgaagctcgagttcatctcttccgatattgtagggatcgcttttgattagcacatttttccgatttttattaaaccctaatatattagataccttttaaagcctcaaaatactcagacgctaattctctatcaaattttgagatttttggtgagtttttcctaaacatttttttaatttctcctcttcagatttttgtaactttttcggcaattcattatcagaattttttgcatgtttaggattagacgttcgcctctgttattagttctctatcaccgatcaggtaagcttcatttttttctttgttcaatttttaatctcactccaagaaagtgagatttaagctttttaatgttgtctatattttcagggatattaatgggttgatctatacttctttaaatctgatcgatcatacaaatccaccgccgttgatcacgaggacaaagtctaggtagatttttggatatttcctagcaaaaaatcgggaggtttcgttcttgatgttttgagattgagtttggactttggtaatagagagtctatcaaactagtgaaatcagtttatcaacccataaatatcattggtcatctatcatttctaaaccgactataagtactaaaccatacatgtctagatacggatttatttcgtcgaaacctttcaagattgtttactaaacacaattttgttatcaatggtataggtgaattatttcgtaaaaccattgctagattcagattgatgttttagcacaccccaatatcctctcaactgcgcgcggagtgcttatggaatatcctgttgagtgggtttaagacgtctgtaatcatttcctatgtaagttctaactatagtaatatttacagtaaaacctaagaaattgattaatctaaaaaggtattaatttatcgataaattaataaaattgtacaacttttgtaaattcttaaaaaaattcgatataaaatgtatttttttctttataacaatagtaattaaaagtagaaagcaaatattaagtttaaaaaacaataaaactttttttacatgttgttaaatattagaattgaacactacaacaaattaataaaaattgaagaaaaaaattactacagatattttacatatgatatttataatatatattagtaaatttataaaattattaatttatactattgatgagaccatatattattgatttgtatcaattttcacattggtctaaactcgggaccggaaaaatttattaatttatagagattattaatttatcgatattaatttatagaggttttactgtattatgcattgatatatcattcttaaagatgaattgtgtaatatactaattttatctgatttaacctaattaatctggactaacatattcagcataatcaatcttgtatacatattattctagcagaattaatcttctcgatatgttgttatttttgtgagttttgagcaatctattaagaaaaagtgctgtctatatgatgctcaatcatagaggttatggtcaaaactaacatttttaacatttaagtgtagaggagaaaagtttatagttaagtctcagaaaaaatcatgtcaacttattccattgatagataccatccatcgtaccaccactgcccgcgacatgcaaaccttctccaaaagtaaagcgttaagtctcttaggagtttaaccaccttttgtgaattttggtgtactccattttgcgtcttccatagatttctttcaataagaaagattatgataaaaaaaattaggatttgctttggacttatcgcttgcaatttaacatgttcaaatacgcaaaacctatatatagttaacaaataaagccacatgagtattgattactaatttctttgtttgcttgtttgaataccaagaaaactttagtgactgtaaaacgctaaaatacacttttcttagagaaaatttcactgaaaaacaaaaagatatacatagagagatttcatgttagaataaggtttctacgagtatttcataagttatattatgtatgaattaattaactattgcacgaaaggagtttatcttcaatatttttttaattccggaattatataggttaattttgttggctagagagaaacttgtatatatatatatatatataaataattacatattattttacagatgacacaagatg

SEQ ID NO: 12600 - DNA, 3000 bp, Unknown
  misc_feature (1)..( 3000): cDNA_ID_2712363_gDNA_ID_2214562_Annot_ID_134880 3000 nt of promoter + ATG
ctttaattaccattattatagctaggaactatggttaactatttgatgattttataattgtcattagtttagttacaagtttgtaaccaaactgtttttttttttttgtttttttaattgaaaattctttgatgtaagttccaaaaatgacatgatagtgtagaagaaatagatgataagtagattgcgaactttgcttagttatcctctttcatgttttaatgactgaatattggcaatttttaactttgtaatttattttcccatggaataaccaaacaaaaattaaaccaactctacggatattataaccgtttaggatgagctcgattggtgtagaacatataagtggacttacactttttgtgagccagtcatattttgttatgtgaacttctaagtgagaaaggttcgaagcatgcgaatccattgttttgatgttagatgttttgggagatgcattcaataaagaagccttcttgataaacagagatccttgtgagttttgatgttaggctttaaacgttcaacatcattacagcacccgttttgttttgtcttttctttttacgatgaagatccttttgacacacaaaataaataaaatattgaaggaagttccaaaaatgacatggatagtcatgaaattaatagtcacaaatggtttcttcttcttattcttcgtctaatcttttaagtcttgatgaagaaacagatgatggtatattgtgaactaatatatggaataaacaaaatgttgactgtcacacatgaatttaaattgttatggatttatatctacgaaaccaaaagggtgaatatcacatatggattaagtttgtcttagatatctatacaatgaagtttaatatattttagctcttcttgtcttcgtgtgtttttcttttactttcttataaatttttttgggtacatacaacgatatatgtgttttgttgatcaataaaaagttcaccttatctcgtagagaactaatcgagtgatggacggcgtttgttatttaatttgtggttgaaatttatcatctacatgactacatcatctacaataaaatgcaaaaatggctatattcttcataaaattccaaattctagtcacaaaatatcaaaattcaaagaaacgcaaattaaatacacacaaacgaaatgttctttccaagtaaaataaagagtgatcatagttgttcgaagggtttctcgtcatcagaggggttcttgaaagcagtgcttccgaagagcatgaaacccacggcgaatccggcgatagcgacaatgaaaactccaccgttaaaggacataacggcgagcatcacgagataagcaaggcctgtcttgagtgtgtagactgcggtctgaacgagccccttggcgcggctagtggagccacgtccacgaaggatcgaagaatgggcaagccactcgacgataacagcaaggaggaagacgacgatgagacatagaacgtacatgccgagacttgtcccgggccagccggagaagagtatctccgtgttctttccccagaagaaagtcatatgcatcatgatcatgttggaattggtatgatttaccattgatgatggtgatgatggtggcatgttaccatgatccattatatgataagtttctgaaattttttgtttgggacaaaacttagagaaaatggtttcgtatttattgtgatgttcttgttatcatgtggtctcttaaatgtgtttgtggttgtactcacgttttgacttgtcaaactttgtgtagtacaagtagaagtcaatactaattttagaaagccttttaaatacctattcagttattcaacttattttcatgatataaatggtaacacaccatttgtagaattgtggtggaagaaaaacgatttacatcatttgaacataatttgagaaagtgatgaaatttatattcgtagtggaatttaacaagttattcttctaaacgatatttacttataaatcaatgacaacaacattgtgttaagcttatgagtttcaagttcagttcaatcaacaaaatgcaactctccccaattcatcacttgcaaaactctaaacatagaccaaagaaattaggcaaacccaaacctacgaagacttatcaaaatataaaaatgtaaatttggctcaaaaccttggacaagaaacatatcaatctaggtctaaaattcactggttcgtcacaacccattctagaaaattcgaaaacaaggacaaaacgaaccaatacagacatatagtggatacaaccatagaaatgttatcaagatcaaacaaatatacaagatatataaaaaagttttctaatatacgatatcaaatcagttgtaatctcaagtgttagtcgcaaatgtggtcacagttatgggattgtaaggtagcaaatcagttgtaatctcaagtgttagtcggaaatgtggtcacaattatgagattactttgcgaattgcgacattagtcaatttctatacaaaattaaatctatctaattattttttgaccaatatggtatatgttctttttactgactaaaatagttataattatattttttaagtaaaacatgttaattaagtttatttcgccgttttttttttttatttgtttggctttgtttttgggtcaaagagaccgattttttctcttttaggttaccttcctccgattagtcttactgaaagaaaaaaatgaacaaactctccaacgctttctctgtcctggctttcgccgatgaagatgctccaatggcttcttcttcttccactggtatcccctgtttccctcttccgatttgattacaacacaaaaccatgtttagatttttgagactgaatttgataatatattgactaaattaatcagtgatttagaggtcaagagtcaattaaagtattgacctttaaactttagtttttttactcatggcactgtctcttgtggctacaagatttgttggtttgagaatg

SEQ ID NO: 12601 - DNA, 3000 bp, Unknown
  misc_feature (1)..( 3000): cDNA_ID_2709235_gDNA_ID_2214562_Annot_ID_134881 3000 nt of promoter + ATG
tctggttcaagacaaatcttaaactctgcaacatctggtttgacattggtgaatacagacggatgactaaggtataatgttgtttaatcaaatcttttgactgacgctgattatgtttagtgatcctagtatggacaataacatctattattgcttgccagattctgaaggaactccataagtcttgtcaaaaggaagatggaactgatgatcagaagaaaggaagtcagctgcttgaggtttatgcaattgaaattcagatttacactgaaacgaaggacaacaaaaagcttaaggtaaatgtcataagctacatggtttcttacaattttgagattctgcaattttattgctgcatactttcttctggcttttgtgactgagactcaacaacactcttgaatggatgcagcaactataccataaggcacttgccatcaagtctgccatacctcatcctaggatcatgggtataatccgcgagtgtggtggaaaaatgcacatggcagaacgtcagtgggaagaagcagcgacagacttctttgaggcttttaaaaattacgatgaagctggcaaccaaagacgtatacagtgcctgaagtatgtttcctatgatcttctcatctctttatcctttcttatttgataccctctggtcacttgattattaacatggtataaaagtaaatataaaagatgtaatggatgattaaagcaaagcatattatttagatttgacttgggacatggttttaggtgcatatgagcattattcgattactcttgtccagtaactttctgtgatcggtccaaacatgttagagttaatgatctttgttttttttttcttttggctatgcaaaggtatcttgttctggcgaatatgctgatggagtcagaagtgaatccgtttgatggccaagaggcaaagccgtaagtcatttccgtatatattttttgttgaacactcgttttggttcgttgcttcatagttggctctctgcaggtacaaaaacgaccctgagattttggcaatgacaaatttgatcgcagcatatcaacgaaatgagatcatagagtttgagagaatactaaaggtaaaaagtgaagtattattgggttgttttttcaactcattatatatgaaaacgacactcatggaatggtttttggaatgtagagtaaccggaggacgataatggatgatccattcatcagaaactacatggaagatctgctgaagaaagtgagaacacaagtgttactgaagctgattaagccatacacaaagatagggattccgttcatatcaaaggaactgaacgtgccagagacggatgtgacggagttactagtgtcgctgatactcgacagcagaatcgatggtcacattgatgaaatgaaccgttacttactgagaggcgacagtggcaatggaaggaagttgcataaggcggttgataaatggaactcacagctcaagtctctttcttcaaatatcaccagccgagtctgttaacttggaaacctctcttttggatagattttgtgatttggcgttgattctttgtggattatctgtttctcttcacatagctggatttgatggagtttataaaccacttcaatgccaagaaaaaggatttgaaacttttcttcattctcatttttaaaattgatttcttaactttgcagcaactagatagtaattgcaagcgatgggtgatatgcaccggaactcttacaaataacgtggatgtctttttcgagtaaggttacgactatgaatattaaaagtgaaacaaatctgaacaagaaaattaggttcgaataatttaattagcttttaatttgtcaatctttctggatctttgcttgttgttacacactggccagtgggccagttgccactgattaaattttataataaccattcaactcaaagtaaactctgcactataactctcatatatcaaatgtcagtcaagttgagactgttaaagcgaagctgcataaaatgtgtttgtccatataaaaattgaacattattatatataaaaatacaaacttatctggtggtataccatctagattagatcctagtattgtccttttttttttacaacagattagtatcttttacatgttcaatcttttgtggaagacaaaattacttaaatcgaaaaatcttgttagttattgtcactatcagtaagtcaataaacaaacattcatcacaaaaacaaaaaaacaaaatcttcactagtcacaacaaaattcgccccaattctttgatccattaaaaaaaactaatattatcatttttaatcattattatttcagaattgtttggcaaaaataattcaacattaaaaaaagaaatttaatatcaaaataaaataaaagaaaagaaaagagaaaacagatccgaattgagttcatcatcttaaaactttgaaatcggttactgtgcctttttttttttttttttttttagtggttacaagttacaaaactcaaaaaaagaccaaagacagcaattaatttttgtttctttctgttctaaggatctttgtctgctactgaaactccttaaagcaaaactgtaacttctcaccaaaaacgaatttttccaacaaaaatttaataatcaaaataaatcttcttcttcttcttcatcgtttatcacgacctctgtctcttcgtctctctcaaaagccattttaaatctctctctttctcactcaatctctctgtagctatcagatcttctcttatgttgatccccaacaaaaaattaaggttcttttttgctttttaaataagtaatatatatatatatatatatatatatatatatatatatataagattgagatattctctgtcttgcttcttctttacccttttcttgtttccaatcaaatcctctaaagtttcgttctttgttctaagttttctgaaggagtgatatttgtttgtggtgtggttagagaaatg

SEQ ID NO: 12602 - DNA, 3000 bp, Unknown
  misc_feature (1)..( 3000): cDNA_ID_1015820_gDNA_ID_2214562_Annot_ID_134882 3000 nt of promoter + ATG
ttgttataccacgttcttccaaaaaaacaatttatttaggtaaataattaatcaagcattttcatattatattcatgggtgttctaatttatatataaaagattattcaaggattcttgatatttaaattcatctgattttcttcactttgagcaacaaacaatgggagagataatgaacgttgactttgtaaactgtttgatcttaatcctcctctgcctcctttcaatcctctgttactctttcttcttcaagaaaccaaaggatggtttcaatttgccaccgagccctccctctctaccgatcattggccatcttcatcatctcctctctctttttatgcacagatctttgcaaaaactctcctccaagtatggacctctcctctatcttcacgtcttcaatgttcccatactccttgtctcctctccctcaatagcctatgagatctttagggcacaagacgtaaacgtttccactcgcgacttccctacgaatgaggggtctctcttcctcggatcatttagcttcattaccgcaccttacggagaatactggaagttcatgaagaagctcatcgtcacaaagctcctcgggcctcaagcactcgagaggtcacaacgcatccgtgcaaatgaagtagagaggttttactcaaacctattagataaggcgatgaagaaagaaagtgttgagattgctgatgaagctatgaagctagtcaacaacataatctgcaagatgattatggggaggacctgttcagaagaaaatggtgaagcagagagaattagaggcttggtgaccaagtcagatgccttgttgaagaagtttttgctggcggccatcttgcggaaaccacttaagaagattgggatcacactgtttaaaaaggtgttcatggatatttctctcaagtttgacgaggtgttagagaagattcttgtggaaaacgaagagagacttgaggagaatcaacaaggtactgacataatggataagctcttagaagtttatggagacaaaacttccgagtataagatcactagagaccatatcaagtccttgtttgtggtaaatattcatctcttataacaaatttagcgaacaccaatggtttttcttgactaagaaacgtttgatactacaggatcttttctttgcaggtactgacaccgcaacacacactatagagtggaccatggccgagatcatgaacaactctttgattcttgagagattgagagaagaaattgattctgttgtagggaaaacaaggttgattcaagaaactgatctaccgaatctcctttacttgcaagcaactgtcaaagaagggctaagattgcaccctacgatccctcttgtgttgaggacgtttcaagacgggtgtacgatcggaggcttttctatacctaagaagacaaaacttgttgttaatggttatgctataatgagagatcctgataactgggaagatccactggagtttaaaccagagaggtttctagcttcttcaagatcaagccaaaaagacgcaataaaagaagaagttctaaaatatctttcattcggaagcggaaggagaggatgtcctggagtgaatctagcttatgtgtctgtagaaaccgctattggagtgatggtgcaatgctttgattggaagatcgacggacataagatcaacatgaatgaggttgctggtaaaggaacgttgagcatggctcatcctcttaagtgcactcttgttcctcgaagtgtaaccccattaacttcaaagtaggcaatctacttcttgactttgtgttgttttttcttaatctcatcgtttcacatcttcaccagtttattggttacctttggtttaggtcaatttggccttatgtccactttaatattgtatgaaacttaaaccttttgtatggttcataattttattttcttaagaataacgaaaatgaaaaatgcttgctttacttttaagatttaaaagcagagcacacacgctcctagccaaacaacaccaaacatgcattaccccccatcaatctcaacgcttttcctcctcaatccgggaatgcaaccacgctggttctctacgagcggctaaagtggtttataaattataattgtgtcttcgccacaaactttagattgcagcttcttctattcttttacagttttttttttcttgcatcatttttacagaatttatgtgagcaattcattttcaaatttcttatctttcttttaataaaattattaagagaaaaaacttataaaatgtttattaggttttcattattttatatcatataaggctattaaaattttaaatcctcctttttaagacaaatttctgattttgttctcaattttgaaaaggtctatctctaacttaatttccattttatttattatctataccatataaatttcttcaaatctcaatcaattaaaaatttctattttgcttaaaaattaaatgattgcaaatttataactaataatttctttttttaccatatccatgatataatttattttaaagttaaaaaaatattttgattcatattatatgtgtatatatatatatatatactgtatatgtatatatacatatatatctgatcggactattattatctcttacctactcggcccaatagtaatatttcacaaatccagcaacaaatcttacttcttccaccttcttcttctcttcttcttctcttcttcttctacttccgcaaaaaccctttgagaaagagaagcaaaattctctaatcgttctttctctgccctaatccacgtatcgtttggtgttcttcttcatcgaatcgacatggcttcaggtcttgttcttgttttgctatgtctaatcttctactctgaaacaatctagggttcgaaagttcccgaattcgactacttactttgttacgaatcgatagtgttttattgatttgggttttcgatttttgtgtagatgctgacatg

SEQ ID NO: 12603 - DNA, 3000 bp, Unknown
  misc_feature (1)..( 3000): cDNA_ID_2709251_gDNA_ID_2214562_Annot_ID_134883 3000 nt of promoter + ATG
gagactcatgagtgagtgtttgaatagtaaaaaacttcttagctggatctgaatatgatttggatttaatactactgaaaagaaaagattccatctatctactatcccacttcttccggaaagataaacaattgtgtttacgtaagaaatgaagcatgtcatcatattatattcaattattcatgggctcttgctatatacatctgttttttcactttgagcaacaatggaagcaataatgaacgttgactttcaaaactgtttgatcttaatcctcctctgcctcctttccttcctctgttactctttcttcttcaagaaaccaaaggatggtttcaatttgccaccgagccctccctctctaccgatcattggccatcttcatcatctcctctctctttttatgcacagatctttgcaaaaactctcctccaagtatggacctctcctctatcttcacgtcttcaatgttcccatactccttgtctcgtctccctcaatagcctatgagatctttaggacacaagacgtaaacgtttcctcgcgcgactttcctacgaacgaagggtctctcctcttcggatcctttggcttcggcaccgcaccgtacggagaatactggaagttcatgaagaagctcattgtcaccaagttcctcgggcctcaagcactcgagaggtcacaaaaagtccgtgcagaggagttattacttaaacctattagataaggcggtgaagaaggagagcgttgagattgctgaggaagctatgaagctggtcaacaataccgtttgccagatgattatggggaggagttgttcagaggaaaacggtgaagcagagagagtcagaggcttggtgaccaagacagatgccttgacgaagaagtttatcttggcaggcatcttgcggaaaccgcttcagaagattgggatctcactgttcaaaaaggagttaatggatgcttcctgcaagttcaacgaggtgttggagaagattcttgtagaatataaagagaaagttgaagagcatcatcaaggtactgacatgatggataagctcttagaagtttatggagacgaaaaagcagagtataagatcactagagaccatatcaagtccttgtttgtggtaaatattcatctcttatgagaaatttagcgaacaccattagtttgtcttgactaagaaacgtttgatactgcaggatcttttctttgcaggcactgacacctggacgcacgctatacaatggattatggccgagatcattaacaactcgtacattcttgagagattgagagaagaaattgattctgttgtaggaaaaacaaggttgattcaagaaactgatctaccgaacctcccgtgcttgcaagcaaccgtcaaagaagggctaaggttgcaccctccggttcctcttgtgttaagaacgtttaaagaagggtgtacgattggaggcttttatgttccggagaagacaacacttgttgttaatgggtatgctatgatgagagatcctgaatactgggaagatcctcaagaatttaagccagagagatttctagcttcttcaagatcaagccaaaatgatgagataagagacgaactcctaaaataccttcctttcgggaatggaagaagagcctgtccaggagctaacctagcttatatctctgtaggaaccgcgattggagtgatggttcagtgctttgactgggagatcaaaggagataagatcaacatggatgaggctcctggaaaaataacgttgaccatggctcatcctcttaactgcactcttgttcctcgaaccctaatccctgttacttcaactgtacagattcctagttcttgacattctgcctttgtttttaatctcctggttaattggctacctttgatttagttcggtttgctttatctctggtttgttgaataaaacttgaaacatttcgtatggttcataatttccttctttcaagtacatttagtattgttttactagtgatcgtcgtccatttcgtattgctcaattcaacttgtttgaagcaaattctaattagcttcacatttaacttagaggatcaaataagttaacatggttgatggaattgatcatttggatttaatgaatgaaggcgctttccaaatacaatcattgtgttgtatatcctctataactttcagtggtaaaagagtgagtcgagtctattctagagtgaagtttcttccaagcagactactcacattcacaagtaaagacaagacttctgctgaatgttttttcatatttaatctttaaacttttccacaaaaagatatcgttcattttgaaagtaggaatatgagatagaagaagcaacgaaaacaattagaaaattaatcataattcacaatttagagacttacgttattttttggtctatgtctagtttttaaaaagacgtagttttcagaaaataagaaatactttttaaaggttaaaacaaaataccaaactcgaagattctacccattcaaccgatttttactaaaatggaatacctgaaccgacatagcctcgcagagttaaattttccagccatttattatggttattctggttaacatgcaatggtcaaagatgagatcttctatggtctttatagtctttatgttagttgggtaattgaatatccaaatcatatcaaatactaattgacgtatttaagggtcacacggttttcaaagttactaaattaatgatttatcatgagtgtatatactatatagtaaaaaacttatgtattgattactatctatattattcaaaaggaaagattccatctgtctgttgttataccacgttcttccaaaaaaacaatttatttaggtaaataattaatcaagcattttcatattatattcatgggtgttctaatttatatataaaagattattcaaggattcttgatatttaaattcatctgattttcttcactttgagcaacaaacaatg

SEQ ID NO: 12604 - DNA, 3000 bp, Unknown
  misc_feature (1)..( 3000): cDNA_ID_3025851_gDNA_ID_2214562_Annot_ID_134884 3000 nt of promoter + ATG
gcattggaactgggtacgatctctccgtcaccactttctctcccgatggccgtgttttccagatcgagtacgccgctaaagctgtcgacaacagtgggttagttggctttatcttcttcgatcttcgccctttagtagatcggatttagcttctgaaaactttgagattttggttatcgacacgaattagggtttgttaaaagtctttccctttttttttcttcgcaggactgttgttggaatcaagtgcaaagatgggattgttatggtttgattcttcctccttcctctattgatttttatactactttgtcactttcttcagtgggtttagtctctcgtgctgtgatttaaccttggaatgaagtattcacatttttgttatcagaattgtagatttgatgtaatatataccgtgtaaattttgacccaagatgacacattttacagtcccttagtttcatttcctgttcgatatgttgtgaatctgttgttagttttgggttttgtaagattttacgcagatttttgataaaggaatggtcttgctaagtgtttatcatttggtggtttttagggagttgagaaacttattgcatcaaagatgatgctaccaggttccaacaggagaatccattctgttcatcgtcatgctggcatggtatgtttttttctcctaaactataggaaattagtttctgctgaggatatgtatctttcaagttttttgtaactactattgtgtctagtctcgtagtatattgttttgtttcatgattatgggtatttctacttctgtcatgtcaggctgttgctgggcttgcagctgatgggaggcaaattgttgcgcgtgctaagtctgaagcacgaagctatgagaggtatcaatgaaaacatcagtagcttatatctaagatttattattatgaaagaactgttcaactcctaaagcttttctcaaggggatgtttctcttagttaaacgttcaaaatattttttatctgcattttgttagattaaaaatctaaatatatgggtataagatgtcaatgtgtatgttctcctttcttcctacatggctttgcataactttttccgactgtgtaaccaactctaccttcacttgtgataatttagtgtttatggcgatgctgtacctgtgaaggaactttctgagcgtgttgcaagttatgtacatctgtgtaccctgtattggtggctcaggtttgtccaattcatctacgtctttggtagtcacctacgcatttctcctacttgaatgaattataagaaaatggtttttattttgtaggccttttggctgtggggttattcttggaggttatgatagagatggacctcaattgtacatgattgaaccatcaggcatatcatatgtaagttatttctgcccgtagatatgtgtctttaagtatgaaattttacgttatttttccctgtcatcatatgaattctattcctgcagagatactttggtgcggccattggcaaaggaaagcaagctgccaaaacgtaagctacatcgtgaatgtatttggtatcatactagtattttctaggattctcttatagtggatatgcgtagtcactaagggtatatactatgtagtaccactaggattgatcaatttaacttgtccgaaggaaattctaactaacttaacagttaaatcaaagaaatcatttaaacttgaaggatcaagtgagctttcatggttgataggattgatgattctccataaatgttattaagaactttatgacagatgtttctggattgcataccttttggccgcctttgacatgtgtggaactagtttcaactaaacggttatagatttagttatcaaaaaggcaagggtatgcaagtgttctgatggatcagaggatttcttgcagggaaattgagaaattaaatttatctgagatgacatgcaaagaaggcgttatcgaggtggcgaaaatgtgagtagtgcttgcttctcatgtacatgttttctggttctcatgtgctttctataaccaggttcattttatagcaagatgtgatgttactttttcatgtgcagcatctacaagctacacgatgaagccaaggacaaggcttttgaattggagatgagctggatatgcgaggagtcaaaacgagagcatcagaaggtaaaattttataagtgcttgcttatgaaggatgatttaaggagatattcataaaccatatataaattggactcgtcgtataggtccctgatgatcttctggaagaagcaaagacggcagctaaaactgcgctcgaggagatggatgctgactaaaactgaggagtgtgttgaatttagatccgtcttattgcgtcgtttgatgtttcttatgtactctgaattgaattttgtctggagggacagttgttgcagtttcgcatgaaccattggagtcttttatcttattgctatcaacagttgctacgatgactccttcactagaattaacatccattaaaagtgaccacatgaataactatacaaacaacatttaaaaatttactcacttctcgaatactcttgacctacctaatctataatcattatatgtcaatttcatagtagaaagtcatgattcgttttactgtgtgaaacagatatatactagcagtagcaaaaactaaactaaaccgagaatctgtatttataatgcaaaatcatttgcaaattcagatagatatcaatttcatagtagagagactcatgagtgagtgtttgaatagtaaaaaacttcttagctggatctgaatatgatttggatttaatactactgaaaagaaaagattccatctatctactatcccacttcttccggaaagataaacaattgtgtttacgtaagaaatgaagcatgtcatcatattatattcaattattcatgggctcttgctatatacatctgttttttcactttgagcaacaatggaagcaataatg

SEQ ID NO: 12605 - DNA, 3000 bp, Unknown
  misc_feature (1)..( 3000): cDNA_ID_2709247_gDNA_ID_2214562_Annot_ID_134885 3000 nt of promoter + ATG
atctgccttttaatttaaacaattacgttctacctcacgaataactactgtatgcatacaccactttttatatgtttttgttaaaatgtagaatatattgaatcaagaaaaacacgaatgttatttacaaagctgaaagttgaagtggggaaaaagagaactgaagcttgaaaacttttgaaagaaaaaatgaaatggaagttatgtttttctttaaccctttttcgtatttcctaaattttatctcttgttttaatcgttacaaatgataatacttttttctaacagtttacttattttcttatatgaaccgtaaaataagaaaaacatattttaatttgactcaaattatatggattattgccaacattcctctaaaaaataggggaatttccaaattgaccaacaatttaaaaataaataaaaaattctaagcttttaaaactaccgatataatgttttcagacatttttcctacaaattttaatcacacaaataaccctttttttttttaacaaacattgcaaactataaaatacaataaaataaaaaagtactaataccaagagatagctttttcaacgaccattacaatggtacttcacataatataaaataaactaaaaacttccaaacaaataatttaacccaaagtcacaaaatagttcataacatgaaatttgggacgaatgcataataatgaacagtcaaacatagaataaagcaataatcagagttgttcaattcaaaaaaagaaagaaagaaaaagagagaaaagatatgagaatagtttcctcactttgccatcataactttgacaaactcttcataattgatctgaccatctccatcaacatcagcttctttgatcatctcatcaacttcttcatcagttaacttctcaccaagatttgtcattacatgtcttaactcagctgccgagatgaaaccgttctggtccttatcgaaaaccctgaaagcttctttgagctcttcttcagagtcagtgtccttcatcttcctagccattaggttcagaaactcagggaagtctatggttccgttaccatcagcatctacttcgtttatcatatcttgtaactctgcttctgttggattttgacctaatgatctcatcactgttcctagctctttcgttgtgatgcaacctaaacacaaaaccacacatttctctcaaatcagtaacagattttaacaccaaatcttcaaattttcattgtaatttactctaataacacacaaaatcttcaaatttcattttagttactctaacaactgtatcaaatgaacacaaaatcttcaaatttcattgtaacctactcaaataactgaatcaattaaacaaaaaatctacaaatgtcaatgtaatctacttcgattattgaattctaagatttgtgtcaattctaatcacaattagtaaaatctggaagactaaaacacgattaagttagagattattatcgagatagatccgattgcgattataatttataatcaacgaacgataaagatatcatcaaatctcgcgtttaatgttaatgtgaatatccagagattttatggacaacgaagagcatcaaattcctaaagccaagactaagtgatactcaaaacaccaaaaaaaacgcaagtgagtctattatgaatgaaaattatacaaaagaggaaagatctgagagagaagaaccatctccgtctttgtcgaaaaggctaaaagcttccttgaactcagagatctgatcatcggtgagctgatctgccattttttggtttagatgagaaagagagaagaagaagaagaagaagaatcaacgttggtgtgtgtaatgagaggattgttgtgtggaattataaagaaggaaaaagaaaaggcccattaggcccaataacaataatttcgaatctgattctcttttttattcttcttttgttttgttctccactgggccttattgtgttttcaattcgactagctttacttaagagggaggtgatgtatatattcccttgtgaaaagaaatagtattgttgttttgccgacaaccatttacatgctttgaatggtttagttcatataagttactgatcttaccatgcgtaccaatactaagtattcaacgagttggtagaatgggattactagtgatataaaacggtaaaaaaggtttagctttgtgtttaccatggattttaaactactttttaattaagttaaccaaagaaaaagttttagcattataagaaaatttagaaatagtagtactttttatttactgtttttgtaattaataatcatctaggagttaggacaaaaatcactactttgttgttggaagggtcacctaatgggtagttaagcatcatgaccttcacttaaagatttgatattaaacaagatccagttttcgcaaaactgtcatacttttttgatcgccacaactatgtctctcagtttggctagagatgtagtaaaaaacaaacttattgtatccatcacaattataggtaatttactgtcttggttttaaaaacatgtaatgttgagcatcccaaagtttgtgtgtcccaatgctagagcatattatagtcttacctctagtgagttcataaagaagtgttgtatgatcatatattttgttgagtaagagaaatatttctttcttcctcatgtggttgattattcaaaattatacaaaagaggaaaatcacttaaaaatattcacgataccgttaaaagattaccaaagaatgggccaaatcataatattaataaagcccgttaataaccgaatcgacccacccgacaaaacaacccgaatcgttttaatatccaacccggagtcagacggagctccaaagatttggcttgtctctggcttgagaacaaagaaaacccctttcttcgatctcagcttaaatcactcgacgaagaagaaatcagaaaagagtcagagaaaaaaaaaatcaaggaagatg

SEQ ID NO: 12606 - DNA, 3000 bp, Unknown
  misc_feature (1)..( 3000): cDNA_ID_2712355_gDNA_ID_2214562_Annot_ID_134887 3000 nt of promoter + ATG
aatacaagatcgtaacataaacgtgaacaagctctactaactacgaataatgataatgggctccatatttaagttatataggcaaatgtttttgacttttgtaacaaaatcaaatttatcttcacttttcctaaccttcctttcgccaacctcctcacctgagacatgaagaagaaactctcatggatcttagagtaaatacataaatttcacagctcgtctcatcttgtacattgatttatacattgtctcatataccatcccttacacagtattaaacaccacttgtacagagttaaacacaccatcttgtatactatcttttacataatctcacattatcttgtacacggccttgtacatcatcttatacacctctgtttataccatctcatacatcccttcacgcacacagcctagtatattattttgtactgaaccatatgaattatcccatacaccgtcttatacactacctcgtatacatttttgtaaattgtccgatactctcatgtgatgtaattttaaccataaatacacattacgcatatgcgtggtatgtcattggagtaactaaagattgaatcaaatccacgggaaaatgccataacagtataacacattaaattatgatgaaatcatttgccataagacggtatgagaatctacggtctcactaataccctaacatgcatagaataaaagaagggataaatgaaagcaattaaactatatatagtagataattgaaaactaaactaacaaaattaagaactaaaatgagcaaataaacaagatagataaattgaacaatcaagatgttagaaatcatgcaatcgatctacatattttcaagataatgaacctctaacaattaggctaattcatgattagtgtggtaaaagcctctaacgtaacttagccaaattcaaaatcaatttggtaaactatcacaatggttaagaaacaatgcacacaaattcctttaagttacaaagcatccgatcctaaatatcacttgctagatggttaggccagaaatcgttttctttcaattttctttgggtctgaacgtagacacaactcaaacacctctcttgatcttgtatgctttaaaatgtggtctcttcaagtcgggtatcttgtttgttttggttccgagtgcatctgtctttagccacctagctagctagaaggtaattgtagatatccattttcaccaactagctagtttttgtcctccagctggcttggctaactacgtacgttccaaatgtcaaacacttaaaaactatatgtcaacactaactaactaaatttattatatcctatatctcaagtgtacacaatgtataatattaataacataattcaagcacctcctgatcttatatacttcaaaaatgtgatgtctctctaagtggagtatcattttaattttggttccaattgcatctgtaattaaccatatatagctaacttgccgatgtgtgtaatataactaaactatagagaatatttgtagataccctcattctccagctggctagctatgtaagttccaaatgtcacacacttgactatttgtctttctccacttataaccttaatcacagatcaagaatcatctccaattatagttttctttattgaatccacctaatctctattcaccaatttataatttttataattgcggcttagatacctttttagtcaataatcaaaaatggattccagtgaggatcaaccataaacgagatcattgaagcacataaactaattgacaataagttacatagtttaggagacataaaactgtttaaattttatattgtgcttaataataatttataattattgtaacacagttgttaaatccatagttatgtagcatgtacgtgtcaattaatgcgcacattcaatattagaacacagaaggtttgtctaccaccactaccaattgaaattaaaaaatttaaaataatctagcgggacacaaagcgaagtcaataacataagtcaaccattttaacggtcaagattgtaagagtagctctactatgatggagccgtgacgtagaggaacataactgaaagcgaagaatcctcgatttatgctactgtcactgaaccattttcctctcaggtcggagctaaattttgagagtaaaataaaaaagcaaaagagagaaattgaaaaaaaaagaaagaaaaataatcctctcttgtttcggctagggtttcgtttttgtttcatcgataaactcaaaggtgatgattttagggtcttgtgagtgtgcttttttgtttgattctactgtagggtttatgttctttagctcataggttttgtgtatttcttagaaatgtggcttctttaatctctgggtttgtgactttttgtgtggtttctgtgtttttcatatcaaaaacctattttttccgagtttttttttacaaattcttactctcaagcttgaatacttcacatgcagtgttcttttgtagattttagagttaatgtgttaaaaagtttggatttttcttgcttatagagcttcttcactttgattttgtgggtttttttgttttaaaggtgagatttttgatgaggtttttgcttcaaagatgtcacctttctgggtttgtcttttgaataaagctatgaactgtcacatggctgacgcaattttgttactatgtcatgaaagctgacgtttttccgtgttatacatgtttgcttacacttgcatgcgtcaaaaaaattggggctttttagttttagtcaaagattttacttctcttttgggatttatgaaggaaagttgcaaactttctcaaattttaccatttttgctttgatgtttgtttagattgcgacagaacaaactcatatatgttgaaatttttgcttggttttgtataggattgtgtcttttgcttataaatgttgaaatctgaactttttttttgtttggtttctttgagcaggagatg

SEQ ID NO: 12607 - DNA, 3000 bp, Unknown
  misc_feature (1)..( 3000): cDNA_ID_3025817_gDNA_ID_2214562_Annot_ID_185906 3000 nt of promoter + ATG
taagtctgtgaaaggtttcctctgggtaccatattctcaggagcagtatcatctcggtgaagtgacactggtgccatacgcggcagattcagatcagaaacagattgagctctggccccaccatcgttaaggttaaatctgcgtatcatttcatcctggcgcggccacagcaaaggggttgtgtcagcagctgatagagaggtcttgtcaccactaccaattccaccaccatgtgagctaggaggcgcagctctacctatccttttcctgacaactgaaaccttctttccaccttctctgagttgccctaaagcaatattataagcttcagctgtaattgccccttcctcagcatacttgatggcttcgcgacataaatgattatagcggtgtatcgagctatcatgcccattttcactgacatgctcatctaactctaccatgctcttggcatttcttgtccaccgtctcaaaatataatgtggtggcaaagtgagtatattagtgacagtaaacaccgtcaaaacatgtcggcagagtatgccggagtgctcaaacatttgacagctgcagtttgctctcatttcagggtagcaaaacgttactatataagctttgttgtcattttcaaaatttgcaaccctaaatgtgctggtagtaccatcatcttcaattctgtttgccgtgtgagcgaatgtctctaccaactcttcctggaactttccaaatattttccttgtaaagagatttgcagcctgattctccatgggtgatggcgtcttcaagactggaggtgtgttgacagtgtcaagatctgcttcaatctccatctcgaaccagctctccatagccctttcgtacagcctaaagaacatcggaagggttgtctgctgattcacatatccatcgaaaaaggaacccgaataaccttggctaggaaacactgcagcaaaaaacgaatcccggaaataaacaggtacccactgagctcgagcattatataaagaattaagccattcatgtcttcctaagtcatatttgtcaatgacagaactccaggacgattcaaactcctcaatcgtttcagtaaagttgatacaattatatagctccacctgaaaactaggatacgcaagacacacatgagccagcttttcctgaccttctcttagcacatcccacttattaatacagtgacgagcacctggaaatacctgaccagcagcaatctgtatggctctatcttgatcagtcaccaaagaaaccggcggttgatctctcattgctgttagaaaagtcttgaacagccagataaatgaagtgtctgactcgtccaaaataagtgcacagccaaataagatagcctgaccatgatgattcacaccagtaaatggcgcaaaaggaacacgaaactgattgcacctgtacctcgtatctaaggtaaccgtgtcaccaaaatgagtataagcaaccctagatctcgaatcagcccaaaacacatttgacatctgattatcttcatcaagctgaaccgcatagaaaaagccaggattctctgcctgcatcctcttaaaatactccaacagattatgtgcatcccgtccaatcgttctcttcgtgtttgtagccatagacgcatttctagctcctctgctattagcatccatagaaacatacatcataccactaggcacattaaccccttcttgataactagatttctccgagttagcaaaatgcctacgaggacgaagacaatgaagcatattagaacttgctaatccatgagtatgctctttaacaaactttgtaacaacccatttctcatgaccttgcaactctatcctaaccattgcatcacaactctcagaaagccttctctttgaccttttactactactactacacacaaattctcgaacactaacagacccatcagttctaggaagaagcttagaagtaaaaccaagctgcctcgagtactcatcatagaaagatttagcttctttttctgaattaaactccataccaacacatggctctgcaattccaatctcatcttgcacccctaacgagttatccatgttgttctgtccactgcaatcactaggttcaacatctccttcatctcctatctcatgattccccattgacacattctcttccaccaaatgaacatccataaccttcacttagtagagaagttctaatttcacacaaatgtttctcatcttcatagtctacaaaaaagtactattagtgtttggagatcttcttccgaacatataaatatgaggactttttgcatctctcactctccgattgtttgttgagagagagagaaacccagaaagaggagaaagcaaaagagagaaagaggagcttacgtcagtcagtgatgcgaagaactcagaactcagaagaatcgaaagtcgtgaaattagggagaagggcaacaacaattggggaaaattgagaagaagctatggcagctatttcgttttcagattcgaccggaggaaattaaactcctgcttcttctcagtcgttcgcgaggaagaagagattcaagcacgaaaccgacgtcgtttcgtgcttttgttggtttttttttttcaatttaaatagcgagacctcgttttaatctaaacccaacaacagaaagccctcataaaaagtgaggcctcatttgaaccgaacccaacaaccaggaaagcccttgatacaagagacaacgcgcgcgaaagcatttcatcttcttcatctgtcttttttagttgagccctaattcattttcggatgacaacttcatttccttgtattgtcgtcataagaatctcaggttctagatgattctctcttctcttatttgatctggttccatctcttcaccgtaccagtgtcaatcacgaatccctttgttttgaaccctaatttatttaatacgcaacacaagcaatcaatacaagagtctcttagcatcatcggcgtgggccaaat

SEQ ID NO: 12608 - DNA, 3000 bp, Unknown
  misc_feature (1)..( 3000): cDNA_ID_2709225_gDNA_ID_2214562_Annot_ID_185903 3000 nt of promoter + ATG
aaaaacatcttagacagagatgtctcaccctgatagcgacccataaagcgaccatgaggcctttcatcaccataaccaggcctcccacccatttcacggtcatatcctccaccatggtcatacccaaatctaacatgcaaagtaaaaattgagtacagattaggaaatctcgaaaacgatggaatataacaaccatcgatacaagaggataatcaacagttatcagctaagcaacaatgcaaacacagttcccatatgactttgaattataattcaatcggtaacaaattaactctgatgtaattccaattgaagtgtaagcataagaaatgaagattaccttctatcgggtggtccatagccaccacgaggactaccacggcgaccatcatagccattatcatccctccgataacgcttttgaggaggcgagcgacgctgaggaggagagtgtcgcctatctctatacggtggcggaggactcaagctaggacgtctcttgtaatccctacgaggcggtgggagaggcgaacggtcacgttcacggcgattaggcggaggacgttcgatgtctctctcgtcacgacgctctcgtgaatctctctcacggcgtagcggaagctgctgctggtcttgttcctgttcctgctgcggcagagaagaagaaggcggtggaggaggtggtgaggaagaggttgatttctcagggagacggttatcgacggaatcagacggaggaagattaacatcggccatttcgttcggaaccctaaatcggagaatgtacgatttcactcgaagcctctgtgtctctccctctacctttacgggttttgctgctgttactgttacagtgagctttatttccaatagggccttactctcagagacccatcttcgtcttcataaataggccttactctcagaggcccatcttcgtctttatgaaaatacagtatttggatttctatgttaattatttgtccacacctttgactattcctccatttcatcgaagcaaaactattttaatatttcagtcagattctttcccatcatttccagaaaaattcttcaaacaattctgtaaattaagccaataataagtcttagtatctctgtcaatttgataagattagtttctattttttatgggatcactatggattattttttcataatctgtctatggatttgattattagtaaaatactaaaatgtgagttgacatgtaacaaaattgttttgtaaagcaattgactaagaccatagattaaggatgtttatcataaactaatgaatccttaaaaaaataaaaagacaaacaaaaaaaaggtgtaagaaaagtaaccggagtagaaataacaacggcaagagaaagttaccgtttttggagtcatccgtcaaaatcgtctttacaagcaagcaaatgctttattgcatgttggtagtcacacacatacacacacaatctcctttttctcctctcgcataagattcctcttctctctctctctcttctctctacccatctgattcgctgctgactcacacacgacacagaccacctctctccttcttcttcgtctcctgtagaagaagacgttttgttttcttttgggtttgatcctctcgcgtaactccaaagctctcaaaggacatctctttaggtatcaccgtttctccatcttactgttgtttcttctacttgtgtgaaaaatctcaccttttctaggttttcttctactctaatggtccaatttcatttgggtttctttacctttctataaaaatctctcttttttgtcaaattcgtgcacttttcaggttttgattttcgattactctaagaaaacttcttaatttgttcaatcagttttgtgttttgtctgcggtatgactttggttatgctctccttatattctctctcgccctattttgggattccgattacgaaaaagttgccttcttatgtgattctgattgtttgtcatctatccgatggttctgtgaaagttttactctttccataaggattttgcttgaggaactttaaacggcggaacaggttactaagttaagagaataggttagattgtgttaggatttcaaagtggaaatttgttctttaattgttgatagatagttgctttgagggttttttttatttggtatgtatgattgatttgtgttgtgttgggagcaacataagcttgatttgtatttgttgccttggatttaatttatgtatcttcgttgtgtttgcttgggatttctttgtttttttctatatacggaggcatgagatttgagtttgagatttgagagaatgatcatgtctcgctaaatagcaaatatcctgcaatgcgtaattttcatttgttttatatatcatgatgcaatttggtaataaagggcactgttcttctctcatattcaacatgaatacaatgatactctcactcacacctttgcattagataacttagtggaacagatgactcgctattacttaattctctcttctagttatgttttggttatttctgatcgggtcttgccaggggtcagtgcattgatccctagaatacagtgtcttgagaggctttaatactttttttttttttgaagtggttttgtgattgttgtgtttgtttttgttagagttaaggatcactagaatataatcagaaccactattttactgaaatcaataactgaaatagaaccccaaaatacagaacacagttccctcggtctaaaccaagcctatgtcgcaggatggatctatccatcgtcctgcttcctatttattagaatctccaaaaccacttaacagaaaatttcctagtcggaatagttagtgagtcctaattaacatatgatcactccccactaattaaagtttctttttctgaatttgaagctattctagtagttctgcaggttgtaaatctaactcatgttactcttttttttgcatgtaagcttggacaatg

SEQ ID NO: 12609 - DNA, 3000 bp, Unknown
  misc_feature (1)..( 3000): cDNA_ID_3025833_gDNA_ID_2214562_Annot_ID_185900 3000 nt of promoter + ATG
agctaggtggctaaagacagatgcactcggaaccaaaacaaacaagatacccgacttgaagagaccacattttaaagcatacaagatcaagagaggtgtttgagttgtgtctacgttcagacccaaagaaaattgaaagaaaacgatttctggcctaaccatctagcaagtgatatttaggatcggatgctttgtaacttaaaggaatttgtgtgcattgtttcttaaccattgtgatagtttaccaaattgattttgaatttggctaagttacgttagaggcttttaccacactaatcatgaattagcctaattgttagaggttcattatcttgaaaatatgtagatcgattgcatgatttctaacatcttgattgttcaatttatctatcttgtttatttgctcattttagttcttaattttgttagtttagttttcaattatctactatatatagtttaattgctttcatttatcccttcttttattctatgcatgttagggtattagtgagaccgtagattctcataccgtcttatggcaaatgatttcatcataatttaatgtgttatactgttatggcattttcccgtggatttgattcaatctttagttactccaatgacataccacgcatatgcgtaatgtgtatttatggttaaaattacatcacatgagagtatcggacaatttacaaaaatgtatacgaggtagtgtataagacggtgtatgggataattcatatggttcagtacaaaataatatactaggctgtgtgcgtgaagggatgtatgagatggtataaacagaggtgtataagatgatgtacaaggccgtgtacaagataatgtgagattatgtaaaagatagtatacaagatggtgtgtttaactctgtacaagtggtgtttaatactgtgtaagggatggtatatgagacaatgtataaatcaatgtacaagatgagacgagctgtgaaatttatgtatttactctaagatccatgagagtttcttcttcatgtctcaggtgaggaggttggcgaaaggaaggttaggaaaagtgaagataaatttgattttgttacaaaagtcaaaaacatttgcctatataacttaaatatggagcccattatcattattcgtagttagtagagcttgttcacgtttatgttacgatcttgtattgatagaagaatgttttcacttgtcttcgactgaatcagtgttgccttctctcaggttatatctttcgtctatgctttcgtcaaagcaaaaaatccctaaattagatgaattttatgccttgactcaaggcataaattcatcaaatgtggtatatagagcgtatttagcttcatatatactattgagtttccagagtcgtacgagcgctatcaagtatcagaagcgaataaaaataaaatatccttacgaaaaaaaaaatcgtctacaaaaaataaacatcattgtcatgtaagaaaaagaaaattgacaaactaaatattagttcttaaacagttgttgacccttcctctccactaaatcgttaaccaagctttcaaaatcaatgtctctaaccaattctctttcgattgataatatagccaactcactcaatctttcttgtgacatagtcgaccgaagatacgatttgatcaacttcagctttgaaaaacttctttaagcagatgcaaccgaaactggaatcgtcaacattgttcctataaagcaatggtaccttcaatatgagacaaaaattatatattaaatctgctttgaaagcaaagtgaaatttttgtctccaattataaagtaacataactattctaatgagcttttgctatttggatctaatgttatcatattattacctctacaacgttcatccttttctagcgcttgttgttgttcatcttttgcatgcggatcatatatgcgtgtaatctggtcgttgtcaaatttttattaattagcatttcaagccattgccattgtcaacgaatattcagtatttattagaaaaatcaacagaaatttaatatctatttagttttgttgaaatttaaagatataaatcaatatttactataaatttaattttagtaatatttttccgatttagattttgttattcccgtttttttatattgatcagttttagcgttttttagcggtgaacagtagactcaactcggattggactagacgggcgatcccggtagaacaggtccgaacgcccggtctggttcccaaacactgcaattaccgcatcttgtgttgtggaccggaccgactatgactgaatattgcattcattttgatcctaaaaatgtcaatcaatgctcatttatttattatatattttggaaaaaagtgagaaaaaactgaaacggtgcgacgttattaaatcttttaaatccccccaccaaagcatctgcttcttcctcttgtctctctctctctctctctctctttcatcttcaaactctacaaacccagaaaccaccacacagtaattaatgtctctttctttcttcccatgtgatctttaacagacttttcttcttattctccatctctgaagttgtggggattcatcaagacttccttatctgtttcttttataaaacaagagagagataccacttttggtgttctttatttgcaactctttcaggcaaacactctttgtctcttttcttatcttattattgtttctattttttgttgataatactttcgattttttttggctctctgttctttctagatcgtttggttttattgtctataatattcattttgacaatctatgtattgatatgagaacattacttcttagtctctttagtttttttttttgtttttgacccttaagcttgatttgttgtttttagcttctggtgatttgtttgatcaaagaaagcttataagtttttttttctttttcaggttaaagaaatcgataggctctgttcttgattgtggtggaagagac

SEQ ID NO: 12610 - DNA, 3000 bp, Unknown; identical to SEQ ID NO: 12606
  misc_feature (1)..( 3000): cDNA_ID_3025837_gDNA_ID_2214562_Annot_ID_185899 3000 nt of promoter + ATG

SEQ ID NO: 12611 - DNA, 3000 bp, Unknown
  misc_feature (1)..( 3000): cDNA_ID_3025841_gDNA_ID_2214562_Annot_ID_185898 3000 nt of promoter + ATG
ggttttgtgtttaggttgcatcacaacgaaagagctaggaacagtgatgagatcattaggtcaaaatccaacagaagcagagttacaagatatgataaacgaagtagatgctgatggtaacggaaccatagacttccctgagtttctgaacctaatggctaggaagatgaaggacactgactctgaagaagagctcaaagaagctttcagggttttcgataaggaccagaacggtttcatctcggcagctgagttaagacatgtaatgacaaatcttggtgagaagttaactgatgaagaagttgatgagatgatcaaagaagctgatgttgatggagatggtcagatcaattatgaagagtttgtcaaagttatgatggcaaagtgaggaaactattctcatatcttttctctctttttctttctttctttttttgaattgaacaactctgattattgctttattctatgtttgactgttcattattatgcattcgtcccaaatttcatgttatgaactattttgtgactttgggttaaattatttgtttggaagtttttagtttattttatattatgtgaagtaccattgtaatggtcgttgaaaaagctatctcttggtattagtacttttttattttattgtattttatagtttgcaatgtttgttaaaaaaaaaaagggttatttgtgtgattaaaatttgtaggaaaaatgtctgaaaacattatatcggtagttttaaaagcttagaattttttatttatttttaaattgttggtcaatttggaaattcccctattttttagaggaatgttggcaataatccatataatttgagtcaaattaaaatatgtttttcttattttacggttcatataagaaaataagtaaactgttagaaaaaagtattatcatttgtaacgattaaaacaagagataaaatttaggaaatacgaaaaagggttaaagaaaaacataacttccatttcattttttctttcaaaagttttcaagcttcagttctctttttccccacttcaactttcagctttgtaaataacattcgtgtttttcttgattcaatatattctacattttaacaaaaacatataaaaagtggtgtatgcatacagtagttattcgtgaggtagaacgtaattgtttaaattaaaaggcagatatgttttggggaataaaatcaaaaatggatggtaagtagcaaaagctagatagatgaaatgagaatctccaaacctttaattatgactgaacttttttgttggtaaccagtattttttatttttacttttttttgttacaaggcttagtttcttctttttcttttaaatattatcgaaaatcttgatacctaattattttaaaatgtgtgtaatttattaggagaagagggaagagagttatggcagcaaagcgtagtagcaattctgctgaatacaaagaaaagaatggtcgccggaaaagtcactgccgtattctctgagctccgaccatttgcttcttaattccttttctttatatgtttgtgtgcaataagagatttgtacctctcacacccattaaacggattttaaatgtcatatcttgtttgaatatgttaaatatttactatactgttatataaaaagttttaaagtactatcaatatagtaagttcatttaggcatttcctatctaccacaatgtttaattttcgtctacaacatacgcacacttatcaaacttgaatccaagtatatagcgacaacactaaatccgagttatgatacgacggtggcactagtacagaaacactatcacaatgtttttaagatattagcaagagaaaactcagaaaagatacacgaccaatattaggagactttaactaatactctggcgatctaactgttataatttatcagttgatttaggcgttaggcatttgctatctatcaacaatgtgggcgggcatatggtctaattcttgtgagatgataatacaattaaaacaaagaaaatacttttttaggaactaaacctaaacttaaaagtctttctaatcagttgctatttaagtattttcataataaatcaagaaatgcaaattgtacatgaattcgaaaagcctctcgttaagaaaacttatgattaagaatataatatccaaatactagtttataacaccaaatgcattgaaacactttgtgtcacttagcatcaaacattaaacacttataccaatttgaatttaacatggcaacaaccgatatcggaaaacaaaatccatcgcgtatattaatcggttgaatattttggtcagatgcaactaattgttccctttctctatgatacttcaatttgtatgggacaaaatggaaatcttatggataagaaacaaaagaaaaaagagttgtgtgaagaaaggtcatgcatatacattaagtgaagctttaggattcatgcaaaacgctttagtaacatatttcttcattttgtataagatttaacaagtaaaattctattcaaaaattctagtaattaaatgatttatagataggggattaacagtaaaaatacatctaacaatatttaatctaaaatggcaatagtatttaatctaaaatggctaggaatagcatccattgctttttgagaattttcctcttatgcaagtaatcctttcctttctctacaatatttttcattccatagttcataattagaaaaagctccaatgataagggacaaaatggaatatttatagacaaaaaataatagaaaagttctttgaatggccaataaattaaaggagtaatataaaaaaaaatgcgtataggaaaagcaacaaagatgtgtgtgaaaaaatctcatgcatttacaatgaagttgaagcattagcgttcatgcaaaaatgttatgctcattggctataaatatatatcttcaagaaaacaaaataaacaaaagagagaataacaaacaaacaaaaaagagatg

SEQ ID NO: 12612 - DNA, 3000 bp, Unknown; identical to SEQ ID NO: 12605
  misc_feature (1)..( 3000): cDNA_ID_2709247_gDNA_ID_2214562_Annot_ID_185895 3000 nt of promoter + ATG

SEQ ID NO: 12613 - DNA, 3000 bp, Unknown
  misc_feature (1)..( 3000): cDNA_ID_3025851_gDNA_ID_2214562_Annot_ID_185894 3000 nt of promoter + ATG
ggaagatgagtagcattggaactgggtacgatctctccgtcaccactttctctcccgatggccgtgttttccagatcgagtacgccgctaaagctgtcgacaacagtgggttagttggctttatcttcttcgatcttcgccctttagtagatcggatttagcttctgaaaactttgagattttggttatcgacacgaattagggtttgttaaaagtctttccctttttttttcttcgcaggactgttgttggaatcaagtgcaaagatgggattgttatggtttgattcttcctccttcctctattgatttttatactactttgtcactttcttcagtgggtttagtctctcgtgctgtgatttaaccttggaatgaagtattcacatttttgttatcagaattgtagatttgatgtaatatataccgtgtaaattttgacccaagatgacacattttacagtcccttagtttcatttcctgttcgatatgttgtgaatctgttgttagttttgggttttgtaagattttacgcagatttttgataaaggaatggtcttgctaagtgtttatcatttggtggtttttagggagttgagaaacttattgcatcaaagatgatgctaccaggttccaacaggagaatccattctgttcatcgtcatgctggcatggtatgtttttttctcctaaactataggaaattagtttctgctgaggatatgtatctttcaagttttttgtaactactattgtgtctagtctcgtagtatattgttttgtttcatgattatgggtatttctacttctgtcatgtcaggctgttgctgggcttgcagctgatgggaggcaaattgttgcgcgtgctaagtctgaagcacgaagctatgagaggtatcaatgaaaacatcagtagcttatatctaagatttattattatgaaagaactgttcaactcctaaagcttttctcaaggggatgtttctcttagttaaacgttcaaaatattttttatctgcattttgttagattaaaaatctaaatatatgggtataagatgtcaatgtgtatgttctcctttcttcctacatggctttgcataactttttccgactgtgtaaccaactctaccttcacttgtgataatttagtgtttatggcgatgctgtacctgtgaaggaactttctgagcgtgttgcaagttatgtacatctgtgtaccctgtattggtggctcaggtttgtccaattcatctacgtctttggtagtcacctacgcatttctcctacttgaatgaattataagaaaatggtttttattttgtaggccttttggctgtggggttattcttggaggttatgatagagatggacctcaattgtacatgattgaaccatcaggcatatcatatgtaagttatttctgcccgtagatatgtgtctttaagtatgaaattttacgttatttttccctgtcatcatatgaattctattcctgcagagatactttggtgcggccattggcaaaggaaagcaagctgccaaaacgtaagctacatcgtgaatgtatttggtatcatactagtattttctaggattctcttatagtggatatgcgtagtcactaagggtatatactatgtagtaccactaggattgatcaatttaacttgtccgaaggaaattctaactaacttaacagttaaatcaaagaaatcatttaaacttgaaggatcaagtgagctttcatggttgataggattgatgattctccataaatgttattaagaactttatgacagatgtttctggattgcataccttttggccgcctttgacatgtgtggaactagtttcaactaaacggttatagatttagttatcaaaaaggcaagggtatgcaagtgttctgatggatcagaggatttcttgcagggaaattgagaaattaaatttatctgagatgacatgcaaagaaggcgttatcgaggtggcgaaaatgtgagtagtgcttgcttctcatgtacatgttttctggttctcatgtgctttctataaccaggttcattttatagcaagatgtgatgttactttttcatgtgcagcatctacaagctacacgatgaagccaaggacaaggcttttgaattggagatgagctggatatgcgaggagtcaaaacgagagcatcagaaggtaaaattttataagtgcttgcttatgaaggatgatttaaggagatattcataaaccatatataaattggactcgtcgtataggtccctgatgatcttctggaagaagcaaagacggcagctaaaactgcgctcgaggagatggatgctgactaaaactgaggagtgtgttgaatttagatccgtcttattgcgtcgtttgatgtttcttatgtactctgaattgaattttgtctggagggacagttgttgcagtttcgcatgaaccattggagtcttttatcttattgctatcaacagttgctacgatgactccttcactagaattaacatccattaaaagtgaccacatgaataactatacaaacaacatttaaaaatttactcacttctcgaatactcttgacctacctaatctataatcattatatgtcaatttcatagtagaaagtcatgattcgttttactgtgtgaaacagatatatactagcagtagcaaaaactaaactaaaccgagaatctgtatttataatgcaaaatcatttgcaaattcagatagatatcaatttcatagtagagagactcatgagtgagtgtttgaatagtaaaaaacttcttagctggatctgaatatgatttggatttaatactactgaaaagaaaagattccatctatctactatcccacttcttccggaaagataaacaattgtgtttacgtaagaaatgaagcatgtcatcatattatattcaattattcatgggctcttgctatatacatctgttttttcactttgagcaacaatg

SEQ ID NO: 12614 - DNA, 3000 bp, Unknown; identical to SEQ ID NO: 12603
  misc_feature (1)..( 3000): cDNA_ID_2709251_gDNA_ID_2214562_Annot_ID_185893 3000 nt of promoter + ATG

SEQ ID NO: 12615 - DNA, 3000 bp, Unknown; identical to SEQ ID NO: 12601
  misc_feature (1)..( 3000): cDNA_ID_3025859_gDNA_ID_2214562_Annot_ID_185891 3000 nt of promoter + ATG

SEQ ID NO: 12616 - DNA, 3000 bp, Unknown
  misc_feature (1)..( 3000): cDNA_ID_3025833_gDNA_ID_2214562_Annot_ID_134889 3000 nt of promoter + ATG
agttcaagtagccagcataacaatcatgaaacaatatggaactcttctcttttttctctttttcttttaagtgttaagtctgtcatttttgttggttgttctctagtcaactcaattcaataatcaatatcataagaaaaacacatggcttagccatatttatagggttataaaaagcatttatcttataatataagttatcttctttgctttcatgtagaaagtatattctcttataatttgtttggtcaaacacaattgaataatatagtaacaggttgccaacaattgcatcagtgtcggctactgtggcttcttcttcaccactggcaaattctaatgtaactttttttatccacattgtaatccaaaacggatatttatataataataaggtgaaaaaagccaaaaatggtgagagtgtttttgggaggaagagaagacaaacgttgttgtctcctttattttggaattggaggacaggccatgtgatatgcgttgtgaaaccccaccactcttttagtctcttcatcgccaaaactgactacattcatgcacccattttttggttctttattattcttatattctgaacataatatatagtaatgcaaagatataattgccagttttaacttagtaattttttggtatgattttttattttaatataaaaaagtaacgtagtaatttatgtaagtgtcgtgactatgcatcattcacatttaattcttatagtatatgactattttattttgtcattttattattcttaaacaaaaaatgttttgatatgttctaaatttccaattcaccaagataagttatggatctatcaattttcaataatttacttaataggttttgtcacaatttcattcatataatctgaattttcagtagtgagaatgatgataaacggattcggaaaaaagaaatatgatgagaaaagtggatgtcaaaaaaatattttcagttactattggggtgaggaaaaaagagaatcttctttttttttttttattatactcacaattaggaggctttaaaaaacaaataaaaatacagacgaaaaaaataaaagtagcgttgacgacttaaaaagaaaaaactaaaattgtttaattggaagaaataaactgtaaggctgtgaaatgtagttacagcatatggtagattcttaaatgaatgaaataatatgataaggatttatcggtggttgtggttgtggttgtatttcacactaacaaaaaacttatataaacaagtttaccaaatatgctataatttttctaagaaaacgaaaaccaatttggataattggataaaaaatattgattagtgggagtactgaaagtattttttctctttaaaagatttacatagttttggataagaaatcaccacttctactccaaaaagcgaacatgagacactagatctccatggtattgcaaaacttgtcatcaatactccaaaaagcaaacatgagatgctagatatcctggcattaccatcagctcattttcgttatgtttcatgtttgtaatgatgcctcatgtattatactcaagatattggagaaggtggcgttaagttcaggtgcacttttggcgttatgtgttattagatggtaattgatttgatcaagtaaaaaatgtattaggctattagccacgacagtatatatgcagactatatgaaggaagaatatcacatcggtggctaatagtgaaaatcaccttttaggttattctgcttgtttatacagagcaaaagcatgcctgctaatctgcttatacttgttggtggctttgaggcaaaacttagggaacaggtcagacttacaattagaggcacttgaatgtagtttattgagtctaagctgcactagtttgtggattgagtttaagctgcacagatttcccactttggttctgtttttagtctaattttcctcctgcttggtttctcgtttctcatgtgtgattctgttctgtttgattccttgtaggtgtggtcaagtcttcatcagcttgcctcgtgtttggttctgttcttttctcaaacttactaccactggctgtaagatttactatccaaatgtgctatttacaaatgttaagatttgttgttttatgcttaaaatgcttacgtctagatggtgtttgtgtcaataattggtatcgaattcagatatgcaagttctctctatgtataactgtataactccctctttttgttactgtttctagtggtttcattcttaagacacccacattaaaaaggatcaccaatagattatatttatagcaaagacacccattaaaggatgactaatgaggatcgcctaatgttacctttagaaaaccatcagagacataataaaatccttacacatcaactagttcataaaagagacaaatttagcatgtactcttgtcaaatacagactgattcaatcttagtagttcccatattttattttattttaagatttaacctattcccataaaattattacctgaaaaagaaaaatcatcatagaagtacgaataaatgagagctgacaattaaagagcattacctactttttctgtcctcatctatctcctccattgattacgcttcttgattgaagcaccccacagagagagaaaaaaatagcatacatacattctctagttccttctctcttcttcttcttcttctaccccgcacgaacgtttctggagtatctcttttctcttatctttcactccattacagagcaaagcttgactctttaagttcacatggtgtgttttaaagttccttcttttttactcaatttcgaagctttgtgtctgttttatcaaataatgatgagaaattgagaatgtgggtttttgtgactctttgattcgttgtttagagaattgggttttgggattttgtgttgaattgctcagttttgaagtcatgcagataatatgttcgatgatattcctgttagtgatg

SEQ ID NO: 12617 - DNA, 3000 bp, Unknown; identical to SEQ ID NO: 12608
  misc_feature (1)..( 3000): cDNA_ID_2709225_gDNA_ID_2214562_Annot_ID_134892 3000 nt of promoter + ATG

SEQ ID NO: 12618 - DNA, 3000 bp, Unknown
  misc_feature (1)..( 3000): cDNA_ID_2712347_gDNA_ID_2214562_Annot_ID_134893 3000 nt of promoter + ATG
atcacggcgcactctattgaagttttcaaagcttctaacaagagtatcacttgtgggttcatcaaactcatcatcatccgaatctctggactcttccctttcttgaaaagaaaagtcctcaccatcatcttcctcctctggagttccatcttcctccttaacagatctcgacacatgaccattcccaacatgagaagaagaaaactggttgtcaattggatgagaaagaccaaaataatcccaaggtgcttcaggtggcatggaagaagattcctcaaatggggttgattccatcttttctatagacctgcttggtgggatactggatgaggtaacagtggcaataatagatactggtggtttctcttccactttttttgaagaaaaccctttgaatttcatatgattgacctggaacggactggtactaggaggcgacggaggaggagaatacgtgtcatggtgggaatgtgaagcaggtggaggagagtatgacaaatgagaaacagatttctcgattaaagcaagaggttgttctggtgttgcactagtggacgtgtacaaggaagattcaactggaacttcagtctcagaaaatttcctgagggcagttccggtactcttaagagactgaacgtatgaaacgtgagcagcagctaacaaacatcttccatcgagtgcttgttggacgaatttttttctttctcgacataactgtaaggctttatcttcatctattctggatgttgatgcacccattgtccaagcttacatgcaaaaaaaagagtaacatgagttagatttacaacctgcagaactactagaatagcttcaaattcagaaaaagaaactttaattagtggggagtgatcatatgttaattaggactcactaactattccgactaggaaattttctgttaagtggttttggagattctaataaataggaagcaggacgatggatagatccatcctgcgacataggcttggtttagaccgagggaactgtgttctgtattttggggttctatttcagttattgatttcagtaaaatagtggttctgattatattctagtgatccttaactctaacaaaaacaaacacaacaatcacaaaaccacttcaaaaaaaaaaaaagtattaaagcctctcaagacactgtattctagggatcaatgcactgacccctggcaagacccgatcagaaataaccaaaacataactagaagagagaattaagtaatagcgagtcatctgttccactaagttatctaatgcaaaggtgtgagtgagagtatcattgtattcatgttgaatatgagagaagaacagtgccctttattaccaaattgcatcatgatatataaaacaaatgaaaattacgcattgcaggatatttgctatttagcgagacatgatcattctctcaaatctcaaactcaaatctcatgcctccgtatatagaaaaaaacaaagaaatcccaagcaaacacaacgaagatacataaattaaatccaaggcaacaaatacaaatcaagcttatgttgctcccaacacaacacaaatcaatcatacataccaaataaaaaaaaccctcaaagcaactatctatcaacaattaaagaacaaatttccactttgaaatcctaacacaatctaacctattctcttaacttagtaacctgttccgccgtttaaagttcctcaagcaaaatccttatggaaagagtaaaactttcacagaaccatcggatagatgacaaacaatcagaatcacataagaaggcaactttttcgtaatcggaatcccaaaatagggcgagagagaatataaggagagcataaccaaagtcataccgcagacaaaacacaaaactgattgaacaaattaagaagttttcttagagtaatcgaaaatcaaaacctgaaaagtgcacgaatttgacaaaaaagagagatttttatagaaaggtaaagaaacccaaatgaaattggaccattagagtagaagaaaacctagaaaaggtgagatttttcacacaagtagaagaaacaacagtaagatggagaaacggtgatacctaaagagatgtcctttgagagctttggagttacgcgagaggatcaaacccaaaagaaaacaaaacgtcttcttctacaggagacgaagaagaaggagagaggtggtctgtgtcgtgtgtgagtcagcagcgaatcagatgggtagagagaagagagagagagagaagaggaatcttatgcgagaggagaaaaaggagattgtgtgtgtatgtgtgtgactaccaacatgcaataaagcatttgcttgcttgtaaagacgattttgacggatgactccaaaaacggtaactttctcttgccgttgttatttctactccggttacttttcttacaccttttttttgtttgtctttttatttttttaaggattcattagtttatgataaacatccttaatctatggtcttagtcaattgctttacaaaacaattttgttacatgtcaactcacattttagtattttactaataatcaaatccatagacagattatgaaaaaataatccatagtgatcccataaaaaatagaaactaatcttatcaaattgacagagatactaagacttattattggcttaatttacagaattgtttgaagaatttttctggaaatgatgggaaagaatctgactgaaatattaaaatagttttgcttcgatgaaatggaggaatagtcaaaggtgtggacaaataattaacatagaaatccaaatactgtattttcataaagacgaagatgggcctctgagagtaaggcctatttatgaagacgaagatgggtctctgagagtaaggccctattggaaataaagctcactgtaacagtaacagcagcaaaacccgtaaaggtagagggagagacacagaggcttcgagtgaaatcgtacattctccgatttagggttccgaacgaa

SEQ ID NO: 12619 - DNA, 3000 bp, Unknown
  misc_feature (1)..( 3000): cDNA_ID_2712343_gDNA_ID_2214562_Annot_ID_134894 3000 nt of promoter + ATG
tcaaatcaagagctaatttactttacctcgttggtaacattcgtgactttgaaatacccttcaaactctggtttgggtgtatattccagatcttctatgtctttgccaacacactgaattaagaagtgcaaagttaatactacaaattttatcaaacaagattgaagtggcccaaatatttaaaagaaataatagagctgagatatcaaccagagatgatatatccaatggaaaattgttaagaaaaaaaattcatgttttaaattacatagcaaaacgttatgttagtccacaacaataagtcttacagtcacacatcaatcaatcaaacaagcgggataatttcgtatggatcatatctgatttatcttggattaagaatgcaatcaaaataatccaaattcacataagggctatatagcagcttatctacgtttatgatttggaaacggtcatcatccatcatgtaatatatcatcattgattagatcaaatccaatgcaatacaaatgtatgcagcagttacctctctgttagtaattagaaaaccttgcccatcaaccatgtaggatatcatcataatttgatcatattcagcatccgggaacttcaatggaagctttactgtctctatatcgaatgcacaaacgcgaacttctgcgcgttggagaagatccgtcctcttctctagtatgacatcagtgctggaaatactgacattgtaccattgcccactacgcacatctggacagcgagaacacatcatgattttgacaaccttgagggctaaactaggattaaaagtttgactaaataggttaccattatcaattgcaaatcggacatgataaggaacatcgtactcgcggaggtccaccacagagtctaagcagtcttgaggacgttgttctctacattccaagacttggaaattataactaaggaacaacatagttttaagggataaatttgtaagaactctggaaatttataagaacaaaaatacattgccttaccgttttccagacaagatggattcgtaagcttcaagtgcattaaattttgcgaggtttcgttcgacaatatgcaacagatccctctttacttccaccaattgttgcacagtgtcaaatgatactttgagatattttttttgcaggccagatagatgatttttctgctcatgaacataagaaatcaagaaactcaaattggtatggtaggtcaaagaaaaggtcagcaaaagtgacaaccaaacaagaggtactgaaaacgttcatatcttgcataatgttgccactaaagaagaagcattaaacacttaaacatttactagcaaacgttttttgagttacaagaacgtttttggcaggctagatagatgatttgagcacatggaagcaagatcagttttggacttattactagagctgctcaatttgaagttgcaagaagaggaaaataactaaaagttgtagcaaatgtaattgacatgagtcctctatatagagagaaagaaacgagtaatcaacaggtagttgcaaactgcgtaaaaggagttatgctttagtgacttacaagataaagatcttctttgtgaacaatctgaatatcagcaacttgtctttcatatcggcgtctcaagtaggcttcaacttccagttccatattgtcctgtaaaaagggcattgcagtttagttgacatataggaagaaaacactcgagtacagagagaacatatatactttggtggcggcatacaagtaagggcggaacttgtacttagtcttaaaagaagagccgtcctgaaagaaacaaaaagggttgagcaactgatacgaagaaagaagctaatatagtagcaatgaccacagctgacctgagtgacaaagaaaaggtccacacaactaaaggttttcccagtatcggcatcttcccaagatgactgccaacaacgtagtataataaccaatcagtgagtgtacttagaagttttcagtattcagagaactaactactagggaagtcacaaaacgtgacttactgatgcaaacgtgagtagccacccgagccgcgtttccccttgggagaaaagcccaaatccaagtttagtttcgagttcatctgccgctgaaactttctgcacattcaacctccgatcacatctccttccgctcatatttggcccacgccgatgatgctaagagactcttgtattgattgcttgtgttgcgtattaaataaattagggttcaaaacaaagggattcgtgattgacactggtacggtgaagagatggaaccagatcaaataagagaagagagaatcatctagaacctgagattcttatgacgacaatacaaggaaatgaagttgtcatccgaaaatgaattagggctcaactaaaaaagacagatgaagaagatgaaatgctttcgcgcgcgttgtctcttgtatcaagggctttcctggttgttgggttcggttcaaatgaggcctcactttttatgagggctttctgttgttgggtttagattaaaacgaggtctcgctatttaaattgaaaaaaaaaaaccaacaaaagcacgaaacgacgtcggtttcgtgcttgaatctcttcttcctcgcgaacgactgagaagaagcaggagtttaatttcctccggtcgaatctgaaaacgaaatagctgccatagcttcttctcaattttccccaattgttgttgcccttctccctaatttcacgactttcgattcttctgagttctgagttcttcgcatcactgactgacgtaagctcctctttctctcttttgctttctcctctttctgggtttctctctctctcaacaaacaatcggagagtgagagatgcaaaaagtcctcatatttatatgttcggaagaagatctccaaacactaatagtacttttttgtagactatgaagatgagaaacatttgtgtgaaattagaacttctctactaagtgaaggttatg

SEQ ID NO: 12620 - DNA, 3000 bp, Unknown; identical to SEQ ID NO: 12607
  misc_feature (1)..( 3000): cDNA_ID_2712339_gDNA_ID_2214562_Annot_ID_134895 3000 nt of promoter + ATG

SEQ ID NO: 12621 - DNA, 3000 bp, Unknown
  misc_feature (1)..( 3000): cDNA_ID_2707655_gDNA_ID_2214563_Annot_ID_134898 3000 nt of promoter + ATG
gatctgaagccttcagctttcgatccaaaagataagatatggaggaggtttccgcgcgaaggaaccaagtacacacctccacatcaatctactgaattcaaatggaaagattattgcccactagttttcaggttagacaaaaaaattcctttacctatttcacattgctacaaatcctgtcttacttattgacatgttttgcttatggtttaattttccaggagcttgaggaagctattcaaagtagacccagctgattacatgttatcgatctgtgggaatgatgcccttcgagaactatcatcccctggaaaaagtgggagttttttttatttaacaaacgatgatcgttacatgataaaaacaatgaagaagtcggaaacaaaagtgagttcttttcaagttaccggttagagagtgttggctggctattaccaaaacttttcagattgcaattactgagcgtcttttttgtcttcttaatgtaggtgcttctggggatgcttgcagcatattataaccatgttcgagcatttgagaactctttggtaatcagattctttggtctacactgtgtgaaattgaatggaccaacccaaaagaaggtagatacaaaaaattaacactttatgtggcatggttttgaaacgtttggtttagtttggtaactctcttggtttgcatataatgcaggtccgattcgtcattatgggtaatctgttttgttctaagtactctgttcacagacgctttgatctaaaaggatcttctcttggccgtacaactgacaaacctgaatcagaaatcgattcaaacacgatcttaaaagacctcgacctgaatttcattttcagattgcagaaagcatggtaccaagaattcatcaggtaaaaaccattatactttactctatccatagtttgtttgtgcttgtttcatttctcatggttcattgtttacatcacaggcaaatcgataaagactgcgagtttctagaacaggagagaatcatggattacagtcttctagttgggattcacttcagagaagcttctgtcgctggagagctgattccttctggagctcgaacgcccattggttcgcttttgtccaatctaaaaactacttttcccatcagcaaaaatgtatcattcacagaaacaaagtaattgtttgtttatctacaggtgaatcagaagaagaatcaggccctcgtctttctagagcagaggttgatgagcttctttcagatccctcaaggtaacacaacataagatatcaattaacaacactttcaaaactcaaaaccgaaacacagaaacatggattttgaatatggttgtgttcttgcaggtgggcaagtattagattggggacaaacatgccagcacgtgcagagagaacgatgagaaaaaacgacagcgagctgcagcttgtgggagagcctacaggagagttctacgaagtggtgatgatatttggtataattgacattcttcaggattatgatatcagcaagaagcttgaacacgcttacaagagcatacagtatgatccttcctctatatctgcggttgatccgagacaatactctaggcgtttccgtgactttatcttcaaggtcttcacagatgacaattgagatggtctcaagttgtctctggcgtttttagatttcttgattcccaagtaagagctctgcaaataggctaccttgcaaatatgaagttcgacgaatcccatttcgtttgttcgtttgtttcaatttatagattttgtatcaagctttgtaatcagctaaaagccatagcaatgaatattcttttttcttgtatactttttatgtaacctttcataatatgattaagattttcttgtctggaaattcttgtaaatgaaatgattttaattatcgtggtggttgattcattttatattttaactatacatttgcagtatagtgttgtcaatgtgacgtagttaacataaaagaaaacaagttgcataatttcttttacagatacttttccactaaaaatacttcatcgacaactacataaaaaattgaagtggtttaaagtttatagaatttacaaatgtgattgtatattctaaattgggaacaaagaatatttgatgcaccaacaaaaagattcgttcaaaaacaaaagagattcttgaaagaaactagagtttttatttctctaaaaggtggaaagtttcttggtcaggtaattagatactgaataaagacatgaagcaaaactttataaaagatagacaactttgggcaatgttagttacgtaggtgatgatgatatcttttgttttcttcaataaagaaataagagtaaaagattccaataattgttctaaggttaacactcgctgttgttgtcgctttatgtggtaaacgtatagagaatctctttgttctcttctgccatttgtccccttacaaaattaaatttgcgactcttcaaacgctatttaattattttaaattgattacgtattcttgaaattgagccaagcacttgccatttatttacatattaactacttattcaacattagatttgtagtctatattcattcaattgttctaaagtacaatctgtaaataaagacatgcgtcaccaaacgcaccgctaaatcttagaaaatcgcgatcgcgtttgaagacaaaagaaagctaataaaactagcactttcatcaactttacaacaacaaccaaataagcgacggcgattagagagtcctgcgtagtcgtgctcactgatcactcttagctcgtgccgtgatctgagactgagaaaacatcaccggttgggttttctctacgattccggtgcaccgtacacttcaccgcagtggataaatctctgcttccattttgactttttgaaaataaaactacaacagtcgcagagagattaaacttcgaaatccgatcgatcgctttctctctcggcgtttcttctcaggagcttcattcc

SEQ ID NO: 12622 - DNA, 3000 bp, Unknown
  misc_feature (1)..( 3000): cDNA_ID_2709259_gDNA_ID_2214563_Annot_ID_134900 3000 nt of promoter + ATG
gctttgcttgttgatgctgttggtactctccttgttcccgctcaacctactgctcaggtctctcaaatttctctgttactttgtgtgattcaacagttgaacaaatgcttcacatgtttcttgctctgtgattgaaattttttagaaagctatgagcattttgaggattcatgtttgattctgagtaaaaatttgatgcttattgttatgttaagaatgtcttaggctttttatgatctctgtttgttcttagaagagtagatagagatttttattgtgtagattctaagatgtgttatggattctgattttgtagatatataagaatattggagagaagtacggagtggagtactcggaggctgagatacttactagatacagaagagcttatcagaaaccatggggtggatctcatcttaggtatttagaatcatcttctttctctttttgtttcttctactccaagaaaatcaccactaggcaaaatgttcttttgtggctttctatttgtttgtatgacaacttttaatacttgatcatgattatgactctagtgatgcatctccgtacaaagatatctggtttaatactgactctttcgaatatacatttgctgtggaatctctgttggattcataaatgggtctgcttaagacatttacttctgtgctggtcttgatttttgattctttgtttgtagatatgtaaacgatgcaagacctttctggcagtatatagtgactgcatcaacaggctgctcggattcacagtactttgaagagctttacagctattttactacagaacaggtttgatctctactactacttctccatatgcttcagtaatagttttggttctttctcttgagatttctccatttgctttcccaggcgtggaagttatgtgatccagatgcagggaaagtgtttaaggctattaaagaagcgggtgtaaaagttgcaatagtctccaacttcgatactcggttaagacctctcctacgtgcattgagatgtgaagattggtttgatgctgtagctgtttcagcagaagtaagataacctcttttcgtttatatatttttgttgatgatccgaaacgttttgggagtgagtgtgtaaatacttaaggtttttggttgaatgtttaacaggttgaagcggaaaaaccaaacccgactatcttcttaaaagcttgtgagttattagaagtgaatcccgaggatgcggttcatgtaggagatgaccgtaggaatgatgtatggggagctagagacgcaggctgtgacgcttggctctggggaagtgaagttacgtcatttaaacaggtaaacgaatctctctggttttgctcaaatctctcaagaatttaaaaatcattggtttacttgaaatgaatgtgcttttgttttgttctgcaggttgctcaacggataggagtgaaggtctgaagcaaaagcatatgagagaaatggttcagagacatgttcagacttcagttttagcttcttctttttttgtgtgagcagttttgtatattccatttctcttttgtagcataatgtgtgtaatatatgttgcggctaatgtagaaaaccagaaaacaatgtataataaaagatcaataataagcttcatgatcgttcttaatccgaaccgaagtgttgtactgttttcgacatttgcttataaaagaaggagaattgagttctttaaatatgtgatcaagaagagatcaagaaaaatggaaatttagagttgaacctaggcaacgtatggacaataccaaaagttgccaacatatcaatggataaatctaatcaaactgtatctgtgattattgtgggttgtattttaacattatgttcataattgttgacaaatagtcaaatacttcacattttagagattatctacatataatgggctacaaacatgtaaactcattgcaaaaaaaagaaaaagaaaaagcaattatcttagggccaattgtttttagagaagcccatttagatctttggatttaaagaggcgtaaatagaatgaggaaaaatccaaaatatctccgtctctcttttatcctcgtccatggataatagaatagaatcaaggcttttggcctgaccgagatgaccggagttgacttgtgtaatatgatcagaaaggctataatataatacaaaataaacgatagacactacaccatataagatgtaattaataaatttaaataaggaatatacatttgttaaatatttgtaaacacttaatgcctacgtatatactacatagaaatggttggattcaggagaaaagccttaacatattccacgtgatttgctcgtgcctctcaatagtccacgtccaccaaacccgtgtatcctcgtgtacttcttctcagtgtctgtctcttttcttccagctgcgtcataattcatatttttggtcttagtttacttaacgtatttgtggtagaaaaatgtgattgcatattctgtatcttcttatagtagttgttcctatttaactgttattttttgctaactaaataatttgcttaataaatcgaatttctattttgacacattataaaatatttagaatttttgattaatactcatacattcatattcatgtaattatacgatacaatagtgtaaacttatgttataaattacgataagaacattaggatattaatgcctgtatccggaggtcaacaggtgatccttggaacatgctcctacttgggggaaaagtgctcaaccacgtgtcaacgcatgtccactcgtgacccaatgtattttaatttattacatatacaacacagagtcattagtatttttcttgtgtccgtgtgtgtgtatcagtgtatatataaacaaaaatgagtgtccacataaataatccaactaacacatcagcataatcccaaccgaaacagcttctagagagagacaaaaaagaacagagtaactatctaaaactcaaaatg

SEQ ID NO: 12623 - DNA, 3000 bp, Unknown
  misc_feature (1)..( 3000): cDNA_ID_2709263_gDNA_ID_2214563_Annot_ID_134901 3000 nt of promoter + ATG
aacatactgtagctctgaaagcaaaaacgtattatatttgcaagtaacacaatcagatctgagctatttagtattatgatgaacggaaacgttaaaaaaacgtttactttgttaaattgcttacaagaggagtcagtatttttatactaatacttgactgttattatatactcacaattgtcgtcaaaaaagtatataataactaaaataaaaaactagctaaaccaaatattattactttttgctaaaaaaagtaaatatcatcagaggaaagttagattgtgccttgtcaaaagacctagatgcaaatacaataccatcatacatatctctttggttactcactagtcactagtgaacaaatgaaattaatatcacaatttcaacggatacagttttgtcaactagcagtactcatggatatatatgttccacgctaataatattatattttaataatctaaaatactgcaccaactaaaaatttaatcactatcctctgtaacttctgggatcaaaataatatttctgtttcttattaattgattttctttgaaaaaaattgtttcaaaaatattaatattttagatttttatacaatattaattagttataattgatgaatatcaaattttaaaataaataactaatattattagtttaaaattataaaaaatataaatcacaaaaagtaatatatttataatgagctttaatatattttttgatatgtgtgtttttttagaaaatcaattattaaagaatagaggaagtatattacaaaccagtagaaataagccaaaaaataaaaataagaaaaaaaacaaaattatatcctttttcaaactgaaattttcaatcgagtgaaatatttcatatatcaaatttgaaatacctgtttaattttaatgtattaaagtaatgacagggttagcgataagttgacaacatcaaaattgaatcatatgggtagtttaatcagctggtaaaggctcgagttattttcaatattttttacttttttttttgcgtccaaacccataaaataagagttgaacgttgaaagccatatcaagcatcgtatgcttcaacagctaaactattctctgtggttccacgtgtaaatgccatgctctctactaacctacggttcttacacgtctccaatggacttcaaacccatcgttcgaaatgataatgttaacttctatacattccaaaaacaatcgcacaataccaattcaaaccctcctccttcttttggtaatatcactaaaattgatctaaatgaaagaaaagaaagcaaaaagggattagaaacagaaaccatgaaccgaccggtataggagatagaactgaaatagcactacttagaccaaattcaacatttctgataaaataacctaaccaaaccattatctaagcaagagaagaggctagcataatgattagaaaacgttattactttttaaaaatgggtatcgaacgttactacgttagacactcgagttcagagagatcttcattactggcgtttaagacgtttcatctatttcccgagtgatcctttttgaacccttggatgttcttcttattcttattttaccaaatgaactttctaagtaagtaaacattatgaataaatcatatgcttcgaaatctatttaatacttaactgttagttttactggaaaaggttggataaagaaaaacttgagaagaaacgtcgtttttgaacgttaactcaaaattctccaaaatgggtccaattatggatttatgtttccttatccataagactttttctaatcttctttaacatcgtgatgtcttattataccacatagacacatacgtataaaggactcattgtctatccaaagaaacactaaaccaaatcttattttgttcgtttttccatacgaaatgatgaaatcgaccaaaaagctcatgaaataaaccaaagccataaaattttgtggaacaaaacattttccttagccatgttggtgaattcggcattttgttaatagtcaatcaaattatgcataaaatggcccaaaactatatactccttaaattttgtggcccatatttgtcaacacgtgggcccgtttgtcaatttataagccacgaatttctaaagaggtccctctaaaatagaccagttcttcaattgtatccttatattactttgcatgacacataattggttagggcccaattttcccacttcttttcttttcatgacttttatccaaaaatatttgtggataaaactttttatccttgtcgatgtgaaagctaaaatttaatgaagcttaagcttaaccgtttttccacgaaataatagtatccttctcgatgtgaaaataaatactacaagaaaactaattgtatgcatttattcctttttattggctaatttgatgtttcaacaacgtaatatatcatcaatcagacaagtagacgtttgtgaattcttgaagaatatctgcatgtaaaacacggatccatatatcaataatcaatatatagaacaagataaataattctgattgaaaaagaaataatgataaatctttttttactttttgtttttttataaagaaagataaagctatttttgtgtgtcaagtacataactttaatctggatctcaactttaaaaaccaaaattcaaaacacaaccctttcttcatatctcaggattataagactcatatggtttctttaacaaaaaaaaaaaactcatgattaaagattaagagtgtaataacaagtttttaaaaatgccacatcatcagttcttctgattagcggatagggtagaaaaactgtagacggataataatatgaaagggtataaccgtaacaacacatctctctttatgcgttaaagattctccgcacacgcttcttctccttttataatccccagacgaagacgaagccgaagataacggaacaatcaaatcaatcatacagaagcagctaatg

SEQ ID NO: 12624 - DNA, 3000 bp, Unknown
  misc_feature (1)..( 3000): cDNA_ID_2709265_gDNA_ID_2214563_Annot_ID_134902 3000 nt of promoter + ATG
aacatggctaaggaaaatgttttgttccacaaaattttatggctttggtttatttcatgagctttttggtcgatttcatcatttcgtatggaaaaacgaacaaaataagatttggtttagtgtttctttggatagacaatgagtcctttatacgtatgtgtctatgtggtataataagacatcacgatgttaaagaagattagaaaaagtcttatggataaggaaacataaatccataattggacccattttggagaattttgagttaacgttcaaaaacgacgtttcttctcaagtttttctttatccaaccttttccagtaaaactaacagttaagtattaaatagatttcgaagcatatgatttattcataatgtttacttacttagaaagttcatttggtaaaataagaataagaagaacatccaagggttcaaaaaggatcactcgggaaatagatgaaacgtcttaaacgccagtaatgaagatctctctgaactcgagtgtctaacgtagtaacgttcgatacccatttttaaaaagtaataacgttttctaatcattatgctagcctcttctcttgcttagataatggtttggttaggttattttatcagaaatgttgaatttggtctaagtagtgctatttcagttctatctcctataccggtcggttcatggtttctgtttctaatccctttttgctttcttttctttcatttagatcaattttagtgatattaccaaaagaaggaggagggtttgaattggtattgtgcgattgtttttggaatgtatagaagttaacattatcatttcgaacgatgggtttgaagtccattggagacgtgtaagaaccgtaggttagtagagagcatggcatttacacgtggaaccacagagaatagtttagctgttgaagcatacgatgcttgatatggctttcaacgttcaactcttattttatgggtttggacgcaaaaaaaaaagtaaaaaatattgaaaataactcgagcctttaccagctgattaaactacccatatgattcaattttgatgttgtcaacttatcgctaaccctgtcattactttaatacattaaaattaaacaggtatttcaaatttgatatatgaaatatttcactcgattgaaaatttcagtttgaaaaaggatataattttgttttttttcttatttttattttttggcttatttctactggtttgtaatatacttcctctattctttaataattgattttctaaaaaaacacacatatcaaaaaatatattaaagctcattataaatatattactttttgtgatttatattttttataattttaaactaataatattagttatttattttaaaatttgatattcatcaattataactaattaatattgtataaaaatctaaaatattaatatttttgaaacaatttttttcaaagaaaatcaattaataagaaacagaaatattattttgatcccagaagttacagaggatagtgattaaatttttagttggtgcagtattttagattattaaaatataatattattagcgtggaacatatatatccatgagtactgctagttgacaaaactgtatccgttgaaattgtgatattaatttcatttgttcactagtgactagtgagtaaccaaagagatatgtatgatggtattgtatttgcatctaggtcttttgacaaggcacaatctaactttcctctgatgatatttactttttttagcaaaaagtaataatatttggtttagctagttttttattttagttattatatacttttttgacgacaattgtgagtatataataacagtcaagtattagtataaaaatactgactcctcttgtaagcaatttaacaaagtaaacgtttttttaacgtttccgttcatcataatactaaatagctcagatctgattgtgttacttgcaaatataatacgtttttgctttcagagctacagtatgttgtccacaacttcgcaaacatacttttaaataagagtctagaaacgcttgcaatttgttaaagagcgacctaattaataaataaacgtgagtttctagtaattactgatgtaattaaaatgatgcgtaattataaaaatatacacctgtttttctctagcattctcgaacggtatttaattttgccgatttgcatcgttcaattaactatatacaacaaagttgtttcctaattagactccatatataattggattatcaaacaaattcctcaattccaaaatgctttcaaaatttgtattcgaaaaataaatttacaaaatggtatcgatgttaaaattatgaattttgaatagaagctacaccattaaacaattttcatcaatggtttctcattgaaaaactgttcaatataaaaataaaatataatcaaaaaatatgaaaaagaatataattagtttctcaagtgagaaactttaaaaaacgcataaaaatacttgtatatcatctattgatcaaatattattttattattaaactttaattatataactaatatttattaaaatactaatattttttttttttgagaaaccatgaaggtattttactgatagagatgtttttagctaaagctttaacttctttttttgaaaaaacaaaagctcgaattaggcgaaaaaaaactagaaaagataaaaaagatttcaaagaattaaagattctatataatctttctcaatcaatttatgagacttctcgatcatatctattagcatggattatagtgatcttttgatatgattttctttacattttatatatgtgtatatatatatatatccccttaaataaatatgtcattaactcattatcttccctcactcgacatagttgactggtttcttgtcgccaagttttgctgcccaactataaatatgtgctgtgctcatgcactcttcaatataagtgttttgtgtaactaaaacaaaat

SEQ ID NO: 12625 - DNA, 3000 bp, Unknown
  misc_feature (1)..( 3000): cDNA_ID_1807035_gDNA_ID_2214563_Annot_ID_134903 3000 nt of promoter + ATG
agcaacccatgccatagaggcgcaaaaacatgacggtaaaccccagatcgcggaagcccaagttgaggccaatgaccctgttgtagagccccagcaagactggggtggccgtggtggttgtaggtggggatgttgcggtgggtggtggcgtggacggtgcagatactgttgcaggagtcaagccgaggccagcgaggttgtggaaactgttgagcccaacgatgttgagcctcagcagggtggccgtggtggtggcggtggtggtggcggaggccgtggtggttgtaggtggggatgttgcggtgggtggtggcgtggacggtgcagatactgttgcaggagtcaagccgaggccagcgaggttgtggaaactgttgagcccaacgatgttgagcctcagcagggtggccgtggtggtggcggtggtggtggcggaggccgtggtggttgtaggtggggatgttgcggtgggtggtggcgtggacggtgcagatactgttgcaggagtcaagccgaggccagcgaggttgtggaaactgttgagcccaacgatgttgagcctcagcagggtggccgtggtggtggcggtggtggtggcggtggccgtggtggttgtaggtggggatgttgcggtgggtggtggcgtggacggtgcagatactgttgcaggagtcaagccgaggcaaacgaggttgtggaaactgttgaggcccaacaagctaagccatgaattgcgtgtaatacaaactctctatgtttgtatgcatgcatagctaattaccattacgtacgtatgtcaaaataaagcaaaaatagtacctaagaaggtacctagaggtcaataaaagaaaacgtaggttcatataatatgtattttgttatgtagtgtttcttttctcgtggatgttataaataataacaactgttttttaatttattttttgacaaatttcgagtcataaccaattcatattatacgggtaacacaattgagttaagtcaaattccgataggaaaaacggaataaaatggacttaatcatttgagtaaagaaagatccccaaataataacaactgttttaataccatggattataatattttgttcacagtttaaattatgaagaggcatgcatgtagctaagctagctagctcaataaaagccataggttaatataaaatggaaccaaacagaattattatcctaaaagttaagaataaagaataactgattctactataaaatcgtaaacattaaaggtgctgctgtaaaatcatgtattcgaggggaatatctcgtctaattatgtatgaatcaagtatatttgtattaatcaattttagtttctacattagttacttgtatgggtgtttttaaatggatagttttaaatatataaaaaaacattttctgtattcctaaaaagtttgatgttctagagttttcacatatattcaaaaataatcattgtttaattattggttaatcatttttaaaaattaaatattttttaacaattttgaactaattgtagtataaaatagttaatcattatgtcttaaaatctaagatttattaatattaattaataaaaataaagtaaaaacctaaaaaatcaatctttatgtaacaaactacaaacacgtaaacatcaatattttatgaaaaaagagagtaaaaatatgagtgtatttaaatgagaactgtgtcttcttagagacatttaaaactcctatttttgggatatttttaactttactattatttttcgtgaaagatatttgtgaaaaattgttgaatgaggatggtcaaatagatatacccagttatccacttacattattttcatgtttctttttatttgtattttcattttttttgtggtttcatttcttaccttccaaaacttccgaaattattcgaaattacgccactactctcggtcaacctcacgacgatgtcgttccttttgtacttggcccaaaccgaatggatccagtccactggcagttccaagccacatgttcaatatgcctacccggctactccgaattctggatctatttctgttgtcggataaccccaaaagcctttccacaaaaatttagtagttttcctaaaatttagacgttaacccagtaatataggattccacacgtggtggcatcgatcgacaactataaagtaatcaccgtttttactccaaacgatgcctgcgaatgctatgttgcttagaacttggaagagtggtcaattgtttcgtagttgggtcatacttcattagtctaccgattctgtctccactcatcgtactatccctcaattaatcaattaaattaacaattacgagctaatccatcatataaacatgctccttttattaatataaagtataaacatgttctttgtttaagataatataagataattttaactctataaagtagataacttcggtccgtggatcgatatcctatccattggtcaatcgaagggcttcattcagctcacatgacaaaacctgattggttacaccacatgttgtgccaactttaagaaggcccgtataagcatcggctatatagaggtcacaagtggatttgtcaaaggcaaggccgaacggacgaacggtcgtttttggaatggatagaagctaacattatcatttcgaacggtgggtttgaacttttaagtccaagaataggactttgtgaccactggtggacacgtgtaaacacgataggttatgatcagatctattatatatggtctctaaagatcatataatttttttttaacattttcgttatagaaatatccctataaatatatatgccattatcttcgatcacgcgacaaagttgactggtatcttgtccccaagttttgctgcccaactataaatacatgtgctgtgctcatcatacacttcactaacaaaatcatcttccctcaataaaccaaataagctaagtgttttgtgtaacgaaaacaaaaa

SEQ ID NO: 12626 - DNA, 3000 bp, Unknown
  misc_feature (1)..( 3000): cDNA_ID_2709268_gDNA_ID_2214563_Annot_ID_134904 3000 nt of promoter + ATG
cggtcgcatcctcaaatggagcggtgaagatcttggctggattgaattcgcctactcatctccccataggtttgttttatttatggatgaagtcatgcaccaataataagtagactgtttcaacgcaaatatttgtgtttgattatattactggttaaaattttatatttatatcttggttattatatatttatatctttaacaaacattatacacatttttttggtaaatttaataatgtttgaaaacacttaattatcaataacattggttatagacaacacaattatttaactatattttaattttgtgttgtaaatatatgaagaaaaaattgttcgagccataaggtggaacctgcgtgtggaaggcctttgggacttagcttcgagaagaaatcgggagatttgtatttttgcgacggttacttaggggtaatgaaggttgggcctaaaggaggattggctgagaaagtcgtggacgaggtcgaaggtcagaaagttatgtttgcaaaccaaatggatatagatgaagaagaggatgctatctacttcaacgatagcagcgatacgtaccacttcgggtattataacatcacttctctaataatttttttaattaaaaaaaaaaaactgaaaccaaaaaaattggataatttttagtgttctatgttgagaattgagatggttagaaatgataatttgcatgtttgtattttataattttacaaattgcaaaccacaaatgaaaataaaatttctccttctaacgtttgaggtttacaattattagataaaatctttgttttaaattatacttaagattgtagcttcatcatctgagaagaaagatagtaattaaccttcaggtttttaatgttcgctcgtgtttacaactttttttttttttttaaacgtataaagtaaaagaaaaatgttcttaagacaacaaaatcttaatgtggggatattttgaaaatgattttttttttataaacgttacattattatttggagcagggacgtattctacgcttttctgtgcggtgaaaagacaggaagagcaattcgatacgacaagaagacaaaagaggccaaagttataatggaccgtcttcatttccctaatggtcttgccttaagcatagatggttcgttcgtgctttcttgtgaggtcccaacgcaacttgtgcatcgatattgggccaagggacccaacgccgggacccgtgacatatttgcaaagctccctggctacgcagataacatcagaaggaccgagacaggggatttctgggttgccttgcattccaagaaaactccattttcgaggttatctatgatccacccgtgggttgggaaattcttcataaagacgttgaagatggagctcttggtttttctttttgaaggagggaagcctcacgccgtggctgtgaaactttctggcaagactggagagattatggagattcttgaggatagtgaagggaagaatatgaagtttataagtgaggttcaagagagagatggtaggctctggtttgggtctgtgtttttgccttcggtttgggttcttgaccgtcaatgatttatacgttttacattatataagtttctcatgtgtgtggatttgatgataattacaggtttaaacgttaaagtttttgctgtatccggttagatatgcatctaaatacatcaaactcttgattttattaatttactgaaaatatgggttcttttttcttgttaggtaattttggtttctttatggttttctctccttttaatccgaggacccatttttgagtttgaatatctttagagtttgttttttttgggtttattcttgcagatgaaaatgtttcttttaatctttgtatatattacttcaaaacaaagatatgcctatttatgaaaacaaaacaaaacatgtacgtatctctatgagttttcttttaattaaaaactttacaagaaatttgaaacttgtgagtctacgaaccggcttgcgcagtccacttaccataacaggcagtattagagtgggatatttgtaaattgaggaagtcactgcctcactggtgacagtactttgtagatacctttctttaattggttctgatgtgtttggaattgtttgtttggaaggatttgataacaaataaaatacaagcaaaaaaaaaaaagatatggtcagaactcagaaggcaacacaacgaataggttgccgagtggggctcatgccgttgattcttctgctcactgccccttctcctgtctattcacttcctttgtcccttatttttatctttatttttggtggtgaaaatttatgtttcatttatacaagctaaaatgtttttgttataagtcaaacaaaaacaattattattaataatattggaggcttttattgtacttttggtttgaaattttcgaaactacgtctcttaattctcatcctttgatattctgtgcaaatgaatatttattttccatatagatagatattattttttttgttggataacatttacactttacccaaacttgtaaacatgatttcaccaaaaaaaagcttgtaaacttgaatggaaaaaaatcagagtatataaaagatagtcttaaaattggacaatgaagtaaatgtggccctcaatatccggcatttgcaagcaaatcataccatctacatgtatatatactaaaatgaaatgctttattaggaaggaaatctttgaacagaaaaatagaaataaggtaagacaagaaaaaataacaatgaattacaatccacaaatcccaagaatgagaaaatttttaatttcctaaagaatattttgacacgaattcgacatgtataagataaaactattaattatttcagacgcctatatataaccaccataactcttactctgttaccaccacaaagacaaaacaaaaaaaaagaggaagcaattactataggggaaaaaaaaatctgaacaaaatg

SEQ ID NO: 12627 - DNA, 3000 bp, Unknown
  misc_feature (1)..( 3000): cDNA_ID_2709272_gDNA_ID_2214563_Annot_ID_134905 3000 nt of promoter + ATG
gattatttattataacaaaatctagaatccatgtaatagccaaacaaaagtaaatatttgacttgttctacacatataataagtacatccgatctttacattgaaattttcatactctgtgatttgactggttgaaagaaacgtattgtgtaattatcatatcttattcagcgaatattttgtatttgacttgtaattttgatattgttctatattaagtacaaaattatatccatgtgcataataaaataagattaaagattggtataaatgcaaagtcaatgtcacgaatattactaacgcatagagagacgttggcatgtgacatgatagaagatacggtggatcgtatctggtggcgtccatctttgctttacatatatagactattttatgattaatactaaagttataaaaacttttttctaagggagttttaagaaattaaactttaattgtgtaatatgttaacgttatggaaaagatgttacttaaaatcacccaattaatagaaaaatagtatccaatttttgaaaacaacaacaattgatgcgtattacgagtggttgtacccaatcggtcttatagttgacaaaatatgtaaaacaattctgtatcgataagctacactattattagtatatgtctttatttgtttcggtgtgtataaattagtatcgaatcacgttagctcatcgtgatatcattaacaataactagattattatataaaagaaatgagcttatgttcttaatacggtgaacccaaacctcagccattatattaaaaagatacgaccgtacgttgagatctattttgagaatatgaacagctcgacttgtcgacaaaataatatgaaaaaccgagttaataacttttgcatattccgaaaacttcggttgcttttagttgtgcgatctcaaattttcactgatttttgaatagaaaacggtttatatggaagtatatatatcatgtaacataatgttagcagaaacatattgttagcttttagtcctacaacacaaaacaggctactgtcaaggttaggggttacccttacgtattttagcgagaatattttaccgaataataccatttataacattgaaaaattaatcattaaatcgtatggctataatcaattctctacaaatctcatcgttttctgttttcctattgataattttcacaatttataaactacgtcgttttatctgtccagaaaaataaaacatttatatacaaaaatgtattgtatgaaaatttaaaaatatattccaaatttctactgcttaaagaatcccaaaaggaacaaaagaaaaaacgagtggctatctcaagagattagaatcgttcttgggatcaggctttattcaaatggcattttgtggaaaaggctatatatgacgtaattaccattaacctttttgaatggttactatatattatatacgaactcttttacgtgtaaattaaactgggataacaaagtccatttcatgtgaattttaattaagttaaaatgtagatgatccttatttttcctgtcccaagatggtttcatcattagtctttgatctgtaaaaaaataaaatactaaaccgaaatttaaaatgcccttacaagcgatgttaggacacaatagacggtatatggccagtgcccctccgatagagcacaaggccaagggaaagcaaatattacacaccaaatctttatattttatgttacgtatcatataatacaataaataaataaaagattatatgattatgttcgtgtaactctaccaacaaaaaatctccagttgattataaagctaacattaaactcctttctaaagccacaactaatttatttggttggtttagaataatgttattatataagggtgtagaccaaaatcaatctcttgaaggagcgagcaagctagggttaaagagatcgatgttggtctacatcgctgaccttaatattcataaccatataaatattatatattttaaaaaatcataaacgaaagttacataaccaggtaagagtaagatacggtatacggtattaccgcgattattgggctgatctggacatgttattgggcttattgaacttcaaatacaagtgatgaggccgcatattctattttcctttttggtgttatgatcgactaaacaaagaaacttcatacgctaaaactgtataacttccaccaacgcaaacaagagccaaaaaccaatatttctaaacaaaccaccaagctcaccctcactgcatatctccttctccgaaccacctttagccgaaccattgatatagtttctcaagcgatgacggatccgaattgacggcaagttatgtgtgagccgtgaggaatttgatgcattagtgaactacttgtcgcaacttataatcttgtgggttgcaaatagggttttaatgttaaacatctttctaatggttgtcttaatcggtaagaaaataaactgtaaaagtgctttacaaaaacgtgactctttttcttttcaccacaaacagaataattctaacataagacagagagacacacgtcacaaagtgaaaacaaagtatccccatttaaattaaaacagtttaacaagataaaatacaagtccgattttttcatctcccaaagattctcacagttaaaaatagaaaatagaaaaagtatatattctcacaatgctataaacgcttgaggagcatctgatttatcaataaagagaactaaaactttacaaatccaaaaacaataaaattatataaatccaactactttaaacgattttccaactagaaatttcgacttgatgattatagtgtcactgttttgcgtatctttatttaaatctaatagtctcatggttcccacatgttgaaggaacagaataactaattagaaaactagtacttatttatcgataaagaaaaatattattcttaaagacaaaaaacatgtaattaaaagtagtaacatg

SEQ ID NO: 12628 - DNA, 3000 bp, Unknown
  misc_feature (1)..( 3000): cDNA_ID_2712373_gDNA_ID_2214563_Annot_ID_134906 3000 nt of promoter + ATG
ataaataatcggaaaacgtttttatcgtcgtcaaattagtgagctcagaatacgactcattaagtcatgacaatctgataaagacacaaaaagattccaccaaccggttgatttctggttaaataagaaaaaaaaatgtttttctttttactgttgaaaatattgagacacaagagaaatacacacaaaaattgagagctgctaccatgagtccatgaaggccaaaaaagcccgaagacaggggaaggtgctggtcaccgtcagttatattatctaaccatttctaaagattattaaaaatattttatccaccacaatgtgtgatccgatttacatcgactcacttaatgccttcatttaccgcacttgttaatagacgtcttgttcttcaaatttgtccattttgtaaaattgtagggtcaaaagttgtgatgatgaagttatgaatgtgttgaagaggaggaggggtcctctatcatcaaagagtcatggacggttgtgctgaagtttcatgagacaagatctcgatggaagatctatttgactctttttttagggtttttttgaaattgaaagcatgtcttcccgacacatcgtgcattacaatttcatgatcactccattaattcatcaaatcgcttttatagtcaacgccatgatcctttgactcttgcttcttgagctctacgattgctggactcaattcttttttccgatagtttttcagtatggtggtacatatatgttttggtggtacactagctagttttgtacacataattttgtggcggtaaaaaggtgaaacgtgcaatattagtttaagaaattgagattactaggatccttgtatcatagccaatggtatgtcaacaaacaaaaataaaagccatagtcttatacaatggcggatccaggaaataattttatatggagcacaattataaaaaatcaataaaaagacatagcaaggcttgaacttgggttaatgtggggcaccattaagtaaaataccactacactacatacatttttaattacataatgcaaacttatataagatttatataattgagtatcgggcacatgccccacccaagaccaacgtgtgtccgcccctggtcttatacattgtcatattgctgcggataacaaataaaacaacaaaaattgactgtatagaaagaaaaagaaaagagataggaaatgtggaaagtgagagagcaatatggaacccactagacccataagagagtattggttattggacggacttttcatgtgtctaccatactttggatacgtgtcgtccatataaagatgatgattgatgatgatagtggtgatgatgggcatgaccatgggaggcaaatctttggcagagaatcaagtgaacattgccatgtctttgccactaccacactacctaactatttagtaaattttcttattcttttgccaacgaatctgatcgccaagtataatacgatgagcgcaaaacactatttcacatttaggttacattttttttatttaatactgttcgtagatgtaaaagcatttaaaaatagtatctataatacttagaatataaaacatcatttatactatatattttatattgtggatttttaacaaatcccattaacaagagatacttgtagcatgggaacttacaactaaattaccgttatactactattttcctctctaaataatacattcatctcttcttatttatctccaaccactaaaaactttgactggtcatataatttttatgttaccaatcatcataattaagatttaccaatttaacttcacaaaaaaaaagatttatcaatctaatttactgattgagtattacaccagagaccaaccacatttgtactaaaagtgagaaaaagaaaacataaaaattatatccaataagtaaatgatacgcagcaaaacacgtcacatcgactcgcatatgaatacacaaaccccacaacataaactgctaaatagaaatagggacgatgttgtggtccgacgaaaatcttttccactagtcactctttcaatcaggaccattacaaattatttcgaatgtttgtgcagagtataaataaaaacaaattgaatattgtaaatacatcaacgatccaccgtaaaaacattcaaaattctattccttttttttttttttgggatttaaaccactcttaacattcaaaattataagcaaattcttaattaggttcaacgattatttgatcggtgacatcccagcagctcaataaacatatattaaaatcgaaaataaaaaatactgtcatcacaaaaactcgttattatttaatctcttttaaaacatcttgttttcgaacatcttgctaactaatgtataagtttttttgtttttttaaacgttaaactacaattctttttgacaatgaacggttttttctatatatatatattttcaaatggctgttaaaacccaccaatagcaatgcatgtggttgtggtagtatacacattattaaatccctcatcctcttatcttaaaaaaaaaaaaagtctttggtgggctaaacaaatcctttaaaatcttcatatagatttctttccattatttattttatccattatcaaagtcttttttttttttaaatttctttctctcgttgtctccttggaaattactttcatcatttaaaaaacttgcttactccgtaaaccaaagctagatccaattagtcttatttcctttttattcgtctctctctcactatccgagatttgggttgaaaaatacaaacccccttttatttctcctcttctctcctacaagctcattcagaactctcaacatttccggtagagaaaaaaaaaccgttttttttttaatctctttctaaagaaggatatcaaaacaaaacacaaagttgaaaactttgcatctgggtttgtctattttagattcagatcttagtttttttcgattgaatatctaca

SEQ ID NO: 12629 - DNA, 3000 bp, Unknown
  misc_feature (1)..( 3000): cDNA_ID_2709280_gDNA_ID_2214563_Annot_ID_134908 3000 nt of promoter + ATG
tgatatgtgaatttggactatattcgtccatttgatgagttacattcctagagtctagagattcagctgattttagttgagaatcattcaaatagcttaaaaatgttacaagactaattgtaggacgagttatgtcagaaacttgtttcaaatttgacatgaagaaattataagcaaatagtaagtaaagatttcacttcctttttctgttggtaaaagcaaaaaagtacatacatattgaaatattctaaacaaatttagcgcgttggcttctttctttacggataagttaccaagatttccttctttttatacataaaagaaactaaaataacttcttttgcccatcttgcttttgtttatgatgatgatgatattttctttatttattccagttattaaaaggcaaagtaccaaaggaatcttcaatgagtgttccttgtgcgattcagcttcatgtttattctcatataacagaaagtatcagtgcacagcacaatttctctaacagtaaacttatatccaacttttactttgtatgtgtcgtcgggatttgaatgtgtggtatgatattttattttagtcttctataacaattaagtttctataaggttggatattaatttgctctgtttttattaccctagaaaaattatattagtgggagtcattggctagttcacgtttggaagttatgcaatttttgaggatcttgacagtttactttctttgatttcagttataattacttttctgaaattaagctctaaaaataaggatcaaatggatacttaccttagttatcaaatcaaagcaaattcgatatggacgaatcaacatcacaatcgtcttctttagtgttttcaccatcttccacctctaacttacttagacagctcctttccacctgtttcttctctctctgtctttcttttttctctttcttcttttatattctccgacaaaagaaaaagtacaagatacccagaaaaagagtgtagaaactacatttgttcttcttctctgttctgcttcgaaattatgggttcctctgtttctaaaaccgcttcctctgcttctgcttcttctataacatcgattttgaattcacctccggagacggaattcaacatcccttcttcatcggtacctaaagctttcacatttccgatgccgtcgattcatcatccacctgctaaaaaaggcgacacacaccactttgtctctcttacatcgaccacttacggttctcttgttctcgacgacagacaaacattgcctcacatctccgtttccgggaagagtaacaagaagatgcctgaaacagaggaggctcgcgactcgttctctcctgactcagtgatcaacacatgggagctcatgaacgacctcgacgacgaattcgattccgcgaattccgatacaagtaagagtaattccgtcgtaaatttggattccttttctaaacccatcacgaatcgagacgtggttattaatgggtctgcgtatggatcttacgaagatgaggaagattggagattattgccttttaaacctaagcaacctctgtggaaacatatgtctgaagaatcatttctctctgatttagatcctaacattatctcatcttacaaaagagcactgtcctccaaacagctaggcaagaacagtagcaatggccactcaaatcattcggttttagtcagtttaccagaatatgtatcttctagtccattgagttctcagacttcggaaaaagaccaagagaaaccaagattgcttgaaaaagaagataacgagaacaagatagtagtatacttcactagcctcagaggaattcgaaagacgtatgaagattgttgttgcgttagagcgatattgagagggtttcaggttgcggtagaggagcgtgacatctcaatggactccaaatacaggaaagagcttcagaatgcactcggcgaagagaaaccggtttgtttgcctcaggtgtttataagaggcgtccgcattggtggaattgaggagatcaagatactcaacgatggaggtgaactggcagagatgttaaaagattttcctgcttgcgaatccattggagcctgcgatagctgcggagatgcaaggtttgtgccgtgtactaattgtggcggtagtactaaagtgtttgaggaacaagaagatgggtttaagagatgcaatggatgcaatgagaatggattggtacgttgtaacaagtgttgtctttagtaattggattcgtttgagtgatgttgttgtgaaaatgtgaagagaagaaaaagaatctaaagatataacttttgacttaagatatgtttggttggttgtgttctttgaatgatttgtttgttttcatgctgtatattataagaagtggcctaaagctcaaacctagaatgtcaagcctcaattgtttcttcacgttgatctttgtaatttacatgttataaaatgatttttttttccaaacaaatacaaacaggatgaaaatatttatgtaaacctagaactattttatttctttgaaaataatagctaaacctttttttaatatggatatgcaaactgaaaaattagagtttgctgttttggccttttggtcttgtacaaatttgtttttgttacattttacagatgacctgttacggcagtagcggtaacgaaaatgttactaggcattccacagtaattgtctcttaacgtcatctactatcttatctcttctagctattttagtatggcttaccatttttccaaaaaccagtgtcactaaagttacagaacaatcgcctttgactacatcacctgcttgatcattggctaccatccaagtctgtttgtaaacttcatccgctgtcacggtaaaaacgtcacgggtaaactgattattgaaaacgacaacgggtcttatcatcttcaaacccctcacattactcaagctttgcttccttccccgagaccgagagagagagagagacg

SEQ ID NO: 12630 - DNA, 3000 bp, Unknown
  misc_feature (1)..( 3000): cDNA_ID_2709291_gDNA_ID_2214563_Annot_ID_134911 3000 nt of promoter + ATG
cgtttaaatgaatacaataattcacttgcgcaaactaggccaatcacgacgattgtgtatttcaaacttttgtctatatatatacataaatgtatgatactaatatgatgtccggaaaaagaaacaaaaaaaaccgagaaatagaacattttgatgatcataaaaatcatttcattgagttcaaaaaagaaaagaatacatatatatactactacattttgaagaaaaacagagtaagaaaaatgtataaaattgaaaagaagagagagagaatgaaaagacaagtcaaacgtcaaatcgaaccacttccttatcatacgactgtcagtgcccttctgtgttgtcattcttttttctctttttttttctcactttccttttaccccaaaattaccaaacaaagagagaaatagcttcttctttttttttttgtcaaaataattatcctctcacacgtgtgctctcgaacgcacgacgtagataacaagatgtcaagatgtatgccaaaaattttgttcgtacaagaaatcattccatcatctttttcattacatcaaaaaaatctcataatatgttttttcttttcttcaagaaggcatcgcaaattagatgttatagagttttatcaaggttttcacatttatagcaacaaacactatatattcgatgggaaaaaataagaaatttcccttttagaatgaccaaatcataaattaattcttacataccgaatttggttataataatgagaagaaaaacaacaacaagacggaccctatcgatccggccgacacgcttctccatgtccgtcccactctctctcccatccatgtgtatttttttctgaaattattattatttataaagaaaaatgaatttaatttaatttgattggtccagtccaactagttaaatacagctttctcaactggtgaatatatatatgggttcggaccacgactgcgccattatcagagccccgtcttgacttctgtggttggatgtttcacattaatttcattctctacctgattgatttgatttttgtatgttagaagaataatagctttgtttgatgatttactactctttgattttttttccattaacatatatcttgataatcagttaatcactatatcgtatactattgaagtttaataatttacaaaaaaatgcatttttatgataaaatttatataaccatgtttataattttaatttaaaaacaataattttctaataacttgttttgagctactgacaaaaaaatatcaccatatttatgataaaatttagagcttgatttttagtttctacatttaactcatcaaataattatatcaagaataaaaaacatggatcacacatttaattaaaaattattggataaattagtatttaaattatagacatatatagataaaccgcttaaaaaatgttttaacccatagtatttcttagctccttgcccttttctttgttattctattatgttgccatctagtgcagttatccttatttatgaaacgtatcttacataatatacaaaatgtttaacattttatgtatagtattataatacatgataagtcctttaacaaaaacaaaaaaacatgataagtcatcataaaacttatataaatttactcgactataaatgaataattcaatccacaacaaatgcaaatacctttaacaaaaaaaaaaaaatttaaaatatcatcaattaacaacatgcaaatcagtaagaaatattgaattcatgatatgtagtaagagaattttcaatgaatatactccatgttgtttacaaaatttagggattatatctgtacataaataagtaaaatttcgataattttaggctaatcttactaggattagttttattacagttgattactaagtatttactaaagtaagaaaatccagttcttacgtaaaatcaagagaccaaaattttccttcccggatcttctggttagaaaaaaaaaaaaaaaaatagaaggtaaagtaaatttaaataagaaaaaagaaaaagtaaagaggggcaaaggaagatggtgaggattggtccaacggtcaaacagaaaaccatcaaatcagatttcactacagttacgaaatttatttcactccttctgtcttttaacttaattaggcctatgttcttatccaccatcttcctctctttttttaccattttatcccatcctccatttatatgtgtaacgtatccattgtgttgctcaggctttcacatggttctgtatcaagccaaaaagacaattgccgaggatcttggatttattatcttatcaccctactactcaattcatatccctcgtttgtttggaaatcagatttaagtaggattttcattagtcaggtgctaatgatatttcattgtttattaacacttttattaaaattctctcgtttcaattatttccattttccattaatagatttggcccacctttgtattcttttcttcttaataattgttttcctattttagtaaccaaatcactaaatttcaattcattaataatactttaaccctttttataatcagcatcaagacaaaacactgaaacagttataatttttttttaaccatcttagtttaaatatctgagccgcccggttcatccattcaaatctctctctcacttaccaaacccaaacaaatatctaacaccacaaactcaaagcaataaagaatccttctctctctctctttctttctttcttctttcagagaggaggagcaagaaagaagcttcaaaagaacaaagcttaagctttttcccccggaaaatttgttcccctttttcgaaaaactaataattcgtaacttcatagccaacaagatcaataaaaggaggcaacttatttctttcattctctcttgtaaagagtacttgctaaaccctagcttttgttctatagagaatccaagaaccaatcaattttttattttataaaaagatg

SEQ ID NO: 12631 - DNA, 3000 bp, Unknown
  misc_feature (1)..( 3000): cDNA_ID_3025902_gDNA_ID_2214563_Annot_ID_185933 3000 nt of promoter + ATG
ggaaaatttagggttccaacaaaaacgcgatcgcattacccaaaaattcaaatttgcaactgatttcgtcctgtttgaatcactccaattctattgctttcttcgtcgtttgatccaaaacagtgagaagcgatacaccattttttctgggtgtgtgaatttttattttaccccaaattagattagagacgatgagcgacgtcaccggtgatctcgcggcggtgagtgaagccaagggaggttctgacgccgcccggatatcggaggtgaaggcgtggctcacctctcagttcgaagctgtcggcaaagaagtacccaatttcgagtacactcatcgaagcattacccatttgtataatctcgctaccgcttctcaagctaagtctcaggctgccaccattgtcgctaacgattttcgtctcaaggcttcagaatatcgtgctcaaggtacttgcttgtaatccttagctcctaatttgctcgcgtggctgattcgaattatgaaaatcttcttttgggcattatcagtttctgatctgttactatgatttcaaacaaagttgtgtttttttggaaatttccaagttcctctctcttagatctctgggtggaaattttgttgatgtagcggctaggattagagagatattggagagtgcaggaatgtcacaagagagcttaccgtcaaatgtggtctcttcagctcaagttcttgcaaatgtggctaatttgttgaacatacgggacactgaactgagcaggtgactgtactgttagctctctcattagatgtgttgctatctcgaatcgggaaactgatgcagaagaaatatgtatagtttccttgtagcaatgggagacatatctctgaggaagactggagtggaagagaagagggctaaagcacagaaggagtccaatgctcttcttgactatacaaggaaagcgatacagaggctgacgtatttgaagaagtaagtttcgtaataaagcaccatataacttataatatgatcttggtggtggtgtacatgtaaaccttgccatttttcctttgggatgtgacttatctaactttatctgtgtgagctgttacagaatccttgcgcagctagaagatgatgtagtcccttgtgaatcacagatggagaactggaaaacaaatttggaagtgatggcggtgaaggaggaacaatacatacagcagtacaagaagtatgaggtagactccttcttcttttagtttttacattctcagttggtaataggtaaactgagaatcagataccttcctgcaattagctctggtgaggggtatttgagaatcatatacttttatgtaaaaactggaacaaaatggattgttctgtaactttagtgccctttagtgacactggtttttggaaaaatggtaagccatactaaaatagctaggtgcttttgaaacaggatggattagtaagggttgctagtaattgaggatttgattctagggctaaagtttttttaagttttgttactctcatatcataaaaacacacacacactctctgattaagttctagatcgtatcagaaatgcagtgatgatgttcactaggtaagtcaatatgagtttttgaagtctaatgtgcttctagtggtttgttgtgatttatatggatgatttggctccttcaaataatctgacagagtcaagatgaatggttttgatagcagatgttactcaatcgtgttggctacactcctaagatcagccacagagagctggtagaaatggcagagcaccggaaggaattggacaagatgacaaaaccagtccttgatactctacgaagctaccaggatttacctccggtaatcttcatctctggttctccaagcccttattgatctgcattgtcaatctcctctttgttattggtcattgctagtcctggttcacagtagattggttgttcatttctgtaaacaggacaaagctttagctgcactagcaatcgaagacaagaaaagacagtttacagccgcggaaaagtatctagaagaagtattacaatcagcccttgagacaaacgatgagtgatcgatataaaccagaaaatattatgttttgggaatatgtaacatatgttttgtaatgcaacaatctctcggttattaaactctactggtgagatagatcattttcttgtttcagcagttcttcagtttgtctttgcagttcttgagtccgggcattagttgcagctgtcacttctcttataagcgtggtgattaggggaagtaattttttgagttcagaaaaactcaaatggggaattctgcttctctcatactcaagaagatgtgcaaaatcaagaccctgagcgatccacttagtctggtcaagtcgtttgcgaagaagttcacgttcctcattgtacttgtcatcatcatcttcaaacacaaaggatcctcctccattaccttccagtacaatttttgcatgcttgacaatcttttcagttctgtcatgataacaacaattacaacacattcagtcacaaacaatttacttagaacttcaacgaataccaagatccaggaaacatacgtgaagaattcgttctgaatcttaaccaacacaatctaagatacatgaaacatacatgaagaattcgttctgaatcttaactaacacagtgtaagatccatgaagaaacatgttgaatacgaatcacggatctgaatcttaacaaaaccaaaaccagtctacgattccatgtagaattcgaattcgtatacagctactaccgaatcacgggatcttagaactacaaatatgaaagtttccttaaatttgcaactaattacttccaattctattagaactagatccaaaactatatttcttaaaaaattaggtattattaaccctgcgcagacctgccccttgcatggctgtttagtttctctaacttatatagtcaaaaagaaaatctgaaaagacgtttgatca

SEQ ID NO: 12632 - DNA, 3000 bp, Unknown; identical to SEQ ID NO: 12629
  misc_feature (1)..( 3000): cDNA_ID_2709280_gDNA_ID_2214563_Annot_ID_185930 3000 nt of promoter + ATG

SEQ ID NO: 12633 - DNA, 3000 bp, Unknown; identical to SEQ ID NO: 12628
  misc_feature (1)..( 3000): cDNA_ID_3025914_gDNA_ID_2214563_Annot_ID_185927 3000 nt of promoter + ATG

SEQ ID NO: 12634 - DNA, 3000 bp, Unknown; identical to SEQ ID NO: 12626
  misc_feature (1)..( 3000): cDNA_ID_2709268_gDNA_ID_2214563_Annot_ID_185923 3000 nt of promoter + ATG

SEQ ID NO: 12635 - DNA, 3000 bp, Unknown; identical to SEQ ID NO: 12625
  misc_feature (1)..( 3000): cDNA_ID_3025927_gDNA_ID_2214563_Annot_ID_185922 3000 nt of promoter + ATG

SEQ ID NO: 12636 - DNA, 3000 bp, Unknown; identical to SEQ ID NO: 12624
  misc_feature (1)..( 3000): cDNA_ID_2709265_gDNA_ID_2214563_Annot_ID_185921 3000 nt of promoter + ATG

SEQ ID NO: 12637 - DNA, 3000 bp, Unknown; identical to SEQ ID NO: 12623
  misc_feature (1)..( 3000): cDNA_ID_2709263_gDNA_ID_2214563_Annot_ID_185920 3000 nt of promoter + ATG

SEQ ID NO: 12638 - DNA, 3000 bp, Unknown; identical to SEQ ID NO: 12622
  misc_feature (1)..( 3000): cDNA_ID_2709259_gDNA_ID_2214563_Annot_ID_185919 3000 nt of promoter + ATG

SEQ ID NO: 12639 - DNA, 3000 bp, Unknown
  misc_feature (1)..( 3000): cDNA_ID_2709295_gDNA_ID_2214563_Annot_ID_185936 3000 nt of promoter + ATG
caaactgttatggtaaacatgaatgcatagatagatgattttaagtatgcgattaaaattttgttgggatgcaaaatgaaatatgtatgacaagacaagacaatggtgtgtgttattgcatgtgaagagatgtgatggtgacttcaatgacttgacctctcaatctcctcctctctctgtctctctgctggtcctctcttaaatttgttttcttatttttttctttttcttataactaattcgattttttttaatgaagctaagctaccaaaaaaccatctcctttctaattttcgctatagtaattaaatgatcaaaacgcaccaaaaccaacacccatatgtttacatgcatagaatttaaatgtaattcatattatatactaattagcttctttttttttgcaactttttgttttcttatatagcacataaatttttgtaccattgcctcttcacttctatagcttgccgaaattaatataaatattattattggctatttattttgttgtcaatacttttcttgtaggtaataataattacatgaactttttatctatcacatgagactatgagaggtcccttcctagttatacggttatgcgaaaatagcggctttcaaaaataacggtacggccgaggcgtttactttaaacgggctccgtttacttcaagtctgtcacaacgttcgtcacgtgtcattgaacacactatcacctgactagcttaccacaccccagaccaataattattgctctgttactaaacattagccacgtaaaagtcttgagtttaagaaaattgtatagtaataagacaaacttttacttatagttcaataattttttttatgtaattccatatatatatatatatatattatcacatggtatagtatttaattatgtgatggtctccatctacaccagattttctttgcaatgacctaacaaaccaagaccaactttaaccatgtgttgaaagcacttgaaaccgtctatgttcacaggttagctactcaattataactaaagttagctaacgtaatagtatatgaatgatttagttggaatgcgaataataatttttgttgtaggagcactgacttccacatgccatgagtaggcctagagcttaagtctcagtctcattttcatgcgtctctctcactcaatgttccactagttccagtagtattaaatgaataatagagcctttgcatataaccagagagagtgagagacctttgggccaaaagctctaacaaaaattccttttgtttcagagaatagagagaaagagagagagctagagagagaaaatgacaattgaaaaaacttgggagttggagttaagagatacctgaaactttctgtttctgtgatgactgtgaccactggactttgcttttctctatcatctctgctctcaggggctttcttgtctattcatcatcttatatatatcattttcagttaactctacttatcaaaatttacactgtattattgcataaaataagatctggattagactaaaatcttgtattgacactaatcaaacatctcagtgttttctctttgtattttcctcggtcaaacatctcaagatttttttttttaattattttttttcattttacaaatttcgtatctttacattatttgtttgacaagacatatacttctctgatttgaaagcataacaagaaaacgtacttgtgtgattgatacctcagtaacagtttttttttccgctcttcatattatctaccatatggaaaagacattcttatagatcaatatgttttttaaatgaaactatggtctaagacaaaatagctagacacaatggccatgatattttctgtatatataaaaacgaaaaaaaaaaatattgatcaaccagtatatgaaatttaagatcatgtaaataacaaataaagacatttagtagcaaaaaaagaaggatagatcgcgtaataagatacatttatcatcgaacaaatcacatattcatatgccgacccacaaaaaatcacatattcatattacagtcataattcataacaacattcgtcttatttatttgagttgcagacccccaatttatatagtacgtatgtatagtagacgggtttaaggtctacaacaattattcgattttgataactttgaaccatatggttcacgtggacaagagtggtgttttttattccacatatcatatatggtgttgagtgtcgatcaaattagaatccaaggaaaaaagaaactccataattaaatttattattctttaattatacagactatatatagtaatgttgcatttgtggacaagactaattaatatgttttcgataggtaaaatcgaataaaagagtcaatggtgaaacaagttggcgataattaacctttttctaatcgaggggccaaagaaaggtaaaataataatggcccgacaaatgaaattcgatatgatttaatgaggatttaccattaaatttggttgtcactttcatagacttttttcaccaatttccagatctcccactttaccattccatcatttttgggaatttcattattctaaattcaagtatcagtctaattaattaactaatactcctatctttccgtagctattattttataacagttacaaaaatacgtggcaagaaaaagagtgtatttccattttccagcgttcaagattaatgggccatttgattttctaaatattgggccaaagagagaatccatagaagcccattttaaactatcatatcttcccgcgaaaaagatagtgtaaccactttctttaacagcgaatatgaccttcccgtgatagtcactcttttggattccattcaccacctttgatcaattcaagtttgacacgcttctctcgaatccttctaacatataatagatccatcggatcctccaaaaccacaagttaaaaaaattattcaagaaacacgagaacaaaaaca

SEQ ID NO: 12640 - DNA, 3000 bp, Unknown; identical to SEQ ID NO: 12630
  misc_feature (1)..( 3000): cDNA_ID_2709291_gDNA_ID_2214563_Annot_ID_185934 3000 nt of promoter + ATG

SEQ ID NO: 12641 - DNA, 3000 bp, Unknown; identical to SEQ ID NO: 12621
  misc_feature (1)..( 3000): cDNA_ID_3025930_gDNA_ID_2214563_Annot_ID_185916 3000 nt of promoter + ATG

SEQ ID NO: 12642 - DNA, 3000 bp, Unknown; identical to SEQ ID NO: 12639
  misc_feature (1)..( 3000): cDNA_ID_2709295_gDNA_ID_2214563_Annot_ID_134912 3000 nt of promoter + ATG

SEQ ID NO: 12643 - DNA, 3000 bp, Unknown
  misc_feature (1)..( 3000): cDNA_ID_2708769_gDNA_ID_2214564_Annot_ID_134916 3000 nt of promoter + ATG
gatgagacgggtttccagttaccaaatggacatttctaaaagagcattatagaagactctgttacctttagtattctgctaaaaagatggtcaagatctcaggtacaagttctagatgataagcggccaacaaaaagacgagtgttcctatagctatcatcataccgaggcattttcaaactacaaagttaaaaagggacaaaaagaaacacaaattttgatcataacccgtaagaaactatacaacaagaaaataacacttctctaactcaagacataagaaaaggccccaaaggaaagtaaaacttcaatcaaacgccactcagctaattcagagacaaggaagcaattaatcggaaaaaccgaaggtccgaagctaaggaaaccatcaccggagatacatcaaaccaatttaaaatcatgaatcctagctcggaaggcactaaatttcaatctaaattatcaaattcaaaagatttttgatacctaagaaggtgagcactgcgaaatcggaagccctaattttgaaacaaaatggggaagaagataagacgacaacgattgtttttaaaataaaaatctgtacaaataaataaattaatttgaaaatattaaatgggtgtaggagtactaatcggctcaacaaaagtttattctccttgactaatgggccagtgacttaccaattttaacatctactatcttaataagaaaatgtgttggaaatggtccagaacctctaggacttatactttttgtagattactacatctattttttttttaagttgattatgaaattttaattattaaaaatatattcatatgtcaaatctattttggttataaagcaaatgaaaggtgataggattacttatattttgaataaaatggcatgagcttgcatatttgttagagagcttgaattatgggtcacttaagtaaattttaatttataaactgtagttttgtatagaaagtttaaactgtttaaaatttaatattctttcacaaatatacacatttctattataagtttataactattagacttctaaaactgttaaaattatttgttatcagcaaaatcaaactatttatataaataaaacattaataaatgatgcaaaaatcgttaaatctttaaataaccaaaatttctattcaaaaattaaaactaatcaaacaaaaataaaagtatgtactaaagtaattttaagaacaaaataaaaatttccaatgaaatgttactacattatggctctgattggtgatgacaaaaagaacaataggaatatgaatgaaaaagaacaaaaaggaacaaaaaaaaggaaaatagtcataagtaggaaccaagaggaacataagaattgaacaaaatgattatggtaaatggtaaccaaaaaggtgaactaatatttaacataagaattactaaaaaaatcatttattgaattttgtttattaatttcatttaaaattaaagttctgtatgaatttaaaataaattaaattataaatttctcttcaaaacatttatttattttatagtaaaaatttaaattatattacaaatttaaaataaatttcactttaaaacatttatttatactaatttaaaataaattcataacattcattaaattgaaagtttgataaaaaagtatatatatatatatatatcaatatatactaaagatatagaaaatattatatatagaaatataaatattatcataaagctattttaaattgatttaataaataaaacgaattttatttttttgctcctcttggttcctgtacaattttggggtggaacaattttgttctatcattcctttttttttgaaaaatgatgatgaaaaatgtaggacccacatgtctgaaaatggaacaaaaatacgttgtaaatggtaaaaaaactaaggaacaaagaagaacaccactttcctactcattcttttcctcaaaagtggttatcaatcggaacctatgatatatatgtttttatataattcactaacaaaaaaaacaatcttaactaaaactttttgcaaacactattatttttacattaccttccacacatcttatatttttaaatataatgataagtgacaagtttatgatatatatatatatatatatatatactataatttaattcactaacacaaaaaaacatatacaaactttaataaaaaaccatacgataatacttacaacccgcataatatgcggtacacaacattagctattgtgtcataaataacactatacatttttctatgtacattataatttatacactacaatatatatatcactaaaaattattctaatatgtttattagaatataaaatctccaagtacgtgcgggtcagaatctagtttgttatataaaaataaaaaaccaaaatgtaataaaaaaatttataataaactctcataaaaacgaattaaaaaacattactacgttaaaataatcttaaacttcaacagtcaaattataataatgtttataaatatatatgatgatattcttagaatcaaatctcgattttggtagatttcgattcggttggattctcaacatttctttcaaattatctatgattttttttctttctttctttttttaaacatatctgaactctagaacaagcgaccgtgagtcataaataaaaggaaagagatccaaaaatataaatgcaactacttgaaatcgactaaatatatcgaaatcacgtgacaaatcagcattttatttattctattaactttatagttggttccacatcctttcactctattcgatgtattgtacacatctggcacaaatctgcatctctgtcttcttcttcgatcctcgatttcatccacaatatacaatagccaaatttccgattttctcctcactgaatctctagaatccatcgttgattcaaactcattttccgatcaaacggcatatttttccctctcgagagagcgata

SEQ ID NO: 12644 - DNA, 3000 bp, Unknown
  misc_feature (1)..( 3000): cDNA_ID_2709339_gDNA_ID_2214564_Annot_ID_134918 3000 nt of promoter + ATG
tgatctttggaaggtatgacaactggggggaagagacctcagaaagtctttgattccagttagagagaggagcaggcaggagaggtggagtttgagggtccggggagaggacatctctctcaagagggggtcttcttgttctggaagaatcagaggtttcctgggaaaatcttggtacatttgagtgtttttcttgccattagagattccccagattagcagaacccgcaccatgagggtggttagtgtgataaacttgagctttagagctaggccgtgctctataccctgaggataatagtgaaacacttctttgcggaaagacacttctagacctttctccagaggggaggttagttctatccaccgcagaataatgtttatgagaagaggatccgtggccctgagaggaagcattaggagagatccctctaccatggcttttggatgcaacgaagttgtctgcaggggtatagtaattcctagagacaccacctgagcctcgggaatgagtagaggtgggcggtttagatttttctgaagaagaaattaaacctgggcaatccttaatgtcatgagatagtcttagacaatggcggcagtgatttttcaggtttttataatcaagaagcactaaggcttcactaccatcagggaactctaccactatctcttttgttaggggttggagtccattgataagcactttgagtttgacagaagaagaagagatctccatatccaagatttcaccaagctcttcactaatggtttttaacatttcctcttgccagtaatgtttacggagaccttggagttcaatccaaaaaggcagcatagatggaaaggagtcacagaaaactgtcccatttttggagaatgaccatccattggtcataatggtaaggtctattatctagaaccttctacatatcctcttcaaaatcaaatttaaactggaaacacccttttcccagacctgagcccacaacctttcctttgaggttccatctgttggagaggaaaggaaagagagaccagagacgttgagccgctggattagtgagtcgacccatgagagtgagagcatttgctttaataagctctgaagtatctaggtctagagctcagattcgtttgcgagttggagaggagtagcctcttgctaaacttttgcctttaaggtgagcatggattcttgtactcatggttaggtttgggtaataaatgagaacatggtaatagttgggggaaacgaactttcaaggagcaataaattttcaggagcagccggaggaagttgcagataggtttaaacacagttcaacagggttaaaacagggttaccaggatagcagagggaggggatatacctgaaggagagcagatatatcagatggtagcaagaaggaagtttcagagggagaaaacatcaggtccacgctggagaagttcatcagaaacctcgcaaacgcaccggaaaaagctagcctggctagggaccgttgggtattgctaaaaataggagggaaaagtggttgagatccggttagtagcaagtaccatacttctaatagccgtcttgattacagtgcctactagaatgactctctaagggtgtaaaaagacatgaaagctggggttgaaattttttattacagttatgccatttagattttaattttgtttgttttcattatttatgtctgttttaattgaatataattatgagaattgaaaagaataaatatttaattatgtggatattgtagacctattacatctaaacataattacgaccacatataaaacctaattttgagagagccgattaagggcggcaaaaggagaagcgatttccgacgacgacttgagaggcggtatccggcgacgattgttgtttaaatccgacaacgagaggagaagcgagtacggaggaagacaggagagtcgagctgattaattaagggcgactttatgagccgaagctaggagcgatggactcttgaaaggaggttagttattaacaactaagttttggtaatattagtgttaaggaaccgaaatgcatttatgttgtcggcttttgtgtatatgaaagttgtcggaaaatgacggacataatgtcttcttattttaagttgatgaacacaatcttatgtatgtcataaaatgcgattgacgtattcttgaatatgttgtttgagaagcatttgggtgacgaaagagaattaagtgttatgttgtttataatttgaaattcgcgcagttgatttgtacagtagacttaaaaaatataagttgtatgatgatagaggttttgaactgatggtagacataatgcgtatgtaagtctgtctaaaaaaactaatgcatttgattataaagaagtttaggccgttaatgatatgtggaacttgaagaaacagagtgtctgaagttcaacaggcgtgtctgaagcaacacagagcagaacaaaggaacagaggaagcggaaaagaagcagttgcttttgccagcgtggcatgttgattggagtgaagaaaaggcgtatcactttagacaaaggagacgaagtcgtcagacagaggacgtgggcctagtgtcaagataatgatgaggagctagacttggaccttctagataaagtggagcatcctgccttttccgagaaactacataagagaagtttcggtctcttagtagaacttgttcttgtgggttttattggtgagtgaacaaagtgagcacacggttgttgttgtgtttgtgagctgggtagttttagtatctgacatgagcaaatcaggttgttgatgttgcgtaacactgtccaaagttatctgtgattgatcagtttgaaagttgttctaataaagtgtgtttattggagttgtgttctttgtcttgtcaaagtacttagagttcttttactacaattggtatcagagcgggtaaccaatctgagattagtatatctgaacaggttagatcctaatt

SEQ ID NO: 12645 - DNA, 3000 bp, Unknown
  misc_feature (1)..( 3000): cDNA_ID_2709337_gDNA_ID_2214564_Annot_ID_134919 3000 nt of promoter + ATG
agaactgtcttttctttatacttatgtatactttccccggtttcgttgctactgcgggctttacgcaattgatcggatcatctagatatcccttcaacacaacataggtcgtcgaaaggatctcggagacctgccaaagcacgaaagccaaaatctttcagaaaatgaattcctattcgaagagtgcataaccgcatggataagctcacactaacccgccaatttgggatccaattcggaattttccttgagggatattggtaaggaattggaatgtaataatatcgattcataatggattcatatcgatacataagacaaggttctctatcgattcaacaagtgttgtacttatgggaaagcgatagagaaagagaaaaaaaaacaaagatttcacatagaaataaatggatggtgaatgcaaagacccaaaagaaaaatttataaatttatttttgtgattctgatgagctgttcactctttgaaagatatttgacttatttttaaacatttttgttattaatagatcaatccatctgagtcttatatctcacctccaagaatcgtgaaaaatggtatgttttttcttaagtctttggttaagagaaacagaaaaattgcgttaatggttgttgaaatagtagcttatatgttttgtataacaaatttggacaacgtttaagaaatacattttcgctggcgttttcattcaaatccaagccgttttgactatgtgagaaaggtgcttatggagattattgaaggttttgattttctttcgtgtgtttatatagtcaagtcacttgtgaataaaatgaatgtaccatcctcttttttggtcagaaaggtttttatttattaacatttttaggagcatgaaataaataaacatattagatttggcacaataatgtctcgccttaattgacgatgcatggataatgttatgtgtatacctttgtgtggatatgaagcgaagacagatgagagagatgtgattattatctaaatatatttttttttaaatatgcgaggatttgtaaaaagtgaagtattcaaatttgcatttttgtgaagagagattggctacaacctaaaaagtctttctacgactaacatttgaaaaactattccgaaattattatggtttatacatcatgactgatacacatgatgggaagatttaacatagagtaaaaaacgatgatattacaaagaaaattcaatcaattaggcttttttttagattagaacaactctcgtacaaacatatatgtcattaatgaaacatttttagaaaaaactattgaaaaagatttaagcttatacatgtttgaatgtctgctagagttcatgcttgttatcatggagccactttcccgtgacacacacaatcattccagatccaattttgaaacatatttaacatgtattcttgagaaaaaatatcgtatgacacattgtcgcctattaaaaagatgtcgtttttgaaaactcaaaaacaattatcttgtatggtgattgtgtgccctttgaattggtcatttttccagtttcagtagtcctaaatatgcaacgtagttgtgacttcaagtgttttagccactactcactaaactaaaacatctcgcttaggattctaatattgtgtgattgtgaaatcatatttactattattttttactcttacacattagaaattatatgatttttgttataaaaatagtgtcacaaaacagtcacactttgtgacaatgttgcgacgacgttgcaactctcgcaattttattcatatattcaccaatagaaaattttaaatatgttaagttttaaggtttctacaacgatttgaagtacatagatgttaaaaatcattataataccaaaaaatttgatttattttttatgttttaaacaataattctaagcttacgtaatgttatatgtgatgtgaactaatggttttttgaattttcataattttctttgcatttcatgtatttacttattaaattgattgatcttgtttagtattatgatttcattgattttaaccttatagatataaccttttggatcttaaactttaaaattcatatgaatagggttgtgactcataaaaattcatcataaaatattagcattttgcaactattctaaggaaaagttacaaacaagtcattacataccaacatatatttggctgagttgtgacgaacaactgagattgagacgattgtgctaccttttagcaacccttgcagtttttgttaagatattaaccaacataatattgttaatatgttaagtttcaaggcgttgcacaaaaaaaaaaagtttcaaggattctaaattgattttaactactatatctacaaaatcattacaatggcaaaaaatccctttaaagtttttaatgttttaaacaaaattcctaaacttacgtaacgattatatgtgatgatacttataatttctaaatttctaattattcttacatttcttttctttctcattaaactgatttatcttgtttagtatcgtaatttacatgactataacattatacatagattttatttagttagtaagctttaaattcatagaaatatagttgtgactcataaacattagtcacaaaagagtaacactttattattactttaaaaaaaaggaaaaatatcagaaaaatcgtcaactttcaaaaaagagacgaaaaactcgtcaactcacgagacgttgttttaatcacatacttttggttaacctctccaaaaaataccaaagttttgttgaccgagacaaataagttatcgcgttaagtctctgttagtacacgagaaacggggttaatacttcgttaacggtcaccgttaaacctaaacgacttcgtctctttaaaaacaaaacaagcctctgaaacccccaattcaattttagaatctcaaaccctaaattttccaaatctcttctttttcttttacattctcactctaaca

SEQ ID NO: 12646 - DNA, 3000 bp, Unknown
  misc_feature (1)..( 3000): cDNA_ID_2709328_gDNA_ID_2214564_Annot_ID_134922 3000 nt of promoter + ATG
catttacgattaccaatctatccggtttaaggcttccatatgacttcaaacaagccttctcagcattttcgttcttcttcgttcttgctttaggtccgtattgcgcagatagaacttttgtatcctctgaaaatataaacgagagagttccatgtatcccattcaaaaaggataaaaacaactttgtacccataatagatattgagaaagctgataaagtaccttctgaccaactaggagagccatgaggacgatgaaggatattacgcgaataagcaagaggtttcagctgacaagtaagtctttcacgagttatatttcaagtaaaaaaaaaagatataatcttaaaaattgtaactacataagatagttttagttttattaattaactacataataacgaataaaaaataaacataaattagcaaaaacaatcaataattgtttttcacaattttcaaaacaaactcacgcttcacaattttcaaaacaaacccacgctacacgtgggtatttatctagtataatataaaagacatgaaaaaagaatcacatttcaaagactgtttgtactcgaaaaatcgaaattctaaacttgcagtgatctgaattccaaaggaaccgaggtcaaacttggaagatggacacattgagaaaacccaagagagacagaatctatttgaatcttcttgcagaagtctcccctcgcaataaagatgcaacccactccagtttgattgtcgtcacagcacaggataagggtcatgtcatggatgaagtaactaatatcagaaagctgatggaatagcgagggaaaatcaggtattgacagtgtcatcaagtttaaccacaccacattattactagagttaatcatgtcatttgttacccaaatctctgtattacttgatatacgagattgctttaacaatgcaaactgatcgcccttaaatacagtgaggacaagtttatctcgtaagccagaaacatgcttcccacaaggaaggagacaaaagtgcatggatatttctgtggagaaatcaaagcttccgagaaaatgctcacgagtatcttcattgtaagcagtccaatacaaatttccattcaaggacacatattcacctcgacctgccagcattggccattccggggaatcaatgaacttaaacgcttgagacgcacattcaaagatcgcaaatctgtggccgattttcagtgtagtgtcatagaaacgactaaaatacccaaagatcttgtaatccttttcgggtttacaagcatcgtatcctacaccgcaaaaacggaaatctctgtcctccttatactcgatccacccaacctgtcttaaccatggattccaaatggtaaccccttggttccaaaagtcacgaaacaataatccatcgcaagccgtgatcctggtaaatgcccacttctcagccttaaaatgaaattgacaggctagctcacgcacctctatcttcggatcaaagtcgtccaggccgatggttcctatcgaataaatcttggattcgggcaggatgataaattggggacgtgcacaacccaagcttttcttgatgaaccatttgtcgttgagaagatcgttcagtgtttacatacggatcttacccgaacaagggatccaggtggaagccgacacagtatctcttcctccaactcccacggaagcttccccgacgccattacctttctccgacttcggtggctttagaggagaatctatatatataccaccgcgtgtacgactcaaataaataagaaaaggaatatttttatctgttacgaaaatgaaataacacccttttttggggataatattaaataattcttaaaagtaaatgtcaaataattcttaataattatttaggaaagagatttatcttccaataataaaattactgaataattatttctcaaggataagaagttaaaaacatagatttgaggaataaataaaaaaacaattattctttaaattgtttataaaaaagaaagaaatatatctttcaataagaactgcatatttttgtaagaaataagaaaaaaaattcatttcttaagagttaagaacaagaagacaatatttggagaaatattctgtttatatattctgtttttaattgttaaccttgtaacctgtttacgacaaaaatagagaagatctattggttttaatcagcagaatctagcaagaaactagattgattaccattatacgagattacaagaattgatttcgatgcaaaacttaatttgtaaatttgtaattcagctaaaggtagttggtcggtaggtttgacacagaacatataacctaatttttatatgactatggttttgcctatgtgatctctacagcttcattgatcaacttgaaaactagttctaaactttttcacaaaataccaacactgagactaatcaatcacatcaaatctagagcagcataagtattgaatattggtttaatttaaacaaatttctctacatatacaagttaaatgtctgaaaataaacttaatttaaacttttttaaaacaaataaatggttttttaattaatcaatataaaaaaatcgcctttaaattcccttggaaacataaatattgcgcatcggtttaattttttaaaaattaccaaaagaggaaagctgaaaaccaaaaccctaaaataatattaagagccacgttatcctaatagatcaaatgataacataacattgagagccacctgctgccgttttcttcggcgactaacgatgacgatgccgaatcttccaaatgagttggtagaggagattctcagcttttttccagccacatatctgaaacgtttgagctacttgcaaaccatggaaccgtttgatccacaacgacaagagattcgcaagaaagcactacgataacgccgcaaaggagtttctggttttcatgttgaggaagaacttcaggatttgtctgataggcgtcaatctcc

SEQ ID NO: 12647 - DNA, 3000 bp, Unknown
  misc_feature (1)..( 3000): cDNA_ID_2709320_gDNA_ID_2214564_Annot_ID_134924 3000 nt of promoter + ATG
ctcaacatggatcgcttggataatgaagtgtatctctacagtcagcttttcggttctaatcaatggttctccacatggtcacatcaaccccactcgtggaatccgacaaggcgatccattatctccctatatattcatactttgtgctgaagttctctctcacatgatgaaccaagccgagatcaacaagcagcttaaagggataaaactatccacaagaggtccatctatctctcatcttctctttgctgatgattctctattttttactatggcaaatcataggtcatgccatgccattaaaacggttctacgtacttacgaggaagcttcgggtcaagcagtcaatttgcgaaaatcaactattacctttggcaaaaatgttagcaatgacataaagcgaagaatgagaaatctcctcggaatacacaatgagggaggtggcggaaaatacttggggctaccggaacagtttgataagaagaaatctgagatgtttcggtatattgttgagaaagttaaagaaaaaactcaaggttggagcaagaaatatctgtcacaagctggaaaagaggtactactcaaagcagtgctttagctatgccaatctactccatgaatgtgtacaagcgaacaaaagagatttgcaatgagattagtggagtactagcaaaattctggtgcggttcagacgctgaaaatcacggtatgcactggtttgcttgggatcgtcttgctttgccaaaacaggagggtggtcttggttttagggatcttgaaagttttaatttagcattacttggcaagcaaacgtggcgaatgcttcaatatccagagagtctaatggcaaaacttcttaaagggcgatatttccatgattcaaatatcctaaatgcagtccaagggaagaaggcctcttttatttggaaatccatcctacatggtagagatttagtcaggaaagggcttcgattctgtataggtgatggcacaatcgtcgacgcttggctggacccatggttaccaatgcatccccctagaccaagtgactccaccacctagaaacgttctcttgaaacaaagactatggaaattaagaactgctccgaaaatcaaacacttcttctggcggcttctatctacttctcttcctactggtgcaactttgaggtatcgacatattactaatgatgctaaacgtgtgagatgttgcagagaggacgaaacggtcaatcatctcttcttccgctgccattacgctcaagtcatatgaagaggctcgagaatcccaaatcccatctttctcgaccaaactgctccatgggacgataaaattcgcgccatctttaatatcaacacctcagcacgaacatctcatatgagacagttgcccttatggatcatgtggcgattatggaaaagtcgaaacacacttatgttccaacaacaaagtatacactggcggaaaagtctaagattagcgaagcaagatgcatgcgaatggcaagatgcagaagattatgttcaaaaaagctcaagcgggactcagattctaccctcaacggttaatattcaaaaaaattggacactcccacctagcggctggacaaaatgcaactatgatggtactttcaacagagacttgccaagtaaagctgcttggattatcagaaatgacagaggaacgttcttaggagcaggacaagcggtggggataacaacaacaaactctcttgagagcgagttacaagctctggtcatggcaatgcaaaattgttggagcaaaggccataagaaggtttattttgagggagataacaaagaggtagccgatacaatcaatgacaggaatccaaactttgcggtttttaattggctaagagaggttgtggcttggaaaacaagatttgaggattgtcgcttcacatgggttcgacgaaattccaacatggcagcagacacattagctaaacatgcactaccttcacatacttcttatcatttttctagttttactcctcatgtaattacagacatactccatcgagactttgtctctgcagttcaataataagattgatgttgatgaaaaaaaaagaaagtaaacttagtaaccgaaatatccgataaccgaaccgaatacccggaaacccaggattagctatagttaacaaaattaaatggataaaacaaaacgtacggttactacaaaatatccggcccataaaaggcccagtgatctctgaaaacatgcttcatgtcagatagataaaaaaaaaaaatagttattacggtcaaactttttttcctcttctgtgtttaaatttccaaatctcagtgtaccccacaaaacaaaattcgaaaaacctcgcaacgagcgcgagattcaaaaatcaaaatcaacaacacgcgaatcaaaagaaactgactcacacgcgcctctctcctcgaactccgtctcttttctctgctaaaacaaaaatcatctctcttctcgctctctgcttttgaatctctcttttttctctccaccacctgagattttcccatcactttcccggaaaaagcagcgattatcttcatggcttctcactcaccactatcccactgatgcttcagagtatgtttcgctactctctcttccccttaatttttcactttctctgcatttttctgtgttgttctttggaattagagtaatgcgcgatgaagaaaatggttgaatcgttactttagagtaattcgctgttgttttttggttattatcatcgtcttctatccaattttagagcgaattaagtagagattcgattttgtttagagtagagaaaatttcgaattcgctgttgttttttggttattatcatcttcttctttccaattatagagcgaattagggagagatttgaatttgcttcttcgattcaccagatccttgagctacatgtctcagactcaattctaattccttgttgcagttattggatttgaggaaggatt

SEQ ID NO: 12648 - DNA, 3000 bp, Unknown
  misc_feature (1)..( 3000): cDNA_ID_2709312_gDNA_ID_2214564_Annot_ID_134926 3000 nt of promoter + ATG
aaaattcaatttttttatttaaaatataggcttatgatgtacctcttgaatatgtaatttatatataaataatattaactaaaataaaaatctctaattttctaacaaaaatattaacatgcggtataccgcgggtcaatctctagataatacaacttttaaatctttattacctctaaaaaactctaacaacaaaaaaatactgaattttaatattcaattaatgtacaacaaatatcagaagataaaacatgaattacccaagcttaacatatataaaaattaggtgtcaaaaatttatcattcatatacaaataataatttttataaaaaatttatataattttaaataaacatattcacccgcggtacaccgcggataaatatctagtaaaataatcattatggtgaaagaattcattgaataagtttagattgaaagatatcaatttatgatcttatcataattatatatatattagattaataatttttattgtgcctgaatgctatgttattaacaatcttatttattagaatatatgaatctatctaatgataattatctaatactattatttgaaaaatacatttatttaagtggacagaaagttgaaaaaaataacaaatttgctatcgggttaaaaattttatgtcatgaaaaaatccgtttagaaatatgtgtatcctttagactatctacaatggcttattgaaaaaaattattcaatagttgaatgcttacaatggggtattgaataaagaaatgaatcgtatgtggattaaatggtgttgaaccgattcaacattgttgaatctttaaaaatggacccctcattgccatttgtccttaaatgattggagacagaagttgtggggagagttaaataaagataggacatatgttgctcttttatttgctactgagatttatgatattttattttcctctaaattattagaaatcaattatcttataaaatatttatttgttttaaattatttttacactaaaattcatcatttttcaaactctataaataaagacttgtttcatttgatttggacacagaaaaaaatatatttattttcactataatttttttattagtcggtaaactcgtgtctatatttttattctgtttttttcagtgaaatggatccccacaataactcctttaacaactaaaattccacttattatccatttaaaatataaaagaaaagaaaaataatgaaataaaatgttttggggtagggtgttgaatttttaaaaaaaaccattgtagagtgtaaaatttgagtgggtattgaattattatgtggaagaaagaggaaaggatgtggaagagagagaagatgatgtggagggtgttaaatgaaaaaaccattgttgatagccttagagcaggattttaaaagtcagattatcgcatctaatcttggaaattgaaatgcagtgttatgagccgttgattttttgagttgaaccgaataaaaaaatcacgcgtctatatttcatcaaccgaattgcattaatttcaaatattcattgcttatattcctatattgaatttgaatatatcacttctccataattataggtaatcaaatacttactttggatcttcattttgaattttcataaattttcttaacgattttcataattaaataactacttatatggtaaatggtaaacattctcctataattatgggatcatcataatcactaaacatggattccacgattttgtattttgtccatattttttgacataaaaatttatatcttataaataccgtaagtcccatttcaataactcactcagcaatacctcatactctattacattcatttcgaacttatcaccaaaacagatgctcgctaatcctcttccatttgcttctttgagatcactaaagccttacaagaacgcttggcgtattcatgttaaattgcttcatgtttggaggcaatactctgtaaggctggtaaatccatcaaaatgattttggttgatgaagcagtaagtattatattctatgtatttattttccataatatatattgtttctggcaagtatcatattcactgatatatatatatatatatatataaatatttgtatatttttaaacttatagggtgataaaattttatctgctgtgagaagagagtagatcaaaaagtttgaaaagagtttaaccgaaggtgtttggaagattattacgatcgtcactctcaatcctacaagtggtgagtatcgtatttctgacttgaaatacaatattgtttttgttttcaaaaccacggtctctccatggataacgtctcaaattattagtttgtctctcttgctaagtttgacgtgatcttttctggatccgctaacacaaatctcgtcatcggttagtttaacttttaaagttgaacatacatgccttattataaagtcaattatttatattttttctcttctttgtctatacagatgttattggtcaagttgttgaccagactaaaatccaagatcttaatgctaacaacaagcccaccaaaaaaattgatttccaatatgagagacatgcagtaaaagaaatttctatttttattttctaattaaatgtttattatttatttatcaattttttctttctatataagcgacactcgcttggcatgtgcactttagggaaagtatgttaagattgttgataaagcttgcgagaaatcaactgatggtattgttgtttgcttaatacgatttgcgaagatcaatctctataacggtaattatattaatatgcatatatatatgtaatatttcattttatatatacgcagataataagagcatttccaattcatttgatgtttcacaagtctttgttgatacaaaattggttgagttggttctttttaagaaaaggtaaatttttatcccatttccaaaaaaataattactgaaaagatgggactcaagtagactgatg

SEQ ID NO: 12649 - DNA, 3000 bp, Unknown
  misc_feature (1)..( 3000): cDNA_ID_3025938_gDNA_ID_2214564_Annot_ID_185968 3000 nt of promoter + ATG
taatcacccataattgcaaagttagcggtcgtatgagacaaagttttaaaacccttacttagcgctcactttttactcatatacacatgatgaacaaagtaacttgagaattaaattcgtacctgagccttcaattactctgatcttgttatcgtcgccttagtaaatgcagatatttgaagttaggtgtttacagttcttttggtgaagcaacatagataggggcgtaataaatacacaaacacgcaaactgaattatatctctcatcatcattacaattctctctctctttaagtctcggcggcgtattttcttgcagtttttgtcgtctcattaaatgcgggatatgcgaaaatctcgtagcttacactacgcgtatcattagctatagggccaaatctggcatatttattttgcatgttttctttcacctaatttttggttttacatgtacacatccttaaataaatccccgtagaagtatatatatttaactgacccatattagaactatattaatatacaataaatgttataaaattcaaatctaaataaaaacaaagaattaactatatcatataaaagaaaagaaacctaccaaaagcacgaatctgatttacatttcccgtttgcatttttaaaattttccaaagcagaaaaactaaagccaacttttcatcagtttttgccatttggtaagatgagcaaacttaatattaaatgagttataattatatgttctaaagcttggagagtgatgaccagaaaatattttatgaactaccattcaccttctttaatatctctaaacttgttgaagttgtaaaatacagaaaaagataatataaaacaaaaccaaaaaaaacaaataaccattgtatccacgagaatcatgttttttttttgccatccttcatattgtcaaaattgtaaagattgagaatcttcacacttacaatcgaatatgtgaaacatccctacttttcttacttatgccaaaataaacagttcttttaaaaagagattaggtaaaagtctgcgttatgccactggtatttgttttgaaaatgtgtttatatctctaacaattttaaaactgttgatatatcattaaaactattaaaactattgatacatcaattttaaaactattgaaaatgtgtttagtacatgaatgcgtgtagaaggttcttgaatcctaacttgattgatgagacccagcgacgaaagcctaatagatataattgtggaatttggtatgaaatttaggatgttgtgtaagcgtgcagagaattacatggtggttaggacttgattagaactgttaagtgcatggatttggtttgaatgatcaaggtaatatgctagaaagatcaggagtttctacgttttcaaacccctcccacaggttaagtttattgtttcgcttgagggcaagcaaaagctaagtctgagagagttgatatatcatgggtttttactgatttctaacatagttttgggatagttttgagagtctttctagtgattttcgtatgttttgtagtcattagaggtgcatatatacttttgagagctatggagcataataaggaactttggaagcttttcagcaaagaagaccagcaaaaacgttattcatgcgatggtgtcgatcgacaaccttattcgacaaagaaaatccccacgttttaccaagtcttaaagaagtcccataagtttttcttatttgcaaaatagaccatgcacgtttttagtaacgtatatatatatatatatatatatatatatatatttaaggtcattgtttagacctaagaaagttttgtgtaagagacatacttttggagagaagaatcatatccatttagagaacattctgaaatccttttactctatttcatattataattcaatgcaatttattcaaatcaagatttgtgattctttgatcatgtctaagtagtcactttgttgggtttagggtgtctcactagggatttagattgattagtaaatcgataacctgttaggattatttttagagttcttcatctataattgttcttactgctagttctagattgatcacctagaatttgatcttagataataggtatgcccaaaaaagtatctgtcatcagaactattatagatgagccgggtttataggtgtgtaataagaatcgacatgtttactaagttgaagttataaaactcgttagcatgcatgtcttaaattagggatttgccaagccaacacaaggaatctttagccttggacataatgagtaatatagcgaaccacaagttactctgtaatagtgtttgagtttaagaacagtttgataacaatcctagtcatagcaagatctacaatttatctatttcctaagactatccctagacctcacgctttaatctcctgaactcacaactcgatttactgttttcttgtcttttactttcatctactttgtctagcttaatattaatcatcataagtttattgtgtgaacaacgagagcttagtgaaattcgatcattcagtgctaacgacgatctcttatttgagggaataagcttaaggataatttgagctatatcaaatttgaaattttcgaaaattgaatatgacctatgaatgatactttgacagaggtatattaattttttgtttgttttcaagattatcatgattggtcttgtttctaagtgattattttataatttaaaatctttagcaatcaattgctttttttctcaagatcataatgattgtttaagtttaccttttaagggattcataatcgaatctttgttttttttttggacaaatgcttgttttcatacaactaagatagaaacaagtacaatggaaagaggattctaagatcccaaagtttaaaagataacaaaagtaggcattcgccaataccataagaagaaaagcaaacacacaaataaaatatatcaacaaaaattccaagagagctatg

SEQ ID NO: 12650 - DNA, 3000 bp, Unknown
  misc_feature (1)..( 3000): cDNA_ID_3025959_gDNA_ID_2214564_Annot_ID_185961 3000 nt of promoter + ATG
catgtttacaaattctactatacactaacacacaacgtatatactaacacataatgttatactaacacacaacgtatacaactatataaactataagattcaaacttgatatagacttttatactttgtaaattatagaagttaacatttatccacactaattatccaccaaattaatatagaaaagatattgccaaaactaatagacgaattaaaacgttattcccgtgcaaagcgcagagcactgacctagattaatccaaatggtatgatttttttttattttttttaaatatttttacatattaattattctacacagtttatgaaatactaagtgtttttccttttgtatatgcatgttgcaagaattattatatgaccattgtttttttattttttttagtgctgccttttttatatacgattaaagaagtatgtagtttattaataattcttttaagtttttcttctataattctgattttgacaaaagttatgtttatcttattaatttgtcaaatttaataattaatttacatgtttataaaatacattataccccgacacaccatgtatacaactacatatactaaatatacaattatgtacacaaagagacacatcaattctataatatattcaatagtattcatgtttaaatgataccaataataaattcataaatttttaaattcaaaaattatacaagtaaacatttatagacaaaaaaaatataaaccatattagtaatatatacagaagcaaaatttataaaataattaaagcatgaatctcatgtgaagcatgaatcctgacctagtaagtgtttaatcaacaaacttttgttatatatgatttgagctctttgcacatggtctctccttctatgttatctctctttttatccattataaatttgaagaaatttgagttggcgttgttttctaaaatcactattcggtaaaaaaatatatgatatagtcacagcatagagaggtgaccatcaagccgtcgagctttaaagaggagcatccactatgaagcctttactcaaaatcaatttctagcaagataatgtggaatgcctaagttaaggaatccttttgtcctcgtgtccatctttcaatccccaaaatatcttttgtgaacatttccattttagctattaattgacactgaatacctcgctatagactattcagtgcttcagttattgatgttttgactagtttgtttgagatatagtacaaacatagtcaaccctcattttgtatcaacatcaagttctcaagatgggtttgagagacaggaacatgattatgtagatgatcatgactttatgaatgtgggggttgaaggtttagcttctgtttacgacaagatggtaaatgaagaggggtttgatgcaaccaagactaagcttgatgtgtacttgaaagaaagtgttgaaaacacaagggccaatacattgggaacaaaatatgatgtgttatcatactggaagctcaatagtcttaagtttccgattttatctgtactagctagagaaattctagctttgcaagtttcttctgcagcttctgagtattgttttagcactagtggtcggatcgtagagccaaagagaagtttcttaacacattatataattgaggtcttgatgtgtacagaacaatggatgaaggctgactattatattagtgaaaaagttgtggaaaactatgcaaagatggttgaggatattgaagattcggatgatctggagaaaggtataagtgttggcacttgtccgtttcttactttcttttcaaagtctaataattttatgttttcttcaatgtatagagtttgacaatttgtgtaagagactagagacttaaccaagacaagtcatccactcatgaactcaggtacgtgattcagattcttcagtttttgtgacatgtatttgagttttactaattaactatgattaagtttaaaattgttgtgacatgtctgactttatcattcaattttgtagacaagaaaaaaaggtatggtaaagaagttctcaacatggtaaagaactaaagattaaagaagttctcaaacttttcaactctctgttgagttttaactctctattttctctagaaagcctttttaatttgagtttgatttctcgtttgtactttcactctcttttggatttgagttttaactctagtttgtactttttaattgttctattgtattttgaactttgtatttggtaattttggtcaatttggtcactttttgggtataatgtaatggtccgaaatgtattcggttaccatatggatagtaaacttagtaaccgaaagacccgataaccaaatggttatatccaaaaccgaaccaaaatgtgttcggttaccatatggatagtaaacttagtaaccgagaattaaagaatattcgggaacaacaaagggaacaaaacaacacttgagttagttatggagattctcaaagcgatttctaagcggttatttcatcggtttatcctcacctttttggtgacggttcacagcgttttcgccggcgaagtggttcccaaccccattttccctcaggcggttatctccatgcttgatcccacgatcaatcgtgatgtttattcggttcccaaacaccttcatctatttaagcaacgaattgtcgattggggaatggcactttgtcttctcatcaaattctcaattttttacccacttcgattctataaaaacctctcaaaaatggcagacaatctcaggcgtgcagttcagaacatcaatctgggtgcagacgaagagcccatagcgatcccaaaagaaattgtgaatcaagcaattgccgacaatcgtttcatcctgattggcagaccggtgatacctagacgtcagaacatccgctccatagttgcttctttaccgcgaatatggggacaagcagggctagtttcagttcattttcccgacaaaggaatcc

SEQ ID NO: 12651 - DNA, 3000 bp, Unknown
  misc_feature (1)..( 3000): cDNA_ID_3025963_gDNA_ID_2214564_Annot_ID_185960 3000 nt of promoter + ATG
aaacttttctctatctttaatctctcgtagtactaatgttaaagcggattttttggcacgaaaagttcgtacccaaccgcttcatattacatttgtaaacaacattcctcaggattggctcgtttgagtcctaattaattttcggatgacaaaaaaaaaaaaaaaaactcatgtgtaactccacatttaaattcatttgtaactcctccactataaattaaactctacatttaaactcaattgtaacttctaccaatcaataatagtttgtaactcttgtttattaattataagagttttaccacttctcatctataaatatacattctactatcgtccttcaccatattttcaaatctgtaaatctacattatttttatttattttgcatgagcttaaaacaattattgtgtcatatagtaatggtaagagtttgattgtataattttatttttagagattatatgatatgtaggttacattgtactcaattttattttgtttattttatttttagaggttatatggtatagagtttgtatcgtactcaattttttttgtctaccacattacaataatatttatattcatcttaatatttccaattttacgattttttatgaaatatttaaggaaatctttttaaatactaagatcataaaatttgaaatatttaaggaaatatttttaaatattacaatcataaaactaataatttatcataaattttgattttaaagaaaaataaattcaggtaccataaatttcggttactattagctagcatttctaaaattatgttttaaatttggaaaatcttattagacgtaagcatattccgtaaaatattcataatccttaaattaatttttttgtttacattttttggaataaacctaaattgtttgacatacttatatgggaaatttgtaaaactaccctttttttactacccttttaaaataataaccttttgtgttgtccatttttactacccttttaaaataatacccttttgtgttgtccatttttaaaataccccttccattgaacagaatgaccaaatgaccaaattttccaaccaaaaaaaaaatccgccaaactttttttccgccaaaaaaaaaattttccgccaaaaataaaaaaaaattccgccaaaaaaattttcgtgacaaattttttctcagccaaaaaatacttttaaaaattcttgtaaattttttttggcgggaaagagatttacaaaggattttaaaaatgttttaaaagatttacaatggattttaaaagggtttaaaatatttataagggattttgaagggctttcaaagatttataaaggttttttaaaaatttttaaagggtttaaaaatgttttaaaagatttacaagagattgaaaagggttttaaaatatttacacgggattttaaaagtgttttacaagatttacaagagattttaaaaggttttaataaaatttacaagagtttttaaagggtcttcttgtaaattatttaaaaatcttttaaaactccttgtacatcttttaaaactcttttaaaatttcttgtaaatctttaaaaccctttaaaatcccttgtaaatcttttaaaatacttttataccctttaaaaatcttttaaaaatctttgtaaatcttttaaagccctttgaaatcccttgtaaatattttaaaatcttttaaaattccttgtaaatgttttaaaacccttttaaaatcacatgtaaatattttaaaactcttttaaaatcccttgtaaatattttaaaacctttctaaaatcgcttgtaaatattttaaaactcttttaaaatcccttgtaaatctattttacggaaaaatatttttgaaaaaagttttggcgggaatgtttttttttcaaaaatttttggcggaaatttttttttcgaaaacttttggtgggacaattttggcgggaattttattttggaatattttaggcaaaaactattaatatttcattttgttaacataaaacaatttccaaataagggtaaaatgatcattaaaaaattaaagagggtagaaataaaaatggcaaataggaaagggtagaattgaaaaagggtagtgtgcaaagggcattctcagcaattattctactttcagtccctataaatactgtaaatatctagagtttattccatccttaccaacgttagttttaagaaaaaaaattatattttattctaacacaaatcaattgatattaagtaatttttttatcattatccttatatgaattagaatgtaggaaaaacacataaaaataaaagtatagtttgtattaagtctaaatatagtatgaaaataattactttgtatatctaaacagaaaataaaacctacaaattatcatatatctattttattacgtaaaaaaattagaatatgttttattgtacaataaaaaaaattgtaatgaaactcatactacacatttaatctttttacatgtgcgaattgcaagaattatatcgaggatcattgttgctttttaaattttattatcagttatatcaatatattttaaaacaaattcaactcttagataaattaagaatttattgttgaaatttgtggtttaaaattattgattttgataagttatatgtttattgtttttatttattatatgtgaatactcagctaatagaacaggatttgtaaaacaaatatttactaaaatatacatgtttacaaattctactatacactaacacacaacgtatatactaacacataatgttatactaacacacaacgtatacaactatataaactataagattcaaacttgatatagacttttatactttgtaaattatagaagttaacatttatccacactaattatccaccaaattaatatagaaaagatattgccaaaactaatagacgaattaaaacgttattcccgtgcaaagcgcagagcactgacctagattaatccaa

SEQ ID NO: 12652 - DNA, 3000 bp, Unknown; identical to SEQ ID NO: 12645
  misc_feature (1)..( 3000): cDNA_ID_2709337_gDNA_ID_2214564_Annot_ID_185953 3000 nt of promoter + ATG

SEQ ID NO: 12653 - DNA, 3000 bp, Unknown; identical to SEQ ID NO: 12643
  misc_feature (1)..( 3000): cDNA_ID_3025995_gDNA_ID_2214564_Annot_ID_185949 3000 nt of promoter + ATG

SEQ ID NO: 12654 - DNA, 3000 bp, Unknown
  misc_feature (1)..( 3000): cDNA_ID_2709305_gDNA_ID_2214564_Annot_ID_134928 3000 nt of promoter + ATG
atgggacttctttaagacttggtaaaacgtggggattttctttgtcgaataaggttgtcgatcgacaccatcgcatgaataacgtttttgctggtcttctttgctgaaaagcttccaaagttccttattatgctccatagctctcaaaagtatatatgcacctctaatgactacaaaacatacgaaaatcactagaaagactctcaaaactatcccaaaactatgttagaaatcagtaaaaacccatgatatatcaactctctcagacttagcttttgcttgccctcaagcgaaacaataaacttaacctgtgggaggggtttgaaaacgtagaaactcctgatctttctagcatattaccttgatcattcaaaccaaatccatgcacttaacagttctaatcaagtcctaaccaccatgtaattctctgcacgcttacacaacatcctaaatttcataccaaattccacaattatatctattaggctttcgtcgctgggtctcatcaatcaagttaggattcaagaaccttctacacgcattcatgtactaaacacattttcaatagttttaaaattgatgtatcaatagttttaatagttttaatgatatatcaacagttttaaaattgttagagatataaacacattttcaaaacaaataccagtggcataacgcagacttttacctaatctctttttaaaagaactgtttattttggcataagtaagaaaagtagggatgtttcacatattcgattgtaagtgtgaagattctcaatctttacaattttgacaatatgaaggatggcaaaaaaaaaacatgattctcgtggatacaatggttatttgttttttttggttttgttttatattatctttttctgtattttacaacttcaacaagtttagagatattaaagaaggtgaatggtagttcataaaatattttctggtcatcactctccaagctttagaacatataattataactcatttaatattaagtttgctcatcttaccaaatggcaaaaactgatgaaaagttggctttagtttttctgctttggaaaattttaaaaatgcaaacgggaaatgtaaatcagattcgtgcttttggtaggtttcttttcttttatatgatatagttaattctttgtttttatttagatttgaattttataacatttattgtatattaatatagttctaatatgggtcagttaaatatatatacttctacggggatttatttaaggatgtgtacatgtaaaaccaaaaattaggtgaaagaaaacatgcaaaataaatatgccagatttggccctatagctaatgatacgcgtagtgtaagctacgagattttcgcatatcccgcatttaatgagacgacaaaaactgcaagaaaatacgccgccgagacttaaagagagagagaattgtaatgatgatgagagatataattcagtttgcgtgtttgtgtatttattacgcccctatctatgttgcttcaccaaaagaactgtaaacacctaacttcaaatatctgcatttactaaggcgacgataacaagatcagagtaattgaaggctcaggtacgaatttaattctcaagttactttgttcatcatgtgtatatgagtaaaaagtgagcgctaagtaagggttttaaaactttgtctcatacgaccgctaactttgcaattatgggtgattatcgacaggtgcaatggcgatggttgttcggctggttcgaggagaatggaaaagagatgagtacgggtgctatgaacacgtagcagaactagatgggttatgcttggcggtaaaactccgggaaagggacacgttcgctaaagttgttaccgtcgtgaaggagagactgtcactcgggtcggaggatgaagtggagttgtcttaccaatggctgcagtggatgatgggaccagatttggcagagggcaaacccaatacctattctcgatgatgaggatatgactttgtttatggcgatccgatctgatctagaggaggttcacctgaaggtgaagatcatacggaaaatgttgggagcatcaaccgtaaattcccaccgaagcgtcttagatatggggaatatgacctcggaaacgatatccgataagtattggaatagcagtgaaacacgagcagcttgggattccgcagtaacgagaatgttgtatggtatcgtctctggtaatagtgtaaccggtgatgtcggtctagccaaatacggtgcaggaccccatatagtcaggggagggggtataactatcagagaaaacacgggagagactggtgttggaagcgtcgcaccaagaacgctaacctaaggccatccaactgcaaccgctaaagggaaagaacgtgtcttggacgaagagagcatcaatgacttggagttcgcagtttggaggaagaaccaacaggaagtgatgctgcgagagatggaggagagagaaatacgactggtaagctctacggtaggacagctcgtcacgactccagctaaagctacggataacgatgttagagggcaaacaagttcaaacccggaggaagccattcgtcttacacttggcaacgcggctccagttgctgacgtggtatccgtagtggctctatcttcaacagactcgacattcaagacaccggctaagagtataagcttctctagtgaggatctaatggacgaagacgaagtatctagtaacaattgtctggcaaggataggtatgttagcaaatacagttagtcttatccaaataacattcatgttgacttgtaactaaccgcaggatctgataaagtttttcttacccatatacaaaggcgaagacgaggtggcgcactactactcagaccccgacggaccgctgtgtatggcaccaatgaacacccccaaaatgagtagagtcaacaacattgttaggggggagattgttgcaactgaggcacaagttaatgagttaaataccc

SEQ ID NO: 12655 - DNA, 3000 bp, Unknown
  misc_feature (1)..( 3000): cDNA_ID_2710418_gDNA_ID_2214565_Annot_ID_134929 3000 nt of promoter + ATG
ttttgataccataacaaatgaaataaataaagtgaaagcgtctctattcatattaggggaaattaaataggaaataaaagctgaggggtcaaatctaaaagaaggaaataatattagatttcatggtgaggacggtttggtcggtcggtggctccattggtggtgtgggccttcttactcgcttttttcgaccagccagccgttcagccaccgcctctctttttgttcttcttctgttcttcccaaatgactaatctgcccttttattcattctacatacttttttggtcaactccttacaaaaaattatgaatcattaaatataacatatgtatctaatgcaattcaatgtcatttttgtattagatgttttcactttttttttaattgagtaaaatatgctatttttactgaggtaatgcataattattatttttagtaagaaatcatgttaatccatgattatttcttgttaatccatgatttcaattacatgttaggcataaatcactatttagatgtgttattgatcactttcttctttaaaagtaactttaggtatacattataacatgcaaactaaatatgttttatggtttacatatgacatattaagttttatcacaaatgtgaaacacacctttcaaaaaactaattattctaaattttctaaatataaagattttttttattttttattttataacctcattagattaattgtatataagaaatagtatagaagaaaactaaaaactttttaaaaatatgatgtgtacagtaatttaacaaacattggatcttctcacttctctcttttactatatataaagatagttcttatcattgtctttttttacagcactattgttatcattgtttagtgtcaaatgtcaatatacacaccacacatattacctctagttcttttattttttaaaataaaacaattacatttgtaacattttgataattaatggaagctaatgatcaatttgtgccacatcacatttaggggtactaaaaattataatgagagaaaacaaagggcaaaacgggaaataaaaacaaaatgcgacggtcttctcgtccgccagatttggctttcaaaaatacgaaacgaccccacactcactctccactttataaaccctaaaagattctccttctctctctcacacacacccaatttgcatttctttcgtcatcatcatctactctttctgcgtttttcccagctgaataatctaaacaaggaaaagtaaaacagagtaccaatctcagattcatcagctccacttggtaagcactttcaaattcatggtctgtttctatcatttgatcttcttaactcttttttcgggatttctaaccgaccacaaattgattcagatcctttaagttcattttcagaaaaatgggttattagaaagttttgttgggtgccgcttcgtcttcttcttagttactgaattctctaatttgtatgattttgaaatattcatcgatccaagtttcacgtctctctgcgtttagatctctagagatcgaacttgtttgtgatagctgcagattcatcagatgaatcaaatcattttgaagtagtgttgactctgtagtgattaatcttaggatctcttgtgttgtgaacggatttagaagggtttttttctatggtgattaaggtgaagaaatttttgaactgtgtgattactaatctgaacttcttacaaacatttagtggtaggttttggaaaaaaaagtattatactactaatcatcgtcttgttctgattactagattatagtattaattaaatatttaaaacatggtaattaggaacatgatttgggtgttaagcttgcaacttttgaacaaacaaataaaaaaaggttgcttgcaagttgcacagccttaccaatatatatgtctttatctatataggcaacgattagacttagaccaaataagttgacaaatcaagataaacttcttagattagagaaattcctcttttgatcgaatattcttgggttttatacagaaaaagaaatttggttggatattgaatcaagcgttaatgatgtttgtgatccatcatcagcaaccatttcttgtatcgttactctttagtctttaccttaagatttaactttaatgcgttttcgtttgttcttttagttttttttaaccagatgttttataaatagaataatattctggtctttgttttcttgttacaaaaccacgggctcatgagtcatccgctgcatctggtcggcgtaccttatgattcttttcattctctattatatagtcgtctaattatatgtataatagaaatgattgctattagtttaatataatttgctttctagtacttatttgttttggcacaatgaaattgaaaaccactttactttattttcttatacaaaaagaaagaaactttgatgatgatggttttggtgggcactttacacattacttatctttagtttgtttggtaggaatttatttatataataagtgtgcttttattcatttgtattctggtagagattgttggctattgaaacagattcttactctggtaacatcacatgcctgcacccataatacctattgatctttgtcttctcctgattgtttttggattctttagctttctgatctaaacatatgtcattttctaaacttaaaaaaaaaaaaaaaaactgaaacgaaaattagaaatctttattgaattggtatttcaaatagttgtgtaatgagagatgatgtatacctgttgactgttcacattaaatatcttatcttgtttgttttgtatctcttacttgcaagctactgttttcttttttgatgtaaagaaggaactttaaatctgatatattagtagaagtatatcatcttcgaatttcttctcatgcgatatcttatatttcttttctcttctgcagaatttaaagtagccataactgttcgatcataggatg

SEQ ID NO: 12656 - DNA, 3000 bp, Unknown
  misc_feature (1)..( 3000): cDNA_ID_2709350_gDNA_ID_2214565_Annot_ID_134930 3000 nt of promoter + ATG
tactataatctagtaatcagaacaagacgatgattagtagtataatacttttttttccaaaacctaccactaaatgtttgtaagaagttcagattagtaatcacacagttcaaaaatttcttcaccttaatcaccatagaaaaaaacccttctaaatccgttcacaacacaagagatcctaagattaatcactacagagtcaacactacttcaaaatgatttgattcatctgatgaatctgcagctatcacaaacaagttcgatctctagagatctaaacgcagagagacgtgaaacttggatcgatgaatatttcaaaatcatacaaattagagaattcagtaactaagaagaagacgaagcggcacccaacaaaactttctaataacccatttttctgaaaatgaacttaaaggatctgaatcaatttgtggtcggttagaaatcccgaaaaaagagttaagaagatcaaatgatagaaacagaccatgaatttgaaagtgcttaccaagtggagctgatgaatctgagattggtactctgttttacttttccttgtttagattattcagctgggaaaaacgcagaaagagtagatgatgatgacgaaagaaatgcaaattgggtgtgtgtgagagagagaaggagaatcttttagggtttataaagtggagagtgagtgtggggtcgtttcgtatttttgaaagccaaatctggcggacgagaagaccgtcgcattttgtttttatttcccgttttgccctttgttttctctcattataatttttagtacccctaaatgtgatgtggcacaaattgatcattagcttccattaattatcaaaatgttacaaatgtaattgttttattttaaaaaataaaagaactagaggtaatatgtgtggtgtgtatattgacatttgacactaaacaatgataacaatagtgctgtaaaaaaagacaatgataagaactatctttatatatagtaaaagagagaagtgagaagatccaatgtttgttaaattactgtacacatcatatttttaaaaagtttttagttttcttctatactatttcttatatacaattaatctaatgaggttataaaataaaaaataaaaaaaatctttatatttagaaaatttagaataattagttttttgaaaggtgtgtttcacatttgtgataaaacttaatatgtcatatgtaaaccataaaacatatttagtttgcatgttataatgtatacctaaagttacttttaaagaagaaagtgatcaataacacatctaaatagtgatttatgcctaacatgtaattgaaatcatggattaacaagaaataatcatggattaacatgatttcttactaaaaataataattatgcattacctcagtaaaaatagcatattttactcaattaaaaaaaaagtgaaaacatctaatacaaaaatgacattgaattgcattagatacatatgttatatttaatgattcataattttttgtaaggagttgaccaaaaaagtatgtagaatgaataaaagggcagattagtcatttgggaagaacagaagaagaacaaaaagagaggcggtggctgaacggctggctggtcgaaaaaagcgagtaagaaggcccacaccaccaatggagccaccgaccgaccaaaccgtcctcaccatgaaatctaatattatttccttcttttagatttgacccctcagcttttatttcctatttaatttcccctaatatgaatagagacgctttcactttatttatttcatttgttatggtatcaaaatccacatcacgttgattattttttctatttaaagatttgtttcatttccaagttgtgcaattgaaaatgtatcgtcaccgtcctgaaatcgtcactacaactttttcaataagactacaaaatgacaagtttagttatctacacagtcaatatcacaaaatgtttggttcgacttttatgttcggtggctataaatgggttttacaaagttacatgaacaataataattatggtttacatgttaaatgtatgactttgtttatatatgagcttaaggaagtatttaaaattcaaaagtggtcaagttagccaaattggcggctattgaaacgtccacattgggtcaaagttcaaagaaacgcagccaatgctcttccggacttttcatcgtactttttttgttattaagaagaaaaactaagaaagtcacaagagagaaattcaaacaaaatttttatattagaagtcccaaaacataattcaaattaactaaactacgtcgtactatatgaaattcttattaaaatatctttttgaataatacttctgttgaataatatgtagaagaaaaagagaataaaaagaaccggttcaatctttgtcaaaaaaaataaaaagatttaagattaagccaactcaacctcaactatttttcaaagtgggcgtttttcaaattttctcaaacatagatctttttccaaatgaatacaaaaatataagggtcgacttgctattataaaaagttcctaaattctctcccgtgctcattttgaaaacctccctctttcgctgcaagcagagaaaaagacgacggagaaattttaaatctgaggttcttttagtcctcgcgaagccagatgctactctctattgcacgtctgtgacagaagagctcgattagggaactgaagacaaagacacggagaaattttgaactcgagaggtttgattttgaacctttgaatctctgggtttctgatttcttcgagatttaactaggtagttgaattgaatcctgataccaccttgaagcgtttttgttgtgctttctcagattatccatgatcatgtgatgcactaatttcgtagtattcaattgctgggattctgaaattagcaaaccttaaaatggttgatttgtggaaatttgtctaaccggttaatcggttaacagagttggaactagtgtt

SEQ ID NO: 12657 - DNA, 3000 bp, Unknown
  misc_feature (1)..( 3000): cDNA_ID_2712377_gDNA_ID_2214565_Annot_ID_134931 3000 nt of promoter + ATG
acattattttcatggaatttgtttagctggactgtctggacctgaaagatctggcagtatcgcctctcatttcgacaagtatatgaactcggaggctacattcaaggacttctttgagctctacatgaagtttctgcaatatcgatgtgatgtggaagctaaggatgatcttgaatatcagagcaaacagcctacactgaggtcttctttggctttcgagaaacagctttccttgatctacacggacgctgcttttaagaagttccaagctgaggtacccggagttgtttcttgtcaacttcaaaaagaaagagaagatgggacaacagcaatattccgcattgaagatttcgaggaacgacaaaatttcttcgttgctttgaacaacgagttgttggatgcgtgttgctcttgtcatttatttgagtaccagggattcctatgcaaacatgcgatacttgtacttcaaagcgctgatgtttcccgcgttccgtctcagtatatattgaagcgctggtcaaagaaaggtaacaacaaagaagacaaaaacgataaatgtgccactatagataaccgaatggcacgttttgatgatctatgtaggcgctttgtcaagctgggagtagttgcatctttatcagatgaagcctgcaaaactgctttaaagttattggaggaaaccgtgaagcattgtgttagtatggataattcttccaagtttccttcagagccagacaagttaatgacaggtggatctattggcttagaaaacgaaggtgtgttggactgtgcatcaaaagtgtccaagaaaaagaaaattcagaagaaaagaaaggtgatttttagattcttcaatcttatgagattatttgtagtttgctagccctggcggaaagatctgattgattatcttgtgtttaaaggtatactgtgggccagaggatgcaacaaacaggtcagaagaacttcgccaagaaaccgttagtaatctgattttgccatgctattatatctgaaatctcccattttcttagcagtgttattattcatggcaaattattttcatccaaatacttgaaattagtccatgcaccctgatactattaggcttatttttcatgtgcaggaacaagttagctccagagctcctacgtttgagaattgttacattcctcaagcaaatatggaagagcccgaactaggctcccgtgcaacaactcttggggtctattattcaacacaacaaactaatcaaggagtgggtgcacattattactctgtcattttgttgtctaacaatttttatattactgtttcattgaaattgatacactgttcttgttattctggcagttcccatcgatttcttccatccagaatggttactatggacatccgccaaccatacaagctatggtgaaatgctttatctatctcatttttagtttcaaagcttttgttataacacatgcaaatccatatccgtaaccaatatccaatcgcttgacatagtctgatgaagtttttggtagttaagataaagctcgagactgatatttcatatactggatgatttagggaaacttgcattctattcatgaacgaatgagtcaatacgagacacaaccaagcatgcaaggagctgtgagttgatgttctatgctatttaagtatttttcgggagatatatatatcttattgttctcctcctcccgagtcaagttgttctaagaaagaaggatctatttcattttgtggattgtctagtttcagggacagacggggtttaggggaagcgctatccgtggctgctatgacatcgaagaaactctgcacgacatggtatgtaatcttgtgacgttagtaaaaacgctctaatgttacaaaagaaagaaagagaaaacgaacccaattcctcaaaatgttttcttttgacaatgtcaacttcttccttctcgggtttttatcagtttgattgaagcgagactgcgaaattcctctgtttacagtagaaaatgtgatcagccctatttataaccgttgtatgttttccggtttttgtttgtgcagacaatggggtcctcacagtttcagggatctgattcgagccatcctagtgatcaccgcttatccaattaacagaacagaacaagctcaagagttgctactttcatatctttaaaatagtggaatgttttgtatgtacagaaataggaaaggtctaaagtgtggaactggctttgaggtaaactcttactctgattggatttgcttgtatttataccggaatcataatataaatatatgattaatgtattcacattctctaatcttcttttagacttgtagttaccattcaaaagtcatggacaaccttcgttaaccttgagggccactgagagacaaccttggacttggtcactggctcacttagcaatattcagttattcactctgttgtatataactcaccaattaaattcaaacaactaattcaaaacattatactatagcttttcattaaaaaaattccaaaacattcatttaattatataaaccaaagaacagcttttaagacttaaaatatttcctaagtatccaacaagtcaatacagattttttaagaaaactaaaccattttttcaactttacaacaaaaacaccaactgttacaaaaaaactctcgaatttcctatttctccagccttatgacaaagatatcagattaataaaatttagaattcattactttttcttcatttttaaaattatctacatactatttatttctctccattttattcagtgagaaaataaaattacaaatgcctgaacacaaaaataaataaaattagaataatcagtttcctctagaggatattcttcgtcacaaaattaaaaaaaaaaagagtaggagaagagggaagcgactagcaccttttgtagttttccgtttattttctgtataaggcgggtgatttcggctccttcatcggaaatt

SEQ ID NO: 12658 - DNA, 3000 bp, Unknown
  misc_feature (1)..( 3000): cDNA_ID_2709354_gDNA_ID_2214565_Annot_ID_134932 3000 nt of promoter + ATG
ttattatttagagtgattctcactaaatcttaggcggttagcaaccgccatagttttcaaaatctcattctatcgggattaaatctgtttttggtgactatatataaacattggtcgaatttttaggtaagtaaaatcagagttatattgaaaagaatcatgaaattaaattacaaaccaaagtagaacccatgttttgcttttttctttaatttgactttaccaacgtcgagtttcagagaaacttaaagaaacaaatgcagaagcaaaaacttaaacggcaaaattgtaagaccccaaattacttattagaaaaagaatatgtatatgttaccttcaccagtgcaactcatatcactagacaactaagaccccgacgaaagaaaaagtttttaatatcaagattcattttcttacagtaatatcaagactttttcatcttttagactacaactttgaatacattgaagaaaactacaataagattgagaaaaattatgtttctctaagaaataaaaaagtaagatatatattaaggttaatttggaactgtattattttgaatcaaaaagaaactcaaaaagtgtgaaactcaaaattaagtctcctcatataatttgaaactcaaaatgaactaaaagtaaaccattaaatgatgtatgtatcctcaaacaatttttgaaacaatttaaaatttatctacgttactataaggatagaagagtacatatacttacttaaaagtgttatatttaaaatttataaatgtgctaaaaggaagaaagatagagcatccctatatataactgcaacatttatggactatcttttatgaaaacttaggctcaccacacttctttgtatacaaattgtatcatttatacatttatgaaaaattaatttggatgtattcatgtatagattgtcaaattaatttgtacacccacattttaaatatatgctaatattaggataagtattctgcattttaaatatctaatggcaatacaaagtttagttagtaaagtcaaaatagttaattatttttttctataacataataatttgaaaaatgtattatgtaatttgataatttgtacattaattttattagtataaagacaaataagttagattaaatacttatagaatttgttgacaaaaaaattaacaatattaaacgaaaatgacaggataatctgtatccagaaagatgatgtgtatacataactgcgtcaagacggatattgtatgaatatatgtaatagaacattaagaatcaaataaaaagatgtaagcatatgaagatgtaaaaaatgagtcatagtatcgacatatttagagtttgacttgatatgtttaagcttcattaccattatttttctctagctaagagaggagtcaacttgtgtgctacataggtccgtacattttatgtcgacattctttcgccattctttttgaaaaaagaaaaaggaaatattctttgtcttatatcttttcatcttttcgatttcttaattatttaaaaatagtatcgtaaaccagggtactcgtgacgacgtgtctgaatcagtctagtttgaattaatataatgaaaaactaatcactatgaagcaaacgatattaatttactctcttttttttcataatagtcgctctcgactacgtttacgatgcccacattttcctttgagaacatatattaatttgtagtcactatgaaaattaatactgttacatagaagacatatagaattccactttaacttgagttccacaagagcaaaaaataatatttctcctttttacaagatttaatttttctatgagactatattttcaacataattttgtgatatatgacttaaataaattaattttgatttcatatactaattatatgaactggataaacattttaattacgtcataatatcatatgtcatgcttccagttaatcgttatcggaggcttcggcccatgttgtctgaaaacccaagccatatcaatcatttcttcatacaaactaaaattccttcaattggagaagggatatgaaaataagagaacaatccaacaaacaaacacttacaaaaagatttagagacatttcctccagatcaatactcaattactcaccaaaattttgaacgatatatacttctgaactaaacatgttatacgcatctctcactcattaaaagctttcccaatatcatattaatcccgggatactttgaccatttattcatgtcgcatggacaactagttaagagtacatcgagacattgtatgagaatatcagtgtccccaaatctctgccaactccaccctggagaagggacatcacgtcggcaagattaaacgattactggtcgtacacagattcaaccttacctaacgcatgaacaaaccctccagtgagaaaaagacgcatcaccccatttacaattatcctcgcgcggactaatcccaagtcgaggacgcaactaaagctctgagactcatgatgagtttcctatttcatacccaaacgatatagtaatatcaaattattgctatattaattaaattaaacaattcgttcaagttgactttcattagatatgatcagatttgtctcttatgaatcgtaactaataatgcgcattattatataaaacaagtttaaatacatggtatacttcctaaaaaattacgtattgagtttgaattaattttaccatcaagatctcgtgaagataaaagggcaaaacgagatacaaaatcattagttgaatattttagtttttgttagtttaagaagttcaatatcttattaacgaatgaccaaacgaacaaaattaatactaccacacatttttatatgatattaatatacgtatatatacattcagtacttccattaccataccaagcttttctcttcttttcatcatcaagaatccaacctatccggttcataaaagccctaattttaaaataagatagagatt

SEQ ID NO: 12659 - DNA, 3000 bp, Unknown
  misc_feature (1)..( 3000): cDNA_ID_1808383_gDNA_ID_2214565_Annot_ID_134933 3000 nt of promoter + ATG
gtatcgaggacagtgttacagcgacaaaaccatttgtaataaatttagatctctttaagatgtctttctttcttccaaaaaacaacattgtgattttagtctttgttcttgacctagttcatgatataaaaatcatcatcccttttatctgaccttcactcatgtttaatcaacttgaatcttatgagacctactacaatcacacaactctcctcttcttagagcttgctgcaacaatgacttcatcgaagctgatatagagtacctaccgtacctaaagtgtttcattaagttgatcaaacttgtgaggcaatgagattttgagaggatagcttgaacctctttggatatagctacaccaagattgctaagatgttctaccaatttcagaataaatcatcaatgttcacatcaattatacaactttgatttttccatctcaaacgtatatatagaatttgagttgcatatagatacgatctttacctatacaatcttgttaaagtagaccacatcgaggttgcaattaatgttctcccgcaatatgtaatcacaaacaataaagattatcaagttttaagtcttcctatatcacaaactaacctttaaggagtcttaagtcaatttatgtgtttcaccagattctacctttgtttagacatggattgtgtctttagcatccattcattcatccatagttacaaatcacctttccatcaaaatgatccactcccatccatagtagtatccaccaccattaaaattgtaacatggggctatgaatatgatagcattcttcgattcttgcatcaatctggaacctaaatcgaagcataaactacaccaaatacaatcgtaaacaaccagaacaaagatctaacaactcatgctcaagaacatatatagattaatgatggagaagatagataagagaagtagatgaacacaagaagttattagttaagatcaatcggtgtgatattgatcctacatctcggcgagagcgggattgaacaattcataaacttaacttcacaagatcatggagagctccataaatccggaggttcacgaatcatggccaaaaaatctatcgtacaagataacaacatgaacacggctcataaaaaaccttatctctattaatcagtaaaaccctaattttcagccaattccggttcagttagtcttcggtttaacattttttcttcggtttaatatttaaacaaaaaaaatacaaattcggtttaatgtcacacaaccattactaaaccgcgtgattcgaagcacaacttaacaattagaaattagaatattcatttttttcaaaaacaaatttggattattgcattattgtttggataaaaccacgatgatgttcacatgacaaaatgatgtttagtgaacgagacgccaaccgctttatatgaactgttttagttcggagattttgcgagttccgactatgggttagaactaaaattttcccatattgtcaaatgatgttgttataaataatatattctctacataattactgtggaattaaggaacataaatttgattctttaacagagaagtgaagatattggccatgcttggttgggttgtattatgccctacttttcttcccccccaacacaaagaatccaaccatgtttaaccaaaccaaataaatatataaaaagcaactataaattattcacttgaagaaatgttaattaacaaatcgataatttttatttaaagcgaattcgccattccatgaccatatggacaaaaagaagctttattgggccaaagtacccacatgcatatcccacagctaatcttttttatttttgacatatcccagctaatcatattccatgtttcttctatcctttttttttaaaaaattgattatattcccatgataatcatttcaattgttttacctaatcctatatttgttcggagtttctactagaatttctatctacatcaacatcaaattgtaatagctttatgtctttgctaaagcacattacctatgtagcaaacaatcgtattaaatataaacgaaaatatagctttatgtcttttcactaaaatcaacaatactaatccaaatcggagatttgctttcggtaaacatttttgttcgactttttatctagaatattataaagtaagaaattttgtgaataagttactaaaatgaattcattacaaaagtagataaagtataaactatcatgataatttagaagtaaaaggattatttttttgtgaatagtaattttagataaataaattatatatctactaaagagtaaataaaaatatcaatacaattatttaatttttaagggcaatacaattatttatcattttgattcataattaaaaaaaattgtcgacaaacaaaaaagcttcataattttaaatttagcatatattaagagatatttcataagagacactaatgtctttctaattttcatgttaacttggatgttttaaatatcaatcaaaaaggttataattgagcctcaccaaaaaaaaaaaggggttataattgatctgattcgatcaattatccagtgtaattatatattgcaatctagttaatgatataacgttataggtctcatttcctacattcaactaaaaggtaagctaaaaaatctaaaagatacaaatatccaacaggagaaatatctttttctctcattgtctatatttgttgttcttctatctctttctctctctttttcttccacaccctcacaactttacttacgactttattatatatataccaccaacccattttgtcataaaagatcattactcgttaagactttccactacccattctcattctctcttcaactaatattcttccccggccctcataaagaagcttctcctgttctttattcacattttccaaaattgtatcttcttaaagtatctccaacaaaactaaatcctactaagttaagagatttgaaa

SEQ ID NO: 12660 - DNA, 3000 bp, Unknown
  misc_feature (1)..( 3000): cDNA_ID_3026049_gDNA_ID_2214565_Annot_ID_134934 3000 nt of promoter + ATG
tagtgacgatgtgtctacttccagatttgcgcaagtgaggattattgacaggcatagacaagacacccccaaacatagatgccaaagacaaaaactttctctgtctctagttttgttctgaaaccaatcgcaaaacaactgacatagcttaaaacctaactcttacgaaattcaactaaaactagtgtctaataaccaaccacgaaagtgaaagactttacaacgaagaaagacaaatgagtaccttccaaaacaggaaactttcttcaccaatagcttgctgctactctgaagaaggcgtcaacactgctcaacatgaacaatcgcatcgagatgatgttaaacccaattgataccaaagaaaataaaaataaagtaaacccatcaaaagattcaatctgaatcacaaaaaaaaaagtcgatggctttattgaagcggctgagaaagattcaattaaaaccctcttttgtattttagcgaaaaactcgcattaacaaaaaaaaaaaacgtcttcaattttttccctaaacgtcaaagtgtacattgcattgagtttcctcctatgaacaattcacgagatgagtatttacgttgtaagaagaattaaggaagacttggaaggcaaaacccagaaaaggaacaatcaataaaagtcttaatggagagaaacgattttagatgaaaagagaaacgttgtgatgattagattaatagcaaagacaataatcaatgaaagcgagacagagggataaacaaatcgaaagagttttttttttttttttttggttaagaaaacaaatgtttttgttttggtcaacggcttatgcaagttaattgactttaacaattcttttgtcttatcaaagcaaatctcttaaatcttaatatagtactagattttgttcatgtaaagttgaaaaatcatccaaaaatggaagacaattacataagatttcgtatttgacaatagtagaacattattaatttattataatcattttcacttaatttgtttacgtttgttaatttgataaaaagctaaaatatttcacatataaagtaagaaaggtacaaaagaaaaatagtttgaattcggtttttcctaataggttcatgatgaatattttattgtctagatttatcgagttgttcgtagttttgataataaacttcttgtgcgtcggggttaggccgagttgatttttctaaaaagaaagacatgtttaaaaaaaaaaactaaaattcttaagtgaagtaccatttgaaaatttctacgtgaagggaaaaaaaagataagttaatgcaaacaccatgacgttaagaaaaaaaagtcaatgccaacaccattttgttttggtcgacggattagataatgcatattgtgcagacgtattacttctttgttgttacggtaccaatgactcgatagtggtcaaccagattggtgaaaaagcccgaccgaacataaacgagactgattttgtcctacatgggcttcctctcagcccttcacgtcattcggtttctctacttgagatcaactttttctaaaaataagttgaaatcgtggaagagcagagccgaagccgcaaagccctaggatttatcattggaggatcgtcttgcatgcctatgcaatatgcgaccaaggacctcacttaatggtggagaaataggcgacgacatgggaaagctccacacacagtttcttggatcatcgagtggattaacaaacaaatccgaaaccgttttccacaatccgacttctaggcgataaacgctatgataacggattacaagtttggtttgaaacaaggatctaagtgtaaaagtttctaattttctgctaaaattttctactattcgatgcactagttgtacaaacgctatgtttttctttaaatataatttaatattattttcaaaaaaaaaaaaaatttatagcgagatgttatcaaagctatgggcttccatacttggccatccctattttaccgtgatgttcttgaccagatctttggctcgcccacagctcttgtttgcctgcaaaaacaacgatgaagtatttttcttctcctcacctcagcctcataatccggatgagaagtcgtctcatgtagccgccactagtcacatgaaaattccgtatgactttgtatttgaaagattcagtcctatcagaggtctggtctttcttagaaatcataagatatcttaaatggaaagaagcagaagttgtcggtgatatgtaatcagaggtctggtctttcttagaaatcagaggatcttatatcgaccactgtccatggaattgattatttatcaaggcacgatgagttgtctcaggagcatacatttttcattagtaactggagaaccttcatggacactgatcgaatgttgcataccccactatcctagtatcacatagatatttattggttatatgataattcattcttctattttccgtgaaactacaaaacaaggaataaaaacgtgactaaacaaaaatacaaaaaaaaaaaaaaaaaaattgggcaagaaaattatggccacgttttgttgatagcatacgaacgcgccagaaaattagcaaatttaattaatttcactgaaaaaattatttttgtgtgtgtatgatcataatgattccagtaaatgatttttgtagttccgtcaagtgcaaggtaccatgacaagcgtattaggaatgatgaaccctaatctgatcaacggaagaaatctccacaaaggatcttcaatttttgtacaagataaagaaactaaaaaacgagtccaatggagattatcaatcaaggagggatctctaagaacgcatcaagccactgcttcttctgcaacagaaccaaaggttagtagtaacaacaatctttgagcttttttttctgttaactctctggttttgtgtttttgaatcattaatcttgaaaacacaggcgacagagttcaatacgacgacgtatgaagacaaaatg

SEQ ID NO: 12661 - DNA, 3000 bp, Unknown
  misc_feature (1)..( 3000): cDNA_ID_2709364_gDNA_ID_2214565_Annot_ID_134937 3000 nt of promoter + ATG
aagtatctctctttcctttggtttttcgtttctgtcttcaacaagtttccatctttctaacacggtttatgatcatttctcttagtaccaaccaccgccaccacaactgccgttatcgtctagtttacacgctatacaagatcttgatcagtctaggcaatttggatacaacgagccaaatgtttctttatgtgaaacaagcaacagaactgctcagtttcaacgtggacactttcactatcaggtatctaatcgatacccttcgaaaactgctcaaagtgtctatcttttataagacaataagttgctaatatatatgtatcatcatttgctttaggaactaaacacaccatttgcaacagagagcttaaattctttattggcctccactgaagcgaaccagaacttatacacagtgccaccacataatttcggatatggtgagcccattggttctttatatgaaactagtaacagaacttatcagcttcaacgtggacactctcactatcaggtatcatcaaatatgatcttatccgtttcatctgctcaaaagtgtccatgttttataagactatgagttggtaatatatgttgttatcatattctgtaggaactatacacaccatcagttgaatttcagacgttattcccactgccacctcttaatattaatttcaatgagcctggtggtggtggttcttcaattgctgctgattctagtcaacaacaattcagctcaaatctacctatgtggcatgaaaatcagttgaacataggctcttttgactctggaccttcctcttctacagtggtaatgtcaaacatggacctatccacattcggtaaatcctctgaaatttgcaataaagcttacagatttgatatattaatcacacttgtcattaggtatcatcatcatcatcatcatcatcatcatcatcagaaaaccaacaagatcatcatgaacaagttgtaccaccaaatgaacttgatccattgaccatccagagaaatcaataccgagaggaagcaaaacagagatattttgagaagaagaggagtcgcaagtaagtgtttcgtttagctttctagttagggctgggatttcatcttcttattattgaggattttggtgaatctttgcagattcgtgaaggcacaccgatatgaaagtcgagcacaaacagctgcgaagaaaaaacgaagcagaggtagatttgtgaaaaacgatgacgaattcgacaatgaccccccagctatacagtgattgttctacttgtactttcgaaaccttggtgaaaaatttgtaaattatgggtgtcattgtcaagctttgttttttttttttttttttttttgtctctgatggtaccttcaatgtcacggaacatagaacttatttactacttctccacttaaaataactaaattggcgaaatgacccctcaatttcttcatttactttcaatgttacccgaaagtttaattttcttgtactttcgactttttcatttctccaaattcaccaaacactctctaattatcaactctccccacggccgttgccgccaacaaatccgccgcgaatccccaaatgtaatctccataacctctactatatcgacactgtgcagcttagagctgtcaaatggtccagcagcaaagccaggagaaactggaaacctcttagaccatcattaacgcaggcctcttaggtgggtttttagggttgttttgtgattaaaattaaattgcaaattgggctaaaatttaagaggcgctcttatataagagggccaaattatattaagaggcggtgacgtggcatgggtgagttgtctgaaaattgaagaaaaggaaagaaaaaaaaacagtcgtgggtttttgtttcttcagtctgtcgacgcttgctctctctctatttatcgaattccccgacggtgaacatcaccagacaaggaggaggagactaggaagatcgattttatcaatctcaattgaacaagatggtaagttttattgtttctcagttcatctttttattcaattacttgttttctatgtcaatcgtttgatttatcttctggtccttgaggttgtaaattgggatagaccacgtttgtttattgtaattgatcccctaagctctaaaattatttttcattgattttgattgcgattagtatgaatctatttggagatatatggttttcgatgctatgatttggttctagggtttattttagaattgttatttcagagtaattagatatttcgtgatttctcaatcgatttctcaatagatttgtctctttgatttggctaatctaatcattacttgcgttctgtcttttttttcttttcttttcttttttacctttttgattattgaggatcatatttggttttgtgtttcattgatttagtttcatcatgtgttaactcttttcaatttgtttcttttttgcagtcgactctgttagctacatgtaaccaaaattgaaaccaaaactaaggttcgtgatcacttattccttttgatcctttgagattcatgtaaattaggttttttcttgttgttgttgctgtgttgtaggataatgtgtttgtgcagctggtttgtttgattcaatatcgtgtagtgaaatctagtgttgatgatgcattttatgagcttcaaatccctaaagagcaaatcctagcttatagtgattctacttttgttaagctaaccagttggtggtttgagtcttatgacttgtttattagtgtattaattaatttattttttcttaagaaccccaacttaatacactaccattgcacaatgccaaaaaataaaacttctacccaaaatctaaactacaattttttttaaaatcaattcataaaatattgctaagaacctttgctaataacctcccattgtggatgctcttagagtctaatgttagaacttcagtttcttcttttgtagccttcttcatcattcaaaat

SEQ ID NO: 12662 - DNA, 3000 bp, Unknown
  misc_feature (1)..( 3000): cDNA_ID_3026036_gDNA_ID_2214565_Annot_ID_185983 3000 nt of promoter + ATG
ccgaatacttgctttgtgatgtgttgcatatgtatgtagaaatctaagagctttcaattggtaacttgaatcgttatgaagattagtaagttctttttgttgagtgttttaattggtgtgcatgtatgtttttgcattgtaaatttcagttgactgaaatcttgtaaatttatttagtcttgtgtcgctgcatcttgcatgttaaggttacaaaatcaattttattagttggaaatgtaaaagtcagatgttctcttgtctctataggtcaggtttaatgtatatatcgtatgtgtgatacttttgttgaatttattcagttggaagaaactgtaaagcatgatgagaatggaaagcctgtaaaacgattgaggagaagagaaactttagtgcattcagaaaatgttgctggaagaagcttttggaatgagcactcctctcttcataaagatcttggacattttgcaaaagacattggcaaaattgaaccagattatgttaagtcgtttcagtttgagagtagattattacctttaacttgggttgtggttaggattgatggctgccattttcacaggtaatatgctttttagtctttgtttattttcattgttagacaatgtgtcttgcatggaagccttagacttgttaaaaaatatacatatgttccctacgatttccttaagctataatgctatattacaagtttatacacttctgaatgctatggtcggtctattcttacattgcgattgcttttgtgctctgctttaaattgtgatttattaggcaatgcttctactttttggaacttagaaaacatataagaacagtagttgacagctttgacaaacaaacgcctgcctattgcttgaatgattactatcgttatattgtaagtgaaactcatagagcttgctttggattttgatagattttctgaagttcatgaatttgagaagccaaatgatgagcaagctctgaaacttatgaattcatgtgcagtggctgttcttgaggagtttcaggatattgcctttgcctacggcgttagtgatgagttcaggtatgtaactctcagcccctttaaaccaagtttacatttctagatactaatcgagttcatctttggtttgcagctttgttcttaagaataaatctgagctttacaaaagacagtccaggtcagactagttttctatgcccttaagttttcttgttgcaggataaacttatctgtcttctcctaggttttcttgttcttttcagtctttataactttaatttctatatcttgttacagtaagataatatctgcagtagtatccttcttcacatcgacttacatgatgagatggggagattttttccctcacaaaaaattgaagtaccctccatcattcgatggacgagctgtttgctatccaacatcagatattctcctggattatctagcttggagacaagtcgactgtgagtatacttgtcttataaatgattcacttgtcttgtgagattgttgcttgatatcaaatagactcgtagtttgagttggatgctcctttcagcaattttgttttgtcttgcaggccatatcaacaatcagtataatacatgtttctggatgcttgttaagtctggaaaaagcaaaattcaagcccaggattacttaaaggtgctttgttcgagtagccaatgctccctcttagttcaatgaataaatggcttgtcacttacatttggctctgtttcagggtacccagacacgagaaaaaaacgagttacttagccagcaatttggaattgagtacaattcattacctgtaatcttccgcatgggttcttccgttttccgcctaaaggtgctacttttattatcatactccaaaatccttctagtgtttcatagcagattcttattattgtgaagaaaagaagggtcctttcaagagaaaccttttaaggcattcttgtttttacaagtggtctgaaatagttttaaacaagtggtctgaaataagtggtctgaaatagtttttacatttagacgcaggaaggtgttacagaggagaatggagaagtttcaggaaagcaagtggaagcagaagtgggcgtagactattcaaacattatcgaccaatgtttctggcaacaacatcctcacattcttagcttctcctaagacaggtattcattgctaccaaaaaaaaattccaaaccgaaaaccgaatgagattcagctcttattttgataaaccgaagctaaagtacaaaacaatcgaaccgaatggtttacttttttctttcactattttttgtttttttccattattttaaattaacctttttcaatttggtagttaattttttccttcaatgagagatttgggttgttaattttcctttgactggtaggataagcaatattagtgcttttcttttttttggtaaagtaagattcgtaaaatgtattgactaaaatgataaaagaggaagaaaatctcatccaaattttttgactaatatgttcatctaaggtaagttgacccaaagtgagatacattgtgttcttgcctaatgattactatagtagaatctcattccaagcacaacaatatttttaaattaatttcaaggggaattccctaattttcaattaatttgtatttataacacctaggtagatttttctctattaattgaaagaaagttccattactaattaattaattagagatttttaacttcaatcataggtgctaataacacaattaataatattttatttctttcattcctttttcaccattttaaaaaagtttattaattaaataaaaaaataagcgttacctccttcgacgatcagacgattctgccattgtcatacatttggcttagctcgtaacgtttcctctctctctctctctcgttccacaccactacattctccgtccgtcagaatcttcgaatttacctgttccgccaatcactcctcgcgta

SEQ ID NO: 12663 - DNA, 3000 bp, Unknown
  misc_feature (1)..( 3000): cDNA_ID_3026039_gDNA_ID_2214565_Annot_ID_185982 3000 nt of promoter + ATG
gagcatcaaattctgattttgatcataagttcataacttctgtacttgaggcttatagtcgaattcattgattttaagagcaaaaagaaaagtatttctggaaactatggttttgtgtattcgtctagtatttaaagttttgaaggtttaactatatattttgctttcaattattcaaatcccatttgaaaatgtgatagacgaaaaaaggtaagtggtaacatttttttttctttctaatcgacggattaaaataattgtgtctttttagtacccttttttccggttattgtacgaatgacttcactgaaggggaaaaaataatagttaaccataaagtaattactattctctacctagcggagatggtttatttcggtttagtcgaatggtttagtaccctatataaaccatttaaacttttaaagttgcaaagagaaacagaaacagagattgtgttgatcgtttttgaacactcgtcaagatttagatcaagattcactttttagtctttctctcgctcataggtatgtttctgcagattctttgttgtttctactaaatctctttcttagctcttttctcaaatctctgtctctccctctccgatcgatctcaagtaaacagtaactctgttcttatctctccctagctgctcattcaagacttgctattttcatctttttgtaatgcttcctgcgttttaccctaaaaacgaaactatagaagagacgagatagagattctttggaaagaagttaacatgaatgatgattgggattgggagggtttttatgatgagatagaggattttctcaagatattcggagaaccagaggtaaagtcttgttacattttcattgtataactagatcccacatttgtttaacgattcaccatattggttagacaccagcgttactaggagatgcagaaacgacacttccgttgaacatcaatcctcgtcccgagcctgtaccatctcaatttcaagtatctctctttcctttggtttttcgtttctgtcttcaacaagtttccatctttctaacacggtttatgatcatttctcttagtaccaaccaccgccaccacaactgccgttatcgtctagtttacacgctatacaagatcttgatcagtctaggcaatttggatacaacgagccaaatgtttctttatgtgaaacaagcaacagaactgctcagtttcaacgtggacactttcactatcaggtatctaatcgatacccttcgaaaactgctcaaagtgtctatcttttataagacaataagttgctaatatatatgtatcatcatttgctttaggaactaaacacaccatttgcaacagagagcttaaattctttattggcctccactgaagcgaaccagaacttatacacagtgccaccacataatttcggatatggtgagcccattggttctttatatgaaactagtaacagaacttatcagcttcaacgtggacactctcactatcaggtatcatcaaatatgatcttatccgtttcatctgctcaaaagtgtccatgttttataagactatgagttggtaatatatgttgttatcatattctgtaggaactatacacaccatcagttgaatttcagacgttattcccactgccacctcttaatattaatttcaatgagcctggtggtggtggttcttcaattgctgctgattctagtcaacaacaattcagctcaaatctacctatgtggcatgaaaatcagttgaacataggctcttttgactctggaccttcctcttctacagtggtaatgtcaaacatggacctatccacattcggtaaatcctctgaaatttgcaataaagcttacagatttgatatattaatcacacttgtcattaggtatcatcatcatcatcatcatcatcatcatcatcagaaaaccaacaagatcatcatgaacaagttgtaccaccaaatgaacttgatccattgaccatccagagaaatcaataccgagaggaagcaaaacagagatattttgagaagaagaggagtcgcaagtaagtgtttcgtttagctttctagttagggctgggatttcatcttcttattattgaggattttggtgaatctttgcagattcgtgaaggcacaccgatatgaaagtcgagcacaaacagctgcgaagaaaaaacgaagcagaggtagatttgtgaaaaacgatgacgaattcgacaatgaccccccagctatacagtgattgttctacttgtactttcgaaaccttggtgaaaaatttgtaaattatgggtgtcattgtcaagctttgttttttttttttttttttttttgtctctgatggtaccttcaatgtcacggaacatagaacttatttactacttctccacttaaaataactaaattggcgaaatgacccctcaatttcttcatttactttcaatgttacccgaaagtttaattttcttgtactttcgactttttcatttctccaaattcaccaaacactctctaattatcaactctccccacggccgttgccgccaacaaatccgccgcgaatccccaaatgtaatctccataacctctactatatcgacactgtgcagcttagagctgtcaaatggtccagcagcaaagccaggagaaactggaaacctcttagaccatcattaacgcaggcctcttaggtgggtttttagggttgttttgtgattaaaattaaattgcaaattgggctaaaatttaagaggcgctcttatataagagggccaaattatattaagaggcggtgacgtggcatgggtgagttgtctgaaaattgaagaaaaggaaagaaaaaaaaacagtcgtgggtttttgtttcttcagtctgtcgacgcttgctctctctctatttatcgaattccccgacggtgaacatcaccagacaaggaggaggagactaggaagatcgattttatcaatctcaattgaacaag

SEQ ID NO: 12664 - DNA, 3000 bp, Unknown
  misc_feature (1)..( 3000): cDNA_ID_3026045_gDNA_ID_2214565_Annot_ID_185979 3000 nt of promoter + ATG
cgttcgtgatgactccaagctgaagcatgacgtagacaggaacatagttggtcaacattttgtcttcatacgtcgtcgtattgaactctgtcgcctgtgttttcaagattaatgattcaaaaacacaaaaccagagagttaacagaaaaaaaagctcaaagattgttgttactactaacctttggttctgttgcagaagaagcagtggcttgatgcgttcttagagatccctccttgattgataatctccattggactcgttttttagtttctttatcttgtacaaaaattgaagatcctttgtggagatttcttccgttgatcagattagggttcatcattcctaatacgcttgtcatggtaccttgcacttgacggaactacaaaaatcatttactggaatcattatgatcatacacacacaaaaataattttttcagtgaaattaattaaatttgctaattttctggcgcgttcgtatgctatcaacaaaacgtggccataattttcttgcccaatttttttttttttttttttgtatttttgtttagtcacgtttttattccttgttttgtagtttcacggaaaatagaagaatgaattatcatataaccaataaatatctatgtgatactaggatagtggggtatgcaacattcgatcagtgtccatgaaggttctccagttactaatgaaaaatgtatgctcctgagacaactcatcgtgccttgataaataatcaattccatggacagtggtcgatataagatcctctgatttctaagaaagaccagacctctgattacatatcaccgacaacttctgcttctttccatttaagatatcttatgatttctaagaaagaccagacctctgataggactgaatctttcaaatacaaagtcatacggaattttcatgtgactagtggcggctacatgagacgacttctcatccggattatgaggctgaggtgaggagaagaaaaatacttcatcgttgtttttgcaggcaaacaagagctgtgggcgagccaaagatctggtcaagaacatcacggtaaaatagggatggccaagtatggaagcccatagctttgataacatctcgctataaattttttttttttttgaaaataatattaaattatatttaaagaaaaacatagcgtttgtacaactagtgcatcgaatagtagaaaattttagcagaaaattagaaacttttacacttagatccttgtttcaaaccaaacttgtaatccgttatcatagcgtttatcgcctagaagtcggattgtggaaaacggtttcggatttgtttgttaatccactcgatgatccaagaaactgtgtgtggagctttcccatgtcgtcgcctatttctccaccattaagtgaggtccttggtcgcatattgcataggcatgcaagacgatcctccaatgataaatcctagggctttgcggcttcggctctgctcttccacgatttcaacttatttttagaaaaagttgatctcaagtagagaaaccgaatgacgtgaagggctgagaggaagcccatgtaggacaaaatcagtctcgtttatgttcggtcgggctttttcaccaatctggttgaccactatcgagtcattggtaccgtaacaacaaagaagtaatacgtctgcacaatatgcattatctaatccgtcgaccaaaacaaaatggtgttggcattgacttttttttcttaacgtcatggtgtttgcattaacttatcttttttttcccttcacgtagaaattttcaaatggtacttcacttaagaattttagtttttttttttaaacatgtctttctttttagaaaaatcaactcggcctaaccccgacgcacaagaagtttattatcaaaactacgaacaactcgataaatctagacaataaaatattcatcatgaacctattaggaaaaaccgaattcaaactatttttcttttgtacctttcttactttatatgtgaaatattttagctttttatcaaattaacaaacgtaaacaaattaagtgaaaatgattataataaattaataatgttctactattgtcaaatacgaaatcttatgtaattgtcttccatttttggatgatttttcaactttacatgaacaaaatctagtactatattaagatttaagagatttgctttgataagacaaaagaattgttaaagtcaattaacttgcataagccgttgaccaaaacaaaaacatttgttttcttaaccaaaaaaaaaaaaaaaaaactctttcgatttgtttatccctctgtctcgctttcattgattattgtctttgctattaatctaatcatcacaacgtttctcttttcatctaaaatcgtttctctccattaagacttttattgattgttccttttctgggttttgccttccaagtcttccttaattcttcttacaacgtaaatactcatctcgtgaattgttcataggaggaaactcaatgcaatgtacactttgacgtttagggaaaaaattgaagacgttttttttttttgttaatgcgagtttttcgctaaaatacaaaagagggttttaattgaatctttctcagccgcttcaataaagccatcgacttttttttttgtgattcagattgaatcttttgatgggtttactttatttttattttctttggtatcaattgggtttaacatcatctcgatgcgattgttcatgttgagcagtgttgacgccttcttcagagtagcagcaagctattggtgaagaaagtttcctgttttggaaggtactcatttgtctttcttcgttgtaaagtctttcactttcgtggttggttattagacactagttttagttgaatttcgtaagagttaggttttaagctatgtcagttgttttgcgattggtttcagaacaaaactagagacagagaaagtttttgtctttggcatctatgtttgggggtgtcttgtct

SEQ ID NO: 12665 - DNA, 3000 bp, Unknown
  misc_feature (1)..( 3000): cDNA_ID_3026049_gDNA_ID_2214565_Annot_ID_185978 3000 nt of promoter + ATG
agatattgaaagggattatcagaataatcacagctgagaaatacaaaaccacctggaaacatccgaaaaggtcactcttatgaaaaaatgaatcaaaatctctttgaaacaactttaagagaagatgcatctattacactggttgagatgcagccaactttacatctccgtgcgagtatagatacagataggcagtcatgctagtcaatataattattgtcatccacctggcacactgtgacatcggttacatagatgtaatcaaaatatatacaaatgatctaactaagagttgtttaccttccatatctctctgtgactaagatgatctgatcctagataaaagattgctgcataatctactccagaccgagaaaaaacccacaaattaacaccccagagccagaccatcagcgtctgaacaaaatagcatacatgaggaaacacacttgaagcaatttgactttactaatttgagagcagaaaagtaacttacaatgagaaggagagggttataatacagaaatgtctcataaaagaacagttctcttgtctctacgcccattttcattacagattccaatccaacctgcaaattttaaacattgttgtatattaccaagactgaaaactcaaacaatggcttcaaatcaaaatctaagatcattgtttgcaagaataagagttcaaattttaacctttccacaaacataaagaccaccaatatacagagcaacctggagaatcaagatagcgaatctcaaatcagctagttagatgatataaagcaggaagaaaaatttgatagtatggaacaatcagcgagaatctaagaactttgagtaaatgaacaaaaccttgagacttcgaaggaatataggagtttgcaatttcgcataagtactcagaagcatacttgcagtcttcaagtcattatctcctgtccaacaccacaaaccatccagaaaaaatgtaatcaaaatcactaagcagaaactgatttttctagtagccaagatttattataaaaacaaaaactaaccgagattagtgacgatgtgtctacttccagatttgcgcaagtgaggattattgacaggcatagacaagacacccccaaacatagatgccaaagacaaaaactttctctgtctctagttttgttctgaaaccaatcgcaaaacaactgacatagcttaaaacctaactcttacgaaattcaactaaaactagtgtctaataaccaaccacgaaagtgaaagactttacaacgaagaaagacaaatgagtaccttccaaaacaggaaactttcttcaccaatagcttgctgctactctgaagaaggcgtcaacactgctcaacatgaacaatcgcatcgagatgatgttaaacccaattgataccaaagaaaataaaaataaagtaaacccatcaaaagattcaatctgaatcacaaaaaaaaaagtcgatggctttattgaagcggctgagaaagattcaattaaaaccctcttttgtattttagcgaaaaactcgcattaacaaaaaaaaaaaacgtcttcaattttttccctaaacgtcaaagtgtacattgcattgagtttcctcctatgaacaattcacgagatgagtatttacgttgtaagaagaattaaggaagacttggaaggcaaaacccagaaaaggaacaatcaataaaagtcttaatggagagaaacgattttagatgaaaagagaaacgttgtgatgattagattaatagcaaagacaataatcaatgaaagcgagacagagggataaacaaatcgaaagagttttttttttttttttttggttaagaaaacaaatgtttttgttttggtcaacggcttatgcaagttaattgactttaacaattcttttgtcttatcaaagcaaatctcttaaatcttaatatagtactagattttgttcatgtaaagttgaaaaatcatccaaaaatggaagacaattacataagatttcgtatttgacaatagtagaacattattaatttattataatcattttcacttaatttgtttacgtttgttaatttgataaaaagctaaaatatttcacatataaagtaagaaaggtacaaaagaaaaatagtttgaattcggtttttcctaataggttcatgatgaatattttattgtctagatttatcgagttgttcgtagttttgataataaacttcttgtgcgtcggggttaggccgagttgatttttctaaaaagaaagacatgtttaaaaaaaaaaactaaaattcttaagtgaagtaccatttgaaaatttctacgtgaagggaaaaaaaagataagttaatgcaaacaccatgacgttaagaaaaaaaagtcaatgccaacaccattttgttttggtcgacggattagataatgcatattgtgcagacgtattacttctttgttgttacggtaccaatgactcgatagtggtcaaccagattggtgaaaaagcccgaccgaacataaacgagactgattttgtcctacatgggcttcctctcagcccttcacgtcattcggtttctctacttgagatcaactttttctaaaaataagttgaaatcgtggaagagcagagccgaagccgcaaagccctaggatttatcattggaggatcgtcttgcatgcctatgcaatatgcgaccaaggacctcacttaatggtggagaaataggcgacgacatgggaaagctccacacacagtttcttggatcatcgagtggattaacaaacaaatccgaaaccgttttccacaatccgacttctaggcgataaacgctatgataacggattacaagtttggtttgaaacaaggatctaagtgtaaaagtttctaattttctgctaaaattttctactattcgatgcactagttgtacaaacgctatgtttttctttaaatataatttaatattattttcaaaaaaaaaaaaaatttatagcgagatg

SEQ ID NO: 12666 - DNA, 3000 bp, Unknown; identical to SEQ ID NO: 12659
  misc_feature (1)..( 3000): cDNA_ID_1808383_gDNA_ID_2214565_Annot_ID_185977 3000 nt of promoter + ATG

SEQ ID NO: 12667 - DNA, 3000 bp, Unknown; identical to SEQ ID NO: 12658
  misc_feature (1)..( 3000): cDNA_ID_2709354_gDNA_ID_2214565_Annot_ID_185975 3000 nt of promoter + ATG

SEQ ID NO: 12668 - DNA, 3000 bp, Unknown; identical to SEQ ID NO: 12657
  misc_feature (1)..( 3000): cDNA_ID_3026055_gDNA_ID_2214565_Annot_ID_185974 3000 nt of promoter + ATG

SEQ ID NO: 12669 - DNA, 3000 bp, Unknown; identical to SEQ ID NO: 12656
  misc_feature (1)..( 3000): cDNA_ID_3026059_gDNA_ID_2214565_Annot_ID_185973 3000 nt of promoter + ATG

SEQ ID NO: 12670 - DNA, 3000 bp, Unknown
  misc_feature (1)..( 3000): cDNA_ID_1808457_gDNA_ID_2214565_Annot_ID_185995 3000 nt of promoter + ATG
ctgatatcgatatgttacttgatggatgtttctaatgaaaatattgcttgtaggtgagaaaagaaagaagttggaagaagagaagggaattattatacggtttgtgattggtcataggtgagagtttgaatcttttagtataatgtcagatatcgaatcaaccacaatgttcttacatagtttctgagatgattcatactcagtgttaattttatttggcattggttctttagtgccacggctggcggaattctagaccgatccattgaagcagaggacaagaagcatggagatttcttgagattggtatttttttttctcaagtttaactctcgcgcttttggtgtccaaatccttgaatattggtttctcattctctgctactttcaccaggaccatgttgaaggataccttgagttatcaggcaaaacgaaaacatatttttctacagctgtttcgaagtgggatgcagagttctatgtcaaagtagatgatgatgttcatgtaaatatcggtaagctgaacaatcttcctacattcaatttctatttcccagtttgtatgttgctcacatcaataacgtggtcaattgttttgttgaaaatatctgcagcaactcttggggaaactcttgttagacacaggaagaaacatcgagtctatctcggctgcatgaaatctggtccagtactatctcaaaagtataatcccatttctctcacttaccttctttttgaatctctttctcagttttgttttaactcacattttgtctatggagcagaggagttagataccatgagcctgagtattggaaatttggtgagaatggaaacaagtacttccgtcacgctactggacagttatacgccatttctagagacttggcttcttacatttcccttaatcagtaagatttgaactcctttgtaccgcatcatttatgcctcattctccatctaacttctcttacaaaatgttccaggcatgttctgcacaaatatgcaaatgaggatgttacattaggtgcttggtttatcgggcttgatgtgacacatatcgatgatagaagactatgttgtggcactcctcctggtaccttccttcaaatatctatagactcagttcaatacatcttagatgattgtgaagtggtaaaaggttaaacttagttagttctatgcacctaactagaatgtttttttttaaaacaaaccttaaccagaatctggatgtaaatggtaatcatatgatatacactaaatatgattcttggtgaattgcagattgtgaatggaaggcacaagcaggcaacatatgtgtagcttcattcgactggacgtgtagcggtatctgcagatcagctgatcggataaaagaggttcacaagcgatgtggtgaaccggaaaacgctatttggaaagccagattttgaggcccttccactacatatacatagatcatataaagaagtagttgttttcaaaccaaacgatcggtcatcaaatgaatgatcacccggaaaacaactcttctccttcttcttcatattctttatgaaccaagaagatagctacatttgttgtatatcatagtaacttgcatagtagagaggactatagagagataagtacgaaatgaaactctagcagagatagatagcgtttgcgtttgagaagcgtttccgattagtagaaggaaattacaaaccaaatgctgcagcaaacgcgattgcttctttctgattttggctgtttttgttttttgtgggagtgaagtagcttgtgggttttatttagatcaatgcaaagtaacgaatgtttttaatatcttgttacaaagaaataagtatgttatgaggtaaaaatagaacagtgttttatcaaagttgtgctctttttagtttactctgtgccacacaatctctggttcaatggtggtacggagatggcggagaaggcaaatccggcaagttctgacacctatttaaccggagggactgaaattttgcatctttttctgctcacgtagctctcgccaatgggggagacgaagcagggtggctcaaaaaggttcgggctttctctcaaatgtgttgtgggttgtgttcagaggaagacaaaattgacggatttgatttggtgacaaaagaaaagtaacgcttgaagagctaaaattgaaccaaacaggaataaagtctttgtgtctttcaatgattcacgagaaatttgataggagttcctgtttctttgttccaattttggattcttctgttaaattgtttccttttgattctgttttgggaatgtgtgctcttcaccaccatttacggtctttgtattcttctgcaacgtttattatttagagtctcacttctcctagactcctactttgagttttgctctttatcacctttctgtctcctctttttacataagttctttgcaaagtttggttttagtttggatccaacggtactgcaatttgcgtggtatgtttttcagtttagaagttttttatgtgattgttgtgatcaatttgcgtggtgtgttgttcaattttggagtttcttatgtgattgttgtcatcaatgaatgttataaagagtatggttttggtaaagaacatatttttctcaaagaagtaaaggcttagggaagagctatagtgagctaaaatggaaaagaaagtatggtcactgagcactacatgtgaacatctatccaacaaatagatagaaaacaagcggtcgggttctttagtttaaagtttagataagtatcattcccttgatagactcaacaacactgttccactattctaattttaagtctttgtccgtttactctcctttgtgtttaagaaacctccttttatagagatatttctcaccattttttatctatatgcagggtatgatataacatctagaggatacaagaggtggtcaggtgcaaaagattgagttttttttataggagagtgtttacgactgaagct

SEQ ID NO: 12671 - DNA, 3000 bp, Unknown
  misc_feature (1)..( 3000): cDNA_ID_2709401_gDNA_ID_2214565_Annot_ID_185993 3000 nt of promoter + ATG
tctacgttttaccgcgatgaataaaagtaccggttgattcaccgttttgaattattccaccatttaccaccattggtaatggtataatacatgtatagtaaacatgtgaaatcaaataaatgaccataaaacttgctagaattgtaaaatgatagcaaatgttgtatccagtataagatgtaaaacttaaacaacctcagaataatgttcgatgatggatgtatataacgatcgacttacaaaaacagaccgaaatatttgctaatgaggtgaagtcatgtggtattgtttttggacacaatttagtaatttacacaaagtgaggaaaaatcatagttccgtggatgaaactcgtgccgttggatccaatgatcattactttaacgcagtaccacgtgacggaaaacggaaaaacgtcacatgattgagcggatctaatgaactgaacagccaaccagataacgacacatgtccaatggcagaaccttgtcacgtgtactttattccgaccgtccccttttgcaagtgcccctcccgtcactccgtcagaaccgcttttctcttctctaacttttgtttgtttaatgttttgattcctagagattactacatgcttcttcttgttttggtttttgatcgagcgtattgttcataaatcgctaaacagcgtgagaattagatcaatttataatttaagtatatgatctatcatcgtgttgatgatttttggtgatattataaatgaaaactgtctttaactacccaacaaaaagctatgcaaacgagtgaacgacttgggaatgcatgtgggagttgtttgataataactaaatttcattggcttagacgctttatgtcatgtgtcacatgtttatactattatttctccactaagaaattactatttgttttcgtcaaatagatggcaacaatcattttaatgccacctcaatgattgtttctacgtacggctaaatgcaatcaattgcactgtatatatcatatatgcatgtgtttgaagtttgaactgatacatagaccactttaaactttctttcccaagtcaaatttattttgagtttattagcaatcacagtctcccaatttcgtcaaatatgatatgaagttgtattgatcttaaattccgttatcaattatatagtttaaaaacagaagttgttagaaaacaattcataaatttttgatccattcagcataacaaaggaagatatcagaaaagttttcattttcttatattcattcattttcatcttctctttatttgctcatgtaaatttcaaatacttttcttgatagttacaaaaagttttgtagttggaacgaatataaaaacgcaagcaatctaattagcttatgctgccgacgtgtttgtcccaagaaaaagacaaagtcagtcgtttcacgtcacttattttgtcaacaataaatcaataatactgttaaccaatattgttatagttagtcacgtataaacttgcaagagtcaaataacaatcactctttaggagaacagatttggatggaatatatggtcctatcccatactttttctttaatattggaattatgtgtatcgccctaattaacccccgaacccagagacttcaggctagctatgatgaaaatgatattcatggtgtaaataattctttttttttgtttgtgaataaaaagtttagttgaataacgaatcctatcaagatcatgtgttatctgctgagaaaagctcaggaccaccatgccctttttcatcaaccgccttattctttcaacctctacgctacacccacaccaaaaggaaaattctcgaaatatagattttttcatgccacaaacatatatgtatatttaattctccctttgagacgtatgataatgggatgataatcttattggtatatatataatattcacaacagtgtaaaaatcaccagaaaggcaaaaggcaaaattttggaatattatagatttctagcacgaattagtagtttagtacacatcattttctttagtggtgtcagatttggtgtcctaacatcgcatttgttacttctatcaattattatgaaatattttcaatcaaatgaatattaattttctttttttaacactatgaatattaatttttactccaagaaaaatcaagagattttttaatatacaataactaattaattggcaactatatcaatctcatttgcatattgttacaatatacttttaaattatcttgaatttagtaaacacatgtatatataatataatttttgaaaagataaatataaatgtgtctcattatgcacctttaaaaactaacaaagcaccaattataaatgaatttttagttttttccgcagaaagaaatatatatctttactagaaaaatttgaaaaattaggtgggtgtctgtgaaaatatgagtcataaagacaagaaataagaaagacatgagatttgattaaatgaaaaaaaaaaaaaaaaggcatacgattgttatcaaaattacacatcataataaattagttaggttttaataaaaaacggtattgatagggatagttgggtaaaatccaagaaatgtcagcccagagttggtataagtataaaccggaacggttaagagttcgttcttatttcttcttcttcaacgacccctcctcttccactcttacgtcaaaaatacagagccagagaaagagaaagaaagagaccaagaatctatttaattccatctcttattatacaatacgaaactacagagcaccacttctctttcaatttctctcggactaattgaaaaatctcaactttattgttattaggaggctctgaagattgatgagctacttctttttgatgtatctgaatttaacctgatttttggttatgattaatcttatggagttgattggattaaattagctacttttactcctgaggaatctctattcttcctctggtagctgaagagaataaata

SEQ ID NO: 12672 - DNA, 3000 bp, Unknown
  misc_feature (1)..( 3000): cDNA_ID_3026009_gDNA_ID_2214565_Annot_ID_185992 3000 nt of promoter + ATG
acaacgagaggatatgacatgacagtcgtcgttacatgccacattcattattttttgaaacttttatcaaaaagtaattcttttaggccggtttttaaagaaatgtagttgaaattgtttataagaaaaaaatcatagaataacagtccattgatgcttgtgctcatgtgtcatgacatctgtttgaaggagttagttcgaatgtacttatattagttaacaagctgatcgaaaaatgaatttgatattggatcaatgctatccaaatttatttaataacaaaaaggcttcagatctctccttgataagtgttctccggagcctatggaatccccaaatggccaaatatctttctgtcttcttttttttctcatgcactttttttgttcttatgcacttattatgtttatctgtatataatgtattgcatgaaattttacattatatttcaatactacaaaacaaatttgagtcaccaccacccaatactggtagtgtatatctatatatatattatattatttacgaattaataaattatattaatcaaatctagaatggcataccaaaaagtgatatagtgactagcgagttacgttacatatggattaacatgtgcatgaaaattatacatgtatttatatacaaatacacatgcaccaataacttaggaaaaatagtgtcattaaagtatatacaacgtacatacgcaccaactgcacaggctgtcaatttgataaatcataatgcattgtacgttttttctttttttgcaatgatatatgtaacccggtttcgaccacgcgagtgaacaactaaacaaaacccaactaggtcaaaatacattcgtttccccttacaaattatacaatataatggcagaaaatttaaaccgtttctgaatctcaaatttacaagaaccaaatattagcttgatttggatgaagccggtcaatttatataggtttacttcagtaagtaagagcctaaaatggttaggcttaggtgctttgcttgtaagaaaggagaatttgtactttaaatgaaaaatataggaacaacctaatttatatgtttggtttggtctctctggtcttctaacgaactctagttaaagctgccatctccatatgtatatatgccgggttcttgttaatacgcctttgtcaaaaggtatttttgtgtgtgttacgataactagcatagttcgacatttgaggctgagtttatattttgaatccaggcacagccgcacattcaaacttgataattctttacttaggcaatgcatatgtgatctcattcattatgcattcatttatttaccgataattctttacttaggtatgaatcttccaagaaagtcttagtcaaacttgaatcccgctggtgagatcgatgtggcaaataataaagaatctgcatggtggaaatatatttaacggtatacagtctaatagtcttttaccatttcactaatttttattaaagttgtacgtacgagaataatcatagtcataaatattatgaaatagaaaatcagatcaatgttgtccgtagtttgctttataagtgagataaagttacgaaagtgtggtaaaatttgtctcggagagtaacttgaaacgtaaagatgaaacaaagttgttaaagatttgattcttattagatgtgccacgcttttagagaaccaaaaacgatcatgaaataaattcgctgtttctatcgagctctttttgttatacattactataatactatgcggtatagaattacgtaccatattgtttttatcaaatagttaataactgtattaaattgctgataaccaaaacaaatttggtatggcttggttcttcggttaacgttttcagtttttgttgttgttgttgtaatttcataaattattaagagaccactacattattaagaggccattttacatattctattaatatatctgtaaaaatctactcgttcgacaaatttataaacttttatttctttttgaaattaccgttttgccaaggttttttgtcgacaattatgtgcatatgacttaaacgttgatcttacttgttttaaaactcttaccgagagaatttactctttattagaaaatttacttcctctatatcttaacgttgaccacatagttttggagtccaaaaatactgaactttcttagtcacgatagtgggcattgataaatgcagcatgagactatatatcactattgattatctgctacaacgatttaatgctcttattgataaataattcacaacttcaatatttttgtctcagttaaaattaccaccggtatggagtcaatagtaagtgatgcccaaaacttgccataaactttcacactagctctcactctcaatggccccaaatcccttaattttatgcattctttgtcaattacaatatttttttttgtcgtatatacatctttccatatctgagtccacatgttgatatattatatcaaatatttcttagtggaaaactcttttaggatttggatatttagcatagttttaaatttgaattgcccttttttaattacgtttatggttgaaactataggtggacttcttggaatatacgtcatgtaaacattaggtcaatcaatcatatcacacaccatacaaaatattcaattctctgctataaaataagacaacaagtgaaaaatactacaacaactaacacaagacacaagacacaagtggtgtcgttgaaattttaatatgcttcaaagacttttgaggtttttgggccaaggaatccaagtttatgtctacacttacaaatgggcctgtttgagtccatagccacaacacgtgtcaggatcttgacgggattctaaataagacacgtgttaagatcttcatggccctttgccgccgtcgtcaccgagaaatgccgcagacagatttgctccgggaacactaacgaacagtttttcgaggttagaagaaaaaaaacatg

SEQ ID NO: 12673 - DNA, 3000 bp, Unknown
  misc_feature (1)..( 3000): cDNA_ID_3026013_gDNA_ID_2214565_Annot_ID_185991 3000 nt of promoter + ATG
tcacttctttccatccataaaaattgataagatccacaagggcagacatttggtgggcatcattaggtgtagtccgaagaaagaagggaaattggagggcagagagagttggatcagttgctgcaaatgagacaagaggaaagtggagcccttttgcaatatcggaaattgtatgagcaacagaggatgaaattggaccgatcatagccaccacttctttctcaagcaattcaaaagctgcaaaacaaaaaccactgaagcttaaaccaggcccttagtggtaaaaccaaagttttgtttccacttatgtacaggaaacacaggtcctagtaacagcctgtttagggtatgcggtctatattgttctatgcattattagcattcggaacccaaaatatgtaccaataaaaaacggattaaaacgtaaatcgatgtgccaatcatttccaactatcacaaaatgaaatattgttgctactgatgtgcattgaccgctttctataatatgtttgatatactgtatcagccatggatgagtgtcacaagtgtttgaaacacaaaagaactagaagaacagtcacggtacctccaaaggacccacgaaagacattgcaggcagaatcctccattaatagccgtagctccgtttctttgagaaagcttttatcattgttcacatcggaaacagctgcctctagagctacttttgcagctcttccgataaccgaatcaaaagcaaaaacagcaccgatgttcaccagttgaggtctttggcaatccattggaaccaccagaatgaccacaatcagtgccgtaatagcgacagatgggtcaatgcccagtcccatggagataatgcaatcaaagtaaggaccacttcagatagtttgtgttggaactagaaccatctcatttaaatctagcaactcttcattcagcattgaggatgagaagattagagaactaagcaaggtaaagtttccaactttgacctgtagagtcaatgcgattagaagacgaatcaagatctaagcgaagagcaatcacaagtcaaaccaaattgattattttagctgaaaactagcaacaatgtggatatgaagacttatatacacaaactcatccggacagaagaaaaatctgaaaaagagtttttacaaattcattgaaattaacaacagtgagacattctctttacctctttgagctaccttctggttctctctgcggaatatacgcaaacactttgtaggcataagttaaaaaagggaaattttacgacaacgcaacgaatttttaacaagagaagtcaagaactatcttttttaaaaaaccatgatttgacaggagattactaaaggaagagaaacaaaactagagagatcaaatcatgcccagaaattcatccatcattcttcttcttctgagaacaaaatagaagagagaaattgaaaaacgtgtgactgaagtgcttttttgattcgagctcacaaagtcctatctagtctatatactctatagtcacagcagccgtttgtttgtatttttgttttcagtggggcccatcattattgggccctacatgtaacggcccattttgttaagtttatttaagattagattacaatataaatattttaattgccatgtgttaatcattttatttcttctcaaaagtttattctcttaagttaatttgtcaatgaaatgttaatagtatttcattttatttttgcataaagagagacccgtagcaaggcaaaatttgagttggcgttttttattcataataaagatttttaggcggcaaaaaactattacataatgagattttatcacttattcatctaataatatttaattaaattacatatgtgtttttttctagctatgtcatttatttttacaatttatataaaattttgatatgtttccatgtatatatatattttaataaatgaaaactcaatccagaaaacataaattttgattttattttaaattatatgtttttatttataatttgttatctcttttatacattaaggtgtttttgcaataatacagtcttaatttttaaaaattacaattaagccctaaactttgtaaatgttccaaattaggaaggaaataaagaaaggagacaacttaaggttctcttattaaatgccattccctttctttcttacaagtcacaacctctctctctctctctctctctctctctctctctctgcgtctttctctttctctctgtctgaagttgagaacacgaaccactgaaaaacccgcgaaagactcgagcacgaaccaacaatggcggaacccaaaaccaagtatgatcgtcagctaaggtgcactctttctcctcccaactctctttctcttcttcaacttctctgtctctttcatcattcttcttaatttcgctcaaattgtgatgattggggataaattcataggatttggggagaattaggtcaatcagctcttgaaaccgcgagcatatgtttgctcaattgtggtccaactggctctgaggctctaaagaatcttgttattggtggaatcggaagtatcaccattgtcgacggatctaaagtagaaattggcgaccttggaaacaatttcatgggtataattctctctttttcatctttcttaagcaatgcgtttcttctatttgctgtttattgacatttattgatgattgttgttgatgtttcagtggatgcgaagagcgttggtcagtcaagagccaaaacggtctgtggctttcttcaggagcttaacgattctgttaaagcaaattttgttgaggagaatccagacactttgatatcgacagacccatctttcttctctcagttcactctagttatcgccactcaggtacattatgttgaggattagatagtttctagtctttgttttcagattttcacagagcgtttgccttattagtttgtcatgtgttgattgtagctagtagaagattca

SEQ ID NO: 12674 - DNA, 3000 bp, Unknown; identical to SEQ ID NO: 12655
  misc_feature (1)..( 3000): cDNA_ID_3026063_gDNA_ID_2214565_Annot_ID_185972 3000 nt of promoter + ATG

SEQ ID NO: 12675 - DNA, 3000 bp, Unknown; identical to SEQ ID NO: 12662
  misc_feature (1)..( 3000): cDNA_ID_2709371_gDNA_ID_2214565_Annot_ID_134939 3000 nt of promoter + ATG

SEQ ID NO: 12676 - DNA, 3000 bp, Unknown
  misc_feature (1)..( 3000): cDNA_ID_2709381_gDNA_ID_2214565_Annot_ID_134942 3000 nt of promoter + ATG
aaagacaaagagattttaaattcttaaacaaaaaaatagattttggtttttcaaccagctgcttacacttttcactatagtctataagatttttatctcctaattttatggatttaattttgattttcttgaatattaaacttatattgtgttctgaagtatgagaaatatagtgactataagttttgagtgatatgatactatgttaggttaatttagattaccaaataatggaaccaattatgttatagactatttttaaagtatgtatagttttgaatgatatgaaatttcacataaaaactaaatttttatttttgatcataaatttaaataattgtttcaagtttgactattatgattaattcttaggtcaaacttattttagatgacaaaatcctaaaaataattatatgaccggcgactagaatttgtacttttggttcttatgttctatctagtgtcagtcgttacgtcactatccatatttaaaaatgtatattgaacatattgatagaaaaataattgactaatgactaactatgtttaaggatattttggataatgtattgactagctattaaagttagttaaataaattttaccaaattattatctattgatatttgaatatgtttaataaatagtagtaacgatcgatcgagtcagtaattctattttggacctttcttatttttttgttccgccgacttttttctttcttattataaatgatcgatctagtcaataattattttctagttttttctttattttgctcactttatatgtgtataacgatctatatagttaataaaagcatagatttgtcgtttctgtatttttattccgtacatctcatatctacaaatagtattattaactagatcgattaatattacaaatcttctaacattcaaaaatcaattgatggtaatcattatcaaaacaactaattatacttgaatttttttctatgataatatgttataaactcttatcttattttactctttcctaaactatttgatggtccatttcactatgaaattcaaatcttaaaattgaaataatcttacattatttctcctaggctcataccatataagcataatattttatagaaatctttgtttcaaattaaaaattttaaaatgactaaattaaatataccaaaaatggttaaaaatatttcaatgacattaaatctaaattttattatatttctcttttaatggagaaaacttaatttagttttttatttatttaattagaattatgtaataatactataaacgtatctggaaaaccaattgaattgagacacatggatggaaagatagaatctactttttttattatttatctttttaacgtgtagctttctctccctcttcttccagagtgtagggttaagtaagtgtctctccctctctacctataaatatgtgtgtgtaaaccactcaattcactcgcactctcagcactttcatttacctctcaaaactgcttcataaaacctcgataccatctaagagttactcccatatttcatcgcccatgtaatacaccaaccattcattgattttctcattaatctcaaatatatcattggattcaaccttttcattcgattgaatttcgttgcaccatatcctctgtatatataaaaatatcgagttatcagtagcatatttgttgtatctgtcatatacatcaaatgatgaactgattcttgtatatctttctactgggaacgaaattttgttttaatattttttttcgtttttgtagaaaagagtgagccaaagatatacggagggatagatcaagctagcaaaggaacgaaaaacataaaaaagatttgatttttctgagtttatcacagccaaaacttcaaaaggtattgttggatctcttcgttatcctttgtattttatgtttatgttcttaataatgcatctacgattatatactttatatcctaccaaatacaaagatgataacaaatagtgggaaaattttaatacatcacacacaattattctttgctgcttggtcggaacatatacagatgatactctgactcataccatttttttttttttttggtctcttcctgtatacaaaaattgataatatatctgaagggagaaaataaatgttgagtgggagatctttacaaaactaattttaaatctatcaatttttttaaaaaaatattgtttgattaaaaaataaaataataataagtctatcttcgatctactcttttttttttttttttttttcgatctacttatatatggtgattttatttgttttgggcaaatgaatccaacagttctctttttgtattctcttcctctatagtccctccttgttctatatttagatctataaattgtgaaatcctggaattaaagaacaattaaatcaaacttctaaaaactaatctcggagagttcataaagttgatctccggttagggcttgtttcttaattcatgttctttgcaaaatatttttggggttaatttaatagtctatatatatataattcattttgtttgggttgattatttgttaatctctactggtgggttttttttattccaagtttccaactatcatcctcaattactttgtcttttttttttttgtctgtttctcttttatctataagatcttctagaaaaagaaaataaagataaaaaattggttgacttggaaaagcaaactttttgttgtcaggaatttagtgaaagagagtgtactgttttgtctgactgcaaaaatccaaatcttggaaaaaaatcctttttgattcttgtactcaagaagaaaagaaaagaaaaagaaacctttttcacaaaccctaatttctagatcttatgaattcttatcattttatatccctctaatttgatgtaactcatgatattttctatttcaactctcagatctttagaatcccaaagaaaagaaaacaacaacaaaa

SEQ ID NO: 12677 - DNA, 3000 bp, Unknown
  misc_feature (1)..( 3000): cDNA_ID_2709389_gDNA_ID_2214565_Annot_ID_134945 3000 nt of promoter + ATG
ttctcgttgcagtttttcccattctccaaccaatttctttatttccagcatctatagtatatatttaaaagtccagtttccaccgatgtcaagacgaggtgtatgtatacttactgattcctgtaggagcaaagactttgaaagctgcaagaagggcttctttgtaattttcttcatccgctgataccatcttggacttaactaagtcctaaaatttcaaggagtaagagagataaagacaaggaatcacaagaaaaacaaagattaataactgtttgctgattaacaaaaagtaaggataccttaaactcgtttttctcttccctggttgatggaaggttgccgctatggtgttgagcccattcttcagccaccttgactagaatgacgacgtaaggaatgtgcttatgggcagcgggttcttctacatttagatcaatggactccacatagctgcagatcattgaataaataagattttctttcaactggttgcaagtttgtggagattaaaagtaatttgaaacacaagtttaaagaatggcaagaacacataacgagtgagaagattgaagcagagtacctcttcagctcaggccatggactattcaagcggagatcatcaagagaatgatcaggctttgtctcaatagcggtgtgttcctgacaggaaagagcgaacatgacatagcagttagcagacagaccatatgacaagtgacaaagcactctatccacaaaaatcttacctttacactgatacgaacaaacccagtaagtccataggagcgagccaaaaccaacatgacgtttgcttcccggcagattctatctaatttcaccattgaatcttctactagctacaatcaacacatgacaaactaataaggcaaacgctctgtgaaaatctgaaaacaaagactagaaactatctaatcctcaacataatgtacctgagtggcgataactagagtgaactgagagaagaaagatgggtctgtcgatatcaaagtgtctggattctcctcaacaaaatttgctttaacagaatcgttaagctcctgaagaaagccacagaccgttttggctcttgactgaccaacgctcttcgcatccactgaaacatcaacaacaatcatcaataaatgtcaataaacagcaaatagaagaaacgcattgcttaagaaagatgaaaaagagagaattatacccatgaaattgtttccaaggtcgccaatttctactttagatccgtcgacaatggtgatacttccgattccaccaataacaagattctttagagcctcagagccagttggaccacaattgagcaaacatatgctcgcggtttcaagagctgattgacctaattctccccaaatcctatgaatttatccccaatcatcacaatttgagcgaaattaagaagaatgatgaaagagacagagaagttgaagaagagaaagagagttgggaggagaaagagtgcaccttagctgacgatcatacttggttttgggttccgccattgttggttcgtgctcgagtctttcgcgggtttttcagtggttcgtgttctcaacttcagacagagagaaagagaaagacgcagagagagagagagagagagagagagagagagagaggttgtgacttgtaagaaagaaagggaatggcatttaataagagaaccttaagttgtctcctttctttatttccttcctaatttggaacatttacaaagtttagggcttaattgtaatttttaaaaattaagactgtattattgcaaaaacaccttaatgtataaaagagataacaaattataaataaaaacatataatttaaaataaaatcaaaatttatgttttctggattgagttttcatttattaaaatatatatatacatggaaacatatcaaaattttatataaattgtaaaaataaatgacatagctagaaaaaaacacatatgtaatttaattaaatattattagatgaataagtgataaaatctcattatgtaatagttttttgccgcctaaaaatctttattatgaataaaaaacgccaactcaaattttgccttgctacgggtctctctttatgcaaaaataaaatgaaatactattaacatttcattgacaaattaacttaagagaataaacttttgagaagaaataaaatgattaacacatggcaattaaaatatttatattgtaatctaatcttaaataaacttaacaaaatgggccgttacatgtagggcccaataatgatgggccccactgaaaacaaaaatacaaacaaacggctgctgtgactatagagtatatagactagataggactttgtgagctcgaatcaaaaaagcacttcagtcacacgtttttcaatttctctcttctattttgttctcagaagaagaagaatgatggatgaatttctgggcatgatttgatctctctagttttgtttctcttcctttagtaatctcctgtcaaatcatggttttttaaaaaagatagttcttgacttctcttgttaaaaattcgttgcgttgtcgtaaaatttcccttttttaacttatgcctacaaagtgtttgcgtatattccgcagagagaaccagaaggtagctcaaagaggtaaagagaatgtctcactgttgttaatttcaatgaatttgtaaaaactctttttcagatttttcttctgtccggatgagtttgtgtatataagtcttcatatccacattgttgctagttttcagctaaaataatcaatttggtttgacttgtgattgctcttcgcttagatcttgattcgtcttctaatcgcattgactctacaggtcaaagttggaaactttaccttgcttagttctctaatcttctcatcctcaatgctgaatgaagagttgctagatttaaatgagatggttctagttccaacacaaactatctgaagtggtccttactttgattgcattatctccatg

SEQ ID NO: 12678 - DNA, 3000 bp, Unknown
  misc_feature (1)..( 3000): cDNA_ID_2709393_gDNA_ID_2214565_Annot_ID_134946 3000 nt of promoter + ATG
cattgataatttcgtagtcacagccgataacgtttcggccagaaccaaactgaacttgaccggctataccagtaaagtttactttcagaagtttctcaagtagtaactccccactgttgaaaaatttgattttctccaagtgcagtttggttccccgtgcatgaagtaacttttcggagtaagaaaacgttatgttgattccttcattcagcaattcctcgatgccatgcgcaatcatccacactgtatcataggcatgtaatgcgtaggcattcattgatctgttgctctgcagtttatgcgtgaaatgttccatctttacggattctgggatatgttgacgaagccccactactccttcaaggcgttttagagtacctttgtcactcaaagaatctaaggtaacagagagccagtctgtggcgagccatacgtattcatgggtcatcatctgcagcttttgcgctatatcaaaaattctgagcaatgggtccggaccaaaatgaagaatataaactcgaggaccgatggacttggatttgttcaaagcattagtaaggaatttttcatcagaatgaactgagagcggcactttataggaaattctggatcttttcttgtacagttcatcatctagagcagaaactccatttcttccgagctcatcatccgagtaaactgagatcacttctttccatccataaaaattgataagatccacaagggcagacatttggtgggcatcattaggtgtagtccgaagaaagaagggaaattggagggcagagagagttggatcagttgctgcaaatgagacaagaggaaagtggagcccttttgcaatatcggaaattgtatgagcaacagaggatgaaattggaccgatcatagccaccacttctttctcaagcaattcaaaagctgcaaaacaaaaaccactgaagcttaaaccaggcccttagtggtaaaaccaaagttttgtttccacttatgtacaggaaacacaggtcctagtaacagcctgtttagggtatgcggtctatattgttctatgcattattagcattcggaacccaaaatatgtaccaataaaaaacggattaaaacgtaaatcgatgtgccaatcatttccaactatcacaaaatgaaatattgttgctactgatgtgcattgaccgctttctataatatgtttgatatactgtatcagccatggatgagtgtcacaagtgtttgaaacacaaaagaactagaagaacagtcacggtacctccaaaggacccacgaaagacattgcaggcagaatcctccattaatagccgtagctccgtttctttgagaaagcttttatcattgttcacatcggaaacagctgcctctagagctacttttgcagctcttccgataaccgaatcaaaagcaaaaacagcaccgatgttcaccagttgaggtctttggcaatccattggaaccaccagaatgaccacaatcagtgccgtaatagcgacagatgggtcaatgcccagtcccatggagataatgcaatcaaagtaaggaccacttcagatagtttgtgttggaactagaaccatctcatttaaatctagcaactcttcattcagcattgaggatgagaagattagagaactaagcaaggtaaagtttccaactttgacctgtagagtcaatgcgattagaagacgaatcaagatctaagcgaagagcaatcacaagtcaaaccaaattgattattttagctgaaaactagcaacaatgtggatatgaagacttatatacacaaactcatccggacagaagaaaaatctgaaaaagagtttttacaaattcattgaaattaacaacagtgagacattctctttacctctttgagctaccttctggttctctctgcggaatatacgcaaacactttgtaggcataagttaaaaaagggaaattttacgacaacgcaacgaatttttaacaagagaagtcaagaactatcttttttaaaaaaccatgatttgacaggagattactaaaggaagagaaacaaaactagagagatcaaatcatgcccagaaattcatccatcattcttcttcttctgagaacaaaatagaagagagaaattgaaaaacgtgtgactgaagtgcttttttgattcgagctcacaaagtcctatctagtctatatactctatagtcacagcagccgtttgtttgtatttttgttttcagtggggcccatcattattgggccctacatgtaacggcccattttgttaagtttatttaagattagattacaatataaatattttaattgccatgtgttaatcattttatttcttctcaaaagtttattctcttaagttaatttgtcaatgaaatgttaatagtatttcattttatttttgcataaagagagacccgtagcaaggcaaaatttgagttggcgttttttattcataataaagatttttaggcggcaaaaaactattacataatgagattttatcacttattcatctaataatatttaattaaattacatatgtgtttttttctagctatgtcatttatttttacaatttatataaaattttgatatgtttccatgtatatatatattttaataaatgaaaactcaatccagaaaacataaattttgattttattttaaattatatgtttttatttataatttgttatctcttttatacattaaggtgtttttgcaataatacagtcttaatttttaaaaattacaattaagccctaaactttgtaaatgttccaaattaggaaggaaataaagaaaggagacaacttaaggttctcttattaaatgccattccctttctttcttacaagtcacaacctctctctctctctctctctctctctctctctctctgcgtctttctctttctctctgtctgaagttgagaacacgaaccactgaaaaacccgcgaaagactcgagcacgaaccaaca

SEQ ID NO: 12679 - DNA, 3000 bp, Unknown; identical to SEQ ID NO: 12671
  misc_feature (1)..( 3000): cDNA_ID_2709401_gDNA_ID_2214565_Annot_ID_134948 3000 nt of promoter + ATG

SEQ ID NO: 12680 - DNA, 3000 bp, Unknown; identical to SEQ ID NO: 12670
  misc_feature (1)..( 3000): cDNA_ID_1808457_gDNA_ID_2214565_Annot_ID_134949 3000 nt of promoter + ATG

SEQ ID NO: 12681 - DNA, 1032 bp, Unknown
  misc_feature (1)..( 1032): cDNA_ID_2990746_gDNA_ID_2214566_Annot_ID_134950 3000 nt of promoter + ATG
gatctcctataaattatttaaaatgtgggttggaatatttctctgtttttcggaaaagtacttttaaaactaccctctaatcagtaattatttttttaatgtcattagagccaatataattcatataattgaactctactttgatttatgtgttctttaagataatgtaatatgaaatgtttaaatttagaagtcttttcaatcttttttttcttactactttgaactctactctattctagaagaaaacttgggccttcaattttcaagcctcgaggactgattagtgattattttgtctttgttcagacaacaaaaataaagaaagtgaaaaagataaaaacttttttcttttctcttcttcagtttcttcttctttttgttttccttcctcgttctttcatgtcttccttgtgccattgatgagtccgtcaagaccaaatcgagagtagtgcaagacttttttctcacactgtttctaaaaccgcgtgagaaatcttcttcctcctcagatctctaccttttcccttaaattttcccgcattttctctctcttccaagcttctccaagcgtacaagctacttcttcttccataaactcaaagtaaaaccctaaaccaaaactctcttcacctctataaaaacaccacctttttttagctcctgtctctttcacagacttcaatcgcattttcattaccagccaaaaatcatcttcaatttccaggtaattaacatcaatcttgaattctctgtttcactttttttactaattctctgcaatatttttagtaagttactcttgcgctttaagttttctcttttcaatgtcggttacaaaaatttagattgctccgtaagattcggcataaagtttgttgctttaagctataaatcaattacccatttcgattttgtcccatttctcattgcaaagctcaagataggtttggtttctaatctgtcgttcttgctctttgattaggttacaagcttaagctttttcatagatagatagaaaagagaatgatg

SEQ ID NO: 12682 - DNA, 3000 bp, Unknown
  misc_feature (1)..( 3000): cDNA_ID_1809125_gDNA_ID_2214566_Annot_ID_186025 3000 nt of promoter + ATG
ggtgttccttgggtcagcttcatggtttacttggagatcgaggttttattgatctgggtatctcatcttcttgttcagtggcggaagcgctttctagtcataggaggagaagccatcgcgatgacatcttaaatgacatcgaagaagagttagaaaagcttctgtgtcgcggtatttgcacagaacaagataggtctctttgtcgaagtattgggggtcagtttaaggctaagtttttctctccggaaatttggcatcagataagagaacaaggattagttaagcaatggcacaaggcgatctggttctccggagctacgcctaaattcacgtttatatcttggcttgctgctcatgacagattaacaaccggtgataaaatggcatcttggaacaggggaatctcctctgtttgtgttctttgtaatatctcagctgagtcaagagatcatctgttcttctcctgcaatttctcttcacacatttgggatagactaacccgaagacttcttctttgccgctacacaaccaactttcctgctttgctcctccttctttcaggacaagacttctcaggtacaaagcgtttcctcttgcgctatgtatttcaagcaacgatacacacattatggagagaaagaaacaagcgtaggcatggagatctgcctataccatcagatcatatcatcaaattcattgatcggcaaactcgaaaccgtttaagcacaatcacaaagcaaggcttgcacaaatatgccgatggcctccgcatatggtttgcagcgagagacaacttaacgccaaatcattagtatttctttgtttttttccttttgattttaagtctaaatcaagttaataaatggctgcatatattgtaaaccaggttttttctttgaataaatttaacaatttttcaaaaaaaaaaaaaaagaacatctggatgtcgtacaatagcttcttgcaagatatcaagaagctgatcagcaaagaaaagctcggtaatcttcctcgcgtcttgtggcaccaatcgaaacgaaacagagccactgactccatcgtgtagcatcgcgattccattttcatcgagctttcgcttcttcaacatatccatggtcgaagatagcagccaaggaactttgtgggaagaatgagtgaagttagaagagatcacatgttcgtaggacataattaagcctagctctttttccttaaaatataactatagcattggtacaccaaaagaaattaaacgtattcgtcaaattcatagtttaattgattagagtagatgagaaaaccatttgctgtttcatacccgacttttttccaatcacgtgaaacgtaaaggtaaaacatatttgtaactaaaccatatttttctttctttctttctctcgtgtttgttttagaacctaatctgatctgaatattaacacacaaaaagatgataaatgagaacatataacaaatcatgaaatgagatgagaacatacttctctagaaaattttctaaaatatccgaatcaattgatggcgaacaactaaacagtagaatacaatatgtatattaaacagaaaatcaaacgctaaggaattaaaaatcatgaaaagattattaacacgagagatgagaacttaactctccgaaaatttgtcctaaaacatccatttcaattttctcgcaaagaattaaaacttagaacacaatatatcaaatcaaacgtgtatgaattgaacttaaaaatttacatgttacatcagcatctaaatttttataaattaattcacgacttatggattagtatgtatattcaaaaaaatagttggcacgatcaaaaaagaaacattaggtagctataatctgatagtgaattaaatgaaaagtatttataaaaaactaagaggctgctcatgatttaggattttacctttttacaatttccagaaacacacaaaataagaaaatttattttgtgaagttacattaacatttatatccaatattacacactaaaaaaacgaaaccaccatatattcattattataaacatatggcttattaatctaaatctgttaaactatatatctaaatctgttaatctaaatctgttaaattatataaatatgttattataaacatatccttttattatataaatctgttaaattatatatctaaatctgttattataaacatatccttttatcttctaaatcttactaatctaaatctgttaaattatataagggtgtttaaaaaatggatatatatgtttttgtccacaaatgaatatatacatttatatcgattttttttatatactttcgtaaatgttaattgatgacatgtccaaccgtaatttgctgtttaaaattttatgtggacggcatacgaatcaaatagcctcgacttttctatagtataaattgtatgtaacttgtaggctctctctaaggcggaacgctcccctaccgatgtattttgacatcccacagcttcggcccatgtagtctattggttatttttgtggttcagtttaaattttaaatacatgtatttatcctcaaacttttttttttgcgattctcaaactatttaattcaaatccagaaacggtttatttctccccaaaatacatgtatttatccatgttaatttttttatttctttggcttaagtaataattagatcaatacattttagaccaataaacgtttgaacgtctttttgcatcagaacgtgaaattaatgtcaaacgcaaacgcatgtacaaatcctgaacaaacataccgcttaggtgatggatggttgcgtaagaacaaaacaccttaaacggcagcgttttgtaggagcaccgcttcgcacgtttcttccatatctctgatcacgtgatagtcgtcttcttcagatcttttatcactttcttcttcccggagaaaatttggccctaaatcactttcccgggaaaatcaaactctggggaaagagttgaaaca

SEQ ID NO: 12683 - DNA, 3000 bp, Unknown
  misc_feature (1)..( 3000): cDNA_ID_2712394_gDNA_ID_2214566_Annot_ID_134953 3000 nt of promoter + ATG
gtgagggtttatatgatcaaacgcccatctgcttagtgcttatatattaccataagatcgacccgctacttctctatggaggaaagagtccttggcttgtattgtacctcttcgtagcttcagttttggagattcttatcatccattagactgagtccacgtctacataaccacacaatattacctattcaatcaaaaatcaaacgaaagaaaccaagacttagacaaattcaagaacaagaaaccgaagtataacacatcgatgaaaagtctaaacaattacttcctgacagcgacacaaatagagatgttaaagagagaaaacaagagctcggtaacatgttcaacaattcgtgttgaatcggtcaagaaactctgtagcaccgtgttaaaactgaaaacgactacatatctatctatttatatatttttcgagagcttaagggttctaatcattctataaaccaataatgaagcaattagtctcctccaacgaactagtcatcaagaacgagttagaaactataactatgttgaatgagcttaaaacattattaaatgattataacttctaatccaaatatgattgaaacaaaacaaaaacaagaaacatagcacttacaaatctagcaaactacttcttctatgaccaaaacatctccataattctccttcttgtggatcttcctcccacaatctaaccctagctctgcaaataggacacgtcgaggctttgagcaaccaagtgtccacacactttcgatgaaacacgtgtccacaaccaggaagattccgacaccattgtccttgtctgaatccatcaaaacaaaccacacaatcgctctcgtaccgtgtgtatgtgctaggttcggagaatttgaattgaggaagctttttcacgaatcttgaagataacccatctgaggattcttgtcggcgattacgacgacgacgtcggtggtgacgatggagagaagagaggaggagagggaggataagaacagaggcgataccgataagaacgaggaagagaaagaagattgaaaacatgattacaccaacgaggaatagagagagaatccttgttttcggttttggcggtggatgagacggcgtagtagacggtggttcgccggagattcggtaattattggtcggaggcatcggaaagaaaaaaaaaaaaaagaattctcctctttttttggttgtttcgtattctggcttatcttttttttgtgctaataattaccagaatctaatgtgaaagctaaagaaggtaagatttgatgttttgagcgaactgaaatgctaaatcaaagacatttccaaagtagaaaatgacgcaatcaaaaatatttgtcagagcaaaatttaagaaagaaaaatagatttcatttagtgacagtaacgtttggttaaaaatggtcatgtgatgagatactttttattttactttttgggctttggatcatgtgataaaagattttaatttttatatatatatataaatttttttggctccatgtctacaagaaatataaataataagaaatatcttctcatccaataattttaaacattatcttgaaggataagcaaatatcatcatcccactgtttttaagaccatagtatggaaaaagatggaatattcgaacttataatttagttttaaaagtaatattcgtacttggaggcctatggaatcgctactaattctaaatactcgttctgaacatagcttgtcgtttgattcggacgttttgaaattttgtacattcttttggtttgctctctttttttcttaacaatatacgttttgtaaatttaaacttggacgatgatataacaacacaaatgacatatgcttaaaagttaaaatctcattttttatattttgaatctttgattgatgaattatagcgacaagccgacaaaggcaacttcctcggtaagggcaatcgttatcttaagtttaatttgatcaaatctctttctcagcgatagaaagtttaattggtatatagagatttgggcctttacataaaatgatatttgaaggcccactaagcccaattattttccagaatgttgaattcataaacgcagatttacttgacatgataacaaagagaaatttgtcttgattcaaaaaaataaaataaagaagagacatttgtctttctcttgtaaaagaggtcaataaagcaaatttgtttttcatacttcatcatttgactaattttattggtgttatgtaacaaaccgaatattggagatatcttagggagcaagtacgtgaagtccgaagaatattctagatttcactattaccttttgttcaagttatttttttatatgtttagaaaagttgaagaacaatctgactcggataccatgatagatttgggcttttaatatgagatttcaactaaaaatcaattggtaataggtggagtgaccctaacactttatatactatttgataatttttaatttttaatgtgggactttcttcattaacacattttgttttagtagatggtcctaacgttagaacctaacactcatcagaaggtttaaaagacggttatacttttcccgatggttttggatttgggtaaggttgagaattttctcaaggtaggattcgaagtgatgttgagaataccctccttagtttcttcgaaatttccttcgcagctttgtgaaaataatatccacaaagaaaaaaaaaatgaactttaaatttcaaaccctcgtggaattttccttcacacatcatcatatattcatattcattcaattcaccaagaaaatttaggtggagtaaggaataacaaattgtcctgtatgaaatcaatacaataagtaatggaagacttgacgtagaccaaagacttttccttttacttacagtctttgagtccaattatatataaatactcgcttccctttgcttcgttatttcacaaacaagttaaagaaaatgataaaaatg

SEQ ID NO: 12684 - DNA, 3000 bp, Unknown
  misc_feature (1)..( 3000): cDNA_ID_2709433_gDNA_ID_2214566_Annot_ID_134957 3000 nt of promoter + ATG
gaaattgttaaaaaaaaaaacgtacagacatctcttacacttaaatatttctgatggaaacactaaaataaaatattttgatcgtagaaatataactaatatttacttattttttctttttttttaggttttaaaattctcattatgttggttttagtatgtttttattttatttttaattgcataattaattaagatatttttttgtacaagataatgccacgcaagcattttacgggactttttttccttcgcatgcaaagtccggcggctcattttacacgataatgaggatttgctcatgtttctacgaatttaacaaaaaccgaaaattgcctttaaatgaaaaagggagagtcaaaaaaaaggaaaaaggaatattcaaaatagaaaagtagaaaagagaataatataaaaataattatctcaagaggctatagataaagtgggacccaagcaaatcttttagacaacgtggctgatcctatcgggccccacaaagacaatggttatgtggaatttggatatgtctccttttttttttttgctctcccacgctcttatcttgtatttagttagaaatctgaaacaattccctcaaaaaaaaaacaacactattcgccactcatttcatattcaaactttaaaaaactgaataaattttaataagaaaatttttaaccttttgaacaagagttttttttgttatattttgataatttttcctaacttcaaccaattaaattataatagacaacaaaatttaccgttttgttatttataacttacatgcatattgtccaattttaaacgtgaacgacatgatggtaacgttagttacattgtagtctcagttaaattcaaaacatttgattatttataacccacacacgcataatatccattttaaacgtgatttatacatgatgatgacattagttacatagtagtgttcgttaattacaaaaaaaaaaaaaaattggacgtttttcttgtttagaactcacaagcgtatattgtccagtctaaatttataaaatagtggtgacattagttacataatagtctttcgtcaaaaacaattttttgaccacttttatcattcataattcacacactcatattgtccaatttaaacgtgaactaaatatggtggtaacattagttacttagtaatcttcgttaaataaaaaaagttcaaccgttttatcatttttaacccacacatatatttaacgtgaattatatcacgagttacataatagtctccgttaaatttggaatttagctcaaatttgttgtaagtgaattgcttgttaccaatgtcgtcagtaaaacataacggtaaatgtttctattttgtattataactattttaacataaaagatataaagaaagatttctatgtataatacattatttcgatatatagatttaaattatagttataaatatattttttgcttgatatctctgtaaattaataagacggaatttaaaataattacaataaataaattttaagcaaattagatgttagttaaaagttagatgagaaaacactgtagcatatgaagaaaaaaaaacacaaaaaagtataattagatgtgaagcattaaaaatgttcccattgagatgacgccacgtgtcacaatctgaggtcggcggtcgatgttataccgttgaaatgaggaagaaacggaaaaaaagtttgaaacgttcctaggagggaatggatgacgtgtcataatatgattggagtacatagctgccgttgatcgcgaaagtaatgccaagtcatcagtcgcacatgcctcgtgacttttcttatctttctcttcccaccctaacacgccacgtttcctctacatgtttgccacgtggcttttcactatccacccaccaatattcctaacactaaaattagattaaaatttatttactatgggatatgaaattatgaattgtgaagttatgtgattatggttaggctgatgctacgtaatttgttactctttagtagcagtacaaatgtactttacaaaaagatttggtgtgtttcaagcatatcatacaattctttttatttttacagtacatatccctattttacaataaaaatatcgtattttatttatcaaaatgttgttttgctaataatatttagtaaaataattttaacaatagtaagaaaaagcttgaaaaatcaaattttgtaaatttccccttctacttgttagtaattaatagaaatagataaatattagtttcttttgattttatttttcccaaattcactagcatttgtggaaaattgatgtgagtacaaaactgatgtgatttttctttgttattcctcaaaaatataatttttcaaccttcaattttaagttttttgatggatatgagcagcttttgtcaaatctattaaataaaaagacgtgtgccacaaattatccacatcagcaataagtttttttttaaaacaacatatatatggaaaaataatagctgtaaaatatttatttcccatttaggttaaaaaagtagaaatataattggagataagagacgaaacagctcacagcaaactaatcagtaattagggttatagctttttaaagatttgtttccttttatttcatttttcaaagacaaaagtcggtttgagttaaccacacgcgcttatctaacggttcagatataccaatcatatccatctcgagaaaatcgagaccgtccaaaaattgtgttgattttttaaactttaattttgtttcctctttcgttttcgttcttatcctcaccgaaaaaatttccgttttttcttccttcttaaattccacaatatggacgctctcttccttcttcttcttcgtaaaactatccttctttttcttctctccttgttatgaaatctgagaaacccagaaacaatatttgatttcttcatttacccaattttaaagttttgatttttttttcttctcttcttcgtt

SEQ ID NO: 12685 - DNA, 3000 bp, Unknown
  misc_feature (1)..( 3000): cDNA_ID_2712388_gDNA_ID_2214566_Annot_ID_134958 3000 nt of promoter + ATG
catagatttcctactcttttttttttgtcatcatataaacatatactactttttgttcaaggatcaatgtttcttagtttggtgaaagatagaagtaaactggagtgggccaatggttaggcgtgtaagcccaaactttggaacgattttagcccatctcaaaaggagcgtgctatattttgtaaatgaaattgcaaaattacctaacacaaattttcctataaaaaaacatttcgggtaagaaaccgacaattataaaataaaaattgtaagacatgttttattgacacatggaaaaatgaagttggcgaaaaagacaaacagtaaacgttaagataaaaccctacctataaatataccttacacgccacctgactttatcaaaaccaaaaacacaaaccttcaacggcacgctttctcctctgaaatctctgcgagcaaacttcttcatctacctcttaccgtacttcaggtttgtgtaaatcatttttataagaacttcagtgaaatagattagcaaccctaattgaatttaatcgaatcgtaactattgtgaacggaacccatccatcttgcataaaaaccctagtttctgaacagcctttcgaaacttctagtgttattgtattggctctgatcaacgttgttctaaagttgtgaactttgattgattgcaacagagtgtttaagatgaaatctgtcgtaatgtcgaagaacaagggcttagctgaacaagatctaagtaaacttgatgtagctcagctgcatcctctctctcctgaggtcatctctcgtcaagccaccattaacataggtatacacaagtttttgtttcattgagttttgatgctgaagaaactgatcagccgtgcattgaaagctaaagatatgactatgctctctatatctcaggaaccattggccatgtcgctcacgggaaatcgacaatcgtgaaagccgtttccggtgtgcacactgtcaaattcaagagtgaattggagcgtaacattaccattaaacttggttacgcaaacgcaaagatttacaaatgtgaaaaatgccctagaccagtagcctacaagtgaattcttgctcttcttttgctacaataaggttacgtagtgtacgtagcaacttatgatatgtgttaattataggtctttcgggagtggcaaagaagacaacccaagttgtgatgtctctggacatgagaagtacaagatgaaactactaagacatgtctcatttgttgattgcccggtataaaatgagttttaacactatttctaaatcttttgtaaccattttctatatgttaatgaggtgttttgtgtgttgattagggacacgatatcctaatggcgacaatgctgaatggagcagcgattatggatggtgctttactaatcattgctgcgaatgagacatgtccacaaccacaaacagctgaacatcttgcttctgttgatatgatgcatcttaaagatatcataatcattcagaacaagattgatctcatccaagaaaacgaggctattaaacagcacgaggacatccagagatttataacggtttgattcaattttcccattctgttttttttttgcatttttcacttcttgattagttggttaagttttaaacttgttattacagaacacgaatgcggaaggtgctcctatagttcctgtctcagcgcaactgaaatacaacatcgatgttttgtgtgagtacattgtcaagaagattccactccctgtgagggattttgtgtcacctccaagaatgattgtgattcgttcttttgatgtcaataaacctggctctgattatgatggtatgaaaggtggagttgcaggtgggagtatccttcaggtaaaacatactcaataccccgaaaaactaggataaatcgcggttgaatcaatgtaacttatgtctctctttgctttgtttgcagggtgttttgaaggtggggcatataatagagataagacctggaatcactagaaaagatgagaatggagacactaaatgcactcccatttacacgcgtataacttcattgtacgcggaacagaacgagcttcagtttgctgtcccgggaggtttgattggaattgggacaagcatggatcctacgcttacgcgtggtgataggttagttggtcaagtccttggtgaaataggtactctccctgatgtctatgttgaacttgaagtgagtttccagcttctgacacgtctcattggagtgaagacaaaggaaacagagaggcaaatgagagtgtcaaagctagtcaagggagagatactgatgttgaatatcggatcgatgtctacgggagctatggttattggagtaaagaaagatatggtgaaagttaatctgacactccctgtgtgcaccagcattggagagaaagtggctataagtcgccgtgtggataggcattggcgtttgatcggtcgcggtcagattgaggctggaaccaccatttttatcccttctcctccttctttggcatgattatatttgatgcattcacatataccaaacttgtagtctcattatatcttcagagtattcctaatctgtcaccaaaggagataactaaacttctatgtgcttatgctttttgtgtgaagtctaactagagtttgatcaattgcatcatcttgatttgttattaaaagttttatagtctatggatgttacagcttaattaactaattatcctacatagttcatttgagagaaagatataatttgtgattgttgaaacttgaaacttgaagtcttgaagaaacagaaagaaagacttgaagtcatggtctcattcctaacgcccaaaacaacaaagattaataatgtgcaaaagatgtattgggcctaaaaggcctggcccattagctggattccgtaagaaaaaaaaaaaaagtgaaaaggaaaagaagaaatcgtcgttgttgtggagaaggagaagaaggataaggatg

SEQ ID NO: 12686 - DNA, 3000 bp, Unknown
  misc_feature (1)..( 3000): cDNA_ID_2709429_gDNA_ID_2214566_Annot_ID_134959 3000 nt of promoter + ATG
tcatctccttccgctgccactttctccaaacaccccaacccgtatcgaacaaactcatgcggcttcacttccgtgaggtcaaacacctgtatcaacacaaaagtcaccatgaagtttcaatatcaaaagctcaaaccaataacttgacaacatcaacatcactcagctttccaaaagactcaatctttaaacgtaactcatccttcaaagttccaacaaaacactagatctaacatcagctaagcataaacatataaatcaagcattaaaaacttaaaagccagagactttaagaaagtttccaaactaacataatcaaaacacaaagtagatacaaattagattcgaaattcccccaaaaacccaaagaaaaagatttgaaatacaagttcagtgagagcaaaacctgttcctcgctcatcaactgttgaagcctctctttaagaacaggaccatgacgaccaccagaattggggttaatgaaaacaaccataggagcatgaggagccatatcagcaacagcaccaccaggaagaagtaaatgatcaggaatagccgaggaatctttgcgtttgatacagtcacgcatagcgagacgaagatactcaggcatcatcaacctctgacgaagctctactttatctacaccaacccatgccagattcgcgagtccacaacctctcatcgtctttgaatcagccgttgatggtcgtgaagccacgaatttctctttcgatgcatcggtttttgataccggagagtccattgtagtctctcgccggagaagaaaagacaaaaagatgattacttttcgtcctgtgattggagaaaatgaggaatattcgaaacccagataatcaaaattggagttgaaatgaaaaataataaaggattgtttttttttaatctttcttcttcttctttgctgagagatttcaaatcaaccaatataaaatcttcttttgacagtttgtattttcttgtctgttttgtcttttttataaatgatttagtttcgaagacagcgcacaaaacgtgtgaattaatttgcttatattgaaaaaaaaagaatttacacggttggatttcaatgtgacgtcataaaaatgccactctttagatctttgattctttttctttttttattgtttgacatttatgaaagcgactgataaatgtttattttgtaaaagttctaatttagaataattttgattattaataatattaaactactaagatttgtatagtttaataccattatcttctgtaactaagatttgtagatcttttgtttctgtaagatcaaatttacaatttaaagtgtacaaaatcttacaatactaatgatggcataaagagattaacaatgagattttttaacgttattgttatatcaagaaaaccagagaaaattaattagtaattgattgatacattgtaagaataggatctaatgatattttaatattcaaaaaggttccattatagaggttacatctggtgaatatgattgaatacaatttgatatagagaattagagatacttgcattattatttgcttcctattattatttgactgcattattggtttctttttctatgtaaaaaatattttcaactctccaacaaagaaacaaaattctctgacattttgcttagaaagagtggcgttttcgtcattaaacaaaggaatagttttggtggtaacgtaaattgtaaaaaaacagcgaaggagacaatagaaaatgagagcagacattgaagttagtggattttccacagaatggggcctacaatgttattgcccactcagagaaatagggtcactgaaagtgatagctacttcccattgctgggatcgttgtgtactttttctaacctaaatttccctcaatgcctttttcttaacttatagaattggtcgaaacttgaaagtatatacaaatgccacagaaaaaaacatcatttaataccttcttaattgcacgatatgatatcagatgttttgtaaccaagaattggtccatgtaaacaatttattatgtggcagaggaagactcaaattcaggtggctgataaaaagtggggtttaagatatttcttgaactggaagacaatgagcgtgtgttctcattagtattacaaatcatatttacattattataaagcggaacatatttacattatactccaaatgatgtaactataaaatttgatctaacaatatatatcgttaagaaaaataacctaaatttatcacagcttattcatttacactcctatagaatcatagatttcctactcttttttttttgtcatcatataaacatatactactttttgttcaaggatcaatgtttcttagtttggtgaaagatagaagtaaactggagtgggccaatggttaggcgtgtaagcccaaactttggaacgattttagcccatctcaaaaggagcgtgctatattttgtaaatgaaattgcaaaattacctaacacaaattttcctataaaaaaacatttcgggtaagaaaccgacaattataaaataaaaattgtaagacatgttttattgacacatggaaaaatgaagttggcgaaaaagacaaacagtaaacgttaagataaaaccctacctataaatataccttacacgccacctgactttatcaaaaccaaaaacacaaaccttcaacggcacgctttctcctctgaaatctctgcgagcaaacttcttcatctacctcttaccgtacttcaggtttgtgtaaatcatttttataagaacttcagtgaaatagattagcaaccctaattgaatttaatcgaatcgtaactattgtgaacggaacccatccatcttgcataaaaaccctagtttctgaacagcctttcgaaacttctagtgttattgtattggctctgatcaacgttgttctaaagttgtgaactttgattgattgcaacagagtgtttaagatgaaatctgtcgtaatg

SEQ ID NO: 12687 - DNA, 3000 bp, Unknown
  misc_feature (1)..( 3000): cDNA_ID_2709425_gDNA_ID_2214566_Annot_ID_134960 3000 nt of promoter + ATG
atcatatcaacagaagcaagatgttcagctgtttgtggttgtggacatgtctcattcgcagcaatgattagtaaagcaccatccataatcgctgctccattcagcattgtcgccattaggatatcgtgtccctaatcaacacacaaaacacctcattaacatatagaaaatggttacaaaagatttagaaatagtgttaaaactcattttataccgggcaatcaacaaatgagacatgtcttagtagtttcatcttgtacttctcatgtccagagacatcacaacttgggttgtcttctttgccactcccgaaagacctataattaacacatatcataagttgctacgtacactacgtaaccttattgtagcaaaagaagagcaagaattcacttgtaggctactggtctagggcatttttcacatttgtaaatctttgcgtttgcgtaaccaagtttaatggtaatgttacgctccaattcactcttgaatttgacagtgtgcacaccggaaacggctttcacgattgtcgatttcccgtgagcgacatggccaatggttcctgagatatagagagcatagtcatatctttagctttcaatgcacggctgatcagtttcttcagcatcaaaactcaatgaaacaaaaacttgtgtatacctatgttaatggtggcttgacgagagatgacctcaggagagagaggatgcagctgagctacatcaagtttacttagatcttgttcagctaagcccttgttcttcgacattacgacagatttcatcttaaacactctgttgcaatcaatcaaagttcacaactttagaacaacgttgatcagagccaatacaataacactagaagtttcgaaaggctgttcagaaactagggtttttatgcaagatggatgggttccgttcacaatagttacgattcgattaaattcaattagggttgctaatctatttcactgaagttcttataaaaatgatttacacaaacctgaagtacggtaagaggtagatgaagaagtttgctcgcagagatttcagaggagaaagcgtgccgttgaaggtttgtgtttttggttttgataaagtcaggtggcgtgtaaggtatatttataggtagggttttatcttaacgtttactgtttgtctttttcgccaacttcatttttccatgtgtcaataaaacatgtcttacaatttttattttataattgtcggtttcttacccgaaatgtttttttataggaaaatttgtgttaggtaattttgcaatttcatttacaaaatatagcacgctccttttgagatgggctaaaatcgttccaaagtttgggcttacacgcctaaccattggcccactccagtttacttctatctttcaccaaactaagaaacattgatccttgaacaaaaagtagtatatgtttatatgatgacaaaaaaaaaagagtaggaaatctatgattctataggagtgtaaatgaataagctgtgataaatttaggttatttttcttaacgatatatattgttagatcaaattttatagttacatcatttggagtataatgtaaatatgttccgctttataataatgtaaatatgatttgtaatactaatgagaacacacgctcattgtcttccagttcaagaaatatcttaaaccccactttttatcagccacctgaatttgagtcttcctctgccacataataaattgtttacatggaccaattcttggttacaaaacatctgatatcatatcgtgcaattaagaaggtattaaatgatgtttttttctgtggcatttgtatatactttcaagtttcgaccaattctataagttaagaaaaaggcattgagggaaatttaggttagaaaaagtacacaacgatcccagcaatgggaagtagctatcactttcagtgaccctatttctctgagtgggcaataacattgtaggccccattctgtggaaaatccactaacttcaatgtctgctctcattttctattgtctccttcgctgtttttttacaatttacgttaccaccaaaactattcctttgtttaatgacgaaaacgccactctttctaagcaaaatgtcagagaattttgtttctttgttggagagttgaaaatattttttacatagaaaaagaaaccaataatgcagtcaaataataataggaagcaaataataatgcaagtatctctaattctctatatcaaattgtattcaatcatattcaccagatgtaacctctataatggaacctttttgaatattaaaatatcattagatcctattcttacaatgtatcaatcaattactaattaattttctctggttttcttgatataacaataacgttaaaaaatctcattgttaatctctttatgccatcattagtattgtaagattttgtacactttaaattgtaaatttgatcttacagaaacaaaagatctacaaatcttagttacagaagataatggtattaaactatacaaatcttagtagtttaatattattaataatcaaaattattctaaattagaacttttacaaaataaacatttatcagtcgctttcataaatgtcaaacaataaaaaaagaaaaagaatcaaagatctaaagagtggcatttttatgacgtcacattgaaatccaaccgtgtaaattctttttttttcaatataagcaaattaattcacacgttttgtgcgctgtcttcgaaactaaatcatttataaaaaagacaaaacagacaagaaaatacaaactgtcaaaagaagattttatattggttgatttgaaatctctcagcaaagaagaagaagaaagattaaaaaaaaacaatcctttattatttttcatttcaactccaattttgattatctgggtttcgaatattcctcattttctccaatcacaggacgaaaagtaatcatctttttgtcttttcttctccggcgagagactaca

SEQ ID NO: 12688 - DNA, 3000 bp, Unknown
  misc_feature (1)..( 3000): cDNA_ID_3434151_gDNA_ID_2214566_Annot_ID_134961 3000 nt of promoter + ATG
gaagaaaacgaacttgatcaggttttgctctatttcattaggcttgcttcttctcattgaatcatcagcatgtgattttgtaaattgccacggtttagtaattaaccaggctttatggtggtttcagggtttggacgcgggaattgatgcgcctccacttgcaaaggcttatgaaggtgttttctacaattacttaagcataggtttgttgaacttctctttttgatatcctaaacaattttcacaattgtttttctgaccagattcttgtgtttgtctggtttgtttaggtatggatgctcaagttgcatatggcttccaccatcttcgcaacactaaaccatatcttgctcaaggccctatttcaaataaggtttgtttattatatttgcacctaaactttggactcattatttgtctttgttaaaagctaaagtagttatgttggttttgagaaacgacattaccaaccacacaatgtttgcttttgcagattatatattcaagttttggttgcagtcagggttggttttgcacgccttgtgtcaacgatccaggtttaaggttcgccatttcgactcttattgtgtagttgaacttgtgtgtaagtctctgcttaagccctttgttgtgttgttgaccccttgtttgtgctatatgaatttgcaggggacttaggaacataatgaaaattcacatcaaaaaggttaactgctctcagtgggaagagatcgcagtcccgaaaaagtaaaaaacagttttcgatatatgatttatgtattacaatctttgatatcaatgcttaaaacctgatgctatggatttctcttgtagtgtgagatcaattgtcgcattgaatcttcacagctatggaagtggaagccatccttggggcaatctaaaaccggactatctagagaaggtattgtttctgttccatttcatcatatatgaactcagttctctgatgttaacccgaatgttttctttggtttttctcagagaggctttgtggaagcacattgtgatgatggtttgatagagattttcggttttaagcaaggatggcacgcgtcatttgtcatggctgagctcatctctgccaagcacatagctcaggtaacttcaaaagacactggtcaatgtataatctttttagccatgtgtttgactgtttcattttggtgatcatttcaggctgctgcggtaagatttgagctaagaggaggtgactggagagacgcattcttgcaaatggatggtgagccatggaagcaaccaatgagcactgagtactcaacatttgtggagatcaagaaggttccttatcaatctctgatgataaataatgaatgattgagattcaaagctggattctttgtacaaagctaattgttttgtatttggatttgattcagttagtcatagatatagcctaagctttttagtcttcttttcttttaaatctgagattgtgaccatttttctctttttaatttctgcttattgttggttttgtacatttttgtgttgtgaggaatgaagtttgtttatttataagaatgtgggaagataatatttggtcaaatttcaatctctcttcaatctttgtaattctagcattgagcacatagatgtgattctttgtcatatttttatttattttaacactagttcgactgagaaccaatttatcatcgacaccaatttctaagtaagaatatttttaataattatcattattagtcgtatatttttaccagaataataaaaaattaaaaacctaagttaataaaccacacaaaaaagtttttctctcttcgctctctcgtagtttgtaaagatagaaactgaaatttcttttgtttttgttaaccggatagttttccggtgagtcgccgtcccgtttaattcgggctttcgtccgacatcttctagctacgttagtggagatggttggctttttgtatggcatcgttggctaacttagcgacgttggccagcttccgtacggcagcgttgggcttacactaacagcgttggtcatctttgtttttgttttgttacttcaaaggtttgatgatgaagctttatggcatgcagaatcgtcagatctgaagagggtttctctttacaagatctattctccttctgttttgtttagcttcactattgggttatgcttttggctctggtagtttttcggcgatgtgtgcgtttccagcaattaccctcgtttggatctaccatatttaagacagtttcaattttattttcgcctaagattgggttaaagcttctatcctatgcaaatttgatatgcctttagtgcttttgcaagagagttcgaagattcaatggttggacaagtttgaactactcaatttttttaatttctttacccgttttgatgaattatttgtgattctagcaaccatatgagattaggaaattgatgtttgttctataacatctaattgccataatcggtgatagaaaaaaagagtttcattgctcggtgctttcccggcgatggttctccgattcaccagacttgagtctcatccggtggaggttgtggaagattcacgtgtccttagcttattattattggtctgacacgtcttaagcttatctcttttttgtgacgtaaaagtctgttgtggacctcatatgtagactgtcttgagccttttatgttgtaacactgagcctcagtatattaaaaataaatctttctctgaaaaaaaaaaaaaaaaagttaaaaacctacgctaaaaaattctaggtcttggaaaagagtatttgggccaaatgatcacattaattagttatgggctgaaataacattctgaagttttatgaggaccgagagaactaagtttaagaaaaatgttgaaaaaagcgtattagcagagggacaaacgctttttagggttttagatttcctctgagagagaattttcgaaagcttgagagagatttccaactacgttagcc

SEQ ID NO: 12689 - DNA, 3000 bp, Unknown
  misc_feature (1)..( 3000): cDNA_ID_2709421_gDNA_ID_2214566_Annot_ID_134962 3000 nt of promoter + ATG
tagaaaaaaagagtttcattgctcggtgctttcccggcgatggttctccgattcaccagacttgagtctcatccggtggaggttgtggaagattcacgtgtccttagcttattattattggtctgacacgtcttaagcttatctcttttttgtgacgtaaaagtctgttgtggacctcatatgtagactgtcttgagccttttatgttgtaacactgagcctcagtatattaaaaataaatctttctctgaaaaaaaaaaaaaaaaagttaaaaacctacgctaaaaaattctaggtcttggaaaagagtatttgggccaaatgatcacattaattagttatgggctgaaataacattctgaagttttatgaggaccgagagaactaagtttaagaaaaatgttgaaaaaagcgtattagcagagggacaaacgctttttagggttttagatttcctctgagagagaattttcgaaagcttgagagagatttccaactacgttagccatggcgagcaccaaagttcaaaggattatgacccaacctatcgtacgtttcttcttcgattcctttgttccatctctttattgtttctatcgaaacctaattttgtatcttgctttttgttttccggtggcggcggctccagaacttgatttttaggtttcttcaaagtgtaagttgttcaatttcttctgatttgctctctgaggttttaggttattagtagttcgtctactgatttgttccctggtcttttgtgtttgtgatgcagaaagctaggatccagatttggctatttgagcagaaagatttgaggattgaaggaagaatcactgtaagttgatgttgaagctccgttatcatgaattgattagattcctggctttgtttataggacattcgagggttatgctaactttaggagagtttgaaatgcattagcagtgtgactatctctctaatttagtctgtgtttgaactgttgcatttgttgtgaattgaaaagggatagttgtcactgttactactactgcacaaagaactgataagagcctgccaatagaaactagtttgattagctagctgttcttaggttgagtatgattgtgtcattctcttcggcttaaaacttattgtctcctacagcctacttggctttgggtgttacttgtttcagtttgttgctatgcttgtagttgtatgtcctctatgattttcgagttatgattcaagcattcaagcttttcttagtttgattctatgataatttggagaaacttgagattttgtgatggtgtcattctcattggcttaaaggtttgagttgtctacttgacttttgttgttccatgttgcagtctacttgacttttgttgttcctcgagttaagatcctagcttttctgaggttgattatatgtatggaggaacatgatatttgtgatagtgtcactctactcggttttaaacttagatttttgtctacttgaatttgggtgtattattgattcttctaggagaatccatcaaaccttgcttatccgtcgtcctttgcagggttttgacgaatacatgaatctagttttggatgaggctgaagaagtgagcatcaagaagaacaccaggaaaccacttggtgagttatcctgaactcactctttgataacaagtctcagatctgtctgcttatggtttgataactcgtgttaatacctattttcaggaaggattttactcaaaggagacaacataactctgatgatgaacacgtaagtaacacaatctctactctgtcttctctctttatgatgtatagcagcttgatttgtcacataacaaaagattgaaacaaaatcctttctatgttaacaggggaaagtgatgtctgtctcaaacaactctcttcgatgaccttcaagcttatgttaaatatctgttgagttcttcctcagcttaattggtacttgacgataccttcttttcttcaatgtcgtataatatattgcaatgtagtgagtgacaaaggagcttgatcgaatctagtggattggttggttaaaacttcaaaaaagagatttggtcccttttggttaaatctagtgttatgtaatttggctgatctttgttgcaactttttaacctctgtttaaatttcaaaccttaaaaaagtaaaaccaattgattttgattataaaaaaaattgtatcatttttgtttgtttggtgaactgaccgagttggccattctcagggctcaagtagattgaaagtttaattatactaatagaccaatcagaatataatctgttaaagttaacataaaaatacagaaatctatgtgaacattaacttttcattgcaattagatgtttttatatccatgttgattgttgaatcttatccctaatcttgctattggtgaaatgaatgtatttttactattaaagtctttttttaataacaaataattggactttatacaacaaagtattattatttaattatcaactttagaatatagcatgtgccaaaaatacatacactagccgccggcccaagaatgtcgtccaataaacgaaaagcaaaagtgacggcaatccaagcctactgtgatcttgtccgcacccgataactatctttaattactaaaactagtcaaagtactcgactaatcacaaaactagacaagtgtttcaagtaaattaatttttgatcttttcattttatctctctctctttttcttctatccaaaacaccatttttgaggtatttttctctctccttcgaatcgaattttcaggtttctctttccgtttgtttgaagaagcttttaagtagaattcataaaatcttgcttagcttctgggtttgatttgtttgtggtaaagttttgattttttttttagtttgagagctggatttgtgattctttctctgggttggtgaagttttttacttgcttcgatcttatagatcagagcttctagcagcgtaaaaa

SEQ ID NO: 12690 - DNA, 3000 bp, Unknown
  misc_feature (1)..( 3000): cDNA_ID_1030924_gDNA_ID_2214566_Annot_ID_134964 3000 nt of promoter + ATG
caccgtgtacttctgttttcacagactcagcaaatgcttgacatcctcgagagcttcttggttgcaaatgagtatagttaccggaggatggatggtcttactccagtgaaacagagaatggctttaattgatgagtttaataattcagaagacatgtttgttttcgttctgacgacgaaggttggtggtttgggaacaaatttgactggtgcgaacagggtcattatctttgacccggattggaacccctcaaatgatatgcaggtacgttttactttgaatgtcacagattcagtgtgcaaaaaacccgtcgtggccataaataacaatcaattttctgcttttttgggcaggcaagggaacgtgcatggcgtattgggcagaagaaggatgttaccgtttacagattgatcactcgtggcacaattgaggagaaggtatatcatagacagatttataaacattttctcaccaataagatcttgaagaatccacaacagagaagattcttcaaagctcgggatatgaaagatcttttcatcctgaaagatgatggcgatagcaacgcctccacggaaacctctaacatcttcagtcagctggcggaagagataaacatcgtaggagttcaatcagataaaaaacctgaatccgatacacaacttgctcttcacaaaactgcagagggatcctcagagcaaacagatgtggaaatgactgataaaactggtgaagccatggatgaagagacaaatatcttaaagagtctctttgatgcgcatggaatacatgtaagtacattaataagtgctcattgaaggttcttctccgacttactttcccataatttccaattcccttcactctcttacaatttttaacacagagtgctgtgaatcacgacgccataatgaatgcaaacgacgaggaagagaagatgagacttgaacaccaagcatctcaagtggcacaaagagctgcggaagcattgcgccaatcacgaatgctgcgtagccgcgaaagcatctcagtgcctacatggacgggaagatctggttgtgcaggtgcaccatcatctgtacggaggagatttggatcaactgtcaattcccggttaacccagactggagacaaaccatcagcgattaagaatggaatcagtgcgggtctatcttcaggcaaagcaccatcttccgcagagcttctcaacagaatccgcggaagcagagaacaagccattggcgttgggcttgagcagccacagtcttcattcccttcttcttcgggttcaagcagcagagtaggttcgttgcagcccgaggtcctgatccgaaagatatgcagctttgtacagcaaaaaggtggaagtgcagacacgaccagcatcgtcaaccatttcagggacatagtttcttttaatgacaagcagttgtttaagaatctcttgaaagagattgccacgcttgagaaggatcaaaatagatcgttttgggtcctcaaatcagagtataaagactaaaaaggagatgttttggctgcctctactgttcaagtctgaagacggagaaggcaacattggctccacacatatttgccaagtattctctttttctttataagctcacgcacttcttaacctttttttttaccagcaaagtcacttacacttcaaagtctacttttttgttttgtttaacatgatgttaaataaaaaagtaggaaaatcttagtaaagagagcacaactatgaatcttttattgaccaactcgaaaggcagacaccagttaagtaacagtaaaacaaactctcaagtgtaaagactaaagataggttttcttgtgtttgaatgttggtgcaggcaggtcgagagaggttgggatcgacctaccgagtaacttatgaagaacttgaatcaaacggctgatgtagattactcttatttggaagccgtattgagacgaagtggttgaaggtagagttttcatcagctacaatctctcaattcttttactcctggtggacggtgaaccaaattaacactcagactcagtcattgtgggttttcagcgaccagagtgtcagtctcagcttgcttggaaaacacttggtttcgctccgcaagaccagctaattagcaattttcatgagtcatgactccacaaagcatgatcaaaatagcaattgtggtgtgattcacaattgctaacatccctaggtgtgaatattgattcagcctgctcctgagattttaactcttgtaatgattgctcaaacacaagcaacagaggaagttatgagagctagaaagtaactcttgtaatcttgttttaaaacttctaaaaaatgtatatttgtcaatatattaatgtttggacccaaaaaaaaagtcaatattgttgtttttgttaactttgatattactgaaatttcttgtacgaattaaatcgaattagtgtgattacaagtaatcaatcgaattactgtaaatctgaaccaatcgatttcggttcaagttggtaggtataaattaccaatttagaaccgtactcaattcaatgcgttgttgactcatcataacttattaacttgtgcatatctgacgaaaatacccttgtctaattccaaaatatacaagaaacccttatcagtcccaattctcacaaataacaacaacaatttcgccggcgtcgtcgtcgtcgtctctccatcaccgtctctgctgcattgattcgcagcactgagtcctaaatttccagtattcttctctaattctttcgctgtttcattgatctcaattttaaaattttctctttttttttttttttttgcattcgcattcgttttatgatcggtgactaatttcacttataggcatcaattctattcaattcctcttcttcgttttatgattgatggtttgatctccaatttgattgtatattgtctgatcttaatagtggtaaattgttatgttctcaaggtgtaaaaaaaatcagaaa

SEQ ID NO: 12691 - DNA, 3000 bp, Unknown
  misc_feature (1)..( 3000): cDNA_ID_3026114_gDNA_ID_2214566_Annot_ID_186023 3000 nt of promoter + ATG
tgcgtcttgtgaagcctcgagacaagccgtctccacggtcaatttagccaataaatttaggcactcccaatctttagtcggagctagatctggatctgaaagaacgagggcgaaaaagagcatgtctggggagtggaaggaccagagccgaagcctcgtgcctgtctctagaatgttttcggtgacgaccttgttccatcctgaacctaagacgtagttggaagtggaagtcatatcccatctcttgagcttaagcttcctctgtagaccctcggaattcaccaagatcacatccgctcctttgtcactgtcacttatctttttgtaatgtctatctattttttctaactcttcctcgtttaagaagtccatatctagtatctgttccagggcatcaagagacgtgtctgaagttcgtcgacatcactatcgggaagaaccttcacaaatatcagctttgcatccacaccgttcacttctctcatcacgttaatcagtcattccgtcggtgtcctatcttcatccgtcactataactttaagcggctttctttttcttaccggtttgtttgaaacccctttttgaggcctcttggactctacatggcacaaacttggagaagaagcaacacgattagggttttgttccgggtcttgattcttgcactcatcaatcttcagtcatttgcttaagctggaaatcatcgttgtgctccttagattgtaattaattactcttttcgttctctctctcttattatcctcgagacgtacaatatctaacgctctgttgtctccctgcaaaccattgaattgatcatcagctctcaccatggttatcaaaaaatagatagacaagaagaaaagagttaagcggcagagaggacttatatattattctgatggtcaattcctttctcgaacggacaaaggtatatatatatatataactctctattaatttttttttgttataatatctttatatttttgtattagttttagataatcactaaattacttgcttcttttctatgtcataactacaggcttgtattgtgttggttattcttttgtttgttgttcggtttaaactttaaatacatgtatttaccttcaaactttttttttttggtgagattctcaaactatttaatttaagtccagaaaaacgatttatttctccccaaaatatttgtatttcttactggtttgtttgaaacccctttttgaggcctcttggactttacatggcacaaacttggagaagaagcaacacgattagggttttgttccgggtcttgattcttgcactcatcaatcttcaatcgtttgctcaagctggaaatcatcgttgtgctccttagattgtaattaattactcttctcgttctatctctcttattatcctcgacactagcatgagcttcagtggatgtttctcctatttcctcatatgcaaaagctctaaccattctctccctcgctacacgtacaatatctaacgctctcttgtctccctgcaaaccattgaattccctttttcgaacggacaaaggtatatataactctctattaaatatatttttttgttagtgataatctctatatatttttgtattagatttagataatcactaaattacttgcttcttttttagcgtgggaatattttattttttaatttttagtaattttttgtgtgactaataatatttaaattttttgaaatatatgtttttatatgtctacttattgttaataatttaataatttaaatttctttaattttaaaattaccatggcaaataaattcaatttatatacacaactgtttttaaaaactctaatacaacttttaagtttttacaacattttatcaaaacaacatatttttctttataaggaaacacccataaaaagtggacctatccagttccaaaataataagaaaaccaccagaaaataaatatgaaaacaataatattcaaatccaaataaaattacaaaattaaattaaatacccaagatttggccttctcacatgcacatgcaaacgtgatatttgcggttcaataccctctccttggacatcattatattcttgattagagtcaaatataaagagaaacgtgattgctgatgatagacacgattcattattgtttgctcaacttgatccgttaatttcagtttcgtatcaccacactattgccaaaatctcaagtatccaatccatctattctctctcgcaatctcttgtatcttcaactacaaatccctaataaaatctcgttctcacaaatatattttcacctctttagtattgattttcgatttgagttgtgatccaaagagtatacatgagtttaaaggttctatgcttcccatgaatggatgatccttttggttgttagttgaatatttttccattctattgtttagtcctagttttttctcatcatttagttattgatgattatgtatagttaggaataagccgttatattttaagtgaaattaagttaaaaaatatatataaaaattattatcccataatacgagactaattattatactatttttttttattctaacaattaattttgtttttcatatgttattttttcaaagtttatatttctatctttacatatatatatatatatatatatatatatatatatatatatatatatattatttatatgtttctgtttcataagccaaaaactgattcactaacttatccgccggcatatcaaacggcacattcgccacataaatcttcatcatcgatatatccgaaacatgtgaatttgttgtaccttgattccaagcagcagcgagctgcataaccgtcccacccctatcaatcttctaacggtttctagaacatctggatgtcacgtcagcaaagtagggcgatttcgagagtgattagggttttttcgtccgccgcaagtcttttctgccaaggcggctagccgccactgccacc

SEQ ID NO: 12692 - DNA, 3000 bp, Unknown
  misc_feature (1)..( 3000): cDNA_ID_2709409_gDNA_ID_2214566_Annot_ID_186021 3000 nt of promoter + ATG
ggctatgaactctaaagttgtggatggtgtggttcagccatgtagggatatggcgggggaacaggggattgatgagttaggtgcagttgcaagagagatggttaggctcattgagactgcaactgttcctatattcgctgtggatgccggaggctgcatcaatggatggaacgctaagattgcagagttgacaggtctctcagttgaagaagctatggggaagtctctggtttctgatttaatatacaaagagaatgaagcaactgtcaataagcttctttctcgtgctttgagaggtatattcagttcttcagctatgttgtatctgcggtgtatataccaattcgcgggtatttgattattttgttgcatttggcaatgcaggggacgaggaaaagaatgtggaggttaagctgaaaactttcagccccgaactacaagggaaagcagtttttgtggttgtgaatgcttgttccagcaaggactacttgaacaacattgtcggcgtttgttttgttggacaagacgttactagtcagaaaatcgtaatggataagttcatcaacatacaaggagattacaaggctattgtacatagcccaaaccctctaatcccgccaatttttgctgctgacgagaacacgtgctgcctggaatggaacatggcgatggaaaagcttacgggttggtctcgcagtgaagtgattgggaaaatgattgtcggggaagtgtttgggagctgttgcatgctaaagggtcctgatgctttaaccaagttcatgattgtattgcataatgcgattggtggccaagatacggataagttccctttcccattctttgaccgcaatgggaagtttgttcaggctctattgactgcaaacaagcgggttagcctcgagggaaaggttattggggctttctgtttcttgcaaatcccgagccctgagctgcagcaagctttagcagtccaacggaggcaggacacagagtgtttcacgaaggcaaaagagttggcttatatttgtcaggtgataaagaatcctttgagcggtatgcgtttcgcaaactcattgttggaggccacagacttgaacgaggaccagaagcagttacttgaaacaagtgtttcttgcgagaaacagatctcaaggatcgtcggggacatggatcttgaaagcattgaagacgggtgagtatagttagaatttatctagaagctagttttgcttacttcacaaaatgtgaccaaatcccaaattttgtttttttcattgatcagttcatttgtgctaaagagggaagagtttttccttggaagtgtcataaacgcgattgtaagtcaagcgatgttcttattaagggacagaggtcttcagctgatccgtgacattcccgaagagatcaaatcaatagaggtttttggagaccagataaggattcaacagctcctggctgagtttctgctgagtataatccggtatgcaccatctcaagagtgggtggagatccatttaagccaactttcaaagcaaatggctgatggattcgccgccatccgcacagaattcaggtacatttcattgttcccgctgttgtctccacatatccataaccaaaattatgcaatccggtttttttggttccttattttgtacataaagaaaatgaatttggtttggttaattacgaatttgatttaggcgtttaaagaatttgaggttttaaccaattcactatttgttttggttattgtttagttggaacctagattagtttgatttttgtattcggtttagtcgacttgggaacttttagacacatccataggcctagaattagcagtcaaggaatgtaatgttttcaaattgatgaaaaccagctcaaaagtgtaaaacttgggtttcatgtgttggtgtctttgttatgtctttattcgttgtttgcagaatggcgtgtccaggtgaaggtctgcctccagagctagtccgagacatgttccatagcagcaggtggacaagccctgaaggtttaggtctaagcgtatgtcgaaagattttaaagctaatgaacggtgaggttcaatacatccgagaatcagaacggtcctatttcctcatcattctggaactccctgtacctcgaaagcgaccattgtcaactgctagtggaagtggtgacatgatgctgatgatgccatattagtcacacttcagttggtatgagagtttgtatcattgtatgagtgtttgtgtgtctaacgacgtcggaggaggatagaaagttttttttttgtttccggtgagattagtagagaagagggagattatttgcgttcagctcagctcgccggaaaaaaaacgtaacagtagttgtagagaatttcaagacttttgtttgtgctgtgtaaattgacaactccgagagaaacaaaacaatgagataagaagagagcatattaatcgatgaccaatccttttaatttgttactcgttacatcaattcaaaattattatttgattgttaaccatttataaatcatattatatccaattagtctgtctacgcaatcaagaggtaaaggccaatcacattaattttaaaagatttatgatgaaatggtaccgtccaaaaagttgaaattttacaaactccactatatatataaaaagtgagatgtttaaattaggctggctaagcttaggatgtaacacattaacaatagttaatttaatgtttatgatgtatcgcactatagttttgatgtgtatgctctccaggctgtttcgtttttcacattacccacactaaactcaccttttttcttaaagaaaattaaagtaaagctcaaagactgaaatattaacaatatataactaatcattaaggaatcaaaactccattatatatgctctataaatactcaccaatcaatagccttctaaatgtctcaaacccaattcaaacccttaaacccacctaaaaccttcaaaacttata

SEQ ID NO: 12693 - DNA, 3000 bp, Unknown; identical to SEQ ID NO: 12690
  misc_feature (1)..( 3000): cDNA_ID_1030924_gDNA_ID_2214566_Annot_ID_186017 3000 nt of promoter + ATG

SEQ ID NO: 12694 - DNA, 3000 bp, Unknown; identical to SEQ ID NO: 12689
  misc_feature (1)..( 3000): cDNA_ID_2709421_gDNA_ID_2214566_Annot_ID_186015 3000 nt of promoter + ATG

SEQ ID NO: 12695 - DNA, 3000 bp, Unknown; identical to SEQ ID NO: 12687
  misc_feature (1)..( 3000): cDNA_ID_2991431_gDNA_ID_2214566_Annot_ID_186012 3000 nt of promoter + ATG

SEQ ID NO: 12696 - DNA, 3000 bp, Unknown; identical to SEQ ID NO: 12686
  misc_feature (1)..( 3000): cDNA_ID_2709429_gDNA_ID_2214566_Annot_ID_186011 3000 nt of promoter + ATG

SEQ ID NO: 12697 - DNA, 3000 bp, Unknown; identical to SEQ ID NO: 12685
  misc_feature (1)..( 3000): cDNA_ID_2712388_gDNA_ID_2214566_Annot_ID_186010 3000 nt of promoter + ATG

SEQ ID NO: 12698 - DNA, 3000 bp, Unknown; identical to SEQ ID NO: 12684
  misc_feature (1)..( 3000): cDNA_ID_2709433_gDNA_ID_2214566_Annot_ID_186009 3000 nt of promoter + ATG

SEQ ID NO: 12699 - DNA, 1029 bp, Unknown
  misc_feature (1)..( 1029): cDNA_ID_2990746_gDNA_ID_2214566_Annot_ID_186001 3000 nt of promoter + ATG
gatctcctataaattatttaaaatgtgggttggaatatttctctgtttttcggaaaagtacttttaaaactaccctctaatcagtaattatttttttaatgtcattagagccaatataattcatataattgaactctactttgatttatgtgttctttaagataatgtaatatgaaatgtttaaatttagaagtcttttcaatcttttttttcttactactttgaactctactctattctagaagaaaacttgggccttcaattttcaagcctcgaggactgattagtgattattttgtctttgttcagacaacaaaaataaagaaagtgaaaaagataaaaacttttttcttttctcttcttcagtttcttcttctttttgttttccttcctcgttctttcatgtcttccttgtgccattgatgagtccgtcaagaccaaatcgagagtagtgcaagacttttttctcacactgtttctaaaaccgcgtgagaaatcttcttcctcctcagatctctaccttttcccttaaattttcccgcattttctctctcttccaagcttctccaagcgtacaagctacttcttcttccataaactcaaagtaaaaccctaaaccaaaactctcttcacctctataaaaacaccacctttttttagctcctgtctctttcacagacttcaatcgcattttcattaccagccaaaaatcatcttcaatttccaggtaattaacatcaatcttgaattctctgtttcactttttttactaattctctgcaatatttttagtaagttactcttgcgctttaagttttctcttttcaatgtcggttacaaaaatttagattgctccgtaagattcggcataaagtttgttgctttaagctataaatcaattacccatttcgattttgtcccatttctcattgcaaagctcaagataggtttggtttctaatctgtcgttcttgctctttgattaggttacaagcttaagctttttcatagatagatagaaaagagaatg

SEQ ID NO: 12700 - DNA, 3000 bp, Unknown
  misc_feature (1)..( 3000): cDNA_ID_2709413_gDNA_ID_2214566_Annot_ID_134966 3000 nt of promoter + ATG
tatgtttttatcaagaaccacagccatcttcttctcctcgtcaacaaagaaactcccacccgaataagagaaggaattaccagtgagaggtttcatgtcaacctttaagaacaacttgttccacgacactgcattgggctcaaccttgctgctaatccatatcttcaaggtatacggcgaagaagaccgctgacacaagaccgcaatctggttatccccaacgctagatagagccacagtatcaccaaagtaaggctgaaatggcagaggcagaggcggtctaaatctctccgttgtgaaatcaaaacacagcaagaaataagaaggatcttgtcctccatatggaacaaccttgtctcgtgcaaaccagtaactgtttccatcgatagacaaaccacggtgaacaaaatctatctcccaatccggattcacatcaagaacctcccatgaatcagactcaaaactgtagatttcaaactcacaaagtaagtgtctccttccatactcaccgtcatccacaaatctcaaaactttatgattcttcatcacatcgtagcccagagcatacctatcccatttgttgaaagagtttctgggtttgatccaaattgtttgcccaacacaagggttccaaacaacaaccctagatatgtctttagtggtgcataacaagaaaccctcgcagtgaaaaatgttagatatgtcgacttgtgcaccaccgtctaagctaacaagttgacctaaacgctctatgggattagggtttagtagattgagactgaataaagaaaccctaaaatcgagcatcatcacaacatgaaactccttactctgcttcttctttgcttcttctttatcgatgtgcttccttgtaaaagacatatctttggataaagtgttcaactttttgcatgtgaatcgtactcttctcagagatgtcactggaaacttcgagagcacctcctccgccacatcctttggaagatccgagagcatcgtcgttgattgtttttgcatatcgaagaaattttactttaccttttactctgatttcttcagagattatgagagaacgaacacttcagaaatgttagatgtttctaaattgggcttgggctttaaagtattacccaaaggctattaaagtcgttttttccaatttgggctcctgatttattagtatgggagggcttagttttgggctttaaagtatgccccaatgcctaataatgtctagctagttcttcgttatactaaagaacgaattttggaaattcttgaattacgattgtacccttatattaatttcatcttttgtcttattcttatttatgcaaaagttatgcaaaagttttaagaaattagcagccaagcctaaagaatcattgagagtttataagggtgatttggtaattgagtagtttattagctaatttgatttcagtggcacgtggtaaattactggtggtttaaaactattgtacgtggacgattcttagccaacgaactagtacactctagtgcgaacaggtacatgattaaattcgtggacatccaatcatatctcgtccaagataagaccaaaacatatgaggtcattactcactaataaacatttaaacttttgttttgtcaacgaatagtgtgtttttcttttgtcattccaatttttttctgttttcttttcactattcacttttggtccataatattttatgggtatataagataatcgtttttgtcttcatacatggtaacatggatgtttatatatgtaatagtgttaaaaagaaaaagtggtcggttatacttaacttattatgatagagctttgaaaacaaacaacacgagatggagaaattagtcattcaacaaaagaaaaggacgaacgcagtgacttaacatgaaactgtgagcggcccaaaatcatttatgtaatggacccttaacttttcatgcacacgatttttctcatttatatgtttttctgctctctttttttcctctttatcattactttaatttattttatgttcttttttcgaagcaccataattgtatgctttcaccaaataatccaaatttagaatcattaatatgtcaaaaaagaattgcatatattcaataaaacgtaatgctaagtagtacaatgcatgtattatacaaaatgtaatgatatagatccaacgtatatatcaaagtggaccaaaatatatcttatgtattagacgagtttactatgcaaaatttatgattctattccgcatggagcgtgctaatactacttcgaacccctttgagaccaatatgtgattctatattctatctagtacaaattatgagaagtatatacgtacgatgagagtataaaacatttcaatatttgtatagagaggacaccacttggttgacttgacccacgataagatattgaagaaaccaaacttgtatagtacgaattcgaaatcgtaattgatgatgcgattcgacaagtccaggggctccctcccacgcgcaatgggcccagcaaccacgtgtggccactagagagaataaaccattagcccacgtgatcttgggcccaatcaatctctccctcacattaaacgacaaaacaaaagctcttctgggttaaattgataaatatcaaaactttaaaggtaatttgctaaaatcgccacacaaaaaaagtcgcagaaaatatatgaggaaacaaaaagcgaagacgacaaaaaaaaaaaaaactctgatttttttttgttatctctctctatctgagaggcacacattttgcttcgtcttcttcaatttattttattggtttctccacttatctccgatctcaattctccccattttcttcttcctcaagttcaaaattcttgagaatttagctctaccagaattcgtctccgataactagtggatgatgattcaccctaaatccttccttgtctcaaggtaattctgagaaatttctcaaattcaaaatcaaacggc

SEQ ID NO: 12701 - DNA, 3000 bp, Unknown; identical to SEQ ID NO: 12692
  misc_feature (1)..( 3000): cDNA_ID_2709409_gDNA_ID_2214566_Annot_ID_134967 3000 nt of promoter + ATG

SEQ ID NO: 12702 - DNA, 3000 bp, Unknown; identical to SEQ ID NO: 12691
  misc_feature (1)..( 3000): cDNA_ID_2707060_gDNA_ID_2214566_Annot_ID_134969 3000 nt of promoter + ATG

SEQ ID NO: 12703 - DNA, 3000 bp, Unknown; identical to SEQ ID NO: 12682
  misc_feature (1)..( 3000): cDNA_ID_1809125_gDNA_ID_2214566_Annot_ID_134971 3000 nt of promoter + ATG

SEQ ID NO: 12704 - DNA, 3000 bp, Unknown
  misc_feature (1)..( 3000): cDNA_ID_1808196_gDNA_ID_2214567_Annot_ID_134975 3000 nt of promoter + ATG
gcttacttgcgggtgaagtaaaagaagatctcaagaatatacaagaacgtgtgattctctcaattaaaagagtgaataatagttcgcaaccgtcagtaacaccagaatctgatccgaaaaaccccgatgagtgcctccaaacacttcaggaaatcccgggaacgcctcaagatttgcccttttacttcttcttgttctgcatcaggctccttgaaaccatcataatagctaaaccggaggagaacaaagtcaaggtcttagaaaacaaattcaagacgaggtcttggataagtgattgggacagcaagaaaattatgccggcgctaaagctatcactctcattaggcttagcgattttgctaggttcgatgtttagtaagccaaacggttattgggctggtttacccgtagcagtcagcttcgcagcggccagagaggcgacgtttaaagtgacgaatgtgaaggcacaagggacagtgatagggacagtgtatggagtgatgggctgttttgtgtttcagaagtttttgacggttcggtttctttctttgcttccatggtttctcttctctagcttcttaagcaggagcaagatgtacgggcaagccggagggatatcagcggccataggggccgttttgattctcggaagaaagaatttcgggccaccaagcgagttcgcgatcgagagaattatcgagacttttattgggttgtcttgttcgatcatggtggagcttgtctttcagcctacaagagccgctaacatagcaaaacttgagctctctagaagcttccacgctttgtacgagtgtgcaagcttgtttggagctaaagcgagtaaagcagatataatggaaagtcaaaagaagttgagaagtcatttaaatgagctcaagaagttcacagcagaagcccatgcagagccaagtttctggttttcgcctttcaacttttcttgctacgaaaagctgttcaagtcattgtctaaaatggctgatctattgcaattcagcggttacgccataggctttcttggagaacaaggaaaaacaaaatcaccgcagtgtaaggagattctaagcaacgtagacaaagatctcaagagtctaacagaaagcataggtcttttagccaaatcattcgaggaaatcacacttctaaaatcactagacgcactcgaaaaggcgctcgccaagagcgacaacacctcatgggacattgagctcgggaagacaccgaaccctagcttctcaaccgccgtgagcgagccggagaagattttagaaacgtatctccagcattgcagaagcgtggcggatggactattccgtgtggaagaagatggagaagaagaggttgaagtggacaagagtgaggttgtgttgagtttgtgtgcattagggttttgtgtggagagaattgggaaagagacaagagagattgaggagatggttaaagaggttgtgcaatcggaaaatccttcaagccatgttaacttgcatgagatctcttgcaaaatacgttctttgtataaatgataatattttaccattgataaacaacaaatggcgtgtgaaagacgaaaacgtttgtttttttggtttatcatctctttttttttttgttcctgtaataaggctttgtggttaaccggtttatataccaataataccaataccaattatgtgaagactgaagagtctaaaaagtgcatagaaaattagtaaataataaatgttgggactctttgagtaattcgttggcctcttattcaaatgttaaaataatataacaagtttagagaaaaaaaaaagtgtggctgctgggattcgagcccaggtccccacggccacaacgtgggattctaaccactaaactacagccacttttatgtttgatttcgcttgattgctttatttaattcgtattggtcaacgacaactttaagactttaatactctattttttatagtttttttttcatatctaatttctttatatactaagctatttcgaaaagtttatgttttttttttcctaatattctgaaatgaatgtcattttttttttttattcgatgtttacactcatttttaaaagttagtcagatagcaaaatctcgcaccttttctatttcaagttaaaataaaaaaaaatctcttttagttttatatttttcttggaacaaataaacactgaaatcaaagaaaaatcatattctcgacaaattgcgaatgaaattatgaaaatggtgcgatattcgtttagcgcaatatcaagtcaacggttcgattcctacggcgaatatctaactcccgtcaatatgtaatactctaagcttttctttttctttttattaatactcaagtttaagttaatcgagtcgcgcaaatctcgaaatttaagatctataaaatccttaaaacccataatttattattccatcttccttcctcagtcttaattcttaaatgtcgagaatagtctaaagtcaaactctcttagtctttgttttctcttatctttctttctttattttttgtcatctctctttcttgatataaaaacgttctcattttctttattgaaactttattcataagcgacgtttggtgaccaacttaaaattgggtttggtgcatttcgtagtctcacttttcgttcatttgaagcttcattttttctggtagggatttttttttttttttttggtgtggcttagttaacaaattttgtgggactatcttcatgtttcatatgatttatttaaatttacatgcgtataaatattgattccagtgaatctcttaatgtcatcaagatcagaagacaatttttatttttcatcaagtttcttagatcatcaggttgattgatactctaatcagtgtgattgtgtatgtaaatgcatgtgtattattctgtttttggttttctaaatctcatgatgaatctgtgattagagtttattaaatttgattcaaaattgtagaaatg

SEQ ID NO: 12705 - DNA, 3000 bp, Unknown
  misc_feature (1)..( 3000): cDNA_ID_2709492_gDNA_ID_2214567_Annot_ID_134976 3000 nt of promoter + ATG
ttttcgatatagttttaatttaaatgtattttaaaattttgaatattttgttaattatcataatattttgtatagtattttatctcataaacacttaaatcaattaatatcgtttagatcttgagtaaaattttaaacattaagtattttatctcataaacacttaaatttttaatattgtttatatagtttggattagtgttaatttaagagataaaagctgtacgggagtagtagatagcaaagaaattagttttgtttctttctaaagtaaaaagtaaaagatgtgatttgcatagaatgtgcaaattttcctttccaaaaggtgtagttgaaacttggtgtgaaacaaccaacagctgtacggatttgaatctgaagttgctttatctttctcaggtttatacctttctcttgttttcttgaagtttggttttattcatttttttttaattgaattgtgtaaacggcgattttctctcttatgtgaattgttaatttatcttgtcgggacgaagataataatgccataagataactttgcatacttccgagttacgaatttacctatttgataaatttgaataagtgtaacttataatatctacaaaataatgcgtctattacattaaactagattgatactaaagataaagaatgttatataagctgtatagatccattacaaaagagattaagatatctttgtttccaaaatttctctgttcatcaagtttcatactctttttacaacgggaaaagaaaaaagagtatgaaaattaaacagataaactttggaattagtataataagatatcgcgtatttgcttttcaacatacaaagaaaaaatcttatttgccttctacaagatttttattgccctatgtatacaaaataaaatttgatgctaactttagttttgcatgagaattttccacgtgtgttaagtgatctccaaagactgatgtctgctgttgcatgcatgtgctgaacaatattcataactgatcaattttgatattatatgatcttgagtcggcaattcttgtttctggaaagtctttgtccttttatagttttgagtcggtgagtcttgtgttcttaagaatttctgtttgtcatctaaatacaactggtgaaaaacacaactggtgaaaataatttatattctcgaataaataaactagcagaaactagtgatattttttaaaataatagtccaaccaaaaaatattgtaaaataaaatatattatttaattgtattttctataaaatataggatatatatatatataatgcaacattaacataatagtaacactatataatataaaaaaatttaaaaacataaagtaaatatgctaaaacaatatattgagatttgggaaattctctttttttaattcacgggttttatttaaaggaatttcataatctaaattgcttagtccgtaaaatacacatcttgctagtatacttttttttttttgttaaagtcttgctagtatactaacaagaatacaaaacgaaaatacaaaaactaaattcaaatatctaatccaaacaaattcaaatctagaaaataaggttaaagcagaaacaaactgcaatttattatatcggtgcaacatttttttttgtaaaataatattgctacaacattactgaagaactagttgaactacaagctactacacacaatcaaaccaactaagtgacagttttcttttcttcagaaccaaatcatgaatttaacttagacttggaccttattatgtagctagatgaacgattcagaagttcacatagacagaaaacgcacaaaagaaaaaactaatcgttgacgtcctctaaaaaaacgagatggaaaagcggggatctcagaccggaacacccggaaaaagagatatagaaaccgacaactgttggagatctgctacgatactctttgacacaaaagctacgagaccggtagaaccgaactcaaaactacgaatgtcggaagtgatagattcgattctagaattgaaagggatttaatcaaattacatagtctaagcctaaacctttttaaatatacggatttattatcttcttcataataaaaagcatatacgaaataatcaattttcccgctttgctacactgtaaactattttcactttaatgttcaatcataaataaactattccctaataattttcaactatatggatatatttttaaattgtttttgaaaataaatttatgagtttactacaatattattcactttcaaaatataacatcaattgaaatcgttattcaaccatattttttttattgtatcaccatctatattaactctatgtctgatttttctaccacacaatacttttataaaattcactacaagaatattacaccatctatattagttggtcaaagcacacacacgtagatcaaactcttatttgaactccaataatgatacttgaattcctcattagatacggatacaatctttttcattttatttgttgaaaacgtgattaaagaccgctttgtgtcaaatactataaaactcttggtcctttttaatatgttccagccgtatagatcagtagaggccaggaacacatatatacataaataggcaccaaatatgatcattactatatagccactatgccgtatcaactaaacaatccattgattaaaagataaaatttgattttcattacataataatccattaatttcctcacgtggaacccacttggtgtacttccacgtcgtccttatatcactgacccactcatcaaatcaacgcatctttataagccccttcatcgtcacacacttctttcaaattattccatattcttcttatttccattatttcacctcaaatcattagattcttacacaacacaacaacaaactagctcccaagtctaagcttttatttcacttcaaagttgtctttggctgtctctctctatatataatgctaatg

SEQ ID NO: 12706 - DNA, 3000 bp, Unknown
  misc_feature (1)..( 3000): cDNA_ID_2709490_gDNA_ID_2214567_Annot_ID_134979 3000 nt of promoter + ATG
attttatatgacaacgaacgattaagagttcgtatttattgttttataacataacgacgtcgacacagaactttcaaggctaaactcactttttgatggagacgtaagaataatttatgggtaataactcattaatttgttactaaatagaaattatttctctaaaatgcttttcaattcatatacaaaggatacataggaaaattataaaaagtaatatttgtatgtacggaccatcagaataataacgtaatattttttaatcaggttgcatattacctcgggcttccattgattaatgggtgcataagtaattaagtaaattcatatgcaaagttaagagtggtacaaattataaccgcatatgcgttctttaaaaaagtaattatgaaaatttgttcggcagatgaagcaaatgattagtacacctatgccaaatcttaaaaaattagaatggaaagcgatatatgaaattgaacgtagtcatattgaattcgtaatcgagactttcactattgtttttaagaatgtttggacgagaaagaagctcataaagcaataaattagttaacgttcataattgaagcattgacaccaggagagaaaaaaagagcaattcattgcttccctagtaaaaaaaaaaaaaaaaaaaaaaaaaaaaaaaaaaaaaatcagatatttgtggataaagagttaaaagaaattgtttcgtcatttttttctgtcataatttcgtcaactttttgtttaacaatatgcattatataaattttattaataatagtaacacatagacacgattgtagcataaaccactaaaatacatggtttcagtgtatctaagcttttgacatgtagaagttctacgtttttcatgataaattcgaaaaattattgagaaatgatatatggtcaaaatgaagaaaaaaagagagaagataacaacaaaatggagaaggacaagagcacaaaagagatgagtgggattatgaaaaggtttgctgatgatttcatgcatgatcaactaacgttaaagattatttgtttttagggtaataatacaacatatacgccattttaggcaatctctttctgaaaaagatgttcgcatttatatacgaaacgactgattattaaagatatatactacatacaacaaaatcgttagggaaaagtaaaagagaagataaaatgtagagacaatttgaaagatctcttctttgttcttcttttgaaaataaaaataaaagtagacataaaatagaagttgtaaatgacaggtttcatctttttcatgcttttttttccctttctttacgtcgtttgataccgagtaaagttattttcatactaagattcagtcattattcttgttagagttattgttcttatatattgaaatattaatatcaataggaaacgagattagtatcatagttttttaatgatgacgtagaacatttatatttcattgaatagttaatagtagacaatcaatggttgttttattgtgaatttggttcacccctttcatttgttttattgcaagattacaagcttatatatgtttgcaatcaacaagataattaatatattcaaaaaagattcatataagagataaaaccatcgccatgaagatatctaatgaacgaagacgaaaacgacagatcagggacaagcctactcttgagtcttgacccacaaagataccctaattaagctttcatgattacggatctatatgataatgaaccctattaagcaaagttaatttatacttagccatcaacgtacatatatatttccaataataaatgcaaataaaaatgataattatgacaaattaaccaaaagttaagttagcaatggaccttggcgttttaaatattggcatggttagcaaatagcatacaaatatatgaaatgatagcctgaaaatctagtaatattatttttattttagtttataaggctcatccattactttttataaaaatgcctttattctgtttactgaaaaaaaaatcttttaacatagttttgtcaatttaaaattctgactgacacaaaaatgtaagtgtaaccaaaacagaaaagtgcgatataatattaaaaatatatagttactgataaaaagtcatactatttagttcagcattttacaatttcaaaataacaagattcccaacataaaaattgctgaaccagaaagcacgactatagctagatctaatgactagaatgaccaaagatatgattttcatttgtgagaaaaaaagaaagaaagaaagagttaaatttgtttgattgcacaactttttcgaaagtccctcttatcactaaaccaattctgaaatgttcacaaacttgttttacttaatggtaaagataaagctaaaatagtattttattaataaacacattgcttaaagcaaatcaaggtctttgactcttttggttgtcacttagaattaatgtcttcaattatctattcatctaggtccctcttatttcttcatacttagaccttgtaaatcatatgtatacatatgtggtattttctaacaaaaatcatatattatagatattattcgacagagggaaccttataggcgaagaaacgtccctccactcaaaccctaaaaagagaatcacaaaaataataatattaatacataagcatatacaaataatgcatgagagtggaaaatatatataagaaaagaaataaagcataagaacatgacccatgtttagaaaagcattatgttctcactttatctttgtgctccttcactatcatcatcttctctctaaacctctatcttctctctttctcttttggttctgtgctcgatctcctcacatctctctttaacctttggttcccttctttcgtttttatatgattctcccaccatttttgttcttttgagttttaaagatccatcaaactttattaaagaaagaagaacaaagagataaaagggaagaagaaca
